United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 78

SEQ ID NO: 3560507 - RNA, 24 nt, Human
acuucuugucagacauaaagccau

SEQ ID NO: 3560508 - RNA, 15 nt, Human
acuucuuguguguau

SEQ ID NO: 3560509 - RNA, 21 nt, Human
acuucuuuaauuuuggaauuu

SEQ ID NO: 3560510 - RNA, 12 nt, Human
acuucuuucccu

SEQ ID NO: 3560511 - RNA, 18 nt, Human
acuucuuucccuuccucc

SEQ ID NO: 3560512 - RNA, 12 nt, Human
acuucuuucuau

SEQ ID NO: 3560513 - RNA, 13 nt, Human
acuucuuucuauu

SEQ ID NO: 3560514 - RNA, 14 nt, Human
acuucuuugcaguu

SEQ ID NO: 3560515 - RNA, 17 nt, Human
acuucuuuucacauucu

SEQ ID NO: 3560516 - RNA, 18 nt, Human
acuucuuuucacauucuu

SEQ ID NO: 3560517 - RNA, 19 nt, Human
acuucuuuugcucuuagcu

SEQ ID NO: 3560518 - RNA, 22 nt, Human
acuucuuuuuucaaaagaaagu

SEQ ID NO: 3560519 - RNA, 17 nt, Human
acuugaaaagagacagg

SEQ ID NO: 3560520 - RNA, 18 nt, Human
acuugaaagcauccaugu

SEQ ID NO: 3560521 - RNA, 19 nt, Human
acuugaaauaccagugaac

SEQ ID NO: 3560522 - RNA, 18 nt, Human
acuugaaaucuaggauua

SEQ ID NO: 3560523 - RNA, 13 nt, Human
acuugaacaaaag

SEQ ID NO: 3560524 - RNA, 18 nt, Human
acuugaacaaaaggguca

SEQ ID NO: 3560525 - RNA, 20 nt, Human
acuugaaccuaugaagcaau

SEQ ID NO: 3560526 - RNA, 22 nt, Human
acuugaacguuuucuaauugcu

SEQ ID NO: 3560527 - RNA, 13 nt, Human
acuugaacugauu

SEQ ID NO: 3560528 - RNA, 16 nt, Human
acuugaacuuuccugg

SEQ ID NO: 3560529 - RNA, 20 nt, Human
acuugaagccaucuaaagua

SEQ ID NO: 3560530 - RNA, 16 nt, Human
acuugaagccugcucc

SEQ ID NO: 3560531 - RNA, 22 nt, Human
acuugaagucuaaaagcagaaa

SEQ ID NO: 3560532 - RNA, 11 nt, Human
acuugaaguug

SEQ ID NO: 3560533 - RNA, 16 nt, Human
acuugaauaguauugu

SEQ ID NO: 3560534 - RNA, 17 nt, Human
acuugacagaacacugu

SEQ ID NO: 3560535 - RNA, 18 nt, Human
acuugacagaacacuguc

SEQ ID NO: 3560536 - RNA, 20 nt, Human
acuugacagaacacugucuu

SEQ ID NO: 3560537 - RNA, 22 nt, Human
acuugaccccgacgccacagcc

SEQ ID NO: 3560538 - RNA, 21 nt, Human
acuugacuccauuucaucauu

SEQ ID NO: 3560539 - RNA, 16 nt, Human
acuugagaggaugaau

SEQ ID NO: 3560540 - RNA, 19 nt, Human
acuugagauguaugaaggc

SEQ ID NO: 3560541 - RNA, 20 nt, Human
acuugagcaccgucauggcu

SEQ ID NO: 3560542 - RNA, 15 nt, Human
acuugaggaaaccag

SEQ ID NO: 3560543 - RNA, 15 nt, Human
acuugaggacacaug

SEQ ID NO: 3560544 - RNA, 18 nt, Human
acuugaggacacaugucc

SEQ ID NO: 3560545 - RNA, 19 nt, Human
acuugaggacacaugucca

SEQ ID NO: 3560546 - RNA, 12 nt, Human
acuugaggauuu

SEQ ID NO: 3560547 - RNA, 17 nt, Human
acuugagggcccagagc

SEQ ID NO: 3560548 - RNA, 14 nt, Human
agcccccucuuccc

SEQ ID NO: 3560549 - RNA, 12 nt, Human
agcccccugacc

SEQ ID NO: 3560550 - RNA, 19 nt, Human
agcccccugaccacucaga

SEQ ID NO: 3560551 - RNA, 14 nt, Human
agcccccuggccuc

SEQ ID NO: 3560552 - RNA, 12 nt, Human
agcccccugguc

SEQ ID NO: 3560553 - RNA, 16 nt, Human
agcccccuugacaccg

SEQ ID NO: 3560554 - RNA, 20 nt, Human
agcccccuuugggcccaggg

SEQ ID NO: 3560555 - RNA, 14 nt, Human
agccccgacuccag

SEQ ID NO: 3560556 - RNA, 15 nt, Human
agccccgacuccagc

SEQ ID NO: 3560557 - RNA, 18 nt, Human
agccccgacuccagccag

SEQ ID NO: 3560558 - RNA, 17 nt, Human
agccucugucaggccuu

SEQ ID NO: 3560559 - RNA, 14 nt, Human
agccucugucuggc

SEQ ID NO: 3560560 - RNA, 13 nt, Human
agccucuguguca

SEQ ID NO: 3560561 - RNA, 18 nt, Human
agccucugugucacuggc

SEQ ID NO: 3560562 - RNA, 22 nt, Human
agccucuuaaagcugccuguag

SEQ ID NO: 3560563 - RNA, 15 nt, Human
agccucuuucugucc

SEQ ID NO: 3560564 - RNA, 20 nt, Human
agccugaauuuuguugcugu

SEQ ID NO: 3560565 - RNA, 20 nt, Human
agccugaccaacauggagaa

SEQ ID NO: 3560566 - RNA, 16 nt, Human
agccugagcaacucuu

SEQ ID NO: 3560567 - RNA, 19 nt, Human
agccugagcgacagugaga

SEQ ID NO: 3560568 - RNA, 14 nt, Human
agccugagggaaag

SEQ ID NO: 3560569 - RNA, 15 nt, Human
agccugagggaaagg

SEQ ID NO: 3560570 - RNA, 21 nt, Human
agccugagggaaaggccagca

SEQ ID NO: 3560571 - RNA, 22 nt, Human
agccugagggaaaggccagcac

SEQ ID NO: 3560572 - RNA, 22 nt, Human
agccugaguaaaguuaaaagaa

SEQ ID NO: 3560573 - RNA, 19 nt, Human
agccugaguacuccacacu

SEQ ID NO: 3560574 - RNA, 22 nt, Human
agccugaguacuccacacugca

SEQ ID NO: 3560575 - RNA, 23 nt, Human
agccugaguagaaaggccuuuaa

SEQ ID NO: 3560576 - RNA, 20 nt, Human
agccugagucagggcccaga

SEQ ID NO: 3560577 - RNA, 21 nt, Human
agccugagucagggcccagag

SEQ ID NO: 3560578 - RNA, 23 nt, Human
agccugaguccacgaccuaggca

SEQ ID NO: 3560579 - RNA, 13 nt, Human
agccugaucucuu

SEQ ID NO: 3560580 - RNA, 15 nt, Human
agccugaucucuucc

SEQ ID NO: 3560581 - RNA, 16 nt, Human
agccugaucucuuccu

SEQ ID NO: 3560582 - RNA, 20 nt, Human
agccugaucucuuccuguuu

SEQ ID NO: 3560583 - RNA, 18 nt, Human
agccugaugagauuuuua

SEQ ID NO: 3560584 - RNA, 17 nt, Human
agccugcaaacucacug

SEQ ID NO: 3560585 - RNA, 21 nt, Human
agccugcaacucaucuuucau

SEQ ID NO: 3560586 - RNA, 18 nt, Human
agccugcacggugaaugg

SEQ ID NO: 3560587 - RNA, 20 nt, Human
agccugcacuugggggcuca

SEQ ID NO: 3560588 - RNA, 14 nt, Human
agccugcacuuuga

SEQ ID NO: 3560589 - RNA, 16 nt, Human
agccugcacuuugaug

SEQ ID NO: 3560590 - RNA, 21 nt, Human
agccugcaggaccucgugcca

SEQ ID NO: 3560591 - RNA, 23 nt, Human
agccugcaggaucucaccaggca

SEQ ID NO: 3560592 - RNA, 23 nt, Human
agccugcagggaagccccacaug

SEQ ID NO: 3560593 - RNA, 12 nt, Human
agccugcagggu

SEQ ID NO: 3560594 - RNA, 17 nt, Human
agccugcaggugcugcu

SEQ ID NO: 3560595 - RNA, 19 nt, Human
agccugcaggugcugcugc

SEQ ID NO: 3560596 - RNA, 20 nt, Human
agccugcaggugcugcugcg

SEQ ID NO: 3560597 - RNA, 22 nt, Human
agccugcaggugcugcugcgug

SEQ ID NO: 3560598 - RNA, 21 nt, Human
agccugcccaagcccaggcca

SEQ ID NO: 3560599 - RNA, 22 nt, Human
agccugcccaagcccaggccac

SEQ ID NO: 3560600 - RNA, 14 nt, Human
agccugccccagcg

SEQ ID NO: 3560601 - RNA, 16 nt, Human
agccugccccagcgcu

SEQ ID NO: 3560602 - RNA, 18 nt, Human
agccugccccagcgcuga

SEQ ID NO: 3560603 - RNA, 13 nt, Human
agccugcccuugu

SEQ ID NO: 3560604 - RNA, 11 nt, Human
agccugccugg

SEQ ID NO: 3560605 - RNA, 15 nt, Human
agccugccuggagcg

SEQ ID NO: 3560606 - RNA, 14 nt, Human
agccugccuggagu

SEQ ID NO: 3560607 - RNA, 23 nt, Human
agccugccuugcccacuccugcu

SEQ ID NO: 3560608 - RNA, 16 nt, Human
agccugcgccugcugc

SEQ ID NO: 3560609 - RNA, 18 nt, Human
agccugcgccugcugcau

SEQ ID NO: 3560610 - RNA, 20 nt, Human
agccugcgccugcugcaugc

SEQ ID NO: 3560611 - RNA, 9 nt, Human
agccugcua

SEQ ID NO: 3560612 - RNA, 15 nt, Human
agccugcuccagcug

SEQ ID NO: 3560613 - RNA, 16 nt, Human
agccugcuccagcugu

SEQ ID NO: 3560614 - RNA, 17 nt, Human
agccugcuccagcuguu

SEQ ID NO: 3560615 - RNA, 19 nt, Human
agccugcuccagcuguuca

SEQ ID NO: 3560616 - RNA, 15 nt, Human
agccugcucccccac

SEQ ID NO: 3560617 - RNA, 14 nt, Human
agccugcuggaagc

SEQ ID NO: 3560618 - RNA, 19 nt, Human
agccugcuggaagcccagc

SEQ ID NO: 3560619 - RNA, 12 nt, Human
agccugcuggau

SEQ ID NO: 3560620 - RNA, 11 nt, Human
agccugcuggc

SEQ ID NO: 3560621 - RNA, 17 nt, Human
agccugcuggcacccac

SEQ ID NO: 3560622 - RNA, 22 nt, Human
agccugcuucccaccucccugc

SEQ ID NO: 3560623 - RNA, 14 nt, Human
agccugcuuuuuaa

SEQ ID NO: 3560624 - RNA, 19 nt, Human
agccuggaaaccugucuga

SEQ ID NO: 3560625 - RNA, 19 nt, Human
agccuggaacaucaucaag

SEQ ID NO: 3560626 - RNA, 20 nt, Human
agccuggaacaucaucaagg

SEQ ID NO: 3560627 - RNA, 21 nt, Human
agccuggaacaucaucaaggc

SEQ ID NO: 3560628 - RNA, 15 nt, Human
agccuggacccccag

SEQ ID NO: 3560629 - RNA, 24 nt, Human
agccuggaccucugacagcagcau

SEQ ID NO: 3560630 - RNA, 15 nt, Human
agccuggaugccauc

SEQ ID NO: 3560631 - RNA, 16 nt, Human
agccuggcacaggacu

SEQ ID NO: 3560632 - RNA, 16 nt, Human
agccuggccacgcagc

SEQ ID NO: 3560633 - RNA, 22 nt, Human
agccuggccacgcagccaggac

SEQ ID NO: 3560634 - RNA, 16 nt, Human
agccuggccagacaca

SEQ ID NO: 3560635 - RNA, 18 nt, Human
agccuggccagacacagg

SEQ ID NO: 3560636 - RNA, 21 nt, Human
agccuggccagacacaggccc

SEQ ID NO: 3560637 - RNA, 14 nt, Human
agccuggcccagcu

SEQ ID NO: 3560638 - RNA, 16 nt, Human
agccuggcccagcucc

SEQ ID NO: 3560639 - RNA, 17 nt, Human
agccuggcccauagaaa

SEQ ID NO: 3560640 - RNA, 19 nt, Human
agccuggcccauagaaaca

SEQ ID NO: 3560641 - RNA, 19 nt, Human
agccuggccuccugccucu

SEQ ID NO: 3560642 - RNA, 19 nt, Human
agccuggcuauguccuaau

SEQ ID NO: 3560643 - RNA, 16 nt, Human
agccuggcuccccugg

SEQ ID NO: 3560644 - RNA, 17 nt, Human
agccuggcuccccuggg

SEQ ID NO: 3560645 - RNA, 14 nt, Human
agccuggcuucugg

SEQ ID NO: 3560646 - RNA, 18 nt, Human
agccuggcuucuggagcc

SEQ ID NO: 3560647 - RNA, 15 nt, Human
agccugggaggcaca

SEQ ID NO: 3560648 - RNA, 16 nt, Human
agccugggaggcacag

SEQ ID NO: 3560649 - RNA, 18 nt, Human
agccugggaggcacagca

SEQ ID NO: 3560650 - RNA, 20 nt, Human
agccugggaggucaaggcug

SEQ ID NO: 3560651 - RNA, 22 nt, Human
agccugggauaggggcagagga

SEQ ID NO: 3560652 - RNA, 18 nt, Human
agccugggcaacagagca

SEQ ID NO: 3560653 - RNA, 21 nt, Human
agccugggcaacagagcaaga

SEQ ID NO: 3560654 - RNA, 15 nt, Human
agccugggcagccag

SEQ ID NO: 3560655 - RNA, 19 nt, Human
agccugggcagccaggcug

SEQ ID NO: 3560656 - RNA, 20 nt, Human
agccugggcagccaggcugc

SEQ ID NO: 3560657 - RNA, 22 nt, Human
agccugggcccaucucccugcu

SEQ ID NO: 3560658 - RNA, 23 nt, Human
agccugggcccaucucccugcuu

SEQ ID NO: 3560659 - RNA, 16 nt, Human
agccugggccccagcu

SEQ ID NO: 3560660 - RNA, 13 nt, Human
agccuggggccug

SEQ ID NO: 3560661 - RNA, 14 nt, Human
agccuggggccugg

SEQ ID NO: 3560662 - RNA, 14 nt, Human
agccuggggcucua

SEQ ID NO: 3560663 - RNA, 15 nt, Human
agccuggggcucuaa

SEQ ID NO: 3560664 - RNA, 21 nt, Human
agccuggggcucuaacgccug

SEQ ID NO: 3560665 - RNA, 14 nt, Human
agccuggggcuggc

SEQ ID NO: 3560666 - RNA, 16 nt, Human
agccugggggccuggc

SEQ ID NO: 3560667 - RNA, 21 nt, Human
agccugggggccuggcuggcu

SEQ ID NO: 3560668 - RNA, 15 nt, Human
agccuggggucugga

SEQ ID NO: 3560669 - RNA, 19 nt, Human
agccugggugacaaagcga

SEQ ID NO: 3560670 - RNA, 21 nt, Human
agccugggugacagagugaga

SEQ ID NO: 3560671 - RNA, 12 nt, Human
agccugggugua

SEQ ID NO: 3560672 - RNA, 20 nt, Human
agccuggguguaaaaccugg

SEQ ID NO: 3560673 - RNA, 21 nt, Human
agccuggguguaaaaccugga

SEQ ID NO: 3560674 - RNA, 22 nt, Human
agccuggucccacgagggugcc

SEQ ID NO: 3560675 - RNA, 18 nt, Human
agccuggugggccuccuc

SEQ ID NO: 3560676 - RNA, 21 nt, Human
agccuggugggccuccucugu

SEQ ID NO: 3560677 - RNA, 22 nt, Human
agccuguaaacuuuaucacuua

SEQ ID NO: 3560678 - RNA, 16 nt, Human
agccuguaagccugca

SEQ ID NO: 3560679 - RNA, 17 nt, Human
agccuguaaucccagcu

SEQ ID NO: 3560680 - RNA, 18 nt, Human
agccuguaaucccagcua

SEQ ID NO: 3560681 - RNA, 16 nt, Human
agccugucauccuugg

SEQ ID NO: 3560682 - RNA, 15 nt, Human
agccuguccugccug

SEQ ID NO: 3560683 - RNA, 20 nt, Human
agccuguccugccuguggcc

SEQ ID NO: 3560684 - RNA, 14 nt, Human
agccugucucuucc

SEQ ID NO: 3560685 - RNA, 15 nt, Human
agccugucucuucca

SEQ ID NO: 3560686 - RNA, 17 nt, Human
agccugugaacccagga

SEQ ID NO: 3560687 - RNA, 22 nt, Human
agccugugacauacccccuccc

SEQ ID NO: 3560688 - RNA, 21 nt, Human
agccugugccucugggacugg

SEQ ID NO: 3560689 - RNA, 20 nt, Human
agccuguggaugaucaaucc

SEQ ID NO: 3560690 - RNA, 23 nt, Human
agccuguggaugaucaauccuuu

SEQ ID NO: 3560691 - RNA, 22 nt, Human
agccuguggcaucuuugccuug

SEQ ID NO: 3560692 - RNA, 15 nt, Human
agccuguggcccugu

SEQ ID NO: 3560693 - RNA, 19 nt, Human
agccuguggcccuguccug

SEQ ID NO: 3560694 - RNA, 17 nt, Human
agccuguggccuuugca

SEQ ID NO: 3560695 - RNA, 18 nt, Human
agccuguggcggugccug

SEQ ID NO: 3560696 - RNA, 15 nt, Human
agccuguggcugugg

SEQ ID NO: 3560697 - RNA, 15 nt, Human
agccuguguaacagc

SEQ ID NO: 3560698 - RNA, 20 nt, Human
agccuguguaacagcuccuu

SEQ ID NO: 3560699 - RNA, 14 nt, Human
agccuguucauggc

SEQ ID NO: 3560700 - RNA, 17 nt, Human
agccuguucauggcaga

SEQ ID NO: 3560701 - RNA, 14 nt, Human
agccuguuccccuc

SEQ ID NO: 3560702 - RNA, 16 nt, Human
agcggacaguggcagg

SEQ ID NO: 3560703 - RNA, 16 nt, Human
agcggagaaaggaagg

SEQ ID NO: 3560704 - RNA, 16 nt, Human
agcggaggcugugugc

SEQ ID NO: 3560705 - RNA, 12 nt, Human
agcggccccucc

SEQ ID NO: 3560706 - RNA, 23 nt, Human
agcggccccuugacucuggggac

SEQ ID NO: 3560707 - RNA, 18 nt, Human
agcggcccugucauccag

SEQ ID NO: 3560708 - RNA, 19 nt, Human
agcggcugagucaugaucu

SEQ ID NO: 3560709 - RNA, 21 nt, Human
agcggcugagucaugaucucc

SEQ ID NO: 3560710 - RNA, 20 nt, Human
agcggcuggaauuggguggg

SEQ ID NO: 3560711 - RNA, 19 nt, Human
acuuuaccuuuuuuauaca

SEQ ID NO: 3560712 - RNA, 15 nt, Human
acuuuagaagccugc

SEQ ID NO: 3560713 - RNA, 16 nt, Human
acuuuagaagccugca

SEQ ID NO: 3560714 - RNA, 21 nt, Human
acuuuagaaguagaauugaca

SEQ ID NO: 3560715 - RNA, 21 nt, Human
acuuuagaagugcauuucuga

SEQ ID NO: 3560716 - RNA, 14 nt, Human
acuuuaggcuuuca

SEQ ID NO: 3560717 - RNA, 21 nt, Human
acuuuaggcuuucagcuuaca

SEQ ID NO: 3560718 - RNA, 13 nt, Human
acuuuagggaagu

SEQ ID NO: 3560719 - RNA, 23 nt, Human
acuuuagggaaguacuuuuggca

SEQ ID NO: 3560720 - RNA, 15 nt, Human
acuuuagggcuguaa

SEQ ID NO: 3560721 - RNA, 23 nt, Human
acuuuaguaugacgcugauacau

SEQ ID NO: 3560722 - RNA, 18 nt, Human
acuuuagucugcaaaaug

SEQ ID NO: 3560723 - RNA, 13 nt, Human
acuuuauaaaucc

SEQ ID NO: 3560724 - RNA, 17 nt, Human
acuuuauagaagaaugc

SEQ ID NO: 3560725 - RNA, 18 nt, Human
acuuuaucaugaaugcuu

SEQ ID NO: 3560726 - RNA, 13 nt, Human
acuuuaucuaaag

SEQ ID NO: 3560727 - RNA, 23 nt, Human
acuuuaucuaauaccucugugug

SEQ ID NO: 3560728 - RNA, 22 nt, Human
acuuuaucuugaauaauguaag

SEQ ID NO: 3560729 - RNA, 15 nt, Human
acuuuaugccggaug

SEQ ID NO: 3560730 - RNA, 17 nt, Human
acuuuaugcuaagugaa

SEQ ID NO: 3560731 - RNA, 13 nt, Human
acuuuauguaguu

SEQ ID NO: 3560732 - RNA, 15 nt, Human
acuuuauuaaauaca

SEQ ID NO: 3560733 - RNA, 19 nt, Human
acuuuauucuugaaagaag

SEQ ID NO: 3560734 - RNA, 17 nt, Human
acuuuauugacaaguga

SEQ ID NO: 3560735 - RNA, 21 nt, Human
acuuuauugccuuuuaauuuu

SEQ ID NO: 3560736 - RNA, 21 nt, Human
acuuuauuuuauauaauaaag

SEQ ID NO: 3560737 - RNA, 23 nt, Human
acuuuauuuuauauaauaaagua

SEQ ID NO: 3560738 - RNA, 22 nt, Human
acuuuauuuucuauaauuuaaa

SEQ ID NO: 3560739 - RNA, 13 nt, Human
acuuuauuuucug

SEQ ID NO: 3560740 - RNA, 24 nt, Human
acuuuauuuucugguagauagaaa

SEQ ID NO: 3560741 - RNA, 18 nt, Human
acuuucaaaauuaaaucu

SEQ ID NO: 3560742 - RNA, 20 nt, Human
acuuucaaaauuaaaucugu

SEQ ID NO: 3560743 - RNA, 20 nt, Human
acuuucaauugucacuuuuu

SEQ ID NO: 3560744 - RNA, 16 nt, Human
acuuucacuauaaugu

SEQ ID NO: 3560745 - RNA, 20 nt, Human
acuuucacuauaaugugaaa

SEQ ID NO: 3560746 - RNA, 23 nt, Human
acuuucacuauaaugugaaaugu

SEQ ID NO: 3560747 - RNA, 13 nt, Human
acuuucagcuguc

SEQ ID NO: 3560748 - RNA, 22 nt, Human
acuuucagcugucuuuuggagg

SEQ ID NO: 3560749 - RNA, 22 nt, Human
acuuucaggccacauggcuaaa

SEQ ID NO: 3560750 - RNA, 22 nt, Human
acuuucauauuuuaaacagagg

SEQ ID NO: 3560751 - RNA, 21 nt, Human
acuuucauccugacucugccc

SEQ ID NO: 3560752 - RNA, 23 nt, Human
acuuucauccugacucugccccc

SEQ ID NO: 3560753 - RNA, 19 nt, Human
acuuucauuaaagcauuua

SEQ ID NO: 3560754 - RNA, 18 nt, Human
acuuucauugccaguguc

SEQ ID NO: 3560755 - RNA, 20 nt, Human
acuuucauugccagugucuu

SEQ ID NO: 3560756 - RNA, 18 nt, Human
acuuuccaauucuccuuu

SEQ ID NO: 3560757 - RNA, 17 nt, Human
acuuuccauuacaagua

SEQ ID NO: 3560758 - RNA, 21 nt, Human
acuuuccauuacaaguauuuu

SEQ ID NO: 3560759 - RNA, 21 nt, Human
acuuucccagguucuguuuau

SEQ ID NO: 3560760 - RNA, 17 nt, Human
acuuuccccaccagaug

SEQ ID NO: 3560761 - RNA, 20 nt, Human
acuuuccccaccagaugcug

SEQ ID NO: 3560762 - RNA, 23 nt, Human
acuuuccccaccagaugcugaaa

SEQ ID NO: 3560763 - RNA, 21 nt, Human
acuuuccccauacucugucuc

SEQ ID NO: 3560764 - RNA, 22 nt, Human
acuuuccccauacucugucucc

SEQ ID NO: 3560765 - RNA, 17 nt, Human
acuuucccuugcuuuuc

SEQ ID NO: 3560766 - RNA, 22 nt, Human
acuuucccuugcuuuucccucu

SEQ ID NO: 3560767 - RNA, 21 nt, Human
acuuuccucuuagucgagcca

SEQ ID NO: 3560768 - RNA, 21 nt, Human
acuuuccucuuuggucuacac

SEQ ID NO: 3560769 - RNA, 17 nt, Human
acuuuccuuuccccagc

SEQ ID NO: 3560770 - RNA, 21 nt, Human
acuuuccuuuucuauuccuuc

SEQ ID NO: 3560771 - RNA, 15 nt, Human
acuuucguacauugg

SEQ ID NO: 3560772 - RNA, 17 nt, Human
acuuucuaauguuucug

SEQ ID NO: 3560773 - RNA, 17 nt, Human
acuuucuacaaugugaa

SEQ ID NO: 3560774 - RNA, 21 nt, Human
acuuucuacaaugugaacuuu

SEQ ID NO: 3560775 - RNA, 17 nt, Human
acuuucucaguuuucau

SEQ ID NO: 3560776 - RNA, 18 nt, Human
acuuucucaguuuucaua

SEQ ID NO: 3560777 - RNA, 14 nt, Human
acuuucucuaauaa

SEQ ID NO: 3560778 - RNA, 15 nt, Human
acuuucucuaauaau

SEQ ID NO: 3560779 - RNA, 17 nt, Human
acuuucucuaauaauaa

SEQ ID NO: 3560780 - RNA, 16 nt, Human
acuuucucugccauca

SEQ ID NO: 3560781 - RNA, 19 nt, Human
acuuucugaaauucacaaa

SEQ ID NO: 3560782 - RNA, 23 nt, Human
acuuucuggggccuaauaaaacu

SEQ ID NO: 3560783 - RNA, 18 nt, Human
acuuucuguuaugggcuu

SEQ ID NO: 3560784 - RNA, 14 nt, Human
acuuucuuauccua

SEQ ID NO: 3560785 - RNA, 23 nt, Human
acuuucuuuaaauuauguuuuua

SEQ ID NO: 3560786 - RNA, 19 nt, Human
acuuucuuuucuggaaugu

SEQ ID NO: 3560787 - RNA, 23 nt, Human
acuuucuuuuuguagcuggggcu

SEQ ID NO: 3560788 - RNA, 22 nt, Human
acuuucuuuuuuuucuauuuca

SEQ ID NO: 3560789 - RNA, 23 nt, Human
acuuucuuuuuuuucuauuucac

SEQ ID NO: 3560790 - RNA, 18 nt, Human
acuuugaaaggagauguc

SEQ ID NO: 3560791 - RNA, 14 nt, Human
acuuugaaauaccu

SEQ ID NO: 3560792 - RNA, 16 nt, Human
acuuugaaauaccuca

SEQ ID NO: 3560793 - RNA, 20 nt, Human
acuuugaaauaccucauguu

SEQ ID NO: 3560794 - RNA, 23 nt, Human
acuuugaaauaccucauguuuau

SEQ ID NO: 3560795 - RNA, 21 nt, Human
acuuugaagacccgcuacaaa

SEQ ID NO: 3560796 - RNA, 15 nt, Human
acuuugaagauguca

SEQ ID NO: 3560797 - RNA, 17 nt, Human
acuuugaaguuagcuuu

SEQ ID NO: 3560798 - RNA, 14 nt, Human
acuuugaauaaaga

SEQ ID NO: 3560799 - RNA, 22 nt, Human
acuuugaauaaagaauacuuga

SEQ ID NO: 3560800 - RNA, 22 nt, Human
acuuugaauguguuucacaguu

SEQ ID NO: 3560801 - RNA, 17 nt, Human
acuuugacacuuuucau

SEQ ID NO: 3560802 - RNA, 19 nt, Human
acuuugacagcgcacagcu

SEQ ID NO: 3560803 - RNA, 14 nt, Human
acuuugaccucugc

SEQ ID NO: 3560804 - RNA, 20 nt, Human
acuuugacuuuuugcauuua

SEQ ID NO: 3560805 - RNA, 16 nt, Human
acuuugagaucuaaaa

SEQ ID NO: 3560806 - RNA, 18 nt, Human
acuuugagccugggaaau

SEQ ID NO: 3560807 - RNA, 19 nt, Human
acuuugaggguguauauuu

SEQ ID NO: 3560808 - RNA, 23 nt, Human
acuuugaggguguauauuuucug

SEQ ID NO: 3560809 - RNA, 14 nt, Human
acuuugaugucaug

SEQ ID NO: 3560810 - RNA, 22 nt, Human
acuuugcacacuuuggcccagg

SEQ ID NO: 3560811 - RNA, 14 nt, Human
acuuugcacauuuu

SEQ ID NO: 3560812 - RNA, 15 nt, Human
acuuugcacauuuug

SEQ ID NO: 3560813 - RNA, 20 nt, Human
acuuugcacauuuugauuuu

SEQ ID NO: 3560814 - RNA, 17 nt, Human
acuuugcacugauauau

SEQ ID NO: 3560815 - RNA, 21 nt, Human
acuuugcacugauauaucaug

SEQ ID NO: 3560816 - RNA, 16 nt, Human
acuuugcaucucagua

SEQ ID NO: 3560817 - RNA, 16 nt, Human
acuuugcauugucugu

SEQ ID NO: 3560818 - RNA, 20 nt, Human
acuuugccuuuccauaauca

SEQ ID NO: 3560819 - RNA, 20 nt, Human
acuuugcuaaagacaugaag

SEQ ID NO: 3560820 - RNA, 13 nt, Human
acuuugcuccuca

SEQ ID NO: 3560821 - RNA, 15 nt, Human
acuuugcuugcuuug

SEQ ID NO: 3560822 - RNA, 15 nt, Human
acuuugcuuuaauau

SEQ ID NO: 3560823 - RNA, 15 nt, Human
acuuugcuuucauga

SEQ ID NO: 3560824 - RNA, 12 nt, Human
acuuuggaaaga

SEQ ID NO: 3560825 - RNA, 23 nt, Human
acuuuggaaagaguaggaagacu

SEQ ID NO: 3560826 - RNA, 15 nt, Human
acuuuggaacaagau

SEQ ID NO: 3560827 - RNA, 21 nt, Human
acuuuggaaguuuguguucug

SEQ ID NO: 3560828 - RNA, 18 nt, Human
acuuuggaauacauuucu

SEQ ID NO: 3560829 - RNA, 19 nt, Human
acuuuggauaauaaggaaa

SEQ ID NO: 3560830 - RNA, 16 nt, Human
acuuuggaucaggaaa

SEQ ID NO: 3560831 - RNA, 13 nt, Human
acuuuggcugcau

SEQ ID NO: 3560832 - RNA, 21 nt, Human
acuuuggcuuauaauucuuuc

SEQ ID NO: 3560833 - RNA, 19 nt, Human
acuuugggaggccaaggug

SEQ ID NO: 3560834 - RNA, 20 nt, Human
acuuugggaggccaaggugg

SEQ ID NO: 3560835 - RNA, 17 nt, Human
acuuugggaggcugagg

SEQ ID NO: 3560836 - RNA, 19 nt, Human
acuuugggaggcugaggcg

SEQ ID NO: 3560837 - RNA, 20 nt, Human
acuuugggauaggaaaaaug

SEQ ID NO: 3560838 - RNA, 14 nt, Human
acuuugggggagga

SEQ ID NO: 3560839 - RNA, 19 nt, Human
acuuugguacauggccagu

SEQ ID NO: 3560840 - RNA, 21 nt, Human
acuuugguuauuuuacuuuuu

SEQ ID NO: 3560841 - RNA, 17 nt, Human
acuuuguaaaaaucuuu

SEQ ID NO: 3560842 - RNA, 21 nt, Human
acuuuguaaauucugauuucu

SEQ ID NO: 3560843 - RNA, 18 nt, Human
acuuuguaccccccaacc

SEQ ID NO: 3560844 - RNA, 15 nt, Human
agaacaaagcuguua

SEQ ID NO: 3560845 - RNA, 17 nt, Human
agaacaaagcuguuaaa

SEQ ID NO: 3560846 - RNA, 20 nt, Human
agaacaaagcuguuaaacug

SEQ ID NO: 3560847 - RNA, 22 nt, Human
agaacaaagcuguuaaacuguu

SEQ ID NO: 3560848 - RNA, 24 nt, Human
agaacaaauauucagaauauucau

SEQ ID NO: 3560849 - RNA, 18 nt, Human
agaacaacauauacaaca

SEQ ID NO: 3560850 - RNA, 15 nt, Human
agaacaacuaccuga

SEQ ID NO: 3560851 - RNA, 17 nt, Human
agaacaauauugacuuu

SEQ ID NO: 3560852 - RNA, 20 nt, Human
agaacaauauugacuuuguc

SEQ ID NO: 3560853 - RNA, 13 nt, Human
agaacaauugucc

SEQ ID NO: 3560854 - RNA, 15 nt, Human
agaacacaaagcggg

SEQ ID NO: 3560855 - RNA, 16 nt, Human
agaacacaaggucauu

SEQ ID NO: 3560856 - RNA, 14 nt, Human
agaacacacacacu

SEQ ID NO: 3560857 - RNA, 22 nt, Human
agaacacacacauauacacgaa

SEQ ID NO: 3560858 - RNA, 21 nt, Human
agaacacagaaagccuaucaa

SEQ ID NO: 3560859 - RNA, 20 nt, Human
agaacacagcaauuccucag

SEQ ID NO: 3560860 - RNA, 14 nt, Human
agaacacgcguauu

SEQ ID NO: 3560861 - RNA, 14 nt, Human
agaacacgcuuuca

SEQ ID NO: 3560862 - RNA, 18 nt, Human
agaacacggcucacgcuu

SEQ ID NO: 3560863 - RNA, 13 nt, Human
agaacacuaaccu

SEQ ID NO: 3560864 - RNA, 11 nt, Human
agaacacuaau

SEQ ID NO: 3560865 - RNA, 15 nt, Human
agaacacuaauucau

SEQ ID NO: 3560866 - RNA, 11 nt, Human
agaacacuggu

SEQ ID NO: 3560867 - RNA, 14 nt, Human
agaacacugugaaa

SEQ ID NO: 3560868 - RNA, 10 nt, Human
agaacagaaa

SEQ ID NO: 3560869 - RNA, 20 nt, Human
agaacagaaaacaacaaaaa

SEQ ID NO: 3560870 - RNA, 19 nt, Human
agaacagaucuccaaagcu

SEQ ID NO: 3560871 - RNA, 16 nt, Human
agaacagaucuuuuac

SEQ ID NO: 3560872 - RNA, 18 nt, Human
agaacagcagacucagcu

SEQ ID NO: 3560873 - RNA, 18 nt, Human
agaacagcagagguucuu

SEQ ID NO: 3560874 - RNA, 18 nt, Human
agaacagcaggcccaccu

SEQ ID NO: 3560875 - RNA, 18 nt, Human
agaacagccgcuccuguc

SEQ ID NO: 3560876 - RNA, 15 nt, Human
agaacagcuguugac

SEQ ID NO: 3560877 - RNA, 17 nt, Human
agaacaggccucuccau

SEQ ID NO: 3560878 - RNA, 19 nt, Human
agaacagggaaaauaggca

SEQ ID NO: 3560879 - RNA, 20 nt, Human
agaacagggaaaauaggcag

SEQ ID NO: 3560880 - RNA, 13 nt, Human
agaacaguaaaca

SEQ ID NO: 3560881 - RNA, 14 nt, Human
agaacaguaaacau

SEQ ID NO: 3560882 - RNA, 22 nt, Human
agaacaguaucuuugcacucca

SEQ ID NO: 3560883 - RNA, 14 nt, Human
agaacauaaagcaa

SEQ ID NO: 3560884 - RNA, 17 nt, Human
agaacauaaagguaaaa

SEQ ID NO: 3560885 - RNA, 11 nt, Human
agaacauagaa

SEQ ID NO: 3560886 - RNA, 19 nt, Human
agaacauagacagaagaaa

SEQ ID NO: 3560887 - RNA, 14 nt, Human
agaacaucauuaga

SEQ ID NO: 3560888 - RNA, 20 nt, Human
agaacaucauuagaacaaag

SEQ ID NO: 3560889 - RNA, 13 nt, Human
agaacaucccucc

SEQ ID NO: 3560890 - RNA, 18 nt, Human
agaacaucccugccagcu

SEQ ID NO: 3560891 - RNA, 22 nt, Human
agaacaucuuugacacucugca

SEQ ID NO: 3560892 - RNA, 23 nt, Human
agaacaucuuugacacucugcag

SEQ ID NO: 3560893 - RNA, 20 nt, Human
agaacaugcaguuugaaauu

SEQ ID NO: 3560894 - RNA, 23 nt, Human
agaacaugcaguuugaaauucug

SEQ ID NO: 3560895 - RNA, 13 nt, Human
agaacaugugaga

SEQ ID NO: 3560896 - RNA, 19 nt, Human
agaacauguugguauuuau

SEQ ID NO: 3560897 - RNA, 20 nt, Human
agaacauguugguauuuauc

SEQ ID NO: 3560898 - RNA, 19 nt, Human
agaacauugguauucgcuu

SEQ ID NO: 3560899 - RNA, 11 nt, Human
agaacauugua

SEQ ID NO: 3560900 - RNA, 13 nt, Human
agaacauuuuaau

SEQ ID NO: 3560901 - RNA, 21 nt, Human
agaaccaaaaagaggcuaugu

SEQ ID NO: 3560902 - RNA, 11 nt, Human
agaaccaaaga

SEQ ID NO: 3560903 - RNA, 16 nt, Human
agaaccaaaucuggaa

SEQ ID NO: 3560904 - RNA, 23 nt, Human
agaaccaccccggcccccugccc

SEQ ID NO: 3560905 - RNA, 24 nt, Human
agaaccagauucuauccucaucuu

SEQ ID NO: 3560906 - RNA, 16 nt, Human
agcugcaaaggacaga

SEQ ID NO: 3560907 - RNA, 19 nt, Human
agcugcaaaggacagaucc

SEQ ID NO: 3560908 - RNA, 14 nt, Human
agcugcaaaguguu

SEQ ID NO: 3560909 - RNA, 19 nt, Human
agcugcaaaguguuuugua

SEQ ID NO: 3560910 - RNA, 21 nt, Human
agcugcaagguacucugguga

SEQ ID NO: 3560911 - RNA, 23 nt, Human
agcugcaagguacucuggugagu

SEQ ID NO: 3560912 - RNA, 21 nt, Human
agcugcaagugacaucucuuu

SEQ ID NO: 3560913 - RNA, 23 nt, Human
agcugcacagggcagcugggccc

SEQ ID NO: 3560914 - RNA, 23 nt, Human
agcugcaccagagcaaccucuca

SEQ ID NO: 3560915 - RNA, 15 nt, Human
agcugcaccccuucc

SEQ ID NO: 3560916 - RNA, 17 nt, Human
agcugcaccccuuccug

SEQ ID NO: 3560917 - RNA, 13 nt, Human
agcugcacccuca

SEQ ID NO: 3560918 - RNA, 19 nt, Human
agcugcacccucaggcagg

SEQ ID NO: 3560919 - RNA, 20 nt, Human
agcugcacccucaggcaggu

SEQ ID NO: 3560920 - RNA, 22 nt, Human
agcugcaccugccagccuggcu

SEQ ID NO: 3560921 - RNA, 21 nt, Human
agcugcagaaacgaagccauc

SEQ ID NO: 3560922 - RNA, 17 nt, Human
agcugcagagacagaga

SEQ ID NO: 3560923 - RNA, 19 nt, Human
agcugcagagacagagagg

SEQ ID NO: 3560924 - RNA, 16 nt, Human
agcugcagagauuucu

SEQ ID NO: 3560925 - RNA, 19 nt, Human
agcugcagagauuucucau

SEQ ID NO: 3560926 - RNA, 13 nt, Human
agcugcagcuucc

SEQ ID NO: 3560927 - RNA, 13 nt, Human
agcugcagcuugg

SEQ ID NO: 3560928 - RNA, 17 nt, Human
agcugcaggaaucaaaa

SEQ ID NO: 3560929 - RNA, 20 nt, Human
agcugcaggaaucaaaaauu

SEQ ID NO: 3560930 - RNA, 22 nt, Human
agcugcaggaaucaaaaauuga

SEQ ID NO: 3560931 - RNA, 23 nt, Human
agcugcaucauccuugcaggugg

SEQ ID NO: 3560932 - RNA, 19 nt, Human
agcugcauccuccaagaau

SEQ ID NO: 3560933 - RNA, 15 nt, Human
agcugccaaguaaau

SEQ ID NO: 3560934 - RNA, 13 nt, Human
agcugccaccugc

SEQ ID NO: 3560935 - RNA, 19 nt, Human
agcugccaggugagaaacu

SEQ ID NO: 3560936 - RNA, 14 nt, Human
agcugccauggcua

SEQ ID NO: 3560937 - RNA, 24 nt, Human
agcugcccacuguuucucuugagc

SEQ ID NO: 3560938 - RNA, 17 nt, Human
agcugcccccagagcca

SEQ ID NO: 3560939 - RNA, 16 nt, Human
agcugccccucccugc

SEQ ID NO: 3560940 - RNA, 14 nt, Human
agcugccccucucu

SEQ ID NO: 3560941 - RNA, 18 nt, Human
agcugcccuaugggccug

SEQ ID NO: 3560942 - RNA, 19 nt, Human
agcugcccuaugggccugc

SEQ ID NO: 3560943 - RNA, 22 nt, Human
agcugcccuccuuguccaccca

SEQ ID NO: 3560944 - RNA, 14 nt, Human
agcugcccucuccu

SEQ ID NO: 3560945 - RNA, 16 nt, Human
agcugcccucuccugg

SEQ ID NO: 3560946 - RNA, 18 nt, Human
agcugcccucuccugggc

SEQ ID NO: 3560947 - RNA, 19 nt, Human
agcugcccucuccugggca

SEQ ID NO: 3560948 - RNA, 17 nt, Human
agcugccgaccagagcc

SEQ ID NO: 3560949 - RNA, 18 nt, Human
agcugccgggccugauuu

SEQ ID NO: 3560950 - RNA, 16 nt, Human
agcugccggucgcccu

SEQ ID NO: 3560951 - RNA, 21 nt, Human
agcugccuagcaagcuggccu

SEQ ID NO: 3560952 - RNA, 22 nt, Human
agcugccuagcaagcuggccuc

SEQ ID NO: 3560953 - RNA, 22 nt, Human
agcugccuccccuccucugcuu

SEQ ID NO: 3560954 - RNA, 20 nt, Human
agcugccucucgguggccag

SEQ ID NO: 3560955 - RNA, 14 nt, Human
agcugccucuucug

SEQ ID NO: 3560956 - RNA, 23 nt, Human
agcugccugcuuuucacugcugc

SEQ ID NO: 3560957 - RNA, 13 nt, Human
agcugccuggacc

SEQ ID NO: 3560958 - RNA, 14 nt, Human
agcugccuggaccc

SEQ ID NO: 3560959 - RNA, 15 nt, Human
agcugccuggacccg

SEQ ID NO: 3560960 - RNA, 13 nt, Human
agcugccugggau

SEQ ID NO: 3560961 - RNA, 19 nt, Human
agcugccugggaucccuca

SEQ ID NO: 3560962 - RNA, 15 nt, Human
agcugccugguauau

SEQ ID NO: 3560963 - RNA, 13 nt, Human
agcugccuguuca

SEQ ID NO: 3560964 - RNA, 19 nt, Human
agcugccuguucagcucca

SEQ ID NO: 3560965 - RNA, 20 nt, Human
agcugccuguucagcuccag

SEQ ID NO: 3560966 - RNA, 18 nt, Human
agcugccuuagcuucagg

SEQ ID NO: 3560967 - RNA, 22 nt, Human
agcugccuuagcuucaggaacc

SEQ ID NO: 3560968 - RNA, 14 nt, Human
agcugccuucccua

SEQ ID NO: 3560969 - RNA, 16 nt, Human
agcugccuucccuagc

SEQ ID NO: 3560970 - RNA, 17 nt, Human
agcugccuucccuagcu

SEQ ID NO: 3560971 - RNA, 19 nt, Human
agcugccuuggcucagaca

SEQ ID NO: 3560972 - RNA, 20 nt, Human
agcugcgguccacccaggag

SEQ ID NO: 3560973 - RNA, 23 nt, Human
agcugcgguccacccaggagccc

SEQ ID NO: 3560974 - RNA, 18 nt, Human
agcugcggugucucccug

SEQ ID NO: 3560975 - RNA, 14 nt, Human
agcugcuaaaucuc

SEQ ID NO: 3560976 - RNA, 19 nt, Human
agcugcuacaaagaagaca

SEQ ID NO: 3560977 - RNA, 21 nt, Human
agcugcuacucgugagcgcca

SEQ ID NO: 3560978 - RNA, 16 nt, Human
agcugcuauagccugg

SEQ ID NO: 3560979 - RNA, 20 nt, Human
agcugcuauuuauuuuccua

SEQ ID NO: 3560980 - RNA, 20 nt, Human
agcugcucaacuugcaaaau

SEQ ID NO: 3560981 - RNA, 16 nt, Human
agcugcucagggaaaa

SEQ ID NO: 3560982 - RNA, 12 nt, Human
agcugcuccccu

SEQ ID NO: 3560983 - RNA, 18 nt, Human
agcugcuccgaggaccca

SEQ ID NO: 3560984 - RNA, 20 nt, Human
agcugcuccgaggacccagg

SEQ ID NO: 3560985 - RNA, 17 nt, Human
agcugcuccuagaggga

SEQ ID NO: 3560986 - RNA, 20 nt, Human
agcugcuccuagagggaggg

SEQ ID NO: 3560987 - RNA, 15 nt, Human
agcugcucugagcca

SEQ ID NO: 3560988 - RNA, 16 nt, Human
agaacugcagucacug

SEQ ID NO: 3560989 - RNA, 18 nt, Human
agaacugcagucacugca

SEQ ID NO: 3560990 - RNA, 23 nt, Human
agaacugcagucacugcacguuu

SEQ ID NO: 3560991 - RNA, 20 nt, Human
agaacugcauauguuucgcu

SEQ ID NO: 3560992 - RNA, 17 nt, Human
agaacugcauggaccua

SEQ ID NO: 3560993 - RNA, 22 nt, Human
agaacugccuuuggcagaguuc

SEQ ID NO: 3560994 - RNA, 22 nt, Human
agaacugcuuuaucccacggaa

SEQ ID NO: 3560995 - RNA, 15 nt, Human
agaacuggacucagg

SEQ ID NO: 3560996 - RNA, 19 nt, Human
agaacuggguaaaugcaaa

SEQ ID NO: 3560997 - RNA, 21 nt, Human
agaacugucggaggaaagaca

SEQ ID NO: 3560998 - RNA, 16 nt, Human
agaacugugccacaau

SEQ ID NO: 3560999 - RNA, 18 nt, Human
agaacuucagaaagacuu

SEQ ID NO: 3561000 - RNA, 20 nt, Human
agaacuuccccauacaaaua

SEQ ID NO: 3561001 - RNA, 20 nt, Human
agaacuucuccguccucgau

SEQ ID NO: 3561002 - RNA, 12 nt, Human
agaacuuguuua

SEQ ID NO: 3561003 - RNA, 15 nt, Human
agaacuuuauuucca

SEQ ID NO: 3561004 - RNA, 16 nt, Human
agaacuuucauuuuuu

SEQ ID NO: 3561005 - RNA, 18 nt, Human
agaacuuucauuuuuuuc

SEQ ID NO: 3561006 - RNA, 20 nt, Human
agaacuuugagcuacugccg

SEQ ID NO: 3561007 - RNA, 16 nt, Human
agaacuuuuuuaaaua

SEQ ID NO: 3561008 - RNA, 19 nt, Human
agaacuuuuuuaaauaaac

SEQ ID NO: 3561009 - RNA, 20 nt, Human
agaacuuuuuuaaauaaacu

SEQ ID NO: 3561010 - RNA, 11 nt, Human
agaagaaaaaa

SEQ ID NO: 3561011 - RNA, 13 nt, Human
agaagaaaaaaac

SEQ ID NO: 3561012 - RNA, 13 nt, Human
agaagaaaaagaa

SEQ ID NO: 3561013 - RNA, 23 nt, Human
agaagaaaacaucuauucucucc

SEQ ID NO: 3561014 - RNA, 19 nt, Human
agaagaaaauagaauugac

SEQ ID NO: 3561015 - RNA, 16 nt, Human
agaagaaaauugcugu

SEQ ID NO: 3561016 - RNA, 18 nt, Human
agaagaaacgucuaugug

SEQ ID NO: 3561017 - RNA, 13 nt, Human
agaagaaagaacu

SEQ ID NO: 3561018 - RNA, 12 nt, Human
agaagaaagaug

SEQ ID NO: 3561019 - RNA, 13 nt, Human
agaagaaagaugu

SEQ ID NO: 3561020 - RNA, 15 nt, Human
agaagaaagauguuu

SEQ ID NO: 3561021 - RNA, 14 nt, Human
agaagaaaugaaau

SEQ ID NO: 3561022 - RNA, 22 nt, Human
agaagaaauucugucauagaaa

SEQ ID NO: 3561023 - RNA, 12 nt, Human
agaagaacagua

SEQ ID NO: 3561024 - RNA, 14 nt, Human
agaagaacugaaau

SEQ ID NO: 3561025 - RNA, 21 nt, Human
agaagaacuugcauggagcag

SEQ ID NO: 3561026 - RNA, 15 nt, Human
agaagaagaaaaaaa

SEQ ID NO: 3561027 - RNA, 15 nt, Human
agaagaagaagaaaa

SEQ ID NO: 3561028 - RNA, 15 nt, Human
agaagaagaagaaga

SEQ ID NO: 3561029 - RNA, 14 nt, Human
agaagaaggaaaug

SEQ ID NO: 3561030 - RNA, 14 nt, Human
agaagaaguguguc

SEQ ID NO: 3561031 - RNA, 22 nt, Human
agaagaaguuucaucauuuuuu

SEQ ID NO: 3561032 - RNA, 16 nt, Human
agaagaauauucagga

SEQ ID NO: 3561033 - RNA, 22 nt, Human
agaagaauauuguuccuaaguu

SEQ ID NO: 3561034 - RNA, 22 nt, Human
agaagaaucucaucucagugaa

SEQ ID NO: 3561035 - RNA, 19 nt, Human
agaagaaugcuuaaucaga

SEQ ID NO: 3561036 - RNA, 20 nt, Human
agaagaauguguuucaaacu

SEQ ID NO: 3561037 - RNA, 17 nt, Human
agaagaauugaacccag

SEQ ID NO: 3561038 - RNA, 22 nt, Human
agaagaauuuucagaccccagc

SEQ ID NO: 3561039 - RNA, 13 nt, Human
agaagacaaaaag

SEQ ID NO: 3561040 - RNA, 15 nt, Human
agaagacaaacugcu

SEQ ID NO: 3561041 - RNA, 14 nt, Human
agaagacaccagag

SEQ ID NO: 3561042 - RNA, 15 nt, Human
agaagacaccagagc

SEQ ID NO: 3561043 - RNA, 16 nt, Human
agaagacaccagagca

SEQ ID NO: 3561044 - RNA, 19 nt, Human
agaagacaccagagcagau

SEQ ID NO: 3561045 - RNA, 22 nt, Human
agaagacaccagagcagaugca

SEQ ID NO: 3561046 - RNA, 21 nt, Human
agaagacacugaugggcaacc

SEQ ID NO: 3561047 - RNA, 13 nt, Human
agaagacaggcug

SEQ ID NO: 3561048 - RNA, 12 nt, Human
agaagacaugaa

SEQ ID NO: 3561049 - RNA, 14 nt, Human
agaagacauggaga

SEQ ID NO: 3561050 - RNA, 15 nt, Human
agaagacauguuuua

SEQ ID NO: 3561051 - RNA, 16 nt, Human
agaagacauguuuuag

SEQ ID NO: 3561052 - RNA, 14 nt, Human
agaagacccuucuc

SEQ ID NO: 3561053 - RNA, 17 nt, Human
agaagaccugagaaugu

SEQ ID NO: 3561054 - RNA, 21 nt, Human
agaagacugcauuauauuuau

SEQ ID NO: 3561055 - RNA, 15 nt, Human
agaagagaaugcaca

SEQ ID NO: 3561056 - RNA, 18 nt, Human
agaagagacucuuugcau

SEQ ID NO: 3561057 - RNA, 15 nt, Human
agaagagagaucaaa

SEQ ID NO: 3561058 - RNA, 13 nt, Human
agaagagaggaga

SEQ ID NO: 3561059 - RNA, 20 nt, Human
agaagagaggagaggagaga

SEQ ID NO: 3561060 - RNA, 22 nt, Human
agaagagaggagaggagagagg

SEQ ID NO: 3561061 - RNA, 20 nt, Human
agaagagaugggcuuguuuu

SEQ ID NO: 3561062 - RNA, 20 nt, Human
agaagagccccacucucaga

SEQ ID NO: 3561063 - RNA, 12 nt, Human
agaagagcgcag

SEQ ID NO: 3561064 - RNA, 18 nt, Human
agcugggccccagcccac

SEQ ID NO: 3561065 - RNA, 20 nt, Human
agcugggccccagcccaccc

SEQ ID NO: 3561066 - RNA, 21 nt, Human
agcugggcccgacauggcucc

SEQ ID NO: 3561067 - RNA, 18 nt, Human
agcugggccgggacccag

SEQ ID NO: 3561068 - RNA, 17 nt, Human
agcugggcuaaguaaau

SEQ ID NO: 3561069 - RNA, 14 nt, Human
agcugggcucugcc

SEQ ID NO: 3561070 - RNA, 16 nt, Human
agcugggcuggggagg

SEQ ID NO: 3561071 - RNA, 20 nt, Human
agcugggcuggggaggaccu

SEQ ID NO: 3561072 - RNA, 15 nt, Human
agcuggggaucccuc

SEQ ID NO: 3561073 - RNA, 20 nt, Human
agcuggggcguggggagggc

SEQ ID NO: 3561074 - RNA, 16 nt, Human
agcugggggccaugag

SEQ ID NO: 3561075 - RNA, 18 nt, Human
agcugggggccaugagcu

SEQ ID NO: 3561076 - RNA, 20 nt, Human
agcugggggccaugagcucc

SEQ ID NO: 3561077 - RNA, 17 nt, Human
agcugggggugggccag

SEQ ID NO: 3561078 - RNA, 22 nt, Human
agcugggugaguggggagacac

SEQ ID NO: 3561079 - RNA, 22 nt, Human
agcugggugucaagagggucug

SEQ ID NO: 3561080 - RNA, 16 nt, Human
agcuggguuggaaaac

SEQ ID NO: 3561081 - RNA, 21 nt, Human
agcugguaguuaguagcaugu

SEQ ID NO: 3561082 - RNA, 16 nt, Human
agcuggucccacucag

SEQ ID NO: 3561083 - RNA, 12 nt, Human
agcuggugcauu

SEQ ID NO: 3561084 - RNA, 14 nt, Human
agcuggugcauuac

SEQ ID NO: 3561085 - RNA, 20 nt, Human
agcuggugcauuacagagag

SEQ ID NO: 3561086 - RNA, 14 nt, Human
agcuggugcccugc

SEQ ID NO: 3561087 - RNA, 15 nt, Human
agcugguggcagagu

SEQ ID NO: 3561088 - RNA, 15 nt, Human
agcuggugggaagcg

SEQ ID NO: 3561089 - RNA, 21 nt, Human
agcuggugggugaaagaaauc

SEQ ID NO: 3561090 - RNA, 23 nt, Human
agcuggugggugaaagaaaucau

SEQ ID NO: 3561091 - RNA, 14 nt, Human
agcugguguagcua

SEQ ID NO: 3561092 - RNA, 21 nt, Human
agcugguguagcuacagagaa

SEQ ID NO: 3561093 - RNA, 22 nt, Human
agcugguguagcuacagagaaa

SEQ ID NO: 3561094 - RNA, 15 nt, Human
agcugguuagaaaug

SEQ ID NO: 3561095 - RNA, 16 nt, Human
agcugguuccugcuag

SEQ ID NO: 3561096 - RNA, 14 nt, Human
agcugguuuuuagc

SEQ ID NO: 3561097 - RNA, 22 nt, Human
agcugguuuuuagcggagacgg

SEQ ID NO: 3561098 - RNA, 22 nt, Human
agcuguaaacuuccaauuucua

SEQ ID NO: 3561099 - RNA, 16 nt, Human
agcuguaacaguucuu

SEQ ID NO: 3561100 - RNA, 17 nt, Human
agcuguaacaguucuuu

SEQ ID NO: 3561101 - RNA, 19 nt, Human
agcuguaaggcaugaagga

SEQ ID NO: 3561102 - RNA, 21 nt, Human
agcuguacuucgucuucuaau

SEQ ID NO: 3561103 - RNA, 20 nt, Human
agcuguaguagcccuuucug

SEQ ID NO: 3561104 - RNA, 21 nt, Human
agcuguaguagcccuuucugu

SEQ ID NO: 3561105 - RNA, 22 nt, Human
agcuguaguagcccuuucugug

SEQ ID NO: 3561106 - RNA, 15 nt, Human
agcugucacaacuug

SEQ ID NO: 3561107 - RNA, 21 nt, Human
agcugucacuucgcgugcccu

SEQ ID NO: 3561108 - RNA, 14 nt, Human
agcuguccccccac

SEQ ID NO: 3561109 - RNA, 16 nt, Human
agcugucccugcccuu

SEQ ID NO: 3561110 - RNA, 14 nt, Human
agcugucccuguca

SEQ ID NO: 3561111 - RNA, 17 nt, Human
agcuguccucccuccac

SEQ ID NO: 3561112 - RNA, 22 nt, Human
agcuguccugcagcaaacacuc

SEQ ID NO: 3561113 - RNA, 18 nt, Human
agcuguccuuuuuccucu

SEQ ID NO: 3561114 - RNA, 20 nt, Human
agcuguccuuuuuccucucc

SEQ ID NO: 3561115 - RNA, 23 nt, Human
agcuguccuuuuuccucuccaca

SEQ ID NO: 3561116 - RNA, 15 nt, Human
agcugucucuaacuu

SEQ ID NO: 3561117 - RNA, 11 nt, Human
agcugucugcu

SEQ ID NO: 3561118 - RNA, 16 nt, Human
agcugucuguggcuuc

SEQ ID NO: 3561119 - RNA, 14 nt, Human
agcugucuuuugga

SEQ ID NO: 3561120 - RNA, 17 nt, Human
agcugugaccucucccc

SEQ ID NO: 3561121 - RNA, 14 nt, Human
agcugugaccugcu

SEQ ID NO: 3561122 - RNA, 15 nt, Human
agcugugagccuugg

SEQ ID NO: 3561123 - RNA, 17 nt, Human
agcugugagccuuggcu

SEQ ID NO: 3561124 - RNA, 12 nt, Human
agcugugauuuu

SEQ ID NO: 3561125 - RNA, 10 nt, Human
agcugugcag

SEQ ID NO: 3561126 - RNA, 18 nt, Human
agcugugccacccugggc

SEQ ID NO: 3561127 - RNA, 20 nt, Human
agcugugccacccugggcuc

SEQ ID NO: 3561128 - RNA, 21 nt, Human
agcugugcucuggacaggcau

SEQ ID NO: 3561129 - RNA, 22 nt, Human
agcuguggaggauugcuaucug

SEQ ID NO: 3561130 - RNA, 20 nt, Human
agcuguguccggcccaguuu

SEQ ID NO: 3561131 - RNA, 24 nt, Human
agcuguguccuugcaccugcaucc

SEQ ID NO: 3561132 - RNA, 23 nt, Human
agcugugugaaauaccagugugg

SEQ ID NO: 3561133 - RNA, 21 nt, Human
ugcaaaaugaggaauguauau

SEQ ID NO: 3561134 - RNA, 21 nt, Human
ugcaaaauuuccaguaccuuu

SEQ ID NO: 3561135 - RNA, 22 nt, Human
ugcaaaauuugaugccaggaca

SEQ ID NO: 3561136 - RNA, 23 nt, Human
ugcaaacacacaaagguauaauu

SEQ ID NO: 3561137 - RNA, 22 nt, Human
ugcaaaccugaccccugcucag

SEQ ID NO: 3561138 - RNA, 17 nt, Human
ugcaaacgcugccugcc

SEQ ID NO: 3561139 - RNA, 16 nt, Human
ugcaaagaaaaucaga

SEQ ID NO: 3561140 - RNA, 23 nt, Human
ugcaaagaaagaaaaaaaaccau

SEQ ID NO: 3561141 - RNA, 15 nt, Human
ugcaaagaggcaaga

SEQ ID NO: 3561142 - RNA, 12 nt, Human
ugcaaagaucug

SEQ ID NO: 3561143 - RNA, 22 nt, Human
ugcaaagcacugacuucuaagu

SEQ ID NO: 3561144 - RNA, 14 nt, Human
ugcaaagcccagcu

SEQ ID NO: 3561145 - RNA, 15 nt, Human
ugcaaagcccagcuu

SEQ ID NO: 3561146 - RNA, 16 nt, Human
ugcaaaggaaauacca

SEQ ID NO: 3561147 - RNA, 12 nt, Human
ugcaaaggcugg

SEQ ID NO: 3561148 - RNA, 13 nt, Human
ugcaaaggcuggg

SEQ ID NO: 3561149 - RNA, 21 nt, Human
ugcaaaggguaucaggugcug

SEQ ID NO: 3561150 - RNA, 13 nt, Human
ugcaaaguacugu

SEQ ID NO: 3561151 - RNA, 14 nt, Human
ugcaaaguacugua

SEQ ID NO: 3561152 - RNA, 22 nt, Human
ugcaaaguauaaauuuguguaa

SEQ ID NO: 3561153 - RNA, 19 nt, Human
ugcaaaguguuuuguacca

SEQ ID NO: 3561154 - RNA, 18 nt, Human
ugcaaauaaguguauuuu

SEQ ID NO: 3561155 - RNA, 17 nt, Human
ugcaaauauaaacaucu

SEQ ID NO: 3561156 - RNA, 18 nt, Human
ugcaaauauuuuuuugua

SEQ ID NO: 3561157 - RNA, 20 nt, Human
ugcaaaucaggcuuuuguuu

SEQ ID NO: 3561158 - RNA, 21 nt, Human
ugcaaauccuaugugauuuua

SEQ ID NO: 3561159 - RNA, 22 nt, Human
ugcaaaugucagauacaaugua

SEQ ID NO: 3561160 - RNA, 13 nt, Human
ugcaacacacaga

SEQ ID NO: 3561161 - RNA, 22 nt, Human
ugcaacacuggucugcuguucc

SEQ ID NO: 3561162 - RNA, 13 nt, Human
ugcaacagacaag

SEQ ID NO: 3561163 - RNA, 17 nt, Human
ugcaacagcacuggcuc

SEQ ID NO: 3561164 - RNA, 13 nt, Human
ugcaacaggcugg

SEQ ID NO: 3561165 - RNA, 13 nt, Human
ugcaacaguagca

SEQ ID NO: 3561166 - RNA, 14 nt, Human
ugcaacaguagcau

SEQ ID NO: 3561167 - RNA, 15 nt, Human
ugcaacaugaugagg

SEQ ID NO: 3561168 - RNA, 21 nt, Human
ugcaaccagggagcugcaggg

SEQ ID NO: 3561169 - RNA, 20 nt, Human
ugcaacccaaggacugaggg

SEQ ID NO: 3561170 - RNA, 15 nt, Human
ugcaacccuuacccc

SEQ ID NO: 3561171 - RNA, 13 nt, Human
ugcaaccuccacc

SEQ ID NO: 3561172 - RNA, 20 nt, Human
ugcaaccuccaccuccuggg

SEQ ID NO: 3561173 - RNA, 18 nt, Human
ugcaaccuccgccucuug

SEQ ID NO: 3561174 - RNA, 14 nt, Human
ugcaaccucgcugg

SEQ ID NO: 3561175 - RNA, 19 nt, Human
ugcaaccucugcuucccag

SEQ ID NO: 3561176 - RNA, 18 nt, Human
ugcaaccucuuggccuga

SEQ ID NO: 3561177 - RNA, 18 nt, Human
ugcaacugacacucccac

SEQ ID NO: 3561178 - RNA, 21 nt, Human
ugcaacuucuuuuuauuuucu

SEQ ID NO: 3561179 - RNA, 14 nt, Human
ugcaacuuggacuu

SEQ ID NO: 3561180 - RNA, 16 nt, Human
ugcaacuuguaaaugu

SEQ ID NO: 3561181 - RNA, 19 nt, Human
ugcaacuuuaagcagcucu

SEQ ID NO: 3561182 - RNA, 22 nt, Human
ugcaagaacucaucacuguggc

SEQ ID NO: 3561183 - RNA, 23 nt, Human
ugcaagagggagcacgugacugu

SEQ ID NO: 3561184 - RNA, 14 nt, Human
ugcaagaugugaau

SEQ ID NO: 3561185 - RNA, 18 nt, Human
ugcaagaugugaauuauu

SEQ ID NO: 3561186 - RNA, 18 nt, Human
ugcaagauucugaaacau

SEQ ID NO: 3561187 - RNA, 15 nt, Human
ugcaagcacagcccu

SEQ ID NO: 3561188 - RNA, 16 nt, Human
ugcaagcacagcccuu

SEQ ID NO: 3561189 - RNA, 16 nt, Human
ugcaagcagaggacca

SEQ ID NO: 3561190 - RNA, 22 nt, Human
ugcaagcagaggaccagggccu

SEQ ID NO: 3561191 - RNA, 15 nt, Human
ugcaagcaguuucaa

SEQ ID NO: 3561192 - RNA, 21 nt, Human
ugcaagcaguuucaauaaagu

SEQ ID NO: 3561193 - RNA, 19 nt, Human
ugcaagccugucugagacu

SEQ ID NO: 3561194 - RNA, 13 nt, Human
ugcaaggcaaaga

SEQ ID NO: 3561195 - RNA, 17 nt, Human
ugcaaggcacuguacua

SEQ ID NO: 3561196 - RNA, 16 nt, Human
ugcaaggcagccgugg

SEQ ID NO: 3561197 - RNA, 17 nt, Human
ugcaaggcccacaggag

SEQ ID NO: 3561198 - RNA, 14 nt, Human
ugcaaggccuuucu

SEQ ID NO: 3561199 - RNA, 20 nt, Human
ugcaagggaguuagggaaau

SEQ ID NO: 3561200 - RNA, 20 nt, Human
ugcaagggcagaacacuaac

SEQ ID NO: 3561201 - RNA, 21 nt, Human
ugcaagggcagaacacuaacc

SEQ ID NO: 3561202 - RNA, 15 nt, Human
ugcaagggcucccca

SEQ ID NO: 3561203 - RNA, 18 nt, Human
ugcaaggggaaaaucuca

SEQ ID NO: 3561204 - RNA, 16 nt, Human
ugcaagguaaaauuuu

SEQ ID NO: 3561205 - RNA, 18 nt, Human
ugcaagguacucugguga

SEQ ID NO: 3561206 - RNA, 22 nt, Human
ugcaagguauuacacucuguaa

SEQ ID NO: 3561207 - RNA, 13 nt, Human
ugcaagguuccac

SEQ ID NO: 3561208 - RNA, 15 nt, Human
ugcaagguuccacag

SEQ ID NO: 3561209 - RNA, 17 nt, Human
ugcaaguauacuaggga

SEQ ID NO: 3561210 - RNA, 15 nt, Human
ugcaaguaugugagu

SEQ ID NO: 3561211 - RNA, 22 nt, Human
ugcaaguaugugagugugucca

SEQ ID NO: 3561212 - RNA, 19 nt, Human
ugcaaguauguuuuagcau

SEQ ID NO: 3561213 - RNA, 21 nt, Human
ugcaaguauguuuuagcaugu

SEQ ID NO: 3561214 - RNA, 22 nt, Human
ugcaaguauguuuuagcaugug

SEQ ID NO: 3561215 - RNA, 15 nt, Human
ugcaaguauucucau

SEQ ID NO: 3561216 - RNA, 12 nt, Human
ugcaagucucuu

SEQ ID NO: 3561217 - RNA, 16 nt, Human
ugcaagugacaucucu

SEQ ID NO: 3561218 - RNA, 23 nt, Human
ugcaagugagcaaaccugcccca

SEQ ID NO: 3561219 - RNA, 18 nt, Human
ugcaagugucugugugca

SEQ ID NO: 3561220 - RNA, 22 nt, Human
ugcaaguguguaugugcgugug

SEQ ID NO: 3561221 - RNA, 23 nt, Human
ugcaagugugugcacaugugugc

SEQ ID NO: 3561222 - RNA, 16 nt, Human
ugcaaguuuaucagua

SEQ ID NO: 3561223 - RNA, 17 nt, Human
ugcaauaaaauggguuu

SEQ ID NO: 3561224 - RNA, 21 nt, Human
ugcaauaaaauggguuuuacu

SEQ ID NO: 3561225 - RNA, 20 nt, Human
ugcaauaaaauuauuugcag

SEQ ID NO: 3561226 - RNA, 22 nt, Human
ugcaauaaaauuauuugcaggu

SEQ ID NO: 3561227 - RNA, 16 nt, Human
ugcaauaaaauuuaaa

SEQ ID NO: 3561228 - RNA, 16 nt, Human
ugcaauaaaguauaau

SEQ ID NO: 3561229 - RNA, 12 nt, Human
ugcaauaacagc

SEQ ID NO: 3561230 - RNA, 16 nt, Human
ugcaauaacuucugac

SEQ ID NO: 3561231 - RNA, 19 nt, Human
ugcaauaacuucugaccuu

SEQ ID NO: 3561232 - RNA, 12 nt, Human
ugcaauaaugca

SEQ ID NO: 3561233 - RNA, 20 nt, Human
ugcaauaaugcaguauggua

SEQ ID NO: 3561234 - RNA, 14 nt, Human
ugcaauacauacca

SEQ ID NO: 3561235 - RNA, 13 nt, Human
ugcaauagaaauc

SEQ ID NO: 3561236 - RNA, 16 nt, Human
ugcaauagaaggugau

SEQ ID NO: 3561237 - RNA, 19 nt, Human
ugcaauagagacuguagau

SEQ ID NO: 3561238 - RNA, 20 nt, Human
ugcaauauacuggaaagcuu

SEQ ID NO: 3561239 - RNA, 22 nt, Human
ugcaauauaucuaaauugaaua

SEQ ID NO: 3561240 - RNA, 14 nt, Human
ugcaauauguauua

SEQ ID NO: 3561241 - RNA, 21 nt, Human
ugcaauauuaaugccuuuaaa

SEQ ID NO: 3561242 - RNA, 16 nt, Human
ugcaaucauaugugau

SEQ ID NO: 3561243 - RNA, 17 nt, Human
ugcaaucauaugugauc

SEQ ID NO: 3561244 - RNA, 22 nt, Human
ugcaaucauaugugaucugucu

SEQ ID NO: 3561245 - RNA, 23 nt, Human
ugcaaucauaugugaucugucuu

SEQ ID NO: 3561246 - RNA, 17 nt, Human
ugcaauccuuacaaaug

SEQ ID NO: 3561247 - RNA, 22 nt, Human
ugcaaugaaagguacuauauuu

SEQ ID NO: 3561248 - RNA, 22 nt, Human
ugcaaugaagucucugaaguga

SEQ ID NO: 3561249 - RNA, 21 nt, Human
ugcaaugacacagucuuggcu

SEQ ID NO: 3561250 - RNA, 17 nt, Human
ugcaaugaccuuucaau

SEQ ID NO: 3561251 - RNA, 19 nt, Human
ugcaaugaccuuucaauag

SEQ ID NO: 3561252 - RNA, 13 nt, Human
ugcaauggcagcc

SEQ ID NO: 3561253 - RNA, 14 nt, Human
ugcaauggcagccu

SEQ ID NO: 3561254 - RNA, 16 nt, Human
ugcaauggcagccuug

SEQ ID NO: 3561255 - RNA, 15 nt, Human
ugcaaugggcacugg

SEQ ID NO: 3561256 - RNA, 19 nt, Human
ugcaauguaucccuucuca

SEQ ID NO: 3561257 - RNA, 16 nt, Human
ugcaaugugcuacuga

SEQ ID NO: 3561258 - RNA, 15 nt, Human
ugcaauguuuuccuu

SEQ ID NO: 3561259 - RNA, 22 nt, Human
ugcaauuaaacuuccaaagaaa

SEQ ID NO: 3561260 - RNA, 24 nt, Human
ugcaauuaaacuuccaaagaaagu

SEQ ID NO: 3561261 - RNA, 20 nt, Human
ugcaauuagguuuuuccuua

SEQ ID NO: 3561262 - RNA, 20 nt, Human
uggggcuagggggagccccu

SEQ ID NO: 3561263 - RNA, 17 nt, Human
uggggcucacacaccug

SEQ ID NO: 3561264 - RNA, 17 nt, Human
uggggcucagagccggg

SEQ ID NO: 3561265 - RNA, 12 nt, Human
uggggcucccag

SEQ ID NO: 3561266 - RNA, 13 nt, Human
uggggcucccagc

SEQ ID NO: 3561267 - RNA, 15 nt, Human
uggggcucccagcca

SEQ ID NO: 3561268 - RNA, 16 nt, Human
uggggcucccgccucc

SEQ ID NO: 3561269 - RNA, 23 nt, Human
uggggcucccgccuccaaccccu

SEQ ID NO: 3561270 - RNA, 21 nt, Human
uggggcuccuuucuccagcca

SEQ ID NO: 3561271 - RNA, 23 nt, Human
uggggcuccuuucuccagccagc

SEQ ID NO: 3561272 - RNA, 13 nt, Human
uggggcucgccau

SEQ ID NO: 3561273 - RNA, 23 nt, Human
uggggcucuaacgccugagccca

SEQ ID NO: 3561274 - RNA, 18 nt, Human
uggggcugaccuuccucg

SEQ ID NO: 3561275 - RNA, 23 nt, Human
uggggcugaccuuccucgcagag

SEQ ID NO: 3561276 - RNA, 22 nt, Human
uggggcugcaccggcuggccug

SEQ ID NO: 3561277 - RNA, 14 nt, Human
uggggcugcuccuc

SEQ ID NO: 3561278 - RNA, 17 nt, Human
uggggcugcuccuccag

SEQ ID NO: 3561279 - RNA, 21 nt, Human
uggggcugcuccuccagggcc

SEQ ID NO: 3561280 - RNA, 13 nt, Human
uggggcuggcuuu

SEQ ID NO: 3561281 - RNA, 18 nt, Human
uggggcuggcuuuucugu

SEQ ID NO: 3561282 - RNA, 16 nt, Human
uggggcuugggggcuc

SEQ ID NO: 3561283 - RNA, 22 nt, Human
ugggggaaagcaaagcacagag

SEQ ID NO: 3561284 - RNA, 17 nt, Human
ugggggagagcaggcug

SEQ ID NO: 3561285 - RNA, 20 nt, Human
ugggggaggggagacuuuga

SEQ ID NO: 3561286 - RNA, 21 nt, Human
ugggggaguagaucuuucuag

SEQ ID NO: 3561287 - RNA, 19 nt, Human
ugggggagucugaagcaga

SEQ ID NO: 3561288 - RNA, 17 nt, Human
ugggggaguuuuccucu

SEQ ID NO: 3561289 - RNA, 20 nt, Human
ugggggaucacagccucuga

SEQ ID NO: 3561290 - RNA, 20 nt, Human
ugggggaugacuagaggcag

SEQ ID NO: 3561291 - RNA, 17 nt, Human
ugggggaugggccugag

SEQ ID NO: 3561292 - RNA, 13 nt, Human
ugggggcaagaag

SEQ ID NO: 3561293 - RNA, 23 nt, Human
ugggggcaagaagaucacgcucc

SEQ ID NO: 3561294 - RNA, 17 nt, Human
ugggggcagccugcgug

SEQ ID NO: 3561295 - RNA, 19 nt, Human
ugggggcagccugcguggc

SEQ ID NO: 3561296 - RNA, 17 nt, Human
ugggggccaccugccug

SEQ ID NO: 3561297 - RNA, 16 nt, Human
ugggggccaugagcuc

SEQ ID NO: 3561298 - RNA, 19 nt, Human
ugggggccccgucucaggu

SEQ ID NO: 3561299 - RNA, 23 nt, Human
ugggggccccgucucaggucuga

SEQ ID NO: 3561300 - RNA, 19 nt, Human
ugggggccugaccuccccc

SEQ ID NO: 3561301 - RNA, 14 nt, Human
ugggggccuggauu

SEQ ID NO: 3561302 - RNA, 17 nt, Human
ugggggccuggcuggcu

SEQ ID NO: 3561303 - RNA, 20 nt, Human
ugggggccuggcuggcugag

SEQ ID NO: 3561304 - RNA, 21 nt, Human
ugggggcggggugggaaagau

SEQ ID NO: 3561305 - RNA, 14 nt, Human
ugggggcuagggag

SEQ ID NO: 3561306 - RNA, 13 nt, Human
ugggggcugcagu

SEQ ID NO: 3561307 - RNA, 19 nt, Human
ugggggcugggcagaggaa

SEQ ID NO: 3561308 - RNA, 13 nt, Human
ugggggcuggugc

SEQ ID NO: 3561309 - RNA, 13 nt, Human
uggggggaacgcc

SEQ ID NO: 3561310 - RNA, 19 nt, Human
uggggggaacgcccacuuc

SEQ ID NO: 3561311 - RNA, 19 nt, Human
uggggggacccagugcaga

SEQ ID NO: 3561312 - RNA, 11 nt, Human
uggggggaggc

SEQ ID NO: 3561313 - RNA, 13 nt, Human
uggggggaggcug

SEQ ID NO: 3561314 - RNA, 15 nt, Human
uggggggcauugagu

SEQ ID NO: 3561315 - RNA, 13 nt, Human
uggggggggugcu

SEQ ID NO: 3561316 - RNA, 23 nt, Human
uggggggguggccgcugaguggc

SEQ ID NO: 3561317 - RNA, 20 nt, Human
uggggggugaugagggcagc

SEQ ID NO: 3561318 - RNA, 16 nt, Human
ugggggguggccaggc

SEQ ID NO: 3561319 - RNA, 20 nt, Human
uggggguaaaaaauauagcc

SEQ ID NO: 3561320 - RNA, 21 nt, Human
uggggguagagcugauccaga

SEQ ID NO: 3561321 - RNA, 16 nt, Human
uggggguagcagcugg

SEQ ID NO: 3561322 - RNA, 18 nt, Human
ugggggucagugcugccu

SEQ ID NO: 3561323 - RNA, 14 nt, Human
ugggggucugugug

SEQ ID NO: 3561324 - RNA, 15 nt, Human
ugggggugcauuuga

SEQ ID NO: 3561325 - RNA, 19 nt, Human
uggggguucuuucuuccuc

SEQ ID NO: 3561326 - RNA, 22 nt, Human
uggggguucuuucuuccucugc

SEQ ID NO: 3561327 - RNA, 16 nt, Human
ugggguacccacugcu

SEQ ID NO: 3561328 - RNA, 16 nt, Human
ugggguagggcugacu

SEQ ID NO: 3561329 - RNA, 20 nt, Human
uggggucaagaaacagccag

SEQ ID NO: 3561330 - RNA, 21 nt, Human
uggggucaagaaacagccagc

SEQ ID NO: 3561331 - RNA, 17 nt, Human
uggggucagagacugcu

SEQ ID NO: 3561332 - RNA, 19 nt, Human
uggggucagccagggccag

SEQ ID NO: 3561333 - RNA, 22 nt, Human
uggggucaggccgggcagagca

SEQ ID NO: 3561334 - RNA, 18 nt, Human
uggggucaugcccuccuc

SEQ ID NO: 3561335 - RNA, 20 nt, Human
uggggucaugcccuccucuc

SEQ ID NO: 3561336 - RNA, 21 nt, Human
uggggucccagcagcugccag

SEQ ID NO: 3561337 - RNA, 12 nt, Human
ugggguccccag

SEQ ID NO: 3561338 - RNA, 13 nt, Human
ugggguccccauc

SEQ ID NO: 3561339 - RNA, 13 nt, Human
uggggucccucua

SEQ ID NO: 3561340 - RNA, 12 nt, Human
ugggguccuggc

SEQ ID NO: 3561341 - RNA, 19 nt, Human
uggggucuacacugcaauc

SEQ ID NO: 3561342 - RNA, 21 nt, Human
uggggucucacaguguugccc

SEQ ID NO: 3561343 - RNA, 19 nt, Human
uggggucucccucuccugc

SEQ ID NO: 3561344 - RNA, 21 nt, Human
uggggucucccucuccugccu

SEQ ID NO: 3561345 - RNA, 19 nt, Human
uggggucuccucaggacca

SEQ ID NO: 3561346 - RNA, 22 nt, Human
uggggucuccucaggaccaggg

SEQ ID NO: 3561347 - RNA, 21 nt, Human
uggggucuggaguugaucugg

SEQ ID NO: 3561348 - RNA, 14 nt, Human
uggggucuggcagc

SEQ ID NO: 3561349 - RNA, 16 nt, Human
uggggucuguaaaauc

SEQ ID NO: 3561350 - RNA, 12 nt, Human
uggggugacagu

SEQ ID NO: 3561351 - RNA, 15 nt, Human
uggggugacagucau

SEQ ID NO: 3561352 - RNA, 17 nt, Human
uggggugacagucauca

SEQ ID NO: 3561353 - RNA, 19 nt, Human
uggggugcccuccacugcc

SEQ ID NO: 3561354 - RNA, 15 nt, Human
uggggugccgccugc

SEQ ID NO: 3561355 - RNA, 17 nt, Human
uggggugccgccugccc

SEQ ID NO: 3561356 - RNA, 14 nt, Human
ugggguggcugcag

SEQ ID NO: 3561357 - RNA, 20 nt, Human
ugggguggcugcagccucag

SEQ ID NO: 3561358 - RNA, 21 nt, Human
ugggguggggggggguccuaa

SEQ ID NO: 3561359 - RNA, 18 nt, Human
ugggguuaucucuguguu

SEQ ID NO: 3561360 - RNA, 19 nt, Human
ugggguuaucucuguguua

SEQ ID NO: 3561361 - RNA, 14 nt, Human
ugggguucagcccc

SEQ ID NO: 3561362 - RNA, 19 nt, Human
ugggguuuaucagaauucu

SEQ ID NO: 3561363 - RNA, 16 nt, Human
uggguaaaauacuuuu

SEQ ID NO: 3561364 - RNA, 15 nt, Human
uggguaaaugcaaag

SEQ ID NO: 3561365 - RNA, 23 nt, Human
uggguaauccaggcacagcugag

SEQ ID NO: 3561366 - RNA, 15 nt, Human
uggguacagagaggu

SEQ ID NO: 3561367 - RNA, 19 nt, Human
uggguacuucuugaaggug

SEQ ID NO: 3561368 - RNA, 18 nt, Human
uggguaggguaaaucagu

SEQ ID NO: 3561369 - RNA, 14 nt, Human
uggguauaaaagau

SEQ ID NO: 3561370 - RNA, 18 nt, Human
uggguauagauguugcua

SEQ ID NO: 3561371 - RNA, 19 nt, Human
uggguauauucauuucaaa

SEQ ID NO: 3561372 - RNA, 22 nt, Human
uggguaucaccacuggagauca

SEQ ID NO: 3561373 - RNA, 14 nt, Human
uggguauguguagg

SEQ ID NO: 3561374 - RNA, 13 nt, Human
ugggucaaggaau

SEQ ID NO: 3561375 - RNA, 21 nt, Human
ugggucaccagacggggcugg

SEQ ID NO: 3561376 - RNA, 23 nt, Human
ugggucaguguccaaagcagggu

SEQ ID NO: 3561377 - RNA, 22 nt, Human
ugggucaugaugcucuuuccca

SEQ ID NO: 3561378 - RNA, 13 nt, Human
uggguccaaauaa

SEQ ID NO: 3561379 - RNA, 18 nt, Human
uggguccaaauaaaaacu

SEQ ID NO: 3561380 - RNA, 20 nt, Human
uggguccaggauuccucuuu

SEQ ID NO: 3561381 - RNA, 17 nt, Human
uggguccaugggcagag

SEQ ID NO: 3561382 - RNA, 20 nt, Human
ugggucccacuuccccuccu

SEQ ID NO: 3561383 - RNA, 13 nt, Human
ugggucccaggac

SEQ ID NO: 3561384 - RNA, 16 nt, Human
uggguccccagcccuu

SEQ ID NO: 3561385 - RNA, 22 nt, Human
ugggucccccucagcaagcccu

SEQ ID NO: 3561386 - RNA, 19 nt, Human
ugggucccggcucuguggg

SEQ ID NO: 3561387 - RNA, 18 nt, Human
uggguccgauaauaucuu

SEQ ID NO: 3561388 - RNA, 16 nt, Human
ugggucgcccaugaga

SEQ ID NO: 3561389 - RNA, 16 nt, Human
ugggucgcccuggacu

SEQ ID NO: 3561390 - RNA, 21 nt, Human
ugggucgcccuggacugugug

SEQ ID NO: 3561391 - RNA, 21 nt, Human
ugggucuaggacacaguuccu

SEQ ID NO: 3561392 - RNA, 22 nt, Human
ugggucucgcuuuguugcccag

SEQ ID NO: 3561393 - RNA, 18 nt, Human
ugggucucucuugcccca

SEQ ID NO: 3561394 - RNA, 21 nt, Human
ugggucucucuugccccaccu

SEQ ID NO: 3561395 - RNA, 13 nt, Human
ugggucuggagga

SEQ ID NO: 3561396 - RNA, 21 nt, Human
ugggucuggaggaccugcccg

SEQ ID NO: 3561397 - RNA, 17 nt, Human
ugggucuggcugagcug

SEQ ID NO: 3561398 - RNA, 20 nt, Human
ugggucugugucucuuuucu

SEQ ID NO: 3561399 - RNA, 12 nt, Human
ugggucugugug

SEQ ID NO: 3561400 - RNA, 14 nt, Human
ugggucuuccaggg

SEQ ID NO: 3561401 - RNA, 15 nt, Human
ugggugaagacagag

SEQ ID NO: 3561402 - RNA, 18 nt, Human
ugggugacaagagccuga

SEQ ID NO: 3561403 - RNA, 17 nt, Human
ugggugacagagcaaga

SEQ ID NO: 3561404 - RNA, 21 nt, Human
ugggugagaugcuggagaaga

SEQ ID NO: 3561405 - RNA, 18 nt, Human
ugggugcccacagcccgc

SEQ ID NO: 3561406 - RNA, 16 nt, Human
aagcugugccacccug

SEQ ID NO: 3561407 - RNA, 23 nt, Human
aagcugugucugcccaaugaaua

SEQ ID NO: 3561408 - RNA, 14 nt, Human
aagcuguuaaacug

SEQ ID NO: 3561409 - RNA, 15 nt, Human
aagcuguuaaacugu

SEQ ID NO: 3561410 - RNA, 17 nt, Human
aagcuguuaaacuguua

SEQ ID NO: 3561411 - RNA, 12 nt, Human
aagcuguuguac

SEQ ID NO: 3561412 - RNA, 14 nt, Human
aagcuguuuggaaa

SEQ ID NO: 3561413 - RNA, 19 nt, Human
aagcuguuugguuuuaaaa

SEQ ID NO: 3561414 - RNA, 13 nt, Human
aagcuuaaaacuu

SEQ ID NO: 3561415 - RNA, 17 nt, Human
aagcuuaaaacuuugaa

SEQ ID NO: 3561416 - RNA, 10 nt, Human
aagcuuagaa

SEQ ID NO: 3561417 - RNA, 20 nt, Human
aagcuuagcaggagaggaga

SEQ ID NO: 3561418 - RNA, 13 nt, Human
aagcuuaggcagg

SEQ ID NO: 3561419 - RNA, 18 nt, Human
aagcuuauccauaaaaaa

SEQ ID NO: 3561420 - RNA, 14 nt, Human
aagcuuauuaaugc

SEQ ID NO: 3561421 - RNA, 16 nt, Human
aagcuuauuaaugcua

SEQ ID NO: 3561422 - RNA, 13 nt, Human
uggugccccagga

SEQ ID NO: 3561423 - RNA, 20 nt, Human
uggugccccaggaccagcuc

SEQ ID NO: 3561424 - RNA, 14 nt, Human
uggugcccugcuuu

SEQ ID NO: 3561425 - RNA, 19 nt, Human
uggugcccugcuuucagau

SEQ ID NO: 3561426 - RNA, 19 nt, Human
uggugcccuggaugcccag

SEQ ID NO: 3561427 - RNA, 19 nt, Human
uggugccuaguauugacaa

SEQ ID NO: 3561428 - RNA, 10 nt, Human
uggugccuga

SEQ ID NO: 3561429 - RNA, 13 nt, Human
uggugccugagag

SEQ ID NO: 3561430 - RNA, 17 nt, Human
uggugccuggccuggca

SEQ ID NO: 3561431 - RNA, 22 nt, Human
uggugccuggccuggcacacau

SEQ ID NO: 3561432 - RNA, 23 nt, Human
uggugccuggccuggcacacauc

SEQ ID NO: 3561433 - RNA, 14 nt, Human
uggugccuucauuu

SEQ ID NO: 3561434 - RNA, 13 nt, Human
uggugccuuuccu

SEQ ID NO: 3561435 - RNA, 19 nt, Human
uggugccuuuccuguucag

SEQ ID NO: 3561436 - RNA, 22 nt, Human
uggugccuuuccuguucagcau

SEQ ID NO: 3561437 - RNA, 16 nt, Human
uggugcgaucuggguu

SEQ ID NO: 3561438 - RNA, 14 nt, Human
uggugcggcuggcc

SEQ ID NO: 3561439 - RNA, 16 nt, Human
uggugcggcuggccau

SEQ ID NO: 3561440 - RNA, 16 nt, Human
uggugcuacgccugca

SEQ ID NO: 3561441 - RNA, 23 nt, Human
uggugcuauaggcuggagaagcu

SEQ ID NO: 3561442 - RNA, 17 nt, Human
uggugcucaguuguaga

SEQ ID NO: 3561443 - RNA, 14 nt, Human
uggugcucauuuca

SEQ ID NO: 3561444 - RNA, 13 nt, Human
uggugcugaccuc

SEQ ID NO: 3561445 - RNA, 15 nt, Human
uggugcugagaagcu

SEQ ID NO: 3561446 - RNA, 23 nt, Human
uggugcugaguagaugcgcagcc

SEQ ID NO: 3561447 - RNA, 18 nt, Human
uggugcuggauauuuuca

SEQ ID NO: 3561448 - RNA, 13 nt, Human
uggugcugggacu

SEQ ID NO: 3561449 - RNA, 14 nt, Human
uggugcugggacug

SEQ ID NO: 3561450 - RNA, 16 nt, Human
uggugcugggacugag

SEQ ID NO: 3561451 - RNA, 19 nt, Human
uggugcugggacugagcca

SEQ ID NO: 3561452 - RNA, 13 nt, Human
uggugcugggaga

SEQ ID NO: 3561453 - RNA, 17 nt, Human
uggugcuguggccaggg

SEQ ID NO: 3561454 - RNA, 16 nt, Human
uggugcuuaaguucca

SEQ ID NO: 3561455 - RNA, 19 nt, Human
ugguggaagaggggacagg

SEQ ID NO: 3561456 - RNA, 17 nt, Human
ugguggacaguccuggg

SEQ ID NO: 3561457 - RNA, 21 nt, Human
ugguggagaggcccggccucu

SEQ ID NO: 3561458 - RNA, 21 nt, Human
ugguggaugauccccacgcca

SEQ ID NO: 3561459 - RNA, 15 nt, Human
ugguggauguaaaua

SEQ ID NO: 3561460 - RNA, 19 nt, Human
ugguggcaacauucauugc

SEQ ID NO: 3561461 - RNA, 17 nt, Human
ugguggcacugagcccc

SEQ ID NO: 3561462 - RNA, 15 nt, Human
ugguggcagagugga

SEQ ID NO: 3561463 - RNA, 19 nt, Human
ugguggcagauuuuacaaa

SEQ ID NO: 3561464 - RNA, 13 nt, Human
ugguggcagcugc

SEQ ID NO: 3561465 - RNA, 12 nt, Human
ugguggcagugg

SEQ ID NO: 3561466 - RNA, 18 nt, Human
ugguggcagugggagcug

SEQ ID NO: 3561467 - RNA, 19 nt, Human
ugguggcccucuccccugc

SEQ ID NO: 3561468 - RNA, 10 nt, Human
ugguggccuc

SEQ ID NO: 3561469 - RNA, 21 nt, Human
ugguggccucugccccgucuc

SEQ ID NO: 3561470 - RNA, 15 nt, Human
ugguggccugguccc

SEQ ID NO: 3561471 - RNA, 13 nt, Human
ugguggcuuugca

SEQ ID NO: 3561472 - RNA, 12 nt, Human
uggugggagggg

SEQ ID NO: 3561473 - RNA, 17 nt, Human
uggugggcauucucucu

SEQ ID NO: 3561474 - RNA, 18 nt, Human
uggugggcuucagggcag

SEQ ID NO: 3561475 - RNA, 20 nt, Human
ugguggggaggggcgcuggc

SEQ ID NO: 3561476 - RNA, 18 nt, Human
uggugggggccucggugu

SEQ ID NO: 3561477 - RNA, 17 nt, Human
ugguggggucuccucag

SEQ ID NO: 3561478 - RNA, 17 nt, Human
ugguggguccaugggca

SEQ ID NO: 3561479 - RNA, 18 nt, Human
ugguggguccaugggcag

SEQ ID NO: 3561480 - RNA, 21 nt, Human
ugguggguucaggggacucag

SEQ ID NO: 3561481 - RNA, 17 nt, Human
uggugguaacccuggug

SEQ ID NO: 3561482 - RNA, 14 nt, Human
uggugguagagaag

SEQ ID NO: 3561483 - RNA, 16 nt, Human
uggugguauuuucaau

SEQ ID NO: 3561484 - RNA, 15 nt, Human
ugguggucccugggu

SEQ ID NO: 3561485 - RNA, 15 nt, Human
ugguggucuguuggc

SEQ ID NO: 3561486 - RNA, 14 nt, Human
uggugguugcuguu

SEQ ID NO: 3561487 - RNA, 17 nt, Human
uggugguuucagaaaug

SEQ ID NO: 3561488 - RNA, 19 nt, Human
uggugguuuucuguucuuu

SEQ ID NO: 3561489 - RNA, 23 nt, Human
ugguguaaccugagauggcccuc

SEQ ID NO: 3561490 - RNA, 15 nt, Human
ugguguaauaagaca

SEQ ID NO: 3561491 - RNA, 15 nt, Human
ugguguagaacacua

SEQ ID NO: 3561492 - RNA, 17 nt, Human
ugguguagaacacuaau

SEQ ID NO: 3561493 - RNA, 15 nt, Human
ugguguagcuacaga

SEQ ID NO: 3561494 - RNA, 18 nt, Human
ugguguagcuacagagaa

SEQ ID NO: 3561495 - RNA, 22 nt, Human
ugguguagcuacagagaaacca

SEQ ID NO: 3561496 - RNA, 21 nt, Human
uggugucaccccagagccaca

SEQ ID NO: 3561497 - RNA, 15 nt, Human
uggugucacuguccc

SEQ ID NO: 3561498 - RNA, 18 nt, Human
uggugucagacccuggag

SEQ ID NO: 3561499 - RNA, 19 nt, Human
uggugucagacccuggagg

SEQ ID NO: 3561500 - RNA, 17 nt, Human
uggugucauagaauagc

SEQ ID NO: 3561501 - RNA, 17 nt, Human
ugguguccaccuggccc

SEQ ID NO: 3561502 - RNA, 21 nt, Human
ugguguccagacagagcccug

SEQ ID NO: 3561503 - RNA, 20 nt, Human
ugguguccugaccacccucc

SEQ ID NO: 3561504 - RNA, 21 nt, Human
ugguguccugaccacccuccc

SEQ ID NO: 3561505 - RNA, 21 nt, Human
uggugucgcgccuucuccccc

SEQ ID NO: 3561506 - RNA, 18 nt, Human
uggugucgggcaugacac

SEQ ID NO: 3561507 - RNA, 19 nt, Human
uggugucgggcaugacacg

SEQ ID NO: 3561508 - RNA, 11 nt, Human
uggugucucca

SEQ ID NO: 3561509 - RNA, 13 nt, Human
uggugucugccug

SEQ ID NO: 3561510 - RNA, 19 nt, Human
uggugucuggauucccagg

SEQ ID NO: 3561511 - RNA, 22 nt, Human
uggugugaacuaaacuuucaca

SEQ ID NO: 3561512 - RNA, 16 nt, Human
ugguguggcaaagccu

SEQ ID NO: 3561513 - RNA, 15 nt, Human
ugguguggccugugg

SEQ ID NO: 3561514 - RNA, 16 nt, Human
ugguguggguguccug

SEQ ID NO: 3561515 - RNA, 23 nt, Human
ugguguggguguccugccugucu

SEQ ID NO: 3561516 - RNA, 17 nt, Human
uggugugguacagagaa

SEQ ID NO: 3561517 - RNA, 18 nt, Human
uggugugguacagagaag

SEQ ID NO: 3561518 - RNA, 20 nt, Human
uggugugguacagagaagcc

SEQ ID NO: 3561519 - RNA, 21 nt, Human
uggugugguacagagaagcca

SEQ ID NO: 3561520 - RNA, 19 nt, Human
uggugugucccccucuguc

SEQ ID NO: 3561521 - RNA, 16 nt, Human
ugguguguuggacaga

SEQ ID NO: 3561522 - RNA, 22 nt, Human
ugguguuaaaacacuucugucc

SEQ ID NO: 3561523 - RNA, 14 nt, Human
ugguguuaacagaa

SEQ ID NO: 3561524 - RNA, 18 nt, Human
ugguguuacugcaguuga

SEQ ID NO: 3561525 - RNA, 19 nt, Human
ugguguuagggugcagcca

SEQ ID NO: 3561526 - RNA, 21 nt, Human
ugguguucaaaaaacuuguaa

SEQ ID NO: 3561527 - RNA, 20 nt, Human
ugguguugccaguuguccuc

SEQ ID NO: 3561528 - RNA, 17 nt, Human
ugguguuuccuggcacu

SEQ ID NO: 3561529 - RNA, 21 nt, Human
ugguguuuuaaagagaaugua

SEQ ID NO: 3561530 - RNA, 19 nt, Human
ugguguuuuggauuuggag

SEQ ID NO: 3561531 - RNA, 13 nt, Human
ugguuaagagucc

SEQ ID NO: 3561532 - RNA, 14 nt, Human
ugguuaagagucca

SEQ ID NO: 3561533 - RNA, 17 nt, Human
ugguuaagaguccaaga

SEQ ID NO: 3561534 - RNA, 13 nt, Human
ugguuaaugccau

SEQ ID NO: 3561535 - RNA, 14 nt, Human
ugguuacuucuucu

SEQ ID NO: 3561536 - RNA, 17 nt, Human
uguacaguuaucuaagu

SEQ ID NO: 3561537 - RNA, 18 nt, Human
uguacaguuaucuaaguu

SEQ ID NO: 3561538 - RNA, 17 nt, Human
uguacaguuauuuaugc

SEQ ID NO: 3561539 - RNA, 15 nt, Human
uguacaguuugcugu

SEQ ID NO: 3561540 - RNA, 13 nt, Human
uguacaguuuguu

SEQ ID NO: 3561541 - RNA, 16 nt, Human
uguacaguuuguuuac

SEQ ID NO: 3561542 - RNA, 17 nt, Human
uguacaguuuguuuaca

SEQ ID NO: 3561543 - RNA, 19 nt, Human
uguacauaaacaaugaugc

SEQ ID NO: 3561544 - RNA, 14 nt, Human
uguacauaacucug

SEQ ID NO: 3561545 - RNA, 23 nt, Human
uguacauaacucuguaaaaacac

SEQ ID NO: 3561546 - RNA, 20 nt, Human
uguacauaaugcgugcauac

SEQ ID NO: 3561547 - RNA, 23 nt, Human
uguacauaaugcuuaauuucuaa

SEQ ID NO: 3561548 - RNA, 21 nt, Human
uguacauacccuggccgcccc

SEQ ID NO: 3561549 - RNA, 21 nt, Human
uguacauacgauuuaagguau

SEQ ID NO: 3561550 - RNA, 20 nt, Human
uguacauacuuuuuggguuu

SEQ ID NO: 3561551 - RNA, 14 nt, Human
uguacauagauuua

SEQ ID NO: 3561552 - RNA, 21 nt, Human
uguacauagugcuaacaugaa

SEQ ID NO: 3561553 - RNA, 16 nt, Human
uguacauaguguaaug

SEQ ID NO: 3561554 - RNA, 13 nt, Human
uguacauauguaa

SEQ ID NO: 3561555 - RNA, 16 nt, Human
uguacauauguaaaau

SEQ ID NO: 3561556 - RNA, 19 nt, Human
uguacauauguaaaauaaa

SEQ ID NO: 3561557 - RNA, 15 nt, Human
uguacauaugugcug

SEQ ID NO: 3561558 - RNA, 17 nt, Human
uguacaucccauguaac

SEQ ID NO: 3561559 - RNA, 15 nt, Human
uguacaucuggcuua

SEQ ID NO: 3561560 - RNA, 17 nt, Human
uguacaucuggcuuauu

SEQ ID NO: 3561561 - RNA, 18 nt, Human
uguacaugaaaacacauu

SEQ ID NO: 3561562 - RNA, 23 nt, Human
uguacaugggacuaugcuuuucu

SEQ ID NO: 3561563 - RNA, 14 nt, Human
uguacauguauuaa

SEQ ID NO: 3561564 - RNA, 21 nt, Human
uguacauuuaugauuuaauaa

SEQ ID NO: 3561565 - RNA, 20 nt, Human
uguacauuucacaggcuaau

SEQ ID NO: 3561566 - RNA, 18 nt, Human
uguacauuuccaaauuca

SEQ ID NO: 3561567 - RNA, 21 nt, Human
uguacauuuccaaauucacaa

SEQ ID NO: 3561568 - RNA, 12 nt, Human
uguacauuucua

SEQ ID NO: 3561569 - RNA, 15 nt, Human
uguacauuucuaagu

SEQ ID NO: 3561570 - RNA, 19 nt, Human
uguacauuucuaagucaaa

SEQ ID NO: 3561571 - RNA, 16 nt, Human
uguacauuucuauaaa

SEQ ID NO: 3561572 - RNA, 13 nt, Human
uguacauuucuga

SEQ ID NO: 3561573 - RNA, 16 nt, Human
uguacauuuuguugua

SEQ ID NO: 3561574 - RNA, 17 nt, Human
uguacauuuuguuguaa

SEQ ID NO: 3561575 - RNA, 17 nt, Human
uguaccaaaauuuuaaa

SEQ ID NO: 3561576 - RNA, 14 nt, Human
uguaccaagugaaa

SEQ ID NO: 3561577 - RNA, 17 nt, Human
uguaccacuuuugcaaa

SEQ ID NO: 3561578 - RNA, 17 nt, Human
uguaccagcccagaugu

SEQ ID NO: 3561579 - RNA, 20 nt, Human
uguaccagugaauuuuugca

SEQ ID NO: 3561580 - RNA, 21 nt, Human
uguaccagugaauuuuugcaa

SEQ ID NO: 3561581 - RNA, 22 nt, Human
uguaccagugaauuuuugcaau

SEQ ID NO: 3561582 - RNA, 11 nt, Human
uguaccaguua

SEQ ID NO: 3561583 - RNA, 12 nt, Human
uguaccaguuaa

SEQ ID NO: 3561584 - RNA, 14 nt, Human
uguaccaguuaauu

SEQ ID NO: 3561585 - RNA, 13 nt, Human
uguaccauuaaaa

SEQ ID NO: 3561586 - RNA, 23 nt, Human
uguaccauuaaaauaugcacuaa

SEQ ID NO: 3561587 - RNA, 16 nt, Human
uguacccaccgggcca

SEQ ID NO: 3561588 - RNA, 16 nt, Human
uguaccccccaacccc

SEQ ID NO: 3561589 - RNA, 12 nt, Human
uguacccuuaag

SEQ ID NO: 3561590 - RNA, 22 nt, Human
uguacccuuaagucacccuagc

SEQ ID NO: 3561591 - RNA, 21 nt, Human
uguaccgcgucuacccuggga

SEQ ID NO: 3561592 - RNA, 22 nt, Human
uguaccgcgucuacccugggau

SEQ ID NO: 3561593 - RNA, 19 nt, Human
uguaccuccucucaguguu

SEQ ID NO: 3561594 - RNA, 14 nt, Human
uguaccucugccuc

SEQ ID NO: 3561595 - RNA, 17 nt, Human
uguaccucuggcugacu

SEQ ID NO: 3561596 - RNA, 23 nt, Human
uguaccucuugagccuugaacuu

SEQ ID NO: 3561597 - RNA, 18 nt, Human
uguaccuggugaccccuu

SEQ ID NO: 3561598 - RNA, 17 nt, Human
uguaccuguuccuuaga

SEQ ID NO: 3561599 - RNA, 22 nt, Human
uguaccuuuuaacaccugaugu

SEQ ID NO: 3561600 - RNA, 23 nt, Human
uguaccuuuuaacaccugaugug

SEQ ID NO: 3561601 - RNA, 22 nt, Human
uguacgaagaguauuuuugaca

SEQ ID NO: 3561602 - RNA, 23 nt, Human
uguacgacacggguggggaaagg

SEQ ID NO: 3561603 - RNA, 16 nt, Human
uguacgucugacaggc

SEQ ID NO: 3561604 - RNA, 15 nt, Human
uguacuaaagccaaa

SEQ ID NO: 3561605 - RNA, 21 nt, Human
uguacuaauuaacauauaaua

SEQ ID NO: 3561606 - RNA, 19 nt, Human
uguacuaguacuguguacu

SEQ ID NO: 3561607 - RNA, 20 nt, Human
uguacuauaacauagaauug

SEQ ID NO: 3561608 - RNA, 18 nt, Human
uguacuaucuuaucucag

SEQ ID NO: 3561609 - RNA, 14 nt, Human
uguacuauuuaacu

SEQ ID NO: 3561610 - RNA, 12 nt, Human
uguacucccagg

SEQ ID NO: 3561611 - RNA, 19 nt, Human
uguacucuggggugcugcc

SEQ ID NO: 3561612 - RNA, 14 nt, Human
uguacucuuccgaa

SEQ ID NO: 3561613 - RNA, 14 nt, Human
uguacugaaguaaa

SEQ ID NO: 3561614 - RNA, 14 nt, Human
uguacugaauuuuu

SEQ ID NO: 3561615 - RNA, 15 nt, Human
uguacugacuugagg

SEQ ID NO: 3561616 - RNA, 20 nt, Human
uguacugagccuuguaauuc

SEQ ID NO: 3561617 - RNA, 17 nt, Human
uguacugauuucaguaa

SEQ ID NO: 3561618 - RNA, 20 nt, Human
uguacugcucaggcugcagc

SEQ ID NO: 3561619 - RNA, 12 nt, Human
uguacuggagag

SEQ ID NO: 3561620 - RNA, 13 nt, Human
uguacuggggguu

SEQ ID NO: 3561621 - RNA, 18 nt, Human
uguacuguaaagagaccu

SEQ ID NO: 3561622 - RNA, 17 nt, Human
uguacuuccugaguggc

SEQ ID NO: 3561623 - RNA, 21 nt, Human
uguacuucgucuucuaauuuc

SEQ ID NO: 3561624 - RNA, 16 nt, Human
uguacuucuugaauau

SEQ ID NO: 3561625 - RNA, 19 nt, Human
uguacuugcucuugaugcc

SEQ ID NO: 3561626 - RNA, 23 nt, Human
uguacuugcucuugaugccuggc

SEQ ID NO: 3561627 - RNA, 15 nt, Human
uguacuugucaaaga

SEQ ID NO: 3561628 - RNA, 14 nt, Human
uguacuuguuugca

SEQ ID NO: 3561629 - RNA, 19 nt, Human
uguacuuuaucaugaaugc

SEQ ID NO: 3561630 - RNA, 13 nt, Human
uguacuuucuguu

SEQ ID NO: 3561631 - RNA, 15 nt, Human
uguacuuucuguuaa

SEQ ID NO: 3561632 - RNA, 19 nt, Human
uguacuuugauucacaugu

SEQ ID NO: 3561633 - RNA, 11 nt, Human
uguacuuugug

SEQ ID NO: 3561634 - RNA, 16 nt, Human
uguacuuuuaaggcag

SEQ ID NO: 3561635 - RNA, 15 nt, Human
uguacuuuuuaguaa

SEQ ID NO: 3561636 - RNA, 15 nt, Human
uguacuuuuuggcau

SEQ ID NO: 3561637 - RNA, 16 nt, Human
uguacuuuuuggcaua

SEQ ID NO: 3561638 - RNA, 18 nt, Human
uguagaaaagggaacuga

SEQ ID NO: 3561639 - RNA, 20 nt, Human
uguagaaaagggaacugaac

SEQ ID NO: 3561640 - RNA, 21 nt, Human
uguagaaaugaugauguggaa

SEQ ID NO: 3561641 - RNA, 17 nt, Human
uguagaacucacucugg

SEQ ID NO: 3561642 - RNA, 21 nt, Human
uguagaacucacucugggcug

SEQ ID NO: 3561643 - RNA, 13 nt, Human
uguagaagcauuc

SEQ ID NO: 3561644 - RNA, 15 nt, Human
uguagaagcauuccu

SEQ ID NO: 3561645 - RNA, 13 nt, Human
uguagaaggcaca

SEQ ID NO: 3561646 - RNA, 21 nt, Human
uguagaagucacauuccugaa

SEQ ID NO: 3561647 - RNA, 15 nt, Human
uguagaauauucaga

SEQ ID NO: 3561648 - RNA, 16 nt, Human
uguagacuauauacau

SEQ ID NO: 3561649 - RNA, 17 nt, Human
uguagacuauauacaug

SEQ ID NO: 3561650 - RNA, 20 nt, Human
uguagacuauauacaugugu

SEQ ID NO: 3561651 - RNA, 23 nt, Human
uguagacuauauacaugugugua

SEQ ID NO: 3561652 - RNA, 14 nt, Human
uguagacuguggcu

SEQ ID NO: 3561653 - RNA, 17 nt, Human
uguagagaaaacaugca

SEQ ID NO: 3561654 - RNA, 19 nt, Human
uguagagaaaacaugcaga

SEQ ID NO: 3561655 - RNA, 16 nt, Human
uguagagccagggucu

SEQ ID NO: 3561656 - RNA, 13 nt, Human
uguagagugggag

SEQ ID NO: 3561657 - RNA, 15 nt, Human
uguagaguuaagaag

SEQ ID NO: 3561658 - RNA, 16 nt, Human
uguagaguuaagaagc

SEQ ID NO: 3561659 - RNA, 21 nt, Human
uguagaguuaagaagcuguug

SEQ ID NO: 3561660 - RNA, 18 nt, Human
uguagauacaaucagcug

SEQ ID NO: 3561661 - RNA, 20 nt, Human
uguagauacaaucagcugcu

SEQ ID NO: 3561662 - RNA, 21 nt, Human
uguagauacaaucagcugcuu

SEQ ID NO: 3561663 - RNA, 19 nt, Human
uguagauauugugaaguac

SEQ ID NO: 3561664 - RNA, 22 nt, Human
uguagauauugugaaguacaua

SEQ ID NO: 3561665 - RNA, 15 nt, Human
uguagauauuuggcu

SEQ ID NO: 3561666 - RNA, 17 nt, Human
uguagauauuuggcuua

SEQ ID NO: 3561667 - RNA, 20 nt, Human
uguagaucaacucauguuaa

SEQ ID NO: 3561668 - RNA, 11 nt, Human
uguagaugaaa

SEQ ID NO: 3561669 - RNA, 13 nt, Human
uguagaugaaaaa

SEQ ID NO: 3561670 - RNA, 23 nt, Human
uguagaugaaaaagcauguacag

SEQ ID NO: 3561671 - RNA, 15 nt, Human
uguagaugauguauu

SEQ ID NO: 3561672 - RNA, 16 nt, Human
uguagauggaaaaacu

SEQ ID NO: 3561673 - RNA, 14 nt, Human
uguagauguaugca

SEQ ID NO: 3561674 - RNA, 18 nt, Human
uguagauguaugcacaca

SEQ ID NO: 3561675 - RNA, 15 nt, Human
uguagauucugugga

SEQ ID NO: 3561676 - RNA, 21 nt, Human
uguccugugagguuucccaau

SEQ ID NO: 3561677 - RNA, 15 nt, Human
uguccuguugauuaa

SEQ ID NO: 3561678 - RNA, 14 nt, Human
uguccuuagccugg

SEQ ID NO: 3561679 - RNA, 17 nt, Human
uguccuuagccuggacc

SEQ ID NO: 3561680 - RNA, 16 nt, Human
uguccuucccugcauu

SEQ ID NO: 3561681 - RNA, 16 nt, Human
uguccuugaaugccau

SEQ ID NO: 3561682 - RNA, 17 nt, Human
uguccuugaaugccaua

SEQ ID NO: 3561683 - RNA, 13 nt, Human
uguccuugcaccu

SEQ ID NO: 3561684 - RNA, 15 nt, Human
uguccuugcaccugc

SEQ ID NO: 3561685 - RNA, 18 nt, Human
uguccuuggaaguuucau

SEQ ID NO: 3561686 - RNA, 16 nt, Human
uguccuuuaaaaaaga

SEQ ID NO: 3561687 - RNA, 18 nt, Human
uguccuuuaaaaaagaaa

SEQ ID NO: 3561688 - RNA, 19 nt, Human
uguccuuuaccaaagauga

SEQ ID NO: 3561689 - RNA, 21 nt, Human
uguccuuuaccaaagaugaau

SEQ ID NO: 3561690 - RNA, 13 nt, Human
uguccuuucccuc

SEQ ID NO: 3561691 - RNA, 18 nt, Human
uguccuuucccuccacuc

SEQ ID NO: 3561692 - RNA, 13 nt, Human
uguccuuucccuu

SEQ ID NO: 3561693 - RNA, 23 nt, Human
uguccuuucccuucaguacccuc

SEQ ID NO: 3561694 - RNA, 20 nt, Human
ugucgaaaagagucuuccaa

SEQ ID NO: 3561695 - RNA, 13 nt, Human
ugucgagacacuu

SEQ ID NO: 3561696 - RNA, 15 nt, Human
ugucgagacacuugc

SEQ ID NO: 3561697 - RNA, 19 nt, Human
ugucgauauuuccaucauu

SEQ ID NO: 3561698 - RNA, 22 nt, Human
ugucgauguaggcauucuggag

SEQ ID NO: 3561699 - RNA, 22 nt, Human
ugucgauuaaaaucacucucag

SEQ ID NO: 3561700 - RNA, 14 nt, Human
ugucgcccagucug

SEQ ID NO: 3561701 - RNA, 17 nt, Human
ugucgcccagugcccug

SEQ ID NO: 3561702 - RNA, 14 nt, Human
ugucgcgccuucuc

SEQ ID NO: 3561703 - RNA, 14 nt, Human
ugucgcgcucagca

SEQ ID NO: 3561704 - RNA, 22 nt, Human
ugucgcucaugugugcaacagg

SEQ ID NO: 3561705 - RNA, 17 nt, Human
ugucgcucugcuggccu

SEQ ID NO: 3561706 - RNA, 19 nt, Human
ugucgcucugcuggccugg

SEQ ID NO: 3561707 - RNA, 14 nt, Human
ugucggaggaaaga

SEQ ID NO: 3561708 - RNA, 17 nt, Human
ugucggaggaaagacaa

SEQ ID NO: 3561709 - RNA, 20 nt, Human
ugucggccccaccagugccu

SEQ ID NO: 3561710 - RNA, 23 nt, Human
ugucggccccaccagugccucuc

SEQ ID NO: 3561711 - RNA, 21 nt, Human
ugucggccucuaaccccaggc

SEQ ID NO: 3561712 - RNA, 22 nt, Human
ugucggccucuaaccccaggcc

SEQ ID NO: 3561713 - RNA, 19 nt, Human
ugucggccugguguucugu

SEQ ID NO: 3561714 - RNA, 12 nt, Human
ugucggcuccag

SEQ ID NO: 3561715 - RNA, 17 nt, Human
ugucggcuccagucccc

SEQ ID NO: 3561716 - RNA, 19 nt, Human
ugucggcuccaguccccag

SEQ ID NO: 3561717 - RNA, 12 nt, Human
ugucggcugcuu

SEQ ID NO: 3561718 - RNA, 23 nt, Human
ugucgguuuuuuuuaaauaaaag

SEQ ID NO: 3561719 - RNA, 21 nt, Human
ugucguuaaaaaguuguuugu

SEQ ID NO: 3561720 - RNA, 23 nt, Human
ugucguuaaaaaguuguuuguuu

SEQ ID NO: 3561721 - RNA, 18 nt, Human
ugucuaaauuugaauguu

SEQ ID NO: 3561722 - RNA, 21 nt, Human
ugucuaacuuuugugaagaac

SEQ ID NO: 3561723 - RNA, 16 nt, Human
ugucuaagaaacauug

SEQ ID NO: 3561724 - RNA, 13 nt, Human
ugucuaagauucu

SEQ ID NO: 3561725 - RNA, 17 nt, Human
ugucuaagauucuagau

SEQ ID NO: 3561726 - RNA, 13 nt, Human
ugucuaauuaaaa

SEQ ID NO: 3561727 - RNA, 18 nt, Human
ugucuaauugcaucucaa

SEQ ID NO: 3561728 - RNA, 19 nt, Human
ugucuaauugcaucucaaa

SEQ ID NO: 3561729 - RNA, 13 nt, Human
ugucuacaaauau

SEQ ID NO: 3561730 - RNA, 18 nt, Human
ugucuacaccauuaugug

SEQ ID NO: 3561731 - RNA, 15 nt, Human
ugucuagcacuuccu

SEQ ID NO: 3561732 - RNA, 21 nt, Human
ugucuagcacuuccuugccag

SEQ ID NO: 3561733 - RNA, 17 nt, Human
ugucuaggcaggaccug

SEQ ID NO: 3561734 - RNA, 18 nt, Human
ugucuaggucaguaccca

SEQ ID NO: 3561735 - RNA, 21 nt, Human
ugucuaggucaguacccaccu

SEQ ID NO: 3561736 - RNA, 13 nt, Human
ugucuauaaagca

SEQ ID NO: 3561737 - RNA, 18 nt, Human
ugucuauaguugucagua

SEQ ID NO: 3561738 - RNA, 20 nt, Human
ugucuauggauuugccuucu

SEQ ID NO: 3561739 - RNA, 14 nt, Human
ugucuaugggacuc

SEQ ID NO: 3561740 - RNA, 15 nt, Human
ugucuaugggacuca

SEQ ID NO: 3561741 - RNA, 12 nt, Human
ugucuauugucc

SEQ ID NO: 3561742 - RNA, 14 nt, Human
ugucuauuucugcu

SEQ ID NO: 3561743 - RNA, 12 nt, Human
ugucuauuuuaa

SEQ ID NO: 3561744 - RNA, 18 nt, Human
ugucucaagagggcacug

SEQ ID NO: 3561745 - RNA, 20 nt, Human
ugucucaagagggcacuggu

SEQ ID NO: 3561746 - RNA, 21 nt, Human
ugucucaagagggcacuggug

SEQ ID NO: 3561747 - RNA, 19 nt, Human
ugucucaagcucuuccuua

SEQ ID NO: 3561748 - RNA, 14 nt, Human
ugucucacacuggc

SEQ ID NO: 3561749 - RNA, 14 nt, Human
ugucucacauggga

SEQ ID NO: 3561750 - RNA, 16 nt, Human
ugucucaccuggacuu

SEQ ID NO: 3561751 - RNA, 17 nt, Human
ugucucacugaaacauu

SEQ ID NO: 3561752 - RNA, 20 nt, Human
ugucucagacuuuuguacau

SEQ ID NO: 3561753 - RNA, 13 nt, Human
ugucucagccucc

SEQ ID NO: 3561754 - RNA, 15 nt, Human
ugucucagccuccca

SEQ ID NO: 3561755 - RNA, 16 nt, Human
ugucucagccuccuga

SEQ ID NO: 3561756 - RNA, 17 nt, Human
ugucucaggcugccuga

SEQ ID NO: 3561757 - RNA, 18 nt, Human
ugucucaggcugccugag

SEQ ID NO: 3561758 - RNA, 16 nt, Human
ugucucaggucccugc

SEQ ID NO: 3561759 - RNA, 17 nt, Human
ugucucaggucccugca

SEQ ID NO: 3561760 - RNA, 15 nt, Human
ugucucaguuggaaa

SEQ ID NO: 3561761 - RNA, 16 nt, Human
ugucucauccaucauc

SEQ ID NO: 3561762 - RNA, 16 nt, Human
ugucucauccccaggg

SEQ ID NO: 3561763 - RNA, 11 nt, Human
ugucuccaacc

SEQ ID NO: 3561764 - RNA, 17 nt, Human
ugucuccaaccccccag

SEQ ID NO: 3561765 - RNA, 20 nt, Human
ugucuccaaccccccagcac

SEQ ID NO: 3561766 - RNA, 21 nt, Human
ugucuccaaccccccagcacu

SEQ ID NO: 3561767 - RNA, 22 nt, Human
ugucuccaaccccccagcacug

SEQ ID NO: 3561768 - RNA, 19 nt, Human
ugucuccagacccccaccc

SEQ ID NO: 3561769 - RNA, 12 nt, Human
ugucuccagcuu

SEQ ID NO: 3561770 - RNA, 15 nt, Human
ugucuccagcuuccc

SEQ ID NO: 3561771 - RNA, 14 nt, Human
ugucuccccucugc

SEQ ID NO: 3561772 - RNA, 15 nt, Human
ugucucccuggcccu

SEQ ID NO: 3561773 - RNA, 16 nt, Human
ugucucccuggcccuc

SEQ ID NO: 3561774 - RNA, 13 nt, Human
ugucuccuaagca

SEQ ID NO: 3561775 - RNA, 16 nt, Human
ugucuccuaagcaccu

SEQ ID NO: 3561776 - RNA, 16 nt, Human
ugucuccuaccucugc

SEQ ID NO: 3561777 - RNA, 17 nt, Human
ugucuccuacuccugac

SEQ ID NO: 3561778 - RNA, 15 nt, Human
ugucuccuacugagg

SEQ ID NO: 3561779 - RNA, 12 nt, Human
ugucuccuaucc

SEQ ID NO: 3561780 - RNA, 21 nt, Human
ugucuccuggcgguuccucgu

SEQ ID NO: 3561781 - RNA, 17 nt, Human
ugucuccuuaacacuga

SEQ ID NO: 3561782 - RNA, 18 nt, Human
ugucuccuuaacacugag

SEQ ID NO: 3561783 - RNA, 17 nt, Human
ugucuccuuaagcugca

SEQ ID NO: 3561784 - RNA, 19 nt, Human
ugucucggaaccugugagc

SEQ ID NO: 3561785 - RNA, 18 nt, Human
ugucucguuugugauucu

SEQ ID NO: 3561786 - RNA, 16 nt, Human
ugucucuaacuuauuu

SEQ ID NO: 3561787 - RNA, 18 nt, Human
ugucucucagggccaggc

SEQ ID NO: 3561788 - RNA, 12 nt, Human
ugucucuccuuu

SEQ ID NO: 3561789 - RNA, 16 nt, Human
ugucucuccuuuucuu

SEQ ID NO: 3561790 - RNA, 22 nt, Human
ugucucugcucgcccuccuuuc

SEQ ID NO: 3561791 - RNA, 23 nt, Human
ugucucugggcuuggggcuuccu

SEQ ID NO: 3561792 - RNA, 20 nt, Human
ugucucuucaucuaauauga

SEQ ID NO: 3561793 - RNA, 13 nt, Human
ugucucuucugag

SEQ ID NO: 3561794 - RNA, 12 nt, Human
ugucucuucugg

SEQ ID NO: 3561795 - RNA, 13 nt, Human
ugucucuuucaug

SEQ ID NO: 3561796 - RNA, 22 nt, Human
ugucugaaaaauuccuuugugu

SEQ ID NO: 3561797 - RNA, 13 nt, Human
ugucugaacuugc

SEQ ID NO: 3561798 - RNA, 16 nt, Human
ugucugagaugcuggu

SEQ ID NO: 3561799 - RNA, 15 nt, Human
ugucugaguuuggua

SEQ ID NO: 3561800 - RNA, 15 nt, Human
ugucugauuggcuug

SEQ ID NO: 3561801 - RNA, 16 nt, Human
ugucugcacccagggg

SEQ ID NO: 3561802 - RNA, 12 nt, Human
ugucugcagccc

SEQ ID NO: 3561803 - RNA, 13 nt, Human
ugucugcagcccu

SEQ ID NO: 3561804 - RNA, 12 nt, Human
ugucugcagccu

SEQ ID NO: 3561805 - RNA, 16 nt, Human
ugugauguauucuagc

SEQ ID NO: 3561806 - RNA, 15 nt, Human
ugugaugugaagcca

SEQ ID NO: 3561807 - RNA, 19 nt, Human
ugugaugugacauuuguca

SEQ ID NO: 3561808 - RNA, 18 nt, Human
ugugauguucuaaggcuc

SEQ ID NO: 3561809 - RNA, 22 nt, Human
ugugauuagacagaacaccuau

SEQ ID NO: 3561810 - RNA, 17 nt, Human
ugugauuauuucacuuu

SEQ ID NO: 3561811 - RNA, 14 nt, Human
ugugauucaaucug

SEQ ID NO: 3561812 - RNA, 16 nt, Human
ugugauucaaucugua

SEQ ID NO: 3561813 - RNA, 19 nt, Human
ugugauuccuuugaagagg

SEQ ID NO: 3561814 - RNA, 16 nt, Human
ugugauucuaaugucu

SEQ ID NO: 3561815 - RNA, 20 nt, Human
ugugauucuuccagauguga

SEQ ID NO: 3561816 - RNA, 17 nt, Human
ugugauugggaauaaau

SEQ ID NO: 3561817 - RNA, 17 nt, Human
ugugauuuaauaguguu

SEQ ID NO: 3561818 - RNA, 18 nt, Human
ugugauuuagaacuguau

SEQ ID NO: 3561819 - RNA, 23 nt, Human
ugugauuuagaacuguaugucag

SEQ ID NO: 3561820 - RNA, 20 nt, Human
ugugauuucccguggcccca

SEQ ID NO: 3561821 - RNA, 23 nt, Human
ugugauuuccuacuaaccuguuc

SEQ ID NO: 3561822 - RNA, 21 nt, Human
ugugauuucuuuaaaagaaug

SEQ ID NO: 3561823 - RNA, 22 nt, Human
ugugauuugacuguuuuuaccc

SEQ ID NO: 3561824 - RNA, 20 nt, Human
ugugauuuuugguauuugaa

SEQ ID NO: 3561825 - RNA, 11 nt, Human
ugugauuuuuu

SEQ ID NO: 3561826 - RNA, 14 nt, Human
ugugcaaaaauuuu

SEQ ID NO: 3561827 - RNA, 17 nt, Human
ugugcaaaaauuuuugg

SEQ ID NO: 3561828 - RNA, 19 nt, Human
ugugcaaaaccuuuuacug

SEQ ID NO: 3561829 - RNA, 15 nt, Human
ugugcaacagacaag

SEQ ID NO: 3561830 - RNA, 17 nt, Human
ugugcaaguaugugagu

SEQ ID NO: 3561831 - RNA, 16 nt, Human
ugugcaaguguaugca

SEQ ID NO: 3561832 - RNA, 12 nt, Human
ugugcaagugug

SEQ ID NO: 3561833 - RNA, 17 nt, Human
ugugcaauaauuuacau

SEQ ID NO: 3561834 - RNA, 13 nt, Human
ugugcaauagaag

SEQ ID NO: 3561835 - RNA, 18 nt, Human
ugugcaauguaaauauuu

SEQ ID NO: 3561836 - RNA, 16 nt, Human
ugugcaauguguauaa

SEQ ID NO: 3561837 - RNA, 22 nt, Human
ugugcaauguguauaaacaaga

SEQ ID NO: 3561838 - RNA, 17 nt, Human
ugugcacaaaguggcau

SEQ ID NO: 3561839 - RNA, 15 nt, Human
ugugcacaauucugu

SEQ ID NO: 3561840 - RNA, 20 nt, Human
ugugcacacacacacacaug

SEQ ID NO: 3561841 - RNA, 19 nt, Human
ugugcacacacaccacaca

SEQ ID NO: 3561842 - RNA, 13 nt, Human
ugugcacaucucu

SEQ ID NO: 3561843 - RNA, 14 nt, Human
ugugcacaucucug

SEQ ID NO: 3561844 - RNA, 20 nt, Human
ugugcacaucugugucuugu

SEQ ID NO: 3561845 - RNA, 21 nt, Human
ugugcacaucugugucuuguu

SEQ ID NO: 3561846 - RNA, 22 nt, Human
ugugcacaugcacgugugugca

SEQ ID NO: 3561847 - RNA, 18 nt, Human
ugugcacaugugugcgug

SEQ ID NO: 3561848 - RNA, 21 nt, Human
ugugcaccaccacacccggcu

SEQ ID NO: 3561849 - RNA, 21 nt, Human
ugugcacgagugggaaggacu

SEQ ID NO: 3561850 - RNA, 20 nt, Human
ugugcacguaaaguacuugu

SEQ ID NO: 3561851 - RNA, 17 nt, Human
ugugcacuaaggggccc

SEQ ID NO: 3561852 - RNA, 23 nt, Human
ugugcacuaaggggcccggccag

SEQ ID NO: 3561853 - RNA, 21 nt, Human
ugugcacugucacuuugcucu

SEQ ID NO: 3561854 - RNA, 17 nt, Human
ugugcacuuauuuauga

SEQ ID NO: 3561855 - RNA, 22 nt, Human
ugugcagccccgccuccaggcc

SEQ ID NO: 3561856 - RNA, 15 nt, Human
ugugcagcgcagcug

SEQ ID NO: 3561857 - RNA, 12 nt, Human
ugugcagcuuuu

SEQ ID NO: 3561858 - RNA, 17 nt, Human
ugugcaggagcggcaga

SEQ ID NO: 3561859 - RNA, 15 nt, Human
ugugcagggagggca

SEQ ID NO: 3561860 - RNA, 17 nt, Human
ugugcagggagggcagu

SEQ ID NO: 3561861 - RNA, 17 nt, Human
ugugcagguuuguuaca

SEQ ID NO: 3561862 - RNA, 20 nt, Human
ugugcaguccugggaugugg

SEQ ID NO: 3561863 - RNA, 13 nt, Human
ugugcaguucuag

SEQ ID NO: 3561864 - RNA, 15 nt, Human
ugugcaugggagcaa

SEQ ID NO: 3561865 - RNA, 19 nt, Human
ugugcaugggugaagggag

SEQ ID NO: 3561866 - RNA, 15 nt, Human
ugugcaugguggcac

SEQ ID NO: 3561867 - RNA, 17 nt, Human
ugugcauguguguauaa

SEQ ID NO: 3561868 - RNA, 14 nt, Human
ugugcauuaucuag

SEQ ID NO: 3561869 - RNA, 16 nt, Human
ugugcauuaucuagau

SEQ ID NO: 3561870 - RNA, 19 nt, Human
ugugcauuaucuagauacu

SEQ ID NO: 3561871 - RNA, 16 nt, Human
ugugcauuauuuucca

SEQ ID NO: 3561872 - RNA, 23 nt, Human
ugugcauucuuuuaaaagacaag

SEQ ID NO: 3561873 - RNA, 14 nt, Human
ugugcauugcugug

SEQ ID NO: 3561874 - RNA, 22 nt, Human
ugugcauuuuugugaaaugaaa

SEQ ID NO: 3561875 - RNA, 19 nt, Human
ugugccaaccuauuuugaa

SEQ ID NO: 3561876 - RNA, 16 nt, Human
ugugccaauauguauu

SEQ ID NO: 3561877 - RNA, 18 nt, Human
ugugccaauauguauugu

SEQ ID NO: 3561878 - RNA, 22 nt, Human
ugugccacagaguguagccagg

SEQ ID NO: 3561879 - RNA, 16 nt, Human
ugugccacaggcuuag

SEQ ID NO: 3561880 - RNA, 16 nt, Human
ugugccacccaccagg

SEQ ID NO: 3561881 - RNA, 12 nt, Human
ugugccacccug

SEQ ID NO: 3561882 - RNA, 15 nt, Human
ugugccacccugggc

SEQ ID NO: 3561883 - RNA, 17 nt, Human
ugugccacccugggcuc

SEQ ID NO: 3561884 - RNA, 23 nt, Human
ugugccacucaccgaagccacuu

SEQ ID NO: 3561885 - RNA, 12 nt, Human
ugugccagagcc

SEQ ID NO: 3561886 - RNA, 20 nt, Human
ugugccagaggaauccuggc

SEQ ID NO: 3561887 - RNA, 22 nt, Human
ugugccagaggaauccuggcag

SEQ ID NO: 3561888 - RNA, 20 nt, Human
ugugccagguuuuuggucug

SEQ ID NO: 3561889 - RNA, 21 nt, Human
ugugccauagaguuuaacaca

SEQ ID NO: 3561890 - RNA, 18 nt, Human
ugugccauagucacaugg

SEQ ID NO: 3561891 - RNA, 12 nt, Human
ugugccaucugu

SEQ ID NO: 3561892 - RNA, 16 nt, Human
ugugccaugucaaaca

SEQ ID NO: 3561893 - RNA, 21 nt, Human
ugugccaugucaaacaaauag

SEQ ID NO: 3561894 - RNA, 12 nt, Human
ugugcccagcuc

SEQ ID NO: 3561895 - RNA, 14 nt, Human
ugugcccaugggca

SEQ ID NO: 3561896 - RNA, 15 nt, Human
ugugccccaugccug

SEQ ID NO: 3561897 - RNA, 21 nt, Human
ugugcccccauguaagcaccc

SEQ ID NO: 3561898 - RNA, 15 nt, Human
ugugccccccauccu

SEQ ID NO: 3561899 - RNA, 16 nt, Human
ugugccccccauccug

SEQ ID NO: 3561900 - RNA, 18 nt, Human
ugugccccccauccuggc

SEQ ID NO: 3561901 - RNA, 19 nt, Human
ugugccccccauccuggcc

SEQ ID NO: 3561902 - RNA, 20 nt, Human
ugugccccccauccuggccc

SEQ ID NO: 3561903 - RNA, 23 nt, Human
ugugccccccauccuggcccauc

SEQ ID NO: 3561904 - RNA, 23 nt, Human
ugugccccuugacaacuggcagg

SEQ ID NO: 3561905 - RNA, 21 nt, Human
ugugcccuaaaguguauuuuu

SEQ ID NO: 3561906 - RNA, 12 nt, Human
ugugcccuccug

SEQ ID NO: 3561907 - RNA, 15 nt, Human
ugugcccucugggcu

SEQ ID NO: 3561908 - RNA, 11 nt, Human
ugugcccuggu

SEQ ID NO: 3561909 - RNA, 17 nt, Human
ugugccgacacuguucu

SEQ ID NO: 3561910 - RNA, 16 nt, Human
ugugccuaacaccagc

SEQ ID NO: 3561911 - RNA, 20 nt, Human
ugugccuauagucccagcua

SEQ ID NO: 3561912 - RNA, 14 nt, Human
ugugccucagagac

SEQ ID NO: 3561913 - RNA, 13 nt, Human
ugugccuccuccc

SEQ ID NO: 3561914 - RNA, 14 nt, Human
ugugccuccucccu

SEQ ID NO: 3561915 - RNA, 21 nt, Human
ugugccucgcuccccacucug

SEQ ID NO: 3561916 - RNA, 21 nt, Human
ugugccucggcuuuucucagc

SEQ ID NO: 3561917 - RNA, 15 nt, Human
ugugccucuagcuga

SEQ ID NO: 3561918 - RNA, 14 nt, Human
ugugccucugccug

SEQ ID NO: 3561919 - RNA, 15 nt, Human
ugugccucugccugu

SEQ ID NO: 3561920 - RNA, 13 nt, Human
ugugccucuggga

SEQ ID NO: 3561921 - RNA, 15 nt, Human
ugugccucugggacu

SEQ ID NO: 3561922 - RNA, 15 nt, Human
ugugccucuuugucu

SEQ ID NO: 3561923 - RNA, 14 nt, Human
ugugccugcuucag

SEQ ID NO: 3561924 - RNA, 13 nt, Human
ugugccuggcuca

SEQ ID NO: 3561925 - RNA, 22 nt, Human
ugugccugggggaguuuuccuc

SEQ ID NO: 3561926 - RNA, 17 nt, Human
ugugccuuggugugcug

SEQ ID NO: 3561927 - RNA, 19 nt, Human
ugugccuugucacgccaga

SEQ ID NO: 3561928 - RNA, 13 nt, Human
ugugccuuguuuu

SEQ ID NO: 3561929 - RNA, 18 nt, Human
ugugccuuguuuuuuguu

SEQ ID NO: 3561930 - RNA, 15 nt, Human
ugugccuuuuauagc

SEQ ID NO: 3561931 - RNA, 16 nt, Human
ugugccuuuuauagcu

SEQ ID NO: 3561932 - RNA, 19 nt, Human
ugugcgccuacaggaguga

SEQ ID NO: 3561933 - RNA, 15 nt, Human
ugugcggcugugugu

SEQ ID NO: 3561934 - RNA, 17 nt, Human
ugugcggcugugugugc

SEQ ID NO: 3561935 - RNA, 15 nt, Human
ugugcgugaaacaca

SEQ ID NO: 3561936 - RNA, 20 nt, Human
ugugcgugcuugaguguguu

SEQ ID NO: 3561937 - RNA, 16 nt, Human
ugugcguggugguccc

SEQ ID NO: 3561938 - RNA, 21 nt, Human
ugugcguguguccaugugugu

SEQ ID NO: 3561939 - RNA, 20 nt, Human
ugugcuacaggggccagaag

SEQ ID NO: 3561940 - RNA, 17 nt, Human
ugugcuacaugacgaca

SEQ ID NO: 3561941 - RNA, 23 nt, Human
ugugggagaccggccugccagga

SEQ ID NO: 3561942 - RNA, 13 nt, Human
ugugggagcagcg

SEQ ID NO: 3561943 - RNA, 12 nt, Human
ugugggagccuc

SEQ ID NO: 3561944 - RNA, 16 nt, Human
ugugggaggcuccugu

SEQ ID NO: 3561945 - RNA, 21 nt, Human
ugugggagggagcagacagga

SEQ ID NO: 3561946 - RNA, 13 nt, Human
ugugggauuaugg

SEQ ID NO: 3561947 - RNA, 16 nt, Human
ugugggauuauggguc

SEQ ID NO: 3561948 - RNA, 17 nt, Human
ugugggcacuggcccag

SEQ ID NO: 3561949 - RNA, 18 nt, Human
ugugggcacuggcccagg

SEQ ID NO: 3561950 - RNA, 21 nt, Human
ugugggcagcuuagggcccug

SEQ ID NO: 3561951 - RNA, 16 nt, Human
ugugggcaggaaguga

SEQ ID NO: 3561952 - RNA, 11 nt, Human
ugugggccugg

SEQ ID NO: 3561953 - RNA, 15 nt, Human
ugugggccugggcuc

SEQ ID NO: 3561954 - RNA, 22 nt, Human
ugugggcgugagaccugccccu

SEQ ID NO: 3561955 - RNA, 14 nt, Human
ugugggcugcacuc

SEQ ID NO: 3561956 - RNA, 20 nt, Human
ugugggcugcacucugugcc

SEQ ID NO: 3561957 - RNA, 22 nt, Human
ugugggcugcacucugugccca

SEQ ID NO: 3561958 - RNA, 13 nt, Human
ugugggcugugag

SEQ ID NO: 3561959 - RNA, 20 nt, Human
uguggggcugguagcucagg

SEQ ID NO: 3561960 - RNA, 13 nt, Human
uguggggggaggc

SEQ ID NO: 3561961 - RNA, 23 nt, Human
uguggggggaggcugacuccugg

SEQ ID NO: 3561962 - RNA, 19 nt, Human
ugugggggguaaucccugc

SEQ ID NO: 3561963 - RNA, 22 nt, Human
ugugggggguaaucccugcuuu

SEQ ID NO: 3561964 - RNA, 14 nt, Human
ugugggggguccuu

SEQ ID NO: 3561965 - RNA, 18 nt, Human
uguuaauaucacucauua

SEQ ID NO: 3561966 - RNA, 18 nt, Human
uguuaauauucuuucaau

SEQ ID NO: 3561967 - RNA, 19 nt, Human
uguuaauauugauuuauua

SEQ ID NO: 3561968 - RNA, 12 nt, Human
uguuaaucaauu

SEQ ID NO: 3561969 - RNA, 13 nt, Human
uguuaaucaauuu

SEQ ID NO: 3561970 - RNA, 14 nt, Human
uguuaauccuagcu

SEQ ID NO: 3561971 - RNA, 21 nt, Human
uguuaaucucuguuauguacu

SEQ ID NO: 3561972 - RNA, 17 nt, Human
uguuaaucuuaauguau

SEQ ID NO: 3561973 - RNA, 22 nt, Human
uguuaaucuuaauguauaucgu

SEQ ID NO: 3561974 - RNA, 15 nt, Human
uguuaaugcuuucug

SEQ ID NO: 3561975 - RNA, 19 nt, Human
uguuaauggauuucagaag

SEQ ID NO: 3561976 - RNA, 18 nt, Human
uguuaauguauuuguuca

SEQ ID NO: 3561977 - RNA, 22 nt, Human
uguuaauguauuuguucauguu

SEQ ID NO: 3561978 - RNA, 15 nt, Human
uguuaauuuaaguuu

SEQ ID NO: 3561979 - RNA, 16 nt, Human
uguuaauuuaaguuuu

SEQ ID NO: 3561980 - RNA, 15 nt, Human
uguuaauuuagaaaa

SEQ ID NO: 3561981 - RNA, 20 nt, Human
uguuaauuuguguguuuuua

SEQ ID NO: 3561982 - RNA, 13 nt, Human
uguuaauuuuuga

SEQ ID NO: 3561983 - RNA, 16 nt, Human
uguuaauuuuugauac

SEQ ID NO: 3561984 - RNA, 14 nt, Human
uguuacaaaaugua

SEQ ID NO: 3561985 - RNA, 17 nt, Human
uguuacaaaauguaacu

SEQ ID NO: 3561986 - RNA, 19 nt, Human
uguuacaaaauguaacugu

SEQ ID NO: 3561987 - RNA, 21 nt, Human
uguuacaaaauguaacuguua

SEQ ID NO: 3561988 - RNA, 15 nt, Human
uguuacaauguaacu

SEQ ID NO: 3561989 - RNA, 22 nt, Human
uguuacacaaugguuuuuaaau

SEQ ID NO: 3561990 - RNA, 17 nt, Human
uguuacaguaaugucau

SEQ ID NO: 3561991 - RNA, 15 nt, Human
uguuacauaguguag

SEQ ID NO: 3561992 - RNA, 12 nt, Human
uguuacaucaca

SEQ ID NO: 3561993 - RNA, 13 nt, Human
uguuacauuuuua

SEQ ID NO: 3561994 - RNA, 15 nt, Human
uguuaccauucacaa

SEQ ID NO: 3561995 - RNA, 16 nt, Human
uguuaccauuggaaau

SEQ ID NO: 3561996 - RNA, 17 nt, Human
uguuaccauuggaaauu

SEQ ID NO: 3561997 - RNA, 23 nt, Human
uguuaccauuggaaauuucacgu

SEQ ID NO: 3561998 - RNA, 21 nt, Human
uguuacccaguaacucaucug

SEQ ID NO: 3561999 - RNA, 17 nt, Human
uguuaccgccugucucu

SEQ ID NO: 3562000 - RNA, 14 nt, Human
uguuaccucugaau

SEQ ID NO: 3562001 - RNA, 13 nt, Human
uguuaccugugug

SEQ ID NO: 3562002 - RNA, 17 nt, Human
uguuaccugugugcuug

SEQ ID NO: 3562003 - RNA, 17 nt, Human
uguuacuaacuaaacuc

SEQ ID NO: 3562004 - RNA, 14 nt, Human
uguuacuaaguuuu

SEQ ID NO: 3562005 - RNA, 13 nt, Human
uguuacucugguu

SEQ ID NO: 3562006 - RNA, 17 nt, Human
uguuacucugguucuuu

SEQ ID NO: 3562007 - RNA, 14 nt, Human
uguuacugaucaug

SEQ ID NO: 3562008 - RNA, 17 nt, Human
uguuacugguguccagc

SEQ ID NO: 3562009 - RNA, 9 nt, Human
uguuacugu

SEQ ID NO: 3562010 - RNA, 12 nt, Human
uguuacuguaau

SEQ ID NO: 3562011 - RNA, 15 nt, Human
uguuacugucuucag

SEQ ID NO: 3562012 - RNA, 16 nt, Human
uguuacugucuucagu

SEQ ID NO: 3562013 - RNA, 11 nt, Human
uguuacuguuc

SEQ ID NO: 3562014 - RNA, 12 nt, Human
uguuacuguucu

SEQ ID NO: 3562015 - RNA, 16 nt, Human
uguuacuguucuugcu

SEQ ID NO: 3562016 - RNA, 17 nt, Human
uguuacuguucuugcug

SEQ ID NO: 3562017 - RNA, 18 nt, Human
uguuacuguucuugcugc

SEQ ID NO: 3562018 - RNA, 21 nt, Human
uguuacuguucuugcugcuag

SEQ ID NO: 3562019 - RNA, 22 nt, Human
uguuacuguucuugcugcuaga

SEQ ID NO: 3562020 - RNA, 23 nt, Human
uguuacuguucuugcugcuagaa

SEQ ID NO: 3562021 - RNA, 15 nt, Human
uguuacuuuauacag

SEQ ID NO: 3562022 - RNA, 14 nt, Human
uguuagaacacuau

SEQ ID NO: 3562023 - RNA, 19 nt, Human
uguuagaacacuauuuuca

SEQ ID NO: 3562024 - RNA, 23 nt, Human
uguuagaacacuauuuucagaau

SEQ ID NO: 3562025 - RNA, 13 nt, Human
uguuagaauguaa

SEQ ID NO: 3562026 - RNA, 21 nt, Human
uguuagauagaauuuccaaua

SEQ ID NO: 3562027 - RNA, 16 nt, Human
uguuagaucuaguuca

SEQ ID NO: 3562028 - RNA, 17 nt, Human
uguuagcacuguugaug

SEQ ID NO: 3562029 - RNA, 20 nt, Human
uguuagcacuguugauguau

SEQ ID NO: 3562030 - RNA, 22 nt, Human
uguuagcacuguugauguaucu

SEQ ID NO: 3562031 - RNA, 21 nt, Human
uguuagcaugcuggugagcca

SEQ ID NO: 3562032 - RNA, 21 nt, Human
uguuaggccaaagacaaauag

SEQ ID NO: 3562033 - RNA, 16 nt, Human
uguuaggccuggcaca

SEQ ID NO: 3562034 - RNA, 21 nt, Human
uguuaggccuggcacaguguc

SEQ ID NO: 3562035 - RNA, 16 nt, Human
uguuaggcugggccca

SEQ ID NO: 3562036 - RNA, 18 nt, Human
uguuaggcugggcccaga

SEQ ID NO: 3562037 - RNA, 19 nt, Human
uguuaguaugaggcauuug

SEQ ID NO: 3562038 - RNA, 17 nt, Human
uguuaguuauagauguc

SEQ ID NO: 3562039 - RNA, 14 nt, Human
uguuaguuucuugg

SEQ ID NO: 3562040 - RNA, 14 nt, Human
uguuaguuuuccuu

SEQ ID NO: 3562041 - RNA, 14 nt, Human
uguuauaacuacuc

SEQ ID NO: 3562042 - RNA, 15 nt, Human
uguuauaacucugca

SEQ ID NO: 3562043 - RNA, 17 nt, Human
uguuauaacucugcacu

SEQ ID NO: 3562044 - RNA, 15 nt, Human
uguuauaaucuuuca

SEQ ID NO: 3562045 - RNA, 19 nt, Human
uguuauagaacuucaugga

SEQ ID NO: 3562046 - RNA, 20 nt, Human
uguuauagaacuucauggau

SEQ ID NO: 3562047 - RNA, 13 nt, Human
uguuauauaaaug

SEQ ID NO: 3562048 - RNA, 14 nt, Human
uguuauauaaaugg

SEQ ID NO: 3562049 - RNA, 15 nt, Human
uguuauauaaucauu

SEQ ID NO: 3562050 - RNA, 16 nt, Human
uguuauauaaucauua

SEQ ID NO: 3562051 - RNA, 15 nt, Human
uguuauaucauaugu

SEQ ID NO: 3562052 - RNA, 22 nt, Human
uguuauauccugacaagauuau

SEQ ID NO: 3562053 - RNA, 12 nt, Human
uguuauaugaac

SEQ ID NO: 3562054 - RNA, 14 nt, Human
uguuauaugaacau

SEQ ID NO: 3562055 - RNA, 23 nt, Human
uguuauauuuaaugcauuaaacc

SEQ ID NO: 3562056 - RNA, 13 nt, Human
uguuauauuucau

SEQ ID NO: 3562057 - RNA, 16 nt, Human
uguuauauuuuucuua

SEQ ID NO: 3562058 - RNA, 14 nt, Human
uguuaucagcuuuc

SEQ ID NO: 3562059 - RNA, 13 nt, Human
uguuaucauuuuu

SEQ ID NO: 3562060 - RNA, 22 nt, Human
uguuaucuuauacuguacaaua

SEQ ID NO: 3562061 - RNA, 14 nt, Human
uguuaucuuggugu

SEQ ID NO: 3562062 - RNA, 13 nt, Human
uguuaugaaauaa

SEQ ID NO: 3562063 - RNA, 16 nt, Human
uguuaugaaauaaaga

SEQ ID NO: 3562064 - RNA, 21 nt, Human
uguuaugaaauaaagaaauug

SEQ ID NO: 3562065 - RNA, 16 nt, Human
uguuaugacuauguaa

SEQ ID NO: 3562066 - RNA, 17 nt, Human
uguuaugacuccagaau

SEQ ID NO: 3562067 - RNA, 15 nt, Human
uguuaugauaaaaaa

SEQ ID NO: 3562068 - RNA, 16 nt, Human
uguuaugaugugcuua

SEQ ID NO: 3562069 - RNA, 17 nt, Human
uguuaugguagaaaaau

SEQ ID NO: 3562070 - RNA, 22 nt, Human
uguuauguaaaaggccaaaccu

SEQ ID NO: 3562071 - RNA, 18 nt, Human
uguucagcguuuugcaag

SEQ ID NO: 3562072 - RNA, 17 nt, Human
uguucagcuuuuauucc

SEQ ID NO: 3562073 - RNA, 21 nt, Human
uguucaggaaaagguugaaua

SEQ ID NO: 3562074 - RNA, 23 nt, Human
uguucaggaaaagguugaauaau

SEQ ID NO: 3562075 - RNA, 18 nt, Human
uguucaggaaguccuuau

SEQ ID NO: 3562076 - RNA, 22 nt, Human
uguucaguaacagggccuugcu

SEQ ID NO: 3562077 - RNA, 15 nt, Human
uguucaguguaauuu

SEQ ID NO: 3562078 - RNA, 17 nt, Human
uguucaguguaauuucu

SEQ ID NO: 3562079 - RNA, 22 nt, Human
uguucaguguaauuucuuugcc

SEQ ID NO: 3562080 - RNA, 16 nt, Human
uguucaguuacagaaa

SEQ ID NO: 3562081 - RNA, 17 nt, Human
uguucaguuacagaaag

SEQ ID NO: 3562082 - RNA, 23 nt, Human
uguucauacauauuuuuguagca

SEQ ID NO: 3562083 - RNA, 18 nt, Human
uguucauagacccucuca

SEQ ID NO: 3562084 - RNA, 17 nt, Human
uguucauauuaagaaug

SEQ ID NO: 3562085 - RNA, 18 nt, Human
uguucaucauccagaugu

SEQ ID NO: 3562086 - RNA, 11 nt, Human
uguucauccca

SEQ ID NO: 3562087 - RNA, 21 nt, Human
uguucaucuguaacucuaaaa

SEQ ID NO: 3562088 - RNA, 20 nt, Human
uguucaugaaagauucaaug

SEQ ID NO: 3562089 - RNA, 13 nt, Human
uguucauguuugg

SEQ ID NO: 3562090 - RNA, 17 nt, Human
uguucauguuuggugca

SEQ ID NO: 3562091 - RNA, 22 nt, Human
uguucauuaaagcaugaauggu

SEQ ID NO: 3562092 - RNA, 15 nt, Human
uguucauuccuccag

SEQ ID NO: 3562093 - RNA, 16 nt, Human
uguucauuccuccagg

SEQ ID NO: 3562094 - RNA, 12 nt, Human
uguucauuguaa

SEQ ID NO: 3562095 - RNA, 13 nt, Human
uguucauuguaau

SEQ ID NO: 3562096 - RNA, 14 nt, Human
uguucauuguaaug

SEQ ID NO: 3562097 - RNA, 22 nt, Human
uguucauuguaauguuacugau

SEQ ID NO: 3562098 - RNA, 23 nt, Human
uguucauuguaauguuacugauc

SEQ ID NO: 3562099 - RNA, 17 nt, Human
uguuccaaauucaguuu

SEQ ID NO: 3562100 - RNA, 19 nt, Human
uguuccaaauucaguuuca

SEQ ID NO: 3562101 - RNA, 14 nt, Human
uguuccaagacauu

SEQ ID NO: 3562102 - RNA, 19 nt, Human
uguuccaagacauugucaa

SEQ ID NO: 3562103 - RNA, 15 nt, Human
uguuccaauaaacag

SEQ ID NO: 3562104 - RNA, 21 nt, Human
uguuccaaugccacauacuug

SEQ ID NO: 3562105 - RNA, 14 nt, Human
uguuccagcucuuu

SEQ ID NO: 3562106 - RNA, 10 nt, Human
uguuccaguu

SEQ ID NO: 3562107 - RNA, 15 nt, Human
uguuccauuaaacga

SEQ ID NO: 3562108 - RNA, 16 nt, Human
uguucccaagagcauc

SEQ ID NO: 3562109 - RNA, 20 nt, Human
uguucccaccaggcugcuca

SEQ ID NO: 3562110 - RNA, 15 nt, Human
uguuccccacuggag

SEQ ID NO: 3562111 - RNA, 16 nt, Human
uguuccccacuggagc

SEQ ID NO: 3562112 - RNA, 21 nt, Human
uguuccccucacuggaugaaa

SEQ ID NO: 3562113 - RNA, 15 nt, Human
uguuccccucucccu

SEQ ID NO: 3562114 - RNA, 19 nt, Human
uguuccccucuugucuccc

SEQ ID NO: 3562115 - RNA, 22 nt, Human
uguuccccucuugucuccccug

SEQ ID NO: 3562116 - RNA, 18 nt, Human
uguucccucugcuccugg

SEQ ID NO: 3562117 - RNA, 19 nt, Human
uguucccucugcuccugga

SEQ ID NO: 3562118 - RNA, 22 nt, Human
uguuccgaaaccaaagaagaaa

SEQ ID NO: 3562119 - RNA, 18 nt, Human
uguuccuaaguucuuaga

SEQ ID NO: 3562120 - RNA, 20 nt, Human
uguuccuaaguucuuagaua

SEQ ID NO: 3562121 - RNA, 22 nt, Human
uguuccucaaagcuuggauuaa

SEQ ID NO: 3562122 - RNA, 21 nt, Human
uguuccuggcaauaguguguu

SEQ ID NO: 3562123 - RNA, 18 nt, Human
uguuccuucacauccugu

SEQ ID NO: 3562124 - RNA, 17 nt, Human
uguuccuuggcagugga

SEQ ID NO: 3562125 - RNA, 20 nt, Human
uguucgacagugaauauuca

SEQ ID NO: 3562126 - RNA, 20 nt, Human
uguucgcauggucacacacu

SEQ ID NO: 3562127 - RNA, 20 nt, Human
uguucggaagggguuccuca

SEQ ID NO: 3562128 - RNA, 18 nt, Human
uguucuaaagcucugaca

SEQ ID NO: 3562129 - RNA, 16 nt, Human
uguucuaacauguaau

SEQ ID NO: 3562130 - RNA, 10 nt, Human
uguucuaagg

SEQ ID NO: 3562131 - RNA, 12 nt, Human
uguucuaaggcu

SEQ ID NO: 3562132 - RNA, 18 nt, Human
uguucuaaggcucugaga

SEQ ID NO: 3562133 - RNA, 17 nt, Human
uguucuaagucuuucca

SEQ ID NO: 3562134 - RNA, 12 nt, Human
uguucuaaguuu

SEQ ID NO: 3562135 - RNA, 18 nt, Human
uguucuaaguuucuaaga

SEQ ID NO: 3562136 - RNA, 22 nt, Human
uguucuaauuaauaaauuauuu

SEQ ID NO: 3562137 - RNA, 18 nt, Human
uguucuacccguuccaaa

SEQ ID NO: 3562138 - RNA, 19 nt, Human
uguucuacccguuccaaaa

SEQ ID NO: 3562139 - RNA, 18 nt, Human
uguucuacucauauauau

SEQ ID NO: 3562140 - RNA, 15 nt, Human
uguucuacuuuguuc

SEQ ID NO: 3562141 - RNA, 18 nt, Human
uguucuagcauggcugcc

SEQ ID NO: 3562142 - RNA, 16 nt, Human
uguucuaguuuucagu

SEQ ID NO: 3562143 - RNA, 14 nt, Human
uguucuaugaacaa

SEQ ID NO: 3562144 - RNA, 18 nt, Human
uguucuaugguuaugaaa

SEQ ID NO: 3562145 - RNA, 22 nt, Human
uguucucacacuggucugcugu

SEQ ID NO: 3562146 - RNA, 12 nt, Human
uguucucagauu

SEQ ID NO: 3562147 - RNA, 14 nt, Human
uguucucagcuccc

SEQ ID NO: 3562148 - RNA, 22 nt, Human
uguucuccuagacugacccuga

SEQ ID NO: 3562149 - RNA, 13 nt, Human
uguucuccugcug

SEQ ID NO: 3562150 - RNA, 23 nt, Human
uguucuccugcugcucccucaga

SEQ ID NO: 3562151 - RNA, 20 nt, Human
uguucucuaucauuuaauaa

SEQ ID NO: 3562152 - RNA, 14 nt, Human
uguucucugggaga

SEQ ID NO: 3562153 - RNA, 16 nt, Human
uguucucugggagaaa

SEQ ID NO: 3562154 - RNA, 14 nt, Human
uguucucuucuuca

SEQ ID NO: 3562155 - RNA, 15 nt, Human
uguucucuucuucau

SEQ ID NO: 3562156 - RNA, 20 nt, Human
uguucucuucuucauucuau

SEQ ID NO: 3562157 - RNA, 15 nt, Human
uguucugaacugugg

SEQ ID NO: 3562158 - RNA, 15 nt, Human
uguucugacauuaac

SEQ ID NO: 3562159 - RNA, 16 nt, Human
uguucugacauuaaca

SEQ ID NO: 3562160 - RNA, 17 nt, Human
uguucugacauuaacag

SEQ ID NO: 3562161 - RNA, 15 nt, Human
uguucugauaaugaa

SEQ ID NO: 3562162 - RNA, 15 nt, Human
uguucugauauuaau

SEQ ID NO: 3562163 - RNA, 19 nt, Human
uguucugauuagaaaugac

SEQ ID NO: 3562164 - RNA, 14 nt, Human
uguucugcacugaa

SEQ ID NO: 3562165 - RNA, 14 nt, Human
uguucugcccccag

SEQ ID NO: 3562166 - RNA, 14 nt, Human
uguucugcuguucu

SEQ ID NO: 3562167 - RNA, 15 nt, Human
uguucugcuuuccuc

SEQ ID NO: 3562168 - RNA, 13 nt, Human
uguuucuguuauu

SEQ ID NO: 3562169 - RNA, 23 nt, Human
uguuucuuaauuuggaaacuaau

SEQ ID NO: 3562170 - RNA, 13 nt, Human
uguuucuuccugc

SEQ ID NO: 3562171 - RNA, 18 nt, Human
uguuucuuccuguuaaug

SEQ ID NO: 3562172 - RNA, 14 nt, Human
uguuucuugccuca

SEQ ID NO: 3562173 - RNA, 13 nt, Human
uguuucuugcuug

SEQ ID NO: 3562174 - RNA, 14 nt, Human
uguuucuuguuuau

SEQ ID NO: 3562175 - RNA, 15 nt, Human
uguuucuuuaaaauu

SEQ ID NO: 3562176 - RNA, 16 nt, Human
uguuucuuuaguuuuu

SEQ ID NO: 3562177 - RNA, 18 nt, Human
uguuucuuugaauuuuca

SEQ ID NO: 3562178 - RNA, 14 nt, Human
uguuucuuuguguu

SEQ ID NO: 3562179 - RNA, 13 nt, Human
uguuucuuuugua

SEQ ID NO: 3562180 - RNA, 15 nt, Human
uguuucuuuuguuug

SEQ ID NO: 3562181 - RNA, 21 nt, Human
uguuucuuuuguuugguaaau

SEQ ID NO: 3562182 - RNA, 19 nt, Human
uguuugaaaacuucagaag

SEQ ID NO: 3562183 - RNA, 16 nt, Human
uguuugaaaauauuau

SEQ ID NO: 3562184 - RNA, 19 nt, Human
uguuugaaaauauuaucuu

SEQ ID NO: 3562185 - RNA, 13 nt, Human
uguuugaaaguag

SEQ ID NO: 3562186 - RNA, 21 nt, Human
uguuugaaaugaggucuguuu

SEQ ID NO: 3562187 - RNA, 15 nt, Human
uguuugaauauggac

SEQ ID NO: 3562188 - RNA, 18 nt, Human
uguuugagauucucaaag

SEQ ID NO: 3562189 - RNA, 22 nt, Human
uguuugagcaucgcuuaggaga

SEQ ID NO: 3562190 - RNA, 23 nt, Human
uguuugagcucagacccccacuc

SEQ ID NO: 3562191 - RNA, 22 nt, Human
uguuugaggauauauuuucacu

SEQ ID NO: 3562192 - RNA, 13 nt, Human
uguuugauagauu

SEQ ID NO: 3562193 - RNA, 21 nt, Human
uguuugauauaccaaauuaaa

SEQ ID NO: 3562194 - RNA, 16 nt, Human
uguuugcaauaucgau

SEQ ID NO: 3562195 - RNA, 18 nt, Human
uguuugcaauaucgauca

SEQ ID NO: 3562196 - RNA, 20 nt, Human
uguuugcaccuuucuaguug

SEQ ID NO: 3562197 - RNA, 23 nt, Human
uguuugcaccuuucuaguugaaa

SEQ ID NO: 3562198 - RNA, 22 nt, Human
uguuugcauaaacauucuuuua

SEQ ID NO: 3562199 - RNA, 14 nt, Human
uguuugcauauaag

SEQ ID NO: 3562200 - RNA, 15 nt, Human
uguuugcaucugaaa

SEQ ID NO: 3562201 - RNA, 16 nt, Human
uguuugccaggacaug

SEQ ID NO: 3562202 - RNA, 19 nt, Human
uguuugccaggacaugcaa

SEQ ID NO: 3562203 - RNA, 14 nt, Human
uguuugccucugcc

SEQ ID NO: 3562204 - RNA, 16 nt, Human
uguuugccucugccuc

SEQ ID NO: 3562205 - RNA, 20 nt, Human
uguuugccuucuacuuuuaa

SEQ ID NO: 3562206 - RNA, 12 nt, Human
uguuugcucccc

SEQ ID NO: 3562207 - RNA, 23 nt, Human
uguuugcuccccuuccccuuccu

SEQ ID NO: 3562208 - RNA, 23 nt, Human
uguuugcucucccgguucuucca

SEQ ID NO: 3562209 - RNA, 13 nt, Human
uguuugcugcuau

SEQ ID NO: 3562210 - RNA, 18 nt, Human
uguuugcuuauuguucca

SEQ ID NO: 3562211 - RNA, 21 nt, Human
uguuugcuuauuguuccaaga

SEQ ID NO: 3562212 - RNA, 21 nt, Human
uguuugcuucaugugucccag

SEQ ID NO: 3562213 - RNA, 12 nt, Human
uguuugcuuucu

SEQ ID NO: 3562214 - RNA, 20 nt, Human
uguuuggaauguuagaauga

SEQ ID NO: 3562215 - RNA, 19 nt, Human
uguuuggagacguuuauaa

SEQ ID NO: 3562216 - RNA, 21 nt, Human
uguuuggauguaauuuagggu

SEQ ID NO: 3562217 - RNA, 22 nt, Human
uguuuggcguagcagaguuaaa

SEQ ID NO: 3562218 - RNA, 20 nt, Human
uguuugggaagagcuuagaa

SEQ ID NO: 3562219 - RNA, 15 nt, Human
uguuuggggcaggag

SEQ ID NO: 3562220 - RNA, 20 nt, Human
uguuugggggacguuucuca

SEQ ID NO: 3562221 - RNA, 23 nt, Human
uguuuggguauccugcccagugu

SEQ ID NO: 3562222 - RNA, 14 nt, Human
uguuugguaaaugu

SEQ ID NO: 3562223 - RNA, 15 nt, Human
uguuugguaaauguu

SEQ ID NO: 3562224 - RNA, 19 nt, Human
uguuuggugcauagaacug

SEQ ID NO: 3562225 - RNA, 14 nt, Human
uguuugguuuacau

SEQ ID NO: 3562226 - RNA, 16 nt, Human
uguuuguaaaaaugua

SEQ ID NO: 3562227 - RNA, 18 nt, Human
uguuuguaaauaagagau

SEQ ID NO: 3562228 - RNA, 17 nt, Human
uguuuguaagugaagug

SEQ ID NO: 3562229 - RNA, 18 nt, Human
uguuuguacaagauuguc

SEQ ID NO: 3562230 - RNA, 20 nt, Human
uguuuguacaagauugucau

SEQ ID NO: 3562231 - RNA, 15 nt, Human
uguuuguauguauaa

SEQ ID NO: 3562232 - RNA, 15 nt, Human
uguuugucauuagcc

SEQ ID NO: 3562233 - RNA, 17 nt, Human
uguuugucauuagccug

SEQ ID NO: 3562234 - RNA, 15 nt, Human
uguuugucccuucua

SEQ ID NO: 3562235 - RNA, 19 nt, Human
uguuugucucuccuuuucu

SEQ ID NO: 3562236 - RNA, 17 nt, Human
uguuugucugucuucau

SEQ ID NO: 3562237 - RNA, 16 nt, Human
uguuugucuucucccc

SEQ ID NO: 3562238 - RNA, 17 nt, Human
uguuugugcaguaacuu

SEQ ID NO: 3562239 - RNA, 23 nt, Human
uguuugugcaguaacuugggagu

SEQ ID NO: 3562240 - RNA, 15 nt, Human
uguuugugcuguggu

SEQ ID NO: 3562241 - RNA, 13 nt, Human
uguuugugcuucu

SEQ ID NO: 3562242 - RNA, 14 nt, Human
uguuugugcuucua

SEQ ID NO: 3562243 - RNA, 14 nt, Human
uguuuguggccuca

SEQ ID NO: 3562244 - RNA, 14 nt, Human
uguuugugugagag

SEQ ID NO: 3562245 - RNA, 16 nt, Human
uguuugugugucaagu

SEQ ID NO: 3562246 - RNA, 15 nt, Human
uguuuguucaucugu

SEQ ID NO: 3562247 - RNA, 14 nt, Human
uguuuguucuuguu

SEQ ID NO: 3562248 - RNA, 16 nt, Human
uguuuguugucagcug

SEQ ID NO: 3562249 - RNA, 14 nt, Human
uguuuguuuaauuu

SEQ ID NO: 3562250 - RNA, 18 nt, Human
uguuuguuuauuagauga

SEQ ID NO: 3562251 - RNA, 15 nt, Human
uguuuguuucuuugu

SEQ ID NO: 3562252 - RNA, 16 nt, Human
uguuuguuugucuguu

SEQ ID NO: 3562253 - RNA, 12 nt, Human
uguuuuaaaaaa

SEQ ID NO: 3562254 - RNA, 18 nt, Human
uguuuuaaaaaggaacug

SEQ ID NO: 3562255 - RNA, 18 nt, Human
uguuuuaaaacuggaccu

SEQ ID NO: 3562256 - RNA, 18 nt, Human
uguuuuaaaaugagaaau

SEQ ID NO: 3562257 - RNA, 23 nt, Human
uguuuuaaaaugagaaaucuaaa

SEQ ID NO: 3562258 - RNA, 22 nt, Human
uguuuuaaagaauaugacuuuu

SEQ ID NO: 3562259 - RNA, 23 nt, Human
uguuuuaaauguacagacauauu

SEQ ID NO: 3562260 - RNA, 14 nt, Human
uguuuuaaauucug

SEQ ID NO: 3562261 - RNA, 15 nt, Human
uguuuuaaauucuga

SEQ ID NO: 3562262 - RNA, 22 nt, Human
uguuuuaaauucugagacaugu

SEQ ID NO: 3562263 - RNA, 22 nt, Human
uguuuuaaauuuauuucaaaaa

SEQ ID NO: 3562264 - RNA, 11 nt, Human
uguuuuaacaa

SEQ ID NO: 3562265 - RNA, 15 nt, Human
uguuuuaagaaaugu

SEQ ID NO: 3562266 - RNA, 20 nt, Human
uguuuuaagaggcagggucu

SEQ ID NO: 3562267 - RNA, 17 nt, Human
uguuuuaaggaagaaaa

SEQ ID NO: 3562268 - RNA, 16 nt, Human
uguuuuaauaacuuau

SEQ ID NO: 3562269 - RNA, 20 nt, Human
uguuuuaaucugaaauucua

SEQ ID NO: 3562270 - RNA, 14 nt, Human
uguuuuaauuccau

SEQ ID NO: 3562271 - RNA, 16 nt, Human
uguuuuaauuccauga

SEQ ID NO: 3562272 - RNA, 21 nt, Human
uguuuuacaauaguucugugg

SEQ ID NO: 3562273 - RNA, 22 nt, Human
uguuuuacaauaguucuguggg

SEQ ID NO: 3562274 - RNA, 21 nt, Human
uguuuuacuaaagaaagauua

SEQ ID NO: 3562275 - RNA, 14 nt, Human
uguuuuacugcuuu

SEQ ID NO: 3562276 - RNA, 18 nt, Human
uguuuuacugugaaacug

SEQ ID NO: 3562277 - RNA, 13 nt, Human
uguuuuauaaaau

SEQ ID NO: 3562278 - RNA, 22 nt, Human
uguuuuauaaguucacaaaaug

SEQ ID NO: 3562279 - RNA, 17 nt, Human
uguuuuauauagcaaga

SEQ ID NO: 3562280 - RNA, 21 nt, Human
uguuuuauauagcaagacauu

SEQ ID NO: 3562281 - RNA, 12 nt, Human
uguuuuaucaug

SEQ ID NO: 3562282 - RNA, 16 nt, Human
uguuuuaugagaaagc

SEQ ID NO: 3562283 - RNA, 19 nt, Human
uguuuuaugagaaagccuu

SEQ ID NO: 3562284 - RNA, 15 nt, Human
uguuuuauuccugua

SEQ ID NO: 3562285 - RNA, 21 nt, Human
uguuuuauuuaaccucuaaau

SEQ ID NO: 3562286 - RNA, 16 nt, Human
uguuuuauuucauugg

SEQ ID NO: 3562287 - RNA, 18 nt, Human
uguuuuauuucauugguu

SEQ ID NO: 3562288 - RNA, 21 nt, Human
uguuuuauuuuaauucaguug

SEQ ID NO: 3562289 - RNA, 21 nt, Human
uguuuuauuuucaaaaccagg

SEQ ID NO: 3562290 - RNA, 22 nt, Human
uguuuucaaaccaguauacaag

SEQ ID NO: 3562291 - RNA, 15 nt, Human
uguuuucaguguaca

SEQ ID NO: 3562292 - RNA, 17 nt, Human
uguuuucaguguacaug

SEQ ID NO: 3562293 - RNA, 20 nt, Human
uguuuucauguaaauaaaua

SEQ ID NO: 3562294 - RNA, 17 nt, Human
uguuuuccagcuccuca

SEQ ID NO: 3562295 - RNA, 18 nt, Human
uguuuuccauuguuugaa

SEQ ID NO: 3562296 - RNA, 22 nt, Human
uguuuucccgagcaaagucuaa

SEQ ID NO: 3562297 - RNA, 16 nt, Human
uguuuuccgugaaaac

SEQ ID NO: 3562298 - RNA, 21 nt, Human
uguuuuccucccuucugcuac

SEQ ID NO: 3562299 - RNA, 15 nt, Human
uguuuuccuuucuca

SEQ ID NO: 3562300 - RNA, 14 nt, Human
uguuuucuagugua

SEQ ID NO: 3562301 - RNA, 18 nt, Human
uguuuucuaguguaucaa

SEQ ID NO: 3562302 - RNA, 15 nt, Human
uguuuucucuugaga

SEQ ID NO: 3562303 - RNA, 12 nt, Human
uguuuucugaau

SEQ ID NO: 3562304 - RNA, 17 nt, Human
uguuuucugacuaauua

SEQ ID NO: 3562305 - RNA, 23 nt, Human
uguuuucugagcccgggcugccu

SEQ ID NO: 3562306 - RNA, 12 nt, Human
uguuuucugugu

SEQ ID NO: 3562307 - RNA, 16 nt, Human
uguuuucuuucuuuaa

SEQ ID NO: 3562308 - RNA, 22 nt, Human
uguuuugaaaucaaugcaagag

SEQ ID NO: 3562309 - RNA, 18 nt, Human
uguuuugagcuuuccaug

SEQ ID NO: 3562310 - RNA, 18 nt, Human
uguuuugauaaaguagua

SEQ ID NO: 3562311 - RNA, 15 nt, Human
uguuuugcaagugcu

SEQ ID NO: 3562312 - RNA, 18 nt, Human
uguuuugcacagccaaau

SEQ ID NO: 3562313 - RNA, 13 nt, Human
uguuuugcaugua

SEQ ID NO: 3562314 - RNA, 19 nt, Human
uguuuugccaauuugcaca

SEQ ID NO: 3562315 - RNA, 17 nt, Human
uguuuugccagcccauu

SEQ ID NO: 3562316 - RNA, 17 nt, Human
uguuuugcuuccccucc

SEQ ID NO: 3562317 - RNA, 17 nt, Human
uguuuugcuuuuucuga

SEQ ID NO: 3562318 - RNA, 20 nt, Human
uuaagaguagcaaguucuag

SEQ ID NO: 3562319 - RNA, 21 nt, Human
uuaagagugggggagagcagg

SEQ ID NO: 3562320 - RNA, 21 nt, Human
uuaagauaauaguuuacaugu

SEQ ID NO: 3562321 - RNA, 20 nt, Human
uuaagauacaaauuaauuuu

SEQ ID NO: 3562322 - RNA, 17 nt, Human
uuaagauaguguaacuu

SEQ ID NO: 3562323 - RNA, 17 nt, Human
uuaagauggauucucag

SEQ ID NO: 3562324 - RNA, 23 nt, Human
uuaagauggauucucagauauuu

SEQ ID NO: 3562325 - RNA, 12 nt, Human
uuaagaugugaa

SEQ ID NO: 3562326 - RNA, 15 nt, Human
uuaagaugugaaaau

SEQ ID NO: 3562327 - RNA, 17 nt, Human
uuaagaugugucuucaa

SEQ ID NO: 3562328 - RNA, 15 nt, Human
uuaagauuauaauug

SEQ ID NO: 3562329 - RNA, 16 nt, Human
uuaagauuauaauugu

SEQ ID NO: 3562330 - RNA, 13 nt, Human
uuaagauuuaauu

SEQ ID NO: 3562331 - RNA, 15 nt, Human
uuaagauuuuacaaa

SEQ ID NO: 3562332 - RNA, 16 nt, Human
uuaagauuuuucucaa

SEQ ID NO: 3562333 - RNA, 14 nt, Human
uuaagcacuacaua

SEQ ID NO: 3562334 - RNA, 17 nt, Human
uuaagcacuacauaaac

SEQ ID NO: 3562335 - RNA, 15 nt, Human
uuaagcagaauugga

SEQ ID NO: 3562336 - RNA, 18 nt, Human
uuaagcagaauuggaaaa

SEQ ID NO: 3562337 - RNA, 12 nt, Human
uuaagcagcucu

SEQ ID NO: 3562338 - RNA, 17 nt, Human
uuaagcagcucuugcua

SEQ ID NO: 3562339 - RNA, 20 nt, Human
uuaagcagcucuugcuaauc

SEQ ID NO: 3562340 - RNA, 13 nt, Human
uuaagcauauauu

SEQ ID NO: 3562341 - RNA, 18 nt, Human
uuaagcauauauuuuuau

SEQ ID NO: 3562342 - RNA, 15 nt, Human
uuaagcaucacaaau

SEQ ID NO: 3562343 - RNA, 18 nt, Human
uuaagcauuaccacucag

SEQ ID NO: 3562344 - RNA, 20 nt, Human
uuaagcauuacucuuguaag

SEQ ID NO: 3562345 - RNA, 20 nt, Human
uuaagcauuggguggguaaa

SEQ ID NO: 3562346 - RNA, 23 nt, Human
uuaagcauuguuugcuuauuguu

SEQ ID NO: 3562347 - RNA, 16 nt, Human
uuaagccacugccucu

SEQ ID NO: 3562348 - RNA, 16 nt, Human
uuaagccaucuuggua

SEQ ID NO: 3562349 - RNA, 15 nt, Human
uuaagccuaaagauu

SEQ ID NO: 3562350 - RNA, 16 nt, Human
uuaagccuaaagauuu

SEQ ID NO: 3562351 - RNA, 22 nt, Human
uuaagccucauauuuaaagaca

SEQ ID NO: 3562352 - RNA, 15 nt, Human
uuaagccuuuggaaa

SEQ ID NO: 3562353 - RNA, 15 nt, Human
uuaagcucugagcug

SEQ ID NO: 3562354 - RNA, 17 nt, Human
uuaagcuguuacugucu

SEQ ID NO: 3562355 - RNA, 14 nt, Human
uuaagcuguuucca

SEQ ID NO: 3562356 - RNA, 12 nt, Human
uuaagcuuauuu

SEQ ID NO: 3562357 - RNA, 14 nt, Human
uuaagcuuuuugga

SEQ ID NO: 3562358 - RNA, 22 nt, Human
uuaaggagaaucauguuucuuu

SEQ ID NO: 3562359 - RNA, 19 nt, Human
uuaaggagauguaagagcu

SEQ ID NO: 3562360 - RNA, 17 nt, Human
uuaaggaugcuuguaca

SEQ ID NO: 3562361 - RNA, 22 nt, Human
uuaaggaugcuuguacauaaug

SEQ ID NO: 3562362 - RNA, 13 nt, Human
uuaaggauuuuau

SEQ ID NO: 3562363 - RNA, 15 nt, Human
uuaaggauuuuaugc

SEQ ID NO: 3562364 - RNA, 18 nt, Human
uuaaggauuuuaugcuuu

SEQ ID NO: 3562365 - RNA, 20 nt, Human
uuaaggauuuuaugcuuuaa

SEQ ID NO: 3562366 - RNA, 22 nt, Human
uuaaggcaacugaacaaaaaaa

SEQ ID NO: 3562367 - RNA, 13 nt, Human
uuaaggcauuugu

SEQ ID NO: 3562368 - RNA, 15 nt, Human
uuaaggccugaauca

SEQ ID NO: 3562369 - RNA, 16 nt, Human
uuaagggcaugccuug

SEQ ID NO: 3562370 - RNA, 19 nt, Human
uuaagggcaugccuugugc

SEQ ID NO: 3562371 - RNA, 22 nt, Human
uuaagggccaccuacaauacau

SEQ ID NO: 3562372 - RNA, 17 nt, Human
uuaaggggaagaaugaa

SEQ ID NO: 3562373 - RNA, 18 nt, Human
uuaaggggaagaaugaaa

SEQ ID NO: 3562374 - RNA, 17 nt, Human
uuaaggucucucuuugg

SEQ ID NO: 3562375 - RNA, 19 nt, Human
uuaaggugagcauaaauca

SEQ ID NO: 3562376 - RNA, 14 nt, Human
uuaagguguagcca

SEQ ID NO: 3562377 - RNA, 16 nt, Human
uuaagguguuugaaaa

SEQ ID NO: 3562378 - RNA, 17 nt, Human
uuaagguguuugaaaau

SEQ ID NO: 3562379 - RNA, 21 nt, Human
uuaaguaauguggaagaaaau

SEQ ID NO: 3562380 - RNA, 13 nt, Human
uuaaguagauuuc

SEQ ID NO: 3562381 - RNA, 14 nt, Human
uuaaguaucuuuuu

SEQ ID NO: 3562382 - RNA, 19 nt, Human
uuaaguaucuuuuuucaaa

SEQ ID NO: 3562383 - RNA, 19 nt, Human
uuaaguauuuauauauuua

SEQ ID NO: 3562384 - RNA, 15 nt, Human
uuaagugaaauuuau

SEQ ID NO: 3562385 - RNA, 23 nt, Human
uuaagugaggaaaucaaagugcu

SEQ ID NO: 3562386 - RNA, 16 nt, Human
uuaagugaugaacauu

SEQ ID NO: 3562387 - RNA, 17 nt, Human
uuaagugcguguguaga

SEQ ID NO: 3562388 - RNA, 14 nt, Human
uuaagugcugcauu

SEQ ID NO: 3562389 - RNA, 16 nt, Human
uuaagugcugcauuua

SEQ ID NO: 3562390 - RNA, 16 nt, Human
uuaagugcuuuguaau

SEQ ID NO: 3562391 - RNA, 16 nt, Human
uuaagugguuugauca

SEQ ID NO: 3562392 - RNA, 21 nt, Human
uuaaguguuguaaauauuuau

SEQ ID NO: 3562393 - RNA, 22 nt, Human
uuaaguuacacauuuuucagau

SEQ ID NO: 3562394 - RNA, 18 nt, Human
uuaaguuagggaauggca

SEQ ID NO: 3562395 - RNA, 20 nt, Human
uuaaguuauuuuaccuguuu

SEQ ID NO: 3562396 - RNA, 13 nt, Human
uuaaguuccagca

SEQ ID NO: 3562397 - RNA, 19 nt, Human
uuaaguucucaaugugaaa

SEQ ID NO: 3562398 - RNA, 19 nt, Human
uuaaguuguuugcauguga

SEQ ID NO: 3562399 - RNA, 22 nt, Human
uuaaguuucaaacuuacuauuu

SEQ ID NO: 3562400 - RNA, 11 nt, Human
uuaaguuucuc

SEQ ID NO: 3562401 - RNA, 17 nt, Human
uuaaguuucucugcaga

SEQ ID NO: 3562402 - RNA, 13 nt, Human
uuaauaaaaagac

SEQ ID NO: 3562403 - RNA, 14 nt, Human
uuaauaaaaaggca

SEQ ID NO: 3562404 - RNA, 12 nt, Human
uuaauaaaagaa

SEQ ID NO: 3562405 - RNA, 16 nt, Human
uuaauaaaaguacaug

SEQ ID NO: 3562406 - RNA, 14 nt, Human
uuaauaaacuacuc

SEQ ID NO: 3562407 - RNA, 21 nt, Human
uuaauaaagaauuaacagaga

SEQ ID NO: 3562408 - RNA, 15 nt, Human
uuaauaaguuucacu

SEQ ID NO: 3562409 - RNA, 14 nt, Human
uuaauaauauacuu

SEQ ID NO: 3562410 - RNA, 18 nt, Human
uuaauaauguuucaaaca

SEQ ID NO: 3562411 - RNA, 19 nt, Human
uuaauaauuuagacuucaa

SEQ ID NO: 3562412 - RNA, 15 nt, Human
uuaauaccacagcuu

SEQ ID NO: 3562413 - RNA, 22 nt, Human
uuaauacucaaaugaguaacau

SEQ ID NO: 3562414 - RNA, 20 nt, Human
uuaauacucauccuuguaua

SEQ ID NO: 3562415 - RNA, 14 nt, Human
uuaauacucuauuu

SEQ ID NO: 3562416 - RNA, 14 nt, Human
uuaauacuguuauu

SEQ ID NO: 3562417 - RNA, 23 nt, Human
uuaauacuguuauucuuugcacu

SEQ ID NO: 3562418 - RNA, 23 nt, Human
uuaauagagaaggaaagcuuugg

SEQ ID NO: 3562419 - RNA, 16 nt, Human
uuaauagcaaagaauu

SEQ ID NO: 3562420 - RNA, 20 nt, Human
uuaauagcgucauaacuaga

SEQ ID NO: 3562421 - RNA, 18 nt, Human
uuaauagcuuuuauugua

SEQ ID NO: 3562422 - RNA, 20 nt, Human
uuaauagcuuuuauuguaua

SEQ ID NO: 3562423 - RNA, 22 nt, Human
uuaauagcuuuuauuguauaaa

SEQ ID NO: 3562424 - RNA, 19 nt, Human
uuaauaguaauuuguaaag

SEQ ID NO: 3562425 - RNA, 17 nt, Human
uuaauaguguuaaucaa

SEQ ID NO: 3562426 - RNA, 19 nt, Human
uuaauaguguuaaucaauu

SEQ ID NO: 3562427 - RNA, 15 nt, Human
uuaauaguuugucua

SEQ ID NO: 3562428 - RNA, 19 nt, Human
uuaauaguuugucuauuuu

SEQ ID NO: 3562429 - RNA, 22 nt, Human
uuaauauaaaguaguccuguga

SEQ ID NO: 3562430 - RNA, 14 nt, Human
uuaauauaaaugca

SEQ ID NO: 3562431 - RNA, 14 nt, Human
uuaauauaaauuca

SEQ ID NO: 3562432 - RNA, 14 nt, Human
uuaauuugauuaac

SEQ ID NO: 3562433 - RNA, 19 nt, Human
uuaauuugauuaacaaaua

SEQ ID NO: 3562434 - RNA, 21 nt, Human
uuaauuugauuaacaaauaug

SEQ ID NO: 3562435 - RNA, 11 nt, Human
uuaauuuggaa

SEQ ID NO: 3562436 - RNA, 19 nt, Human
uuaauuuggaccauuuucc

SEQ ID NO: 3562437 - RNA, 21 nt, Human
uuaauuuggaccauuuuccug

SEQ ID NO: 3562438 - RNA, 13 nt, Human
uuaauuugugugu

SEQ ID NO: 3562439 - RNA, 17 nt, Human
uuaauuuuauucaagaa

SEQ ID NO: 3562440 - RNA, 13 nt, Human
uuaauuuuccugg

SEQ ID NO: 3562441 - RNA, 20 nt, Human
uuaauuuugaagugcuguuu

SEQ ID NO: 3562442 - RNA, 23 nt, Human
uuaauuuugaagugcuguuuauu

SEQ ID NO: 3562443 - RNA, 18 nt, Human
uuaauuuugguuguauuc

SEQ ID NO: 3562444 - RNA, 23 nt, Human
uuaauuuuguaaaggugaaaaaa

SEQ ID NO: 3562445 - RNA, 17 nt, Human
uuaauuuuguauuuucc

SEQ ID NO: 3562446 - RNA, 12 nt, Human
uuaauuuugucu

SEQ ID NO: 3562447 - RNA, 17 nt, Human
uuaauuuuuaaugauga

SEQ ID NO: 3562448 - RNA, 18 nt, Human
uuaauuuuuauuucuucc

SEQ ID NO: 3562449 - RNA, 18 nt, Human
uuaauuuuuccaacuacu

SEQ ID NO: 3562450 - RNA, 18 nt, Human
uuaauuuuuugguacaaa

SEQ ID NO: 3562451 - RNA, 20 nt, Human
uuaauuuuuugguacaaaaa

SEQ ID NO: 3562452 - RNA, 18 nt, Human
uuaauuuuuuuaaccaaa

SEQ ID NO: 3562453 - RNA, 19 nt, Human
uuacaaaaacacuucguuc

SEQ ID NO: 3562454 - RNA, 15 nt, Human
uuacaaaaagacacu

SEQ ID NO: 3562455 - RNA, 18 nt, Human
uuacaaaacaaacucauu

SEQ ID NO: 3562456 - RNA, 14 nt, Human
uuacaaaagaugua

SEQ ID NO: 3562457 - RNA, 18 nt, Human
uuacaaaagauguauccu

SEQ ID NO: 3562458 - RNA, 12 nt, Human
uuacaaaaugua

SEQ ID NO: 3562459 - RNA, 13 nt, Human
uuacaaaauguaa

SEQ ID NO: 3562460 - RNA, 16 nt, Human
uuacaaaauguaacug

SEQ ID NO: 3562461 - RNA, 17 nt, Human
uuacaaaauguaacugu

SEQ ID NO: 3562462 - RNA, 18 nt, Human
uuacaaaauguaacuguu

SEQ ID NO: 3562463 - RNA, 19 nt, Human
uuacaaaauguaacuguua

SEQ ID NO: 3562464 - RNA, 13 nt, Human
uuacaaacuacag

SEQ ID NO: 3562465 - RNA, 14 nt, Human
uuacaaacugcaau

SEQ ID NO: 3562466 - RNA, 15 nt, Human
uuacaaacugcaaua

SEQ ID NO: 3562467 - RNA, 22 nt, Human
uuacaaacugcaauagagacug

SEQ ID NO: 3562468 - RNA, 23 nt, Human
uuacaaacugcaauagagacugu

SEQ ID NO: 3562469 - RNA, 15 nt, Human
uuacaaaguguguau

SEQ ID NO: 3562470 - RNA, 22 nt, Human
uuacaaaucagaagucaucuug

SEQ ID NO: 3562471 - RNA, 12 nt, Human
uuacaaaugauu

SEQ ID NO: 3562472 - RNA, 20 nt, Human
uuacaaaugauugcuuuuaa

SEQ ID NO: 3562473 - RNA, 21 nt, Human
uuacaaaugauugcuuuuaaa

SEQ ID NO: 3562474 - RNA, 18 nt, Human
uuacaaauguuaaaaugu

SEQ ID NO: 3562475 - RNA, 14 nt, Human
uuacaacacuuuaa

SEQ ID NO: 3562476 - RNA, 18 nt, Human
uuacaacagauuugugaa

SEQ ID NO: 3562477 - RNA, 21 nt, Human
uuacaacagauuugugaacuc

SEQ ID NO: 3562478 - RNA, 16 nt, Human
uuacaaccuagaagua

SEQ ID NO: 3562479 - RNA, 19 nt, Human
uuacaacggagucaaaaau

SEQ ID NO: 3562480 - RNA, 20 nt, Human
uuacaagcgugagccacugc

SEQ ID NO: 3562481 - RNA, 21 nt, Human
uuacaagcgugagccacugca

SEQ ID NO: 3562482 - RNA, 17 nt, Human
uuacaaguaacaaaaau

SEQ ID NO: 3562483 - RNA, 19 nt, Human
uuacaaguaacaaaaauaa

SEQ ID NO: 3562484 - RNA, 18 nt, Human
uuacaauauuugugugcu

SEQ ID NO: 3562485 - RNA, 22 nt, Human
uuacaauauuugugugcuaaac

SEQ ID NO: 3562486 - RNA, 12 nt, Human
uuacaaucaaag

SEQ ID NO: 3562487 - RNA, 17 nt, Human
uuacaaucauugcugaa

SEQ ID NO: 3562488 - RNA, 14 nt, Human
uuacaauguaauua

SEQ ID NO: 3562489 - RNA, 15 nt, Human
uuacaauguaauuau

SEQ ID NO: 3562490 - RNA, 16 nt, Human
uuacaauguaauuauu

SEQ ID NO: 3562491 - RNA, 14 nt, Human
uuacaauugaaaug

SEQ ID NO: 3562492 - RNA, 13 nt, Human
uuacaauuuacaa

SEQ ID NO: 3562493 - RNA, 16 nt, Human
uuacaauuuacaaagu

SEQ ID NO: 3562494 - RNA, 15 nt, Human
uuacaauuuuuuauc

SEQ ID NO: 3562495 - RNA, 17 nt, Human
uuacaauuuuuuaucau

SEQ ID NO: 3562496 - RNA, 20 nt, Human
uuacaauuuuuuaucaugca

SEQ ID NO: 3562497 - RNA, 22 nt, Human
uuacaauuuuuuuaauuuugua

SEQ ID NO: 3562498 - RNA, 16 nt, Human
uuacacaaaacaaaug

SEQ ID NO: 3562499 - RNA, 19 nt, Human
uuacacacgugcaauuugu

SEQ ID NO: 3562500 - RNA, 19 nt, Human
uuacacagaaaugcugcug

SEQ ID NO: 3562501 - RNA, 17 nt, Human
uuacacagugugaauaa

SEQ ID NO: 3562502 - RNA, 16 nt, Human
uuacacauuuguacag

SEQ ID NO: 3562503 - RNA, 15 nt, Human
uuacacauuuuucag

SEQ ID NO: 3562504 - RNA, 21 nt, Human
uuacaccagccucgucuucau

SEQ ID NO: 3562505 - RNA, 22 nt, Human
uuacacuacacacuguguacug

SEQ ID NO: 3562506 - RNA, 14 nt, Human
uuacacucuuugua

SEQ ID NO: 3562507 - RNA, 15 nt, Human
uuacacucuuuguaa

SEQ ID NO: 3562508 - RNA, 21 nt, Human
uuacacugccuguauacuuua

SEQ ID NO: 3562509 - RNA, 21 nt, Human
uuacacuggcaaugguaguuu

SEQ ID NO: 3562510 - RNA, 14 nt, Human
uuacacuguauuug

SEQ ID NO: 3562511 - RNA, 17 nt, Human
uuacacuguauuuguau

SEQ ID NO: 3562512 - RNA, 17 nt, Human
uuacacuguuagaacac

SEQ ID NO: 3562513 - RNA, 19 nt, Human
uuacacuguuagaacacua

SEQ ID NO: 3562514 - RNA, 20 nt, Human
uuacacuguuagaacacuau

SEQ ID NO: 3562515 - RNA, 20 nt, Human
uuacacuuuaugcacaaaau

SEQ ID NO: 3562516 - RNA, 13 nt, Human
uuacagaaaaaga

SEQ ID NO: 3562517 - RNA, 15 nt, Human
uuacagaaauacuau

SEQ ID NO: 3562518 - RNA, 23 nt, Human
uuacagaauugcuuguuugcuuc

SEQ ID NO: 3562519 - RNA, 19 nt, Human
uuacagacgcugcugucac

SEQ ID NO: 3562520 - RNA, 20 nt, Human
uuacagagacagaaagcaga

SEQ ID NO: 3562521 - RNA, 18 nt, Human
uuacagauaggccuucuu

SEQ ID NO: 3562522 - RNA, 23 nt, Human
uuacagauaguaucuagcaauca

SEQ ID NO: 3562523 - RNA, 18 nt, Human
uuacagauauuugucaug

SEQ ID NO: 3562524 - RNA, 21 nt, Human
uuacagauuuauuccuuuguu

SEQ ID NO: 3562525 - RNA, 19 nt, Human
uuacagcucauuaaacuuu

SEQ ID NO: 3562526 - RNA, 21 nt, Human
uuacagcucugacuuuacacu

SEQ ID NO: 3562527 - RNA, 20 nt, Human
uuacagcuggguggcacugc

SEQ ID NO: 3562528 - RNA, 15 nt, Human
uuacaggaaguacug

SEQ ID NO: 3562529 - RNA, 22 nt, Human
uuacaggaaguacuggagaaaa

SEQ ID NO: 3562530 - RNA, 17 nt, Human
uuacaggcaccgagaau

SEQ ID NO: 3562531 - RNA, 16 nt, Human
uuacaggcuccugcca

SEQ ID NO: 3562532 - RNA, 18 nt, Human
uuacaggcuccugccacc

SEQ ID NO: 3562533 - RNA, 15 nt, Human
uuacagggagccucc

SEQ ID NO: 3562534 - RNA, 21 nt, Human
uuacagggagccuccugccca

SEQ ID NO: 3562535 - RNA, 20 nt, Human
uuacagggaugagccaccgc

SEQ ID NO: 3562536 - RNA, 20 nt, Human
uuacagggcacaggccaugg

SEQ ID NO: 3562537 - RNA, 17 nt, Human
uuacagguaccaguucu

SEQ ID NO: 3562538 - RNA, 15 nt, Human
uuacaggugauuaac

SEQ ID NO: 3562539 - RNA, 20 nt, Human
uuacaggugauuaacuugga

SEQ ID NO: 3562540 - RNA, 19 nt, Human
uuacaguaggagcccagcu

SEQ ID NO: 3562541 - RNA, 18 nt, Human
uuacaguauaauuaacau

SEQ ID NO: 3562542 - RNA, 20 nt, Human
uuacaguauaauuaacaugu

SEQ ID NO: 3562543 - RNA, 17 nt, Human
uuacaguaugcuugcuc

SEQ ID NO: 3562544 - RNA, 20 nt, Human
uuacagugaaaauguaagcu

SEQ ID NO: 3562545 - RNA, 14 nt, Human
uuacagugcagugc

SEQ ID NO: 3562546 - RNA, 18 nt, Human
uuacagugccuaaaauaa

SEQ ID NO: 3562547 - RNA, 17 nt, Human
uuacaguggauugcuca

SEQ ID NO: 3562548 - RNA, 17 nt, Human
uuacaguuaaggaauau

SEQ ID NO: 3562549 - RNA, 13 nt, Human
uuacaguuacuuu

SEQ ID NO: 3562550 - RNA, 16 nt, Human
uuacaguuacuuuucc

SEQ ID NO: 3562551 - RNA, 16 nt, Human
uuacaguuauagaaag

SEQ ID NO: 3562552 - RNA, 11 nt, Human
uuacaguucug

SEQ ID NO: 3562553 - RNA, 13 nt, Human
uuacaguucugug

SEQ ID NO: 3562554 - RNA, 13 nt, Human
uuacauaacugcc

SEQ ID NO: 3562555 - RNA, 15 nt, Human
uuacauaacugccuu

SEQ ID NO: 3562556 - RNA, 17 nt, Human
uuacauaacugccuuga

SEQ ID NO: 3562557 - RNA, 21 nt, Human
uuacauaauuuaguuguuucu

SEQ ID NO: 3562558 - RNA, 16 nt, Human
uuacauagguauauau

SEQ ID NO: 3562559 - RNA, 18 nt, Human
uuacauagucugaaguga

SEQ ID NO: 3562560 - RNA, 16 nt, Human
uuacauaguguaggcu

SEQ ID NO: 3562561 - RNA, 22 nt, Human
uuacauaguuuuaaacucauuu

SEQ ID NO: 3562562 - RNA, 22 nt, Human
uuacauaucaccucauggccua

SEQ ID NO: 3562563 - RNA, 22 nt, Human
uuacauauuugcauauguauga

SEQ ID NO: 3562564 - RNA, 14 nt, Human
uuacaucauuucuu

SEQ ID NO: 3562565 - RNA, 18 nt, Human
uuacaucauuuuuguauc

SEQ ID NO: 3562566 - RNA, 17 nt, Human
uuacauccuuguggcac

SEQ ID NO: 3562567 - RNA, 21 nt, Human
uuacauccuuguggcacauuu

SEQ ID NO: 3562568 - RNA, 16 nt, Human
uuacaugaaguauuuu

SEQ ID NO: 3562569 - RNA, 15 nt, Human
uuacaugagaacaga

SEQ ID NO: 3562570 - RNA, 17 nt, Human
uuacaugagaacagacu

SEQ ID NO: 3562571 - RNA, 22 nt, Human
uuacaugcagccacuuaggaca

SEQ ID NO: 3562572 - RNA, 20 nt, Human
uuacaugcuuauuccaugac

SEQ ID NO: 3562573 - RNA, 18 nt, Human
uuacauguguagccuaug

SEQ ID NO: 3562574 - RNA, 14 nt, Human
uuacauguuugcac

SEQ ID NO: 3562575 - RNA, 16 nt, Human
uuacauguuuuaaaga

SEQ ID NO: 3562576 - RNA, 14 nt, Human
uuacauuaauguua

SEQ ID NO: 3562577 - RNA, 19 nt, Human
uuacauugcuggucuugua

SEQ ID NO: 3562578 - RNA, 22 nt, Human
uuacauugcuggucuuguaaga

SEQ ID NO: 3562579 - RNA, 16 nt, Human
uuacauuguucaauua

SEQ ID NO: 3562580 - RNA, 17 nt, Human
uuacauuguuugucugu

SEQ ID NO: 3562581 - RNA, 17 nt, Human
uuacauuuaaaccuuuu

SEQ ID NO: 3562582 - RNA, 16 nt, Human
uuacauuuaaagcauu

SEQ ID NO: 3562583 - RNA, 22 nt, Human
uuacauuuaaagcauugcuguu

SEQ ID NO: 3562584 - RNA, 15 nt, Human
uuacauuucgauguu

SEQ ID NO: 3562585 - RNA, 13 nt, Human
uuacauuuguaau

SEQ ID NO: 3562586 - RNA, 14 nt, Human
uuacauuuguaauu

SEQ ID NO: 3562587 - RNA, 18 nt, Human
uuacauuuuaaacacauu

SEQ ID NO: 3562588 - RNA, 14 nt, Human
uuacauuuuacaca

SEQ ID NO: 3562589 - RNA, 20 nt, Human
uuacauuuuauuaagcuuuu

SEQ ID NO: 3562590 - RNA, 12 nt, Human
uuacauuuucag

SEQ ID NO: 3562591 - RNA, 14 nt, Human
uuacauuuuguaua

SEQ ID NO: 3562592 - RNA, 16 nt, Human
uuacauuuuuacaaua

SEQ ID NO: 3562593 - RNA, 17 nt, Human
uuacauuuuuacaauaa

SEQ ID NO: 3562594 - RNA, 13 nt, Human
uuacauuuuuauu

SEQ ID NO: 3562595 - RNA, 18 nt, Human
uuacauuuuuauuuauga

SEQ ID NO: 3562596 - RNA, 17 nt, Human
uuaccaaacagcaaacc

SEQ ID NO: 3562597 - RNA, 13 nt, Human
uuaccaaccuguu

SEQ ID NO: 3562598 - RNA, 13 nt, Human
uuaccaacuuucu

SEQ ID NO: 3562599 - RNA, 14 nt, Human
uuaccaacuuucug

SEQ ID NO: 3562600 - RNA, 18 nt, Human
uuaccaacuuucuguaaa

SEQ ID NO: 3562601 - RNA, 23 nt, Human
uuaccaauugaaguaaaaugugg

SEQ ID NO: 3562602 - RNA, 18 nt, Human
uuaccacacaucuaugau

SEQ ID NO: 3562603 - RNA, 12 nt, Human
uuaccaccccca

SEQ ID NO: 3562604 - RNA, 13 nt, Human
uuaccacugaaga

SEQ ID NO: 3562605 - RNA, 21 nt, Human
uuaccagacgguucaccagcc

SEQ ID NO: 3562606 - RNA, 22 nt, Human
uuaccagacgguucaccagccu

SEQ ID NO: 3562607 - RNA, 22 nt, Human
uuaccagcaagaauaaaaaaga

SEQ ID NO: 3562608 - RNA, 21 nt, Human
uuaccagccuccguauuucag

SEQ ID NO: 3562609 - RNA, 23 nt, Human
uuaccagccuccguauuucagac

SEQ ID NO: 3562610 - RNA, 17 nt, Human
uuaccagggauguagau

SEQ ID NO: 3562611 - RNA, 20 nt, Human
uuaccaguaaaguguaacau

SEQ ID NO: 3562612 - RNA, 21 nt, Human
uuaccaguauuuaacuucuga

SEQ ID NO: 3562613 - RNA, 21 nt, Human
uuaccagucuuuaaaggccca

SEQ ID NO: 3562614 - RNA, 17 nt, Human
uuaccauaguuuucuca

SEQ ID NO: 3562615 - RNA, 21 nt, Human
uuaccauuugcuacuguacau

SEQ ID NO: 3562616 - RNA, 23 nt, Human
uuaccauuuguaauaaaguauau

SEQ ID NO: 3562617 - RNA, 19 nt, Human
uuaccauuuguuaauauca

SEQ ID NO: 3562618 - RNA, 18 nt, Human
uuacccacucggucccag

SEQ ID NO: 3562619 - RNA, 16 nt, Human
uuacccagaaugucag

SEQ ID NO: 3562620 - RNA, 22 nt, Human
uuacccagagaauauauacauu

SEQ ID NO: 3562621 - RNA, 16 nt, Human
uuacccaggugggucc

SEQ ID NO: 3562622 - RNA, 16 nt, Human
uuacccauauccccuc

SEQ ID NO: 3562623 - RNA, 17 nt, Human
uuacccauauccccucu

SEQ ID NO: 3562624 - RNA, 13 nt, Human
uuacccaugaaaa

SEQ ID NO: 3562625 - RNA, 22 nt, Human
uuaccccacaacgugcaacuga

SEQ ID NO: 3562626 - RNA, 14 nt, Human
uuaccccuuagccu

SEQ ID NO: 3562627 - RNA, 17 nt, Human
uuacccgguuucuuuuu

SEQ ID NO: 3562628 - RNA, 17 nt, Human
uuacccuauaucuauaa

SEQ ID NO: 3562629 - RNA, 18 nt, Human
uuacccuggccccucucc

SEQ ID NO: 3562630 - RNA, 20 nt, Human
uuacccuggccccucucccu

SEQ ID NO: 3562631 - RNA, 13 nt, Human
uuacccuuagaau

SEQ ID NO: 3562632 - RNA, 12 nt, Human
uuacccuucugu

SEQ ID NO: 3562633 - RNA, 22 nt, Human
uuacccuucugugcccagcuca

SEQ ID NO: 3562634 - RNA, 22 nt, Human
uuaccgcguaaugcgccaauaa

SEQ ID NO: 3562635 - RNA, 15 nt, Human
uuaccgcguuguaaa

SEQ ID NO: 3562636 - RNA, 16 nt, Human
uuaccgcguuguaaaa

SEQ ID NO: 3562637 - RNA, 18 nt, Human
uuaccuaaacagauauaa

SEQ ID NO: 3562638 - RNA, 21 nt, Human
uuaccuaaacagauauaaaug

SEQ ID NO: 3562639 - RNA, 19 nt, Human
uuaccuaccacaugccaag

SEQ ID NO: 3562640 - RNA, 23 nt, Human
uuaccuacuuugacuuuuugcau

SEQ ID NO: 3562641 - RNA, 18 nt, Human
uuaccuagcuaauuauuu

SEQ ID NO: 3562642 - RNA, 20 nt, Human
uuaccuaguagucauuucau

SEQ ID NO: 3562643 - RNA, 15 nt, Human
uuaccuagugaaacu

SEQ ID NO: 3562644 - RNA, 12 nt, Human
uuaccucagccu

SEQ ID NO: 3562645 - RNA, 18 nt, Human
uuaccucagccugggcgc

SEQ ID NO: 3562646 - RNA, 18 nt, Human
uuaccuccaacagaacua

SEQ ID NO: 3562647 - RNA, 23 nt, Human
uuaccuccaacagaacuaaaugu

SEQ ID NO: 3562648 - RNA, 11 nt, Human
uuaccuccuga

SEQ ID NO: 3562649 - RNA, 13 nt, Human
uuaccuccugccc

SEQ ID NO: 3562650 - RNA, 11 nt, Human
uuaccucugau

SEQ ID NO: 3562651 - RNA, 15 nt, Human
uuaccucuuaacaau

SEQ ID NO: 3562652 - RNA, 16 nt, Human
uuaccucuuuggaaaa

SEQ ID NO: 3562653 - RNA, 22 nt, Human
uuaccugaagggguuuucuuga

SEQ ID NO: 3562654 - RNA, 19 nt, Human
uuaccugaccucuugcugu

SEQ ID NO: 3562655 - RNA, 23 nt, Human
uuaccugaccucuugcugucucu

SEQ ID NO: 3562656 - RNA, 18 nt, Human
uuaccugaguugaagagg

SEQ ID NO: 3562657 - RNA, 21 nt, Human
uuaccuggcuuauuuaauaug

SEQ ID NO: 3562658 - RNA, 18 nt, Human
uuaccugggcauucuugu

SEQ ID NO: 3562659 - RNA, 15 nt, Human
uuaccuguauacagu

SEQ ID NO: 3562660 - RNA, 13 nt, Human
uuaccugucacau

SEQ ID NO: 3562661 - RNA, 23 nt, Human
uuaccuuaaaacuaggcauuugu

SEQ ID NO: 3562662 - RNA, 14 nt, Human
uuaccuuacagaag

SEQ ID NO: 3562663 - RNA, 22 nt, Human
uuaccuuagauuagcucuggac

SEQ ID NO: 3562664 - RNA, 15 nt, Human
uuaccuuauugcacu

SEQ ID NO: 3562665 - RNA, 16 nt, Human
uuaccuucaauaaagu

SEQ ID NO: 3562666 - RNA, 18 nt, Human
uuaccuugaacugaaggc

SEQ ID NO: 3562667 - RNA, 16 nt, Human
uuaccuuguauacugu

SEQ ID NO: 3562668 - RNA, 16 nt, Human
uuaccuugucauuuug

SEQ ID NO: 3562669 - RNA, 13 nt, Human
uuaccuuugacaa

SEQ ID NO: 3562670 - RNA, 19 nt, Human
uuaccuuuuaauuaaugaa

SEQ ID NO: 3562671 - RNA, 20 nt, Human
uuaccuuuuaccagcuuuua

SEQ ID NO: 3562672 - RNA, 18 nt, Human
uuaccuuuuuauuugcau

SEQ ID NO: 3562673 - RNA, 19 nt, Human
uuaccuuuuuuauacauaa

SEQ ID NO: 3562674 - RNA, 22 nt, Human
uuaccuuuuuuauacauaaaca

SEQ ID NO: 3562675 - RNA, 16 nt, Human
uuacgaauauuuucag

SEQ ID NO: 3562676 - RNA, 13 nt, Human
uuacgcuuugauu

SEQ ID NO: 3562677 - RNA, 16 nt, Human
uuacgcuuugauucau

SEQ ID NO: 3562678 - RNA, 16 nt, Human
uuacgguaguuaggau

SEQ ID NO: 3562679 - RNA, 20 nt, Human
uuacguaguguagauuuguu

SEQ ID NO: 3562680 - RNA, 17 nt, Human
uuacguguuuaaaaaaa

SEQ ID NO: 3562681 - RNA, 17 nt, Human
uuacuaaaaaguauaaa

SEQ ID NO: 3562682 - RNA, 17 nt, Human
uuacuaaaauauauaua

SEQ ID NO: 3562683 - RNA, 16 nt, Human
uuacuaaaauggacug

SEQ ID NO: 3562684 - RNA, 17 nt, Human
uuacuaaaauggacugu

SEQ ID NO: 3562685 - RNA, 16 nt, Human
uuacuaaacauuuugu

SEQ ID NO: 3562686 - RNA, 18 nt, Human
uuacuaaagaaaauaucu

SEQ ID NO: 3562687 - RNA, 22 nt, Human
uuacuaaagaaaauaucugaaa

SEQ ID NO: 3562688 - RNA, 15 nt, Human
uuacuaaagaaagau

SEQ ID NO: 3562689 - RNA, 18 nt, Human
uuacuaaagaaagauuac

SEQ ID NO: 3562690 - RNA, 20 nt, Human
uuacuaacuaaacucucuuu

SEQ ID NO: 3562691 - RNA, 11 nt, Human
uuacuaacuuc

SEQ ID NO: 3562692 - RNA, 21 nt, Human
uuacuaacuucuaaaacugua

SEQ ID NO: 3562693 - RNA, 15 nt, Human
uuacuaagaagaaaa

SEQ ID NO: 3562694 - RNA, 21 nt, Human
uuacuaagaugacauugcuaa

SEQ ID NO: 3562695 - RNA, 18 nt, Human
uuacuaagccacaagaaa

SEQ ID NO: 3562696 - RNA, 16 nt, Human
uuacuaauagacaauu

SEQ ID NO: 3562697 - RNA, 16 nt, Human
uuacuaauguaaaaug

SEQ ID NO: 3562698 - RNA, 14 nt, Human
uuacuacaaaauuu

SEQ ID NO: 3562699 - RNA, 20 nt, Human
uuacuacaaaauuugaaauu

SEQ ID NO: 3562700 - RNA, 19 nt, Human
uuacuacaauauguacauu

SEQ ID NO: 3562701 - RNA, 15 nt, Human
uuacuacaguuuuua

SEQ ID NO: 3562702 - RNA, 14 nt, Human
uuacuacaugcacu

SEQ ID NO: 3562703 - RNA, 21 nt, Human
uuacuacuucucucuguauuu

SEQ ID NO: 3562704 - RNA, 20 nt, Human
uuacuagggaucccucaucu

SEQ ID NO: 3562705 - RNA, 23 nt, Human
uuacuagggaucccucaucuguc

SEQ ID NO: 3562706 - RNA, 17 nt, Human
uuacuagguaacuucau

SEQ ID NO: 3562707 - RNA, 15 nt, Human
uuacuauaagaacuu

SEQ ID NO: 3562708 - RNA, 17 nt, Human
uuacuauagcaaaguag

SEQ ID NO: 3562709 - RNA, 18 nt, Human
uuacuauagcaaaguagu

SEQ ID NO: 3562710 - RNA, 16 nt, Human
uuacuaugcacaauuu

SEQ ID NO: 3562711 - RNA, 22 nt, Human
uuagguuuuguacaauugaacu

SEQ ID NO: 3562712 - RNA, 16 nt, Human
uuagguuuuuccuuau

SEQ ID NO: 3562713 - RNA, 17 nt, Human
uuaguaaaaaaucaauu

SEQ ID NO: 3562714 - RNA, 22 nt, Human
uuaguaaaaaaucaauuaacca

SEQ ID NO: 3562715 - RNA, 16 nt, Human
uuaguaaaugucuuug

SEQ ID NO: 3562716 - RNA, 24 nt, Human
uuaguaacaugaggggacauuuug

SEQ ID NO: 3562717 - RNA, 12 nt, Human
uuaguaacaugu

SEQ ID NO: 3562718 - RNA, 20 nt, Human
uuaguaaggcuguguacacu

SEQ ID NO: 3562719 - RNA, 13 nt, Human
uuaguaagucuug

SEQ ID NO: 3562720 - RNA, 14 nt, Human
uuaguaauaccucu

SEQ ID NO: 3562721 - RNA, 15 nt, Human
uuaguaaucuguaca

SEQ ID NO: 3562722 - RNA, 21 nt, Human
uuaguaaucuguacauuuugu

SEQ ID NO: 3562723 - RNA, 15 nt, Human
uuaguaaucuguaua

SEQ ID NO: 3562724 - RNA, 22 nt, Human
uuaguaaugcuacgugugauuu

SEQ ID NO: 3562725 - RNA, 14 nt, Human
uuaguacaaaguuu

SEQ ID NO: 3562726 - RNA, 18 nt, Human
uuaguacccaccugagcu

SEQ ID NO: 3562727 - RNA, 19 nt, Human
uuaguacuauaucuguuuu

SEQ ID NO: 3562728 - RNA, 21 nt, Human
uuaguagaaauuuuacaauag

SEQ ID NO: 3562729 - RNA, 23 nt, Human
uuaguagagguacacuugugaau

SEQ ID NO: 3562730 - RNA, 12 nt, Human
uuaguagcaugu

SEQ ID NO: 3562731 - RNA, 19 nt, Human
uuaguauauuuauauaauu

SEQ ID NO: 3562732 - RNA, 15 nt, Human
uuaguaucaguguuu

SEQ ID NO: 3562733 - RNA, 19 nt, Human
uuaguaucaguguuuuaaa

SEQ ID NO: 3562734 - RNA, 16 nt, Human
uuaguaugaggcauuu

SEQ ID NO: 3562735 - RNA, 19 nt, Human
uuaguauuuauuuauguac

SEQ ID NO: 3562736 - RNA, 20 nt, Human
uuaguauuuauuuauguacu

SEQ ID NO: 3562737 - RNA, 13 nt, Human
uuagucacuuuuu

SEQ ID NO: 3562738 - RNA, 15 nt, Human
uuagucauagaagaa

SEQ ID NO: 3562739 - RNA, 16 nt, Human
uuagucauagaagaac

SEQ ID NO: 3562740 - RNA, 19 nt, Human
uuagucauguuuaucugcu

SEQ ID NO: 3562741 - RNA, 13 nt, Human
uuagucgugagcu

SEQ ID NO: 3562742 - RNA, 18 nt, Human
uuagucucuaaagaguuu

SEQ ID NO: 3562743 - RNA, 22 nt, Human
uuagucuuagggauuuauuuuc

SEQ ID NO: 3562744 - RNA, 13 nt, Human
uuagucuucucau

SEQ ID NO: 3562745 - RNA, 19 nt, Human
uuagugaccucagcuuuga

SEQ ID NO: 3562746 - RNA, 15 nt, Human
uuagugacuaaacca

SEQ ID NO: 3562747 - RNA, 16 nt, Human
uuagugagacauauuu

SEQ ID NO: 3562748 - RNA, 14 nt, Human
uuagugaguuauuc

SEQ ID NO: 3562749 - RNA, 14 nt, Human
uuagugauauuucu

SEQ ID NO: 3562750 - RNA, 19 nt, Human
uuagugauauuucucuagu

SEQ ID NO: 3562751 - RNA, 14 nt, Human
uuagugauguaauu

SEQ ID NO: 3562752 - RNA, 18 nt, Human
uuagugaugucaucuguc

SEQ ID NO: 3562753 - RNA, 14 nt, Human
uuagugcauccagu

SEQ ID NO: 3562754 - RNA, 14 nt, Human
uuagugccagaauu

SEQ ID NO: 3562755 - RNA, 17 nt, Human
uuagugcggacaaguuu

SEQ ID NO: 3562756 - RNA, 19 nt, Human
uuagugcggacaaguuuua

SEQ ID NO: 3562757 - RNA, 19 nt, Human
uuaguggacccugaaaugu

SEQ ID NO: 3562758 - RNA, 12 nt, Human
uuaguggcaccg

SEQ ID NO: 3562759 - RNA, 13 nt, Human
uuaguggcaccgc

SEQ ID NO: 3562760 - RNA, 12 nt, Human
uuaguggcuuca

SEQ ID NO: 3562761 - RNA, 15 nt, Human
uuaguguaaaaauga

SEQ ID NO: 3562762 - RNA, 14 nt, Human
uuaguguuauauga

SEQ ID NO: 3562763 - RNA, 12 nt, Human
uuaguguuucug

SEQ ID NO: 3562764 - RNA, 18 nt, Human
uuaguguuucugugcaug

SEQ ID NO: 3562765 - RNA, 16 nt, Human
uuaguguuuuuuuauu

SEQ ID NO: 3562766 - RNA, 13 nt, Human
uuaguuaauauau

SEQ ID NO: 3562767 - RNA, 16 nt, Human
uuaguuaccuuauagu

SEQ ID NO: 3562768 - RNA, 20 nt, Human
uuaguuaccuuauaguuacu

SEQ ID NO: 3562769 - RNA, 18 nt, Human
uuaguuauaguuucagau

SEQ ID NO: 3562770 - RNA, 22 nt, Human
uuaguuauaguuucagauauau

SEQ ID NO: 3562771 - RNA, 16 nt, Human
uuaguuccacugagac

SEQ ID NO: 3562772 - RNA, 12 nt, Human
uuaguuccugug

SEQ ID NO: 3562773 - RNA, 15 nt, Human
uuaguucuuuguuau

SEQ ID NO: 3562774 - RNA, 13 nt, Human
uuaguugcaacuu

SEQ ID NO: 3562775 - RNA, 20 nt, Human
uuaguuuacccgguuucuuu

SEQ ID NO: 3562776 - RNA, 11 nt, Human
uuaguuuagaa

SEQ ID NO: 3562777 - RNA, 14 nt, Human
uuaguuuggauucu

SEQ ID NO: 3562778 - RNA, 15 nt, Human
uuaguuuguguguug

SEQ ID NO: 3562779 - RNA, 17 nt, Human
uuaguuuuauuuucuaa

SEQ ID NO: 3562780 - RNA, 12 nt, Human
uuaguuuugauu

SEQ ID NO: 3562781 - RNA, 22 nt, Human
uuaguuuugugcuuaguuaaau

SEQ ID NO: 3562782 - RNA, 13 nt, Human
uuaguuuuucauu

SEQ ID NO: 3562783 - RNA, 22 nt, Human
uuauaaaaaaaaugaaauguuu

SEQ ID NO: 3562784 - RNA, 15 nt, Human
uuauaaaaaaugguu

SEQ ID NO: 3562785 - RNA, 20 nt, Human
uuauaaaaauaaauagaaaa

SEQ ID NO: 3562786 - RNA, 22 nt, Human
uuauaaaaccaucaaaaauauu

SEQ ID NO: 3562787 - RNA, 15 nt, Human
uuauaaaagugaaua

SEQ ID NO: 3562788 - RNA, 14 nt, Human
uuauaaaauuaaaa

SEQ ID NO: 3562789 - RNA, 20 nt, Human
uuauaaaauuaaagaaaaua

SEQ ID NO: 3562790 - RNA, 17 nt, Human
uuauaaaauuagaaagc

SEQ ID NO: 3562791 - RNA, 20 nt, Human
uuauaaacaagaaugaaggu

SEQ ID NO: 3562792 - RNA, 19 nt, Human
uuauaaacagacaauaugu

SEQ ID NO: 3562793 - RNA, 21 nt, Human
uuauaaacagacaauauguga

SEQ ID NO: 3562794 - RNA, 16 nt, Human
uuauaaaccucuaauu

SEQ ID NO: 3562795 - RNA, 23 nt, Human
uuauaaaccucuaauuuauuuug

SEQ ID NO: 3562796 - RNA, 13 nt, Human
uuauaaacuuuac

SEQ ID NO: 3562797 - RNA, 16 nt, Human
uuauaaacuuuuuucu

SEQ ID NO: 3562798 - RNA, 18 nt, Human
uuauaaagugcuugugua

SEQ ID NO: 3562799 - RNA, 19 nt, Human
uuauaaauaaacuguugcu

SEQ ID NO: 3562800 - RNA, 21 nt, Human
uuauaaauauaagccuuuuau

SEQ ID NO: 3562801 - RNA, 21 nt, Human
uuauaaauaugaagcucaccu

SEQ ID NO: 3562802 - RNA, 21 nt, Human
uuauaaaucauauugaugaaa

SEQ ID NO: 3562803 - RNA, 11 nt, Human
uuauuagauaa

SEQ ID NO: 3562804 - RNA, 12 nt, Human
uuauuagaugaa

SEQ ID NO: 3562805 - RNA, 13 nt, Human
uuauuagaugaau

SEQ ID NO: 3562806 - RNA, 21 nt, Human
uuauuagcagcugacuuucaa

SEQ ID NO: 3562807 - RNA, 23 nt, Human
uuauuagcccugcauuuucauag

SEQ ID NO: 3562808 - RNA, 17 nt, Human
uuauuagggagaaaauu

SEQ ID NO: 3562809 - RNA, 19 nt, Human
uuauuagggagaaaauuca

SEQ ID NO: 3562810 - RNA, 18 nt, Human
uuauuaguauuguugucc

SEQ ID NO: 3562811 - RNA, 15 nt, Human
uuauuaguuaauaua

SEQ ID NO: 3562812 - RNA, 14 nt, Human
uuauuaguuuacau

SEQ ID NO: 3562813 - RNA, 13 nt, Human
uuauuaguuuugc

SEQ ID NO: 3562814 - RNA, 22 nt, Human
uuauuaucauuguucuuuucaa

SEQ ID NO: 3562815 - RNA, 16 nt, Human
uuauuaucuaaagugu

SEQ ID NO: 3562816 - RNA, 20 nt, Human
uuauuaugaaacuuguguaa

SEQ ID NO: 3562817 - RNA, 22 nt, Human
uuauuaugaaacuuguguaaau

SEQ ID NO: 3562818 - RNA, 12 nt, Human
uuauuaugcaug

SEQ ID NO: 3562819 - RNA, 13 nt, Human
uuauuaugcauga

SEQ ID NO: 3562820 - RNA, 16 nt, Human
uuauuauguaaauccc

SEQ ID NO: 3562821 - RNA, 13 nt, Human
uuauuauuaacaa

SEQ ID NO: 3562822 - RNA, 15 nt, Human
uuauuauuuuggggu

SEQ ID NO: 3562823 - RNA, 15 nt, Human
uuauucaaagaaaua

SEQ ID NO: 3562824 - RNA, 13 nt, Human
uuauucaacagca

SEQ ID NO: 3562825 - RNA, 12 nt, Human
uuauucaauaaa

SEQ ID NO: 3562826 - RNA, 23 nt, Human
uuauucaauaaaaaaaagaaaug

SEQ ID NO: 3562827 - RNA, 14 nt, Human
uuauucaauaaagu

SEQ ID NO: 3562828 - RNA, 17 nt, Human
uuauucaauaaaguauu

SEQ ID NO: 3562829 - RNA, 14 nt, Human
uuauucacaaaaau

SEQ ID NO: 3562830 - RNA, 20 nt, Human
uuauucaccauguaaaacaa

SEQ ID NO: 3562831 - RNA, 22 nt, Human
uuauucaggaaaagccucugug

SEQ ID NO: 3562832 - RNA, 15 nt, Human
uuauucagggaagga

SEQ ID NO: 3562833 - RNA, 16 nt, Human
uuauucauuagcugug

SEQ ID NO: 3562834 - RNA, 18 nt, Human
uuauucauuaguuuugaa

SEQ ID NO: 3562835 - RNA, 23 nt, Human
uuauucauucugugaucauuuau

SEQ ID NO: 3562836 - RNA, 13 nt, Human
uuauucauuuaaa

SEQ ID NO: 3562837 - RNA, 14 nt, Human
uuauucauuugagu

SEQ ID NO: 3562838 - RNA, 22 nt, Human
uuauuccaagggaauauugcca

SEQ ID NO: 3562839 - RNA, 12 nt, Human
uuauuccacauc

SEQ ID NO: 3562840 - RNA, 12 nt, Human
uuauuccauauu

SEQ ID NO: 3562841 - RNA, 19 nt, Human
uuauucccuuucacaaaau

SEQ ID NO: 3562842 - RNA, 20 nt, Human
uuauuccuauauaguuuauu

SEQ ID NO: 3562843 - RNA, 20 nt, Human
uuauuccugauaauaauuga

SEQ ID NO: 3562844 - RNA, 21 nt, Human
uuauuccugauaauaauugau

SEQ ID NO: 3562845 - RNA, 15 nt, Human
uuauuccuguauguu

SEQ ID NO: 3562846 - RNA, 16 nt, Human
uuauuccuugaucauu

SEQ ID NO: 3562847 - RNA, 17 nt, Human
uuauucucacuccacca

SEQ ID NO: 3562848 - RNA, 11 nt, Human
uuauucugcuc

SEQ ID NO: 3562849 - RNA, 22 nt, Human
uuauucugggcaccacaaaaua

SEQ ID NO: 3562850 - RNA, 18 nt, Human
uuauucuugaaagaagaa

SEQ ID NO: 3562851 - RNA, 11 nt, Human
uuauucuugau

SEQ ID NO: 3562852 - RNA, 14 nt, Human
uuauucuugaugaa

SEQ ID NO: 3562853 - RNA, 15 nt, Human
uuauucuuucuccuu

SEQ ID NO: 3562854 - RNA, 17 nt, Human
uuauucuuugcacuuuu

SEQ ID NO: 3562855 - RNA, 19 nt, Human
uuauugacacagaaaaugu

SEQ ID NO: 3562856 - RNA, 11 nt, Human
uuauugacacu

SEQ ID NO: 3562857 - RNA, 14 nt, Human
uuauugacacugaa

SEQ ID NO: 3562858 - RNA, 15 nt, Human
uuauugacacugaac

SEQ ID NO: 3562859 - RNA, 17 nt, Human
uuauugacacugaacuu

SEQ ID NO: 3562860 - RNA, 18 nt, Human
uuauugacaguugugcag

SEQ ID NO: 3562861 - RNA, 16 nt, Human
uuauugacucuggguc

SEQ ID NO: 3562862 - RNA, 22 nt, Human
uuauugacucuggguccuuccu

SEQ ID NO: 3562863 - RNA, 16 nt, Human
uuauugacucuugagu

SEQ ID NO: 3562864 - RNA, 21 nt, Human
uuauugacucuugaguuguuu

SEQ ID NO: 3562865 - RNA, 23 nt, Human
uuauugagaaagagcacuuaaga

SEQ ID NO: 3562866 - RNA, 21 nt, Human
uuauugaggaaaaauauguga

SEQ ID NO: 3562867 - RNA, 20 nt, Human
uuauugauaaguucauacau

SEQ ID NO: 3562868 - RNA, 21 nt, Human
uuauugcaaaauagcauuugu

SEQ ID NO: 3562869 - RNA, 15 nt, Human
uuauugcacauuguu

SEQ ID NO: 3562870 - RNA, 17 nt, Human
uuauugcacauuguuca

SEQ ID NO: 3562871 - RNA, 20 nt, Human
uuauugccaaaacccagcug

SEQ ID NO: 3562872 - RNA, 22 nt, Human
uuauugccaaaacccagcugca

SEQ ID NO: 3562873 - RNA, 14 nt, Human
uuauugccuucuca

SEQ ID NO: 3562874 - RNA, 20 nt, Human
uuauugccuucucaccagcu

SEQ ID NO: 3562875 - RNA, 15 nt, Human
uuauugcuguugcuu

SEQ ID NO: 3562876 - RNA, 17 nt, Human
uuauugcuuaguaaaau

SEQ ID NO: 3562877 - RNA, 17 nt, Human
uuauugcuuauugcuua

SEQ ID NO: 3562878 - RNA, 20 nt, Human
uuauugcuuauugcuuagua

SEQ ID NO: 3562879 - RNA, 23 nt, Human
uuauugcuugauacuuuugacaa

SEQ ID NO: 3562880 - RNA, 14 nt, Human
uuauuggcugagau

SEQ ID NO: 3562881 - RNA, 16 nt, Human
uuauuggcugagauau

SEQ ID NO: 3562882 - RNA, 18 nt, Human
uuauuggcuuuucugauc

SEQ ID NO: 3562883 - RNA, 15 nt, Human
uuauugguuuugcag

SEQ ID NO: 3562884 - RNA, 16 nt, Human
uuauuguaacagacau

SEQ ID NO: 3562885 - RNA, 17 nt, Human
uuauuguaacagacauu

SEQ ID NO: 3562886 - RNA, 20 nt, Human
uuauuguaacagacauuguu

SEQ ID NO: 3562887 - RNA, 19 nt, Human
uuauuguacagcuguuuaa

SEQ ID NO: 3562888 - RNA, 12 nt, Human
uuauuguaccuc

SEQ ID NO: 3562889 - RNA, 14 nt, Human
uuauuguaccucuc

SEQ ID NO: 3562890 - RNA, 12 nt, Human
uuauuguacuug

SEQ ID NO: 3562891 - RNA, 14 nt, Human
uuauuguauucugg

SEQ ID NO: 3562892 - RNA, 17 nt, Human
uuauugucaaaguggug

SEQ ID NO: 3562893 - RNA, 18 nt, Human
uuauugucaaagugguga

SEQ ID NO: 3562894 - RNA, 16 nt, Human
uuauugugauuucccg

SEQ ID NO: 3562895 - RNA, 17 nt, Human
uuaggaggcucaacaau

SEQ ID NO: 3562896 - RNA, 19 nt, Human
uuaggagggaguuaucuaa

SEQ ID NO: 3562897 - RNA, 15 nt, Human
uuaggauggcaggac

SEQ ID NO: 3562898 - RNA, 14 nt, Human
uuaggauuuaacag

SEQ ID NO: 3562899 - RNA, 21 nt, Human
uuaggauuuaacagucauuua

SEQ ID NO: 3562900 - RNA, 18 nt, Human
uuaggcagggauuugagg

SEQ ID NO: 3562901 - RNA, 19 nt, Human
uuaggcagggauuugagga

SEQ ID NO: 3562902 - RNA, 18 nt, Human
uuaggcaugcacagcugu

SEQ ID NO: 3562903 - RNA, 18 nt, Human
uuaggcaugguuuugggc

SEQ ID NO: 3562904 - RNA, 15 nt, Human
uuaggccaaagacaa

SEQ ID NO: 3562905 - RNA, 16 nt, Human
uuaggccacaugggag

SEQ ID NO: 3562906 - RNA, 15 nt, Human
uuaggcuauucacaa

SEQ ID NO: 3562907 - RNA, 17 nt, Human
uuaggcugcugggaugg

SEQ ID NO: 3562908 - RNA, 17 nt, Human
uuaggcugggcccagag

SEQ ID NO: 3562909 - RNA, 16 nt, Human
uuaggcugguggccca

SEQ ID NO: 3562910 - RNA, 17 nt, Human
uuaggcugguggcccag

SEQ ID NO: 3562911 - RNA, 19 nt, Human
uuaggcugguggcccagga

SEQ ID NO: 3562912 - RNA, 17 nt, Human
uuaggcuguaacuacuu

SEQ ID NO: 3562913 - RNA, 20 nt, Human
uuaggcuguaacuacuuuau

SEQ ID NO: 3562914 - RNA, 15 nt, Human
uuaggcuuaaaaacu

SEQ ID NO: 3562915 - RNA, 17 nt, Human
uuagggaaaacauucca

SEQ ID NO: 3562916 - RNA, 14 nt, Human
uuagggaagagaaa

SEQ ID NO: 3562917 - RNA, 21 nt, Human
uuagggacaggaccccagcuc

SEQ ID NO: 3562918 - RNA, 21 nt, Human
uuagggagagucauauuuuga

SEQ ID NO: 3562919 - RNA, 12 nt, Human
uuagggaggggu

SEQ ID NO: 3562920 - RNA, 14 nt, Human
uuagggauuuauuu

SEQ ID NO: 3562921 - RNA, 14 nt, Human
uuagggcagcuugc

SEQ ID NO: 3562922 - RNA, 15 nt, Human
uuagggccaggcagg

SEQ ID NO: 3562923 - RNA, 15 nt, Human
uuagggcucuaauuu

SEQ ID NO: 3562924 - RNA, 15 nt, Human
uuaggguacuaaauu

SEQ ID NO: 3562925 - RNA, 15 nt, Human
uuagggugaaccacu

SEQ ID NO: 3562926 - RNA, 21 nt, Human
uuagggugaaccacuucauuc

SEQ ID NO: 3562927 - RNA, 15 nt, Human
uuaggugaggaagca

SEQ ID NO: 3562928 - RNA, 14 nt, Human
uuaggugucugucc

SEQ ID NO: 3562929 - RNA, 19 nt, Human
uuaggugugggggaagcac

SEQ ID NO: 3562930 - RNA, 20 nt, Human
uuagguuaaaaaaaggcauu

SEQ ID NO: 3562931 - RNA, 18 nt, Human
uuagguuaacuauguaca

SEQ ID NO: 3562932 - RNA, 19 nt, Human
uuagguuaacuauguacaa

SEQ ID NO: 3562933 - RNA, 22 nt, Human
uuagguuccauccuuuacgugu

SEQ ID NO: 3562934 - RNA, 20 nt, Human
uuagguucuaaaguucuaag

SEQ ID NO: 3562935 - RNA, 18 nt, Human
uuagguuggcaaaaaggc

SEQ ID NO: 3562936 - RNA, 12 nt, Human
uuagguugugaa

SEQ ID NO: 3562937 - RNA, 14 nt, Human
uucagugauaacuc

SEQ ID NO: 3562938 - RNA, 15 nt, Human
uucagugaugugccu

SEQ ID NO: 3562939 - RNA, 10 nt, Human
uucagugccc

SEQ ID NO: 3562940 - RNA, 12 nt, Human
uucagugccuua

SEQ ID NO: 3562941 - RNA, 13 nt, Human
uucagugccuuau

SEQ ID NO: 3562942 - RNA, 21 nt, Human
uucagugccuuauggaacacu

SEQ ID NO: 3562943 - RNA, 12 nt, Human
uucaguggagaa

SEQ ID NO: 3562944 - RNA, 16 nt, Human
uucaguggcagggcuc

SEQ ID NO: 3562945 - RNA, 14 nt, Human
uucagugggagaaa

SEQ ID NO: 3562946 - RNA, 14 nt, Human
uucaguggggcagu

SEQ ID NO: 3562947 - RNA, 16 nt, Human
uucaguguaaagugug

SEQ ID NO: 3562948 - RNA, 13 nt, Human
uucaguguaaaua

SEQ ID NO: 3562949 - RNA, 20 nt, Human
uucaguguaauuucuuugcc

SEQ ID NO: 3562950 - RNA, 14 nt, Human
uucaguguaguuaa

SEQ ID NO: 3562951 - RNA, 19 nt, Human
uucaguguaguuaauuuau

SEQ ID NO: 3562952 - RNA, 18 nt, Human
uucaguguuaaaugugau

SEQ ID NO: 3562953 - RNA, 22 nt, Human
uucaguguuaaaugugaugaau

SEQ ID NO: 3562954 - RNA, 21 nt, Human
uucaguguuucuggggagcug

SEQ ID NO: 3562955 - RNA, 17 nt, Human
uucaguuaagaaaaaaa

SEQ ID NO: 3562956 - RNA, 14 nt, Human
uucaguuacagaaa

SEQ ID NO: 3562957 - RNA, 17 nt, Human
uucaguuacagaaagug

SEQ ID NO: 3562958 - RNA, 23 nt, Human
uucaguuauuauauuuacaaaug

SEQ ID NO: 3562959 - RNA, 17 nt, Human
uucaguucaaagucaug

SEQ ID NO: 3562960 - RNA, 18 nt, Human
uugacuuauaguacauga

SEQ ID NO: 3562961 - RNA, 13 nt, Human
uugacuucagauu

SEQ ID NO: 3562962 - RNA, 21 nt, Human
uugacuugacagaacacuguc

SEQ ID NO: 3562963 - RNA, 13 nt, Human
uugacuuuaauuu

SEQ ID NO: 3562964 - RNA, 13 nt, Human
uugacuuucaggu

SEQ ID NO: 3562965 - RNA, 14 nt, Human
uugacuuucaggua

SEQ ID NO: 3562966 - RNA, 15 nt, Human
uugacuuucagguac

SEQ ID NO: 3562967 - RNA, 19 nt, Human
uugacuuuccccaccagau

SEQ ID NO: 3562968 - RNA, 20 nt, Human
uugacuuuuauaaagcaugu

SEQ ID NO: 3562969 - RNA, 21 nt, Human
uugacuuuuauaaagcauguu

SEQ ID NO: 3562970 - RNA, 13 nt, Human
uugacuuuucugu

SEQ ID NO: 3562971 - RNA, 12 nt, Human
uugacuuuuuau

SEQ ID NO: 3562972 - RNA, 17 nt, Human
uugacuuuuugcauuua

SEQ ID NO: 3562973 - RNA, 17 nt, Human
uugacuuuuuuuguaug

SEQ ID NO: 3562974 - RNA, 19 nt, Human
uugagaaaaauauauacua

SEQ ID NO: 3562975 - RNA, 20 nt, Human
uugagaaacaaauaauuugu

SEQ ID NO: 3562976 - RNA, 23 nt, Human
uugagaaaccuuauuguaccucu

SEQ ID NO: 3562977 - RNA, 21 nt, Human
uugagaacuaccuggauuugu

SEQ ID NO: 3562978 - RNA, 18 nt, Human
uugagaaguuuuguacag

SEQ ID NO: 3562979 - RNA, 23 nt, Human
uugagaaucccaaauuugauuga

SEQ ID NO: 3562980 - RNA, 16 nt, Human
uugagaauggaaacca

SEQ ID NO: 3562981 - RNA, 22 nt, Human
uugagaauugugcucaaaauuu

SEQ ID NO: 3562982 - RNA, 17 nt, Human
uugagacaaaaauuauc

SEQ ID NO: 3562983 - RNA, 22 nt, Human
uugagacacugguuuacacuuu

SEQ ID NO: 3562984 - RNA, 11 nt, Human
uugagacagag

SEQ ID NO: 3562985 - RNA, 12 nt, Human
uugagacaguuu

SEQ ID NO: 3562986 - RNA, 13 nt, Human
uugagacaguuuc

SEQ ID NO: 3562987 - RNA, 15 nt, Human
uugagaccagccugg

SEQ ID NO: 3562988 - RNA, 17 nt, Human
uugagaccucagccaug

SEQ ID NO: 3562989 - RNA, 22 nt, Human
uugagacuccucaguucuugcc

SEQ ID NO: 3562990 - RNA, 16 nt, Human
uugagacuuuuuggug

SEQ ID NO: 3562991 - RNA, 16 nt, Human
uugagagaauuugugc

SEQ ID NO: 3562992 - RNA, 17 nt, Human
uugagagaccaggcaaa

SEQ ID NO: 3562993 - RNA, 14 nt, Human
uugagagagaugug

SEQ ID NO: 3562994 - RNA, 22 nt, Human
uugagagagauguguaauuuuu

SEQ ID NO: 3562995 - RNA, 16 nt, Human
uugagagagcagccag

SEQ ID NO: 3562996 - RNA, 13 nt, Human
uugagagugugac

SEQ ID NO: 3562997 - RNA, 22 nt, Human
uugagauacuuuuucuuuugua

SEQ ID NO: 3562998 - RNA, 18 nt, Human
uugagauagaagaacugc

SEQ ID NO: 3562999 - RNA, 21 nt, Human
uugagaugcuguaggugguau

SEQ ID NO: 3563000 - RNA, 21 nt, Human
uugagauggagucuugcucug

SEQ ID NO: 3563001 - RNA, 13 nt, Human
uugagauguauga

SEQ ID NO: 3563002 - RNA, 17 nt, Human
uugagauguaugaaggc

SEQ ID NO: 3563003 - RNA, 17 nt, Human
uugagauuagagggagg

SEQ ID NO: 3563004 - RNA, 15 nt, Human
uugagauugccccag

SEQ ID NO: 3563005 - RNA, 11 nt, Human
uugagauuucu

SEQ ID NO: 3563006 - RNA, 21 nt, Human
uugagcacaaaaccuguccua

SEQ ID NO: 3563007 - RNA, 14 nt, Human
uugagcagaauuca

SEQ ID NO: 3563008 - RNA, 18 nt, Human
uugagcagggauccuggu

SEQ ID NO: 3563009 - RNA, 12 nt, Human
uugagcagggcu

SEQ ID NO: 3563010 - RNA, 16 nt, Human
uugagcagggcucagc

SEQ ID NO: 3563011 - RNA, 21 nt, Human
uugagcaguggccuacaaauc

SEQ ID NO: 3563012 - RNA, 19 nt, Human
uugagcaguggcuggucca

SEQ ID NO: 3563013 - RNA, 21 nt, Human
uugagcaugacagccugcagc

SEQ ID NO: 3563014 - RNA, 17 nt, Human
uugagccaggccugggu

SEQ ID NO: 3563015 - RNA, 22 nt, Human
uugagccaggccugggucugug

SEQ ID NO: 3563016 - RNA, 18 nt, Human
uugagccccaaguccuga

SEQ ID NO: 3563017 - RNA, 19 nt, Human
uugagccccaaguccugaa

SEQ ID NO: 3563018 - RNA, 13 nt, Human
uugagcccuggcu

SEQ ID NO: 3563019 - RNA, 15 nt, Human
uugagcccuggcugu

SEQ ID NO: 3563020 - RNA, 15 nt, Human
uugagccugucaaga

SEQ ID NO: 3563021 - RNA, 14 nt, Human
uugagccuugaacu

SEQ ID NO: 3563022 - RNA, 15 nt, Human
uugagccuugaacuu

SEQ ID NO: 3563023 - RNA, 20 nt, Human
uugagcgugaaucuguaucu

SEQ ID NO: 3563024 - RNA, 14 nt, Human
uugagcuaugacuu

SEQ ID NO: 3563025 - RNA, 15 nt, Human
uugagcuaugacuua

SEQ ID NO: 3563026 - RNA, 18 nt, Human
uugagcucucucauuguc

SEQ ID NO: 3563027 - RNA, 19 nt, Human
uugagcucugcagcccagg

SEQ ID NO: 3563028 - RNA, 11 nt, Human
uugagcugccu

SEQ ID NO: 3563029 - RNA, 13 nt, Human
uugagcugccuuc

SEQ ID NO: 3563030 - RNA, 21 nt, Human
uugagcugcuuuuuuugaaac

SEQ ID NO: 3563031 - RNA, 13 nt, Human
uugagcuggccuc

SEQ ID NO: 3563032 - RNA, 12 nt, Human
uugagcuguuuu

SEQ ID NO: 3563033 - RNA, 15 nt, Human
uugagcuuaaucuuu

SEQ ID NO: 3563034 - RNA, 23 nt, Human
uugaggaaagcaagaaucagaga

SEQ ID NO: 3563035 - RNA, 15 nt, Human
uugaggaacuguaca

SEQ ID NO: 3563036 - RNA, 14 nt, Human
uugaggacacugau

SEQ ID NO: 3563037 - RNA, 17 nt, Human
uugaggacuauggaaau

SEQ ID NO: 3563038 - RNA, 13 nt, Human
uugaggacuucuu

SEQ ID NO: 3563039 - RNA, 18 nt, Human
uugaggagcauguuuugu

SEQ ID NO: 3563040 - RNA, 15 nt, Human
uugaggaguuuccua

SEQ ID NO: 3563041 - RNA, 22 nt, Human
uugaggauauauuuucacuuug

SEQ ID NO: 3563042 - RNA, 17 nt, Human
uugaggauuuugaguau

SEQ ID NO: 3563043 - RNA, 13 nt, Human
uugaggcuuugug

SEQ ID NO: 3563044 - RNA, 22 nt, Human
uugagggacaaauuuaaaacaa

SEQ ID NO: 3563045 - RNA, 14 nt, Human
uugagggcugcagu

SEQ ID NO: 3563046 - RNA, 13 nt, Human
uugaggguaggag

SEQ ID NO: 3563047 - RNA, 16 nt, Human
uugaggguugggcugg

SEQ ID NO: 3563048 - RNA, 23 nt, Human
uugagguagaccaggauuucuaa

SEQ ID NO: 3563049 - RNA, 21 nt, Human
uugagguaggagaauugcuug

SEQ ID NO: 3563050 - RNA, 15 nt, Human
uugaggucucagccc

SEQ ID NO: 3563051 - RNA, 16 nt, Human
uugaggucuguucuuu

SEQ ID NO: 3563052 - RNA, 19 nt, Human
uugaggucuuuugacaugu

SEQ ID NO: 3563053 - RNA, 22 nt, Human
uugagguggcacuuuuucauuu

SEQ ID NO: 3563054 - RNA, 21 nt, Human
uugagguggucugaauguucu

SEQ ID NO: 3563055 - RNA, 12 nt, Human
uugaguaauggu

SEQ ID NO: 3563056 - RNA, 16 nt, Human
uugaguaaugguguag

SEQ ID NO: 3563057 - RNA, 20 nt, Human
uugaguagacacauuuaagg

SEQ ID NO: 3563058 - RNA, 15 nt, Human
uugaguauuguuuaa

SEQ ID NO: 3563059 - RNA, 22 nt, Human
uugaguauuguuuaaaauguaa

SEQ ID NO: 3563060 - RNA, 11 nt, Human
uugagucucuu

SEQ ID NO: 3563061 - RNA, 21 nt, Human
uugagucuuuuuuuuuuaagu

SEQ ID NO: 3563062 - RNA, 20 nt, Human
uugagugaagcugggagaac

SEQ ID NO: 3563063 - RNA, 21 nt, Human
uugagugcugucuccauguuu

SEQ ID NO: 3563064 - RNA, 22 nt, Human
uugaguggggggaacgcccacu

SEQ ID NO: 3563065 - RNA, 15 nt, Human
uugaguguaugagua

SEQ ID NO: 3563066 - RNA, 12 nt, Human
uugagugugugu

SEQ ID NO: 3563067 - RNA, 17 nt, Human
uugaguguuuuaagaua

SEQ ID NO: 3563068 - RNA, 16 nt, Human
uugaguuuuauuuauu

SEQ ID NO: 3563069 - RNA, 20 nt, Human
uugaguuuuauuuauuuuau

SEQ ID NO: 3563070 - RNA, 14 nt, Human
uugaguuuucagug

SEQ ID NO: 3563071 - RNA, 18 nt, Human
uugaguuuugacugcuug

SEQ ID NO: 3563072 - RNA, 12 nt, Human
uugaguuuuguu

SEQ ID NO: 3563073 - RNA, 17 nt, Human
uugauaaagauuuuuua

SEQ ID NO: 3563074 - RNA, 13 nt, Human
uugauaaaguuuc

SEQ ID NO: 3563075 - RNA, 13 nt, Human
uugauaaauagug

SEQ ID NO: 3563076 - RNA, 19 nt, Human
uugauaaauuccacuggac

SEQ ID NO: 3563077 - RNA, 21 nt, Human
uugauaaauuccacuggacuu

SEQ ID NO: 3563078 - RNA, 22 nt, Human
uugauaacaaugacacuagaaa

SEQ ID NO: 3563079 - RNA, 14 nt, Human
uugauaacagcacu

SEQ ID NO: 3563080 - RNA, 19 nt, Human
uugauaacagcacugacua

SEQ ID NO: 3563081 - RNA, 14 nt, Human
uugauaacuuugcu

SEQ ID NO: 3563082 - RNA, 22 nt, Human
uugauaagggacugauguuugu

SEQ ID NO: 3563083 - RNA, 11 nt, Human
uugauaauaaa

SEQ ID NO: 3563084 - RNA, 13 nt, Human
uugauaaugauaa

SEQ ID NO: 3563085 - RNA, 13 nt, Human
uugauaauguuaa

SEQ ID NO: 3563086 - RNA, 15 nt, Human
uugauaauguuaaau

SEQ ID NO: 3563087 - RNA, 20 nt, Human
uugauaauguuaaauuugua

SEQ ID NO: 3563088 - RNA, 23 nt, Human
uugauaauugcauucaucuugug

SEQ ID NO: 3563089 - RNA, 13 nt, Human
uugauacauaaua

SEQ ID NO: 3563090 - RNA, 15 nt, Human
uugauacucuuucua

SEQ ID NO: 3563091 - RNA, 16 nt, Human
uugauacuuguucaaa

SEQ ID NO: 3563092 - RNA, 13 nt, Human
uugauacuuguuu

SEQ ID NO: 3563093 - RNA, 18 nt, Human
uugauagcacagacccug

SEQ ID NO: 3563094 - RNA, 20 nt, Human
uugauagcacagacccugcc

SEQ ID NO: 3563095 - RNA, 18 nt, Human
uugauagcugucccaucu

SEQ ID NO: 3563096 - RNA, 19 nt, Human
uugauagggaacuggggaa

SEQ ID NO: 3563097 - RNA, 21 nt, Human
uugauauaauuuccauagugu

SEQ ID NO: 3563098 - RNA, 19 nt, Human
uugauauaccaaauuaaaa

SEQ ID NO: 3563099 - RNA, 21 nt, Human
uugauauacuuuuuucuuauu

SEQ ID NO: 3563100 - RNA, 22 nt, Human
uugauauagaacagugcuugcc

SEQ ID NO: 3563101 - RNA, 23 nt, Human
uugauauauauuauaaauauaua

SEQ ID NO: 3563102 - RNA, 15 nt, Human
uugauaucacagucu

SEQ ID NO: 3563103 - RNA, 23 nt, Human
uugauauccucuuugagugaagc

SEQ ID NO: 3563104 - RNA, 13 nt, Human
uugauaugaaaaa

SEQ ID NO: 3563105 - RNA, 16 nt, Human
uugauaugaguauaca

SEQ ID NO: 3563106 - RNA, 21 nt, Human
uugauauguuuuauuucauug

SEQ ID NO: 3563107 - RNA, 18 nt, Human
uugauauucuaagaaaua

SEQ ID NO: 3563108 - RNA, 22 nt, Human
uugauauucuaagaaauaucug

SEQ ID NO: 3563109 - RNA, 23 nt, Human
uugauauucuaagaaauaucugu

SEQ ID NO: 3563110 - RNA, 13 nt, Human
uugcugcuagaac

SEQ ID NO: 3563111 - RNA, 14 nt, Human
uugcugcuagaacu

SEQ ID NO: 3563112 - RNA, 15 nt, Human
uugcugcuagaacuu

SEQ ID NO: 3563113 - RNA, 17 nt, Human
uugcugcuagaacuuuu

SEQ ID NO: 3563114 - RNA, 21 nt, Human
uugcugcuccuuagcugccaa

SEQ ID NO: 3563115 - RNA, 12 nt, Human
uugcugcucuuc

SEQ ID NO: 3563116 - RNA, 17 nt, Human
uugcugcugauuuaaac

SEQ ID NO: 3563117 - RNA, 16 nt, Human
uugcugcuucucccag

SEQ ID NO: 3563118 - RNA, 14 nt, Human
uugcugcuugaggc

SEQ ID NO: 3563119 - RNA, 21 nt, Human
uugcuggaauaaguucaaauu

SEQ ID NO: 3563120 - RNA, 13 nt, Human
uugcuggccccag

SEQ ID NO: 3563121 - RNA, 17 nt, Human
uugcuggccccagcccu

SEQ ID NO: 3563122 - RNA, 15 nt, Human
uugcugggagcugaa

SEQ ID NO: 3563123 - RNA, 21 nt, Human
uugcugggagcugaaaaauca

SEQ ID NO: 3563124 - RNA, 23 nt, Human
uugcuggggacggggggccccag

SEQ ID NO: 3563125 - RNA, 16 nt, Human
uugcugguaaaaugaa

SEQ ID NO: 3563126 - RNA, 23 nt, Human
uugcugguaaaaugaagaauuua

SEQ ID NO: 3563127 - RNA, 23 nt, Human
uugcuguaccagcccagauguuu

SEQ ID NO: 3563128 - RNA, 16 nt, Human
uugcugucccuuuucc

SEQ ID NO: 3563129 - RNA, 11 nt, Human
uugcuguccua

SEQ ID NO: 3563130 - RNA, 14 nt, Human
uugcugucugcagc

SEQ ID NO: 3563131 - RNA, 20 nt, Human
uugcugugaauuagcucacu

SEQ ID NO: 3563132 - RNA, 19 nt, Human
uugcugugacagugauggc

SEQ ID NO: 3563133 - RNA, 18 nt, Human
uugcugugaggcuguccu

SEQ ID NO: 3563134 - RNA, 19 nt, Human
uugcugugccucccaaaau

SEQ ID NO: 3563135 - RNA, 13 nt, Human
uugcugugggaac

SEQ ID NO: 3563136 - RNA, 15 nt, Human
uugcugugggaacga

SEQ ID NO: 3563137 - RNA, 15 nt, Human
uugcuguguuuaauu

SEQ ID NO: 3563138 - RNA, 22 nt, Human
uugcuguuaugucuguuuaaga

SEQ ID NO: 3563139 - RNA, 15 nt, Human
uugcuguugaaagca

SEQ ID NO: 3563140 - RNA, 17 nt, Human
uugcuguugaaagcaaa

SEQ ID NO: 3563141 - RNA, 21 nt, Human
uugcuguugaaagcaaaaaug

SEQ ID NO: 3563142 - RNA, 23 nt, Human
uugcuguugaaagcaaaaaugcu

SEQ ID NO: 3563143 - RNA, 12 nt, Human
uugcuguugaca

SEQ ID NO: 3563144 - RNA, 19 nt, Human
uugcuguuguuucuaaaca

SEQ ID NO: 3563145 - RNA, 22 nt, Human
uugcuguuuuccucccuucugc

SEQ ID NO: 3563146 - RNA, 21 nt, Human
uugcuguuuuguucugugguu

SEQ ID NO: 3563147 - RNA, 13 nt, Human
uugcuuaaaugug

SEQ ID NO: 3563148 - RNA, 14 nt, Human
uugcuuaaauuucu

SEQ ID NO: 3563149 - RNA, 14 nt, Human
uugcuuacaauuuu

SEQ ID NO: 3563150 - RNA, 14 nt, Human
uugcuuaccucuca

SEQ ID NO: 3563151 - RNA, 24 nt, Human
uugcuuaggauguuuuucaugaaa

SEQ ID NO: 3563152 - RNA, 19 nt, Human
uugcuuaucaacuuccuaa

SEQ ID NO: 3563153 - RNA, 15 nt, Human
uugcuuauuguucca

SEQ ID NO: 3563154 - RNA, 16 nt, Human
uugcuuauuuaauaaa

SEQ ID NO: 3563155 - RNA, 20 nt, Human
uugcuuauuuauuguauucu

SEQ ID NO: 3563156 - RNA, 14 nt, Human
uugcuuccuccucc

SEQ ID NO: 3563157 - RNA, 15 nt, Human
uugcuuccuccuccc

SEQ ID NO: 3563158 - RNA, 15 nt, Human
uugcuucugggaagg

SEQ ID NO: 3563159 - RNA, 19 nt, Human
uugcuucugggaagggguu

SEQ ID NO: 3563160 - RNA, 18 nt, Human
uugcuucuuacugauaau

SEQ ID NO: 3563161 - RNA, 13 nt, Human
uugcuucuucuga

SEQ ID NO: 3563162 - RNA, 21 nt, Human
uugcuucuugugaaggccaug

SEQ ID NO: 3563163 - RNA, 13 nt, Human
uugcuugaacaca

SEQ ID NO: 3563164 - RNA, 15 nt, Human
uugcuugaacacagu

SEQ ID NO: 3563165 - RNA, 17 nt, Human
uugcuugaacacaguau

SEQ ID NO: 3563166 - RNA, 21 nt, Human
uugcuugaagcaaacaguuga

SEQ ID NO: 3563167 - RNA, 16 nt, Human
uugcuugagcccagga

SEQ ID NO: 3563168 - RNA, 18 nt, Human
uugcuugagcccaggagu

SEQ ID NO: 3563169 - RNA, 11 nt, Human
uugcuugccuc

SEQ ID NO: 3563170 - RNA, 16 nt, Human
uugcuugccugauaua

SEQ ID NO: 3563171 - RNA, 19 nt, Human
uugcuugccugcagggcca

SEQ ID NO: 3563172 - RNA, 14 nt, Human
uugcuuggcugcuu

SEQ ID NO: 3563173 - RNA, 14 nt, Human
uugcuugggaaggg

SEQ ID NO: 3563174 - RNA, 15 nt, Human
uugcuugggaagggg

SEQ ID NO: 3563175 - RNA, 13 nt, Human
uugcuuguuacau

SEQ ID NO: 3563176 - RNA, 14 nt, Human
uugcuuuaauauaa

SEQ ID NO: 3563177 - RNA, 17 nt, Human
uugcuuuaauauaaaug

SEQ ID NO: 3563178 - RNA, 21 nt, Human
uugcuuuaauauaaaugcaaa

SEQ ID NO: 3563179 - RNA, 22 nt, Human
uugcuuuaauauaaaugcaaau

SEQ ID NO: 3563180 - RNA, 23 nt, Human
uugcuuuaauauaaaugcaaaua

SEQ ID NO: 3563181 - RNA, 21 nt, Human
uugcuuuaauuccaugaaugu

SEQ ID NO: 3563182 - RNA, 16 nt, Human
uugcuuuaauuguuaa

SEQ ID NO: 3563183 - RNA, 18 nt, Human
uugcuuuaauuguuaaga

SEQ ID NO: 3563184 - RNA, 12 nt, Human
uugcuuuaauuu

SEQ ID NO: 3563185 - RNA, 15 nt, Human
uugcuuuacugucaa

SEQ ID NO: 3563186 - RNA, 16 nt, Human
uugcuuuacugucaaa

SEQ ID NO: 3563187 - RNA, 15 nt, Human
uugcuuucugaaauu

SEQ ID NO: 3563188 - RNA, 22 nt, Human
uugcuuugaagcaguuguguca

SEQ ID NO: 3563189 - RNA, 17 nt, Human
uugcuuuggaaguuuua

SEQ ID NO: 3563190 - RNA, 13 nt, Human
uugcuuuguaugc

SEQ ID NO: 3563191 - RNA, 16 nt, Human
uugcuuuguaugcacu

SEQ ID NO: 3563192 - RNA, 20 nt, Human
uugcuuuguauuguauauua

SEQ ID NO: 3563193 - RNA, 20 nt, Human
uugcuuugugauuuuuguaa

SEQ ID NO: 3563194 - RNA, 12 nt, Human
uugcuuuuaauu

SEQ ID NO: 3563195 - RNA, 15 nt, Human
uugcuuuuauuuuga

SEQ ID NO: 3563196 - RNA, 18 nt, Human
uugcuuuucaugcaaacu

SEQ ID NO: 3563197 - RNA, 15 nt, Human
uugcuuuucccucuu

SEQ ID NO: 3563198 - RNA, 14 nt, Human
uugcuuuugagaga

SEQ ID NO: 3563199 - RNA, 13 nt, Human
uugcuuuugcuuc

SEQ ID NO: 3563200 - RNA, 13 nt, Human
uugcuuuugugaa

SEQ ID NO: 3563201 - RNA, 12 nt, Human
uugcuuuugugc

SEQ ID NO: 3563202 - RNA, 15 nt, Human
uugcuuuuuuaaaua

SEQ ID NO: 3563203 - RNA, 13 nt, Human
uugcuuuuuugua

SEQ ID NO: 3563204 - RNA, 14 nt, Human
uuggaaaagaauac

SEQ ID NO: 3563205 - RNA, 15 nt, Human
uuggaaaaugcauug

SEQ ID NO: 3563206 - RNA, 17 nt, Human
uuggaaacacuaaaugu

SEQ ID NO: 3563207 - RNA, 14 nt, Human
uuggaaacuaauaa

SEQ ID NO: 3563208 - RNA, 22 nt, Human
uuggaaacuaauaaaauauuuu

SEQ ID NO: 3563209 - RNA, 17 nt, Human
uuggaaagaguaggaag

SEQ ID NO: 3563210 - RNA, 13 nt, Human
uuggaaagcaggu

SEQ ID NO: 3563211 - RNA, 12 nt, Human
uuggaaagucag

SEQ ID NO: 3563212 - RNA, 14 nt, Human
uuggaaauacugua

SEQ ID NO: 3563213 - RNA, 23 nt, Human
uuggaaauagaaauuuccagaga

SEQ ID NO: 3563214 - RNA, 18 nt, Human
uuggaaaucaaauguaaa

SEQ ID NO: 3563215 - RNA, 19 nt, Human
uuggaaauccuaguuuccu

SEQ ID NO: 3563216 - RNA, 12 nt, Human
uuggaaaucuuu

SEQ ID NO: 3563217 - RNA, 18 nt, Human
uuggaaauuccuguacug

SEQ ID NO: 3563218 - RNA, 16 nt, Human
uuggaaauuuagcauu

SEQ ID NO: 3563219 - RNA, 13 nt, Human
uuggaacagaaug

SEQ ID NO: 3563220 - RNA, 14 nt, Human
uuggaacagaaugu

SEQ ID NO: 3563221 - RNA, 22 nt, Human
uuggaacauuggaauguucuca

SEQ ID NO: 3563222 - RNA, 14 nt, Human
uuggaaccuuguuu

SEQ ID NO: 3563223 - RNA, 17 nt, Human
uuggaacugaagggggc

SEQ ID NO: 3563224 - RNA, 22 nt, Human
uuggaacuugccugccuuucca

SEQ ID NO: 3563225 - RNA, 19 nt, Human
uuggaagaaaaaaaucuuc

SEQ ID NO: 3563226 - RNA, 16 nt, Human
uuggaagaaaaaaucu

SEQ ID NO: 3563227 - RNA, 16 nt, Human
uuggaagagcagcacc

SEQ ID NO: 3563228 - RNA, 19 nt, Human
uuggaagauccugugagga

SEQ ID NO: 3563229 - RNA, 19 nt, Human
uuggaagauuuucagucua

SEQ ID NO: 3563230 - RNA, 19 nt, Human
uuggaagcagguuaaaugu

SEQ ID NO: 3563231 - RNA, 22 nt, Human
uuggaagcuagcuccccuccuc

SEQ ID NO: 3563232 - RNA, 21 nt, Human
uuggaaggagacacagauguu

SEQ ID NO: 3563233 - RNA, 15 nt, Human
uuggaaguacaugaa

SEQ ID NO: 3563234 - RNA, 13 nt, Human
uuggaaguuucau

SEQ ID NO: 3563235 - RNA, 16 nt, Human
uuggaauauuaaaaaa

SEQ ID NO: 3563236 - RNA, 23 nt, Human
uuggaauauuguccauuguccaa

SEQ ID NO: 3563237 - RNA, 21 nt, Human
uuggaaucuagaagaaaugaa

SEQ ID NO: 3563238 - RNA, 22 nt, Human
uuggaaucuagaagaaaugaaa

SEQ ID NO: 3563239 - RNA, 21 nt, Human
uuggaaugcacucagacugua

SEQ ID NO: 3563240 - RNA, 21 nt, Human
uuggaauucuguucauuuguu

SEQ ID NO: 3563241 - RNA, 13 nt, Human
uuggaauuuacca

SEQ ID NO: 3563242 - RNA, 21 nt, Human
uuggaauuuguaaccucagcu

SEQ ID NO: 3563243 - RNA, 18 nt, Human
uuggacaaaauggaauac

SEQ ID NO: 3563244 - RNA, 20 nt, Human
uuggacaaaucacauauuuu

SEQ ID NO: 3563245 - RNA, 15 nt, Human
uuggacaaaugugaa

SEQ ID NO: 3563246 - RNA, 17 nt, Human
uuggacaaaugugaaga

SEQ ID NO: 3563247 - RNA, 19 nt, Human
uuggacaaaugugaagaug

SEQ ID NO: 3563248 - RNA, 15 nt, Human
uuggacacacacagc

SEQ ID NO: 3563249 - RNA, 19 nt, Human
uuggacaccuuuagguucu

SEQ ID NO: 3563250 - RNA, 14 nt, Human
uuggacacgcucag

SEQ ID NO: 3563251 - RNA, 16 nt, Human
uuggacagaagcagcu

SEQ ID NO: 3563252 - RNA, 13 nt, Human
uuggacagcaaaa

SEQ ID NO: 3563253 - RNA, 14 nt, Human
uuggacagcaaaac

SEQ ID NO: 3563254 - RNA, 23 nt, Human
uuggacagcaaaaccauugcuuc

SEQ ID NO: 3563255 - RNA, 21 nt, Human
uuggacauaacugacuuaguu

SEQ ID NO: 3563256 - RNA, 16 nt, Human
uuggacauagauauuu

SEQ ID NO: 3563257 - RNA, 17 nt, Human
uuggacauagauauuuu

SEQ ID NO: 3563258 - RNA, 20 nt, Human
uuggacauuuuaugucuuuc

SEQ ID NO: 3563259 - RNA, 19 nt, Human
uuggacccaaggaaaacug

SEQ ID NO: 3563260 - RNA, 15 nt, Human
uuggacccugaggcc

SEQ ID NO: 3563261 - RNA, 19 nt, Human
uuguuucuuucucugagga

SEQ ID NO: 3563262 - RNA, 13 nt, Human
uuguuucuuugug

SEQ ID NO: 3563263 - RNA, 13 nt, Human
uuguuucuuuuaa

SEQ ID NO: 3563264 - RNA, 13 nt, Human
uuguuugccagga

SEQ ID NO: 3563265 - RNA, 15 nt, Human
uuguuugccauacuu

SEQ ID NO: 3563266 - RNA, 16 nt, Human
uuguuugccauacuuu

SEQ ID NO: 3563267 - RNA, 21 nt, Human
uuguuuggaccaaaaaccagu

SEQ ID NO: 3563268 - RNA, 23 nt, Human
uuguuuggaucaaaaucuguaga

SEQ ID NO: 3563269 - RNA, 16 nt, Human
uuguuuggauguaauu

SEQ ID NO: 3563270 - RNA, 17 nt, Human
uuguuuggcaaggaaag

SEQ ID NO: 3563271 - RNA, 17 nt, Human
uuguuuggggcaggagu

SEQ ID NO: 3563272 - RNA, 16 nt, Human
uuguuugguauuguau

SEQ ID NO: 3563273 - RNA, 13 nt, Human
uuguuugguuaua

SEQ ID NO: 3563274 - RNA, 21 nt, Human
uuguuugguuauagugcaaua

SEQ ID NO: 3563275 - RNA, 19 nt, Human
uuguuuguauguauaauuc

SEQ ID NO: 3563276 - RNA, 22 nt, Human
uuguuuguauguauaauucaaa

SEQ ID NO: 3563277 - RNA, 13 nt, Human
uuguuuguuuagu

SEQ ID NO: 3563278 - RNA, 12 nt, Human
uuguuuguuuca

SEQ ID NO: 3563279 - RNA, 14 nt, Human
uuguuuuaaaacug

SEQ ID NO: 3563280 - RNA, 20 nt, Human
uuguuuuaaaauuaaagcua

SEQ ID NO: 3563281 - RNA, 16 nt, Human
uuguuuuaaggaagaa

SEQ ID NO: 3563282 - RNA, 14 nt, Human
uuguuuuaaucuga

SEQ ID NO: 3563283 - RNA, 12 nt, Human
uuguuuuacaau

SEQ ID NO: 3563284 - RNA, 18 nt, Human
uuguuuucugacuaauua

SEQ ID NO: 3563285 - RNA, 18 nt, Human
uuguuuucuucuguaugu

SEQ ID NO: 3563286 - RNA, 15 nt, Human
uuguuuugcacuuuu

SEQ ID NO: 3563287 - RNA, 14 nt, Human
uuguuuugcuuuuu

SEQ ID NO: 3563288 - RNA, 15 nt, Human
uuguuuugcuuuuuc

SEQ ID NO: 3563289 - RNA, 14 nt, Human
uuguuuuggaugcc

SEQ ID NO: 3563290 - RNA, 13 nt, Human
uuguuuuguauug

SEQ ID NO: 3563291 - RNA, 21 nt, Human
uuguuuuguugcacugaaguu

SEQ ID NO: 3563292 - RNA, 14 nt, Human
uuguuuuuaaacug

SEQ ID NO: 3563293 - RNA, 16 nt, Human
uuguuuuuaaacugua

SEQ ID NO: 3563294 - RNA, 19 nt, Human
uuguuuuuaaguuugcacu

SEQ ID NO: 3563295 - RNA, 13 nt, Human
uuguuuuucauuc

SEQ ID NO: 3563296 - RNA, 13 nt, Human
uuguuuuucucac

SEQ ID NO: 3563297 - RNA, 15 nt, Human
uuguuuuuguauauu

SEQ ID NO: 3563298 - RNA, 12 nt, Human
uuguuuuuuauc

SEQ ID NO: 3563299 - RNA, 17 nt, Human
uuguuuuuucaaaauag

SEQ ID NO: 3563300 - RNA, 16 nt, Human
uuguuuuuugaagugu

SEQ ID NO: 3563301 - RNA, 12 nt, Human
uuguuuuuugag

SEQ ID NO: 3563302 - RNA, 22 nt, Human
uuuaaaaaaaauccuucuaauc

SEQ ID NO: 3563303 - RNA, 13 nt, Human
uuuaaaaaaagaa

SEQ ID NO: 3563304 - RNA, 19 nt, Human
uuuaaaaaaauaaaacauu

SEQ ID NO: 3563305 - RNA, 18 nt, Human
uuuaaaaaaauuccaagu

SEQ ID NO: 3563306 - RNA, 18 nt, Human
uuuaaaaaaauuuaagug

SEQ ID NO: 3563307 - RNA, 23 nt, Human
uuuaaaaaaccacauggcacaga

SEQ ID NO: 3563308 - RNA, 14 nt, Human
uuuaaaaaacuaaa

SEQ ID NO: 3563309 - RNA, 14 nt, Human
uuuaaaaaagcuua

SEQ ID NO: 3563310 - RNA, 17 nt, Human
uuuaaaaaagcuuaaaa

SEQ ID NO: 3563311 - RNA, 13 nt, Human
uuuaaaaaaguuu

SEQ ID NO: 3563312 - RNA, 18 nt, Human
uuuaaaaaaguuuaaaau

SEQ ID NO: 3563313 - RNA, 19 nt, Human
uuuaaaaaauauuuauuaa

SEQ ID NO: 3563314 - RNA, 16 nt, Human
uuuaaaaaauggucac

SEQ ID NO: 3563315 - RNA, 21 nt, Human
uuuaaaaaauuaaucugggcc

SEQ ID NO: 3563316 - RNA, 18 nt, Human
uuuaaaaacauagaaaaa

SEQ ID NO: 3563317 - RNA, 23 nt, Human
uuuaaaaacuauuuaacuugagc

SEQ ID NO: 3563318 - RNA, 13 nt, Human
uuuaaaaacugga

SEQ ID NO: 3563319 - RNA, 21 nt, Human
uuuaaaaagaaacaagaugcu

SEQ ID NO: 3563320 - RNA, 19 nt, Human
uuuaaaaagggaagaaacu

SEQ ID NO: 3563321 - RNA, 13 nt, Human
uuuaaaaaguauu

SEQ ID NO: 3563322 - RNA, 11 nt, Human
uuuaaaaauaa

SEQ ID NO: 3563323 - RNA, 22 nt, Human
uuuaaaaauaagucaacaguaa

SEQ ID NO: 3563324 - RNA, 23 nt, Human
uuuaaaaauacagauagauauau

SEQ ID NO: 3563325 - RNA, 16 nt, Human
uuuaaaaauagaaaca

SEQ ID NO: 3563326 - RNA, 19 nt, Human
uuuaaaaaucauaaacugu

SEQ ID NO: 3563327 - RNA, 14 nt, Human
uuuaaaaaugaaau

SEQ ID NO: 3563328 - RNA, 22 nt, Human
uuuaaaaaugguaucaaaauua

SEQ ID NO: 3563329 - RNA, 14 nt, Human
uuuaaaaaugucuu

SEQ ID NO: 3563330 - RNA, 15 nt, Human
uuuaaaaauuguuau

SEQ ID NO: 3563331 - RNA, 15 nt, Human
uuuaaaacaagaaag

SEQ ID NO: 3563332 - RNA, 20 nt, Human
uuuaaaacaagaaaguuucc

SEQ ID NO: 3563333 - RNA, 21 nt, Human
uuuaaaacaagaaaguuuccc

SEQ ID NO: 3563334 - RNA, 16 nt, Human
uuuaaaacauguaaua

SEQ ID NO: 3563335 - RNA, 16 nt, Human
uuuaaaacuacuuagc

SEQ ID NO: 3563336 - RNA, 20 nt, Human
uuuaaaacuaguuagauuca

SEQ ID NO: 3563337 - RNA, 16 nt, Human
uuuaaaagaaauuuau

SEQ ID NO: 3563338 - RNA, 14 nt, Human
uuuaaaagaaugau

SEQ ID NO: 3563339 - RNA, 21 nt, Human
uuuaaaagagagagagagaaa

SEQ ID NO: 3563340 - RNA, 20 nt, Human
uuuaaaagauaaauauuaua

SEQ ID NO: 3563341 - RNA, 13 nt, Human
uuuaaaagaugcu

SEQ ID NO: 3563342 - RNA, 14 nt, Human
uuuaaaagcauuuu

SEQ ID NO: 3563343 - RNA, 15 nt, Human
uuuaaaagcauuuuu

SEQ ID NO: 3563344 - RNA, 20 nt, Human
uuuaaaagcccuuuccaaag

SEQ ID NO: 3563345 - RNA, 13 nt, Human
uuuaaaagccugc

SEQ ID NO: 3563346 - RNA, 20 nt, Human
uuuaaaagguauuuugaaua

SEQ ID NO: 3563347 - RNA, 23 nt, Human
uuuaaaagugccauuaacaaaug

SEQ ID NO: 3563348 - RNA, 15 nt, Human
uuuaaaauaaaauga

SEQ ID NO: 3563349 - RNA, 19 nt, Human
uuuaaaauaaaaugaaaau

SEQ ID NO: 3563350 - RNA, 13 nt, Human
uuuaaaauaaacu

SEQ ID NO: 3563351 - RNA, 12 nt, Human
uuuaaaauacug

SEQ ID NO: 3563352 - RNA, 22 nt, Human
uuuaaaauagaaauuuuguaag

SEQ ID NO: 3563353 - RNA, 12 nt, Human
uuuaaaauagca

SEQ ID NO: 3563354 - RNA, 20 nt, Human
uuuaaaauagcguucuugua

SEQ ID NO: 3563355 - RNA, 13 nt, Human
uuuaaaaucacua

SEQ ID NO: 3563356 - RNA, 19 nt, Human
uuuaaaaucacuaacauua

SEQ ID NO: 3563357 - RNA, 20 nt, Human
uuuaaaaucuccuaaaugcu

SEQ ID NO: 3563358 - RNA, 16 nt, Human
uuuaaaaucuuauuaa

SEQ ID NO: 3563359 - RNA, 21 nt, Human
uuuaaaaucuuauuaaaguuu

SEQ ID NO: 3563360 - RNA, 22 nt, Human
uuuaaaaucuuauuaaaguuuc

SEQ ID NO: 3563361 - RNA, 14 nt, Human
uuuaaaaugauuag

SEQ ID NO: 3563362 - RNA, 17 nt, Human
uuuaaaauguaaagcca

SEQ ID NO: 3563363 - RNA, 18 nt, Human
uuuaaaauguaaagccau

SEQ ID NO: 3563364 - RNA, 13 nt, Human
uuuaaaauguaca

SEQ ID NO: 3563365 - RNA, 20 nt, Human
uuuaaaauguacauguauua

SEQ ID NO: 3563366 - RNA, 12 nt, Human
uuuaaaauguau

SEQ ID NO: 3563367 - RNA, 20 nt, Human
uuuaaaauguauaaguugag

SEQ ID NO: 3563368 - RNA, 12 nt, Human
uuuaaaauuugu

SEQ ID NO: 3563369 - RNA, 16 nt, Human
uuuaaaauuuguucuu

SEQ ID NO: 3563370 - RNA, 17 nt, Human
uuuaaaauuuuguaugu

SEQ ID NO: 3563371 - RNA, 18 nt, Human
uuuaaaauuuuuuuagaa

SEQ ID NO: 3563372 - RNA, 19 nt, Human
uuuaaaauuuuuuuagaaa

SEQ ID NO: 3563373 - RNA, 17 nt, Human
uuuaaacaaacauugug

SEQ ID NO: 3563374 - RNA, 14 nt, Human
uuuaaacaaauuca

SEQ ID NO: 3563375 - RNA, 15 nt, Human
uuuaaacaaguauuu

SEQ ID NO: 3563376 - RNA, 23 nt, Human
uuuaaacagauguccaucagaug

SEQ ID NO: 3563377 - RNA, 21 nt, Human
uuuaaacaggcccagcauugc

SEQ ID NO: 3563378 - RNA, 12 nt, Human
uuuaaacauauc

SEQ ID NO: 3563379 - RNA, 20 nt, Human
uuuaaacaugguuacaauca

SEQ ID NO: 3563380 - RNA, 16 nt, Human
uuuaaacauuaaaaau

SEQ ID NO: 3563381 - RNA, 15 nt, Human
uuuaaacauuaauag

SEQ ID NO: 3563382 - RNA, 19 nt, Human
uuuaaacauuaauagcagc

SEQ ID NO: 3563383 - RNA, 15 nt, Human
uuuaaacccauuuua

SEQ ID NO: 3563384 - RNA, 15 nt, Human
uuuaaacuacauuag

SEQ ID NO: 3563385 - RNA, 21 nt, Human
uuuaaacuagaugaccucauu

SEQ ID NO: 3563386 - RNA, 15 nt, Human
uuuaaacuauaagca

SEQ ID NO: 3563387 - RNA, 15 nt, Human
uuuaaacuguacagu

SEQ ID NO: 3563388 - RNA, 16 nt, Human
uuuaaacuguacagug

SEQ ID NO: 3563389 - RNA, 15 nt, Human
uuuaaacugucgugu

SEQ ID NO: 3563390 - RNA, 21 nt, Human
uuuaaacuguguacauaacug

SEQ ID NO: 3563391 - RNA, 11 nt, Human
uuuaaacuuuc

SEQ ID NO: 3563392 - RNA, 20 nt, Human
uuuaaagaaaaaaaugucaa

SEQ ID NO: 3563393 - RNA, 19 nt, Human
uuuaaagaaaaaaauugaa

SEQ ID NO: 3563394 - RNA, 17 nt, Human
uuuaaagaaaagaugaa

SEQ ID NO: 3563395 - RNA, 21 nt, Human
uuuaaagaaaagaugaaaggc

SEQ ID NO: 3563396 - RNA, 14 nt, Human
uuuaaagaaagugu

SEQ ID NO: 3563397 - RNA, 18 nt, Human
uuuaaagaagaaacgucu

SEQ ID NO: 3563398 - RNA, 18 nt, Human
uuuaaagaauaugacuuu

SEQ ID NO: 3563399 - RNA, 16 nt, Human
uuuaaugugaacuugu

SEQ ID NO: 3563400 - RNA, 21 nt, Human
uuuaaugugaacuuguagcug

SEQ ID NO: 3563401 - RNA, 21 nt, Human
uuuaaugugaugauguaauug

SEQ ID NO: 3563402 - RNA, 22 nt, Human
uuuaaugugaugauguaauuga

SEQ ID NO: 3563403 - RNA, 15 nt, Human
uuuaaugugcugugu

SEQ ID NO: 3563404 - RNA, 19 nt, Human
uuuaaugugcuguguaaag

SEQ ID NO: 3563405 - RNA, 21 nt, Human
uuuaaugugcuguguaaaguu

SEQ ID NO: 3563406 - RNA, 18 nt, Human
uuuaauguugaacaaaau

SEQ ID NO: 3563407 - RNA, 20 nt, Human
uuuaauuaaaaacuaguagu

SEQ ID NO: 3563408 - RNA, 20 nt, Human
uuuaauuaaaugcucaucug

SEQ ID NO: 3563409 - RNA, 22 nt, Human
uuuaauuaaucaugaaugugua

SEQ ID NO: 3563410 - RNA, 17 nt, Human
uuuaauuaaugaaauau

SEQ ID NO: 3563411 - RNA, 14 nt, Human
uuuaauuaauuggg

SEQ ID NO: 3563412 - RNA, 20 nt, Human
uuuaauuagugcuaagugug

SEQ ID NO: 3563413 - RNA, 21 nt, Human
uuuaauuagugcuaaguguga

SEQ ID NO: 3563414 - RNA, 13 nt, Human
uuuaauuauuguu

SEQ ID NO: 3563415 - RNA, 12 nt, Human
uuuaauucaguu

SEQ ID NO: 3563416 - RNA, 23 nt, Human
uuuaauucaucccaacugucuuu

SEQ ID NO: 3563417 - RNA, 14 nt, Human
uuuaauucauguuu

SEQ ID NO: 3563418 - RNA, 11 nt, Human
uuuaauuccau

SEQ ID NO: 3563419 - RNA, 17 nt, Human
uuuaauuccaugaaugu

SEQ ID NO: 3563420 - RNA, 21 nt, Human
uuuaauugaaagaauguaaag

SEQ ID NO: 3563421 - RNA, 19 nt, Human
uuuaauuguaaacuguacu

SEQ ID NO: 3563422 - RNA, 13 nt, Human
uuuaauuguauuu

SEQ ID NO: 3563423 - RNA, 20 nt, Human
uuuaauuguccaguuugucu

SEQ ID NO: 3563424 - RNA, 16 nt, Human
uuuaauuguuguuucu

SEQ ID NO: 3563425 - RNA, 18 nt, Human
uuuaauuguuguuucuuu

SEQ ID NO: 3563426 - RNA, 23 nt, Human
uuuaauuguuguuucuuucuagu

SEQ ID NO: 3563427 - RNA, 13 nt, Human
uuuaauuuaaagc

SEQ ID NO: 3563428 - RNA, 18 nt, Human
uuuaauuuaguaaaccaa

SEQ ID NO: 3563429 - RNA, 18 nt, Human
uuuaauuuaguaaauguu

SEQ ID NO: 3563430 - RNA, 16 nt, Human
uuuaauuuaugaguuu

SEQ ID NO: 3563431 - RNA, 14 nt, Human
uuuaauuuauguaa

SEQ ID NO: 3563432 - RNA, 21 nt, Human
uuuaauuuauuaauugcuuug

SEQ ID NO: 3563433 - RNA, 22 nt, Human
uuuaauuuauuaauugcuuuga

SEQ ID NO: 3563434 - RNA, 13 nt, Human
uuuaauuucaagc

SEQ ID NO: 3563435 - RNA, 22 nt, Human
uuuaauuugaagguagaauguu

SEQ ID NO: 3563436 - RNA, 21 nt, Human
uuuaauuugauaucacagucu

SEQ ID NO: 3563437 - RNA, 18 nt, Human
uuuaauuugaugaaagcu

SEQ ID NO: 3563438 - RNA, 22 nt, Human
uuuaauuugaugaaagcugauu

SEQ ID NO: 3563439 - RNA, 17 nt, Human
uuuaauuuuggaauuuu

SEQ ID NO: 3563440 - RNA, 15 nt, Human
uuuaauuuuguauuu

SEQ ID NO: 3563441 - RNA, 17 nt, Human
uuuaauuuuuaaaugca

SEQ ID NO: 3563442 - RNA, 17 nt, Human
uuuaauuuuuuaaauaa

SEQ ID NO: 3563443 - RNA, 13 nt, Human
uuuacaaaaagac

SEQ ID NO: 3563444 - RNA, 17 nt, Human
uuuacaaacaaaagcau

SEQ ID NO: 3563445 - RNA, 13 nt, Human
uuuacaaacugaa

SEQ ID NO: 3563446 - RNA, 14 nt, Human
uuuacaaacugaag

SEQ ID NO: 3563447 - RNA, 21 nt, Human
uuuacaagaaaaaaugaauuu

SEQ ID NO: 3563448 - RNA, 21 nt, Human
uuuacaagaaguuuauucuca

SEQ ID NO: 3563449 - RNA, 15 nt, Human
uuuacaaguguauau

SEQ ID NO: 3563450 - RNA, 19 nt, Human
uuuacaauguaauuauuua

SEQ ID NO: 3563451 - RNA, 15 nt, Human
uuuacaauguauuaa

SEQ ID NO: 3563452 - RNA, 23 nt, Human
uuuacaauuguaaaacugaggca

SEQ ID NO: 3563453 - RNA, 19 nt, Human
uuuacaauuuuuuaucaug

SEQ ID NO: 3563454 - RNA, 18 nt, Human
uuuacacaauagaauuau

SEQ ID NO: 3563455 - RNA, 14 nt, Human
uuuacacaauucuu

SEQ ID NO: 3563456 - RNA, 15 nt, Human
uuuacacaauucuua

SEQ ID NO: 3563457 - RNA, 21 nt, Human
uuuacacacgugcaauuuguu

SEQ ID NO: 3563458 - RNA, 12 nt, Human
uuuacacagaaa

SEQ ID NO: 3563459 - RNA, 14 nt, Human
uuuacacagaaaca

SEQ ID NO: 3563460 - RNA, 20 nt, Human
uuuacacagaaacacugccu

SEQ ID NO: 3563461 - RNA, 21 nt, Human
uuuacaccaguuccuuucaau

SEQ ID NO: 3563462 - RNA, 15 nt, Human
uuuacacgcuuuugu

SEQ ID NO: 3563463 - RNA, 17 nt, Human
uuuacacgcuuuuguga

SEQ ID NO: 3563464 - RNA, 15 nt, Human
uuuacacuuuugaga

SEQ ID NO: 3563465 - RNA, 11 nt, Human
uuuacagaaaa

SEQ ID NO: 3563466 - RNA, 16 nt, Human
uuuacagaaaaaucuu

SEQ ID NO: 3563467 - RNA, 13 nt, Human
uuuacagaaaugg

SEQ ID NO: 3563468 - RNA, 14 nt, Human
uuuacagaauugcu

SEQ ID NO: 3563469 - RNA, 20 nt, Human
uuuacagccucacuugaaug

SEQ ID NO: 3563470 - RNA, 22 nt, Human
uuuacagcucugacuuuacacu

SEQ ID NO: 3563471 - RNA, 13 nt, Human
uuuacagcugccu

SEQ ID NO: 3563472 - RNA, 15 nt, Human
uuuacagcugccugc

SEQ ID NO: 3563473 - RNA, 16 nt, Human
uuuacagcugccugca

SEQ ID NO: 3563474 - RNA, 16 nt, Human
uuuacagcuuuacaca

SEQ ID NO: 3563475 - RNA, 20 nt, Human
uuuacagcuuucaugauuag

SEQ ID NO: 3563476 - RNA, 18 nt, Human
uuuacagggagccuccug

SEQ ID NO: 3563477 - RNA, 20 nt, Human
uuuacagggagccuccugcc

SEQ ID NO: 3563478 - RNA, 22 nt, Human
uuuacaguaucuacuugcaugu

SEQ ID NO: 3563479 - RNA, 17 nt, Human
uuuacagugaagaaagc

SEQ ID NO: 3563480 - RNA, 16 nt, Human
uuuauaaguucacaaa

SEQ ID NO: 3563481 - RNA, 18 nt, Human
uuuauaaguucacaaaau

SEQ ID NO: 3563482 - RNA, 19 nt, Human
uuuauaauaaaaauauauu

SEQ ID NO: 3563483 - RNA, 18 nt, Human
uuuauaauagcaacuuuu

SEQ ID NO: 3563484 - RNA, 19 nt, Human
uuuauaauucaguauguuu

SEQ ID NO: 3563485 - RNA, 20 nt, Human
uuuauaauucucauuaaaag

SEQ ID NO: 3563486 - RNA, 15 nt, Human
uuuauaauuuuaaga

SEQ ID NO: 3563487 - RNA, 22 nt, Human
uuuauaauuuuaagauuccuuu

SEQ ID NO: 3563488 - RNA, 16 nt, Human
uuuauaauuuucugaa

SEQ ID NO: 3563489 - RNA, 15 nt, Human
uuuauacaaauuaga

SEQ ID NO: 3563490 - RNA, 16 nt, Human
uuuauacaacagugcu

SEQ ID NO: 3563491 - RNA, 17 nt, Human
uuuauacaacagugcua

SEQ ID NO: 3563492 - RNA, 23 nt, Human
uuuauacaacagugcuaaaaaug

SEQ ID NO: 3563493 - RNA, 12 nt, Human
uuuauacacaua

SEQ ID NO: 3563494 - RNA, 15 nt, Human
uuuauacaggggaau

SEQ ID NO: 3563495 - RNA, 17 nt, Human
uuuauacaggggaauau

SEQ ID NO: 3563496 - RNA, 13 nt, Human
uuuauacauuagu

SEQ ID NO: 3563497 - RNA, 22 nt, Human
uuuauaccucaauuuucacugu

SEQ ID NO: 3563498 - RNA, 15 nt, Human
uuuauacguguagcu

SEQ ID NO: 3563499 - RNA, 19 nt, Human
uuuauacuccaguguacau

SEQ ID NO: 3563500 - RNA, 16 nt, Human
uuuauacugaaggaaa

SEQ ID NO: 3563501 - RNA, 20 nt, Human
uuuauacugauuaugucuuu

SEQ ID NO: 3563502 - RNA, 13 nt, Human
uuuauacuguaua

SEQ ID NO: 3563503 - RNA, 18 nt, Human
uuuauagcaacaacaauu

SEQ ID NO: 3563504 - RNA, 18 nt, Human
uuuauaggugagaaaaaa

SEQ ID NO: 3563505 - RNA, 18 nt, Human
uuuauagugcacaaaaug

SEQ ID NO: 3563506 - RNA, 16 nt, Human
uuuauaguuaaucuau

SEQ ID NO: 3563507 - RNA, 15 nt, Human
uuuauaguuuauaca

SEQ ID NO: 3563508 - RNA, 19 nt, Human
uuuauaguuuguacaugca

SEQ ID NO: 3563509 - RNA, 15 nt, Human
uuuauauaauaaagu

SEQ ID NO: 3563510 - RNA, 21 nt, Human
uuuauauaauaaaguauucca

SEQ ID NO: 3563511 - RNA, 19 nt, Human
uuuauauaauuauguuauu

SEQ ID NO: 3563512 - RNA, 22 nt, Human
uuuauauagcaagacauuauau

SEQ ID NO: 3563513 - RNA, 19 nt, Human
uuuauauagcuugaaacau

SEQ ID NO: 3563514 - RNA, 14 nt, Human
uuuauauaugaaaa

SEQ ID NO: 3563515 - RNA, 16 nt, Human
uuuauauauuuauaac

SEQ ID NO: 3563516 - RNA, 13 nt, Human
uuuauauccauuu

SEQ ID NO: 3563517 - RNA, 21 nt, Human
uuuauaucuccuuuguauucu

SEQ ID NO: 3563518 - RNA, 14 nt, Human
uuuauaucuggaau

SEQ ID NO: 3563519 - RNA, 23 nt, Human
uuuauaucuggaaugagccuguu

SEQ ID NO: 3563520 - RNA, 14 nt, Human
uuuauaucuuggca

SEQ ID NO: 3563521 - RNA, 14 nt, Human
uuuauaugaagaaa

SEQ ID NO: 3563522 - RNA, 21 nt, Human
uuuauaugaagaaaaucacuu

SEQ ID NO: 3563523 - RNA, 17 nt, Human
uuuauaugaagauaagu

SEQ ID NO: 3563524 - RNA, 19 nt, Human
uuuauaugaagauaagugu

SEQ ID NO: 3563525 - RNA, 23 nt, Human
uuuauauggaugauucagaaauu

SEQ ID NO: 3563526 - RNA, 18 nt, Human
uuuauauggggaauauau

SEQ ID NO: 3563527 - RNA, 13 nt, Human
uuuauauguacau

SEQ ID NO: 3563528 - RNA, 20 nt, Human
uuuauauguauguguuuaga

SEQ ID NO: 3563529 - RNA, 13 nt, Human
uuuauauguugua

SEQ ID NO: 3563530 - RNA, 21 nt, Human
uuuauauuaguugcuuuguua

SEQ ID NO: 3563531 - RNA, 14 nt, Human
uuuauauuguaaau

SEQ ID NO: 3563532 - RNA, 16 nt, Human
uuuauauuguaaauau

SEQ ID NO: 3563533 - RNA, 19 nt, Human
uuuauauuguaaauauugu

SEQ ID NO: 3563534 - RNA, 14 nt, Human
uuuauauuuaaaug

SEQ ID NO: 3563535 - RNA, 13 nt, Human
uuuauauuuacua

SEQ ID NO: 3563536 - RNA, 21 nt, Human
uuuauauuuauugacucuuga

SEQ ID NO: 3563537 - RNA, 15 nt, Human
uuuauauuucaagua

SEQ ID NO: 3563538 - RNA, 14 nt, Human
uuuauauuuccuuu

SEQ ID NO: 3563539 - RNA, 20 nt, Human
uuuauauuuccuuuauguga

SEQ ID NO: 3563540 - RNA, 16 nt, Human
uuuaucacauguaugu

SEQ ID NO: 3563541 - RNA, 19 nt, Human
uuuaucacauguauguuuu

SEQ ID NO: 3563542 - RNA, 22 nt, Human
uuuaucacauguauguuuuggu

SEQ ID NO: 3563543 - RNA, 12 nt, Human
uuucauaacuua

SEQ ID NO: 3563544 - RNA, 15 nt, Human
uuucauaagauauuu

SEQ ID NO: 3563545 - RNA, 18 nt, Human
uuucauaagauauuuuau

SEQ ID NO: 3563546 - RNA, 17 nt, Human
uuucauaaguauuucaa

SEQ ID NO: 3563547 - RNA, 14 nt, Human
uuucauacacuuau

SEQ ID NO: 3563548 - RNA, 16 nt, Human
uuucauacauuuucua

SEQ ID NO: 3563549 - RNA, 16 nt, Human
uuucauacucuagauu

SEQ ID NO: 3563550 - RNA, 22 nt, Human
uuucauacucuagauuuuguuu

SEQ ID NO: 3563551 - RNA, 20 nt, Human
uuucauagcuaagaaauaaa

SEQ ID NO: 3563552 - RNA, 19 nt, Human
uuucauaggaagacacauu

SEQ ID NO: 3563553 - RNA, 17 nt, Human
uuucauaggucugaaau

SEQ ID NO: 3563554 - RNA, 14 nt, Human
uuucauaguucaga

SEQ ID NO: 3563555 - RNA, 23 nt, Human
uuucauauaggaauagaaacaug

SEQ ID NO: 3563556 - RNA, 15 nt, Human
uuucauaucauuucu

SEQ ID NO: 3563557 - RNA, 15 nt, Human
uuucauauguugcuc

SEQ ID NO: 3563558 - RNA, 13 nt, Human
uuucauauucuuu

SEQ ID NO: 3563559 - RNA, 15 nt, Human
uuucauauugugcca

SEQ ID NO: 3563560 - RNA, 18 nt, Human
uuucauauuuuaauuuca

SEQ ID NO: 3563561 - RNA, 17 nt, Human
uuucauauuuuucaaaa

SEQ ID NO: 3563562 - RNA, 18 nt, Human
uuucauauuuuucaaaau

SEQ ID NO: 3563563 - RNA, 19 nt, Human
uuucaucaaucauuguaca

SEQ ID NO: 3563564 - RNA, 16 nt, Human
uuucccuacccucuag

SEQ ID NO: 3563565 - RNA, 17 nt, Human
uuucccuacugaagccc

SEQ ID NO: 3563566 - RNA, 19 nt, Human
uuucccucacccccuccca

SEQ ID NO: 3563567 - RNA, 13 nt, Human
uuucccuccuugg

SEQ ID NO: 3563568 - RNA, 14 nt, Human
uuucccucgcuggg

SEQ ID NO: 3563569 - RNA, 16 nt, Human
uuucccugccucucau

SEQ ID NO: 3563570 - RNA, 16 nt, Human
uuugaauaccauuaaa

SEQ ID NO: 3563571 - RNA, 19 nt, Human
uuugaauauaaacacuaua

SEQ ID NO: 3563572 - RNA, 13 nt, Human
uuugaauaugaaa

SEQ ID NO: 3563573 - RNA, 19 nt, Human
uuugaauauguaguaucua

SEQ ID NO: 3563574 - RNA, 19 nt, Human
uuugaauccucucucugug

SEQ ID NO: 3563575 - RNA, 16 nt, Human
uuugaaucucauaauu

SEQ ID NO: 3563576 - RNA, 19 nt, Human
uuugaaucucauaauuuau

SEQ ID NO: 3563577 - RNA, 21 nt, Human
uuugaaucucauaauuuauac

SEQ ID NO: 3563578 - RNA, 21 nt, Human
uuugaaucuugucucaaugcu

SEQ ID NO: 3563579 - RNA, 21 nt, Human
uuugaaugaaaaauuuaagca

SEQ ID NO: 3563580 - RNA, 23 nt, Human
uuugaaugaaaaauuuaagcauu

SEQ ID NO: 3563581 - RNA, 14 nt, Human
uuugaaugacaaag

SEQ ID NO: 3563582 - RNA, 16 nt, Human
uuugaaugcuuccuga

SEQ ID NO: 3563583 - RNA, 17 nt, Human
uuugaauguguuucaca

SEQ ID NO: 3563584 - RNA, 22 nt, Human
uuugaauguuaaauaaauugua

SEQ ID NO: 3563585 - RNA, 23 nt, Human
uuugaauguuaagaauugaccau

SEQ ID NO: 3563586 - RNA, 13 nt, Human
uuugaauguuaau

SEQ ID NO: 3563587 - RNA, 19 nt, Human
uuugaauuaaaacuucuua

SEQ ID NO: 3563588 - RNA, 22 nt, Human
uuugaauuauccacaugaaaau

SEQ ID NO: 3563589 - RNA, 16 nt, Human
uuugaauuguuuucuu

SEQ ID NO: 3563590 - RNA, 17 nt, Human
uuugaauuuucauuuua

SEQ ID NO: 3563591 - RNA, 16 nt, Human
uuugaauuuucugugu

SEQ ID NO: 3563592 - RNA, 11 nt, Human
uuugcagcuuu

SEQ ID NO: 3563593 - RNA, 22 nt, Human
uuugcaggguccucuucugggc

SEQ ID NO: 3563594 - RNA, 16 nt, Human
uuugcaggucuuuaaa

SEQ ID NO: 3563595 - RNA, 22 nt, Human
uuugcagguggccaaguuccuc

SEQ ID NO: 3563596 - RNA, 14 nt, Human
uuugcagguugcuu

SEQ ID NO: 3563597 - RNA, 9 nt, Human
uuugcagua

SEQ ID NO: 3563598 - RNA, 17 nt, Human
uuugcaguaacuguuuu

SEQ ID NO: 3563599 - RNA, 17 nt, Human
uuugcauaacaauuccu

SEQ ID NO: 3563600 - RNA, 23 nt, Human
uuugcauaacguauaaaagccug

SEQ ID NO: 3563601 - RNA, 20 nt, Human
uuugcauauugcauacuauu

SEQ ID NO: 3563602 - RNA, 14 nt, Human
uuugcaucucagua

SEQ ID NO: 3563603 - RNA, 15 nt, Human
uuugcaucugaaaau

SEQ ID NO: 3563604 - RNA, 21 nt, Human
uuugcauggaauuuguaaguu

SEQ ID NO: 3563605 - RNA, 22 nt, Human
uuugcauggcacuugcaucugu

SEQ ID NO: 3563606 - RNA, 17 nt, Human
uuugcauguuauguuua

SEQ ID NO: 3563607 - RNA, 15 nt, Human
uuugcauuaaauuac

SEQ ID NO: 3563608 - RNA, 16 nt, Human
uuugcauuaaauuaca

SEQ ID NO: 3563609 - RNA, 17 nt, Human
uuugcauuaaauucaca

SEQ ID NO: 3563610 - RNA, 21 nt, Human
uuugcauuaaauucacaaacu

SEQ ID NO: 3563611 - RNA, 22 nt, Human
uuugcauuaaauucacaaacuu

SEQ ID NO: 3563612 - RNA, 13 nt, Human
uuugcauugucug

SEQ ID NO: 3563613 - RNA, 17 nt, Human
uuugcauuuaaaacaga

SEQ ID NO: 3563614 - RNA, 13 nt, Human
uuugcauuuaaga

SEQ ID NO: 3563615 - RNA, 21 nt, Human
uuugcauuuaagaauugccag

SEQ ID NO: 3563616 - RNA, 22 nt, Human
uuugccaagggcauaaauuauu

SEQ ID NO: 3563617 - RNA, 20 nt, Human
uuugccaauuugcacauuaa

SEQ ID NO: 3563618 - RNA, 16 nt, Human
uuugccacagcuuuug

SEQ ID NO: 3563619 - RNA, 13 nt, Human
uuugccagcugcu

SEQ ID NO: 3563620 - RNA, 16 nt, Human
uuugccagcugcugcu

SEQ ID NO: 3563621 - RNA, 22 nt, Human
uuugccauagaguacacugccu

SEQ ID NO: 3563622 - RNA, 20 nt, Human
uuugccaugggcuucacugu

SEQ ID NO: 3563623 - RNA, 20 nt, Human
uuuugaacuaauaaaagcau

SEQ ID NO: 3563624 - RNA, 13 nt, Human
uuuugaaggcaaa

SEQ ID NO: 3563625 - RNA, 13 nt, Human
uuuugaagggagg

SEQ ID NO: 3563626 - RNA, 11 nt, Human
uuuugaagugu

SEQ ID NO: 3563627 - RNA, 11 nt, Human
uuuugaaguuu

SEQ ID NO: 3563628 - RNA, 18 nt, Human
uuuugaaguuuacauuuu

SEQ ID NO: 3563629 - RNA, 14 nt, Human
uuuugaauuguuac

SEQ ID NO: 3563630 - RNA, 22 nt, Human
uuuugacagaauauguuucaaa

SEQ ID NO: 3563631 - RNA, 18 nt, Human
uuuugaccuguggugcaa

SEQ ID NO: 3563632 - RNA, 13 nt, Human
uuuugacugcuug

SEQ ID NO: 3563633 - RNA, 15 nt, Human
uuuugacuuaaugug

SEQ ID NO: 3563634 - RNA, 15 nt, Human
uuuugagacagucuu

SEQ ID NO: 3563635 - RNA, 13 nt, Human
uuuugagcacuuu

SEQ ID NO: 3563636 - RNA, 21 nt, Human
uuuugagcuacuggauucuua

SEQ ID NO: 3563637 - RNA, 21 nt, Human
uuuugagcugaaaugcugcau

SEQ ID NO: 3563638 - RNA, 15 nt, Human
uuuugaggagcccca

SEQ ID NO: 3563639 - RNA, 18 nt, Human
uuuugaggcaaaagaagg

SEQ ID NO: 3563640 - RNA, 16 nt, Human
uuuugaggcuucuguu

SEQ ID NO: 3563641 - RNA, 14 nt, Human
uuuugaggcuuuca

SEQ ID NO: 3563642 - RNA, 21 nt, Human
uuuugaguacggcuauagccu

SEQ ID NO: 3563643 - RNA, 16 nt, Human
uuuugaguagauauua

SEQ ID NO: 3563644 - RNA, 18 nt, Human
uuuugaguggaugauguu

SEQ ID NO: 3563645 - RNA, 18 nt, Human
uuuugagugugugugugc

SEQ ID NO: 3563646 - RNA, 22 nt, Human
uuuugauaaaguaguaaaaauu

SEQ ID NO: 3563647 - RNA, 15 nt, Human
uuuugauagcuuuau

SEQ ID NO: 3563648 - RNA, 16 nt, Human
uuuugauaugaguaua

SEQ ID NO: 3563649 - RNA, 14 nt, Human
uuuugaucucacau

SEQ ID NO: 3563650 - RNA, 13 nt, Human
uuuugaucuucaa

SEQ ID NO: 3563651 - RNA, 23 nt, Human
uuuugaugaacaaaauuuccuaa

SEQ ID NO: 3563652 - RNA, 20 nt, Human
uuuugaugacuggcauuuua

SEQ ID NO: 3563653 - RNA, 20 nt, Human
uuuugaugcagcauuugaua

SEQ ID NO: 3563654 - RNA, 21 nt, Human
uuuugaugcagcauuugauaa

SEQ ID NO: 3563655 - RNA, 15 nt, Human
uuuugauguuugugg

SEQ ID NO: 3563656 - RNA, 15 nt, Human
uuuugauuauuguau

SEQ ID NO: 3563657 - RNA, 12 nt, Human
uuuugauugaag

SEQ ID NO: 3563658 - RNA, 20 nt, Human
uuuugauuuaauguuuucag

SEQ ID NO: 3563659 - RNA, 13 nt, Human
uuuugcaaaauuu

SEQ ID NO: 3563660 - RNA, 13 nt, Human
uuuugcaaagaaa

SEQ ID NO: 3563661 - RNA, 18 nt, Human
uuuugcaagguaaaauuu

SEQ ID NO: 3563662 - RNA, 22 nt, Human
uuuugcaagugaagguuuacaa

SEQ ID NO: 3563663 - RNA, 17 nt, Human
uuuugcaauaaugcagu

SEQ ID NO: 3563664 - RNA, 20 nt, Human
uuuugcacauguuuccucua

SEQ ID NO: 3563665 - RNA, 18 nt, Human
uuuugcaccccaugcugu

SEQ ID NO: 3563666 - RNA, 19 nt, Human
uuuugcaccccaugcuguu

SEQ ID NO: 3563667 - RNA, 17 nt, Human
uuuugcaccccucccau

SEQ ID NO: 3563668 - RNA, 12 nt, Human
uuuugcacuuuu

SEQ ID NO: 3563669 - RNA, 9 nt, Human
uuuugcagu

SEQ ID NO: 3563670 - RNA, 18 nt, Human
uuuugcaucauuguuuua

SEQ ID NO: 3563671 - RNA, 12 nt, Human
uuuugcaugaaa

SEQ ID NO: 3563672 - RNA, 13 nt, Human
uuuugcauucaaa

SEQ ID NO: 3563673 - RNA, 19 nt, Human
uuuugcauuugaauaaagc

SEQ ID NO: 3563674 - RNA, 16 nt, Human
uuuugccaauuugcac

SEQ ID NO: 3563675 - RNA, 17 nt, Human
uuuugcccauuuugaau

SEQ ID NO: 3563676 - RNA, 19 nt, Human
uuuugcccauuuugaauca

SEQ ID NO: 3563677 - RNA, 23 nt, Human
uuuugccuaauacauuaaagcag

SEQ ID NO: 3563678 - RNA, 22 nt, Human
uuuugcuaaguaaaucucuucu

SEQ ID NO: 3563679 - RNA, 22 nt, Human
uuuugcucuaaaauauuuauga

SEQ ID NO: 3563680 - RNA, 22 nt, Human
uuuugcuguaauguuaauauug

SEQ ID NO: 3563681 - RNA, 14 nt, Human
uuuugcuguagaag

SEQ ID NO: 3563682 - RNA, 13 nt, Human
uuuugcuuccccu

SEQ ID NO: 3563683 - RNA, 22 nt, Human
uuuugcuugaagcaaacaguug

SEQ ID NO: 3563684 - RNA, 11 nt, Human
uuuugcuuuug

SEQ ID NO: 3563685 - RNA, 17 nt, Human
uuuugcuuuuucugacu

SEQ ID NO: 3563686 - RNA, 22 nt, Human
uuuuggaaaacgauuuaauuua

SEQ ID NO: 3563687 - RNA, 14 nt, Human
uuuuggaaagucag

SEQ ID NO: 3563688 - RNA, 17 nt, Human
uuuuggaaucuagaaga

SEQ ID NO: 3563689 - RNA, 14 nt, Human
uuuuggacuuuguu

SEQ ID NO: 3563690 - RNA, 16 nt, Human
uuuuggaguguuaugu

SEQ ID NO: 3563691 - RNA, 20 nt, Human
uuuuggauugacaguaacuu

SEQ ID NO: 3563692 - RNA, 16 nt, Human
uuuuggauuggacaaa

SEQ ID NO: 3563693 - RNA, 11 nt, Human
uuuuggcaccu

SEQ ID NO: 3563694 - RNA, 22 nt, Human
uuuuggcacuugccauuccaaa

SEQ ID NO: 3563695 - RNA, 15 nt, Human
uuuuggccuggaguu

SEQ ID NO: 3563696 - RNA, 17 nt, Human
uuuuggcgaaucucaaa

SEQ ID NO: 3563697 - RNA, 17 nt, Human
uuuuggcgcuauuacaa

SEQ ID NO: 3563698 - RNA, 17 nt, Human
uuuugggacaauuguuu

SEQ ID NO: 3563699 - RNA, 23 nt, Human
uuuuggggggccccccuccuugc

SEQ ID NO: 3563700 - RNA, 18 nt, Human
uuuugggggugggucugg

SEQ ID NO: 3563701 - RNA, 18 nt, Human
uuuugggggugugagugu

SEQ ID NO: 3563702 - RNA, 14 nt, Human
uuuuggguagcugc

SEQ ID NO: 3563703 - RNA, 14 nt, Human
uuuugguacaaaaa

SEQ ID NO: 3563704 - RNA, 16 nt, Human
uuuugguacaaaaaua

SEQ ID NO: 3563705 - RNA, 16 nt, Human
uuuugguagauuaaau

SEQ ID NO: 3563706 - RNA, 17 nt, Human
uuuugguauuacacugu

SEQ ID NO: 3563707 - RNA, 16 nt, Human
uuuugguauuugaaac

SEQ ID NO: 3563708 - RNA, 18 nt, Human
uuuuggucuggagggaag

SEQ ID NO: 3563709 - RNA, 14 nt, Human
uuuugguggaugua

SEQ ID NO: 3563710 - RNA, 17 nt, Human
uuuugguggauguaaau

SEQ ID NO: 3563711 - RNA, 21 nt, Human
uuuugguuaagcuuugacacu

SEQ ID NO: 3563712 - RNA, 22 nt, Human
uuuugguuaagcuuugacacug

SEQ ID NO: 3563713 - RNA, 14 nt, Human
uuuugguuaaguug

SEQ ID NO: 3563714 - RNA, 22 nt, Human
uuuugguucauuuucagauuca

SEQ ID NO: 3563715 - RNA, 12 nt, Human
uuuugguuguau

SEQ ID NO: 3563716 - RNA, 22 nt, Human
uuuugguugucaauauuaaaua

SEQ ID NO: 3563717 - RNA, 16 nt, Human
uuuugguuguccucaa

SEQ ID NO: 3563718 - RNA, 12 nt, Human
uuuuguaaaaga

SEQ ID NO: 3563719 - RNA, 16 nt, Human
uuuuguaaacauuuau

SEQ ID NO: 3563720 - RNA, 21 nt, Human
uuuuguaaacgacaagaauaa

SEQ ID NO: 3563721 - RNA, 18 nt, Human
uuuuguaaacucaaaaua

SEQ ID NO: 3563722 - RNA, 21 nt, Human
uuuuguaaacuggaauuaaaa

SEQ ID NO: 3563723 - RNA, 11 nt, Human
uuuuguaaaga

SEQ ID NO: 3563724 - RNA, 17 nt, Human
uuuuguaaagaaaaaua

SEQ ID NO: 3563725 - RNA, 18 nt, Human
uuuuguaaagaaaaauau

SEQ ID NO: 3563726 - RNA, 15 nt, Human
uuuuguaaagaugcc

SEQ ID NO: 3563727 - RNA, 14 nt, Human
uuuuguaaagauuu

SEQ ID NO: 3563728 - RNA, 20 nt, Human
uuuuguaaagauuucuguuc

SEQ ID NO: 3563729 - RNA, 16 nt, Human
uuuuguaaaggugaaa

SEQ ID NO: 3563730 - RNA, 13 nt, Human
uuuuguaaauuaa

SEQ ID NO: 3563731 - RNA, 19 nt, Human
uuuuguaaguugaagcaaa

SEQ ID NO: 3563732 - RNA, 19 nt, Human
uuuuguaauaauaaagaau

SEQ ID NO: 3563733 - RNA, 17 nt, Human
uuuuguaauuauuguga

SEQ ID NO: 3563734 - RNA, 18 nt, Human
uuuuguacaucuggcuua

SEQ ID NO: 3563735 - RNA, 13 nt, Human
uuuuguaccagug

SEQ ID NO: 3563736 - RNA, 14 nt, Human
uuuuguagaugaaa

SEQ ID NO: 3563737 - RNA, 18 nt, Human
uuuuguagcacugacaga

SEQ ID NO: 3563738 - RNA, 16 nt, Human
uuuuguagguacuuuu

SEQ ID NO: 3563739 - RNA, 15 nt, Human
uuuuguauacaaaua

SEQ ID NO: 3563740 - RNA, 13 nt, Human
uuuuguauacauc

SEQ ID NO: 3563741 - RNA, 19 nt, Human
uuuuguauacauccugggu

SEQ ID NO: 3563742 - RNA, 17 nt, Human
uuuuguauaguaaagug

SEQ ID NO: 3563743 - RNA, 18 nt, Human
uuuuguauaguaaaguga

SEQ ID NO: 3563744 - RNA, 20 nt, Human
uuuuguauaguuaacacacu

SEQ ID NO: 3563745 - RNA, 23 nt, Human
uuuuguauaguuguggacauuua

SEQ ID NO: 3563746 - RNA, 14 nt, Human
uuuuguaucuacau

SEQ ID NO: 3563747 - RNA, 14 nt, Human
uuuuguaugugugu

SEQ ID NO: 3563748 - RNA, 14 nt, Human
aaguuaaagggaag

SEQ ID NO: 3563749 - RNA, 14 nt, Human
aaguuaaauuuuau

SEQ ID NO: 3563750 - RNA, 11 nt, Human
aaguuaagaau

SEQ ID NO: 3563751 - RNA, 23 nt, Human
aaguuaagaauguucuuauguug

SEQ ID NO: 3563752 - RNA, 19 nt, Human
aaguuaagagaaacuuuau

SEQ ID NO: 3563753 - RNA, 22 nt, Human
aaguuaagagaaacuuuauaca

SEQ ID NO: 3563754 - RNA, 21 nt, Human
aaguuaaugcuuaagagggaa

SEQ ID NO: 3563755 - RNA, 15 nt, Human
aaguuaauuuaaagu

SEQ ID NO: 3563756 - RNA, 17 nt, Human
aaguuaauuuaaaguug

SEQ ID NO: 3563757 - RNA, 23 nt, Human
aaguuacacagaaaugcugcugg

SEQ ID NO: 3563758 - RNA, 17 nt, Human
aaguuacacauuuuuca

SEQ ID NO: 3563759 - RNA, 18 nt, Human
aaguuacuagguaacuuc

SEQ ID NO: 3563760 - RNA, 20 nt, Human
aaguuacuagguaacuucau

SEQ ID NO: 3563761 - RNA, 21 nt, Human
aaguuacuagguaacuucaua

SEQ ID NO: 3563762 - RNA, 12 nt, Human
aaguuacugaau

SEQ ID NO: 3563763 - RNA, 15 nt, Human
aaguuacugaaugca

SEQ ID NO: 3563764 - RNA, 22 nt, Human
aaguuacuucacuuuaauucuc

SEQ ID NO: 3563765 - RNA, 14 nt, Human
aaguuagaauuccu

SEQ ID NO: 3563766 - RNA, 22 nt, Human
aaguuagaauuccuucagggug

SEQ ID NO: 3563767 - RNA, 22 nt, Human
aaguuagagaacuaaacuaguu

SEQ ID NO: 3563768 - RNA, 16 nt, Human
aaguuagccuuuaucu

SEQ ID NO: 3563769 - RNA, 17 nt, Human
aaguuagccuuuaucua

SEQ ID NO: 3563770 - RNA, 13 nt, Human
aaguuagcucagg

SEQ ID NO: 3563771 - RNA, 21 nt, Human
aaguuagcugagcgugguggc

SEQ ID NO: 3563772 - RNA, 15 nt, Human
aaguuaguaggauau

SEQ ID NO: 3563773 - RNA, 16 nt, Human
aaguuaguaucuuuug

SEQ ID NO: 3563774 - RNA, 23 nt, Human
aaguuaguuuguauauauuauua

SEQ ID NO: 3563775 - RNA, 18 nt, Human
aaguuauaaaucaauguc

SEQ ID NO: 3563776 - RNA, 16 nt, Human
aaguuauaguauaucu

SEQ ID NO: 3563777 - RNA, 21 nt, Human
aaguuauauaaagagaaaauu

SEQ ID NO: 3563778 - RNA, 22 nt, Human
aaguuauauaaagagaaaauug

SEQ ID NO: 3563779 - RNA, 23 nt, Human
aaguuauauagguuuuguuugcu

SEQ ID NO: 3563780 - RNA, 14 nt, Human
aaguuauauuucag

SEQ ID NO: 3563781 - RNA, 13 nt, Human
aaguuaucuuuga

SEQ ID NO: 3563782 - RNA, 14 nt, Human
aaguuaucuuugaa

SEQ ID NO: 3563783 - RNA, 15 nt, Human
aaguuaucuuugaau

SEQ ID NO: 3563784 - RNA, 22 nt, Human
aaguuaucuuugaauauguagu

SEQ ID NO: 3563785 - RNA, 20 nt, Human
aaguuaugggaauaccugug

SEQ ID NO: 3563786 - RNA, 14 nt, Human
aaguuauguguaug

SEQ ID NO: 3563787 - RNA, 16 nt, Human
aaguuauuaaaauugu

SEQ ID NO: 3563788 - RNA, 15 nt, Human
aaguuauuaacuuua

SEQ ID NO: 3563789 - RNA, 18 nt, Human
aaguuauuaauuucuuca

SEQ ID NO: 3563790 - RNA, 20 nt, Human
aaguuauuagugguuuauca

SEQ ID NO: 3563791 - RNA, 20 nt, Human
aaguuauugauaaguucaua

SEQ ID NO: 3563792 - RNA, 16 nt, Human
aaguuauuuaaaucug

SEQ ID NO: 3563793 - RNA, 14 nt, Human
aaguuauuuauuuu

SEQ ID NO: 3563794 - RNA, 15 nt, Human
aaguuauuucccuuu

SEQ ID NO: 3563795 - RNA, 15 nt, Human
aaguuauuucuuguu

SEQ ID NO: 3563796 - RNA, 14 nt, Human
aaguuauuuucuac

SEQ ID NO: 3563797 - RNA, 21 nt, Human
aaguuauuuucuacagugguu

SEQ ID NO: 3563798 - RNA, 19 nt, Human
aaguuauuuuuaauuuggu

SEQ ID NO: 3563799 - RNA, 11 nt, Human
aaguucaagga

SEQ ID NO: 3563800 - RNA, 15 nt, Human
aaguucaaggaccaa

SEQ ID NO: 3563801 - RNA, 15 nt, Human
aaguucaccauuaaa

SEQ ID NO: 3563802 - RNA, 16 nt, Human
aaguucagaguuuucu

SEQ ID NO: 3563803 - RNA, 17 nt, Human
aaguucagaguuuucug

SEQ ID NO: 3563804 - RNA, 16 nt, Human
aaguucagccacccug

SEQ ID NO: 3563805 - RNA, 20 nt, Human
aaguucauaacagugccauu

SEQ ID NO: 3563806 - RNA, 17 nt, Human
aaguucaugcuuuguuc

SEQ ID NO: 3563807 - RNA, 14 nt, Human
aaguuccaagucca

SEQ ID NO: 3563808 - RNA, 19 nt, Human
aaguuccaguguucucucu

SEQ ID NO: 3563809 - RNA, 13 nt, Human
aaguucccaguug

SEQ ID NO: 3563810 - RNA, 20 nt, Human
aaguucccuacuuccuguga

SEQ ID NO: 3563811 - RNA, 14 nt, Human
aaguuccucuagug

SEQ ID NO: 3563812 - RNA, 15 nt, Human
aaguucuaagauucu

SEQ ID NO: 3563813 - RNA, 16 nt, Human
aaguucuaagauucua

SEQ ID NO: 3563814 - RNA, 18 nt, Human
aaguucuaagauucuaau

SEQ ID NO: 3563815 - RNA, 17 nt, Human
aaguucuaagauucuga

SEQ ID NO: 3563816 - RNA, 17 nt, Human
aaguucuagagaagagg

SEQ ID NO: 3563817 - RNA, 16 nt, Human
aaguucucaaugugaa

SEQ ID NO: 3563818 - RNA, 13 nt, Human
aaguucucauugu

SEQ ID NO: 3563819 - RNA, 16 nt, Human
aaguucugccucugau

SEQ ID NO: 3563820 - RNA, 13 nt, Human
aaguucugcuuuc

SEQ ID NO: 3563821 - RNA, 19 nt, Human
aaguucugcuuucucccca

SEQ ID NO: 3563822 - RNA, 12 nt, Human
aaguucugugua

SEQ ID NO: 3563823 - RNA, 15 nt, Human
aaguucuguguuuaa

SEQ ID NO: 3563824 - RNA, 18 nt, Human
aaguucuuagauaucuuu

SEQ ID NO: 3563825 - RNA, 20 nt, Human
aaguucuuaugaggagggga

SEQ ID NO: 3563826 - RNA, 22 nt, Human
aaguucuuaugaggaggggagg

SEQ ID NO: 3563827 - RNA, 15 nt, Human
aaguucuuugauucu

SEQ ID NO: 3563828 - RNA, 21 nt, Human
aaguugaauggccugccuuga

SEQ ID NO: 3563829 - RNA, 12 nt, Human
aaguugaauuuu

SEQ ID NO: 3563830 - RNA, 20 nt, Human
aaguugacucugcucuugca

SEQ ID NO: 3563831 - RNA, 21 nt, Human
aaguugacucugcucuugcau

SEQ ID NO: 3563832 - RNA, 21 nt, Human
aaguugacuuauaguacauga

SEQ ID NO: 3563833 - RNA, 18 nt, Human
aaguugagcuaugacuua

SEQ ID NO: 3563834 - RNA, 21 nt, Human
aaguugauauagaacagugcu

SEQ ID NO: 3563835 - RNA, 15 nt, Human
aaguugaucucccca

SEQ ID NO: 3563836 - RNA, 18 nt, Human
aaguugauggugaugaaa

SEQ ID NO: 3563837 - RNA, 20 nt, Human
aaguugcacugauauuuuac

SEQ ID NO: 3563838 - RNA, 22 nt, Human
aaguugcagauguuagauauuu

SEQ ID NO: 3563839 - RNA, 19 nt, Human
aaguugcagcuguuuuguu

SEQ ID NO: 3563840 - RNA, 18 nt, Human
aaguugccuaaauccauu

SEQ ID NO: 3563841 - RNA, 12 nt, Human
aaguugcugcuu

SEQ ID NO: 3563842 - RNA, 14 nt, Human
aaguugcuggaaag

SEQ ID NO: 3563843 - RNA, 19 nt, Human
aaguuggaaacacuaaaug

SEQ ID NO: 3563844 - RNA, 14 nt, Human
aaguuggacuaaau

SEQ ID NO: 3563845 - RNA, 13 nt, Human
aaguuggacuggg

SEQ ID NO: 3563846 - RNA, 23 nt, Human
aaguuggaguuuuguuuccucug

SEQ ID NO: 3563847 - RNA, 11 nt, Human
aaguuggcuuc

SEQ ID NO: 3563848 - RNA, 20 nt, Human
aaguugguauuaauaaaaag

SEQ ID NO: 3563849 - RNA, 16 nt, Human
aaguugguuggauaag

SEQ ID NO: 3563850 - RNA, 18 nt, Human
aaguuguaacuuauauug

SEQ ID NO: 3563851 - RNA, 12 nt, Human
aaguuguacaug

SEQ ID NO: 3563852 - RNA, 14 nt, Human
aaguuguacuuuaa

SEQ ID NO: 3563853 - RNA, 20 nt, Human
aaguuguacuuuaaaaauuu

SEQ ID NO: 3563854 - RNA, 20 nt, Human
aaguugugccuuuuauagcu

SEQ ID NO: 3563855 - RNA, 18 nt, Human
aaguuguggauuucaguu

SEQ ID NO: 3563856 - RNA, 17 nt, Human
aaguuguuaacuaaauu

SEQ ID NO: 3563857 - RNA, 15 nt, Human
aaguuguuucauuga

SEQ ID NO: 3563858 - RNA, 19 nt, Human
aaguuuaaaacaguauuua

SEQ ID NO: 3563859 - RNA, 14 nt, Human
aaguuuaaaaugua

SEQ ID NO: 3563860 - RNA, 15 nt, Human
aaguuuaaaauguau

SEQ ID NO: 3563861 - RNA, 17 nt, Human
aaguuuaaaauguauaa

SEQ ID NO: 3563862 - RNA, 19 nt, Human
aaguuuaaauauuaagcau

SEQ ID NO: 3563863 - RNA, 23 nt, Human
aaguuuaaggaauaugggagaaa

SEQ ID NO: 3563864 - RNA, 17 nt, Human
aaguuuaauauuaaagc

SEQ ID NO: 3563865 - RNA, 20 nt, Human
aaguuuaauauuaaagccau

SEQ ID NO: 3563866 - RNA, 20 nt, Human
aaguuuaauggugccuucau

SEQ ID NO: 3563867 - RNA, 14 nt, Human
aaguuuaauugacu

SEQ ID NO: 3563868 - RNA, 19 nt, Human
aaguuuacauuguaaauag

SEQ ID NO: 3563869 - RNA, 13 nt, Human
aaguuuacauuuu

SEQ ID NO: 3563870 - RNA, 16 nt, Human
aaguuuacauuuuuau

SEQ ID NO: 3563871 - RNA, 23 nt, Human
aaguuuacauuuuuauuuaugaa

SEQ ID NO: 3563872 - RNA, 17 nt, Human
aaguuuagauuuuaauc

SEQ ID NO: 3563873 - RNA, 21 nt, Human
aaguuuagccccugaaagcca

SEQ ID NO: 3563874 - RNA, 23 nt, Human
aaguuuauaagaggaugaaguga

SEQ ID NO: 3563875 - RNA, 16 nt, Human
aaguuuaugucuaaag

SEQ ID NO: 3563876 - RNA, 15 nt, Human
aaguuucaaaaaucu

SEQ ID NO: 3563877 - RNA, 17 nt, Human
aaguuucaaaaaucuga

SEQ ID NO: 3563878 - RNA, 22 nt, Human
aaguuucaaacuuacuauuuug

SEQ ID NO: 3563879 - RNA, 16 nt, Human
aaguuucaaugugauu

SEQ ID NO: 3563880 - RNA, 18 nt, Human
aaguuucagaguauauug

SEQ ID NO: 3563881 - RNA, 19 nt, Human
aaguuucaggauacaugug

SEQ ID NO: 3563882 - RNA, 19 nt, Human
aaguuucaggugacaugug

SEQ ID NO: 3563883 - RNA, 21 nt, Human
aaguuucaggugacaugugaa

SEQ ID NO: 3563884 - RNA, 19 nt, Human
aaguuucaguauuagaugc

SEQ ID NO: 3563885 - RNA, 13 nt, Human
aaguuucauuuau

SEQ ID NO: 3563886 - RNA, 15 nt, Human
aaguuuccaagcaaa

SEQ ID NO: 3563887 - RNA, 16 nt, Human
aaguuuccaagcaaau

SEQ ID NO: 3563888 - RNA, 19 nt, Human
aaguuuccaagcaaauguu

SEQ ID NO: 3563889 - RNA, 12 nt, Human
aaguuuccauau

SEQ ID NO: 3563890 - RNA, 18 nt, Human
aaguuuccauauguuaua

SEQ ID NO: 3563891 - RNA, 12 nt, Human
aaguuucccuuc

SEQ ID NO: 3563892 - RNA, 19 nt, Human
aaguuuccuuccagcccag

SEQ ID NO: 3563893 - RNA, 17 nt, Human
aaguuuccuuggcuggu

SEQ ID NO: 3563894 - RNA, 13 nt, Human
aaguuucucagcu

SEQ ID NO: 3563895 - RNA, 16 nt, Human
aaguuucucagcuccc

SEQ ID NO: 3563896 - RNA, 22 nt, Human
aaguuucuuugaaaauaguuau

SEQ ID NO: 3563897 - RNA, 18 nt, Human
aaguuugaaaagcaauau

SEQ ID NO: 3563898 - RNA, 17 nt, Human
aauaguguguucugauu

SEQ ID NO: 3563899 - RNA, 22 nt, Human
aauaguguguucugauuagaaa

SEQ ID NO: 3563900 - RNA, 15 nt, Human
aauaguguuaaucaa

SEQ ID NO: 3563901 - RNA, 16 nt, Human
aauaguguuaaucaau

SEQ ID NO: 3563902 - RNA, 21 nt, Human
aauaguuaagacaugauuucc

SEQ ID NO: 3563903 - RNA, 13 nt, Human
aauaguuaauaua

SEQ ID NO: 3563904 - RNA, 22 nt, Human
aauaguugaaccuauuucucuu

SEQ ID NO: 3563905 - RNA, 18 nt, Human
aauaguugagccagcaga

SEQ ID NO: 3563906 - RNA, 21 nt, Human
aauaguuguccauauuuucac

SEQ ID NO: 3563907 - RNA, 23 nt, Human
aauaguuuauaaaugugaacuua

SEQ ID NO: 3563908 - RNA, 17 nt, Human
aauaguuuauuuuaaaa

SEQ ID NO: 3563909 - RNA, 14 nt, Human
aauaguuugucuau

SEQ ID NO: 3563910 - RNA, 17 nt, Human
aauaguuugucuauuuu

SEQ ID NO: 3563911 - RNA, 23 nt, Human
aauaguuugucuauuuuaaaaua

SEQ ID NO: 3563912 - RNA, 20 nt, Human
aauaguuuuauuaauaaaca

SEQ ID NO: 3563913 - RNA, 21 nt, Human
aauaguuuuauuaauaaacau

SEQ ID NO: 3563914 - RNA, 14 nt, Human
aauauaaaacugcg

SEQ ID NO: 3563915 - RNA, 18 nt, Human
aauauaaaacugcguuaa

SEQ ID NO: 3563916 - RNA, 14 nt, Human
aauauaaaaggcaa

SEQ ID NO: 3563917 - RNA, 12 nt, Human
aauauaaaauua

SEQ ID NO: 3563918 - RNA, 14 nt, Human
aauauaaacaaaga

SEQ ID NO: 3563919 - RNA, 14 nt, Human
aauauaaacacuau

SEQ ID NO: 3563920 - RNA, 21 nt, Human
aauauaaagcaucuaaacuuu

SEQ ID NO: 3563921 - RNA, 15 nt, Human
aauauaaaguuuuau

SEQ ID NO: 3563922 - RNA, 22 nt, Human
aauauaaaguuuuauauauuau

SEQ ID NO: 3563923 - RNA, 12 nt, Human
aauauaaaugca

SEQ ID NO: 3563924 - RNA, 15 nt, Human
aauauaaaugcaaau

SEQ ID NO: 3563925 - RNA, 17 nt, Human
aauauaaaugcaaauaa

SEQ ID NO: 3563926 - RNA, 18 nt, Human
aauauaaaugcaaauaac

SEQ ID NO: 3563927 - RNA, 19 nt, Human
aauauaaauguuaagaaaa

SEQ ID NO: 3563928 - RNA, 13 nt, Human
aauauaacaugaa

SEQ ID NO: 3563929 - RNA, 18 nt, Human
aauauaacaugaaaugau

SEQ ID NO: 3563930 - RNA, 21 nt, Human
aauauaaccaauguuuaaaaa

SEQ ID NO: 3563931 - RNA, 13 nt, Human
aauauaagaauaa

SEQ ID NO: 3563932 - RNA, 18 nt, Human
aauauaaggaaagcaaua

SEQ ID NO: 3563933 - RNA, 19 nt, Human
aauauaaggaaagcaauaa

SEQ ID NO: 3563934 - RNA, 14 nt, Human
aauauaaguaaagu

SEQ ID NO: 3563935 - RNA, 16 nt, Human
aauauaaguuucuuug

SEQ ID NO: 3563936 - RNA, 17 nt, Human
aauauaauacacaaaau

SEQ ID NO: 3563937 - RNA, 13 nt, Human
aauauaauauugu

SEQ ID NO: 3563938 - RNA, 15 nt, Human
aauauaauuguuuua

SEQ ID NO: 3563939 - RNA, 23 nt, Human
aauauacaugaagaauagaaaca

SEQ ID NO: 3563940 - RNA, 19 nt, Human
aauauaccccuuaguguuu

SEQ ID NO: 3563941 - RNA, 12 nt, Human
aauauacuguaa

SEQ ID NO: 3563942 - RNA, 13 nt, Human
aauauacuguaaa

SEQ ID NO: 3563943 - RNA, 17 nt, Human
aauauacuguaaagaaa

SEQ ID NO: 3563944 - RNA, 23 nt, Human
aauauacuuguggacuaaaagau

SEQ ID NO: 3563945 - RNA, 21 nt, Human
aauauagaaaaaaacauucua

SEQ ID NO: 3563946 - RNA, 22 nt, Human
aauauagaaaaaaacauucuau

SEQ ID NO: 3563947 - RNA, 13 nt, Human
aauauagaaacac

SEQ ID NO: 3563948 - RNA, 22 nt, Human
aauauagaaacacgaacuuuag

SEQ ID NO: 3563949 - RNA, 17 nt, Human
aauauagauuaaaucau

SEQ ID NO: 3563950 - RNA, 15 nt, Human
aauauagauuagaaa

SEQ ID NO: 3563951 - RNA, 18 nt, Human
aauauagauuagaaaaau

SEQ ID NO: 3563952 - RNA, 20 nt, Human
aauauaggaacuuaaauaau

SEQ ID NO: 3563953 - RNA, 13 nt, Human
aauauaggucucu

SEQ ID NO: 3563954 - RNA, 15 nt, Human
aauauaguuccuaag

SEQ ID NO: 3563955 - RNA, 20 nt, Human
aauauaguuccuaagaagcu

SEQ ID NO: 3563956 - RNA, 16 nt, Human
aauauauaaaaauaua

SEQ ID NO: 3563957 - RNA, 11 nt, Human
aauauauaaau

SEQ ID NO: 3563958 - RNA, 13 nt, Human
aauauauaaauau

SEQ ID NO: 3563959 - RNA, 17 nt, Human
aauauauaaauauauau

SEQ ID NO: 3563960 - RNA, 13 nt, Human
aauauauauaaag

SEQ ID NO: 3563961 - RNA, 15 nt, Human
aauauauauaaauaa

SEQ ID NO: 3563962 - RNA, 13 nt, Human
aauauauauacau

SEQ ID NO: 3563963 - RNA, 13 nt, Human
aauauauauauau

SEQ ID NO: 3563964 - RNA, 14 nt, Human
aauauauauauccu

SEQ ID NO: 3563965 - RNA, 18 nt, Human
aauauauauguugauuuc

SEQ ID NO: 3563966 - RNA, 19 nt, Human
aauauauauuauacuugua

SEQ ID NO: 3563967 - RNA, 14 nt, Human
aauauauauucugg

SEQ ID NO: 3563968 - RNA, 14 nt, Human
aauauaucucuauu

SEQ ID NO: 3563969 - RNA, 21 nt, Human
aauauaucuuauaaaguggaa

SEQ ID NO: 3563970 - RNA, 20 nt, Human
aauauaugccuuguauaaua

SEQ ID NO: 3563971 - RNA, 21 nt, Human
aauauaugccuuguauaauau

SEQ ID NO: 3563972 - RNA, 14 nt, Human
aauauauggcagag

SEQ ID NO: 3563973 - RNA, 13 nt, Human
aauauauggcauu

SEQ ID NO: 3563974 - RNA, 14 nt, Human
aauauauggcauuu

SEQ ID NO: 3563975 - RNA, 17 nt, Human
aauauauggcauuugca

SEQ ID NO: 3563976 - RNA, 14 nt, Human
aauauauguauaua

SEQ ID NO: 3563977 - RNA, 16 nt, Human
aauauauguauauaca

SEQ ID NO: 3563978 - RNA, 12 nt, Human
aauauauguauu

SEQ ID NO: 3563979 - RNA, 21 nt, Human
aauauauguauuauuuauaau

SEQ ID NO: 3563980 - RNA, 13 nt, Human
aauauauuauaau

SEQ ID NO: 3563981 - RNA, 16 nt, Human
aauauauuauaaucuu

SEQ ID NO: 3563982 - RNA, 13 nt, Human
aauauauuauuac

SEQ ID NO: 3563983 - RNA, 21 nt, Human
aauauauuauuacuuguaaau

SEQ ID NO: 3563984 - RNA, 13 nt, Human
aauauauugaacu

SEQ ID NO: 3563985 - RNA, 23 nt, Human
aauauauugaacuuuuguacuga

SEQ ID NO: 3563986 - RNA, 21 nt, Human
aauauauugcugcugguaauu

SEQ ID NO: 3563987 - RNA, 16 nt, Human
aauauauuuaaaaaua

SEQ ID NO: 3563988 - RNA, 15 nt, Human
aauauauuuaaaggg

SEQ ID NO: 3563989 - RNA, 20 nt, Human
aauauauuuaagauaauuau

SEQ ID NO: 3563990 - RNA, 19 nt, Human
aauauauuuguguauuuaa

SEQ ID NO: 3563991 - RNA, 21 nt, Human
aauauauuuguguauuuaaca

SEQ ID NO: 3563992 - RNA, 24 nt, Human
aauauauuuguguauuuaacaggg

SEQ ID NO: 3563993 - RNA, 15 nt, Human
aauauauuuuaagac

SEQ ID NO: 3563994 - RNA, 16 nt, Human
aauauauuuuaccaua

SEQ ID NO: 3563995 - RNA, 21 nt, Human
aauauauuuucuguuuucuuu

SEQ ID NO: 3563996 - RNA, 14 nt, Human
aauauauuuuguau

SEQ ID NO: 3563997 - RNA, 18 nt, Human
aauauauuuuguaugcaa

SEQ ID NO: 3563998 - RNA, 19 nt, Human
aauauauuuuguuuacaaa

SEQ ID NO: 3563999 - RNA, 15 nt, Human
aauauauuuuuagac

SEQ ID NO: 3564000 - RNA, 20 nt, Human
aauauauuuuuauauuuagu

SEQ ID NO: 3564001 - RNA, 20 nt, Human
aauaucaaaugcaguauauu

SEQ ID NO: 3564002 - RNA, 21 nt, Human
aauaucaaauuaauuguguga

SEQ ID NO: 3564003 - RNA, 13 nt, Human
aauaucacucauu

SEQ ID NO: 3564004 - RNA, 12 nt, Human
aauaucacuugu

SEQ ID NO: 3564005 - RNA, 20 nt, Human
aauaucagcaagucucuuua

SEQ ID NO: 3564006 - RNA, 19 nt, Human
aauaucaguagaaacucua

SEQ ID NO: 3564007 - RNA, 16 nt, Human
aauaucaucaguauug

SEQ ID NO: 3564008 - RNA, 18 nt, Human
aauaucaucaguauugaa

SEQ ID NO: 3564009 - RNA, 15 nt, Human
aauaucauucagcaa

SEQ ID NO: 3564010 - RNA, 21 nt, Human
aauauccaggucaacagaaug

SEQ ID NO: 3564011 - RNA, 22 nt, Human
aauauccaggucaacagaauga

SEQ ID NO: 3564012 - RNA, 22 nt, Human
aauaucccagaaaaaguaacuc

SEQ ID NO: 3564013 - RNA, 23 nt, Human
aauaucccuccuguugggagagg

SEQ ID NO: 3564014 - RNA, 20 nt, Human
aauaucccuuggacauuuua

SEQ ID NO: 3564015 - RNA, 14 nt, Human
aauauccuaaacau

SEQ ID NO: 3564016 - RNA, 12 nt, Human
aauauccuaaua

SEQ ID NO: 3564017 - RNA, 13 nt, Human
aauauccuaauaa

SEQ ID NO: 3564018 - RNA, 14 nt, Human
aauauccuaauaaa

SEQ ID NO: 3564019 - RNA, 15 nt, Human
aauauccuaauaaaa

SEQ ID NO: 3564020 - RNA, 14 nt, Human
aaguccacagugga

SEQ ID NO: 3564021 - RNA, 19 nt, Human
aaguccacaguggaaccag

SEQ ID NO: 3564022 - RNA, 21 nt, Human
aaguccagguccugguggggc

SEQ ID NO: 3564023 - RNA, 19 nt, Human
aaguccaggucgggcucag

SEQ ID NO: 3564024 - RNA, 21 nt, Human
aaguccaggucgggcucagcu

SEQ ID NO: 3564025 - RNA, 20 nt, Human
aaguccaguguuucuuuuuu

SEQ ID NO: 3564026 - RNA, 14 nt, Human
aaguccccaggccc

SEQ ID NO: 3564027 - RNA, 18 nt, Human
aaguccccaggccccagg

SEQ ID NO: 3564028 - RNA, 17 nt, Human
aagucccugucaccucu

SEQ ID NO: 3564029 - RNA, 22 nt, Human
aagucccuguuuucugagcccg

SEQ ID NO: 3564030 - RNA, 19 nt, Human
aaguccgcagaagcccuga

SEQ ID NO: 3564031 - RNA, 14 nt, Human
aaguccucccugac

SEQ ID NO: 3564032 - RNA, 18 nt, Human
aaguccucuuuucugaga

SEQ ID NO: 3564033 - RNA, 22 nt, Human
aaguccugaagaggcgggccag

SEQ ID NO: 3564034 - RNA, 23 nt, Human
aaguccugaagaggcgggccagc

SEQ ID NO: 3564035 - RNA, 17 nt, Human
aaguccuggcuucaggc

SEQ ID NO: 3564036 - RNA, 18 nt, Human
aaguccuuugagcuccug

SEQ ID NO: 3564037 - RNA, 20 nt, Human
aaguccuuugagcuccuggg

SEQ ID NO: 3564038 - RNA, 16 nt, Human
aaguccuuuuguaaag

SEQ ID NO: 3564039 - RNA, 17 nt, Human
aaguccuuuuguaaagu

SEQ ID NO: 3564040 - RNA, 21 nt, Human
aaguccuuuuuuuccaucuuu

SEQ ID NO: 3564041 - RNA, 15 nt, Human
aagucguugugaggg

SEQ ID NO: 3564042 - RNA, 15 nt, Human
aagucguuuuccaaa

SEQ ID NO: 3564043 - RNA, 13 nt, Human
aagucuaaaguuu

SEQ ID NO: 3564044 - RNA, 14 nt, Human
aagucuaaaguuua

SEQ ID NO: 3564045 - RNA, 19 nt, Human
aagucuaaaguuuacagua

SEQ ID NO: 3564046 - RNA, 20 nt, Human
aagucuaccaaccuguucaa

SEQ ID NO: 3564047 - RNA, 22 nt, Human
aagucuaggagcugggaggaaa

SEQ ID NO: 3564048 - RNA, 22 nt, Human
aagucuaucuaaugacaugccu

SEQ ID NO: 3564049 - RNA, 17 nt, Human
aagucuaugaugcuguu

SEQ ID NO: 3564050 - RNA, 12 nt, Human
aagucucagcua

SEQ ID NO: 3564051 - RNA, 13 nt, Human
aagucuccagccc

SEQ ID NO: 3564052 - RNA, 18 nt, Human
aagucucuauuuaaauuc

SEQ ID NO: 3564053 - RNA, 21 nt, Human
aagucucucauucuaggccuc

SEQ ID NO: 3564054 - RNA, 16 nt, Human
aagucucugcuggccc

SEQ ID NO: 3564055 - RNA, 19 nt, Human
aagucucuggaauuugaaa

SEQ ID NO: 3564056 - RNA, 18 nt, Human
aagucucuuuucuuuaga

SEQ ID NO: 3564057 - RNA, 12 nt, Human
aagucugaauca

SEQ ID NO: 3564058 - RNA, 21 nt, Human
aagucugcaacuuuaagcagc

SEQ ID NO: 3564059 - RNA, 22 nt, Human
aagucugucuuuccugaaccau

SEQ ID NO: 3564060 - RNA, 22 nt, Human
aagucugugccuggagcuccug

SEQ ID NO: 3564061 - RNA, 23 nt, Human
aagucugugccuggagcuccugg

SEQ ID NO: 3564062 - RNA, 22 nt, Human
aagucugugugaugaacuuucu

SEQ ID NO: 3564063 - RNA, 13 nt, Human
aagucuguuuuau

SEQ ID NO: 3564064 - RNA, 15 nt, Human
aagucuguuuuauga

SEQ ID NO: 3564065 - RNA, 16 nt, Human
aagucuguuuuaugac

SEQ ID NO: 3564066 - RNA, 17 nt, Human
aagucuuaaaauaacuu

SEQ ID NO: 3564067 - RNA, 18 nt, Human
aagucuuaaaauaacuua

SEQ ID NO: 3564068 - RNA, 16 nt, Human
aagucuuagauguaua

SEQ ID NO: 3564069 - RNA, 22 nt, Human
aagucuucaagggcugcuucaa

SEQ ID NO: 3564070 - RNA, 18 nt, Human
aagucuucccugaucaag

SEQ ID NO: 3564071 - RNA, 22 nt, Human
aagucuucccugaucaagucac

SEQ ID NO: 3564072 - RNA, 13 nt, Human
aagucuugcugug

SEQ ID NO: 3564073 - RNA, 9 nt, Human
aagucuugu

SEQ ID NO: 3564074 - RNA, 11 nt, Human
aagucuuguau

SEQ ID NO: 3564075 - RNA, 14 nt, Human
aagucuugugacua

SEQ ID NO: 3564076 - RNA, 16 nt, Human
aagucuuucaagaaug

SEQ ID NO: 3564077 - RNA, 16 nt, Human
aagucuuucacauuua

SEQ ID NO: 3564078 - RNA, 16 nt, Human
aagucuuucucuuucc

SEQ ID NO: 3564079 - RNA, 20 nt, Human
aagucuuuuaaaaaguauug

SEQ ID NO: 3564080 - RNA, 15 nt, Human
aagugaaaaacauga

SEQ ID NO: 3564081 - RNA, 21 nt, Human
aagugaaaaaggaggaagaga

SEQ ID NO: 3564082 - RNA, 12 nt, Human
aagugaaaacuu

SEQ ID NO: 3564083 - RNA, 14 nt, Human
aagugaaaauauag

SEQ ID NO: 3564084 - RNA, 14 nt, Human
aagugaaaaugguc

SEQ ID NO: 3564085 - RNA, 17 nt, Human
aagugaaauggauacua

SEQ ID NO: 3564086 - RNA, 11 nt, Human
aagugaaauuu

SEQ ID NO: 3564087 - RNA, 20 nt, Human
aaugaaaagucguuuuccaa

SEQ ID NO: 3564088 - RNA, 14 nt, Human
aaugaaaauaagaa

SEQ ID NO: 3564089 - RNA, 13 nt, Human
aaugaaaauugua

SEQ ID NO: 3564090 - RNA, 17 nt, Human
aaugaaacaccuucucu

SEQ ID NO: 3564091 - RNA, 19 nt, Human
aaugaaacacucaguuguu

SEQ ID NO: 3564092 - RNA, 18 nt, Human
aaugaaacccccacacac

SEQ ID NO: 3564093 - RNA, 20 nt, Human
aaugaaacuagaaagcagag

SEQ ID NO: 3564094 - RNA, 16 nt, Human
aaugaaagaaaauuga

SEQ ID NO: 3564095 - RNA, 20 nt, Human
aaugaaagacuguacaaagu

SEQ ID NO: 3564096 - RNA, 19 nt, Human
aaugaaagaguaaaggaaa

SEQ ID NO: 3564097 - RNA, 12 nt, Human
aaugaaagauua

SEQ ID NO: 3564098 - RNA, 21 nt, Human
aaugaaauaauguacaucugg

SEQ ID NO: 3564099 - RNA, 19 nt, Human
aaugaaauaggagggaaac

SEQ ID NO: 3564100 - RNA, 14 nt, Human
aaugaaauguaugu

SEQ ID NO: 3564101 - RNA, 23 nt, Human
aaugaaauuacuacaaaauuuga

SEQ ID NO: 3564102 - RNA, 13 nt, Human
aaugaaauuuaaa

SEQ ID NO: 3564103 - RNA, 16 nt, Human
aaugaaauuuaaacau

SEQ ID NO: 3564104 - RNA, 17 nt, Human
aaugaaauuuaaacauu

SEQ ID NO: 3564105 - RNA, 17 nt, Human
aaugaacaaaauuauuu

SEQ ID NO: 3564106 - RNA, 16 nt, Human
aaugaacaaagaccaa

SEQ ID NO: 3564107 - RNA, 18 nt, Human
aaugaacaagagaagcau

SEQ ID NO: 3564108 - RNA, 15 nt, Human
aaugaacaagcauuc

SEQ ID NO: 3564109 - RNA, 15 nt, Human
aaugaacacucuuuu

SEQ ID NO: 3564110 - RNA, 18 nt, Human
aaugaacacucuuuugcu

SEQ ID NO: 3564111 - RNA, 12 nt, Human
aaugaacagaac

SEQ ID NO: 3564112 - RNA, 14 nt, Human
aaugaacagaacau

SEQ ID NO: 3564113 - RNA, 15 nt, Human
aaugaacagaacaua

SEQ ID NO: 3564114 - RNA, 13 nt, Human
aaugaacauucca

SEQ ID NO: 3564115 - RNA, 16 nt, Human
aaugaaccacaucuug

SEQ ID NO: 3564116 - RNA, 23 nt, Human
aaugaaccacaucuugcucugcu

SEQ ID NO: 3564117 - RNA, 14 nt, Human
aaugaacugaaguu

SEQ ID NO: 3564118 - RNA, 15 nt, Human
aaugaacugaaguuu

SEQ ID NO: 3564119 - RNA, 20 nt, Human
aaugaagagcuguugauggg

SEQ ID NO: 3564120 - RNA, 21 nt, Human
aaugaagauaccaucagcaaa

SEQ ID NO: 3564121 - RNA, 12 nt, Human
aaugaagauacu

SEQ ID NO: 3564122 - RNA, 23 nt, Human
aaugaagcaaaugucaugcugcc

SEQ ID NO: 3564123 - RNA, 13 nt, Human
aaugaagccagcu

SEQ ID NO: 3564124 - RNA, 22 nt, Human
aaugaagccauaugaacagcug

SEQ ID NO: 3564125 - RNA, 12 nt, Human
aaugaagcuugu

SEQ ID NO: 3564126 - RNA, 17 nt, Human
aaugaagcuuguguauc

SEQ ID NO: 3564127 - RNA, 22 nt, Human
aaugaaggaaauaaaaaagucu

SEQ ID NO: 3564128 - RNA, 23 nt, Human
aaugaaggaaauaaaaaagucuc

SEQ ID NO: 3564129 - RNA, 21 nt, Human
aaugaaguaacuugucuuaaa

SEQ ID NO: 3564130 - RNA, 16 nt, Human
aaugaaguauuucuca

SEQ ID NO: 3564131 - RNA, 23 nt, Human
aaugaagucucugaagugaaacu

SEQ ID NO: 3564132 - RNA, 14 nt, Human
aaugaaguugaaaa

SEQ ID NO: 3564133 - RNA, 14 nt, Human
aaugaaguuuauac

SEQ ID NO: 3564134 - RNA, 13 nt, Human
aaugaaguuugaa

SEQ ID NO: 3564135 - RNA, 14 nt, Human
aaugaaguuugaau

SEQ ID NO: 3564136 - RNA, 15 nt, Human
aaugaaguuugaaug

SEQ ID NO: 3564137 - RNA, 21 nt, Human
aaugaaguuugaauguuaaau

SEQ ID NO: 3564138 - RNA, 14 nt, Human
aaugaauaucuauu

SEQ ID NO: 3564139 - RNA, 15 nt, Human
aaugaauauugaagu

SEQ ID NO: 3564140 - RNA, 14 nt, Human
aaugaaugaaacau

SEQ ID NO: 3564141 - RNA, 15 nt, Human
aaugaaugaaugaau

SEQ ID NO: 3564142 - RNA, 19 nt, Human
aaugaaugaggucugggcu

SEQ ID NO: 3564143 - RNA, 19 nt, Human
aaugaauggacucaaacug

SEQ ID NO: 3564144 - RNA, 22 nt, Human
aaugaauggcuaagcaaaaugu

SEQ ID NO: 3564145 - RNA, 13 nt, Human
aaugaaugucacu

SEQ ID NO: 3564146 - RNA, 17 nt, Human
aauguuuaugagccaga

SEQ ID NO: 3564147 - RNA, 15 nt, Human
aauguuuauuccuug

SEQ ID NO: 3564148 - RNA, 16 nt, Human
aauguuuauuccuuga

SEQ ID NO: 3564149 - RNA, 15 nt, Human
aauguuucauuugca

SEQ ID NO: 3564150 - RNA, 12 nt, Human
aauguuucuauc

SEQ ID NO: 3564151 - RNA, 22 nt, Human
aauguuucuucuagguucuaaa

SEQ ID NO: 3564152 - RNA, 17 nt, Human
aauguuucuuuuguuug

SEQ ID NO: 3564153 - RNA, 22 nt, Human
aauguuugaggagcauguuuug

SEQ ID NO: 3564154 - RNA, 14 nt, Human
aauguuugcauaua

SEQ ID NO: 3564155 - RNA, 23 nt, Human
aauguuugggcagaagggagaag

SEQ ID NO: 3564156 - RNA, 22 nt, Human
aauguuugucucaguuggaaau

SEQ ID NO: 3564157 - RNA, 18 nt, Human
aauguuuguuaaaaauaa

SEQ ID NO: 3564158 - RNA, 14 nt, Human
aauguuuuaaaugu

SEQ ID NO: 3564159 - RNA, 15 nt, Human
aauguuuuaaaugua

SEQ ID NO: 3564160 - RNA, 17 nt, Human
aauguuuuaaauguaca

SEQ ID NO: 3564161 - RNA, 13 nt, Human
aauguuuuaaauu

SEQ ID NO: 3564162 - RNA, 19 nt, Human
aauguuuucuuugcaaagu

SEQ ID NO: 3564163 - RNA, 22 nt, Human
aauguuuucuuugcaaaguauu

SEQ ID NO: 3564164 - RNA, 14 nt, Human
aauguuuugcuuuu

SEQ ID NO: 3564165 - RNA, 13 nt, Human
aauguuuuguaaa

SEQ ID NO: 3564166 - RNA, 21 nt, Human
aauguuuuguaaacuuugaaa

SEQ ID NO: 3564167 - RNA, 22 nt, Human
aauguuuuguaaacuuugaaau

SEQ ID NO: 3564168 - RNA, 16 nt, Human
aauguuuuuaaauaua

SEQ ID NO: 3564169 - RNA, 22 nt, Human
aauguuuuuaauaaaagaaaau

SEQ ID NO: 3564170 - RNA, 14 nt, Human
aauguuuuucuaaa

SEQ ID NO: 3564171 - RNA, 15 nt, Human
aauguuuuucugcca

SEQ ID NO: 3564172 - RNA, 21 nt, Human
aauguuuuucugccagggagc

SEQ ID NO: 3564173 - RNA, 19 nt, Human
aauguuuuuucauguguuu

SEQ ID NO: 3564174 - RNA, 15 nt, Human
aauguuuuuugccac

SEQ ID NO: 3564175 - RNA, 22 nt, Human
aauguuuuuuuuuaaagacuuu

SEQ ID NO: 3564176 - RNA, 18 nt, Human
aauuaaaaaaaaauugua

SEQ ID NO: 3564177 - RNA, 15 nt, Human
aauuaaaaaagauaa

SEQ ID NO: 3564178 - RNA, 16 nt, Human
aauuaaaaaagauaaa

SEQ ID NO: 3564179 - RNA, 17 nt, Human
aauuaaaaacuaguagu

SEQ ID NO: 3564180 - RNA, 12 nt, Human
aauuaaaaagau

SEQ ID NO: 3564181 - RNA, 16 nt, Human
aauuaaaaagauucuu

SEQ ID NO: 3564182 - RNA, 19 nt, Human
aauuaaaaagauucuuuuu

SEQ ID NO: 3564183 - RNA, 12 nt, Human
aauuaaaacaau

SEQ ID NO: 3564184 - RNA, 14 nt, Human
aauuaaaacaaugu

SEQ ID NO: 3564185 - RNA, 18 nt, Human
aauuaaaacacaacaucu

SEQ ID NO: 3564186 - RNA, 10 nt, Human
aauuaaaacu

SEQ ID NO: 3564187 - RNA, 19 nt, Human
aauuaaaacuauucaugcu

SEQ ID NO: 3564188 - RNA, 16 nt, Human
aauuaaaagcaaauca

SEQ ID NO: 3564189 - RNA, 13 nt, Human
aauuaaaauggau

SEQ ID NO: 3564190 - RNA, 21 nt, Human
aauuaaaauggaugccuugaa

SEQ ID NO: 3564191 - RNA, 14 nt, Human
aauuaaacggauua

SEQ ID NO: 3564192 - RNA, 17 nt, Human
aauuaaacggauuauuu

SEQ ID NO: 3564193 - RNA, 21 nt, Human
aauuaaacggauuauuuuuuc

SEQ ID NO: 3564194 - RNA, 14 nt, Human
aauuaaacuuuuaa

SEQ ID NO: 3564195 - RNA, 14 nt, Human
aauuaaagaaaaua

SEQ ID NO: 3564196 - RNA, 17 nt, Human
aauuaaagaaaauaaaa

SEQ ID NO: 3564197 - RNA, 20 nt, Human
aauuaaaguguccauugaca

SEQ ID NO: 3564198 - RNA, 21 nt, Human
aauuaaaguguccauugacau

SEQ ID NO: 3564199 - RNA, 14 nt, Human
aauuaacauauaau

SEQ ID NO: 3564200 - RNA, 15 nt, Human
aauuaacauauaaua

SEQ ID NO: 3564201 - RNA, 18 nt, Human
aauuaacauguuaaacca

SEQ ID NO: 3564202 - RNA, 20 nt, Human
aauuaacauguuaaaccaug

SEQ ID NO: 3564203 - RNA, 17 nt, Human
aauuaaccaaaaaaguu

SEQ ID NO: 3564204 - RNA, 15 nt, Human
aauuaaccuggugcu

SEQ ID NO: 3564205 - RNA, 16 nt, Human
aauuaaccuggugcug

SEQ ID NO: 3564206 - RNA, 17 nt, Human
aauuaacuuacuuccaa

SEQ ID NO: 3564207 - RNA, 11 nt, Human
aauuaacuuga

SEQ ID NO: 3564208 - RNA, 11 nt, Human
aauuaacuuuu

SEQ ID NO: 3564209 - RNA, 20 nt, Human
aauuaagaaaggauaaaguu

SEQ ID NO: 3564210 - RNA, 21 nt, Human
aauuaagaaaggauaaaguug

SEQ ID NO: 3564211 - RNA, 15 nt, Human
aauuaagaagaaaau

SEQ ID NO: 3564212 - RNA, 16 nt, Human
aauuaagaaggcaaaa

SEQ ID NO: 3564213 - RNA, 23 nt, Human
aauuaagaaggcaaaaauguaaa

SEQ ID NO: 3564214 - RNA, 21 nt, Human
aauuaagaauauguuuccuug

SEQ ID NO: 3564215 - RNA, 23 nt, Human
aauuaagcaaauguuaaaaguuu

SEQ ID NO: 3564216 - RNA, 22 nt, Human
aauuaagcccuaagguccuaag

SEQ ID NO: 3564217 - RNA, 22 nt, Human
aauuaaggauuuuaugcuuuaa

SEQ ID NO: 3564218 - RNA, 15 nt, Human
aauuaagguguuuga

SEQ ID NO: 3564219 - RNA, 17 nt, Human
aauuaagguguuugaaa

SEQ ID NO: 3564220 - RNA, 18 nt, Human
aauuaagguguuugaaaa

SEQ ID NO: 3564221 - RNA, 16 nt, Human
aauuaaguacuaugua

SEQ ID NO: 3564222 - RNA, 17 nt, Human
aauuaaguacuauguau

SEQ ID NO: 3564223 - RNA, 14 nt, Human
aauuaaguaucuga

SEQ ID NO: 3564224 - RNA, 22 nt, Human
aauuaaguccuacuuuuaaaga

SEQ ID NO: 3564225 - RNA, 14 nt, Human
aauuaaguuaucuu

SEQ ID NO: 3564226 - RNA, 14 nt, Human
aauuaauagcuuuu

SEQ ID NO: 3564227 - RNA, 19 nt, Human
aauuaauaucccuacaugu

SEQ ID NO: 3564228 - RNA, 21 nt, Human
aauuaauaucccuacauguau

SEQ ID NO: 3564229 - RNA, 13 nt, Human
aauuaauaucuuu

SEQ ID NO: 3564230 - RNA, 22 nt, Human
aauuaaucugggccagaauuuc

SEQ ID NO: 3564231 - RNA, 21 nt, Human
aauuaaugucaguauuucaac

SEQ ID NO: 3564232 - RNA, 23 nt, Human
aauuaauuccuguuugucuacau

SEQ ID NO: 3564233 - RNA, 17 nt, Human
aauuaauuccuucagca

SEQ ID NO: 3564234 - RNA, 22 nt, Human
aauuaauugugugaacuuggaa

SEQ ID NO: 3564235 - RNA, 12 nt, Human
aauuaauuucag

SEQ ID NO: 3564236 - RNA, 21 nt, Human
aauuaauuugauuaacaaaua

SEQ ID NO: 3564237 - RNA, 13 nt, Human
aauuaauuuggag

SEQ ID NO: 3564238 - RNA, 18 nt, Human
aauuaauuuuuuuauugu

SEQ ID NO: 3564239 - RNA, 18 nt, Human
aauuacaacggagucaaa

SEQ ID NO: 3564240 - RNA, 14 nt, Human
aauuacaacuaagu

SEQ ID NO: 3564241 - RNA, 23 nt, Human
aauuacaauugucauuuauaaaa

SEQ ID NO: 3564242 - RNA, 19 nt, Human
aauuacaguccaaaauacu

SEQ ID NO: 3564243 - RNA, 11 nt, Human
aauuacaguuu

SEQ ID NO: 3564244 - RNA, 17 nt, Human
aauuacauuuguaauuu

SEQ ID NO: 3564245 - RNA, 18 nt, Human
aauuacauuuguaauuua

SEQ ID NO: 3564246 - RNA, 19 nt, Human
aauuacauuuguaauuuaa

SEQ ID NO: 3564247 - RNA, 14 nt, Human
aauuacauuuguau

SEQ ID NO: 3564248 - RNA, 15 nt, Human
aauuaccaaccuguu

SEQ ID NO: 3564249 - RNA, 16 nt, Human
aauuaccagaaagaua

SEQ ID NO: 3564250 - RNA, 23 nt, Human
aauuaccaguaaaguguaacaua

SEQ ID NO: 3564251 - RNA, 15 nt, Human
aauuacgauaaggaa

SEQ ID NO: 3564252 - RNA, 13 nt, Human
aauuacuaacuuc

SEQ ID NO: 3564253 - RNA, 13 nt, Human
aauuacuaauuuu

SEQ ID NO: 3564254 - RNA, 15 nt, Human
aauuacuaauuuuac

SEQ ID NO: 3564255 - RNA, 15 nt, Human
aauuacuacaaaauu

SEQ ID NO: 3564256 - RNA, 16 nt, Human
aauuacuacaaaauuu

SEQ ID NO: 3564257 - RNA, 17 nt, Human
aauuacuauagcaaagu

SEQ ID NO: 3564258 - RNA, 13 nt, Human
aauuacucaggaa

SEQ ID NO: 3564259 - RNA, 13 nt, Human
aauuacuuaguau

SEQ ID NO: 3564260 - RNA, 22 nt, Human
aauuacuuaucauccacauugu

SEQ ID NO: 3564261 - RNA, 23 nt, Human
aauuacuuuuuuccaauuuuaga

SEQ ID NO: 3564262 - RNA, 20 nt, Human
aauuagaaaaaaauuacuaa

SEQ ID NO: 3564263 - RNA, 13 nt, Human
aagugaagacugg

SEQ ID NO: 3564264 - RNA, 10 nt, Human
aagugaaggu

SEQ ID NO: 3564265 - RNA, 14 nt, Human
aagugaagugauac

SEQ ID NO: 3564266 - RNA, 15 nt, Human
aagugaauaaaaauu

SEQ ID NO: 3564267 - RNA, 16 nt, Human
aagugaauaaaaauua

SEQ ID NO: 3564268 - RNA, 12 nt, Human
aagugaauaaac

SEQ ID NO: 3564269 - RNA, 15 nt, Human
aagugaauaaacuuc

SEQ ID NO: 3564270 - RNA, 20 nt, Human
aagugaauaaacuucagcac

SEQ ID NO: 3564271 - RNA, 16 nt, Human
aagugaaugaaagauu

SEQ ID NO: 3564272 - RNA, 14 nt, Human
aagugaauugaagu

SEQ ID NO: 3564273 - RNA, 16 nt, Human
aagugaauuugaauga

SEQ ID NO: 3564274 - RNA, 19 nt, Human
aagugaauuugaaugaaaa

SEQ ID NO: 3564275 - RNA, 15 nt, Human
aagugaauuugccug

SEQ ID NO: 3564276 - RNA, 22 nt, Human
aagugacagggaagcuacaggu

SEQ ID NO: 3564277 - RNA, 18 nt, Human
aagugaccaucauuucac

SEQ ID NO: 3564278 - RNA, 20 nt, Human
aagugaccgcaccucacacu

SEQ ID NO: 3564279 - RNA, 19 nt, Human
aagugacuguucaagagca

SEQ ID NO: 3564280 - RNA, 14 nt, Human
aagugacuucacag

SEQ ID NO: 3564281 - RNA, 17 nt, Human
aagugagagagacaaga

SEQ ID NO: 3564282 - RNA, 14 nt, Human
aagugagagcuggg

SEQ ID NO: 3564283 - RNA, 18 nt, Human
aagugaggccacugaaga

SEQ ID NO: 3564284 - RNA, 21 nt, Human
aagugaggccacugaagagga

SEQ ID NO: 3564285 - RNA, 19 nt, Human
aagugagggcucacucagc

SEQ ID NO: 3564286 - RNA, 18 nt, Human
aagugaguguuucuauga

SEQ ID NO: 3564287 - RNA, 23 nt, Human
aagugauccucccaccucagccu

SEQ ID NO: 3564288 - RNA, 13 nt, Human
aagugaugacaua

SEQ ID NO: 3564289 - RNA, 18 nt, Human
aagugaugggcuuucucu

SEQ ID NO: 3564290 - RNA, 21 nt, Human
aagugauuaaacgugcagacu

SEQ ID NO: 3564291 - RNA, 17 nt, Human
aagugauucucaugccu

SEQ ID NO: 3564292 - RNA, 20 nt, Human
aagugauucucaugccucag

SEQ ID NO: 3564293 - RNA, 21 nt, Human
aagugauucucaugccucagc

SEQ ID NO: 3564294 - RNA, 15 nt, Human
aagugauucuccugc

SEQ ID NO: 3564295 - RNA, 18 nt, Human
aagugauuguaugaauuu

SEQ ID NO: 3564296 - RNA, 18 nt, Human
aagugcaagauggggagu

SEQ ID NO: 3564297 - RNA, 20 nt, Human
aagugcacacagaaauauau

SEQ ID NO: 3564298 - RNA, 23 nt, Human
aagugcacacagaaauauauaua

SEQ ID NO: 3564299 - RNA, 16 nt, Human
aagugcacuuucuaau

SEQ ID NO: 3564300 - RNA, 13 nt, Human
aagugcaggcugg

SEQ ID NO: 3564301 - RNA, 14 nt, Human
aagugcaguucuua

SEQ ID NO: 3564302 - RNA, 14 nt, Human
aagugcauuucuga

SEQ ID NO: 3564303 - RNA, 14 nt, Human
aagugcauuuuugu

SEQ ID NO: 3564304 - RNA, 21 nt, Human
aagugccacucauuccuguag

SEQ ID NO: 3564305 - RNA, 23 nt, Human
aagugccacugcccgagcuggug

SEQ ID NO: 3564306 - RNA, 21 nt, Human
aagugccagucuugugucugc

SEQ ID NO: 3564307 - RNA, 16 nt, Human
aagugccauuaacaaa

SEQ ID NO: 3564308 - RNA, 17 nt, Human
aagugccauuaacaaau

SEQ ID NO: 3564309 - RNA, 12 nt, Human
aagugccccugc

SEQ ID NO: 3564310 - RNA, 13 nt, Human
aagugccccugcu

SEQ ID NO: 3564311 - RNA, 22 nt, Human
aagugccccugcugccucccca

SEQ ID NO: 3564312 - RNA, 12 nt, Human
aagugcccucca

SEQ ID NO: 3564313 - RNA, 13 nt, Human
aagugcccucucc

SEQ ID NO: 3564314 - RNA, 23 nt, Human
aagugcccucucccacccucuuc

SEQ ID NO: 3564315 - RNA, 19 nt, Human
aagugccgcaaauuguacc

SEQ ID NO: 3564316 - RNA, 21 nt, Human
aagugccucaagaggaaugaa

SEQ ID NO: 3564317 - RNA, 23 nt, Human
aagugccucacauuuuuuucuac

SEQ ID NO: 3564318 - RNA, 22 nt, Human
aagugcguccacgagcuguuua

SEQ ID NO: 3564319 - RNA, 16 nt, Human
aagugcgugccgugug

SEQ ID NO: 3564320 - RNA, 15 nt, Human
aagugcguguguaga

SEQ ID NO: 3564321 - RNA, 16 nt, Human
aagugcguguguagag

SEQ ID NO: 3564322 - RNA, 22 nt, Human
aagugcguguguagaguuaaga

SEQ ID NO: 3564323 - RNA, 23 nt, Human
aagugcguguguagaguuaagaa

SEQ ID NO: 3564324 - RNA, 16 nt, Human
aauuagaaaauauucu

SEQ ID NO: 3564325 - RNA, 18 nt, Human
aauuagaacccuugcaca

SEQ ID NO: 3564326 - RNA, 14 nt, Human
aauuagaagacauu

SEQ ID NO: 3564327 - RNA, 15 nt, Human
aauuagaagacauuu

SEQ ID NO: 3564328 - RNA, 17 nt, Human
aauuagacacuuuggaa

SEQ ID NO: 3564329 - RNA, 15 nt, Human
aauuagacugugauu

SEQ ID NO: 3564330 - RNA, 20 nt, Human
aauuagacugugauucagaa

SEQ ID NO: 3564331 - RNA, 16 nt, Human
aauuagauccauuaau

SEQ ID NO: 3564332 - RNA, 14 nt, Human
aauuagaugcaugu

SEQ ID NO: 3564333 - RNA, 21 nt, Human
aauuagauuuuaaaacuucau

SEQ ID NO: 3564334 - RNA, 20 nt, Human
aauuagccuaagauauacuu

SEQ ID NO: 3564335 - RNA, 22 nt, Human
aauuagccuaagauauacuugu

SEQ ID NO: 3564336 - RNA, 22 nt, Human
aauuagcuuauguuaacugaca

SEQ ID NO: 3564337 - RNA, 22 nt, Human
aauuaggaaguguaacagcuga

SEQ ID NO: 3564338 - RNA, 19 nt, Human
aauuaggaggcucaacaau

SEQ ID NO: 3564339 - RNA, 20 nt, Human
aauuaggcaaggcuauguga

SEQ ID NO: 3564340 - RNA, 21 nt, Human
aauuaggcccccaucauccuc

SEQ ID NO: 3564341 - RNA, 19 nt, Human
aauuaggcuguaacuacuu

SEQ ID NO: 3564342 - RNA, 22 nt, Human
aauuaggcuguaacuacuuuau

SEQ ID NO: 3564343 - RNA, 19 nt, Human
aauuagggcucuaauuucc

SEQ ID NO: 3564344 - RNA, 20 nt, Human
aauuagggcucuaauuuccu

SEQ ID NO: 3564345 - RNA, 20 nt, Human
aauuagggguugcuaagaag

SEQ ID NO: 3564346 - RNA, 17 nt, Human
aauuaggguacauuuau

SEQ ID NO: 3564347 - RNA, 19 nt, Human
aauuaggguacauuuauaa

SEQ ID NO: 3564348 - RNA, 15 nt, Human
aauuagguugaaaca

SEQ ID NO: 3564349 - RNA, 22 nt, Human
aauuagguugaaacauaucucu

SEQ ID NO: 3564350 - RNA, 14 nt, Human
aauuccaugaaugu

SEQ ID NO: 3564351 - RNA, 22 nt, Human
aauucccuaucuuuuaguuuua

SEQ ID NO: 3564352 - RNA, 23 nt, Human
aauucccucucucugacucucaa

SEQ ID NO: 3564353 - RNA, 13 nt, Human
aauucccuggacc

SEQ ID NO: 3564354 - RNA, 13 nt, Human
aauuccuaacuuu

SEQ ID NO: 3564355 - RNA, 10 nt, Human
aauuccuaca

SEQ ID NO: 3564356 - RNA, 18 nt, Human
aauuccuacagcacuacu

SEQ ID NO: 3564357 - RNA, 16 nt, Human
aauuccuauugugauu

SEQ ID NO: 3564358 - RNA, 20 nt, Human
aauuccuauugugauuugac

SEQ ID NO: 3564359 - RNA, 22 nt, Human
aauuccuauugugauuugacug

SEQ ID NO: 3564360 - RNA, 21 nt, Human
aauuccucucacuaaacuuua

SEQ ID NO: 3564361 - RNA, 11 nt, Human
aauuccugggc

SEQ ID NO: 3564362 - RNA, 21 nt, Human
aauuccuguagcaucuucugg

SEQ ID NO: 3564363 - RNA, 21 nt, Human
aauuccuguuuuuauuauuaa

SEQ ID NO: 3564364 - RNA, 12 nt, Human
aauucuaaaaug

SEQ ID NO: 3564365 - RNA, 20 nt, Human
aauucuaaauaaaauauaau

SEQ ID NO: 3564366 - RNA, 17 nt, Human
aauucuaacccagguau

SEQ ID NO: 3564367 - RNA, 14 nt, Human
aauucuaacuuuuu

SEQ ID NO: 3564368 - RNA, 23 nt, Human
aauucuaggcaucccaggggacc

SEQ ID NO: 3564369 - RNA, 22 nt, Human
aauucuaucuuuuguuuccuuu

SEQ ID NO: 3564370 - RNA, 17 nt, Human
acaaaugggcgcccccc

SEQ ID NO: 3564371 - RNA, 17 nt, Human
acaaauguaaacauuuu

SEQ ID NO: 3564372 - RNA, 14 nt, Human
acaaaugucuauca

SEQ ID NO: 3564373 - RNA, 15 nt, Human
acaaaugugaagaug

SEQ ID NO: 3564374 - RNA, 16 nt, Human
acaaaugugaagaugc

SEQ ID NO: 3564375 - RNA, 18 nt, Human
acaaaugugaagaugcau

SEQ ID NO: 3564376 - RNA, 13 nt, Human
acaaauguuuugc

SEQ ID NO: 3564377 - RNA, 20 nt, Human
acaaauuagguuuuguacaa

SEQ ID NO: 3564378 - RNA, 22 nt, Human
acaaauuauguuacaucuguuu

SEQ ID NO: 3564379 - RNA, 12 nt, Human
acaaauucuguu

SEQ ID NO: 3564380 - RNA, 15 nt, Human
acaaauuuaaaacaa

SEQ ID NO: 3564381 - RNA, 19 nt, Human
acaaauuuacagagacaga

SEQ ID NO: 3564382 - RNA, 16 nt, Human
acaaauuuuuauuucu

SEQ ID NO: 3564383 - RNA, 14 nt, Human
acaaauuuuucugu

SEQ ID NO: 3564384 - RNA, 16 nt, Human
acaaauuuuucugugg

SEQ ID NO: 3564385 - RNA, 17 nt, Human
acaacaaaaagcuuccc

SEQ ID NO: 3564386 - RNA, 14 nt, Human
acaacacuguagua

SEQ ID NO: 3564387 - RNA, 13 nt, Human
acaacagauugga

SEQ ID NO: 3564388 - RNA, 23 nt, Human
acaacagauuggauuuuauguug

SEQ ID NO: 3564389 - RNA, 14 nt, Human
acaacagauuugug

SEQ ID NO: 3564390 - RNA, 18 nt, Human
acaacagauuugugaacu

SEQ ID NO: 3564391 - RNA, 22 nt, Human
acaacagcucgauccaaauugu

SEQ ID NO: 3564392 - RNA, 18 nt, Human
acaacagucuucauuuuu

SEQ ID NO: 3564393 - RNA, 17 nt, Human
acaacagugcuaaaaau

SEQ ID NO: 3564394 - RNA, 23 nt, Human
acaacaguuacauaauucacucu

SEQ ID NO: 3564395 - RNA, 16 nt, Human
acaacauccaaguggc

SEQ ID NO: 3564396 - RNA, 16 nt, Human
acaacauccauguccu

SEQ ID NO: 3564397 - RNA, 21 nt, Human
acaacaugaggccacuggaga

SEQ ID NO: 3564398 - RNA, 22 nt, Human
acaacauguauaauauuuuuaa

SEQ ID NO: 3564399 - RNA, 19 nt, Human
acaacauguuuaauaaaua

SEQ ID NO: 3564400 - RNA, 19 nt, Human
acaacauguuuccagcauu

SEQ ID NO: 3564401 - RNA, 17 nt, Human
acaacauuuacaacuca

SEQ ID NO: 3564402 - RNA, 15 nt, Human
acaacauuuugagaa

SEQ ID NO: 3564403 - RNA, 18 nt, Human
acaacauuuugagaacaa

SEQ ID NO: 3564404 - RNA, 21 nt, Human
acaaccaauuuacacugccau

SEQ ID NO: 3564405 - RNA, 21 nt, Human
acaaccaccuaaucaggcuga

SEQ ID NO: 3564406 - RNA, 16 nt, Human
acaaccauauuuagca

SEQ ID NO: 3564407 - RNA, 14 nt, Human
acaaccaugucauu

SEQ ID NO: 3564408 - RNA, 13 nt, Human
acaaccauuaaag

SEQ ID NO: 3564409 - RNA, 14 nt, Human
acaaccauuccaga

SEQ ID NO: 3564410 - RNA, 17 nt, Human
acaacccuguuuuauac

SEQ ID NO: 3564411 - RNA, 18 nt, Human
acaaccucccucuuguuu

SEQ ID NO: 3564412 - RNA, 18 nt, Human
acaaccuucuguggcuca

SEQ ID NO: 3564413 - RNA, 22 nt, Human
acaacgagccuuuucacccuuc

SEQ ID NO: 3564414 - RNA, 22 nt, Human
acaacgugcaacugacacuccc

SEQ ID NO: 3564415 - RNA, 13 nt, Human
acaacgugcauug

SEQ ID NO: 3564416 - RNA, 18 nt, Human
acaacgugcucuuuguuu

SEQ ID NO: 3564417 - RNA, 15 nt, Human
acaacuacagaaaaa

SEQ ID NO: 3564418 - RNA, 19 nt, Human
acaacuacagaaaaaccag

SEQ ID NO: 3564419 - RNA, 18 nt, Human
acaacuauccugacuucu

SEQ ID NO: 3564420 - RNA, 17 nt, Human
acaacuauggaucagaa

SEQ ID NO: 3564421 - RNA, 13 nt, Human
acaacuauuuuca

SEQ ID NO: 3564422 - RNA, 20 nt, Human
acaacuauuuucagauguga

SEQ ID NO: 3564423 - RNA, 19 nt, Human
acaacugaguccuuaaaca

SEQ ID NO: 3564424 - RNA, 21 nt, Human
acaacugccucgaaacacaga

SEQ ID NO: 3564425 - RNA, 19 nt, Human
acaacuggcaggcaggcuc

SEQ ID NO: 3564426 - RNA, 17 nt, Human
acaacugucuaacuuua

SEQ ID NO: 3564427 - RNA, 13 nt, Human
acaacugugacug

SEQ ID NO: 3564428 - RNA, 16 nt, Human
acaacuuaaaaagucu

SEQ ID NO: 3564429 - RNA, 13 nt, Human
acaacuuaaguug

SEQ ID NO: 3564430 - RNA, 17 nt, Human
acaacuucaagugcaug

SEQ ID NO: 3564431 - RNA, 22 nt, Human
acaacuuucacuauaaugugaa

SEQ ID NO: 3564432 - RNA, 20 nt, Human
acaacuuuuaaccaaacaau

SEQ ID NO: 3564433 - RNA, 12 nt, Human
acaagaaaacau

SEQ ID NO: 3564434 - RNA, 12 nt, Human
acaagaaaggag

SEQ ID NO: 3564435 - RNA, 19 nt, Human
acaagaaagggccaggaga

SEQ ID NO: 3564436 - RNA, 17 nt, Human
acaagaaauaauagaaa

SEQ ID NO: 3564437 - RNA, 15 nt, Human
acaagaaaucccugu

SEQ ID NO: 3564438 - RNA, 23 nt, Human
acaagaaaucccuguuuaauauu

SEQ ID NO: 3564439 - RNA, 22 nt, Human
acaagaaaugaaagcagggacu

SEQ ID NO: 3564440 - RNA, 19 nt, Human
acaagaacacacacauaua

SEQ ID NO: 3564441 - RNA, 13 nt, Human
acaagaagaccag

SEQ ID NO: 3564442 - RNA, 13 nt, Human
acaagaagaugaa

SEQ ID NO: 3564443 - RNA, 22 nt, Human
acaagaauacuacuuaugaaau

SEQ ID NO: 3564444 - RNA, 23 nt, Human
acaagaaugaagguuuuuguaaa

SEQ ID NO: 3564445 - RNA, 13 nt, Human
acaagacacagug

SEQ ID NO: 3564446 - RNA, 15 nt, Human
acaagacagaagcug

SEQ ID NO: 3564447 - RNA, 19 nt, Human
acaagaccaccacuucgaa

SEQ ID NO: 3564448 - RNA, 20 nt, Human
acaagacuuuccccauacuc

SEQ ID NO: 3564449 - RNA, 16 nt, Human
acaagagcgaaacucc

SEQ ID NO: 3564450 - RNA, 12 nt, Human
acaagagugauu

SEQ ID NO: 3564451 - RNA, 15 nt, Human
acaagauauuguaca

SEQ ID NO: 3564452 - RNA, 22 nt, Human
acaagauauuguacauaaaaga

SEQ ID NO: 3564453 - RNA, 13 nt, Human
acaagaucuuuca

SEQ ID NO: 3564454 - RNA, 14 nt, Human
acaagaucuuucag

SEQ ID NO: 3564455 - RNA, 15 nt, Human
acaagaucuuucagg

SEQ ID NO: 3564456 - RNA, 21 nt, Human
acaagauucccagagacagga

SEQ ID NO: 3564457 - RNA, 17 nt, Human
acaagauugguguuuuu

SEQ ID NO: 3564458 - RNA, 19 nt, Human
acaagauugguguuuuuuu

SEQ ID NO: 3564459 - RNA, 23 nt, Human
acaagauugguguuuuuuucuau

SEQ ID NO: 3564460 - RNA, 14 nt, Human
acaagauuuagaaa

SEQ ID NO: 3564461 - RNA, 18 nt, Human
acaagauuuccuugugca

SEQ ID NO: 3564462 - RNA, 22 nt, Human
acaagauuuuuuaauuguuuaa

SEQ ID NO: 3564463 - RNA, 15 nt, Human
acaagcaaacccaga

SEQ ID NO: 3564464 - RNA, 16 nt, Human
acaagcaaacccagac

SEQ ID NO: 3564465 - RNA, 13 nt, Human
acaagcaagcucc

SEQ ID NO: 3564466 - RNA, 15 nt, Human
acaagcaagcuccca

SEQ ID NO: 3564467 - RNA, 16 nt, Human
acaagcaaguucugag

SEQ ID NO: 3564468 - RNA, 11 nt, Human
acaagcagagg

SEQ ID NO: 3564469 - RNA, 20 nt, Human
acaagcagagugcacagcug

SEQ ID NO: 3564470 - RNA, 15 nt, Human
acaagcauauaaaau

SEQ ID NO: 3564471 - RNA, 19 nt, Human
acaagcauauaaaauggca

SEQ ID NO: 3564472 - RNA, 23 nt, Human
acaagcauggucccacaucccug

SEQ ID NO: 3564473 - RNA, 13 nt, Human
acaagccacagaa

SEQ ID NO: 3564474 - RNA, 18 nt, Human
acaagccacagaagccag

SEQ ID NO: 3564475 - RNA, 13 nt, Human
acaagccagcugg

SEQ ID NO: 3564476 - RNA, 15 nt, Human
acaagccagggugug

SEQ ID NO: 3564477 - RNA, 13 nt, Human
acaagcccacagc

SEQ ID NO: 3564478 - RNA, 15 nt, Human
acaagcccacagcac

SEQ ID NO: 3564479 - RNA, 16 nt, Human
acaagcccacagcaca

SEQ ID NO: 3564480 - RNA, 14 nt, Human
acaagccccaggca

SEQ ID NO: 3564481 - RNA, 17 nt, Human
acaagccccaggcaggc

SEQ ID NO: 3564482 - RNA, 14 nt, Human
acaagcccccccuu

SEQ ID NO: 3564483 - RNA, 22 nt, Human
acaagccugagggaaaggccag

SEQ ID NO: 3564484 - RNA, 23 nt, Human
acaagccugagggaaaggccagc

SEQ ID NO: 3564485 - RNA, 18 nt, Human
acaagcgugagccacugc

SEQ ID NO: 3564486 - RNA, 22 nt, Human
acaagcuaaaauuagaugaacu

SEQ ID NO: 3564487 - RNA, 13 nt, Human
acaagcuccaagc

SEQ ID NO: 3564488 - RNA, 16 nt, Human
acaagcuccaagcucc

SEQ ID NO: 3564489 - RNA, 18 nt, Human
acaagcuccauuuaaaca

SEQ ID NO: 3564490 - RNA, 13 nt, Human
acaagcugcaccc

SEQ ID NO: 3564491 - RNA, 23 nt, Human
acaagcugcacccucaggcaggu

SEQ ID NO: 3564492 - RNA, 16 nt, Human
acaagcuggaagcaca

SEQ ID NO: 3564493 - RNA, 18 nt, Human
acaagcuggaagcacaug

SEQ ID NO: 3564494 - RNA, 13 nt, Human
acaagcuggcuua

SEQ ID NO: 3564495 - RNA, 19 nt, Human
acaagcuucaguaaguuau

SEQ ID NO: 3564496 - RNA, 13 nt, Human
acaagcuucugag

SEQ ID NO: 3564497 - RNA, 15 nt, Human
acaagcuucugagac

SEQ ID NO: 3564498 - RNA, 22 nt, Human
acaaggaaauacccuucuuuua

SEQ ID NO: 3564499 - RNA, 14 nt, Human
acaaggaagaaauu

SEQ ID NO: 3564500 - RNA, 14 nt, Human
acaaggacacgcgc

SEQ ID NO: 3564501 - RNA, 21 nt, Human
acaaggacagccccuccucca

SEQ ID NO: 3564502 - RNA, 22 nt, Human
acaaggacagccccuccuccau

SEQ ID NO: 3564503 - RNA, 19 nt, Human
acaaggacuaggguccugg

SEQ ID NO: 3564504 - RNA, 16 nt, Human
acaaggauugaaaauu

SEQ ID NO: 3564505 - RNA, 14 nt, Human
acaaggcaaggcug

SEQ ID NO: 3564506 - RNA, 16 nt, Human
acaaggcaaggcuguc

SEQ ID NO: 3564507 - RNA, 16 nt, Human
acaaggcagcaaggcc

SEQ ID NO: 3564508 - RNA, 17 nt, Human
acaaggcauucaagugu

SEQ ID NO: 3564509 - RNA, 18 nt, Human
acaaggccaucugggcuc

SEQ ID NO: 3564510 - RNA, 20 nt, Human
acacaggcaacugaggcaga

SEQ ID NO: 3564511 - RNA, 12 nt, Human
acacaggcagcu

SEQ ID NO: 3564512 - RNA, 16 nt, Human
acacaggccacccugu

SEQ ID NO: 3564513 - RNA, 24 nt, Human
acacaggcccggcuccaggcuccu

SEQ ID NO: 3564514 - RNA, 12 nt, Human
acacaggcuggc

SEQ ID NO: 3564515 - RNA, 15 nt, Human
acacagggacuugaa

SEQ ID NO: 3564516 - RNA, 21 nt, Human
acacaggggaggugauagcau

SEQ ID NO: 3564517 - RNA, 22 nt, Human
acacaggggcuugacuuuuuca

SEQ ID NO: 3564518 - RNA, 14 nt, Human
acacaggucuuucc

SEQ ID NO: 3564519 - RNA, 16 nt, Human
acacaggucuuuccua

SEQ ID NO: 3564520 - RNA, 17 nt, Human
acacagguggugucacu

SEQ ID NO: 3564521 - RNA, 19 nt, Human
acacagguggugucacugu

SEQ ID NO: 3564522 - RNA, 20 nt, Human
acacagguggugucacuguc

SEQ ID NO: 3564523 - RNA, 19 nt, Human
acacaguaccauuuaaugg

SEQ ID NO: 3564524 - RNA, 18 nt, Human
acacaguauuacuucugc

SEQ ID NO: 3564525 - RNA, 12 nt, Human
acacaguauuuu

SEQ ID NO: 3564526 - RNA, 15 nt, Human
acacagucaaaauaa

SEQ ID NO: 3564527 - RNA, 19 nt, Human
acacagucaaaauaauucu

SEQ ID NO: 3564528 - RNA, 16 nt, Human
acacagucugcaagau

SEQ ID NO: 3564529 - RNA, 13 nt, Human
acacagugagucg

SEQ ID NO: 3564530 - RNA, 16 nt, Human
acacagugccuucaau

SEQ ID NO: 3564531 - RNA, 22 nt, Human
acacagugcugaccagacagcc

SEQ ID NO: 3564532 - RNA, 20 nt, Human
acacagugggugguggaucu

SEQ ID NO: 3564533 - RNA, 20 nt, Human
acacagugugaauaaagugc

SEQ ID NO: 3564534 - RNA, 15 nt, Human
acacaguugcuguca

SEQ ID NO: 3564535 - RNA, 22 nt, Human
acacaguugcugucauaagaau

SEQ ID NO: 3564536 - RNA, 23 nt, Human
acacaguuuugaccuaacauacc

SEQ ID NO: 3564537 - RNA, 17 nt, Human
acacauaauuaaagugu

SEQ ID NO: 3564538 - RNA, 20 nt, Human
acacauaauuaaagugucca

SEQ ID NO: 3564539 - RNA, 13 nt, Human
acacauacaguuu

SEQ ID NO: 3564540 - RNA, 22 nt, Human
acacauagauuaauggcacuga

SEQ ID NO: 3564541 - RNA, 22 nt, Human
acacauagauucaccuguaaaa

SEQ ID NO: 3564542 - RNA, 23 nt, Human
acacauauaaauugucuuaaugg

SEQ ID NO: 3564543 - RNA, 23 nt, Human
acacauauaccuauaaugugugu

SEQ ID NO: 3564544 - RNA, 15 nt, Human
acacaucagcuugcc

SEQ ID NO: 3564545 - RNA, 16 nt, Human
acacaucaucuguaag

SEQ ID NO: 3564546 - RNA, 17 nt, Human
acacauccagacaucau

SEQ ID NO: 3564547 - RNA, 20 nt, Human
acacauccagacaucaugaa

SEQ ID NO: 3564548 - RNA, 17 nt, Human
acacaucccuaaugugu

SEQ ID NO: 3564549 - RNA, 16 nt, Human
acacauccgccuuuug

SEQ ID NO: 3564550 - RNA, 12 nt, Human
acacaucuccuc

SEQ ID NO: 3564551 - RNA, 18 nt, Human
acacaugcaaggucauuu

SEQ ID NO: 3564552 - RNA, 20 nt, Human
acacaugcaaggucauuuuu

SEQ ID NO: 3564553 - RNA, 15 nt, Human
acacaugcacacaca

SEQ ID NO: 3564554 - RNA, 16 nt, Human
acacaugcauacacac

SEQ ID NO: 3564555 - RNA, 16 nt, Human
acacaugcuaggaugc

SEQ ID NO: 3564556 - RNA, 18 nt, Human
acacaugcugaacaucac

SEQ ID NO: 3564557 - RNA, 21 nt, Human
acacaugcuucccuuuccuga

SEQ ID NO: 3564558 - RNA, 23 nt, Human
acacaugcuucccuuuccugagu

SEQ ID NO: 3564559 - RNA, 15 nt, Human
acacauuaagcaaau

SEQ ID NO: 3564560 - RNA, 22 nt, Human
acacauuacaaaguuaaaauug

SEQ ID NO: 3564561 - RNA, 23 nt, Human
acacauuagauuuuauuuuacua

SEQ ID NO: 3564562 - RNA, 16 nt, Human
acacauuaggaaaagu

SEQ ID NO: 3564563 - RNA, 13 nt, Human
acacauuaucuuc

SEQ ID NO: 3564564 - RNA, 15 nt, Human
acacauuaucuucug

SEQ ID NO: 3564565 - RNA, 22 nt, Human
acacauuguuauuuucagugau

SEQ ID NO: 3564566 - RNA, 17 nt, Human
acacauuugcuuuuugu

SEQ ID NO: 3564567 - RNA, 11 nt, Human
acacauuugua

SEQ ID NO: 3564568 - RNA, 15 nt, Human
acacauuuguacaga

SEQ ID NO: 3564569 - RNA, 13 nt, Human
acacauuuuauuu

SEQ ID NO: 3564570 - RNA, 18 nt, Human
acacauuuuuuaaaugca

SEQ ID NO: 3564571 - RNA, 13 nt, Human
acacauuuuuuug

SEQ ID NO: 3564572 - RNA, 17 nt, Human
acaccaacauaaaaaug

SEQ ID NO: 3564573 - RNA, 16 nt, Human
acaccaagaugucugu

SEQ ID NO: 3564574 - RNA, 18 nt, Human
acaccaagcacagcagcc

SEQ ID NO: 3564575 - RNA, 19 nt, Human
acaccaagcacagcagccu

SEQ ID NO: 3564576 - RNA, 13 nt, Human
acaccaagcagca

SEQ ID NO: 3564577 - RNA, 16 nt, Human
acaccaagcugugcca

SEQ ID NO: 3564578 - RNA, 18 nt, Human
acaccaagcugugccacc

SEQ ID NO: 3564579 - RNA, 21 nt, Human
acaccaagcugugccacccug

SEQ ID NO: 3564580 - RNA, 15 nt, Human
acaccaauauucaua

SEQ ID NO: 3564581 - RNA, 23 nt, Human
acaccaaucuuacuuuguaaauu

SEQ ID NO: 3564582 - RNA, 15 nt, Human
acaccacagacacac

SEQ ID NO: 3564583 - RNA, 15 nt, Human
acaccacuacauucu

SEQ ID NO: 3564584 - RNA, 13 nt, Human
acaccacucuggc

SEQ ID NO: 3564585 - RNA, 14 nt, Human
acaccagacagaca

SEQ ID NO: 3564586 - RNA, 13 nt, Human
acaccagagcaga

SEQ ID NO: 3564587 - RNA, 17 nt, Human
acaccagagcagaugca

SEQ ID NO: 3564588 - RNA, 18 nt, Human
acaccagagcagaugcag

SEQ ID NO: 3564589 - RNA, 22 nt, Human
acaccagagcagaugcagagag

SEQ ID NO: 3564590 - RNA, 13 nt, Human
acaccagagccca

SEQ ID NO: 3564591 - RNA, 16 nt, Human
acaccagcauuccuuu

SEQ ID NO: 3564592 - RNA, 12 nt, Human
acaccagccagg

SEQ ID NO: 3564593 - RNA, 14 nt, Human
acaccagccaggcu

SEQ ID NO: 3564594 - RNA, 22 nt, Human
acaccagccccugccccagccc

SEQ ID NO: 3564595 - RNA, 14 nt, Human
acaccaggcugugg

SEQ ID NO: 3564596 - RNA, 22 nt, Human
acaccauaagcuacugccaucc

SEQ ID NO: 3564597 - RNA, 23 nt, Human
acaccauaagcuacugccauccu

SEQ ID NO: 3564598 - RNA, 17 nt, Human
acaccauagguagaaug

SEQ ID NO: 3564599 - RNA, 19 nt, Human
acaccaucgcuggccccuu

SEQ ID NO: 3564600 - RNA, 14 nt, Human
acaccaucuuuugu

SEQ ID NO: 3564601 - RNA, 23 nt, Human
acaccauguuugagcucagaccc

SEQ ID NO: 3564602 - RNA, 15 nt, Human
acaccauuaccaaaa

SEQ ID NO: 3564603 - RNA, 21 nt, Human
acaccauuaccaaaauaauaa

SEQ ID NO: 3564604 - RNA, 21 nt, Human
acaccauuaugugcgcugaua

SEQ ID NO: 3564605 - RNA, 13 nt, Human
acacccacaggca

SEQ ID NO: 3564606 - RNA, 17 nt, Human
acacccaccguccgccc

SEQ ID NO: 3564607 - RNA, 17 nt, Human
acacccacucagcuccg

SEQ ID NO: 3564608 - RNA, 12 nt, Human
acacccagcccc

SEQ ID NO: 3564609 - RNA, 12 nt, Human
acacccagccuc

SEQ ID NO: 3564610 - RNA, 14 nt, Human
acacccaugaaaga

SEQ ID NO: 3564611 - RNA, 13 nt, Human
acaccccaccugc

SEQ ID NO: 3564612 - RNA, 21 nt, Human
acaccccaccugcgcuucacu

SEQ ID NO: 3564613 - RNA, 21 nt, Human
acaccccagacgaugucuuca

SEQ ID NO: 3564614 - RNA, 21 nt, Human
acaccccucaguugugcagcu

SEQ ID NO: 3564615 - RNA, 17 nt, Human
acaccccuuauccagga

SEQ ID NO: 3564616 - RNA, 20 nt, Human
acaccccuuauccaggacuc

SEQ ID NO: 3564617 - RNA, 21 nt, Human
acacccgugagcgccugugca

SEQ ID NO: 3564618 - RNA, 13 nt, Human
acacccucacacu

SEQ ID NO: 3564619 - RNA, 16 nt, Human
acacccucacacuggg

SEQ ID NO: 3564620 - RNA, 19 nt, Human
acacccucacucugccagg

SEQ ID NO: 3564621 - RNA, 14 nt, Human
acacccuccagaga

SEQ ID NO: 3564622 - RNA, 13 nt, Human
acacccucccccg

SEQ ID NO: 3564623 - RNA, 14 nt, Human
acacccucccccgc

SEQ ID NO: 3564624 - RNA, 19 nt, Human
acacccucccccgccacuc

SEQ ID NO: 3564625 - RNA, 17 nt, Human
acacccucucccaggac

SEQ ID NO: 3564626 - RNA, 20 nt, Human
acacccugcaaggcccacag

SEQ ID NO: 3564627 - RNA, 22 nt, Human
acacccuguacuguucuguguc

SEQ ID NO: 3564628 - RNA, 12 nt, Human
acacccugugau

SEQ ID NO: 3564629 - RNA, 15 nt, Human
acacccuuagaaaau

SEQ ID NO: 3564630 - RNA, 11 nt, Human
acacccuuccu

SEQ ID NO: 3564631 - RNA, 16 nt, Human
acacccuuggacuuga

SEQ ID NO: 3564632 - RNA, 15 nt, Human
acaccgagggcgacc

SEQ ID NO: 3564633 - RNA, 22 nt, Human
acaccgccacauggcuuccucc

SEQ ID NO: 3564634 - RNA, 16 nt, Human
acaccgggcacucaga

SEQ ID NO: 3564635 - RNA, 14 nt, Human
acaccgggccugga

SEQ ID NO: 3564636 - RNA, 19 nt, Human
acaccguguaaaccaaagc

SEQ ID NO: 3564637 - RNA, 19 nt, Human
acaccuaaauaaccaaucu

SEQ ID NO: 3564638 - RNA, 21 nt, Human
acaccuacucuaucagagaaa

SEQ ID NO: 3564639 - RNA, 22 nt, Human
acaccuagccagcugucaaggg

SEQ ID NO: 3564640 - RNA, 22 nt, Human
acaccuagcuuuauucuucaga

SEQ ID NO: 3564641 - RNA, 18 nt, Human
acaccuauuaucccagcu

SEQ ID NO: 3564642 - RNA, 20 nt, Human
acaccuauuaucccagcugc

SEQ ID NO: 3564643 - RNA, 22 nt, Human
acaccuauuaucccagcugccu

SEQ ID NO: 3564644 - RNA, 15 nt, Human
acaccuauuuuagac

SEQ ID NO: 3564645 - RNA, 20 nt, Human
acaccucaacuaaauccaaa

SEQ ID NO: 3564646 - RNA, 17 nt, Human
acaccucacucugcuac

SEQ ID NO: 3564647 - RNA, 18 nt, Human
acaccucacucugcuacc

SEQ ID NO: 3564648 - RNA, 10 nt, Human
acaccucaga

SEQ ID NO: 3564649 - RNA, 20 nt, Human
acaccuccacaguucagugg

SEQ ID NO: 3564650 - RNA, 20 nt, Human
acaccucccacccccuguau

SEQ ID NO: 3564651 - RNA, 14 nt, Human
acaccuccucccac

SEQ ID NO: 3564652 - RNA, 15 nt, Human
acaccuccucccacu

SEQ ID NO: 3564653 - RNA, 20 nt, Human
acaccuccucccacugccca

SEQ ID NO: 3564654 - RNA, 11 nt, Human
acaccuccucu

SEQ ID NO: 3564655 - RNA, 18 nt, Human
acaccuccucucacuccc

SEQ ID NO: 3564656 - RNA, 18 nt, Human
acaccucguuagggaaga

SEQ ID NO: 3564657 - RNA, 14 nt, Human
acaccugaugugua

SEQ ID NO: 3564658 - RNA, 19 nt, Human
acaccugcaccucccccca

SEQ ID NO: 3564659 - RNA, 24 nt, Human
acaccugcaccuccccccacugca

SEQ ID NO: 3564660 - RNA, 19 nt, Human
accccaaagagccuggaga

SEQ ID NO: 3564661 - RNA, 15 nt, Human
accccaaagcuuucc

SEQ ID NO: 3564662 - RNA, 13 nt, Human
accccaaccugcu

SEQ ID NO: 3564663 - RNA, 16 nt, Human
accccaacgcacagga

SEQ ID NO: 3564664 - RNA, 15 nt, Human
accccaagacuccca

SEQ ID NO: 3564665 - RNA, 18 nt, Human
accccaagccagcccggc

SEQ ID NO: 3564666 - RNA, 13 nt, Human
accccaauccucc

SEQ ID NO: 3564667 - RNA, 20 nt, Human
accccacaccaggccguccu

SEQ ID NO: 3564668 - RNA, 21 nt, Human
accccacacuuguuccagcuc

SEQ ID NO: 3564669 - RNA, 18 nt, Human
accccacccacuucugca

SEQ ID NO: 3564670 - RNA, 13 nt, Human
accccacccucag

SEQ ID NO: 3564671 - RNA, 14 nt, Human
accccacccucagc

SEQ ID NO: 3564672 - RNA, 15 nt, Human
accccacccucccug

SEQ ID NO: 3564673 - RNA, 20 nt, Human
accccacccucccuggagug

SEQ ID NO: 3564674 - RNA, 19 nt, Human
accccacccuuccccuccu

SEQ ID NO: 3564675 - RNA, 15 nt, Human
accccacccuugccc

SEQ ID NO: 3564676 - RNA, 18 nt, Human
accccacccuugcccacc

SEQ ID NO: 3564677 - RNA, 20 nt, Human
accccacccuugcccacccc

SEQ ID NO: 3564678 - RNA, 13 nt, Human
accccaccugcag

SEQ ID NO: 3564679 - RNA, 16 nt, Human
accccacgccuuaucc

SEQ ID NO: 3564680 - RNA, 18 nt, Human
accccagacgaugucuuc

SEQ ID NO: 3564681 - RNA, 16 nt, Human
accccagagccacaca

SEQ ID NO: 3564682 - RNA, 14 nt, Human
accccagcucccua

SEQ ID NO: 3564683 - RNA, 17 nt, Human
accccagcucccuagga

SEQ ID NO: 3564684 - RNA, 23 nt, Human
accccagcucccuaggagaccaa

SEQ ID NO: 3564685 - RNA, 10 nt, Human
accccagcug

SEQ ID NO: 3564686 - RNA, 12 nt, Human
accccagcuggg

SEQ ID NO: 3564687 - RNA, 14 nt, Human
accccagcugggag

SEQ ID NO: 3564688 - RNA, 19 nt, Human
accccagcuggggccaggc

SEQ ID NO: 3564689 - RNA, 18 nt, Human
accccagcugugagccuu

SEQ ID NO: 3564690 - RNA, 20 nt, Human
accccaggacgccacucauu

SEQ ID NO: 3564691 - RNA, 16 nt, Human
accccaggcccacuca

SEQ ID NO: 3564692 - RNA, 23 nt, Human
accccaggcuggacaugcugacu

SEQ ID NO: 3564693 - RNA, 11 nt, Human
accccagggca

SEQ ID NO: 3564694 - RNA, 12 nt, Human
accccagggcac

SEQ ID NO: 3564695 - RNA, 18 nt, Human
accccagggcacaggagc

SEQ ID NO: 3564696 - RNA, 16 nt, Human
accccagggcagccag

SEQ ID NO: 3564697 - RNA, 14 nt, Human
accccagggccuga

SEQ ID NO: 3564698 - RNA, 22 nt, Human
accccagggcuguaacugccag

SEQ ID NO: 3564699 - RNA, 16 nt, Human
accccaguucugcucc

SEQ ID NO: 3564700 - RNA, 17 nt, Human
accccaguucugcuccu

SEQ ID NO: 3564701 - RNA, 20 nt, Human
accccaguucugcuccucuc

SEQ ID NO: 3564702 - RNA, 22 nt, Human
accccaguucugcuccucucca

SEQ ID NO: 3564703 - RNA, 15 nt, Human
accccaguuuuuuga

SEQ ID NO: 3564704 - RNA, 23 nt, Human
accccaucaccuacucacacagg

SEQ ID NO: 3564705 - RNA, 15 nt, Human
accccaucaucccuu

SEQ ID NO: 3564706 - RNA, 15 nt, Human
accccaucgccaacu

SEQ ID NO: 3564707 - RNA, 18 nt, Human
accccaucucuacaaaaa

SEQ ID NO: 3564708 - RNA, 16 nt, Human
accccaucugcccagg

SEQ ID NO: 3564709 - RNA, 18 nt, Human
accccaucugugaauaag

SEQ ID NO: 3564710 - RNA, 23 nt, Human
accccaugaccuuauccuuccuc

SEQ ID NO: 3564711 - RNA, 12 nt, Human
accccaugcugu

SEQ ID NO: 3564712 - RNA, 16 nt, Human
accccaugcuguugau

SEQ ID NO: 3564713 - RNA, 19 nt, Human
accccauggcugcacaguu

SEQ ID NO: 3564714 - RNA, 14 nt, Human
accccauucccgca

SEQ ID NO: 3564715 - RNA, 15 nt, Human
accccauuucucucc

SEQ ID NO: 3564716 - RNA, 13 nt, Human
acccccacacaca

SEQ ID NO: 3564717 - RNA, 12 nt, Human
acccccacccaa

SEQ ID NO: 3564718 - RNA, 19 nt, Human
acccccacccccagcucaa

SEQ ID NO: 3564719 - RNA, 13 nt, Human
acccccaccccuu

SEQ ID NO: 3564720 - RNA, 16 nt, Human
acccccagcaacccuc

SEQ ID NO: 3564721 - RNA, 18 nt, Human
acccccagcacccgggcu

SEQ ID NO: 3564722 - RNA, 21 nt, Human
acccccagcacccgggcucag

SEQ ID NO: 3564723 - RNA, 22 nt, Human
acccccagcacccgggcucagg

SEQ ID NO: 3564724 - RNA, 14 nt, Human
acccccagccccga

SEQ ID NO: 3564725 - RNA, 22 nt, Human
acccccagccccgacuccagcc

SEQ ID NO: 3564726 - RNA, 17 nt, Human
acccccagccugggccu

SEQ ID NO: 3564727 - RNA, 12 nt, Human
acccccagcucc

SEQ ID NO: 3564728 - RNA, 22 nt, Human
acccccagcuuugcccaacacc

SEQ ID NO: 3564729 - RNA, 12 nt, Human
acccccaggaca

SEQ ID NO: 3564730 - RNA, 15 nt, Human
acccccaggaccaga

SEQ ID NO: 3564731 - RNA, 21 nt, Human
acccccaggccucagucuccc

SEQ ID NO: 3564732 - RNA, 16 nt, Human
acccccauucuguccu

SEQ ID NO: 3564733 - RNA, 19 nt, Human
accccccaaccccugagga

SEQ ID NO: 3564734 - RNA, 20 nt, Human
accccccaaccccugaggaa

SEQ ID NO: 3564735 - RNA, 16 nt, Human
accccccacucugugc

SEQ ID NO: 3564736 - RNA, 19 nt, Human
accccccacucugugccug

SEQ ID NO: 3564737 - RNA, 18 nt, Human
accccccagaaccugucc

SEQ ID NO: 3564738 - RNA, 19 nt, Human
accccccagaaccuguccu

SEQ ID NO: 3564739 - RNA, 13 nt, Human
accccccagcacu

SEQ ID NO: 3564740 - RNA, 14 nt, Human
accccccagcacug

SEQ ID NO: 3564741 - RNA, 17 nt, Human
accccccagcacugagg

SEQ ID NO: 3564742 - RNA, 19 nt, Human
accccccagcacugaggaa

SEQ ID NO: 3564743 - RNA, 12 nt, Human
accccccucauu

SEQ ID NO: 3564744 - RNA, 11 nt, Human
accccccucug

SEQ ID NO: 3564745 - RNA, 14 nt, Human
accccccuguucua

SEQ ID NO: 3564746 - RNA, 21 nt, Human
accccccuuucacaggcagcc

SEQ ID NO: 3564747 - RNA, 13 nt, Human
acccccgcccagg

SEQ ID NO: 3564748 - RNA, 19 nt, Human
acccccgcccaggcuggcc

SEQ ID NO: 3564749 - RNA, 21 nt, Human
acccccgcccaggcuggccag

SEQ ID NO: 3564750 - RNA, 23 nt, Human
acccccgcccaggcuggccagcc

SEQ ID NO: 3564751 - RNA, 13 nt, Human
acccccgcccccu

SEQ ID NO: 3564752 - RNA, 21 nt, Human
acccccgcccccugcccuccc

SEQ ID NO: 3564753 - RNA, 15 nt, Human
acccccgcuggagga

SEQ ID NO: 3564754 - RNA, 15 nt, Human
acccccggcagcagc

SEQ ID NO: 3564755 - RNA, 17 nt, Human
acccccgucaagaguga

SEQ ID NO: 3564756 - RNA, 15 nt, Human
acccccucccuggcc

SEQ ID NO: 3564757 - RNA, 22 nt, Human
acccccucccuggccuguucug

SEQ ID NO: 3564758 - RNA, 16 nt, Human
acccccuccucucugc

SEQ ID NO: 3564759 - RNA, 13 nt, Human
acccccuccugcu

SEQ ID NO: 3564760 - RNA, 16 nt, Human
acccccuccugcugca

SEQ ID NO: 3564761 - RNA, 15 nt, Human
acccccuccuucaga

SEQ ID NO: 3564762 - RNA, 17 nt, Human
acccccuccuucagaca

SEQ ID NO: 3564763 - RNA, 16 nt, Human
acccccucgcuuggac

SEQ ID NO: 3564764 - RNA, 20 nt, Human
acccccucuucugagcacag

SEQ ID NO: 3564765 - RNA, 23 nt, Human
acccccugagauccccugagccc

SEQ ID NO: 3564766 - RNA, 18 nt, Human
acccccugcaaagcccag

SEQ ID NO: 3564767 - RNA, 22 nt, Human
acccccugcaaagcccagcuug

SEQ ID NO: 3564768 - RNA, 14 nt, Human
acccccugcccugc

SEQ ID NO: 3564769 - RNA, 12 nt, Human
acccccuggaga

SEQ ID NO: 3564770 - RNA, 13 nt, Human
acccccuucucug

SEQ ID NO: 3564771 - RNA, 18 nt, Human
acccccuucucugcccau

SEQ ID NO: 3564772 - RNA, 18 nt, Human
acccccuucucugcucca

SEQ ID NO: 3564773 - RNA, 19 nt, Human
acccccuucucugcuccac

SEQ ID NO: 3564774 - RNA, 17 nt, Human
acccccuucugggcauc

SEQ ID NO: 3564775 - RNA, 14 nt, Human
accccgagcccuac

SEQ ID NO: 3564776 - RNA, 17 nt, Human
accccgaggcccugcau

SEQ ID NO: 3564777 - RNA, 15 nt, Human
accccgagggcugag

SEQ ID NO: 3564778 - RNA, 17 nt, Human
accccgauguggaccuc

SEQ ID NO: 3564779 - RNA, 19 nt, Human
accccgccugcccucaugg

SEQ ID NO: 3564780 - RNA, 14 nt, Human
accccgcucugcau

SEQ ID NO: 3564781 - RNA, 15 nt, Human
accccggcaggcccu

SEQ ID NO: 3564782 - RNA, 16 nt, Human
accccggcaggcccug

SEQ ID NO: 3564783 - RNA, 19 nt, Human
accccggcaggcccugcag

SEQ ID NO: 3564784 - RNA, 22 nt, Human
accccggccggccacccaggag

SEQ ID NO: 3564785 - RNA, 21 nt, Human
accccggggugcccacaggcc

SEQ ID NO: 3564786 - RNA, 19 nt, Human
accccgguggcggccccag

SEQ ID NO: 3564787 - RNA, 14 nt, Human
accccgucaacaaa

SEQ ID NO: 3564788 - RNA, 23 nt, Human
accccgucugggguucagccccu

SEQ ID NO: 3564789 - RNA, 21 nt, Human
accccuaaaagaaacccugca

SEQ ID NO: 3564790 - RNA, 13 nt, Human
accccuaccccug

SEQ ID NO: 3564791 - RNA, 20 nt, Human
accccuaguucccucugcuc

SEQ ID NO: 3564792 - RNA, 13 nt, Human
accugcucugcug

SEQ ID NO: 3564793 - RNA, 14 nt, Human
accugcugagcucu

SEQ ID NO: 3564794 - RNA, 16 nt, Human
accugcugagcucuga

SEQ ID NO: 3564795 - RNA, 18 nt, Human
accugcugagcucugaga

SEQ ID NO: 3564796 - RNA, 20 nt, Human
accugcugagcucugagagg

SEQ ID NO: 3564797 - RNA, 14 nt, Human
accugcugcuucuc

SEQ ID NO: 3564798 - RNA, 14 nt, Human
accugcuggccccu

SEQ ID NO: 3564799 - RNA, 16 nt, Human
accugcuggccccuca

SEQ ID NO: 3564800 - RNA, 21 nt, Human
accugcuggccccucaccugg

SEQ ID NO: 3564801 - RNA, 21 nt, Human
accugcugucuggguggcuca

SEQ ID NO: 3564802 - RNA, 21 nt, Human
accugcuucaugcucagcccu

SEQ ID NO: 3564803 - RNA, 14 nt, Human
accugcuucucugc

SEQ ID NO: 3564804 - RNA, 17 nt, Human
accugcuuuuugaaaug

SEQ ID NO: 3564805 - RNA, 21 nt, Human
accugcuuuuugaaaugaaau

SEQ ID NO: 3564806 - RNA, 17 nt, Human
accuggaaaaauuccag

SEQ ID NO: 3564807 - RNA, 19 nt, Human
accuggaaaaauuccagaa

SEQ ID NO: 3564808 - RNA, 18 nt, Human
accuggaagcauuuguuu

SEQ ID NO: 3564809 - RNA, 18 nt, Human
accuggaaggcccagcac

SEQ ID NO: 3564810 - RNA, 14 nt, Human
accuggacacaggc

SEQ ID NO: 3564811 - RNA, 15 nt, Human
accuggaccccugca

SEQ ID NO: 3564812 - RNA, 21 nt, Human
accuggaccccugcauuggaa

SEQ ID NO: 3564813 - RNA, 20 nt, Human
accuggagagccagaaccug

SEQ ID NO: 3564814 - RNA, 22 nt, Human
accuggagagccagaaccugga

SEQ ID NO: 3564815 - RNA, 21 nt, Human
accuggagagcuagaaccuag

SEQ ID NO: 3564816 - RNA, 22 nt, Human
accuggagagcuagaaccugga

SEQ ID NO: 3564817 - RNA, 16 nt, Human
accuggagggaagagu

SEQ ID NO: 3564818 - RNA, 22 nt, Human
accuggagggcuagaaccugga

SEQ ID NO: 3564819 - RNA, 14 nt, Human
accuggaggggcua

SEQ ID NO: 3564820 - RNA, 16 nt, Human
accuggaguuccugaa

SEQ ID NO: 3564821 - RNA, 19 nt, Human
accuggauggggcaggcca

SEQ ID NO: 3564822 - RNA, 22 nt, Human
accuggauugugccuaaugugu

SEQ ID NO: 3564823 - RNA, 18 nt, Human
accuggcacugcugugcu

SEQ ID NO: 3564824 - RNA, 14 nt, Human
accuggcagcucug

SEQ ID NO: 3564825 - RNA, 21 nt, Human
accuggcaucgcaccauucug

SEQ ID NO: 3564826 - RNA, 21 nt, Human
accuggcaucuaauucugauu

SEQ ID NO: 3564827 - RNA, 13 nt, Human
accuggccaccug

SEQ ID NO: 3564828 - RNA, 16 nt, Human
accuggccaccugagg

SEQ ID NO: 3564829 - RNA, 18 nt, Human
accuggcccaucagggua

SEQ ID NO: 3564830 - RNA, 18 nt, Human
accuggcccugcuuccug

SEQ ID NO: 3564831 - RNA, 15 nt, Human
accuggcccuggggc

SEQ ID NO: 3564832 - RNA, 18 nt, Human
accuggcccuggggccug

SEQ ID NO: 3564833 - RNA, 20 nt, Human
accuggccgcggagccugca

SEQ ID NO: 3564834 - RNA, 22 nt, Human
accuggccgcguuuagaccaag

SEQ ID NO: 3564835 - RNA, 12 nt, Human
accuggccucug

SEQ ID NO: 3564836 - RNA, 13 nt, Human
accuggccucugc

SEQ ID NO: 3564837 - RNA, 14 nt, Human
accuggccucugca

SEQ ID NO: 3564838 - RNA, 17 nt, Human
accuggccucugcacuc

SEQ ID NO: 3564839 - RNA, 15 nt, Human
accuggccugucugu

SEQ ID NO: 3564840 - RNA, 11 nt, Human
accuggccuuc

SEQ ID NO: 3564841 - RNA, 14 nt, Human
accuggcucugugg

SEQ ID NO: 3564842 - RNA, 23 nt, Human
accuggcucuguggcgagccauu

SEQ ID NO: 3564843 - RNA, 19 nt, Human
accuggcugagccuggcug

SEQ ID NO: 3564844 - RNA, 23 nt, Human
accuggcugaggcgccacccuuc

SEQ ID NO: 3564845 - RNA, 23 nt, Human
accuggcugagguuccucugccu

SEQ ID NO: 3564846 - RNA, 17 nt, Human
accuggcuuauuuaaua

SEQ ID NO: 3564847 - RNA, 21 nt, Human
accuggcuuuuuauuguauuu

SEQ ID NO: 3564848 - RNA, 13 nt, Human
accugggaagggg

SEQ ID NO: 3564849 - RNA, 22 nt, Human
accugggagaaaucuggcuucu

SEQ ID NO: 3564850 - RNA, 18 nt, Human
accugggauucaggaaug

SEQ ID NO: 3564851 - RNA, 17 nt, Human
accugggcaagcuggcg

SEQ ID NO: 3564852 - RNA, 13 nt, Human
accugggcaccug

SEQ ID NO: 3564853 - RNA, 13 nt, Human
accugggcccugg

SEQ ID NO: 3564854 - RNA, 24 nt, Human
accuggggagugggacagagucug

SEQ ID NO: 3564855 - RNA, 19 nt, Human
accuggggcacaguccagg

SEQ ID NO: 3564856 - RNA, 21 nt, Human
accuggggcacaguccaggaa

SEQ ID NO: 3564857 - RNA, 20 nt, Human
accuggggcugcugugaagc

SEQ ID NO: 3564858 - RNA, 22 nt, Human
accuggggggcaguggugugga

SEQ ID NO: 3564859 - RNA, 21 nt, Human
accugggguugucagcucuca

SEQ ID NO: 3564860 - RNA, 23 nt, Human
accuggguccaaauaaaaacuaa

SEQ ID NO: 3564861 - RNA, 15 nt, Human
accuggguccuuuuc

SEQ ID NO: 3564862 - RNA, 20 nt, Human
accuggguugcagacaggaa

SEQ ID NO: 3564863 - RNA, 19 nt, Human
accugguacccuccuggcu

SEQ ID NO: 3564864 - RNA, 17 nt, Human
accugguacucccucuc

SEQ ID NO: 3564865 - RNA, 16 nt, Human
accugguccacagggc

SEQ ID NO: 3564866 - RNA, 16 nt, Human
accuggugcugccucu

SEQ ID NO: 3564867 - RNA, 22 nt, Human
accugguuaaacaaaccagaau

SEQ ID NO: 3564868 - RNA, 22 nt, Human
accugguuccggaauccugucc

SEQ ID NO: 3564869 - RNA, 11 nt, Human
accuguaaaac

SEQ ID NO: 3564870 - RNA, 15 nt, Human
accuguaaaacuuua

SEQ ID NO: 3564871 - RNA, 18 nt, Human
accuguaaauuauuuuaa

SEQ ID NO: 3564872 - RNA, 14 nt, Human
accuguaacuuuuu

SEQ ID NO: 3564873 - RNA, 13 nt, Human
accuguaauaaau

SEQ ID NO: 3564874 - RNA, 16 nt, Human
accuguaauaaauaug

SEQ ID NO: 3564875 - RNA, 17 nt, Human
accuguaauaaauauga

SEQ ID NO: 3564876 - RNA, 15 nt, Human
accuguaaucccagc

SEQ ID NO: 3564877 - RNA, 19 nt, Human
accuguaaucccagcacuu

SEQ ID NO: 3564878 - RNA, 19 nt, Human
accuguaaucccagcuacu

SEQ ID NO: 3564879 - RNA, 20 nt, Human
accuguaaucccagcuacuu

SEQ ID NO: 3564880 - RNA, 12 nt, Human
accuguacucag

SEQ ID NO: 3564881 - RNA, 16 nt, Human
accuguagucccagcu

SEQ ID NO: 3564882 - RNA, 21 nt, Human
accuguauaaguggaggcacu

SEQ ID NO: 3564883 - RNA, 23 nt, Human
accuguaugucaauaaacaacag

SEQ ID NO: 3564884 - RNA, 17 nt, Human
accuguaugucuccagu

SEQ ID NO: 3564885 - RNA, 21 nt, Human
accuguauuuaaaaauagaaa

SEQ ID NO: 3564886 - RNA, 12 nt, Human
accugucaauac

SEQ ID NO: 3564887 - RNA, 14 nt, Human
accugucaauacua

SEQ ID NO: 3564888 - RNA, 22 nt, Human
accugucaaugauacagucccu

SEQ ID NO: 3564889 - RNA, 15 nt, Human
accugucacauugca

SEQ ID NO: 3564890 - RNA, 17 nt, Human
accugucacauugcauu

SEQ ID NO: 3564891 - RNA, 18 nt, Human
accugucaugccccccuc

SEQ ID NO: 3564892 - RNA, 20 nt, Human
accuguccccacccuccacu

SEQ ID NO: 3564893 - RNA, 14 nt, Human
accuguccuccugg

SEQ ID NO: 3564894 - RNA, 14 nt, Human
accuguccuugcac

SEQ ID NO: 3564895 - RNA, 12 nt, Human
accugucgccca

SEQ ID NO: 3564896 - RNA, 15 nt, Human
accugucgcccagug

SEQ ID NO: 3564897 - RNA, 16 nt, Human
accugucuccacugug

SEQ ID NO: 3564898 - RNA, 17 nt, Human
accugucuccuggcggu

SEQ ID NO: 3564899 - RNA, 12 nt, Human
accugucugucu

SEQ ID NO: 3564900 - RNA, 19 nt, Human
accugucuugccuuuuuca

SEQ ID NO: 3564901 - RNA, 17 nt, Human
accugucuuuugggagu

SEQ ID NO: 3564902 - RNA, 17 nt, Human
accugugaagcugaaaa

SEQ ID NO: 3564903 - RNA, 13 nt, Human
accugugaccagc

SEQ ID NO: 3564904 - RNA, 19 nt, Human
accugugaccagcacuguc

SEQ ID NO: 3564905 - RNA, 19 nt, Human
accugugaguuuaaagcaa

SEQ ID NO: 3564906 - RNA, 15 nt, Human
accugugccucggcu

SEQ ID NO: 3564907 - RNA, 16 nt, Human
accugugccucggcuu

SEQ ID NO: 3564908 - RNA, 19 nt, Human
accugugcuucgggcccuu

SEQ ID NO: 3564909 - RNA, 13 nt, Human
accuguggauauu

SEQ ID NO: 3564910 - RNA, 14 nt, Human
accuguggauauuu

SEQ ID NO: 3564911 - RNA, 21 nt, Human
accuguggggauuucucccag

SEQ ID NO: 3564912 - RNA, 22 nt, Human
accuguggggauuucucccagc

SEQ ID NO: 3564913 - RNA, 23 nt, Human
accuguggggauuucucccagcu

SEQ ID NO: 3564914 - RNA, 16 nt, Human
accuguggugcaaaag

SEQ ID NO: 3564915 - RNA, 22 nt, Human
accugugucugcgaaguccuau

SEQ ID NO: 3564916 - RNA, 13 nt, Human
accugugugcuug

SEQ ID NO: 3564917 - RNA, 17 nt, Human
accuguuaaaauuauac

SEQ ID NO: 3564918 - RNA, 15 nt, Human
accuguugcuguguu

SEQ ID NO: 3564919 - RNA, 15 nt, Human
accuguugcuuacaa

SEQ ID NO: 3564920 - RNA, 18 nt, Human
accuguugcuuacaauuu

SEQ ID NO: 3564921 - RNA, 19 nt, Human
accuguugcuuacaauuuu

SEQ ID NO: 3564922 - RNA, 20 nt, Human
accuguugcuuacaauuuuu

SEQ ID NO: 3564923 - RNA, 14 nt, Human
accuguuuaaauau

SEQ ID NO: 3564924 - RNA, 23 nt, Human
accuguuuaaauugcucacaguu

SEQ ID NO: 3564925 - RNA, 19 nt, Human
accuguuuuuaagcuguuu

SEQ ID NO: 3564926 - RNA, 17 nt, Human
accuguuuuuuuuucau

SEQ ID NO: 3564927 - RNA, 12 nt, Human
accuuaaaauuu

SEQ ID NO: 3564928 - RNA, 17 nt, Human
accuuaaaauuugaaac

SEQ ID NO: 3564929 - RNA, 22 nt, Human
accuuaaguaagcaacagcaua

SEQ ID NO: 3564930 - RNA, 14 nt, Human
accuuaauauuucu

SEQ ID NO: 3564931 - RNA, 14 nt, Human
accuuaccccuggc

SEQ ID NO: 3564932 - RNA, 17 nt, Human
accuuacgaucaggcac

SEQ ID NO: 3564933 - RNA, 20 nt, Human
accuuacgaucaggcacagg

SEQ ID NO: 3564934 - RNA, 20 nt, Human
accuuagacagucccugcca

SEQ ID NO: 3564935 - RNA, 20 nt, Human
accuuagaccaccaagccuu

SEQ ID NO: 3564936 - RNA, 13 nt, Human
accuuagcucccu

SEQ ID NO: 3564937 - RNA, 23 nt, Human
accuuagcucccucccgcacccc

SEQ ID NO: 3564938 - RNA, 23 nt, Human
accuuaggaauaaucuccuguua

SEQ ID NO: 3564939 - RNA, 13 nt, Human
accuuaggcaggg

SEQ ID NO: 3564940 - RNA, 17 nt, Human
accuuaggccuuccucu

SEQ ID NO: 3564941 - RNA, 19 nt, Human
acagcugaguuaugaugua

SEQ ID NO: 3564942 - RNA, 19 nt, Human
acagcugcaauucccugga

SEQ ID NO: 3564943 - RNA, 16 nt, Human
acagcugccugcagua

SEQ ID NO: 3564944 - RNA, 21 nt, Human
acagcugcuccuagagggagg

SEQ ID NO: 3564945 - RNA, 11 nt, Human
acagcugcugg

SEQ ID NO: 3564946 - RNA, 15 nt, Human
acagcugcuuucugu

SEQ ID NO: 3564947 - RNA, 17 nt, Human
acagcuggacccugacc

SEQ ID NO: 3564948 - RNA, 15 nt, Human
acagcuggagcucuc

SEQ ID NO: 3564949 - RNA, 13 nt, Human
acagcuggccucc

SEQ ID NO: 3564950 - RNA, 13 nt, Human
acagcugggcugu

SEQ ID NO: 3564951 - RNA, 16 nt, Human
acagcuggggugcagg

SEQ ID NO: 3564952 - RNA, 16 nt, Human
acagcuggguggcacu

SEQ ID NO: 3564953 - RNA, 17 nt, Human
acagcuggugcccugcu

SEQ ID NO: 3564954 - RNA, 19 nt, Human
acagcugguguagcuacag

SEQ ID NO: 3564955 - RNA, 20 nt, Human
acagcugguguagcuacaga

SEQ ID NO: 3564956 - RNA, 15 nt, Human
acagcugucccuguc

SEQ ID NO: 3564957 - RNA, 16 nt, Human
acagcugucccuguca

SEQ ID NO: 3564958 - RNA, 12 nt, Human
acagcugugccu

SEQ ID NO: 3564959 - RNA, 23 nt, Human
acagcuguggugagguugggcag

SEQ ID NO: 3564960 - RNA, 12 nt, Human
acagcuguguua

SEQ ID NO: 3564961 - RNA, 15 nt, Human
acagcuguugacucu

SEQ ID NO: 3564962 - RNA, 15 nt, Human
acagcuguuuaagau

SEQ ID NO: 3564963 - RNA, 17 nt, Human
acagcuuagauuucaua

SEQ ID NO: 3564964 - RNA, 18 nt, Human
acagcuuagauuucauag

SEQ ID NO: 3564965 - RNA, 20 nt, Human
acagcuucagguuaucgaaa

SEQ ID NO: 3564966 - RNA, 22 nt, Human
acagcuuccuguccccaucugu

SEQ ID NO: 3564967 - RNA, 18 nt, Human
acagcuuccuuuccugug

SEQ ID NO: 3564968 - RNA, 21 nt, Human
acagcuugaccgugaggccag

SEQ ID NO: 3564969 - RNA, 22 nt, Human
acagcuugaccgugaggccaga

SEQ ID NO: 3564970 - RNA, 19 nt, Human
acagcuugaccugaggcug

SEQ ID NO: 3564971 - RNA, 21 nt, Human
acagcuugagccgggccccug

SEQ ID NO: 3564972 - RNA, 17 nt, Human
acagcuuguaggggagg

SEQ ID NO: 3564973 - RNA, 15 nt, Human
acagcuuguauuuug

SEQ ID NO: 3564974 - RNA, 16 nt, Human
acagcuuguuuuggac

SEQ ID NO: 3564975 - RNA, 23 nt, Human
acagcuuguuuuggacuuuguua

SEQ ID NO: 3564976 - RNA, 17 nt, Human
acagcuuuaucaccaga

SEQ ID NO: 3564977 - RNA, 17 nt, Human
acagcuuucugaccuuc

SEQ ID NO: 3564978 - RNA, 19 nt, Human
acagcuuucugaccuucag

SEQ ID NO: 3564979 - RNA, 11 nt, Human
acagcuuugcu

SEQ ID NO: 3564980 - RNA, 20 nt, Human
acagcuuugugacuguauau

SEQ ID NO: 3564981 - RNA, 21 nt, Human
acagcuuugugacuguauaua

SEQ ID NO: 3564982 - RNA, 13 nt, Human
acagcuuuugcaa

SEQ ID NO: 3564983 - RNA, 15 nt, Human
acagcuuuugcaacu

SEQ ID NO: 3564984 - RNA, 21 nt, Human
acagcuuuugcaacuuaauac

SEQ ID NO: 3564985 - RNA, 14 nt, Human
acaggaaaaaaacu

SEQ ID NO: 3564986 - RNA, 17 nt, Human
acaggaaaaaaacuuuu

SEQ ID NO: 3564987 - RNA, 19 nt, Human
acaggaaacuccugugacc

SEQ ID NO: 3564988 - RNA, 10 nt, Human
acaggaagau

SEQ ID NO: 3564989 - RNA, 17 nt, Human
acaggaagaucuuaaau

SEQ ID NO: 3564990 - RNA, 22 nt, Human
acaggaagaucuuaaauuuugu

SEQ ID NO: 3564991 - RNA, 15 nt, Human
acaggaauuuuaaaa

SEQ ID NO: 3564992 - RNA, 16 nt, Human
acaggacacagucaga

SEQ ID NO: 3564993 - RNA, 20 nt, Human
acaggacagcauggugcaug

SEQ ID NO: 3564994 - RNA, 22 nt, Human
acaggacagugcuucagccuga

SEQ ID NO: 3564995 - RNA, 22 nt, Human
acaggacaugcgguagccagca

SEQ ID NO: 3564996 - RNA, 19 nt, Human
acaggaccccagcucugcg

SEQ ID NO: 3564997 - RNA, 19 nt, Human
acaggacuaacacucagaa

SEQ ID NO: 3564998 - RNA, 14 nt, Human
acaggacucugccu

SEQ ID NO: 3564999 - RNA, 16 nt, Human
acaggacugauucugg

SEQ ID NO: 3565000 - RNA, 14 nt, Human
acaggagacacugu

SEQ ID NO: 3565001 - RNA, 14 nt, Human
acaggagaccuggc

SEQ ID NO: 3565002 - RNA, 19 nt, Human
acaggagagaaaggggaug

SEQ ID NO: 3565003 - RNA, 14 nt, Human
acaggagaugcugu

SEQ ID NO: 3565004 - RNA, 23 nt, Human
acaggagcuaccuguguggacag

SEQ ID NO: 3565005 - RNA, 13 nt, Human
acaggagcuggga

SEQ ID NO: 3565006 - RNA, 15 nt, Human
acaggaggacaauuc

SEQ ID NO: 3565007 - RNA, 22 nt, Human
acaggaggacaauucaugaacu

SEQ ID NO: 3565008 - RNA, 13 nt, Human
acaggaggcaggc

SEQ ID NO: 3565009 - RNA, 19 nt, Human
acaggagggcggccuccuu

SEQ ID NO: 3565010 - RNA, 17 nt, Human
acaggaguguccucuuc

SEQ ID NO: 3565011 - RNA, 23 nt, Human
acaggaguguccucuucccucuc

SEQ ID NO: 3565012 - RNA, 20 nt, Human
acaggauagauaacucuuug

SEQ ID NO: 3565013 - RNA, 15 nt, Human
acaggaucagucuga

SEQ ID NO: 3565014 - RNA, 19 nt, Human
acaggaucaguuaacuauu

SEQ ID NO: 3565015 - RNA, 22 nt, Human
acaggauccuauucucaccagg

SEQ ID NO: 3565016 - RNA, 21 nt, Human
acaggaugaugacuauggaaa

SEQ ID NO: 3565017 - RNA, 19 nt, Human
acaggaugggggcuggccu

SEQ ID NO: 3565018 - RNA, 17 nt, Human
acaggauggucucugcc

SEQ ID NO: 3565019 - RNA, 18 nt, Human
acaggauguguuugcuuu

SEQ ID NO: 3565020 - RNA, 15 nt, Human
acaggauuagacagu

SEQ ID NO: 3565021 - RNA, 15 nt, Human
acaggauuauuuuga

SEQ ID NO: 3565022 - RNA, 22 nt, Human
acaggcaacugaggcagacagc

SEQ ID NO: 3565023 - RNA, 12 nt, Human
acaggcaagcac

SEQ ID NO: 3565024 - RNA, 18 nt, Human
acaggcaagcaccuccug

SEQ ID NO: 3565025 - RNA, 19 nt, Human
acaggcaagcaccuccugc

SEQ ID NO: 3565026 - RNA, 20 nt, Human
acaggcaagcaccuccugcc

SEQ ID NO: 3565027 - RNA, 15 nt, Human
acaggcaaugcuggc

SEQ ID NO: 3565028 - RNA, 18 nt, Human
acaggcaaugcuggcugu

SEQ ID NO: 3565029 - RNA, 19 nt, Human
acaggcaaugcuggcuguu

SEQ ID NO: 3565030 - RNA, 14 nt, Human
acacagaugaaaca

SEQ ID NO: 3565031 - RNA, 16 nt, Human
acacagaugaaacaca

SEQ ID NO: 3565032 - RNA, 16 nt, Human
acacagauguucgguu

SEQ ID NO: 3565033 - RNA, 14 nt, Human
acacagcagcaguu

SEQ ID NO: 3565034 - RNA, 15 nt, Human
acacagcauguguau

SEQ ID NO: 3565035 - RNA, 20 nt, Human
acacagcauuguauauguga

SEQ ID NO: 3565036 - RNA, 14 nt, Human
acacagcauuucaa

SEQ ID NO: 3565037 - RNA, 13 nt, Human
acacagccacaca

SEQ ID NO: 3565038 - RNA, 19 nt, Human
acacagccgauucaccuga

SEQ ID NO: 3565039 - RNA, 23 nt, Human
acacagccgauucaccugagcag

SEQ ID NO: 3565040 - RNA, 23 nt, Human
acacagcuacucuccccacgagg

SEQ ID NO: 3565041 - RNA, 14 nt, Human
acacagcucuucuc

SEQ ID NO: 3565042 - RNA, 21 nt, Human
acacagcucuucuccaggcug

SEQ ID NO: 3565043 - RNA, 22 nt, Human
acacagcucuucuccaggcugu

SEQ ID NO: 3565044 - RNA, 22 nt, Human
acacagcugagagacuuuuaau

SEQ ID NO: 3565045 - RNA, 16 nt, Human
acacagcugggcugug

SEQ ID NO: 3565046 - RNA, 11 nt, Human
acacagcuguu

SEQ ID NO: 3565047 - RNA, 22 nt, Human
acacagcuuuaucaccagagag

SEQ ID NO: 3565048 - RNA, 17 nt, Human
acacaggacccccuucc

SEQ ID NO: 3565049 - RNA, 18 nt, Human
acacaggacccccuuccc

SEQ ID NO: 3565050 - RNA, 20 nt, Human
acacaggacccccuuccccu

SEQ ID NO: 3565051 - RNA, 20 nt, Human
acacaggauagauaacucuu

SEQ ID NO: 3565052 - RNA, 23 nt, Human
acacaggauagauaacucuuugg

SEQ ID NO: 3565053 - RNA, 21 nt, Human
acccauuaaggggaagaauga

SEQ ID NO: 3565054 - RNA, 22 nt, Human
acccauuagcagucccuccaca

SEQ ID NO: 3565055 - RNA, 13 nt, Human
acccauucagaga

SEQ ID NO: 3565056 - RNA, 14 nt, Human
acccauuuguucau

SEQ ID NO: 3565057 - RNA, 20 nt, Human
acccauuuugagugacucga

SEQ ID NO: 3565058 - RNA, 18 nt, Human
accccaaacaccuuccag

SEQ ID NO: 3565059 - RNA, 20 nt, Human
accccaaacaccuuccagcu

SEQ ID NO: 3565060 - RNA, 23 nt, Human
accccaaacaccuuccagcuccu

SEQ ID NO: 3565061 - RNA, 18 nt, Human
acccuggcacccagggug

SEQ ID NO: 3565062 - RNA, 23 nt, Human
acccuggcacuauaauguaagcu

SEQ ID NO: 3565063 - RNA, 18 nt, Human
acccuggccgaguccaag

SEQ ID NO: 3565064 - RNA, 16 nt, Human
acccuggccugagaag

SEQ ID NO: 3565065 - RNA, 23 nt, Human
acccugggaccuaggggcgccgc

SEQ ID NO: 3565066 - RNA, 16 nt, Human
acccugggagacagac

SEQ ID NO: 3565067 - RNA, 20 nt, Human
acccugggcccugggcugga

SEQ ID NO: 3565068 - RNA, 15 nt, Human
acccugggccuggca

SEQ ID NO: 3565069 - RNA, 20 nt, Human
acccugggcucugggagcag

SEQ ID NO: 3565070 - RNA, 18 nt, Human
acccuggggccugacugc

SEQ ID NO: 3565071 - RNA, 22 nt, Human
acccuggggccugacugcucag

SEQ ID NO: 3565072 - RNA, 22 nt, Human
acccuggggccuggaccugccu

SEQ ID NO: 3565073 - RNA, 22 nt, Human
acccuggggcuggcuuuucugu

SEQ ID NO: 3565074 - RNA, 16 nt, Human
acccuggugccuggcu

SEQ ID NO: 3565075 - RNA, 17 nt, Human
acccuggugguugcugu

SEQ ID NO: 3565076 - RNA, 14 nt, Human
acccugguugugug

SEQ ID NO: 3565077 - RNA, 18 nt, Human
acccuguauaucagggua

SEQ ID NO: 3565078 - RNA, 16 nt, Human
acccugucaaacauua

SEQ ID NO: 3565079 - RNA, 14 nt, Human
acccugucccccag

SEQ ID NO: 3565080 - RNA, 21 nt, Human
acccugucccccagcucuggu

SEQ ID NO: 3565081 - RNA, 22 nt, Human
acccugucccccagcucuggug

SEQ ID NO: 3565082 - RNA, 11 nt, Human
acccuguccuc

SEQ ID NO: 3565083 - RNA, 13 nt, Human
acccugucugccc

SEQ ID NO: 3565084 - RNA, 17 nt, Human
acccugugauggggccc

SEQ ID NO: 3565085 - RNA, 20 nt, Human
acccugugauggggcccugc

SEQ ID NO: 3565086 - RNA, 21 nt, Human
acccugugauggggcccugcc

SEQ ID NO: 3565087 - RNA, 22 nt, Human
acccugugauggggcccugccu

SEQ ID NO: 3565088 - RNA, 23 nt, Human
acccugugcugguguccugacca

SEQ ID NO: 3565089 - RNA, 17 nt, Human
acccuguggcccuggcu

SEQ ID NO: 3565090 - RNA, 21 nt, Human
acccugugguuuccaaggagc

SEQ ID NO: 3565091 - RNA, 20 nt, Human
acccuguguauacagcccug

SEQ ID NO: 3565092 - RNA, 17 nt, Human
acccuguuaccauuuug

SEQ ID NO: 3565093 - RNA, 21 nt, Human
acccuguuccugcugcugucu

SEQ ID NO: 3565094 - RNA, 15 nt, Human
acccuguuccuggag

SEQ ID NO: 3565095 - RNA, 16 nt, Human
acccuguuuuauacug

SEQ ID NO: 3565096 - RNA, 17 nt, Human
acccuguuuugagcccu

SEQ ID NO: 3565097 - RNA, 18 nt, Human
acccuguuuugagcccug

SEQ ID NO: 3565098 - RNA, 21 nt, Human
acccuuaaacaguugcacagc

SEQ ID NO: 3565099 - RNA, 18 nt, Human
acccuuaacccaaggagc

SEQ ID NO: 3565100 - RNA, 19 nt, Human
acccuuacagccucugacu

SEQ ID NO: 3565101 - RNA, 16 nt, Human
acccuuagaauccacg

SEQ ID NO: 3565102 - RNA, 14 nt, Human
acccuuauaaaauc

SEQ ID NO: 3565103 - RNA, 15 nt, Human
acccuuauugcuguc

SEQ ID NO: 3565104 - RNA, 21 nt, Human
acccuuauugcuguccuggag

SEQ ID NO: 3565105 - RNA, 21 nt, Human
acccuucacauacccuccccc

SEQ ID NO: 3565106 - RNA, 17 nt, Human
acccuucaucuuccugu

SEQ ID NO: 3565107 - RNA, 16 nt, Human
acccuuccagacauac

SEQ ID NO: 3565108 - RNA, 23 nt, Human
acccuuccaucugauuccagcac

SEQ ID NO: 3565109 - RNA, 20 nt, Human
acccuucccaaucagcacug

SEQ ID NO: 3565110 - RNA, 22 nt, Human
acccuucccugcacuaaagcca

SEQ ID NO: 3565111 - RNA, 13 nt, Human
acccuuccuaagu

SEQ ID NO: 3565112 - RNA, 19 nt, Human
acccuuccucaccacuucc

SEQ ID NO: 3565113 - RNA, 18 nt, Human
acccuuccugagcuuuau

SEQ ID NO: 3565114 - RNA, 15 nt, Human
acccuucucccacuc

SEQ ID NO: 3565115 - RNA, 21 nt, Human
acccuucuccucuuguaaaua

SEQ ID NO: 3565116 - RNA, 13 nt, Human
acccuucugugcc

SEQ ID NO: 3565117 - RNA, 18 nt, Human
acccuucugugcccagcu

SEQ ID NO: 3565118 - RNA, 14 nt, Human
acccuucuucaugu

SEQ ID NO: 3565119 - RNA, 18 nt, Human
acccuucuuuccucuucc

SEQ ID NO: 3565120 - RNA, 20 nt, Human
acccuucuuuccucuucccc

SEQ ID NO: 3565121 - RNA, 14 nt, Human
acccuucuuuucuc

SEQ ID NO: 3565122 - RNA, 20 nt, Human
acccuucuuuucucaugugu

SEQ ID NO: 3565123 - RNA, 16 nt, Human
acccuugaaaagacau

SEQ ID NO: 3565124 - RNA, 23 nt, Human
acccuugaauguagcagccccgg

SEQ ID NO: 3565125 - RNA, 13 nt, Human
acccuugagcccu

SEQ ID NO: 3565126 - RNA, 13 nt, Human
acccuuggacuug

SEQ ID NO: 3565127 - RNA, 14 nt, Human
acccuuggagcucu

SEQ ID NO: 3565128 - RNA, 18 nt, Human
acccuuggagcucugagu

SEQ ID NO: 3565129 - RNA, 11 nt, Human
acccuuggccu

SEQ ID NO: 3565130 - RNA, 18 nt, Human
acccuugggccagaagua

SEQ ID NO: 3565131 - RNA, 20 nt, Human
acccuugggccagaaguacc

SEQ ID NO: 3565132 - RNA, 17 nt, Human
acccuuguggucccacc

SEQ ID NO: 3565133 - RNA, 13 nt, Human
acccuuguuccag

SEQ ID NO: 3565134 - RNA, 20 nt, Human
acccuuuagccaaacccuug

SEQ ID NO: 3565135 - RNA, 14 nt, Human
acccuuuccuuccu

SEQ ID NO: 3565136 - RNA, 18 nt, Human
acccuuuccuuccuuccc

SEQ ID NO: 3565137 - RNA, 21 nt, Human
acccuuuccuuccuucccugg

SEQ ID NO: 3565138 - RNA, 22 nt, Human
acccuuuccuuccuucccuggc

SEQ ID NO: 3565139 - RNA, 17 nt, Human
acccuuucuugacaaaa

SEQ ID NO: 3565140 - RNA, 21 nt, Human
acccuuucuugacaaaaccua

SEQ ID NO: 3565141 - RNA, 12 nt, Human
acccuuuggggg

SEQ ID NO: 3565142 - RNA, 23 nt, Human
acccuuugugugcucuccauucu

SEQ ID NO: 3565143 - RNA, 14 nt, Human
acccuuuguuucuu

SEQ ID NO: 3565144 - RNA, 17 nt, Human
acccuuuucaugauuuu

SEQ ID NO: 3565145 - RNA, 15 nt, Human
accgaaaacguggcu

SEQ ID NO: 3565146 - RNA, 17 nt, Human
accgaaaacguggcugc

SEQ ID NO: 3565147 - RNA, 19 nt, Human
accgaaaacguggcugcuu

SEQ ID NO: 3565148 - RNA, 12 nt, Human
accgaaacagcg

SEQ ID NO: 3565149 - RNA, 12 nt, Human
accgaagcccag

SEQ ID NO: 3565150 - RNA, 20 nt, Human
accgaaguggacuggccccu

SEQ ID NO: 3565151 - RNA, 12 nt, Human
accgaauauuga

SEQ ID NO: 3565152 - RNA, 16 nt, Human
accgaaugugucuuua

SEQ ID NO: 3565153 - RNA, 11 nt, Human
accgacaagca

SEQ ID NO: 3565154 - RNA, 15 nt, Human
accgacaggcccugg

SEQ ID NO: 3565155 - RNA, 23 nt, Human
accgaccugguuuuuaaauagag

SEQ ID NO: 3565156 - RNA, 16 nt, Human
accgacgcgucuccug

SEQ ID NO: 3565157 - RNA, 18 nt, Human
accgagaagguuuauccc

SEQ ID NO: 3565158 - RNA, 17 nt, Human
accgagaguagccgaga

SEQ ID NO: 3565159 - RNA, 19 nt, Human
accgagcaaagaucaaaau

SEQ ID NO: 3565160 - RNA, 15 nt, Human
accgaggagggagag

SEQ ID NO: 3565161 - RNA, 17 nt, Human
accgagucucuucucca

SEQ ID NO: 3565162 - RNA, 20 nt, Human
accgagucucuucuccacug

SEQ ID NO: 3565163 - RNA, 21 nt, Human
accgagugaaccuaccuucau

SEQ ID NO: 3565164 - RNA, 22 nt, Human
accgcagucgucgcacagucuc

SEQ ID NO: 3565165 - RNA, 17 nt, Human
accgccaaggcuggggg

SEQ ID NO: 3565166 - RNA, 17 nt, Human
accgccacauggcuucc

SEQ ID NO: 3565167 - RNA, 12 nt, Human
accgccagcucu

SEQ ID NO: 3565168 - RNA, 15 nt, Human
accgccuaguuuacu

SEQ ID NO: 3565169 - RNA, 16 nt, Human
accgccuccuacagcc

SEQ ID NO: 3565170 - RNA, 13 nt, Human
accgccucuuccc

SEQ ID NO: 3565171 - RNA, 17 nt, Human
accgccuugcccagccu

SEQ ID NO: 3565172 - RNA, 18 nt, Human
accgcgggugugggaaag

SEQ ID NO: 3565173 - RNA, 16 nt, Human
accgcguaaugcgcca

SEQ ID NO: 3565174 - RNA, 15 nt, Human
accgcgucuggugac

SEQ ID NO: 3565175 - RNA, 19 nt, Human
accgcguuguaaaauauag

SEQ ID NO: 3565176 - RNA, 15 nt, Human
accgcuaaaagaaac

SEQ ID NO: 3565177 - RNA, 20 nt, Human
accgcuacaccacucuggca

SEQ ID NO: 3565178 - RNA, 21 nt, Human
accgcuacaccacucuggcag

SEQ ID NO: 3565179 - RNA, 17 nt, Human
accgcucaccuagagcc

SEQ ID NO: 3565180 - RNA, 13 nt, Human
accgcuccccagc

SEQ ID NO: 3565181 - RNA, 15 nt, Human
accgcuccccagccc

SEQ ID NO: 3565182 - RNA, 20 nt, Human
accgcuccccagcccagggu

SEQ ID NO: 3565183 - RNA, 21 nt, Human
accgcugccuaaguggcugcu

SEQ ID NO: 3565184 - RNA, 19 nt, Human
accgcuucccuccugcccg

SEQ ID NO: 3565185 - RNA, 22 nt, Human
accgcuuccggcuccugugcuu

SEQ ID NO: 3565186 - RNA, 15 nt, Human
accgcuucugccuuu

SEQ ID NO: 3565187 - RNA, 18 nt, Human
accuuaggccuuccucuc

SEQ ID NO: 3565188 - RNA, 20 nt, Human
accuuaguguuucugugcau

SEQ ID NO: 3565189 - RNA, 18 nt, Human
accuuauaguuacugugu

SEQ ID NO: 3565190 - RNA, 19 nt, Human
accuuauaguuacugugua

SEQ ID NO: 3565191 - RNA, 18 nt, Human
accuuaugagaaacugca

SEQ ID NO: 3565192 - RNA, 14 nt, Human
accuuauuguaccu

SEQ ID NO: 3565193 - RNA, 13 nt, Human
accuucaaagcug

SEQ ID NO: 3565194 - RNA, 13 nt, Human
accuucaauaaag

SEQ ID NO: 3565195 - RNA, 14 nt, Human
accuucaauaaagu

SEQ ID NO: 3565196 - RNA, 19 nt, Human
accuucaauaaaguaucua

SEQ ID NO: 3565197 - RNA, 14 nt, Human
accuucacucuaag

SEQ ID NO: 3565198 - RNA, 14 nt, Human
accuucagaauaag

SEQ ID NO: 3565199 - RNA, 16 nt, Human
accuucagauccuacc

SEQ ID NO: 3565200 - RNA, 12 nt, Human
accuucagcuca

SEQ ID NO: 3565201 - RNA, 19 nt, Human
accuucaguuuuuguguuu

SEQ ID NO: 3565202 - RNA, 21 nt, Human
accuucauuucaggagggauu

SEQ ID NO: 3565203 - RNA, 14 nt, Human
accuucauuucaug

SEQ ID NO: 3565204 - RNA, 15 nt, Human
accuuccaagagccu

SEQ ID NO: 3565205 - RNA, 14 nt, Human
accuuccacccagu

SEQ ID NO: 3565206 - RNA, 13 nt, Human
accuuccagcucc

SEQ ID NO: 3565207 - RNA, 14 nt, Human
accuuccaggaccc

SEQ ID NO: 3565208 - RNA, 15 nt, Human
accuuccaggacccc

SEQ ID NO: 3565209 - RNA, 19 nt, Human
accuuccauggcucuuuuu

SEQ ID NO: 3565210 - RNA, 19 nt, Human
accuucccaaacgccuccc

SEQ ID NO: 3565211 - RNA, 21 nt, Human
accuucccaaacgccuccccu

SEQ ID NO: 3565212 - RNA, 17 nt, Human
accuucccagcucuccc

SEQ ID NO: 3565213 - RNA, 18 nt, Human
accuucccagcucucccu

SEQ ID NO: 3565214 - RNA, 12 nt, Human
accuuccucacu

SEQ ID NO: 3565215 - RNA, 13 nt, Human
accuuccucgcag

SEQ ID NO: 3565216 - RNA, 16 nt, Human
accuuccucuggggcu

SEQ ID NO: 3565217 - RNA, 12 nt, Human
accuuccugcug

SEQ ID NO: 3565218 - RNA, 15 nt, Human
accuuccuuccuguu

SEQ ID NO: 3565219 - RNA, 21 nt, Human
accuuccuuuuacuuuucuuc

SEQ ID NO: 3565220 - RNA, 15 nt, Human
accuucuagaauuau

SEQ ID NO: 3565221 - RNA, 23 nt, Human
accuucucacauggaaugagggu

SEQ ID NO: 3565222 - RNA, 14 nt, Human
accuucuccuucac

SEQ ID NO: 3565223 - RNA, 22 nt, Human
accuucuccuucaccuuugucc

SEQ ID NO: 3565224 - RNA, 23 nt, Human
accuucucuauggggcauccucu

SEQ ID NO: 3565225 - RNA, 12 nt, Human
accuucucugga

SEQ ID NO: 3565226 - RNA, 23 nt, Human
accuucucuggagccaaguccag

SEQ ID NO: 3565227 - RNA, 15 nt, Human
accuucugaguacag

SEQ ID NO: 3565228 - RNA, 11 nt, Human
accuucuguag

SEQ ID NO: 3565229 - RNA, 18 nt, Human
accuucuucaggcugccu

SEQ ID NO: 3565230 - RNA, 16 nt, Human
accuucuucuccuaca

SEQ ID NO: 3565231 - RNA, 22 nt, Human
accuugaaaaaaaacaguggau

SEQ ID NO: 3565232 - RNA, 19 nt, Human
accuugaaaacuuuaugcu

SEQ ID NO: 3565233 - RNA, 18 nt, Human
accuugaacuccugggcu

SEQ ID NO: 3565234 - RNA, 17 nt, Human
accuugaccuuuguaca

SEQ ID NO: 3565235 - RNA, 19 nt, Human
accuugaccuuuguacagc

SEQ ID NO: 3565236 - RNA, 14 nt, Human
accuugacuugauu

SEQ ID NO: 3565237 - RNA, 15 nt, Human
accuugagacagcuu

SEQ ID NO: 3565238 - RNA, 22 nt, Human
accuugaggaggggcagguaaa

SEQ ID NO: 3565239 - RNA, 22 nt, Human
accuugcacacaucaucuguaa

SEQ ID NO: 3565240 - RNA, 19 nt, Human
accuugcaucucauugcuc

SEQ ID NO: 3565241 - RNA, 20 nt, Human
accuugccccaacccuucuu

SEQ ID NO: 3565242 - RNA, 15 nt, Human
accuugccugguaca

SEQ ID NO: 3565243 - RNA, 23 nt, Human
accuugcugcaagcacagcccuu

SEQ ID NO: 3565244 - RNA, 15 nt, Human
accuugcuuuugcuu

SEQ ID NO: 3565245 - RNA, 18 nt, Human
accuugcuuuugcuucua

SEQ ID NO: 3565246 - RNA, 22 nt, Human
accuuggcaccagacacccagg

SEQ ID NO: 3565247 - RNA, 13 nt, Human
accuuggccuggg

SEQ ID NO: 3565248 - RNA, 12 nt, Human
accuuggcucaa

SEQ ID NO: 3565249 - RNA, 12 nt, Human
accuuggcugca

SEQ ID NO: 3565250 - RNA, 12 nt, Human
accuuggcuugg

SEQ ID NO: 3565251 - RNA, 20 nt, Human
accuuggcuuggcccuggca

SEQ ID NO: 3565252 - RNA, 17 nt, Human
accuuggggcuugacuu

SEQ ID NO: 3565253 - RNA, 13 nt, Human
accuuguaaaaga

SEQ ID NO: 3565254 - RNA, 15 nt, Human
accuuguaauguaac

SEQ ID NO: 3565255 - RNA, 16 nt, Human
accuuguaauguaacu

SEQ ID NO: 3565256 - RNA, 12 nt, Human
accuuguauaaa

SEQ ID NO: 3565257 - RNA, 14 nt, Human
accuugugaucaug

SEQ ID NO: 3565258 - RNA, 17 nt, Human
accuugugccuggcuca

SEQ ID NO: 3565259 - RNA, 13 nt, Human
accuuuaagaaaa

SEQ ID NO: 3565260 - RNA, 22 nt, Human
accuuuaaucagguccugcuca

SEQ ID NO: 3565261 - RNA, 14 nt, Human
accuuuacuuuaga

SEQ ID NO: 3565262 - RNA, 21 nt, Human
accuuuauuccuucauuucau

SEQ ID NO: 3565263 - RNA, 23 nt, Human
accuuuauuccuucauuucaucu

SEQ ID NO: 3565264 - RNA, 12 nt, Human
accuuuauucug

SEQ ID NO: 3565265 - RNA, 13 nt, Human
accuuuauucugg

SEQ ID NO: 3565266 - RNA, 13 nt, Human
accuuuauucuuu

SEQ ID NO: 3565267 - RNA, 14 nt, Human
accuuuauugugau

SEQ ID NO: 3565268 - RNA, 16 nt, Human
accuuuauugugaucu

SEQ ID NO: 3565269 - RNA, 18 nt, Human
accuuuauugugaucuau

SEQ ID NO: 3565270 - RNA, 23 nt, Human
accuuucagauaacuguuauuua

SEQ ID NO: 3565271 - RNA, 19 nt, Human
accuuucauaaucuuugcu

SEQ ID NO: 3565272 - RNA, 21 nt, Human
accuuucauaaucuuugcuuu

SEQ ID NO: 3565273 - RNA, 18 nt, Human
accuuuccaccacagcca

SEQ ID NO: 3565274 - RNA, 15 nt, Human
accuuucccuaaaga

SEQ ID NO: 3565275 - RNA, 22 nt, Human
accuuucccucacccccuccca

SEQ ID NO: 3565276 - RNA, 11 nt, Human
accuuucuagu

SEQ ID NO: 3565277 - RNA, 16 nt, Human
accuuucuccuuugua

SEQ ID NO: 3565278 - RNA, 20 nt, Human
accuuucuucaccaaaucuu

SEQ ID NO: 3565279 - RNA, 22 nt, Human
accuuuguacagcccagaggcc

SEQ ID NO: 3565280 - RNA, 22 nt, Human
accuuuguagcacucaggcucu

SEQ ID NO: 3565281 - RNA, 23 nt, Human
accuuuguauucucuccuguacc

SEQ ID NO: 3565282 - RNA, 17 nt, Human
accuuugugcccuauca

SEQ ID NO: 3565283 - RNA, 16 nt, Human
accuuuguguauuuuu

SEQ ID NO: 3565284 - RNA, 21 nt, Human
accuuuuaaaguguuucagcu

SEQ ID NO: 3565285 - RNA, 22 nt, Human
accuuuuaaaguguuucagcua

SEQ ID NO: 3565286 - RNA, 21 nt, Human
accuuuuaauuaaugaaauau

SEQ ID NO: 3565287 - RNA, 15 nt, Human
accuuuuaccagcuu

SEQ ID NO: 3565288 - RNA, 19 nt, Human
accuuuuaccagcuuuuaa

SEQ ID NO: 3565289 - RNA, 20 nt, Human
accuuuuacugguugcaugg

SEQ ID NO: 3565290 - RNA, 13 nt, Human
accuuuuauuaua

SEQ ID NO: 3565291 - RNA, 16 nt, Human
accuuuucaggaaaau

SEQ ID NO: 3565292 - RNA, 17 nt, Human
accuuuugaggagcccc

SEQ ID NO: 3565293 - RNA, 13 nt, Human
accuuuuggggga

SEQ ID NO: 3565294 - RNA, 17 nt, Human
accuuuugggggagggc

SEQ ID NO: 3565295 - RNA, 15 nt, Human
accuuuuuuaagauu

SEQ ID NO: 3565296 - RNA, 16 nt, Human
accuuuuuuauacaua

SEQ ID NO: 3565297 - RNA, 19 nt, Human
accuuuuuuauacauaaac

SEQ ID NO: 3565298 - RNA, 20 nt, Human
accuuuuuuauacauaaaca

SEQ ID NO: 3565299 - RNA, 21 nt, Human
accuuuuuuauacauaaacaa

SEQ ID NO: 3565300 - RNA, 22 nt, Human
accuuuuuuauacauaaacaag

SEQ ID NO: 3565301 - RNA, 20 nt, Human
accuuuuuuguuuuuucaaa

SEQ ID NO: 3565302 - RNA, 14 nt, Human
acgaaacaaagaca

SEQ ID NO: 3565303 - RNA, 19 nt, Human
acgaaacacaaaccacaac

SEQ ID NO: 3565304 - RNA, 14 nt, Human
acgaaacugcucua

SEQ ID NO: 3565305 - RNA, 21 nt, Human
acgaaacuuguuauugugaau

SEQ ID NO: 3565306 - RNA, 21 nt, Human
acgaaauaauuguuguucugu

SEQ ID NO: 3565307 - RNA, 16 nt, Human
acgaaauguuauuuuu

SEQ ID NO: 3565308 - RNA, 23 nt, Human
acgaaauguuauuuuuuaauuau

SEQ ID NO: 3565309 - RNA, 12 nt, Human
acgaacaaaaca

SEQ ID NO: 3565310 - RNA, 14 nt, Human
acgaacccaccugc

SEQ ID NO: 3565311 - RNA, 17 nt, Human
acgaagaagagccacag

SEQ ID NO: 3565312 - RNA, 20 nt, Human
acgaagaguauuuuugacag

SEQ ID NO: 3565313 - RNA, 13 nt, Human
acgaaggagccca

SEQ ID NO: 3565314 - RNA, 15 nt, Human
acgaauagacaucaa

SEQ ID NO: 3565315 - RNA, 21 nt, Human
acgaaugaaaauaacugaauu

SEQ ID NO: 3565316 - RNA, 19 nt, Human
acgacaaggaaaggcaaau

SEQ ID NO: 3565317 - RNA, 20 nt, Human
acgacaauagcuuuacccuc

SEQ ID NO: 3565318 - RNA, 14 nt, Human
acgacacacuuuga

SEQ ID NO: 3565319 - RNA, 13 nt, Human
acgacacugcagc

SEQ ID NO: 3565320 - RNA, 22 nt, Human
acgacaguacuuucaaugaaca

SEQ ID NO: 3565321 - RNA, 17 nt, Human
acgaccacagggucugc

SEQ ID NO: 3565322 - RNA, 16 nt, Human
acgaccagggccgagg

SEQ ID NO: 3565323 - RNA, 21 nt, Human
acgaccggggccagcaccacu

SEQ ID NO: 3565324 - RNA, 21 nt, Human
acgaccuaggcaguaggccgg

SEQ ID NO: 3565325 - RNA, 14 nt, Human
acgacgcccucucc

SEQ ID NO: 3565326 - RNA, 15 nt, Human
acgacugcccggcag

SEQ ID NO: 3565327 - RNA, 14 nt, Human
acgagaaaacaaua

SEQ ID NO: 3565328 - RNA, 20 nt, Human
acgagaggggaagaguguac

SEQ ID NO: 3565329 - RNA, 18 nt, Human
acgagagguaugccugua

SEQ ID NO: 3565330 - RNA, 17 nt, Human
acgagauaaugugaacu

SEQ ID NO: 3565331 - RNA, 19 nt, Human
acgagaucaagagaucaag

SEQ ID NO: 3565332 - RNA, 19 nt, Human
acgagcaggcuacugucag

SEQ ID NO: 3565333 - RNA, 20 nt, Human
acgagcaggcuacugucagc

SEQ ID NO: 3565334 - RNA, 16 nt, Human
acgagcaggcuucuuc

SEQ ID NO: 3565335 - RNA, 13 nt, Human
acgagccuuuuca

SEQ ID NO: 3565336 - RNA, 11 nt, Human
acgaggcccuc

SEQ ID NO: 3565337 - RNA, 13 nt, Human
acgaggcccucgg

SEQ ID NO: 3565338 - RNA, 13 nt, Human
acuaucugcuuuu

SEQ ID NO: 3565339 - RNA, 20 nt, Human
acuaucugugcguagaaguu

SEQ ID NO: 3565340 - RNA, 13 nt, Human
acuaucuucaucu

SEQ ID NO: 3565341 - RNA, 16 nt, Human
acuaucuuggugaauu

SEQ ID NO: 3565342 - RNA, 18 nt, Human
acuaucuuucagcuccag

SEQ ID NO: 3565343 - RNA, 15 nt, Human
acuaugaaaccuuuu

SEQ ID NO: 3565344 - RNA, 18 nt, Human
acuaugaacuacaaagcu

SEQ ID NO: 3565345 - RNA, 22 nt, Human
acuaugaaucuauuauacugua

SEQ ID NO: 3565346 - RNA, 24 nt, Human
acuaugcauggugccccaggacca

SEQ ID NO: 3565347 - RNA, 15 nt, Human
acuaugcuuuccuuc

SEQ ID NO: 3565348 - RNA, 23 nt, Human
acuauggagugcaccaaagagaa

SEQ ID NO: 3565349 - RNA, 16 nt, Human
acuaugggaugagaaa

SEQ ID NO: 3565350 - RNA, 14 nt, Human
acuauggugccaau

SEQ ID NO: 3565351 - RNA, 20 nt, Human
acuauggugccaauggaacc

SEQ ID NO: 3565352 - RNA, 18 nt, Human
acuauguaaaaauaaccu

SEQ ID NO: 3565353 - RNA, 15 nt, Human
acuauguacaauauu

SEQ ID NO: 3565354 - RNA, 14 nt, Human
acuauguguuuuuc

SEQ ID NO: 3565355 - RNA, 18 nt, Human
acuauguugcccaggcag

SEQ ID NO: 3565356 - RNA, 20 nt, Human
acuauguuuuuguucaguuu

SEQ ID NO: 3565357 - RNA, 21 nt, Human
acuauuaaacaugcuguacau

SEQ ID NO: 3565358 - RNA, 14 nt, Human
acuauuaagaggca

SEQ ID NO: 3565359 - RNA, 19 nt, Human
acuauuaaggauguagcuu

SEQ ID NO: 3565360 - RNA, 11 nt, Human
acuauuauuau

SEQ ID NO: 3565361 - RNA, 13 nt, Human
acuauucaaacag

SEQ ID NO: 3565362 - RNA, 14 nt, Human
acuauucaaacagu

SEQ ID NO: 3565363 - RNA, 13 nt, Human
acuauucaaguau

SEQ ID NO: 3565364 - RNA, 15 nt, Human
acuauucaguugugu

SEQ ID NO: 3565365 - RNA, 18 nt, Human
acuauucgaaugaaaaga

SEQ ID NO: 3565366 - RNA, 19 nt, Human
acuauucgaaugaaaagac

SEQ ID NO: 3565367 - RNA, 22 nt, Human
acuauucugauuacacaaaaca

SEQ ID NO: 3565368 - RNA, 17 nt, Human
acuauucuguaucuuuc

SEQ ID NO: 3565369 - RNA, 17 nt, Human
acuauugacaucagcau

SEQ ID NO: 3565370 - RNA, 21 nt, Human
acuauuggaaucugauauacu

SEQ ID NO: 3565371 - RNA, 16 nt, Human
acuauuguuagucucu

SEQ ID NO: 3565372 - RNA, 14 nt, Human
acuauuuaaacuua

SEQ ID NO: 3565373 - RNA, 15 nt, Human
acuauuuaacuugag

SEQ ID NO: 3565374 - RNA, 22 nt, Human
acuauuuaacuugagcuuuaaa

SEQ ID NO: 3565375 - RNA, 14 nt, Human
acuauuuaagaugu

SEQ ID NO: 3565376 - RNA, 15 nt, Human
acuauuuaucugugu

SEQ ID NO: 3565377 - RNA, 22 nt, Human
acuauuucccuugaaauuuuaa

SEQ ID NO: 3565378 - RNA, 12 nt, Human
acuauuuccuuu

SEQ ID NO: 3565379 - RNA, 22 nt, Human
acuauuucuacacagugggaac

SEQ ID NO: 3565380 - RNA, 21 nt, Human
acuauuucuuauauaugugaa

SEQ ID NO: 3565381 - RNA, 14 nt, Human
acuauuuuaugcaa

SEQ ID NO: 3565382 - RNA, 12 nt, Human
acuauuuucaga

SEQ ID NO: 3565383 - RNA, 13 nt, Human
acuauuuucagaa

SEQ ID NO: 3565384 - RNA, 16 nt, Human
acuauuuucagaaucu

SEQ ID NO: 3565385 - RNA, 18 nt, Human
acuauuuuuacugccacu

SEQ ID NO: 3565386 - RNA, 16 nt, Human
acuauuuuuauuuuua

SEQ ID NO: 3565387 - RNA, 14 nt, Human
acuauuuuucagaa

SEQ ID NO: 3565388 - RNA, 17 nt, Human
acucaaaauauuuguac

SEQ ID NO: 3565389 - RNA, 19 nt, Human
acucaaagcaaaagugcug

SEQ ID NO: 3565390 - RNA, 20 nt, Human
acucaaaguuaaccuaccug

SEQ ID NO: 3565391 - RNA, 22 nt, Human
acucaaaguuucagagaccauu

SEQ ID NO: 3565392 - RNA, 15 nt, Human
acucaaauacacauu

SEQ ID NO: 3565393 - RNA, 16 nt, Human
acucaaauacacauuu

SEQ ID NO: 3565394 - RNA, 21 nt, Human
acucaaauaugaguacaaaug

SEQ ID NO: 3565395 - RNA, 18 nt, Human
acucaaaucuuaagaaau

SEQ ID NO: 3565396 - RNA, 14 nt, Human
acucaaaugaguaa

SEQ ID NO: 3565397 - RNA, 20 nt, Human
acucaaauggggccagaucc

SEQ ID NO: 3565398 - RNA, 18 nt, Human
acucaaauguucuaaguu

SEQ ID NO: 3565399 - RNA, 22 nt, Human
acucaacaaaacccaugcauuu

SEQ ID NO: 3565400 - RNA, 20 nt, Human
acucaacauguuacugacca

SEQ ID NO: 3565401 - RNA, 21 nt, Human
acucaacauguuacugaccag

SEQ ID NO: 3565402 - RNA, 15 nt, Human
acucaagaagcaggc

SEQ ID NO: 3565403 - RNA, 17 nt, Human
acucaagaagugaagaa

SEQ ID NO: 3565404 - RNA, 14 nt, Human
acucaagaggcuga

SEQ ID NO: 3565405 - RNA, 17 nt, Human
acucaagaggcugaggc

SEQ ID NO: 3565406 - RNA, 18 nt, Human
acucaagaggcugaggca

SEQ ID NO: 3565407 - RNA, 16 nt, Human
acucaagccaagcagc

SEQ ID NO: 3565408 - RNA, 18 nt, Human
acucaagcggguggcucu

SEQ ID NO: 3565409 - RNA, 21 nt, Human
acucaaggauaccuucuuauu

SEQ ID NO: 3565410 - RNA, 18 nt, Human
acucaaggcggugcuuga

SEQ ID NO: 3565411 - RNA, 15 nt, Human
acucaaguagcauuu

SEQ ID NO: 3565412 - RNA, 15 nt, Human
acucaaguucaagga

SEQ ID NO: 3565413 - RNA, 12 nt, Human
acucaauauuuu

SEQ ID NO: 3565414 - RNA, 14 nt, Human
acucaaugagcucu

SEQ ID NO: 3565415 - RNA, 18 nt, Human
acucaaugcuuuauuugu

SEQ ID NO: 3565416 - RNA, 24 nt, Human
acucaauggaguaugucugaugga

SEQ ID NO: 3565417 - RNA, 16 nt, Human
acucaauggauuugau

SEQ ID NO: 3565418 - RNA, 15 nt, Human
acucaauugauaaac

SEQ ID NO: 3565419 - RNA, 12 nt, Human
acucaauuuuaa

SEQ ID NO: 3565420 - RNA, 15 nt, Human
acucaauuuuaacaa

SEQ ID NO: 3565421 - RNA, 21 nt, Human
acucacaaccugaaccuagga

SEQ ID NO: 3565422 - RNA, 16 nt, Human
acucacaagaagacca

SEQ ID NO: 3565423 - RNA, 14 nt, Human
acucacacaggacc

SEQ ID NO: 3565424 - RNA, 13 nt, Human
acucacacaggca

SEQ ID NO: 3565425 - RNA, 14 nt, Human
acucacacaggcau

SEQ ID NO: 3565426 - RNA, 20 nt, Human
acucacacaggcauuuccug

SEQ ID NO: 3565427 - RNA, 23 nt, Human
acucacacaggcauuuccugggu

SEQ ID NO: 3565428 - RNA, 18 nt, Human
acucacaccacuagccuc

SEQ ID NO: 3565429 - RNA, 18 nt, Human
acucacagaccuggagcc

SEQ ID NO: 3565430 - RNA, 23 nt, Human
acucacagaccuggagccccugg

SEQ ID NO: 3565431 - RNA, 17 nt, Human
acucacagagacacagg

SEQ ID NO: 3565432 - RNA, 18 nt, Human
acucacagagucaaggcc

SEQ ID NO: 3565433 - RNA, 16 nt, Human
acucacaugcuggaca

SEQ ID NO: 3565434 - RNA, 19 nt, Human
acucacauuuauucugcuc

SEQ ID NO: 3565435 - RNA, 21 nt, Human
acucacauuuauucugcucac

SEQ ID NO: 3565436 - RNA, 13 nt, Human
acucaccacugcc

SEQ ID NO: 3565437 - RNA, 22 nt, Human
acucaccagccccacugccagc

SEQ ID NO: 3565438 - RNA, 17 nt, Human
acucaccaguguccccu

SEQ ID NO: 3565439 - RNA, 15 nt, Human
acucaccauguaaaa

SEQ ID NO: 3565440 - RNA, 17 nt, Human
acucaccgaagccacuu

SEQ ID NO: 3565441 - RNA, 17 nt, Human
acucaccuaauguuuau

SEQ ID NO: 3565442 - RNA, 20 nt, Human
acucaccuaauguuuaugag

SEQ ID NO: 3565443 - RNA, 20 nt, Human
acucaccucccccaucucuu

SEQ ID NO: 3565444 - RNA, 13 nt, Human
acucaccucugcc

SEQ ID NO: 3565445 - RNA, 22 nt, Human
acucacuaggcccccacuugcc

SEQ ID NO: 3565446 - RNA, 14 nt, Human
acucacuccugaga

SEQ ID NO: 3565447 - RNA, 20 nt, Human
acucacuccugagaccccug

SEQ ID NO: 3565448 - RNA, 22 nt, Human
acucacuccugagaccccuggc

SEQ ID NO: 3565449 - RNA, 15 nt, Human
acucacucugggcug

SEQ ID NO: 3565450 - RNA, 16 nt, Human
acucacucugggcugu

SEQ ID NO: 3565451 - RNA, 16 nt, Human
acucacugaagccugc

SEQ ID NO: 3565452 - RNA, 15 nt, Human
acucacugcucaaga

SEQ ID NO: 3565453 - RNA, 18 nt, Human
acucacuggcagccccag

SEQ ID NO: 3565454 - RNA, 20 nt, Human
acucacuggcagccccagca

SEQ ID NO: 3565455 - RNA, 21 nt, Human
acucacuggcagccccagcac

SEQ ID NO: 3565456 - RNA, 23 nt, Human
acucacuggggaacguucucuuu

SEQ ID NO: 3565457 - RNA, 18 nt, Human
acucacugugaucaauau

SEQ ID NO: 3565458 - RNA, 15 nt, Human
acucacuuuucccac

SEQ ID NO: 3565459 - RNA, 16 nt, Human
acucacuuuucccacu

SEQ ID NO: 3565460 - RNA, 15 nt, Human
acucagaaacaucag

SEQ ID NO: 3565461 - RNA, 14 nt, Human
acucagaaagccaa

SEQ ID NO: 3565462 - RNA, 14 nt, Human
acucagaaauuuuu

SEQ ID NO: 3565463 - RNA, 22 nt, Human
acucagaacugucggaggaaag

SEQ ID NO: 3565464 - RNA, 23 nt, Human
acucagaacugucggaggaaaga

SEQ ID NO: 3565465 - RNA, 15 nt, Human
acucagaagacacug

SEQ ID NO: 3565466 - RNA, 12 nt, Human
acucagaagccu

SEQ ID NO: 3565467 - RNA, 15 nt, Human
acucagaagccugag

SEQ ID NO: 3565468 - RNA, 16 nt, Human
acucagaagccugagg

SEQ ID NO: 3565469 - RNA, 15 nt, Human
acucagaagccuggg

SEQ ID NO: 3565470 - RNA, 16 nt, Human
acucagaagccugggg

SEQ ID NO: 3565471 - RNA, 17 nt, Human
acucagaagccuggggg

SEQ ID NO: 3565472 - RNA, 22 nt, Human
acucagaagccugggggccugg

SEQ ID NO: 3565473 - RNA, 21 nt, Human
acucagaauucucuaguuuga

SEQ ID NO: 3565474 - RNA, 22 nt, Human
acucagagaaaaaugcucccca

SEQ ID NO: 3565475 - RNA, 14 nt, Human
acucagagacaugc

SEQ ID NO: 3565476 - RNA, 19 nt, Human
acucagagcagucugugac

SEQ ID NO: 3565477 - RNA, 20 nt, Human
acucagaucacuacugcagu

SEQ ID NO: 3565478 - RNA, 17 nt, Human
acucagauccagggaca

SEQ ID NO: 3565479 - RNA, 16 nt, Human
acucagauccuccuca

SEQ ID NO: 3565480 - RNA, 23 nt, Human
acucagauggaaccgcaggaagc

SEQ ID NO: 3565481 - RNA, 17 nt, Human
acucagcaccacucaag

SEQ ID NO: 3565482 - RNA, 17 nt, Human
acucagcacuuggcccu

SEQ ID NO: 3565483 - RNA, 15 nt, Human
acucagcagaauggu

SEQ ID NO: 3565484 - RNA, 20 nt, Human
acucagccaaccuuacuuac

SEQ ID NO: 3565485 - RNA, 17 nt, Human
acucagccaagcacagu

SEQ ID NO: 3565486 - RNA, 17 nt, Human
acucagccccuaggagu

SEQ ID NO: 3565487 - RNA, 11 nt, Human
acucagcccug

SEQ ID NO: 3565488 - RNA, 15 nt, Human
acucagccugcugcc

SEQ ID NO: 3565489 - RNA, 18 nt, Human
acucagccugcugcccag

SEQ ID NO: 3565490 - RNA, 23 nt, Human
acucagccuucagacagagagga

SEQ ID NO: 3565491 - RNA, 15 nt, Human
acucagcuccccaga

SEQ ID NO: 3565492 - RNA, 19 nt, Human
acucagcuccccagagucc

SEQ ID NO: 3565493 - RNA, 14 nt, Human
acucagcuguccug

SEQ ID NO: 3565494 - RNA, 18 nt, Human
acucagcugucuguggcu

SEQ ID NO: 3565495 - RNA, 17 nt, Human
acucagcuuccuaccca

SEQ ID NO: 3565496 - RNA, 16 nt, Human
acucaggacuccagcc

SEQ ID NO: 3565497 - RNA, 16 nt, Human
acucaggaggcugagg

SEQ ID NO: 3565498 - RNA, 18 nt, Human
acucaggaggcugaggca

SEQ ID NO: 3565499 - RNA, 20 nt, Human
acucaggaggcugaggcaga

SEQ ID NO: 3565500 - RNA, 17 nt, Human
acucaggaggcugaggg

SEQ ID NO: 3565501 - RNA, 18 nt, Human
acucaggauccagucccu

SEQ ID NO: 3565502 - RNA, 15 nt, Human
acucaggaugcccag

SEQ ID NO: 3565503 - RNA, 23 nt, Human
acucaggcccccaccuggcucac

SEQ ID NO: 3565504 - RNA, 23 nt, Human
acucaggcgggacagugcugcag

SEQ ID NO: 3565505 - RNA, 14 nt, Human
acucaggcucucca

SEQ ID NO: 3565506 - RNA, 15 nt, Human
acucaggcuuucacu

SEQ ID NO: 3565507 - RNA, 21 nt, Human
acucagggcagcgccaggcug

SEQ ID NO: 3565508 - RNA, 15 nt, Human
acucagggccccagc

SEQ ID NO: 3565509 - RNA, 17 nt, Human
acucagggcuccuccca

SEQ ID NO: 3565510 - RNA, 19 nt, Human
acucagggcuccucccagc

SEQ ID NO: 3565511 - RNA, 22 nt, Human
acucagguuguaguaaagaaau

SEQ ID NO: 3565512 - RNA, 17 nt, Human
acucagucucucuucuc

SEQ ID NO: 3565513 - RNA, 23 nt, Human
acucaguuuauguuguacaaugu

SEQ ID NO: 3565514 - RNA, 13 nt, Human
acucaguuuguca

SEQ ID NO: 3565515 - RNA, 14 nt, Human
acucaguuugucag

SEQ ID NO: 3565516 - RNA, 15 nt, Human
acucaguuugucaga

SEQ ID NO: 3565517 - RNA, 22 nt, Human
acucaguuuuaacuagaauuua

SEQ ID NO: 3565518 - RNA, 15 nt, Human
acucauaaugugaag

SEQ ID NO: 3565519 - RNA, 15 nt, Human
acucauacaucuggc

SEQ ID NO: 3565520 - RNA, 23 nt, Human
acucauauaauuauauguuguaa

SEQ ID NO: 3565521 - RNA, 13 nt, Human
acucauauuacug

SEQ ID NO: 3565522 - RNA, 12 nt, Human
acucaucauaaa

SEQ ID NO: 3565523 - RNA, 16 nt, Human
acucaucauaaaauaa

SEQ ID NO: 3565524 - RNA, 18 nt, Human
acucaucuagguaaauua

SEQ ID NO: 3565525 - RNA, 16 nt, Human
acucaucugaaauguu

SEQ ID NO: 3565526 - RNA, 12 nt, Human
acucaucuuagg

SEQ ID NO: 3565527 - RNA, 22 nt, Human
acucaucuuagugccugagagu

SEQ ID NO: 3565528 - RNA, 21 nt, Human
acucaucuuucauuaaaggcu

SEQ ID NO: 3565529 - RNA, 18 nt, Human
acucaucuuucccuccuu

SEQ ID NO: 3565530 - RNA, 16 nt, Human
acucaugcauuguccu

SEQ ID NO: 3565531 - RNA, 12 nt, Human
acucaugcugaa

SEQ ID NO: 3565532 - RNA, 15 nt, Human
acucaugugacucuu

SEQ ID NO: 3565533 - RNA, 18 nt, Human
acucaugugacucuuucc

SEQ ID NO: 3565534 - RNA, 19 nt, Human
acucaugugacucuuucca

SEQ ID NO: 3565535 - RNA, 11 nt, Human
acucaugugua

SEQ ID NO: 3565536 - RNA, 14 nt, Human
acucauguuaauug

SEQ ID NO: 3565537 - RNA, 12 nt, Human
acucauuaauua

SEQ ID NO: 3565538 - RNA, 21 nt, Human
acucauuagacuggaacuuga

SEQ ID NO: 3565539 - RNA, 13 nt, Human
acucauucauuag

SEQ ID NO: 3565540 - RNA, 16 nt, Human
acucauucauuaguca

SEQ ID NO: 3565541 - RNA, 15 nt, Human
acucauuccagaucc

SEQ ID NO: 3565542 - RNA, 19 nt, Human
acucauucugaaggagccc

SEQ ID NO: 3565543 - RNA, 16 nt, Human
acucauugaaauguca

SEQ ID NO: 3565544 - RNA, 18 nt, Human
acucauugcugagccucu

SEQ ID NO: 3565545 - RNA, 22 nt, Human
acucauugcugagccucugcuc

SEQ ID NO: 3565546 - RNA, 20 nt, Human
acucauuuaaaguauuuuau

SEQ ID NO: 3565547 - RNA, 20 nt, Human
acucauuuuaaaaaauggaa

SEQ ID NO: 3565548 - RNA, 16 nt, Human
acucauuuucuauaac

SEQ ID NO: 3565549 - RNA, 22 nt, Human
acuccaaacagaccccuguuca

SEQ ID NO: 3565550 - RNA, 14 nt, Human
acuccaaagaaaug

SEQ ID NO: 3565551 - RNA, 15 nt, Human
acuccaaagaaaugu

SEQ ID NO: 3565552 - RNA, 15 nt, Human
acuccaacauccacu

SEQ ID NO: 3565553 - RNA, 18 nt, Human
acuccaacauccacucuc

SEQ ID NO: 3565554 - RNA, 15 nt, Human
acuccaaccuaaccu

SEQ ID NO: 3565555 - RNA, 21 nt, Human
acuccaaccuaaccugugucu

SEQ ID NO: 3565556 - RNA, 20 nt, Human
acuccaacucccuuaaaaua

SEQ ID NO: 3565557 - RNA, 17 nt, Human
acuccaagaacaauugu

SEQ ID NO: 3565558 - RNA, 19 nt, Human
acuccaagauauggacaca

SEQ ID NO: 3565559 - RNA, 18 nt, Human
acuccaagcccagcccau

SEQ ID NO: 3565560 - RNA, 17 nt, Human
acuccaauuaaggauuu

SEQ ID NO: 3565561 - RNA, 13 nt, Human
acuccacacugca

SEQ ID NO: 3565562 - RNA, 17 nt, Human
acuccacaucugccuua

SEQ ID NO: 3565563 - RNA, 20 nt, Human
acuccaccaacccaucagaa

SEQ ID NO: 3565564 - RNA, 14 nt, Human
acuccaccacccaa

SEQ ID NO: 3565565 - RNA, 16 nt, Human
acuccacccuccaccu

SEQ ID NO: 3565566 - RNA, 14 nt, Human
acuccagaaaguga

SEQ ID NO: 3565567 - RNA, 20 nt, Human
acuccagaaaugucccuuuc

SEQ ID NO: 3565568 - RNA, 15 nt, Human
acuccagaucugcac

SEQ ID NO: 3565569 - RNA, 12 nt, Human
acuccagccagc

SEQ ID NO: 3565570 - RNA, 16 nt, Human
acuccagccagcgccu

SEQ ID NO: 3565571 - RNA, 17 nt, Human
acuccagccagcgccuc

SEQ ID NO: 3565572 - RNA, 19 nt, Human
acuccagccagcgccuccc

SEQ ID NO: 3565573 - RNA, 22 nt, Human
acuccagccagcgccucccucc

SEQ ID NO: 3565574 - RNA, 23 nt, Human
acuccagccagcgccucccucca

SEQ ID NO: 3565575 - RNA, 13 nt, Human
acuccagccugag

SEQ ID NO: 3565576 - RNA, 21 nt, Human
acuccagccugggcaacacag

SEQ ID NO: 3565577 - RNA, 20 nt, Human
acuccagcuggguuggaaaa

SEQ ID NO: 3565578 - RNA, 14 nt, Human
acuccaggagagga

SEQ ID NO: 3565579 - RNA, 17 nt, Human
acuccaggcagcagaca

SEQ ID NO: 3565580 - RNA, 14 nt, Human
acuccaggcccaag

SEQ ID NO: 3565581 - RNA, 18 nt, Human
acuccaggcccuccucuc

SEQ ID NO: 3565582 - RNA, 19 nt, Human
acuccaggcccuccucucc

SEQ ID NO: 3565583 - RNA, 14 nt, Human
acuccagugccagc

SEQ ID NO: 3565584 - RNA, 15 nt, Human
acuccagugccagca

SEQ ID NO: 3565585 - RNA, 10 nt, Human
acuccagugg

SEQ ID NO: 3565586 - RNA, 19 nt, Human
acuccaucucaaaaaauaa

SEQ ID NO: 3565587 - RNA, 19 nt, Human
acuccaucugguagaaggg

SEQ ID NO: 3565588 - RNA, 14 nt, Human
acuccauguuggcu

SEQ ID NO: 3565589 - RNA, 14 nt, Human
acuccauucccaac

SEQ ID NO: 3565590 - RNA, 22 nt, Human
acuccauucccaacuagacauu

SEQ ID NO: 3565591 - RNA, 15 nt, Human
acucccaaagagcug

SEQ ID NO: 3565592 - RNA, 16 nt, Human
acucccaaagagcugc

SEQ ID NO: 3565593 - RNA, 14 nt, Human
acucccaagaacag

SEQ ID NO: 3565594 - RNA, 19 nt, Human
acucccaagaacagcaggc

SEQ ID NO: 3565595 - RNA, 23 nt, Human
acucccaaguaugggguucaaga

SEQ ID NO: 3565596 - RNA, 19 nt, Human
acucccacccagucucugc

SEQ ID NO: 3565597 - RNA, 14 nt, Human
acucccaccugaca

SEQ ID NO: 3565598 - RNA, 15 nt, Human
acucccaugaagccu

SEQ ID NO: 3565599 - RNA, 16 nt, Human
acucccaugaagccuu

SEQ ID NO: 3565600 - RNA, 17 nt, Human
acucccaugaagccuuu

SEQ ID NO: 3565601 - RNA, 18 nt, Human
acucccaugaagccuuuu

SEQ ID NO: 3565602 - RNA, 17 nt, Human
acucccaugagggagau

SEQ ID NO: 3565603 - RNA, 15 nt, Human
acuccccaaccccca

SEQ ID NO: 3565604 - RNA, 19 nt, Human
acuccccagccugggccca

SEQ ID NO: 3565605 - RNA, 12 nt, Human
acuccccaggcc

SEQ ID NO: 3565606 - RNA, 16 nt, Human
acuccccgaagucuuu

SEQ ID NO: 3565607 - RNA, 17 nt, Human
acuccccgaagucuuuu

SEQ ID NO: 3565608 - RNA, 19 nt, Human
acuccccgccguacaguuc

SEQ ID NO: 3565609 - RNA, 11 nt, Human
acuccccucca

SEQ ID NO: 3565610 - RNA, 12 nt, Human
acuccccuccuu

SEQ ID NO: 3565611 - RNA, 16 nt, Human
acuccccugcacugga

SEQ ID NO: 3565612 - RNA, 17 nt, Human
acuccccugcugggugu

SEQ ID NO: 3565613 - RNA, 21 nt, Human
acuccccuguuucaaucacug

SEQ ID NO: 3565614 - RNA, 18 nt, Human
acucccggcacuccaugc

SEQ ID NO: 3565615 - RNA, 15 nt, Human
acucccucacaagug

SEQ ID NO: 3565616 - RNA, 13 nt, Human
acucccuccagca

SEQ ID NO: 3565617 - RNA, 14 nt, Human
acucccuccagcac

SEQ ID NO: 3565618 - RNA, 18 nt, Human
acucccuccuaaccuaga

SEQ ID NO: 3565619 - RNA, 16 nt, Human
acucccuccucaccuc

SEQ ID NO: 3565620 - RNA, 17 nt, Human
acucccugcagaugcca

SEQ ID NO: 3565621 - RNA, 17 nt, Human
acucccuggcucucaga

SEQ ID NO: 3565622 - RNA, 13 nt, Human
acucccuucccau

SEQ ID NO: 3565623 - RNA, 21 nt, Human
acucccuucccaugacccagg

SEQ ID NO: 3565624 - RNA, 15 nt, Human
acucccuucuaccug

SEQ ID NO: 3565625 - RNA, 17 nt, Human
acucccuucuaccugcc

SEQ ID NO: 3565626 - RNA, 21 nt, Human
acucccuucuaccugccacuc

SEQ ID NO: 3565627 - RNA, 13 nt, Human
acucccuucuccu

SEQ ID NO: 3565628 - RNA, 17 nt, Human
acucccuugcuggcccc

SEQ ID NO: 3565629 - RNA, 18 nt, Human
acucccuugcuggcccca

SEQ ID NO: 3565630 - RNA, 23 nt, Human
acucccuugcuggccccagcccu

SEQ ID NO: 3565631 - RNA, 12 nt, Human
acucccuuucaa

SEQ ID NO: 3565632 - RNA, 18 nt, Human
acuccgagugaacugguc

SEQ ID NO: 3565633 - RNA, 12 nt, Human
acuccgccccca

SEQ ID NO: 3565634 - RNA, 15 nt, Human
acuccgcccccagcc

SEQ ID NO: 3565635 - RNA, 18 nt, Human
acuccgcccccagccuau

SEQ ID NO: 3565636 - RNA, 23 nt, Human
acuccggagugagaagcuuugcc

SEQ ID NO: 3565637 - RNA, 16 nt, Human
acuccggcccuccaga

SEQ ID NO: 3565638 - RNA, 15 nt, Human
acuccggcccuccua

SEQ ID NO: 3565639 - RNA, 17 nt, Human
agccccucccaccacag

SEQ ID NO: 3565640 - RNA, 23 nt, Human
agccccucccaccacagcaggug

SEQ ID NO: 3565641 - RNA, 18 nt, Human
agccccucccccaucucc

SEQ ID NO: 3565642 - RNA, 11 nt, Human
agccccuccuc

SEQ ID NO: 3565643 - RNA, 13 nt, Human
agccccuccucca

SEQ ID NO: 3565644 - RNA, 20 nt, Human
agccccuccuccagccccug

SEQ ID NO: 3565645 - RNA, 21 nt, Human
agccccuccuccagccccugu

SEQ ID NO: 3565646 - RNA, 21 nt, Human
agccccuccucugccaccucc

SEQ ID NO: 3565647 - RNA, 22 nt, Human
agccccucuggucgcuccugcc

SEQ ID NO: 3565648 - RNA, 16 nt, Human
agccccucuugccccc

SEQ ID NO: 3565649 - RNA, 20 nt, Human
agccccucuugccccccacc

SEQ ID NO: 3565650 - RNA, 23 nt, Human
agccccucuugccccccacccca

SEQ ID NO: 3565651 - RNA, 23 nt, Human
agccccucuuggagaagucucag

SEQ ID NO: 3565652 - RNA, 16 nt, Human
agccccugaaagccau

SEQ ID NO: 3565653 - RNA, 16 nt, Human
agccccugccccagcc

SEQ ID NO: 3565654 - RNA, 14 nt, Human
agccccugccccuc

SEQ ID NO: 3565655 - RNA, 18 nt, Human
agccccugccccucaugc

SEQ ID NO: 3565656 - RNA, 16 nt, Human
agccccugccccuccu

SEQ ID NO: 3565657 - RNA, 13 nt, Human
agccccuggggcc

SEQ ID NO: 3565658 - RNA, 17 nt, Human
agccccuggggccuaga

SEQ ID NO: 3565659 - RNA, 22 nt, Human
agccccuggggccuagacucug

SEQ ID NO: 3565660 - RNA, 21 nt, Human
agccccugggguggccaccag

SEQ ID NO: 3565661 - RNA, 12 nt, Human
agccccugggug

SEQ ID NO: 3565662 - RNA, 17 nt, Human
agccgagagccugcucc

SEQ ID NO: 3565663 - RNA, 21 nt, Human
agccgagauagccaaggccaa

SEQ ID NO: 3565664 - RNA, 14 nt, Human
agccgagcaggagg

SEQ ID NO: 3565665 - RNA, 17 nt, Human
agccgagccgggccugg

SEQ ID NO: 3565666 - RNA, 23 nt, Human
agccgagcucguguauccugggg

SEQ ID NO: 3565667 - RNA, 19 nt, Human
agccgauaucagaauuugu

SEQ ID NO: 3565668 - RNA, 18 nt, Human
agccgcagccucccucug

SEQ ID NO: 3565669 - RNA, 13 nt, Human
agccgccacaucc

SEQ ID NO: 3565670 - RNA, 18 nt, Human
agccgccaguacuuguca

SEQ ID NO: 3565671 - RNA, 17 nt, Human
agccgccauugccacca

SEQ ID NO: 3565672 - RNA, 19 nt, Human
agccgccauugccaccagg

SEQ ID NO: 3565673 - RNA, 15 nt, Human
agccgcccaaggccu

SEQ ID NO: 3565674 - RNA, 15 nt, Human
agccgccuuccuuga

SEQ ID NO: 3565675 - RNA, 13 nt, Human
agccgcuccagag

SEQ ID NO: 3565676 - RNA, 15 nt, Human
agccgcucuccugcc

SEQ ID NO: 3565677 - RNA, 12 nt, Human
agccgcugcccg

SEQ ID NO: 3565678 - RNA, 21 nt, Human
agccggagccuccagcugccc

SEQ ID NO: 3565679 - RNA, 19 nt, Human
agccggagugacagaguaa

SEQ ID NO: 3565680 - RNA, 14 nt, Human
agccggcacagggu

SEQ ID NO: 3565681 - RNA, 16 nt, Human
agccggcacagggucu

SEQ ID NO: 3565682 - RNA, 18 nt, Human
agccggccucucuggccu

SEQ ID NO: 3565683 - RNA, 14 nt, Human
agccgggagccuga

SEQ ID NO: 3565684 - RNA, 22 nt, Human
agccgggcgugguggcaggcac

SEQ ID NO: 3565685 - RNA, 15 nt, Human
agccggggccugccu

SEQ ID NO: 3565686 - RNA, 19 nt, Human
agccggggccugccuagca

SEQ ID NO: 3565687 - RNA, 13 nt, Human
agccggggccuua

SEQ ID NO: 3565688 - RNA, 16 nt, Human
agccgggguggggugg

SEQ ID NO: 3565689 - RNA, 23 nt, Human
agccggggugggguggcugcagc

SEQ ID NO: 3565690 - RNA, 22 nt, Human
agccgggucugccucuucuggg

SEQ ID NO: 3565691 - RNA, 18 nt, Human
agccgguaacuguccugu

SEQ ID NO: 3565692 - RNA, 20 nt, Human
agccgguaacuguccugucc

SEQ ID NO: 3565693 - RNA, 21 nt, Human
agccgguaacuguccuguccu

SEQ ID NO: 3565694 - RNA, 21 nt, Human
agccgguuccugucccugcgc

SEQ ID NO: 3565695 - RNA, 16 nt, Human
agccgucagccaaaug

SEQ ID NO: 3565696 - RNA, 12 nt, Human
agccguccuggc

SEQ ID NO: 3565697 - RNA, 17 nt, Human
agccgugaacugugcau

SEQ ID NO: 3565698 - RNA, 22 nt, Human
agccguggcuucccgcucagcc

SEQ ID NO: 3565699 - RNA, 16 nt, Human
agccuaaaaauaaagc

SEQ ID NO: 3565700 - RNA, 18 nt, Human
agccuaagaugaagagga

SEQ ID NO: 3565701 - RNA, 18 nt, Human
agccuaaggcuccuguuu

SEQ ID NO: 3565702 - RNA, 19 nt, Human
agccuaaggcuccuguuuu

SEQ ID NO: 3565703 - RNA, 15 nt, Human
agccuaauacaacau

SEQ ID NO: 3565704 - RNA, 12 nt, Human
agccuaaucaca

SEQ ID NO: 3565705 - RNA, 16 nt, Human
agccuacagaugaacu

SEQ ID NO: 3565706 - RNA, 13 nt, Human
agccuacaggccu

SEQ ID NO: 3565707 - RNA, 21 nt, Human
agccuacuagggaccugggga

SEQ ID NO: 3565708 - RNA, 17 nt, Human
agccuagaagagcuucu

SEQ ID NO: 3565709 - RNA, 19 nt, Human
agccuagaagagcuucuga

SEQ ID NO: 3565710 - RNA, 18 nt, Human
agccuagaagcugguggc

SEQ ID NO: 3565711 - RNA, 19 nt, Human
agccuagccgaccucagcc

SEQ ID NO: 3565712 - RNA, 18 nt, Human
agccuaggaccacucagc

SEQ ID NO: 3565713 - RNA, 19 nt, Human
agccuaggaccacucagcc

SEQ ID NO: 3565714 - RNA, 21 nt, Human
agccuaggaccacucagcccc

SEQ ID NO: 3565715 - RNA, 22 nt, Human
agccuaggaccacucagccccu

SEQ ID NO: 3565716 - RNA, 17 nt, Human
agccuaggugacagagu

SEQ ID NO: 3565717 - RNA, 14 nt, Human
agccuagugaaggc

SEQ ID NO: 3565718 - RNA, 14 nt, Human
agccuaguucaucc

SEQ ID NO: 3565719 - RNA, 15 nt, Human
agccuaguucaucca

SEQ ID NO: 3565720 - RNA, 17 nt, Human
agccuaguucauccaau

SEQ ID NO: 3565721 - RNA, 20 nt, Human
agccuaguucauccaauccu

SEQ ID NO: 3565722 - RNA, 19 nt, Human
agccuaguuuuuaauagcu

SEQ ID NO: 3565723 - RNA, 17 nt, Human
agccuaucaaagaccuu

SEQ ID NO: 3565724 - RNA, 11 nt, Human
agccuauggca

SEQ ID NO: 3565725 - RNA, 18 nt, Human
agccucaaaacaaaggcc

SEQ ID NO: 3565726 - RNA, 20 nt, Human
agccucaaauccaggacccu

SEQ ID NO: 3565727 - RNA, 22 nt, Human
agccucaaauccaggacccugc

SEQ ID NO: 3565728 - RNA, 18 nt, Human
agccucaaccuccugggc

SEQ ID NO: 3565729 - RNA, 19 nt, Human
agccucaaccuccugggcu

SEQ ID NO: 3565730 - RNA, 22 nt, Human
agccucaagguuuuagguucua

SEQ ID NO: 3565731 - RNA, 23 nt, Human
agccucaagguuuuagguucuaa

SEQ ID NO: 3565732 - RNA, 18 nt, Human
agccucacagcagugaga

SEQ ID NO: 3565733 - RNA, 17 nt, Human
agccucacugauauauu

SEQ ID NO: 3565734 - RNA, 23 nt, Human
agccucacuggggcagacaauaa

SEQ ID NO: 3565735 - RNA, 22 nt, Human
agccucacuuggucugccaggc

SEQ ID NO: 3565736 - RNA, 22 nt, Human
agccucacuuuuaaugaacaaa

SEQ ID NO: 3565737 - RNA, 14 nt, Human
agccucagacugga

SEQ ID NO: 3565738 - RNA, 23 nt, Human
agccucagagacaucagcccuug

SEQ ID NO: 3565739 - RNA, 18 nt, Human
agccucagauuccuuccc

SEQ ID NO: 3565740 - RNA, 23 nt, Human
agccucagauuccuucccaugga

SEQ ID NO: 3565741 - RNA, 15 nt, Human
agccucagcauccug

SEQ ID NO: 3565742 - RNA, 22 nt, Human
agccucagcccccugcuucagu

SEQ ID NO: 3565743 - RNA, 22 nt, Human
agccucagcgcggcccucccga

SEQ ID NO: 3565744 - RNA, 19 nt, Human
agccucaggacugggagcc

SEQ ID NO: 3565745 - RNA, 23 nt, Human
agccucaggacugggagccccca

SEQ ID NO: 3565746 - RNA, 19 nt, Human
agccucaguccuccccuca

SEQ ID NO: 3565747 - RNA, 20 nt, Human
agccucaguccuccccucac

SEQ ID NO: 3565748 - RNA, 16 nt, Human
agccucagucucccuc

SEQ ID NO: 3565749 - RNA, 19 nt, Human
agccucagucucccucccu

SEQ ID NO: 3565750 - RNA, 20 nt, Human
agccucagucucccucccuu

SEQ ID NO: 3565751 - RNA, 21 nt, Human
agccucagugacccuggcucc

SEQ ID NO: 3565752 - RNA, 15 nt, Human
agccucauauuuaaa

SEQ ID NO: 3565753 - RNA, 18 nt, Human
agccucauccgaggcagg

SEQ ID NO: 3565754 - RNA, 15 nt, Human
agccucauguccacu

SEQ ID NO: 3565755 - RNA, 14 nt, Human
agccuccaauuuuu

SEQ ID NO: 3565756 - RNA, 12 nt, Human
agccuccacagc

SEQ ID NO: 3565757 - RNA, 22 nt, Human
agccuccacagcgagggcagcu

SEQ ID NO: 3565758 - RNA, 14 nt, Human
agccuccagccucu

SEQ ID NO: 3565759 - RNA, 17 nt, Human
agccuccauuuaguucu

SEQ ID NO: 3565760 - RNA, 16 nt, Human
agccucccaaagugcu

SEQ ID NO: 3565761 - RNA, 18 nt, Human
agccucccaaagugcugg

SEQ ID NO: 3565762 - RNA, 20 nt, Human
agccucccaaagugcuggga

SEQ ID NO: 3565763 - RNA, 19 nt, Human
agccucccaaggagaacaa

SEQ ID NO: 3565764 - RNA, 14 nt, Human
agccucccacagug

SEQ ID NO: 3565765 - RNA, 18 nt, Human
agccucccgaauagcugg

SEQ ID NO: 3565766 - RNA, 18 nt, Human
agccucccgaguagcugg

SEQ ID NO: 3565767 - RNA, 13 nt, Human
agccucccucuga

SEQ ID NO: 3565768 - RNA, 14 nt, Human
agccucccucugac

SEQ ID NO: 3565769 - RNA, 15 nt, Human
agccucccucugacc

SEQ ID NO: 3565770 - RNA, 16 nt, Human
agccuccgagagggag

SEQ ID NO: 3565771 - RNA, 13 nt, Human
agccuccggaagc

SEQ ID NO: 3565772 - RNA, 14 nt, Human
agccuccuccagcc

SEQ ID NO: 3565773 - RNA, 12 nt, Human
agccuccucugg

SEQ ID NO: 3565774 - RNA, 13 nt, Human
agccuccucugga

SEQ ID NO: 3565775 - RNA, 14 nt, Human
agccuccucuggac

SEQ ID NO: 3565776 - RNA, 20 nt, Human
agccuccucugucugcccuu

SEQ ID NO: 3565777 - RNA, 19 nt, Human
agccuccugaccugaggcu

SEQ ID NO: 3565778 - RNA, 20 nt, Human
agccuccugaguagcuggga

SEQ ID NO: 3565779 - RNA, 14 nt, Human
agccuccugcccag

SEQ ID NO: 3565780 - RNA, 15 nt, Human
agccuccugcccagu

SEQ ID NO: 3565781 - RNA, 14 nt, Human
agccuccugcccuu

SEQ ID NO: 3565782 - RNA, 17 nt, Human
agccuccugcugccaca

SEQ ID NO: 3565783 - RNA, 15 nt, Human
agccucgaacuccug

SEQ ID NO: 3565784 - RNA, 19 nt, Human
agccucgaacuccugggcu

SEQ ID NO: 3565785 - RNA, 21 nt, Human
agccucgaacuccugggcuca

SEQ ID NO: 3565786 - RNA, 22 nt, Human
agccucgaggugccuucuucag

SEQ ID NO: 3565787 - RNA, 23 nt, Human
agccucgcaacccgugccaaguc

SEQ ID NO: 3565788 - RNA, 15 nt, Human
agccucgccccuggc

SEQ ID NO: 3565789 - RNA, 13 nt, Human
agccucgcucugu

SEQ ID NO: 3565790 - RNA, 16 nt, Human
agccucgucuucauua

SEQ ID NO: 3565791 - RNA, 16 nt, Human
agccucguuggaagag

SEQ ID NO: 3565792 - RNA, 20 nt, Human
agccucuagggaccccuccu

SEQ ID NO: 3565793 - RNA, 22 nt, Human
agccucuauccuacaaggccua

SEQ ID NO: 3565794 - RNA, 16 nt, Human
agccucuccacucaug

SEQ ID NO: 3565795 - RNA, 23 nt, Human
agccucuccaggcaccaucuccc

SEQ ID NO: 3565796 - RNA, 16 nt, Human
agccucuccccagguc

SEQ ID NO: 3565797 - RNA, 20 nt, Human
agccucuccccugccugccc

SEQ ID NO: 3565798 - RNA, 15 nt, Human
agccucucucccagu

SEQ ID NO: 3565799 - RNA, 21 nt, Human
agccucucuuccuaucccauc

SEQ ID NO: 3565800 - RNA, 16 nt, Human
caccguuaucgguguc

SEQ ID NO: 3565801 - RNA, 15 nt, Human
caccguucugugcac

SEQ ID NO: 3565802 - RNA, 17 nt, Human
caccuaaagaaaaacaa

SEQ ID NO: 3565803 - RNA, 14 nt, Human
caccuaaagcagcc

SEQ ID NO: 3565804 - RNA, 23 nt, Human
caccuaaauaaccaaucuacaau

SEQ ID NO: 3565805 - RNA, 19 nt, Human
caccuaaucaggcugaggu

SEQ ID NO: 3565806 - RNA, 22 nt, Human
caccuaauccaggcagauccag

SEQ ID NO: 3565807 - RNA, 15 nt, Human
caccuaauuaauuuc

SEQ ID NO: 3565808 - RNA, 21 nt, Human
caccuaauucgaugaaggcug

SEQ ID NO: 3565809 - RNA, 17 nt, Human
caccuacaauacaucug

SEQ ID NO: 3565810 - RNA, 16 nt, Human
caccuacaguguacag

SEQ ID NO: 3565811 - RNA, 20 nt, Human
caccuacaguguacagucuu

SEQ ID NO: 3565812 - RNA, 18 nt, Human
caccuaccacucacauga

SEQ ID NO: 3565813 - RNA, 22 nt, Human
caccuaccaucagggacaggau

SEQ ID NO: 3565814 - RNA, 19 nt, Human
caccuaccuucaaagcuga

SEQ ID NO: 3565815 - RNA, 22 nt, Human
caccuacuuuucuuuccucaga

SEQ ID NO: 3565816 - RNA, 14 nt, Human
caccuagagccaga

SEQ ID NO: 3565817 - RNA, 16 nt, Human
caccuagagccagacc

SEQ ID NO: 3565818 - RNA, 12 nt, Human
caccuagccagc

SEQ ID NO: 3565819 - RNA, 15 nt, Human
caccuagccagcugu

SEQ ID NO: 3565820 - RNA, 19 nt, Human
caccuagcugaauguuuuu

SEQ ID NO: 3565821 - RNA, 16 nt, Human
caccuagcuuuauucu

SEQ ID NO: 3565822 - RNA, 24 nt, Human
caccuaggaagccucagauuccuu

SEQ ID NO: 3565823 - RNA, 16 nt, Human
caccuaggccacuccu

SEQ ID NO: 3565824 - RNA, 17 nt, Human
caccuaggcuagggugg

SEQ ID NO: 3565825 - RNA, 19 nt, Human
caccuaguggcuguccagu

SEQ ID NO: 3565826 - RNA, 21 nt, Human
caccuaguggcuguccagugc

SEQ ID NO: 3565827 - RNA, 20 nt, Human
caccuaucucgugggagagc

SEQ ID NO: 3565828 - RNA, 20 nt, Human
caccuaugucauuucauuuc

SEQ ID NO: 3565829 - RNA, 23 nt, Human
caccuaugucauuucauuuccua

SEQ ID NO: 3565830 - RNA, 21 nt, Human
caccuaugugccaacuguugu

SEQ ID NO: 3565831 - RNA, 17 nt, Human
caccuauuaucccagcu

SEQ ID NO: 3565832 - RNA, 19 nt, Human
caccuauuaucccagcugc

SEQ ID NO: 3565833 - RNA, 21 nt, Human
caccuauuaucccagcugccu

SEQ ID NO: 3565834 - RNA, 14 nt, Human
caccuauuucaaaa

SEQ ID NO: 3565835 - RNA, 13 nt, Human
caccuauuuccau

SEQ ID NO: 3565836 - RNA, 12 nt, Human
caccuauuuuag

SEQ ID NO: 3565837 - RNA, 14 nt, Human
caccucacacuccu

SEQ ID NO: 3565838 - RNA, 14 nt, Human
caccucaccccacu

SEQ ID NO: 3565839 - RNA, 18 nt, Human
caccucaccccguuacag

SEQ ID NO: 3565840 - RNA, 13 nt, Human
caccucacucagc

SEQ ID NO: 3565841 - RNA, 15 nt, Human
caccucacucagcac

SEQ ID NO: 3565842 - RNA, 19 nt, Human
caccucacucagcaccacu

SEQ ID NO: 3565843 - RNA, 20 nt, Human
caccucagagacauacaccu

SEQ ID NO: 3565844 - RNA, 15 nt, Human
caccucagagccccg

SEQ ID NO: 3565845 - RNA, 19 nt, Human
caccucagaggcuguucuu

SEQ ID NO: 3565846 - RNA, 19 nt, Human
caccucagaguauggagcu

SEQ ID NO: 3565847 - RNA, 22 nt, Human
caccucagaguauggagcucag

SEQ ID NO: 3565848 - RNA, 18 nt, Human
caccucagauggcagcuu

SEQ ID NO: 3565849 - RNA, 21 nt, Human
caccucagauggcagcuuuua

SEQ ID NO: 3565850 - RNA, 13 nt, Human
caccucagccucc

SEQ ID NO: 3565851 - RNA, 17 nt, Human
caccucagccugcacag

SEQ ID NO: 3565852 - RNA, 11 nt, Human
caccucaguuc

SEQ ID NO: 3565853 - RNA, 23 nt, Human
caccucaguucccuuggccucag

SEQ ID NO: 3565854 - RNA, 17 nt, Human
caccucaugcccacccc

SEQ ID NO: 3565855 - RNA, 20 nt, Human
caccucaugcccacccccug

SEQ ID NO: 3565856 - RNA, 22 nt, Human
caccucaugcccacccccugcc

SEQ ID NO: 3565857 - RNA, 13 nt, Human
caccuccacaguu

SEQ ID NO: 3565858 - RNA, 17 nt, Human
caccuccacauccucca

SEQ ID NO: 3565859 - RNA, 17 nt, Human
caccuccagcccgggag

SEQ ID NO: 3565860 - RNA, 20 nt, Human
caccuccagcccgggagccu

SEQ ID NO: 3565861 - RNA, 22 nt, Human
caccuccagcccgggagccuag

SEQ ID NO: 3565862 - RNA, 15 nt, Human
caccuccaggccugu

SEQ ID NO: 3565863 - RNA, 13 nt, Human
caccuccaguccc

SEQ ID NO: 3565864 - RNA, 21 nt, Human
caccuccauuaaagucugaau

SEQ ID NO: 3565865 - RNA, 15 nt, Human
caccucccagccccu

SEQ ID NO: 3565866 - RNA, 16 nt, Human
caccucccagccccug

SEQ ID NO: 3565867 - RNA, 12 nt, Human
caccucccagga

SEQ ID NO: 3565868 - RNA, 14 nt, Human
caccuccccacgcc

SEQ ID NO: 3565869 - RNA, 21 nt, Human
caccuccccacgcccuccccu

SEQ ID NO: 3565870 - RNA, 14 nt, Human
caccuccccagcau

SEQ ID NO: 3565871 - RNA, 15 nt, Human
caccuccccaggccg

SEQ ID NO: 3565872 - RNA, 21 nt, Human
caccucccccaucucuucugg

SEQ ID NO: 3565873 - RNA, 23 nt, Human
caccuccccccacaagugcccuc

SEQ ID NO: 3565874 - RNA, 16 nt, Human
caccuccccccacugc

SEQ ID NO: 3565875 - RNA, 18 nt, Human
caccuccccccacugcag

SEQ ID NO: 3565876 - RNA, 21 nt, Human
caccuccccccacugcaggcc

SEQ ID NO: 3565877 - RNA, 23 nt, Human
caccuccccccacugcaggcccc

SEQ ID NO: 3565878 - RNA, 14 nt, Human
caccuccccuaucc

SEQ ID NO: 3565879 - RNA, 18 nt, Human
caccuccccuauccaccc

SEQ ID NO: 3565880 - RNA, 15 nt, Human
caccuccccuccuug

SEQ ID NO: 3565881 - RNA, 17 nt, Human
caccuccccuugccagc

SEQ ID NO: 3565882 - RNA, 14 nt, Human
caccuccccuuggg

SEQ ID NO: 3565883 - RNA, 20 nt, Human
caccucccuauacugcuugg

SEQ ID NO: 3565884 - RNA, 10 nt, Human
caccucccuc

SEQ ID NO: 3565885 - RNA, 19 nt, Human
caccucccucaaccucauc

SEQ ID NO: 3565886 - RNA, 21 nt, Human
caccucccucaaccucauccu

SEQ ID NO: 3565887 - RNA, 12 nt, Human
caccucccuccc

SEQ ID NO: 3565888 - RNA, 14 nt, Human
caccucccugaccc

SEQ ID NO: 3565889 - RNA, 23 nt, Human
caccucccugcccaggccggcca

SEQ ID NO: 3565890 - RNA, 13 nt, Human
caccucccugccu

SEQ ID NO: 3565891 - RNA, 14 nt, Human
caccucccugccuc

SEQ ID NO: 3565892 - RNA, 17 nt, Human
caccuccuaaaaggccc

SEQ ID NO: 3565893 - RNA, 19 nt, Human
caccuccuaaaaggcccag

SEQ ID NO: 3565894 - RNA, 20 nt, Human
caccuccuaaaaggcccaga

SEQ ID NO: 3565895 - RNA, 15 nt, Human
caccuccugccucag

SEQ ID NO: 3565896 - RNA, 14 nt, Human
caccuccuucaauu

SEQ ID NO: 3565897 - RNA, 12 nt, Human
caccuccuucuc

SEQ ID NO: 3565898 - RNA, 19 nt, Human
caccucgcagguucaagca

SEQ ID NO: 3565899 - RNA, 17 nt, Human
caccucuaacagcacca

SEQ ID NO: 3565900 - RNA, 20 nt, Human
caccucuaacagcaccaaau

SEQ ID NO: 3565901 - RNA, 21 nt, Human
caccucuacccaaacccuagg

SEQ ID NO: 3565902 - RNA, 22 nt, Human
caccucuagguccccauacucc

SEQ ID NO: 3565903 - RNA, 21 nt, Human
caccucucaauauucaauaaa

SEQ ID NO: 3565904 - RNA, 11 nt, Human
caccucuccaa

SEQ ID NO: 3565905 - RNA, 12 nt, Human
caccucuccaag

SEQ ID NO: 3565906 - RNA, 16 nt, Human
caccucuccaagggcu

SEQ ID NO: 3565907 - RNA, 18 nt, Human
caccucuccaagggcuuc

SEQ ID NO: 3565908 - RNA, 13 nt, Human
caccucucccuca

SEQ ID NO: 3565909 - RNA, 19 nt, Human
caccucucccugacccugu

SEQ ID NO: 3565910 - RNA, 17 nt, Human
caccucucccuuggauu

SEQ ID NO: 3565911 - RNA, 15 nt, Human
caccucucucacucc

SEQ ID NO: 3565912 - RNA, 18 nt, Human
caccucugcggaccccag

SEQ ID NO: 3565913 - RNA, 18 nt, Human
caccucuggacuggcuag

SEQ ID NO: 3565914 - RNA, 18 nt, Human
caccucuuaugcacaccu

SEQ ID NO: 3565915 - RNA, 14 nt, Human
caccucuucacccc

SEQ ID NO: 3565916 - RNA, 13 nt, Human
caccucuuccgac

SEQ ID NO: 3565917 - RNA, 17 nt, Human
caccucuuccuggccgg

SEQ ID NO: 3565918 - RNA, 13 nt, Human
caccugaacugaa

SEQ ID NO: 3565919 - RNA, 15 nt, Human
caccugaagacucau

SEQ ID NO: 3565920 - RNA, 17 nt, Human
caccugacacaccaggc

SEQ ID NO: 3565921 - RNA, 11 nt, Human
caccugacagc

SEQ ID NO: 3565922 - RNA, 18 nt, Human
caccugacagccccuccc

SEQ ID NO: 3565923 - RNA, 19 nt, Human
caccugacagccccucccu

SEQ ID NO: 3565924 - RNA, 20 nt, Human
caccugacucugaaaucuga

SEQ ID NO: 3565925 - RNA, 16 nt, Human
caccugagcuuuggac

SEQ ID NO: 3565926 - RNA, 19 nt, Human
caccugaggugggcccagg

SEQ ID NO: 3565927 - RNA, 15 nt, Human
caccugaguuccuga

SEQ ID NO: 3565928 - RNA, 18 nt, Human
caccugauucaacuaaaa

SEQ ID NO: 3565929 - RNA, 15 nt, Human
caccugcaccucccc

SEQ ID NO: 3565930 - RNA, 19 nt, Human
caccugcaccuccccccac

SEQ ID NO: 3565931 - RNA, 22 nt, Human
caccugcaccuccccccacugc

SEQ ID NO: 3565932 - RNA, 11 nt, Human
caccugcagcu

SEQ ID NO: 3565933 - RNA, 16 nt, Human
caccugcagcucccuc

SEQ ID NO: 3565934 - RNA, 17 nt, Human
caccugcaucuggggcc

SEQ ID NO: 3565935 - RNA, 15 nt, Human
caccugccacccugg

SEQ ID NO: 3565936 - RNA, 23 nt, Human
caccugccacuaggcugggugcc

SEQ ID NO: 3565937 - RNA, 14 nt, Human
caccugccagccug

SEQ ID NO: 3565938 - RNA, 20 nt, Human
caccugccagccuggcuucu

SEQ ID NO: 3565939 - RNA, 22 nt, Human
caccugccagccuggcuucugg

SEQ ID NO: 3565940 - RNA, 17 nt, Human
caccugccagggacaga

SEQ ID NO: 3565941 - RNA, 18 nt, Human
caccugcccaucacaggg

SEQ ID NO: 3565942 - RNA, 15 nt, Human
caccugccccaacuc

SEQ ID NO: 3565943 - RNA, 21 nt, Human
caccugcccccugguggacag

SEQ ID NO: 3565944 - RNA, 20 nt, Human
caccugcccccuucucccac

SEQ ID NO: 3565945 - RNA, 15 nt, Human
cacgcccccacuggu

SEQ ID NO: 3565946 - RNA, 16 nt, Human
cacgcccguccugccu

SEQ ID NO: 3565947 - RNA, 20 nt, Human
cacgcccguccugccugugg

SEQ ID NO: 3565948 - RNA, 24 nt, Human
cacgcccuccccuccccugcugca

SEQ ID NO: 3565949 - RNA, 18 nt, Human
cacgccuaugaucccagc

SEQ ID NO: 3565950 - RNA, 22 nt, Human
cacgccuaugaucccagcacuu

SEQ ID NO: 3565951 - RNA, 23 nt, Human
cacgccugcaaacgcugccugcc

SEQ ID NO: 3565952 - RNA, 16 nt, Human
cacgccuguaauccca

SEQ ID NO: 3565953 - RNA, 21 nt, Human
cacgccuguaaucccagcagu

SEQ ID NO: 3565954 - RNA, 16 nt, Human
cacgccuuccccucag

SEQ ID NO: 3565955 - RNA, 19 nt, Human
cacgcgccccccucccaga

SEQ ID NO: 3565956 - RNA, 20 nt, Human
cacgcgccccccucccagag

SEQ ID NO: 3565957 - RNA, 22 nt, Human
cacgcgcgcacacacacacaua

SEQ ID NO: 3565958 - RNA, 17 nt, Human
cacgcgcgcgcacacac

SEQ ID NO: 3565959 - RNA, 16 nt, Human
cacgcgugcacacacc

SEQ ID NO: 3565960 - RNA, 21 nt, Human
cacgcgugcacacaccagagc

SEQ ID NO: 3565961 - RNA, 22 nt, Human
cacgcuaaucccgauucacccu

SEQ ID NO: 3565962 - RNA, 16 nt, Human
cacgcuagggcuggcu

SEQ ID NO: 3565963 - RNA, 15 nt, Human
cacgcuccccgccug

SEQ ID NO: 3565964 - RNA, 18 nt, Human
cacgcuccccgccuguuc

SEQ ID NO: 3565965 - RNA, 14 nt, Human
cacgcuccuuccuc

SEQ ID NO: 3565966 - RNA, 17 nt, Human
cacgcugcucugcccca

SEQ ID NO: 3565967 - RNA, 21 nt, Human
cacgcugcucugccccagcuu

SEQ ID NO: 3565968 - RNA, 15 nt, Human
cacgcuggagugcag

SEQ ID NO: 3565969 - RNA, 16 nt, Human
cacgcuggagugcagu

SEQ ID NO: 3565970 - RNA, 19 nt, Human
cacgcuggggaagaauuua

SEQ ID NO: 3565971 - RNA, 14 nt, Human
cacgcugucuccag

SEQ ID NO: 3565972 - RNA, 16 nt, Human
cacgcugucuccagac

SEQ ID NO: 3565973 - RNA, 17 nt, Human
cacgcugucuccagacc

SEQ ID NO: 3565974 - RNA, 18 nt, Human
cacgcugugggcaggugg

SEQ ID NO: 3565975 - RNA, 22 nt, Human
cacgcugugggcaggugggagc

SEQ ID NO: 3565976 - RNA, 20 nt, Human
cacgcuucuucuuuugagca

SEQ ID NO: 3565977 - RNA, 22 nt, Human
cacgcuugacaggacagcaugg

SEQ ID NO: 3565978 - RNA, 13 nt, Human
cacgcuuuuguga

SEQ ID NO: 3565979 - RNA, 15 nt, Human
cacggacaauaaacc

SEQ ID NO: 3565980 - RNA, 21 nt, Human
cacggaccaaagggagucugc

SEQ ID NO: 3565981 - RNA, 17 nt, Human
cacggacguuuccauca

SEQ ID NO: 3565982 - RNA, 21 nt, Human
cacggagccacuccucugacu

SEQ ID NO: 3565983 - RNA, 19 nt, Human
cacggaggaugaugccagu

SEQ ID NO: 3565984 - RNA, 23 nt, Human
cacggaggcauccuacccuuuuc

SEQ ID NO: 3565985 - RNA, 19 nt, Human
cacggaucacgauguaaau

SEQ ID NO: 3565986 - RNA, 21 nt, Human
cacggcaccugggcccugggg

SEQ ID NO: 3565987 - RNA, 22 nt, Human
cacggcaccugggcccuggggc

SEQ ID NO: 3565988 - RNA, 20 nt, Human
cacggcagccacagcuuggg

SEQ ID NO: 3565989 - RNA, 20 nt, Human
cacggcaggacaacgaggaa

SEQ ID NO: 3565990 - RNA, 16 nt, Human
cacggccacacagcug

SEQ ID NO: 3565991 - RNA, 18 nt, Human
cacggccacacagcugcc

SEQ ID NO: 3565992 - RNA, 19 nt, Human
cacggccacacagcugccg

SEQ ID NO: 3565993 - RNA, 13 nt, Human
cacggccaggcca

SEQ ID NO: 3565994 - RNA, 16 nt, Human
cacggccaggccagag

SEQ ID NO: 3565995 - RNA, 21 nt, Human
cacggccccgaagggccccca

SEQ ID NO: 3565996 - RNA, 21 nt, Human
cacggcucuguccccagccug

SEQ ID NO: 3565997 - RNA, 16 nt, Human
cacggcugcgcacugu

SEQ ID NO: 3565998 - RNA, 12 nt, Human
cacgggcagccu

SEQ ID NO: 3565999 - RNA, 24 nt, Human
cacgggccuguccacaggcuucug

SEQ ID NO: 3566000 - RNA, 22 nt, Human
cacggguggggaaaggaggugg

SEQ ID NO: 3566001 - RNA, 15 nt, Human
cacgggugguccccg

SEQ ID NO: 3566002 - RNA, 14 nt, Human
cacgguagugccug

SEQ ID NO: 3566003 - RNA, 17 nt, Human
cacgguauuuauagaga

SEQ ID NO: 3566004 - RNA, 21 nt, Human
cacggucgccaccuggcauuc

SEQ ID NO: 3566005 - RNA, 20 nt, Human
cacggugaauggcuuuguau

SEQ ID NO: 3566006 - RNA, 16 nt, Human
cacgguggcucacgcc

SEQ ID NO: 3566007 - RNA, 14 nt, Human
cacggugggccuug

SEQ ID NO: 3566008 - RNA, 21 nt, Human
cacgguuucgaagucauuaaa

SEQ ID NO: 3566009 - RNA, 23 nt, Human
cacgguuucgaagucauuaaacu

SEQ ID NO: 3566010 - RNA, 23 nt, Human
cacguagcccccaggcugcugga

SEQ ID NO: 3566011 - RNA, 15 nt, Human
cacguauuccccuuc

SEQ ID NO: 3566012 - RNA, 20 nt, Human
cacgucaaaugcauacaagu

SEQ ID NO: 3566013 - RNA, 14 nt, Human
cacgucaugggagg

SEQ ID NO: 3566014 - RNA, 17 nt, Human
cacgucauguuucuuca

SEQ ID NO: 3566015 - RNA, 16 nt, Human
cacguccagaauuuuu

SEQ ID NO: 3566016 - RNA, 16 nt, Human
cacgucccccuggggc

SEQ ID NO: 3566017 - RNA, 17 nt, Human
cacgucccccuggggcu

SEQ ID NO: 3566018 - RNA, 18 nt, Human
cacgucuguaaucccagc

SEQ ID NO: 3566019 - RNA, 14 nt, Human
cacgucugucuuca

SEQ ID NO: 3566020 - RNA, 18 nt, Human
cacgucuuccuucugccu

SEQ ID NO: 3566021 - RNA, 17 nt, Human
cacgugacacaaacaca

SEQ ID NO: 3566022 - RNA, 21 nt, Human
cacgugagaaucccuggcaaa

SEQ ID NO: 3566023 - RNA, 21 nt, Human
cacgugcgcugggcacuuccc

SEQ ID NO: 3566024 - RNA, 19 nt, Human
cacgugcuacccccaugcu

SEQ ID NO: 3566025 - RNA, 20 nt, Human
cacguggaggaaugcucccc

SEQ ID NO: 3566026 - RNA, 18 nt, Human
cacguggaggagcagugc

SEQ ID NO: 3566027 - RNA, 20 nt, Human
cacguggaggagcagugcag

SEQ ID NO: 3566028 - RNA, 21 nt, Human
cacguggaggagcagugcagg

SEQ ID NO: 3566029 - RNA, 19 nt, Human
cacguggcauguggccugu

SEQ ID NO: 3566030 - RNA, 12 nt, Human
cacguggccucu

SEQ ID NO: 3566031 - RNA, 20 nt, Human
cacguggccucuugagcagu

SEQ ID NO: 3566032 - RNA, 23 nt, Human
cacguggccucuugagcaguggc

SEQ ID NO: 3566033 - RNA, 21 nt, Human
cacguggcuucugaugaaucu

SEQ ID NO: 3566034 - RNA, 16 nt, Human
cacgugggcucauaug

SEQ ID NO: 3566035 - RNA, 17 nt, Human
cacgugggcuccccucu

SEQ ID NO: 3566036 - RNA, 18 nt, Human
cacgugggcuccccucuu

SEQ ID NO: 3566037 - RNA, 21 nt, Human
cacgugggcuccccucuuccu

SEQ ID NO: 3566038 - RNA, 16 nt, Human
cacgugguccuaaucu

SEQ ID NO: 3566039 - RNA, 13 nt, Human
cacguguacuggc

SEQ ID NO: 3566040 - RNA, 17 nt, Human
cacguguacuggcuccu

SEQ ID NO: 3566041 - RNA, 18 nt, Human
cacguguacuggcuccuc

SEQ ID NO: 3566042 - RNA, 15 nt, Human
cacguguccuguagu

SEQ ID NO: 3566043 - RNA, 16 nt, Human
cacguguccuguaguu

SEQ ID NO: 3566044 - RNA, 19 nt, Human
cacguguggccuguucuuc

SEQ ID NO: 3566045 - RNA, 18 nt, Human
cacguguguuuuucuauu

SEQ ID NO: 3566046 - RNA, 19 nt, Human
cacguuagaggaaaaauau

SEQ ID NO: 3566047 - RNA, 13 nt, Human
cacguuauggugu

SEQ ID NO: 3566048 - RNA, 13 nt, Human
cacguucaccccu

SEQ ID NO: 3566049 - RNA, 15 nt, Human
cacguucucucugcc

SEQ ID NO: 3566050 - RNA, 13 nt, Human
cacguucuuuccc

SEQ ID NO: 3566051 - RNA, 17 nt, Human
cacguuggggugauuua

SEQ ID NO: 3566052 - RNA, 20 nt, Human
cacguuggggugauuuaauc

SEQ ID NO: 3566053 - RNA, 22 nt, Human
cacguuuuaaggacugacugag

SEQ ID NO: 3566054 - RNA, 14 nt, Human
cacuaaaauuuuag

SEQ ID NO: 3566055 - RNA, 13 nt, Human
cacuaaacaaaga

SEQ ID NO: 3566056 - RNA, 17 nt, Human
cacuaaacagacuauuu

SEQ ID NO: 3566057 - RNA, 22 nt, Human
cacuaaacuuuacccaaaaacu

SEQ ID NO: 3566058 - RNA, 16 nt, Human
cacuaaagcaugaaau

SEQ ID NO: 3566059 - RNA, 16 nt, Human
cacuaaagccagccug

SEQ ID NO: 3566060 - RNA, 15 nt, Human
cacuaaaucagagac

SEQ ID NO: 3566061 - RNA, 19 nt, Human
cacuaaauguuaaagaugu

SEQ ID NO: 3566062 - RNA, 23 nt, Human
cacuaaccaagcugaguuuccua

SEQ ID NO: 3566063 - RNA, 15 nt, Human
cacuaaccacgcugg

SEQ ID NO: 3566064 - RNA, 18 nt, Human
cacuaaccacgcuggacc

SEQ ID NO: 3566065 - RNA, 20 nt, Human
cacuaacuagagcagcccug

SEQ ID NO: 3566066 - RNA, 15 nt, Human
cacuaacucaccagc

SEQ ID NO: 3566067 - RNA, 19 nt, Human
cacuaacucaccagcccca

SEQ ID NO: 3566068 - RNA, 17 nt, Human
cacuaagcagaggaggg

SEQ ID NO: 3566069 - RNA, 20 nt, Human
cacuaagcagaggaggggcc

SEQ ID NO: 3566070 - RNA, 13 nt, Human
cacuaaggggccc

SEQ ID NO: 3566071 - RNA, 22 nt, Human
cacuaagucucuuuuuuacaaa

SEQ ID NO: 3566072 - RNA, 14 nt, Human
cacuaaguuauagu

SEQ ID NO: 3566073 - RNA, 17 nt, Human
cacuaaguuauaguaua

SEQ ID NO: 3566074 - RNA, 15 nt, Human
cacuaauacaccagg

SEQ ID NO: 3566075 - RNA, 11 nt, Human
cacuaauucau

SEQ ID NO: 3566076 - RNA, 22 nt, Human
cacuaauucauuaaucugccuc

SEQ ID NO: 3566077 - RNA, 23 nt, Human
cacuaauugguacuuuuaaaaac

SEQ ID NO: 3566078 - RNA, 15 nt, Human
cacuaauuuuuguau

SEQ ID NO: 3566079 - RNA, 12 nt, Human
cacuacacccag

SEQ ID NO: 3566080 - RNA, 16 nt, Human
cacuacacccagcaau

SEQ ID NO: 3566081 - RNA, 21 nt, Human
cacuacacccagcaauagaga

SEQ ID NO: 3566082 - RNA, 16 nt, Human
cacuacaccuugccuu

SEQ ID NO: 3566083 - RNA, 18 nt, Human
cacuacacuccagccuga

SEQ ID NO: 3566084 - RNA, 18 nt, Human
cacuacaguauuacucuu

SEQ ID NO: 3566085 - RNA, 19 nt, Human
cacuacaugugguuuauag

SEQ ID NO: 3566086 - RNA, 13 nt, Human
cacuacauucugu

SEQ ID NO: 3566087 - RNA, 17 nt, Human
cacuacauucuguuaau

SEQ ID NO: 3566088 - RNA, 14 nt, Human
cacugaugggcaac

SEQ ID NO: 3566089 - RNA, 18 nt, Human
cacugaugggcaaccccc

SEQ ID NO: 3566090 - RNA, 22 nt, Human
cacugauuauaguacugacaga

SEQ ID NO: 3566091 - RNA, 13 nt, Human
cacugauuucaca

SEQ ID NO: 3566092 - RNA, 15 nt, Human
cacugauuuccccuu

SEQ ID NO: 3566093 - RNA, 23 nt, Human
cacugauuuccccuuuugcauuc

SEQ ID NO: 3566094 - RNA, 20 nt, Human
cacugcaaaccgccaccucc

SEQ ID NO: 3566095 - RNA, 15 nt, Human
cacugcaacaggaac

SEQ ID NO: 3566096 - RNA, 16 nt, Human
cacugcaaccuccgcc

SEQ ID NO: 3566097 - RNA, 14 nt, Human
cacugcaaccucug

SEQ ID NO: 3566098 - RNA, 16 nt, Human
cacugcaacuucugcc

SEQ ID NO: 3566099 - RNA, 15 nt, Human
cacugcaagagccuu

SEQ ID NO: 3566100 - RNA, 20 nt, Human
cacugcaaucuccaccuccc

SEQ ID NO: 3566101 - RNA, 20 nt, Human
cacugcaauuggcaccgaag

SEQ ID NO: 3566102 - RNA, 23 nt, Human
cacugcacaauaacuccucccag

SEQ ID NO: 3566103 - RNA, 13 nt, Human
cacugcacagagc

SEQ ID NO: 3566104 - RNA, 15 nt, Human
cacugcacagagcuc

SEQ ID NO: 3566105 - RNA, 21 nt, Human
cacugcacagagcucuccagc

SEQ ID NO: 3566106 - RNA, 21 nt, Human
cacugcacagugcaucucagc

SEQ ID NO: 3566107 - RNA, 23 nt, Human
cacugcacagugcaucucagccc

SEQ ID NO: 3566108 - RNA, 13 nt, Human
cacugcacccccu

SEQ ID NO: 3566109 - RNA, 19 nt, Human
cacugcacccccuccugcu

SEQ ID NO: 3566110 - RNA, 21 nt, Human
cacugcacccccuccugcugc

SEQ ID NO: 3566111 - RNA, 22 nt, Human
cacugcacccccuccugcugca

SEQ ID NO: 3566112 - RNA, 17 nt, Human
cacugcaccccgucuca

SEQ ID NO: 3566113 - RNA, 15 nt, Human
cacugcaccgggcca

SEQ ID NO: 3566114 - RNA, 18 nt, Human
cacugcaccgggccacag

SEQ ID NO: 3566115 - RNA, 19 nt, Human
cacugcacuauagccuagg

SEQ ID NO: 3566116 - RNA, 21 nt, Human
cacugcacucaaccuuaagac

SEQ ID NO: 3566117 - RNA, 19 nt, Human
cacugcacuccagccuggg

SEQ ID NO: 3566118 - RNA, 20 nt, Human
cacugcacuccagccugggu

SEQ ID NO: 3566119 - RNA, 17 nt, Human
cacugcagaaacccuga

SEQ ID NO: 3566120 - RNA, 18 nt, Human
cacugcagccccacccag

SEQ ID NO: 3566121 - RNA, 20 nt, Human
cacugcagccucaaccuccu

SEQ ID NO: 3566122 - RNA, 21 nt, Human
cacugcagccucaaccuccug

SEQ ID NO: 3566123 - RNA, 21 nt, Human
cacugcagccuccgcuucccu

SEQ ID NO: 3566124 - RNA, 12 nt, Human
cacugcaggcac

SEQ ID NO: 3566125 - RNA, 18 nt, Human
cacugcauccuccgccuc

SEQ ID NO: 3566126 - RNA, 14 nt, Human
cacugccacuuugc

SEQ ID NO: 3566127 - RNA, 19 nt, Human
cacugccacuuugcacauu

SEQ ID NO: 3566128 - RNA, 14 nt, Human
cacugccagcagca

SEQ ID NO: 3566129 - RNA, 16 nt, Human
cacugccagcagcagc

SEQ ID NO: 3566130 - RNA, 18 nt, Human
cacugccagcauuucccu

SEQ ID NO: 3566131 - RNA, 14 nt, Human
cacugccaggaggg

SEQ ID NO: 3566132 - RNA, 16 nt, Human
cacugccaggccagcc

SEQ ID NO: 3566133 - RNA, 17 nt, Human
cacugccaggccagccu

SEQ ID NO: 3566134 - RNA, 19 nt, Human
cacugccaggccagccucc

SEQ ID NO: 3566135 - RNA, 16 nt, Human
cacugccauaaaacau

SEQ ID NO: 3566136 - RNA, 14 nt, Human
cacugccauauacu

SEQ ID NO: 3566137 - RNA, 20 nt, Human
cacugccaucuuaguuugga

SEQ ID NO: 3566138 - RNA, 17 nt, Human
cacugccaugcagggcc

SEQ ID NO: 3566139 - RNA, 19 nt, Human
cacugccauggaggcacac

SEQ ID NO: 3566140 - RNA, 13 nt, Human
cacugcccacugg

SEQ ID NO: 3566141 - RNA, 17 nt, Human
cacugcccauggacagg

SEQ ID NO: 3566142 - RNA, 17 nt, Human
cacugcccccugcugcc

SEQ ID NO: 3566143 - RNA, 17 nt, Human
cacugcccucuguucag

SEQ ID NO: 3566144 - RNA, 16 nt, Human
cacugccucucccugg

SEQ ID NO: 3566145 - RNA, 14 nt, Human
cacugccucugccu

SEQ ID NO: 3566146 - RNA, 15 nt, Human
cacugccucugccuu

SEQ ID NO: 3566147 - RNA, 16 nt, Human
cacugccucugccuua

SEQ ID NO: 3566148 - RNA, 16 nt, Human
cacugccucuuccucc

SEQ ID NO: 3566149 - RNA, 13 nt, Human
cacugccugcaga

SEQ ID NO: 3566150 - RNA, 15 nt, Human
cacugccugcccacc

SEQ ID NO: 3566151 - RNA, 15 nt, Human
cacugccugccuuaa

SEQ ID NO: 3566152 - RNA, 19 nt, Human
cacugccugcucccauccu

SEQ ID NO: 3566153 - RNA, 11 nt, Human
cacugccuggg

SEQ ID NO: 3566154 - RNA, 13 nt, Human
cacugccugggcu

SEQ ID NO: 3566155 - RNA, 16 nt, Human
cacugccuguauacuu

SEQ ID NO: 3566156 - RNA, 23 nt, Human
cacugccuguauacuuuaguaug

SEQ ID NO: 3566157 - RNA, 20 nt, Human
cacugccuucgauacaccgg

SEQ ID NO: 3566158 - RNA, 23 nt, Human
cacugccuucgcuucuugccucu

SEQ ID NO: 3566159 - RNA, 12 nt, Human
cacugccuuuga

SEQ ID NO: 3566160 - RNA, 20 nt, Human
cacugcgaagacccucuugc

SEQ ID NO: 3566161 - RNA, 21 nt, Human
cacugcgaagacccucuugcc

SEQ ID NO: 3566162 - RNA, 17 nt, Human
cacugcgccacugcucc

SEQ ID NO: 3566163 - RNA, 20 nt, Human
cacugcuaggcgagugccag

SEQ ID NO: 3566164 - RNA, 22 nt, Human
cacugcuaggcgagugccagga

SEQ ID NO: 3566165 - RNA, 12 nt, Human
cacugcucuggu

SEQ ID NO: 3566166 - RNA, 16 nt, Human
cacugcugcaaggccu

SEQ ID NO: 3566167 - RNA, 14 nt, Human
cacugcuggcugcc

SEQ ID NO: 3566168 - RNA, 18 nt, Human
cacugcuggguggcccau

SEQ ID NO: 3566169 - RNA, 23 nt, Human
cacugcuggguggcccauccccc

SEQ ID NO: 3566170 - RNA, 17 nt, Human
cacugcugugcugugcc

SEQ ID NO: 3566171 - RNA, 21 nt, Human
cacugcuguuauauuucauca

SEQ ID NO: 3566172 - RNA, 14 nt, Human
cacugcuuccagug

SEQ ID NO: 3566173 - RNA, 20 nt, Human
cacugcuuccagugaggcuc

SEQ ID NO: 3566174 - RNA, 21 nt, Human
cacugcuuccagugaggcucu

SEQ ID NO: 3566175 - RNA, 17 nt, Human
cacugcuuccauuuaau

SEQ ID NO: 3566176 - RNA, 13 nt, Human
cacugcuugagga

SEQ ID NO: 3566177 - RNA, 14 nt, Human
cacugcuugaggaa

SEQ ID NO: 3566178 - RNA, 18 nt, Human
cacugcuugaugaagcaa

SEQ ID NO: 3566179 - RNA, 21 nt, Human
cacugcuuuucccuuugugag

SEQ ID NO: 3566180 - RNA, 13 nt, Human
cacugcuuuuggc

SEQ ID NO: 3566181 - RNA, 17 nt, Human
cacugcuuuuggccugg

SEQ ID NO: 3566182 - RNA, 21 nt, Human
cacugcuuuuggucuguguga

SEQ ID NO: 3566183 - RNA, 15 nt, Human
cacuggaaaggggag

SEQ ID NO: 3566184 - RNA, 16 nt, Human
cacuggaaaggggaga

SEQ ID NO: 3566185 - RNA, 19 nt, Human
cacuggaacucagugugac

SEQ ID NO: 3566186 - RNA, 16 nt, Human
cacuggaccacugggc

SEQ ID NO: 3566187 - RNA, 18 nt, Human
cacuggacucaccucccc

SEQ ID NO: 3566188 - RNA, 16 nt, Human
cacuggacuccggccc

SEQ ID NO: 3566189 - RNA, 19 nt, Human
cacuggagacgcauaugag

SEQ ID NO: 3566190 - RNA, 14 nt, Human
cacuggagcccagg

SEQ ID NO: 3566191 - RNA, 16 nt, Human
cacuggaggagagaag

SEQ ID NO: 3566192 - RNA, 22 nt, Human
cacuggaggagagaagaaugag

SEQ ID NO: 3566193 - RNA, 22 nt, Human
cacuggaguggcucgccaggcc

SEQ ID NO: 3566194 - RNA, 19 nt, Human
cacuggaugcaaagaaaau

SEQ ID NO: 3566195 - RNA, 19 nt, Human
cacuggcaaacagggccuc

SEQ ID NO: 3566196 - RNA, 21 nt, Human
cacuggcaaacagggccucug

SEQ ID NO: 3566197 - RNA, 16 nt, Human
cacuggcaaugaaaaa

SEQ ID NO: 3566198 - RNA, 18 nt, Human
cacuggcagacuguguaa

SEQ ID NO: 3566199 - RNA, 14 nt, Human
cacuggcagcccca

SEQ ID NO: 3566200 - RNA, 15 nt, Human
cacuggcagccccag

SEQ ID NO: 3566201 - RNA, 18 nt, Human
cacuggcauugucccugu

SEQ ID NO: 3566202 - RNA, 17 nt, Human
cacuggccacaguuguu

SEQ ID NO: 3566203 - RNA, 18 nt, Human
cacuggccaccaggcugg

SEQ ID NO: 3566204 - RNA, 24 nt, Human
cacuggccccucaaaucguccagc

SEQ ID NO: 3566205 - RNA, 16 nt, Human
cacuggcuaaagauaa

SEQ ID NO: 3566206 - RNA, 13 nt, Human
cacuggcucaccc

SEQ ID NO: 3566207 - RNA, 18 nt, Human
cacuggcucacccagucc

SEQ ID NO: 3566208 - RNA, 19 nt, Human
cacuggcucuccaagugcc

SEQ ID NO: 3566209 - RNA, 14 nt, Human
cacuggcucuccug

SEQ ID NO: 3566210 - RNA, 17 nt, Human
cacuggcugccuccacu

SEQ ID NO: 3566211 - RNA, 19 nt, Human
cacuggcugccuccacucc

SEQ ID NO: 3566212 - RNA, 14 nt, Human
cacuggcugugggc

SEQ ID NO: 3566213 - RNA, 21 nt, Human
cacuggcugugggcucccuuc

SEQ ID NO: 3566214 - RNA, 17 nt, Human
cacugggacuugcaaaa

SEQ ID NO: 3566215 - RNA, 18 nt, Human
cacugggagaaaugaaaa

SEQ ID NO: 3566216 - RNA, 21 nt, Human
cacugggaggccagugagcca

SEQ ID NO: 3566217 - RNA, 20 nt, Human
cacugggaugagccgcugug

SEQ ID NO: 3566218 - RNA, 22 nt, Human
cacugggaugagccgcugugag

SEQ ID NO: 3566219 - RNA, 13 nt, Human
cacugggcuucua

SEQ ID NO: 3566220 - RNA, 18 nt, Human
cacuggggacuuggccuc

SEQ ID NO: 3566221 - RNA, 19 nt, Human
cacuggggacuuggccucu

SEQ ID NO: 3566222 - RNA, 21 nt, Human
cacuggggacuuggccucucu

SEQ ID NO: 3566223 - RNA, 18 nt, Human
cacuggggauugggcccc

SEQ ID NO: 3566224 - RNA, 14 nt, Human
cacuggggccuaca

SEQ ID NO: 3566225 - RNA, 15 nt, Human
cacuggggcucagag

SEQ ID NO: 3566226 - RNA, 20 nt, Human
cacuggggcucagagccggg

SEQ ID NO: 3566227 - RNA, 18 nt, Human
cacugggggaggggacau

SEQ ID NO: 3566228 - RNA, 21 nt, Human
cacugggggaggggacauuga

SEQ ID NO: 3566229 - RNA, 18 nt, Human
cacuggggugccgccugc

SEQ ID NO: 3566230 - RNA, 14 nt, Human
cacugggugguggc

SEQ ID NO: 3566231 - RNA, 20 nt, Human
cacugggugguggccugguc

SEQ ID NO: 3566232 - RNA, 15 nt, Human
cagcagccccacacc

SEQ ID NO: 3566233 - RNA, 13 nt, Human
cagcagcccccag

SEQ ID NO: 3566234 - RNA, 23 nt, Human
cagcagcccccagcucccaccuc

SEQ ID NO: 3566235 - RNA, 16 nt, Human
cagcagccccugcaca

SEQ ID NO: 3566236 - RNA, 23 nt, Human
cagcagccccugcacaaagcccu

SEQ ID NO: 3566237 - RNA, 20 nt, Human
cagcagcccuaaggaucucu

SEQ ID NO: 3566238 - RNA, 12 nt, Human
cagcagcccucc

SEQ ID NO: 3566239 - RNA, 13 nt, Human
cagcagcccuccu

SEQ ID NO: 3566240 - RNA, 19 nt, Human
cagcagcccuccucacccc

SEQ ID NO: 3566241 - RNA, 21 nt, Human
cagcagccucgccccuggcag

SEQ ID NO: 3566242 - RNA, 22 nt, Human
cagcagccucgccccuggcaga

SEQ ID NO: 3566243 - RNA, 23 nt, Human
cagcagccucugaaguuggacag

SEQ ID NO: 3566244 - RNA, 12 nt, Human
cagcagccugcu

SEQ ID NO: 3566245 - RNA, 15 nt, Human
cagcagccugcuucc

SEQ ID NO: 3566246 - RNA, 21 nt, Human
cagcagccugcuucccaccuc

SEQ ID NO: 3566247 - RNA, 22 nt, Human
cagcagccugcuucccaccucc

SEQ ID NO: 3566248 - RNA, 12 nt, Human
cagcagccugga

SEQ ID NO: 3566249 - RNA, 18 nt, Human
cagcagccuggacccugu

SEQ ID NO: 3566250 - RNA, 16 nt, Human
cagcagcgguggccuc

SEQ ID NO: 3566251 - RNA, 14 nt, Human
cagcagcucaggca

SEQ ID NO: 3566252 - RNA, 21 nt, Human
cagcagcuuauaaugggcucu

SEQ ID NO: 3566253 - RNA, 14 nt, Human
cagcaggacugucc

SEQ ID NO: 3566254 - RNA, 19 nt, Human
cagcaggagggacagucuc

SEQ ID NO: 3566255 - RNA, 11 nt, Human
cagcaggcagc

SEQ ID NO: 3566256 - RNA, 19 nt, Human
cagcaggcagccuuggcgg

SEQ ID NO: 3566257 - RNA, 20 nt, Human
cagcaggcucucaggccagc

SEQ ID NO: 3566258 - RNA, 22 nt, Human
cagcaggcucucaggccagcug

SEQ ID NO: 3566259 - RNA, 19 nt, Human
cagcaggcugccagugccu

SEQ ID NO: 3566260 - RNA, 20 nt, Human
cagcaggcugccagugccug

SEQ ID NO: 3566261 - RNA, 24 nt, Human
cagcagggaaaaugcagcagggau

SEQ ID NO: 3566262 - RNA, 18 nt, Human
cagcagggagggcuucug

SEQ ID NO: 3566263 - RNA, 11 nt, Human
cagcagggcag

SEQ ID NO: 3566264 - RNA, 15 nt, Human
cagcagggcaguagc

SEQ ID NO: 3566265 - RNA, 14 nt, Human
cagcagggccucaa

SEQ ID NO: 3566266 - RNA, 17 nt, Human
cagcagggccucaaagu

SEQ ID NO: 3566267 - RNA, 19 nt, Human
cagcagggcuacccugagc

SEQ ID NO: 3566268 - RNA, 17 nt, Human
cagcagggcugcuguga

SEQ ID NO: 3566269 - RNA, 20 nt, Human
cagcagggucuuuucaucug

SEQ ID NO: 3566270 - RNA, 22 nt, Human
cagcagggucuuuucaucuggg

SEQ ID NO: 3566271 - RNA, 19 nt, Human
cagcagguagccugcuggu

SEQ ID NO: 3566272 - RNA, 15 nt, Human
cagcaggugcugcua

SEQ ID NO: 3566273 - RNA, 23 nt, Human
cagcaggugcugcuacccucccu

SEQ ID NO: 3566274 - RNA, 15 nt, Human
cagcaguacaauaaa

SEQ ID NO: 3566275 - RNA, 19 nt, Human
cagcaguaccuauaaagua

SEQ ID NO: 3566276 - RNA, 16 nt, Human
cagcagucucugccuu

SEQ ID NO: 3566277 - RNA, 17 nt, Human
cagcagucuuaugcuuc

SEQ ID NO: 3566278 - RNA, 19 nt, Human
cagcagucuuaugcuucca

SEQ ID NO: 3566279 - RNA, 20 nt, Human
cagcagucuuaugcuuccag

SEQ ID NO: 3566280 - RNA, 22 nt, Human
cagcagucuuaugcuuccagaa

SEQ ID NO: 3566281 - RNA, 22 nt, Human
cagcagugaaaacaagugcugg

SEQ ID NO: 3566282 - RNA, 14 nt, Human
cagcagugagacug

SEQ ID NO: 3566283 - RNA, 20 nt, Human
cagcagugugaggccagggc

SEQ ID NO: 3566284 - RNA, 14 nt, Human
cagcaguguucccc

SEQ ID NO: 3566285 - RNA, 23 nt, Human
cagcaguguuccccaucuggguc

SEQ ID NO: 3566286 - RNA, 18 nt, Human
cagcaguucagagcugcc

SEQ ID NO: 3566287 - RNA, 19 nt, Human
cagcaguucagagcugccc

SEQ ID NO: 3566288 - RNA, 20 nt, Human
cagcaguucagagcugcccu

SEQ ID NO: 3566289 - RNA, 21 nt, Human
cagcaguucagagcugcccuc

SEQ ID NO: 3566290 - RNA, 20 nt, Human
cagcaguugaaaagacucca

SEQ ID NO: 3566291 - RNA, 23 nt, Human
cagcaguugaaugacaacagaag

SEQ ID NO: 3566292 - RNA, 17 nt, Human
cagcaguugcugguaaa

SEQ ID NO: 3566293 - RNA, 18 nt, Human
cagcauaaaggccuuuuu

SEQ ID NO: 3566294 - RNA, 22 nt, Human
cagcauaacaagguccaagaua

SEQ ID NO: 3566295 - RNA, 17 nt, Human
cagcauaagggagcgua

SEQ ID NO: 3566296 - RNA, 19 nt, Human
cagcauaccuuuauuguga

SEQ ID NO: 3566297 - RNA, 18 nt, Human
cagcauauucaggaagcu

SEQ ID NO: 3566298 - RNA, 22 nt, Human
cagcauauuuguauaguugcuu

SEQ ID NO: 3566299 - RNA, 17 nt, Human
cagcaucaccugccugu

SEQ ID NO: 3566300 - RNA, 19 nt, Human
cagcaucaccugccuguua

SEQ ID NO: 3566301 - RNA, 14 nt, Human
cagcaucacucccc

SEQ ID NO: 3566302 - RNA, 17 nt, Human
cagcaucacuccccaag

SEQ ID NO: 3566303 - RNA, 13 nt, Human
cagcaucaggguu

SEQ ID NO: 3566304 - RNA, 23 nt, Human
cagcaucaggguuaagaagacuu

SEQ ID NO: 3566305 - RNA, 19 nt, Human
cagcaucauuuugcauuca

SEQ ID NO: 3566306 - RNA, 20 nt, Human
cagcauccgcaggugcuggu

SEQ ID NO: 3566307 - RNA, 15 nt, Human
cagcauccuggcacc

SEQ ID NO: 3566308 - RNA, 20 nt, Human
cagcauccuggcacccggcc

SEQ ID NO: 3566309 - RNA, 22 nt, Human
cagcauccuuaaguaucagaaa

SEQ ID NO: 3566310 - RNA, 19 nt, Human
cagcaucgcacucuggcag

SEQ ID NO: 3566311 - RNA, 21 nt, Human
cagcaucggacaagaccccca

SEQ ID NO: 3566312 - RNA, 23 nt, Human
cagcaucucccucacugaaacca

SEQ ID NO: 3566313 - RNA, 21 nt, Human
cagcaucucuaccuucucccc

SEQ ID NO: 3566314 - RNA, 14 nt, Human
cagcaucugggccu

SEQ ID NO: 3566315 - RNA, 13 nt, Human
cagcaucuucuca

SEQ ID NO: 3566316 - RNA, 14 nt, Human
cagcaucuucuggu

SEQ ID NO: 3566317 - RNA, 15 nt, Human
cagcaucuucugguu

SEQ ID NO: 3566318 - RNA, 16 nt, Human
cagcaugaaaaugugu

SEQ ID NO: 3566319 - RNA, 21 nt, Human
cagcaugaccugugaccagca

SEQ ID NO: 3566320 - RNA, 17 nt, Human
cagcaugaggaacuagc

SEQ ID NO: 3566321 - RNA, 18 nt, Human
cagcauggcacucccucc

SEQ ID NO: 3566322 - RNA, 19 nt, Human
cagcauggcacucccucca

SEQ ID NO: 3566323 - RNA, 21 nt, Human
cagcauggcacucccuccagc

SEQ ID NO: 3566324 - RNA, 22 nt, Human
cagcauggcacucccuccagca

SEQ ID NO: 3566325 - RNA, 20 nt, Human
cagcaugggcccaggaaugc

SEQ ID NO: 3566326 - RNA, 23 nt, Human
cagcauggucccugccuuaggcc

SEQ ID NO: 3566327 - RNA, 20 nt, Human
cagcauguacggauuuucag

SEQ ID NO: 3566328 - RNA, 16 nt, Human
cagcaugugcccuccu

SEQ ID NO: 3566329 - RNA, 22 nt, Human
cagcauguguauuuccagugca

SEQ ID NO: 3566330 - RNA, 20 nt, Human
cagcauguguuaaucuuaau

SEQ ID NO: 3566331 - RNA, 23 nt, Human
cagcauguguuaaucuuaaugua

SEQ ID NO: 3566332 - RNA, 18 nt, Human
cagcauuacaaauugcuu

SEQ ID NO: 3566333 - RNA, 19 nt, Human
cagcauuaccucuuuggaa

SEQ ID NO: 3566334 - RNA, 16 nt, Human
cagcauuccagccccu

SEQ ID NO: 3566335 - RNA, 19 nt, Human
cagcauucucaggcaccag

SEQ ID NO: 3566336 - RNA, 20 nt, Human
cagcauucucaggcaccagu

SEQ ID NO: 3566337 - RNA, 21 nt, Human
cagcauucuugucacaauaaa

SEQ ID NO: 3566338 - RNA, 17 nt, Human
cagcauugauauuugug

SEQ ID NO: 3566339 - RNA, 20 nt, Human
cagcauugauauuugugcau

SEQ ID NO: 3566340 - RNA, 19 nt, Human
cagcauugcuggacucuga

SEQ ID NO: 3566341 - RNA, 14 nt, Human
cagcauugcugguu

SEQ ID NO: 3566342 - RNA, 16 nt, Human
cagcauuguauaugug

SEQ ID NO: 3566343 - RNA, 23 nt, Human
cagcauuuccacaccaagcagca

SEQ ID NO: 3566344 - RNA, 14 nt, Human
cagcauuugaucug

SEQ ID NO: 3566345 - RNA, 13 nt, Human
cagcauuuuccuc

SEQ ID NO: 3566346 - RNA, 15 nt, Human
cagcauuuuccucug

SEQ ID NO: 3566347 - RNA, 16 nt, Human
cagccaaacacacaga

SEQ ID NO: 3566348 - RNA, 18 nt, Human
cagccaaacacacagaag

SEQ ID NO: 3566349 - RNA, 17 nt, Human
cagccaaacccaugagg

SEQ ID NO: 3566350 - RNA, 15 nt, Human
cagccaaacccuguc

SEQ ID NO: 3566351 - RNA, 17 nt, Human
cagccaaacccugucug

SEQ ID NO: 3566352 - RNA, 13 nt, Human
cagccaacagcua

SEQ ID NO: 3566353 - RNA, 15 nt, Human
cagccaacagcuaca

SEQ ID NO: 3566354 - RNA, 19 nt, Human
cagccaacagcuacaacag

SEQ ID NO: 3566355 - RNA, 22 nt, Human
cagccaacagguggcaggacca

SEQ ID NO: 3566356 - RNA, 15 nt, Human
cagccaaccccugug

SEQ ID NO: 3566357 - RNA, 20 nt, Human
cagccaaccuuacuuacagc

SEQ ID NO: 3566358 - RNA, 21 nt, Human
cagccaacgaguaauuuauug

SEQ ID NO: 3566359 - RNA, 22 nt, Human
cagccaagauuuuccucuugug

SEQ ID NO: 3566360 - RNA, 23 nt, Human
cagccaagauuuuccucuuguga

SEQ ID NO: 3566361 - RNA, 14 nt, Human
cagccaagcacagu

SEQ ID NO: 3566362 - RNA, 16 nt, Human
cagccaagcacagugg

SEQ ID NO: 3566363 - RNA, 14 nt, Human
cagccaagcucugc

SEQ ID NO: 3566364 - RNA, 11 nt, Human
cagccaagcuu

SEQ ID NO: 3566365 - RNA, 13 nt, Human
cagccaagcuugu

SEQ ID NO: 3566366 - RNA, 20 nt, Human
cagccaagggaugaaagaga

SEQ ID NO: 3566367 - RNA, 18 nt, Human
cagccaauuauguuaaac

SEQ ID NO: 3566368 - RNA, 9 nt, Human
cagccacac

SEQ ID NO: 3566369 - RNA, 16 nt, Human
cagccacacacacaga

SEQ ID NO: 3566370 - RNA, 21 nt, Human
cagccacacacacagaaaaua

SEQ ID NO: 3566371 - RNA, 23 nt, Human
cagccacacacacagaaaauaua

SEQ ID NO: 3566372 - RNA, 15 nt, Human
cagccacaugggaaa

SEQ ID NO: 3566373 - RNA, 14 nt, Human
cagccacauuccug

SEQ ID NO: 3566374 - RNA, 19 nt, Human
cagccacauuccugaugcu

SEQ ID NO: 3566375 - RNA, 13 nt, Human
cagccgggcccug

SEQ ID NO: 3566376 - RNA, 16 nt, Human
cagccggggccugccu

SEQ ID NO: 3566377 - RNA, 17 nt, Human
cagccggggcgaguggc

SEQ ID NO: 3566378 - RNA, 20 nt, Human
cagccggggcgaguggcacg

SEQ ID NO: 3566379 - RNA, 15 nt, Human
cagccgguaccuggg

SEQ ID NO: 3566380 - RNA, 18 nt, Human
cagccgucaccccugccu

SEQ ID NO: 3566381 - RNA, 19 nt, Human
cagccgugaugcucaggcu

SEQ ID NO: 3566382 - RNA, 21 nt, Human
cagccguguaaccauggaccc

SEQ ID NO: 3566383 - RNA, 14 nt, Human
cagccuaagagacu

SEQ ID NO: 3566384 - RNA, 16 nt, Human
cagccuaagaugaaga

SEQ ID NO: 3566385 - RNA, 14 nt, Human
cagccuacaggccu

SEQ ID NO: 3566386 - RNA, 12 nt, Human
cagccuacaguu

SEQ ID NO: 3566387 - RNA, 16 nt, Human
cagccuacucuccuug

SEQ ID NO: 3566388 - RNA, 17 nt, Human
cagccuagcacagcagc

SEQ ID NO: 3566389 - RNA, 15 nt, Human
cagccuagccgaccu

SEQ ID NO: 3566390 - RNA, 17 nt, Human
cagccuagccgaccuca

SEQ ID NO: 3566391 - RNA, 16 nt, Human
cagccuaguugaucag

SEQ ID NO: 3566392 - RNA, 19 nt, Human
cagccuaugagcauccuga

SEQ ID NO: 3566393 - RNA, 21 nt, Human
cagccuaugagcauccugagc

SEQ ID NO: 3566394 - RNA, 22 nt, Human
cagccuaugagcauccugagcc

SEQ ID NO: 3566395 - RNA, 17 nt, Human
cagccucaaauccagga

SEQ ID NO: 3566396 - RNA, 21 nt, Human
cagccucaaauccaggacccu

SEQ ID NO: 3566397 - RNA, 18 nt, Human
cagccucaaccuccuggg

SEQ ID NO: 3566398 - RNA, 13 nt, Human
cagccucacagaa

SEQ ID NO: 3566399 - RNA, 21 nt, Human
cagccucacuuggucugccag

SEQ ID NO: 3566400 - RNA, 22 nt, Human
cagccucacuuggucugccagg

SEQ ID NO: 3566401 - RNA, 23 nt, Human
cagccucacuuggucugccaggc

SEQ ID NO: 3566402 - RNA, 17 nt, Human
cagccucagcgcggccc

SEQ ID NO: 3566403 - RNA, 18 nt, Human
cagccucaggacugggag

SEQ ID NO: 3566404 - RNA, 21 nt, Human
cagccucaguccuccccucac

SEQ ID NO: 3566405 - RNA, 20 nt, Human
cagccuccaacacaaggcuc

SEQ ID NO: 3566406 - RNA, 12 nt, Human
cagccuccagcc

SEQ ID NO: 3566407 - RNA, 14 nt, Human
cagccuccagccug

SEQ ID NO: 3566408 - RNA, 15 nt, Human
cagccuccagccugc

SEQ ID NO: 3566409 - RNA, 15 nt, Human
cagccuccaugcugc

SEQ ID NO: 3566410 - RNA, 14 nt, Human
cagccucccaaagu

SEQ ID NO: 3566411 - RNA, 21 nt, Human
cagccucccaaagugcugaga

SEQ ID NO: 3566412 - RNA, 21 nt, Human
cagccucccaaagugcuggga

SEQ ID NO: 3566413 - RNA, 13 nt, Human
cagccucccacag

SEQ ID NO: 3566414 - RNA, 15 nt, Human
cagccucccacagug

SEQ ID NO: 3566415 - RNA, 14 nt, Human
cagccucccacccc

SEQ ID NO: 3566416 - RNA, 16 nt, Human
cagccucccauccagg

SEQ ID NO: 3566417 - RNA, 18 nt, Human
cagccucccauccagggc

SEQ ID NO: 3566418 - RNA, 23 nt, Human
cagccucccccuguccccucuau

SEQ ID NO: 3566419 - RNA, 17 nt, Human
cagccuccccugccagg

SEQ ID NO: 3566420 - RNA, 20 nt, Human
cagccuccccugccagggca

SEQ ID NO: 3566421 - RNA, 20 nt, Human
cagccucccgaguagcuggg

SEQ ID NO: 3566422 - RNA, 22 nt, Human
cagccucccgaguagcugggac

SEQ ID NO: 3566423 - RNA, 23 nt, Human
cagccucccgaguagcugggacu

SEQ ID NO: 3566424 - RNA, 22 nt, Human
cagccucccucugaccugcagg

SEQ ID NO: 3566425 - RNA, 12 nt, Human
cagccucccuga

SEQ ID NO: 3566426 - RNA, 17 nt, Human
cagccucccugaagccu

SEQ ID NO: 3566427 - RNA, 18 nt, Human
cagccuccguauuucaga

SEQ ID NO: 3566428 - RNA, 19 nt, Human
cagccuccguauuucagac

SEQ ID NO: 3566429 - RNA, 22 nt, Human
cagccuccucuggacggcaggc

SEQ ID NO: 3566430 - RNA, 23 nt, Human
cagccuccucugucugcccuuca

SEQ ID NO: 3566431 - RNA, 20 nt, Human
cagccuccugaguagcugga

SEQ ID NO: 3566432 - RNA, 17 nt, Human
cagccucgaacuccugg

SEQ ID NO: 3566433 - RNA, 18 nt, Human
cagccucgaacuccuggg

SEQ ID NO: 3566434 - RNA, 18 nt, Human
cagccucguuggaagagg

SEQ ID NO: 3566435 - RNA, 23 nt, Human
cagccucguuggaagaggaacag

SEQ ID NO: 3566436 - RNA, 19 nt, Human
cagccucucagugcccucc

SEQ ID NO: 3566437 - RNA, 23 nt, Human
cagccucuccaggcaccaucucc

SEQ ID NO: 3566438 - RNA, 14 nt, Human
cagccucuccccag

SEQ ID NO: 3566439 - RNA, 19 nt, Human
cagccucuccccaggucca

SEQ ID NO: 3566440 - RNA, 23 nt, Human
cagccucuccccagguccagcuc

SEQ ID NO: 3566441 - RNA, 17 nt, Human
cagccucuccccugauu

SEQ ID NO: 3566442 - RNA, 16 nt, Human
cagccucucucccagu

SEQ ID NO: 3566443 - RNA, 18 nt, Human
cagccucucucccagucu

SEQ ID NO: 3566444 - RNA, 14 nt, Human
cagccucucuuccu

SEQ ID NO: 3566445 - RNA, 23 nt, Human
cagccucucuuccuaucccaucc

SEQ ID NO: 3566446 - RNA, 15 nt, Human
cagccucugaccccu

SEQ ID NO: 3566447 - RNA, 17 nt, Human
cagccucugaccccucc

SEQ ID NO: 3566448 - RNA, 23 nt, Human
cagccucugacuuaagcugccuc

SEQ ID NO: 3566449 - RNA, 21 nt, Human
cagccucugagccccugggac

SEQ ID NO: 3566450 - RNA, 21 nt, Human
cagccucugggcccacauccg

SEQ ID NO: 3566451 - RNA, 18 nt, Human
cagccucuuggccccaga

SEQ ID NO: 3566452 - RNA, 16 nt, Human
cagccucuuucccuuc

SEQ ID NO: 3566453 - RNA, 17 nt, Human
cagccucuuucuguccc

SEQ ID NO: 3566454 - RNA, 18 nt, Human
cagccugaacagaagcuc

SEQ ID NO: 3566455 - RNA, 22 nt, Human
cagccugaaccccagggcugua

SEQ ID NO: 3566456 - RNA, 20 nt, Human
cagccugagcaacucuugau

SEQ ID NO: 3566457 - RNA, 21 nt, Human
cagccugagcaacucuugauu

SEQ ID NO: 3566458 - RNA, 23 nt, Human
cagccugagcgacagugagacuc

SEQ ID NO: 3566459 - RNA, 15 nt, Human
cagccugaggcugag

SEQ ID NO: 3566460 - RNA, 12 nt, Human
cagccugcagga

SEQ ID NO: 3566461 - RNA, 20 nt, Human
cagccugcaguuaauuagca

SEQ ID NO: 3566462 - RNA, 11 nt, Human
cagccugccac

SEQ ID NO: 3566463 - RNA, 23 nt, Human
cagccugcccaagcccaggccac

SEQ ID NO: 3566464 - RNA, 12 nt, Human
cagccugccugg

SEQ ID NO: 3566465 - RNA, 14 nt, Human
cagccugccuggag

SEQ ID NO: 3566466 - RNA, 19 nt, Human
cagccugccuggcaggcug

SEQ ID NO: 3566467 - RNA, 18 nt, Human
cagccugccuugcccacu

SEQ ID NO: 3566468 - RNA, 15 nt, Human
cagccugcgccugcu

SEQ ID NO: 3566469 - RNA, 18 nt, Human
cagccugcgccugcugca

SEQ ID NO: 3566470 - RNA, 18 nt, Human
cagccugcguggcugacc

SEQ ID NO: 3566471 - RNA, 21 nt, Human
cagccugcguggcugaccccc

SEQ ID NO: 3566472 - RNA, 13 nt, Human
cagccugcuagcu

SEQ ID NO: 3566473 - RNA, 16 nt, Human
cagccugcuagcuagc

SEQ ID NO: 3566474 - RNA, 22 nt, Human
cagccugcuagcuagcucaacu

SEQ ID NO: 3566475 - RNA, 20 nt, Human
cagccugcuccagcuguuca

SEQ ID NO: 3566476 - RNA, 23 nt, Human
cagccugcucuagugggacagcc

SEQ ID NO: 3566477 - RNA, 19 nt, Human
cagccuggaaaccugucug

SEQ ID NO: 3566478 - RNA, 16 nt, Human
cagccuggacauagag

SEQ ID NO: 3566479 - RNA, 13 nt, Human
cagccuggacccc

SEQ ID NO: 3566480 - RNA, 11 nt, Human
cagccuggaug

SEQ ID NO: 3566481 - RNA, 15 nt, Human
cagccuggaugccau

SEQ ID NO: 3566482 - RNA, 17 nt, Human
cagccuggaugccaucc

SEQ ID NO: 3566483 - RNA, 20 nt, Human
cagccuggcacagggcagug

SEQ ID NO: 3566484 - RNA, 21 nt, Human
cagccuggccacgcagccagg

SEQ ID NO: 3566485 - RNA, 13 nt, Human
cagccuggccaga

SEQ ID NO: 3566486 - RNA, 17 nt, Human
cagccuggccagacaca

SEQ ID NO: 3566487 - RNA, 13 nt, Human
cagccuggcccag

SEQ ID NO: 3566488 - RNA, 13 nt, Human
cagccuggccucc

SEQ ID NO: 3566489 - RNA, 17 nt, Human
cagccuggccuccugcc

SEQ ID NO: 3566490 - RNA, 20 nt, Human
cagccuggccuccugccucu

SEQ ID NO: 3566491 - RNA, 21 nt, Human
cagccuggccuccugccucua

SEQ ID NO: 3566492 - RNA, 13 nt, Human
cagccuggcuccc

SEQ ID NO: 3566493 - RNA, 17 nt, Human
cagccuggcuccccugg

SEQ ID NO: 3566494 - RNA, 19 nt, Human
cagccuggcuccccugggg

SEQ ID NO: 3566495 - RNA, 14 nt, Human
cagccuggcuucug

SEQ ID NO: 3566496 - RNA, 19 nt, Human
cagccuggcuucuggagcc

SEQ ID NO: 3566497 - RNA, 12 nt, Human
cagccugggaaa

SEQ ID NO: 3566498 - RNA, 20 nt, Human
cagccugggauaggggcaga

SEQ ID NO: 3566499 - RNA, 18 nt, Human
cagccugggcaacaaagu

SEQ ID NO: 3566500 - RNA, 19 nt, Human
cagccugggcaacagagca

SEQ ID NO: 3566501 - RNA, 16 nt, Human
cagccugggcaaugug

SEQ ID NO: 3566502 - RNA, 20 nt, Human
cagccugggcagcauagcaa

SEQ ID NO: 3566503 - RNA, 18 nt, Human
cagccugggcagccaggc

SEQ ID NO: 3566504 - RNA, 19 nt, Human
cagccugggcagccaggcu

SEQ ID NO: 3566505 - RNA, 20 nt, Human
cagccugggcagccaggcug

SEQ ID NO: 3566506 - RNA, 11 nt, Human
cagccugggcc

SEQ ID NO: 3566507 - RNA, 14 nt, Human
cagccugggcccau

SEQ ID NO: 3566508 - RNA, 15 nt, Human
cagccugggccccag

SEQ ID NO: 3566509 - RNA, 14 nt, Human
cagccugggcgcug

SEQ ID NO: 3566510 - RNA, 20 nt, Human
cagccugggcgcugguccuu

SEQ ID NO: 3566511 - RNA, 16 nt, Human
cagccuggggccuggc

SEQ ID NO: 3566512 - RNA, 19 nt, Human
cagccugguccaugcaggg

SEQ ID NO: 3566513 - RNA, 14 nt, Human
cagccuggucgccu

SEQ ID NO: 3566514 - RNA, 22 nt, Human
cagccugucagauccaggagcu

SEQ ID NO: 3566515 - RNA, 23 nt, Human
cagccugucagauccaggagcuc

SEQ ID NO: 3566516 - RNA, 19 nt, Human
cagccugucccauggacac

SEQ ID NO: 3566517 - RNA, 22 nt, Human
cagccugucccauggacacucc

SEQ ID NO: 3566518 - RNA, 12 nt, Human
cagccuguccug

SEQ ID NO: 3566519 - RNA, 21 nt, Human
cagguggaggugucaggcugc

SEQ ID NO: 3566520 - RNA, 22 nt, Human
cagguggaucuauuucauguuu

SEQ ID NO: 3566521 - RNA, 15 nt, Human
cagguggcaggacca

SEQ ID NO: 3566522 - RNA, 20 nt, Human
cagguggcaggaccaggacu

SEQ ID NO: 3566523 - RNA, 21 nt, Human
cagguggcaggaccaggacua

SEQ ID NO: 3566524 - RNA, 19 nt, Human
cagguggccaaguuccucu

SEQ ID NO: 3566525 - RNA, 19 nt, Human
cagguggccagccuggauc

SEQ ID NO: 3566526 - RNA, 13 nt, Human
cagguggccaugc

SEQ ID NO: 3566527 - RNA, 22 nt, Human
cagguggcucugaggugccugu

SEQ ID NO: 3566528 - RNA, 19 nt, Human
cagguggcugacccagucc

SEQ ID NO: 3566529 - RNA, 21 nt, Human
caggugggcguggucacugcu

SEQ ID NO: 3566530 - RNA, 16 nt, Human
caggugggcuucccag

SEQ ID NO: 3566531 - RNA, 23 nt, Human
caggugggcuucccaguggcugc

SEQ ID NO: 3566532 - RNA, 19 nt, Human
cagguggggagacugggcu

SEQ ID NO: 3566533 - RNA, 22 nt, Human
cagguggggagacugggcugag

SEQ ID NO: 3566534 - RNA, 23 nt, Human
cagguggggagucagggaccccu

SEQ ID NO: 3566535 - RNA, 16 nt, Human
cagguggggcagcuug

SEQ ID NO: 3566536 - RNA, 19 nt, Human
cagguggggucacucuggc

SEQ ID NO: 3566537 - RNA, 20 nt, Human
cagguggggucacucuggca

SEQ ID NO: 3566538 - RNA, 23 nt, Human
cagguggggucacucuggcagcu

SEQ ID NO: 3566539 - RNA, 22 nt, Human
cagguggggugaggcagugggu

SEQ ID NO: 3566540 - RNA, 16 nt, Human
caggugggugucugcg

SEQ ID NO: 3566541 - RNA, 16 nt, Human
caggugguccugagac

SEQ ID NO: 3566542 - RNA, 22 nt, Human
caggugguggcacugagccccc

SEQ ID NO: 3566543 - RNA, 21 nt, Human
caggugguggcugcaaggugg

SEQ ID NO: 3566544 - RNA, 20 nt, Human
cagguggugucacugucccu

SEQ ID NO: 3566545 - RNA, 19 nt, Human
cagguggugucgggcccuu

SEQ ID NO: 3566546 - RNA, 20 nt, Human
caggugguuauggagagggu

SEQ ID NO: 3566547 - RNA, 16 nt, Human
caggugucagccauug

SEQ ID NO: 3566548 - RNA, 16 nt, Human
cagguguccccagccc

SEQ ID NO: 3566549 - RNA, 11 nt, Human
caggugucccu

SEQ ID NO: 3566550 - RNA, 14 nt, Human
caggugucccugca

SEQ ID NO: 3566551 - RNA, 18 nt, Human
caggugucccugcacuug

SEQ ID NO: 3566552 - RNA, 18 nt, Human
caggugucugcccccucu

SEQ ID NO: 3566553 - RNA, 22 nt, Human
caggugugaaccaccacaccca

SEQ ID NO: 3566554 - RNA, 18 nt, Human
caggugugagccaccacg

SEQ ID NO: 3566555 - RNA, 23 nt, Human
caggugugagccaccacgcccgg

SEQ ID NO: 3566556 - RNA, 16 nt, Human
caggugugagggcagu

SEQ ID NO: 3566557 - RNA, 20 nt, Human
caggugugagggcagugcaa

SEQ ID NO: 3566558 - RNA, 22 nt, Human
caggugugguggcucacaccug

SEQ ID NO: 3566559 - RNA, 21 nt, Human
cagguguguccaccugggcau

SEQ ID NO: 3566560 - RNA, 22 nt, Human
cagguguuacuguaauuccuca

SEQ ID NO: 3566561 - RNA, 20 nt, Human
cagguguucuacacucaucu

SEQ ID NO: 3566562 - RNA, 13 nt, Human
cagguguugccaa

SEQ ID NO: 3566563 - RNA, 14 nt, Human
cagguguuuuucca

SEQ ID NO: 3566564 - RNA, 20 nt, Human
cagguuaaauguuuuguaaa

SEQ ID NO: 3566565 - RNA, 14 nt, Human
cagguuaagaaaau

SEQ ID NO: 3566566 - RNA, 13 nt, Human
cagguuacaacag

SEQ ID NO: 3566567 - RNA, 15 nt, Human
cagguuacaacagau

SEQ ID NO: 3566568 - RNA, 16 nt, Human
cagguuacaacagauu

SEQ ID NO: 3566569 - RNA, 23 nt, Human
cagguuaggcaguauaaagaaua

SEQ ID NO: 3566570 - RNA, 15 nt, Human
cagguuauaacagug

SEQ ID NO: 3566571 - RNA, 20 nt, Human
cagguuaucgaaauaacaau

SEQ ID NO: 3566572 - RNA, 24 nt, Human
cagguuaucgaaauaacaauguua

SEQ ID NO: 3566573 - RNA, 21 nt, Human
cagguuauugcaauaaaguau

SEQ ID NO: 3566574 - RNA, 16 nt, Human
cagguuauuuuaguuu

SEQ ID NO: 3566575 - RNA, 13 nt, Human
cagguucagcuug

SEQ ID NO: 3566576 - RNA, 15 nt, Human
cagguuccacagagg

SEQ ID NO: 3566577 - RNA, 15 nt, Human
cagguucccaagcuc

SEQ ID NO: 3566578 - RNA, 14 nt, Human
cagguucccacuua

SEQ ID NO: 3566579 - RNA, 16 nt, Human
cagguucccucccaga

SEQ ID NO: 3566580 - RNA, 15 nt, Human
cagguucugccugcu

SEQ ID NO: 3566581 - RNA, 21 nt, Human
cagguucugguuagcucagcc

SEQ ID NO: 3566582 - RNA, 20 nt, Human
cagguucuucuuccugaagc

SEQ ID NO: 3566583 - RNA, 14 nt, Human
cagguugaacccaa

SEQ ID NO: 3566584 - RNA, 22 nt, Human
cagguugaagaccuaaccaggg

SEQ ID NO: 3566585 - RNA, 11 nt, Human
cagguugacag

SEQ ID NO: 3566586 - RNA, 20 nt, Human
cagguugaggggcuccugga

SEQ ID NO: 3566587 - RNA, 13 nt, Human
cagguugauaaau

SEQ ID NO: 3566588 - RNA, 18 nt, Human
cagguugcugguugcugu

SEQ ID NO: 3566589 - RNA, 21 nt, Human
cagguugcugguugcugugug

SEQ ID NO: 3566590 - RNA, 15 nt, Human
cagguugcuuugccc

SEQ ID NO: 3566591 - RNA, 15 nt, Human
cagguuggaagagaa

SEQ ID NO: 3566592 - RNA, 18 nt, Human
cagguuggaagagaauca

SEQ ID NO: 3566593 - RNA, 20 nt, Human
cagguuggaagagaaucacc

SEQ ID NO: 3566594 - RNA, 22 nt, Human
cagguugggaaugaggcuugcu

SEQ ID NO: 3566595 - RNA, 13 nt, Human
cagguugggccau

SEQ ID NO: 3566596 - RNA, 13 nt, Human
cagguuguuggug

SEQ ID NO: 3566597 - RNA, 15 nt, Human
cagguuuaacauuug

SEQ ID NO: 3566598 - RNA, 16 nt, Human
cagguuuaacauuugc

SEQ ID NO: 3566599 - RNA, 16 nt, Human
cagguuuaagcuguua

SEQ ID NO: 3566600 - RNA, 20 nt, Human
cagguuucuggucucuaggc

SEQ ID NO: 3566601 - RNA, 13 nt, Human
cagguuuguuaca

SEQ ID NO: 3566602 - RNA, 19 nt, Human
cagguuuucacauaaaugc

SEQ ID NO: 3566603 - RNA, 16 nt, Human
cagguuuuccugaaga

SEQ ID NO: 3566604 - RNA, 14 nt, Human
cagguuuugcacuc

SEQ ID NO: 3566605 - RNA, 15 nt, Human
cagguuuuguaaaga

SEQ ID NO: 3566606 - RNA, 13 nt, Human
cagguuuuucaau

SEQ ID NO: 3566607 - RNA, 17 nt, Human
cagguuuuucaauuaaa

SEQ ID NO: 3566608 - RNA, 18 nt, Human
cagguuuuucaauuaaac

SEQ ID NO: 3566609 - RNA, 21 nt, Human
cagguuuuucaauuaaacgga

SEQ ID NO: 3566610 - RNA, 11 nt, Human
cagguuuuucc

SEQ ID NO: 3566611 - RNA, 19 nt, Human
caguaaaaaaaaaaaaugg

SEQ ID NO: 3566612 - RNA, 20 nt, Human
caguaaaaaaugguguuuua

SEQ ID NO: 3566613 - RNA, 11 nt, Human
caguaaaauug

SEQ ID NO: 3566614 - RNA, 16 nt, Human
caguaaaauugccaua

SEQ ID NO: 3566615 - RNA, 20 nt, Human
caguaaaauugccauauugc

SEQ ID NO: 3566616 - RNA, 21 nt, Human
caguaaacacuguguauuguu

SEQ ID NO: 3566617 - RNA, 16 nt, Human
caguaaaccacugaaa

SEQ ID NO: 3566618 - RNA, 18 nt, Human
caguaaaccacugaaaaa

SEQ ID NO: 3566619 - RNA, 15 nt, Human
caguaaagagaaacu

SEQ ID NO: 3566620 - RNA, 16 nt, Human
caguaaagagaaacuu

SEQ ID NO: 3566621 - RNA, 15 nt, Human
caguaaagcacuugc

SEQ ID NO: 3566622 - RNA, 16 nt, Human
caguaaauaaauuguu

SEQ ID NO: 3566623 - RNA, 24 nt, Human
caguaaauaaauuguuugaccaug

SEQ ID NO: 3566624 - RNA, 16 nt, Human
caguaaauaacuggaa

SEQ ID NO: 3566625 - RNA, 23 nt, Human
caguaaauaacuggaaaacagaa

SEQ ID NO: 3566626 - RNA, 12 nt, Human
caguaaaucuuu

SEQ ID NO: 3566627 - RNA, 15 nt, Human
caguaaaugggggug

SEQ ID NO: 3566628 - RNA, 18 nt, Human
caguaaaugggggugcau

SEQ ID NO: 3566629 - RNA, 21 nt, Human
caguaaaugggggugcauuug

SEQ ID NO: 3566630 - RNA, 14 nt, Human
caguaaauuugcua

SEQ ID NO: 3566631 - RNA, 15 nt, Human
caguaaauuugcuag

SEQ ID NO: 3566632 - RNA, 13 nt, Human
caguaacauagcu

SEQ ID NO: 3566633 - RNA, 21 nt, Human
caguaacccccuuaaauuuaa

SEQ ID NO: 3566634 - RNA, 14 nt, Human
caguaacucaucug

SEQ ID NO: 3566635 - RNA, 14 nt, Human
caguaacuugguua

SEQ ID NO: 3566636 - RNA, 16 nt, Human
caguaacuugguuaua

SEQ ID NO: 3566637 - RNA, 18 nt, Human
caguaacuugguuauaca

SEQ ID NO: 3566638 - RNA, 19 nt, Human
caguaacuugguuauacau

SEQ ID NO: 3566639 - RNA, 18 nt, Human
caguaacuuuauguguaa

SEQ ID NO: 3566640 - RNA, 15 nt, Human
caguaagggaaauag

SEQ ID NO: 3566641 - RNA, 18 nt, Human
caguaaguaucuggagga

SEQ ID NO: 3566642 - RNA, 21 nt, Human
caguaaguguuagagggaaca

SEQ ID NO: 3566643 - RNA, 17 nt, Human
caguaauaaaacaucuu

SEQ ID NO: 3566644 - RNA, 17 nt, Human
caguaauaaaugaaugu

SEQ ID NO: 3566645 - RNA, 23 nt, Human
caguaauaagaauggaaaagaga

SEQ ID NO: 3566646 - RNA, 13 nt, Human
caguaauauuuau

SEQ ID NO: 3566647 - RNA, 17 nt, Human
caguaauccuguaggaa

SEQ ID NO: 3566648 - RNA, 21 nt, Human
caguaauccuguaggaaggua

SEQ ID NO: 3566649 - RNA, 13 nt, Human
caguaauguuauu

SEQ ID NO: 3566650 - RNA, 16 nt, Human
caguaauugugaaaau

SEQ ID NO: 3566651 - RNA, 18 nt, Human
caguaauuguguuuacau

SEQ ID NO: 3566652 - RNA, 15 nt, Human
caguaauuuucggau

SEQ ID NO: 3566653 - RNA, 13 nt, Human
caguacaggcagc

SEQ ID NO: 3566654 - RNA, 14 nt, Human
caguacaggcagca

SEQ ID NO: 3566655 - RNA, 20 nt, Human
caguacaggcagcacagaga

SEQ ID NO: 3566656 - RNA, 19 nt, Human
caguacauucucaguuuuu

SEQ ID NO: 3566657 - RNA, 15 nt, Human
caguacauuuaaauu

SEQ ID NO: 3566658 - RNA, 20 nt, Human
caguacauuuaaauuuuuug

SEQ ID NO: 3566659 - RNA, 22 nt, Human
caguacauuuaaauuuuuuggc

SEQ ID NO: 3566660 - RNA, 13 nt, Human
caguacccaccug

SEQ ID NO: 3566661 - RNA, 16 nt, Human
caguacccaccugagc

SEQ ID NO: 3566662 - RNA, 17 nt, Human
caguacccaccugagcu

SEQ ID NO: 3566663 - RNA, 19 nt, Human
caguggggcucucugaguc

SEQ ID NO: 3566664 - RNA, 20 nt, Human
cagugggguuucgcagccug

SEQ ID NO: 3566665 - RNA, 21 nt, Human
cagugggguuucgcagccuga

SEQ ID NO: 3566666 - RNA, 22 nt, Human
cagugggguuucgcagccugag

SEQ ID NO: 3566667 - RNA, 16 nt, Human
caguggguaaaauuag

SEQ ID NO: 3566668 - RNA, 15 nt, Human
cagugggucccacuu

SEQ ID NO: 3566669 - RNA, 13 nt, Human
cagugggugcccc

SEQ ID NO: 3566670 - RNA, 17 nt, Human
cagugguaagcucuggc

SEQ ID NO: 3566671 - RNA, 20 nt, Human
cagugguaagcucuggcuuu

SEQ ID NO: 3566672 - RNA, 19 nt, Human
cagugguccauggaaugcu

SEQ ID NO: 3566673 - RNA, 23 nt, Human
caguggugaagaaaacuccuuua

SEQ ID NO: 3566674 - RNA, 21 nt, Human
caguggugcgaucuggguuca

SEQ ID NO: 3566675 - RNA, 12 nt, Human
cagugguggcag

SEQ ID NO: 3566676 - RNA, 16 nt, Human
cagugguggcagggcc

SEQ ID NO: 3566677 - RNA, 20 nt, Human
caguggugguuuucuguucu

SEQ ID NO: 3566678 - RNA, 21 nt, Human
caguggugguuuucuguucuu

SEQ ID NO: 3566679 - RNA, 22 nt, Human
cagugguucuacaaucuauuua

SEQ ID NO: 3566680 - RNA, 18 nt, Human
cagugguuugagacacug

SEQ ID NO: 3566681 - RNA, 20 nt, Human
cagugguuuuauacugaagg

SEQ ID NO: 3566682 - RNA, 21 nt, Human
cagugguuuuauacugaagga

SEQ ID NO: 3566683 - RNA, 19 nt, Human
caguguaaucccccaggag

SEQ ID NO: 3566684 - RNA, 12 nt, Human
caguguaauuuc

SEQ ID NO: 3566685 - RNA, 17 nt, Human
caguguaauuucuuugc

SEQ ID NO: 3566686 - RNA, 20 nt, Human
caguguaauuucuuugccug

SEQ ID NO: 3566687 - RNA, 12 nt, Human
caguguacaguc

SEQ ID NO: 3566688 - RNA, 17 nt, Human
caguguacagucuugua

SEQ ID NO: 3566689 - RNA, 19 nt, Human
caguguacauaguguaaug

SEQ ID NO: 3566690 - RNA, 16 nt, Human
caguguacauggaaua

SEQ ID NO: 3566691 - RNA, 20 nt, Human
caguguacccccgcccaggc

SEQ ID NO: 3566692 - RNA, 21 nt, Human
caguguacccccgcccaggcu

SEQ ID NO: 3566693 - RNA, 23 nt, Human
caguguacccccgcccaggcugg

SEQ ID NO: 3566694 - RNA, 20 nt, Human
caguguagauuuuauagugu

SEQ ID NO: 3566695 - RNA, 17 nt, Human
caguguaguuaauuuau

SEQ ID NO: 3566696 - RNA, 18 nt, Human
caguguauguagaagcau

SEQ ID NO: 3566697 - RNA, 16 nt, Human
caguguauuucaguuc

SEQ ID NO: 3566698 - RNA, 20 nt, Human
cagugucaaauaaacacugu

SEQ ID NO: 3566699 - RNA, 21 nt, Human
cagugucaaauaaacacugug

SEQ ID NO: 3566700 - RNA, 19 nt, Human
cagugucaaguugugcuug

SEQ ID NO: 3566701 - RNA, 16 nt, Human
cagugucaggcacugg

SEQ ID NO: 3566702 - RNA, 22 nt, Human
cagugucauuucucauccacau

SEQ ID NO: 3566703 - RNA, 13 nt, Human
cagugucauuugc

SEQ ID NO: 3566704 - RNA, 17 nt, Human
caguguccccuccacug

SEQ ID NO: 3566705 - RNA, 19 nt, Human
caguguccccuccacuguc

SEQ ID NO: 3566706 - RNA, 12 nt, Human
caguguccuccc

SEQ ID NO: 3566707 - RNA, 18 nt, Human
caguguccucuugcucaa

SEQ ID NO: 3566708 - RNA, 19 nt, Human
caguguccucuugcucaaa

SEQ ID NO: 3566709 - RNA, 18 nt, Human
caguguccugagcucagc

SEQ ID NO: 3566710 - RNA, 19 nt, Human
cagugucuauaaaagaaac

SEQ ID NO: 3566711 - RNA, 15 nt, Human
cagugucucacagcc

SEQ ID NO: 3566712 - RNA, 11 nt, Human
cagugucugcu

SEQ ID NO: 3566713 - RNA, 15 nt, Human
cagugucugggcuga

SEQ ID NO: 3566714 - RNA, 19 nt, Human
cagugucuguaaaagagcc

SEQ ID NO: 3566715 - RNA, 23 nt, Human
cagugucuguguuuugaaagaau

SEQ ID NO: 3566716 - RNA, 18 nt, Human
cagugucuuccauaaugu

SEQ ID NO: 3566717 - RNA, 16 nt, Human
cagugucuuccugugg

SEQ ID NO: 3566718 - RNA, 18 nt, Human
cagugucuuucuuuggug

SEQ ID NO: 3566719 - RNA, 22 nt, Human
cagugucuuucuuuggugccuu

SEQ ID NO: 3566720 - RNA, 21 nt, Human
cagugucuuuuuuuguauagu

SEQ ID NO: 3566721 - RNA, 23 nt, Human
cagugugaaguacaauaauucau

SEQ ID NO: 3566722 - RNA, 14 nt, Human
cagugugaaguuag

SEQ ID NO: 3566723 - RNA, 15 nt, Human
cagugugaaguuaga

SEQ ID NO: 3566724 - RNA, 20 nt, Human
cagugugaaguuagaauucc

SEQ ID NO: 3566725 - RNA, 18 nt, Human
cagugugaauaaagugcu

SEQ ID NO: 3566726 - RNA, 12 nt, Human
cagugugacuga

SEQ ID NO: 3566727 - RNA, 18 nt, Human
cagugugaggccagggca

SEQ ID NO: 3566728 - RNA, 19 nt, Human
cagugugagggaaagagcu

SEQ ID NO: 3566729 - RNA, 14 nt, Human
cagugugcaaggca

SEQ ID NO: 3566730 - RNA, 18 nt, Human
cagugugcaaggcagccg

SEQ ID NO: 3566731 - RNA, 18 nt, Human
cagugugcacgaguggga

SEQ ID NO: 3566732 - RNA, 19 nt, Human
cagugugcacuaaggggcc

SEQ ID NO: 3566733 - RNA, 13 nt, Human
cagugugcccccc

SEQ ID NO: 3566734 - RNA, 17 nt, Human
cagugugccccccaucc

SEQ ID NO: 3566735 - RNA, 19 nt, Human
cagugugccccccauccug

SEQ ID NO: 3566736 - RNA, 22 nt, Human
cagugugccccccauccuggcc

SEQ ID NO: 3566737 - RNA, 14 nt, Human
cagugugcugaugg

SEQ ID NO: 3566738 - RNA, 21 nt, Human
cagugugggaaugcggcaaga

SEQ ID NO: 3566739 - RNA, 23 nt, Human
cagugugggaaugcggcaagaag

SEQ ID NO: 3566740 - RNA, 13 nt, Human
cagugugucuccu

SEQ ID NO: 3566741 - RNA, 16 nt, Human
cagugugucuccugca

SEQ ID NO: 3566742 - RNA, 21 nt, Human
caguguguggcuuucagagcc

SEQ ID NO: 3566743 - RNA, 14 nt, Human
caguguuagcuuag

SEQ ID NO: 3566744 - RNA, 18 nt, Human
caguguuaggccuggcac

SEQ ID NO: 3566745 - RNA, 20 nt, Human
caguguuaggccuggcacag

SEQ ID NO: 3566746 - RNA, 22 nt, Human
caguguuaggccuggcacagug

SEQ ID NO: 3566747 - RNA, 19 nt, Human
caguguuagggaagggccu

SEQ ID NO: 3566748 - RNA, 19 nt, Human
caguguuccccaucugggu

SEQ ID NO: 3566749 - RNA, 16 nt, Human
caguguucgcuuggcu

SEQ ID NO: 3566750 - RNA, 18 nt, Human
caguguugagccuuuucc

SEQ ID NO: 3566751 - RNA, 14 nt, Human
caguguugucacca

SEQ ID NO: 3566752 - RNA, 22 nt, Human
caguguuguggauuuaacagaa

SEQ ID NO: 3566753 - RNA, 18 nt, Human
caguguuguuuguaaaua

SEQ ID NO: 3566754 - RNA, 20 nt, Human
caguguuguuuguaaauaag

SEQ ID NO: 3566755 - RNA, 21 nt, Human
caguguuguuuguaaauaaga

SEQ ID NO: 3566756 - RNA, 22 nt, Human
caguguuguuuguaaauaagag

SEQ ID NO: 3566757 - RNA, 18 nt, Human
caguguuuauccuuucau

SEQ ID NO: 3566758 - RNA, 18 nt, Human
caguguuucccauaauuu

SEQ ID NO: 3566759 - RNA, 14 nt, Human
caguguuucugggg

SEQ ID NO: 3566760 - RNA, 20 nt, Human
caguguuuuaaacucuccua

SEQ ID NO: 3566761 - RNA, 17 nt, Human
caguguuuuaaauucug

SEQ ID NO: 3566762 - RNA, 16 nt, Human
caguguuuuaggagca

SEQ ID NO: 3566763 - RNA, 20 nt, Human
caguguuuuaggagcaugag

SEQ ID NO: 3566764 - RNA, 15 nt, Human
caguguuuuuguaaa

SEQ ID NO: 3566765 - RNA, 19 nt, Human
caguguuuuuguaaagugu

SEQ ID NO: 3566766 - RNA, 21 nt, Human
caguguuuuuguaaagugugg

SEQ ID NO: 3566767 - RNA, 15 nt, Human
caguuaaaaaaaauu

SEQ ID NO: 3566768 - RNA, 19 nt, Human
caguuaacuuuaagacuga

SEQ ID NO: 3566769 - RNA, 20 nt, Human
caguuaacuuucagaagaga

SEQ ID NO: 3566770 - RNA, 16 nt, Human
caguuaagaaaaaaau

SEQ ID NO: 3566771 - RNA, 17 nt, Human
caguuaagaaaaaaaua

SEQ ID NO: 3566772 - RNA, 18 nt, Human
caguuaagaaaaaaauaa

SEQ ID NO: 3566773 - RNA, 19 nt, Human
caguuaagaaaaaaauaau

SEQ ID NO: 3566774 - RNA, 21 nt, Human
caguuaagaaaaaaauaauuu

SEQ ID NO: 3566775 - RNA, 15 nt, Human
caguuaagaaauuuc

SEQ ID NO: 3566776 - RNA, 20 nt, Human
caguuaaggaccguggcccu

SEQ ID NO: 3566777 - RNA, 12 nt, Human
caguuaaucuug

SEQ ID NO: 3566778 - RNA, 15 nt, Human
caguuaauuagcauu

SEQ ID NO: 3566779 - RNA, 21 nt, Human
caguuaauuagcauucuggca

SEQ ID NO: 3566780 - RNA, 14 nt, Human
caguuacaaauuau

SEQ ID NO: 3566781 - RNA, 18 nt, Human
caguuacaaauuauaaug

SEQ ID NO: 3566782 - RNA, 22 nt, Human
caguuacaugcauacuucaaaa

SEQ ID NO: 3566783 - RNA, 19 nt, Human
caguuacuaagaagaaaau

SEQ ID NO: 3566784 - RNA, 14 nt, Human
caguuacucagaau

SEQ ID NO: 3566785 - RNA, 13 nt, Human
caguuacucagcc

SEQ ID NO: 3566786 - RNA, 15 nt, Human
caguuacucagcccu

SEQ ID NO: 3566787 - RNA, 17 nt, Human
caguuacucagcccugg

SEQ ID NO: 3566788 - RNA, 19 nt, Human
caguuacucagcccugggc

SEQ ID NO: 3566789 - RNA, 23 nt, Human
caguuacuuuccaauucuccuuu

SEQ ID NO: 3566790 - RNA, 13 nt, Human
caguuagacuagu

SEQ ID NO: 3566791 - RNA, 18 nt, Human
caguuagagaugccuccc

SEQ ID NO: 3566792 - RNA, 15 nt, Human
caguuauauuuugca

SEQ ID NO: 3566793 - RNA, 13 nt, Human
caguuauggcuau

SEQ ID NO: 3566794 - RNA, 19 nt, Human
caguuauggcuauaggugc

SEQ ID NO: 3566795 - RNA, 16 nt, Human
caguuauguucaguca

SEQ ID NO: 3566796 - RNA, 18 nt, Human
caguuauuacauguaauu

SEQ ID NO: 3566797 - RNA, 21 nt, Human
caguuauuauauuuacaaaug

SEQ ID NO: 3566798 - RNA, 17 nt, Human
caguuauucauucugug

SEQ ID NO: 3566799 - RNA, 20 nt, Human
caguuauugucccuggcuuc

SEQ ID NO: 3566800 - RNA, 15 nt, Human
caguucaaagcagga

SEQ ID NO: 3566801 - RNA, 13 nt, Human
caguucaaaguca

SEQ ID NO: 3566802 - RNA, 22 nt, Human
caguucaaagucaugauguuuu

SEQ ID NO: 3566803 - RNA, 14 nt, Human
caguucaagaaagc

SEQ ID NO: 3566804 - RNA, 13 nt, Human
caguucacacccu

SEQ ID NO: 3566805 - RNA, 14 nt, Human
caguucacacccug

SEQ ID NO: 3566806 - RNA, 14 nt, Human
cauggcccugggcg

SEQ ID NO: 3566807 - RNA, 14 nt, Human
cauggcccugugcu

SEQ ID NO: 3566808 - RNA, 17 nt, Human
cauggccggcuuucagg

SEQ ID NO: 3566809 - RNA, 19 nt, Human
cauggccggcuuucaggag

SEQ ID NO: 3566810 - RNA, 20 nt, Human
cauggccugcaaacugggaa

SEQ ID NO: 3566811 - RNA, 19 nt, Human
cauggccuuugcuugaaag

SEQ ID NO: 3566812 - RNA, 22 nt, Human
cauggcguagagggugcugccc

SEQ ID NO: 3566813 - RNA, 19 nt, Human
cauggcgugucccucucgg

SEQ ID NO: 3566814 - RNA, 16 nt, Human
cauggcuaagcuuuau

SEQ ID NO: 3566815 - RNA, 19 nt, Human
cauggcuaaggcaccagcc

SEQ ID NO: 3566816 - RNA, 18 nt, Human
cauggcuacuugcuuuga

SEQ ID NO: 3566817 - RNA, 12 nt, Human
cauggcuaucug

SEQ ID NO: 3566818 - RNA, 14 nt, Human
cauggcuauuuuau

SEQ ID NO: 3566819 - RNA, 15 nt, Human
cauggcucacugcag

SEQ ID NO: 3566820 - RNA, 16 nt, Human
cauggcucacugcagc

SEQ ID NO: 3566821 - RNA, 17 nt, Human
cauggcuccagaaaugu

SEQ ID NO: 3566822 - RNA, 13 nt, Human
cauggcuccaguc

SEQ ID NO: 3566823 - RNA, 14 nt, Human
cauggcuccagucu

SEQ ID NO: 3566824 - RNA, 17 nt, Human
cauggcuccggccucug

SEQ ID NO: 3566825 - RNA, 20 nt, Human
cauggcugagcugcccacag

SEQ ID NO: 3566826 - RNA, 16 nt, Human
cauggcugcacaguug

SEQ ID NO: 3566827 - RNA, 14 nt, Human
cauggcugugagga

SEQ ID NO: 3566828 - RNA, 17 nt, Human
cauggcuguguuugcag

SEQ ID NO: 3566829 - RNA, 15 nt, Human
cauggcuuaauguuu

SEQ ID NO: 3566830 - RNA, 15 nt, Human
cauggcuuccuccuc

SEQ ID NO: 3566831 - RNA, 18 nt, Human
cauggcuuucagaaaacg

SEQ ID NO: 3566832 - RNA, 21 nt, Human
caugggaaaggaggcaugccu

SEQ ID NO: 3566833 - RNA, 21 nt, Human
caugggaaaguauucucuuuu

SEQ ID NO: 3566834 - RNA, 20 nt, Human
caugggaagacgaggcccuc

SEQ ID NO: 3566835 - RNA, 17 nt, Human
caugggaaugaauguca

SEQ ID NO: 3566836 - RNA, 22 nt, Human
caugggaaugaaugucagugug

SEQ ID NO: 3566837 - RNA, 16 nt, Human
caugggacagggagga

SEQ ID NO: 3566838 - RNA, 17 nt, Human
caugggacagggaggac

SEQ ID NO: 3566839 - RNA, 18 nt, Human
caugggacagggaggacg

SEQ ID NO: 3566840 - RNA, 23 nt, Human
caugggacagggaggacgcucuc

SEQ ID NO: 3566841 - RNA, 20 nt, Human
caugggagcaguccaugcau

SEQ ID NO: 3566842 - RNA, 22 nt, Human
caugggagccgggucugccucu

SEQ ID NO: 3566843 - RNA, 14 nt, Human
caugggagggagcu

SEQ ID NO: 3566844 - RNA, 22 nt, Human
caugggagggggcuugaagcca

SEQ ID NO: 3566845 - RNA, 18 nt, Human
caugggauaaaugccauc

SEQ ID NO: 3566846 - RNA, 23 nt, Human
caugggauaaaugccaucaauaa

SEQ ID NO: 3566847 - RNA, 16 nt, Human
caugggauacaaccuc

SEQ ID NO: 3566848 - RNA, 13 nt, Human
caugggcacugcu

SEQ ID NO: 3566849 - RNA, 18 nt, Human
caugggcacugcugggug

SEQ ID NO: 3566850 - RNA, 17 nt, Human
caugggcagagcccaag

SEQ ID NO: 3566851 - RNA, 14 nt, Human
caugggccaccacg

SEQ ID NO: 3566852 - RNA, 14 nt, Human
caugggccagcccc

SEQ ID NO: 3566853 - RNA, 15 nt, Human
caugggccagccccu

SEQ ID NO: 3566854 - RNA, 21 nt, Human
caugggccagccccuccaucu

SEQ ID NO: 3566855 - RNA, 20 nt, Human
caugggccccaggggaacac

SEQ ID NO: 3566856 - RNA, 21 nt, Human
caugggcuucacuguauaaau

SEQ ID NO: 3566857 - RNA, 15 nt, Human
cauggggaaaaaaau

SEQ ID NO: 3566858 - RNA, 12 nt, Human
cauggggaggag

SEQ ID NO: 3566859 - RNA, 19 nt, Human
cauggggaggaggaggguc

SEQ ID NO: 3566860 - RNA, 17 nt, Human
cauggggcugggcagcu

SEQ ID NO: 3566861 - RNA, 17 nt, Human
caugggggagggggcag

SEQ ID NO: 3566862 - RNA, 13 nt, Human
caugggggcaggg

SEQ ID NO: 3566863 - RNA, 20 nt, Human
cauggggggagcacccugag

SEQ ID NO: 3566864 - RNA, 16 nt, Human
cauggggucucucaca

SEQ ID NO: 3566865 - RNA, 19 nt, Human
cauggggugaugcugggcu

SEQ ID NO: 3566866 - RNA, 15 nt, Human
cauggggugggccuc

SEQ ID NO: 3566867 - RNA, 17 nt, Human
cauggggugggccucug

SEQ ID NO: 3566868 - RNA, 18 nt, Human
cauggggugggccucugg

SEQ ID NO: 3566869 - RNA, 19 nt, Human
cauggguagcuucugaccu

SEQ ID NO: 3566870 - RNA, 23 nt, Human
cauggguagcuucugaccucagc

SEQ ID NO: 3566871 - RNA, 20 nt, Human
cauggguauaguucaugucu

SEQ ID NO: 3566872 - RNA, 21 nt, Human
caugggucgcccaugagagcg

SEQ ID NO: 3566873 - RNA, 14 nt, Human
caugguaccagccc

SEQ ID NO: 3566874 - RNA, 17 nt, Human
caugguaccagcccugg

SEQ ID NO: 3566875 - RNA, 20 nt, Human
caugguagagaaucucuccc

SEQ ID NO: 3566876 - RNA, 14 nt, Human
caugguauuugaga

SEQ ID NO: 3566877 - RNA, 16 nt, Human
cauggucagcccuagg

SEQ ID NO: 3566878 - RNA, 19 nt, Human
cauggucagcccuagggug

SEQ ID NO: 3566879 - RNA, 15 nt, Human
cauggucccacaucc

SEQ ID NO: 3566880 - RNA, 23 nt, Human
cauggucccacaucccugggccu

SEQ ID NO: 3566881 - RNA, 15 nt, Human
caugguccccauggc

SEQ ID NO: 3566882 - RNA, 16 nt, Human
cauggucggaaaacau

SEQ ID NO: 3566883 - RNA, 19 nt, Human
cauggugcaguugacagca

SEQ ID NO: 3566884 - RNA, 22 nt, Human
cauggugccccaggaccagcuc

SEQ ID NO: 3566885 - RNA, 22 nt, Human
cauggugccugagaggcaggca

SEQ ID NO: 3566886 - RNA, 17 nt, Human
cauggugcuaggaagag

SEQ ID NO: 3566887 - RNA, 19 nt, Human
cauggugcuuguuaaugcu

SEQ ID NO: 3566888 - RNA, 16 nt, Human
caugguggacccagcg

SEQ ID NO: 3566889 - RNA, 22 nt, Human
caugguggacccagcgggcagg

SEQ ID NO: 3566890 - RNA, 23 nt, Human
caugguggcaccagcgaagggag

SEQ ID NO: 3566891 - RNA, 20 nt, Human
caugguggcaugcaccugca

SEQ ID NO: 3566892 - RNA, 17 nt, Human
caugguggcgcaagccu

SEQ ID NO: 3566893 - RNA, 20 nt, Human
caugguggggucuccucagg

SEQ ID NO: 3566894 - RNA, 18 nt, Human
caugguguaauaagacau

SEQ ID NO: 3566895 - RNA, 22 nt, Human
caugguguaauaagacauaacg

SEQ ID NO: 3566896 - RNA, 16 nt, Human
caugguguccagacag

SEQ ID NO: 3566897 - RNA, 15 nt, Human
caugguguguuacac

SEQ ID NO: 3566898 - RNA, 16 nt, Human
caugguguucuccugc

SEQ ID NO: 3566899 - RNA, 19 nt, Human
caugguguucuccugcugc

SEQ ID NO: 3566900 - RNA, 21 nt, Human
caugguuacaaucauugcuga

SEQ ID NO: 3566901 - RNA, 17 nt, Human
caugguuaccaugucuu

SEQ ID NO: 3566902 - RNA, 18 nt, Human
caugguuaccaugucuuu

SEQ ID NO: 3566903 - RNA, 19 nt, Human
caugguuaccaugucuuuc

SEQ ID NO: 3566904 - RNA, 14 nt, Human
caugguugagaaau

SEQ ID NO: 3566905 - RNA, 18 nt, Human
caugguuuaaaagaaaaa

SEQ ID NO: 3566906 - RNA, 22 nt, Human
caugguuuaaaagaaaaaauga

SEQ ID NO: 3566907 - RNA, 16 nt, Human
caugguuucagcacua

SEQ ID NO: 3566908 - RNA, 20 nt, Human
caugguuuugugccaucugu

SEQ ID NO: 3566909 - RNA, 24 nt, Human
caugguuuugugccaucuguagcu

SEQ ID NO: 3566910 - RNA, 12 nt, Human
cauguaaaacaa

SEQ ID NO: 3566911 - RNA, 16 nt, Human
cauguaaaacaaaaaa

SEQ ID NO: 3566912 - RNA, 14 nt, Human
cauguaaaagccua

SEQ ID NO: 3566913 - RNA, 16 nt, Human
cauguaaaagcggaaa

SEQ ID NO: 3566914 - RNA, 20 nt, Human
cauguaaagcaguauuaaaa

SEQ ID NO: 3566915 - RNA, 15 nt, Human
cauguaaauguaaac

SEQ ID NO: 3566916 - RNA, 16 nt, Human
cauguaaauguaaacu

SEQ ID NO: 3566917 - RNA, 16 nt, Human
cauguaaauuuuguau

SEQ ID NO: 3566918 - RNA, 14 nt, Human
cauguaacaauguu

SEQ ID NO: 3566919 - RNA, 14 nt, Human
cauguaacagaaag

SEQ ID NO: 3566920 - RNA, 22 nt, Human
cauguaaccggcauguuuccag

SEQ ID NO: 3566921 - RNA, 19 nt, Human
cauguaacugccuagaaac

SEQ ID NO: 3566922 - RNA, 17 nt, Human
cauguaagcugaaaaua

SEQ ID NO: 3566923 - RNA, 14 nt, Human
cauguaauccucaa

SEQ ID NO: 3566924 - RNA, 21 nt, Human
cauguaaugguaucuuaaagu

SEQ ID NO: 3566925 - RNA, 23 nt, Human
cauguaauguuaauguuauauca

SEQ ID NO: 3566926 - RNA, 18 nt, Human
cauguaauuuguguaaau

SEQ ID NO: 3566927 - RNA, 15 nt, Human
cauguacaaaaccau

SEQ ID NO: 3566928 - RNA, 14 nt, Human
cauguacagacaga

SEQ ID NO: 3566929 - RNA, 16 nt, Human
cauguacagacagaga

SEQ ID NO: 3566930 - RNA, 10 nt, Human
cauguacagu

SEQ ID NO: 3566931 - RNA, 11 nt, Human
cauguacagug

SEQ ID NO: 3566932 - RNA, 20 nt, Human
cauguacaguguucuguuua

SEQ ID NO: 3566933 - RNA, 21 nt, Human
cauguacaguguucuguuuaa

SEQ ID NO: 3566934 - RNA, 14 nt, Human
cauguaccuccccu

SEQ ID NO: 3566935 - RNA, 18 nt, Human
cauguaccuccccugccu

SEQ ID NO: 3566936 - RNA, 14 nt, Human
cauguacuaucuua

SEQ ID NO: 3566937 - RNA, 20 nt, Human
cauguagaaaauuuguuauu

SEQ ID NO: 3566938 - RNA, 13 nt, Human
cauguagaagcug

SEQ ID NO: 3566939 - RNA, 19 nt, Human
cauguagagaaaagcacac

SEQ ID NO: 3566940 - RNA, 14 nt, Human
cauguagcaggacu

SEQ ID NO: 3566941 - RNA, 17 nt, Human
cauguagcccccuggcc

SEQ ID NO: 3566942 - RNA, 16 nt, Human
cauguaggacccugca

SEQ ID NO: 3566943 - RNA, 17 nt, Human
cauguaguaacacuaau

SEQ ID NO: 3566944 - RNA, 21 nt, Human
cauguaguaacacuaauauau

SEQ ID NO: 3566945 - RNA, 16 nt, Human
cauguaguaucaaaua

SEQ ID NO: 3566946 - RNA, 21 nt, Human
cauguaguaucaaauauuaga

SEQ ID NO: 3566947 - RNA, 14 nt, Human
cauguauaaaugaa

SEQ ID NO: 3566948 - RNA, 18 nt, Human
cauguauaaaugaaguuu

SEQ ID NO: 3566949 - RNA, 23 nt, Human
cauguauaaaugaaguuuauaca

SEQ ID NO: 3566950 - RNA, 19 nt, Human
cauucucaguuuuucuuaa

SEQ ID NO: 3566951 - RNA, 19 nt, Human
cauucucauaauuccuaca

SEQ ID NO: 3566952 - RNA, 21 nt, Human
cauucucauaauuccuacagc

SEQ ID NO: 3566953 - RNA, 15 nt, Human
cauucucaucugcac

SEQ ID NO: 3566954 - RNA, 22 nt, Human
cauucucauuggaaauuuagca

SEQ ID NO: 3566955 - RNA, 15 nt, Human
cauucuccacagcaa

SEQ ID NO: 3566956 - RNA, 17 nt, Human
cauucuccacagcaacc

SEQ ID NO: 3566957 - RNA, 18 nt, Human
cauucuccacagcaaccc

SEQ ID NO: 3566958 - RNA, 16 nt, Human
cauucuccaccugcca

SEQ ID NO: 3566959 - RNA, 21 nt, Human
cauucuccaccugccagggac

SEQ ID NO: 3566960 - RNA, 11 nt, Human
cauucuccugc

SEQ ID NO: 3566961 - RNA, 20 nt, Human
cauucuccuuagcuucuggc

SEQ ID NO: 3566962 - RNA, 20 nt, Human
cauucuccuuguguuacuaa

SEQ ID NO: 3566963 - RNA, 17 nt, Human
cauucucgcuucccuga

SEQ ID NO: 3566964 - RNA, 19 nt, Human
cauucucgugagucauuua

SEQ ID NO: 3566965 - RNA, 23 nt, Human
cauucucgugagucauuuaaaug

SEQ ID NO: 3566966 - RNA, 22 nt, Human
cauucucuccauuucacuggcu

SEQ ID NO: 3566967 - RNA, 18 nt, Human
cauucucucuccugucca

SEQ ID NO: 3566968 - RNA, 13 nt, Human
cauucugaaugcu

SEQ ID NO: 3566969 - RNA, 16 nt, Human
cauucugaaugcuucu

SEQ ID NO: 3566970 - RNA, 21 nt, Human
cauucugacucgguuucucca

SEQ ID NO: 3566971 - RNA, 15 nt, Human
cauucugaugagcaa

SEQ ID NO: 3566972 - RNA, 23 nt, Human
cauucugauucgaaugacacugu

SEQ ID NO: 3566973 - RNA, 17 nt, Human
cauucugcaaguauacu

SEQ ID NO: 3566974 - RNA, 18 nt, Human
cauucugcauugcuagau

SEQ ID NO: 3566975 - RNA, 22 nt, Human
cauucugccgcccccuccugaa

SEQ ID NO: 3566976 - RNA, 23 nt, Human
cauucugccgcccccuccugaac

SEQ ID NO: 3566977 - RNA, 12 nt, Human
cauucugccugc

SEQ ID NO: 3566978 - RNA, 13 nt, Human
cauucugccugcc

SEQ ID NO: 3566979 - RNA, 18 nt, Human
cauucugccugcccaggc

SEQ ID NO: 3566980 - RNA, 16 nt, Human
cauucugcuccuuccc

SEQ ID NO: 3566981 - RNA, 12 nt, Human
cauucuggaagu

SEQ ID NO: 3566982 - RNA, 16 nt, Human
cauucuggaccucugg

SEQ ID NO: 3566983 - RNA, 17 nt, Human
cauucuggaccucuggg

SEQ ID NO: 3566984 - RNA, 23 nt, Human
cauucuggucaagggcugucauu

SEQ ID NO: 3566985 - RNA, 22 nt, Human
cauucugucgccuuagcauguu

SEQ ID NO: 3566986 - RNA, 12 nt, Human
cauucuuacuua

SEQ ID NO: 3566987 - RNA, 23 nt, Human
cauucuuacuuacuaaaauauau

SEQ ID NO: 3566988 - RNA, 15 nt, Human
cauucuuagccugug

SEQ ID NO: 3566989 - RNA, 22 nt, Human
cauucuuagccuguggcaguaa

SEQ ID NO: 3566990 - RNA, 21 nt, Human
cauucuuauuucaugaaaauu

SEQ ID NO: 3566991 - RNA, 13 nt, Human
cauucuucaagau

SEQ ID NO: 3566992 - RNA, 22 nt, Human
cauucuucugaucacugaaaua

SEQ ID NO: 3566993 - RNA, 17 nt, Human
cauucuugguuggcugg

SEQ ID NO: 3566994 - RNA, 19 nt, Human
cauucuuguaaggcuuuga

SEQ ID NO: 3566995 - RNA, 19 nt, Human
cauucuugucacaauaaau

SEQ ID NO: 3566996 - RNA, 12 nt, Human
cauucuuuccca

SEQ ID NO: 3566997 - RNA, 13 nt, Human
cauucuuugcuug

SEQ ID NO: 3566998 - RNA, 15 nt, Human
cauucuuugcuugaa

SEQ ID NO: 3566999 - RNA, 15 nt, Human
cauucuuuuguaauu

SEQ ID NO: 3567000 - RNA, 18 nt, Human
cauucuuuuguaauuuaa

SEQ ID NO: 3567001 - RNA, 16 nt, Human
cauucuuuuuuucuug

SEQ ID NO: 3567002 - RNA, 17 nt, Human
cauucuuuuuuucuugg

SEQ ID NO: 3567003 - RNA, 18 nt, Human
cauucuuuuuuucuuggc

SEQ ID NO: 3567004 - RNA, 17 nt, Human
cauugaaaaauguccac

SEQ ID NO: 3567005 - RNA, 22 nt, Human
cauugaaaucuaggaaaauuau

SEQ ID NO: 3567006 - RNA, 20 nt, Human
cauugaaaugagcaccucca

SEQ ID NO: 3567007 - RNA, 11 nt, Human
cauugaaaugu

SEQ ID NO: 3567008 - RNA, 14 nt, Human
cauugaacagcaaa

SEQ ID NO: 3567009 - RNA, 15 nt, Human
cauugaacucugaga

SEQ ID NO: 3567010 - RNA, 14 nt, Human
cauugaagagagag

SEQ ID NO: 3567011 - RNA, 14 nt, Human
cauugaaggccugg

SEQ ID NO: 3567012 - RNA, 14 nt, Human
cauugaauuagaaa

SEQ ID NO: 3567013 - RNA, 23 nt, Human
cauugaauucuugguugaggaaa

SEQ ID NO: 3567014 - RNA, 13 nt, Human
cauugacaaaucu

SEQ ID NO: 3567015 - RNA, 16 nt, Human
cauugacaagaacuga

SEQ ID NO: 3567016 - RNA, 14 nt, Human
cauugacagauuga

SEQ ID NO: 3567017 - RNA, 15 nt, Human
cauugacauguacag

SEQ ID NO: 3567018 - RNA, 19 nt, Human
cauugacauguacagagaa

SEQ ID NO: 3567019 - RNA, 19 nt, Human
cauugaccaagaacugcau

SEQ ID NO: 3567020 - RNA, 15 nt, Human
cauugaccugaggcc

SEQ ID NO: 3567021 - RNA, 18 nt, Human
cauugaccugaggcccuu

SEQ ID NO: 3567022 - RNA, 23 nt, Human
cauugacgauuccuucucugaac

SEQ ID NO: 3567023 - RNA, 18 nt, Human
cauugacuaucaaacuga

SEQ ID NO: 3567024 - RNA, 22 nt, Human
cauugacugguuuacaggcccu

SEQ ID NO: 3567025 - RNA, 20 nt, Human
cauugacuuucaguaaacau

SEQ ID NO: 3567026 - RNA, 18 nt, Human
cauugagaguuuugucuu

SEQ ID NO: 3567027 - RNA, 9 nt, Human
cauugagua

SEQ ID NO: 3567028 - RNA, 15 nt, Human
cauugaguaauauag

SEQ ID NO: 3567029 - RNA, 13 nt, Human
cauugaguagaca

SEQ ID NO: 3567030 - RNA, 23 nt, Human
cauugaguagacacauuuaagga

SEQ ID NO: 3567031 - RNA, 15 nt, Human
cauugaguauuguuu

SEQ ID NO: 3567032 - RNA, 18 nt, Human
cauugaguauuguuuaaa

SEQ ID NO: 3567033 - RNA, 22 nt, Human
cauugaguauuguuuaaaaugu

SEQ ID NO: 3567034 - RNA, 18 nt, Human
cauugaguugguuacuuc

SEQ ID NO: 3567035 - RNA, 19 nt, Human
cauugauaugaaaaauaug

SEQ ID NO: 3567036 - RNA, 19 nt, Human
cauugauauuugugcauuu

SEQ ID NO: 3567037 - RNA, 12 nt, Human
cauugaugcuga

SEQ ID NO: 3567038 - RNA, 15 nt, Human
cauugauucagccug

SEQ ID NO: 3567039 - RNA, 16 nt, Human
cauugauugucagcua

SEQ ID NO: 3567040 - RNA, 14 nt, Human
cauugauuuccugu

SEQ ID NO: 3567041 - RNA, 13 nt, Human
cauugcaauagaa

SEQ ID NO: 3567042 - RNA, 15 nt, Human
cauugcaauagaaau

SEQ ID NO: 3567043 - RNA, 16 nt, Human
cauugcacccagccca

SEQ ID NO: 3567044 - RNA, 18 nt, Human
cauugcacuccagccugg

SEQ ID NO: 3567045 - RNA, 16 nt, Human
cauugcagaauaaugu

SEQ ID NO: 3567046 - RNA, 18 nt, Human
cauugcagucugcuucug

SEQ ID NO: 3567047 - RNA, 12 nt, Human
cauugcaguuua

SEQ ID NO: 3567048 - RNA, 16 nt, Human
cauugcaucaaagcau

SEQ ID NO: 3567049 - RNA, 22 nt, Human
cauugcaucaccucuguaauuu

SEQ ID NO: 3567050 - RNA, 15 nt, Human
cauugccaaaaagga

SEQ ID NO: 3567051 - RNA, 15 nt, Human
cauugccaagggcuu

SEQ ID NO: 3567052 - RNA, 16 nt, Human
cauugccaccaggaga

SEQ ID NO: 3567053 - RNA, 14 nt, Human
cauugcccagucuu

SEQ ID NO: 3567054 - RNA, 17 nt, Human
cauugcccagucuuuca

SEQ ID NO: 3567055 - RNA, 22 nt, Human
cauugccccaaauggauuccug

SEQ ID NO: 3567056 - RNA, 13 nt, Human
cauugccuauuuc

SEQ ID NO: 3567057 - RNA, 23 nt, Human
cauugccugauuuguuccuucug

SEQ ID NO: 3567058 - RNA, 11 nt, Human
cauugccuggc

SEQ ID NO: 3567059 - RNA, 13 nt, Human
cauugccuuuucu

SEQ ID NO: 3567060 - RNA, 14 nt, Human
cauugcggacagcc

SEQ ID NO: 3567061 - RNA, 15 nt, Human
cauugcggacagcca

SEQ ID NO: 3567062 - RNA, 21 nt, Human
cauugcggacagccacggcca

SEQ ID NO: 3567063 - RNA, 15 nt, Human
cauugcuaagaugcu

SEQ ID NO: 3567064 - RNA, 16 nt, Human
cauugcuaagaugcuc

SEQ ID NO: 3567065 - RNA, 16 nt, Human
cauugcugaaaauggu

SEQ ID NO: 3567066 - RNA, 13 nt, Human
cauugcugcuccu

SEQ ID NO: 3567067 - RNA, 18 nt, Human
cauugcugcuccuuagcu

SEQ ID NO: 3567068 - RNA, 20 nt, Human
cauugcugcuccuuagcugc

SEQ ID NO: 3567069 - RNA, 20 nt, Human
cauugcuggucuuguaagag

SEQ ID NO: 3567070 - RNA, 14 nt, Human
cauugcuguaggau

SEQ ID NO: 3567071 - RNA, 22 nt, Human
cauugcuguuaugucuguuuaa

SEQ ID NO: 3567072 - RNA, 19 nt, Human
cauugcuguuguccaacua

SEQ ID NO: 3567073 - RNA, 17 nt, Human
cauugcuuacacggaug

SEQ ID NO: 3567074 - RNA, 11 nt, Human
cauugcuucac

SEQ ID NO: 3567075 - RNA, 15 nt, Human
cauugcuucacaacc

SEQ ID NO: 3567076 - RNA, 20 nt, Human
cauugcuucacaacccaucu

SEQ ID NO: 3567077 - RNA, 17 nt, Human
cauugcuucacuaccca

SEQ ID NO: 3567078 - RNA, 15 nt, Human
cauugcuucuucuga

SEQ ID NO: 3567079 - RNA, 19 nt, Human
cauugcuuucguguaaauu

SEQ ID NO: 3567080 - RNA, 14 nt, Human
cauugcuuucugaa

SEQ ID NO: 3567081 - RNA, 15 nt, Human
cauugcuuucugaaa

SEQ ID NO: 3567082 - RNA, 16 nt, Human
cauugcuuugaagcag

SEQ ID NO: 3567083 - RNA, 22 nt, Human
cauugcuuugaagcaguugugu

SEQ ID NO: 3567084 - RNA, 19 nt, Human
cauugcuuuuauuuugaaa

SEQ ID NO: 3567085 - RNA, 20 nt, Human
cauugcuuuuauuuugaaaa

SEQ ID NO: 3567086 - RNA, 14 nt, Human
cauuggaaauuuca

SEQ ID NO: 3567087 - RNA, 15 nt, Human
cauuggaacuggagg

SEQ ID NO: 3567088 - RNA, 19 nt, Human
cauuggaagagcagcaccu

SEQ ID NO: 3567089 - RNA, 21 nt, Human
cauuggaagcagguuaaaugu

SEQ ID NO: 3567090 - RNA, 18 nt, Human
cauuggacccacaugagg

SEQ ID NO: 3567091 - RNA, 16 nt, Human
cauuggacccuuccau

SEQ ID NO: 3567092 - RNA, 20 nt, Human
cauuggcagcaggugcugcu

SEQ ID NO: 3567093 - RNA, 23 nt, Human
cauuggcagcaggugcugcuacc

SEQ ID NO: 3567094 - RNA, 24 nt, Human
cauuggcagcaggugcugcuaccc

SEQ ID NO: 3567095 - RNA, 14 nt, Human
aucuguaugauucu

SEQ ID NO: 3567096 - RNA, 15 nt, Human
aucuguaugauucua

SEQ ID NO: 3567097 - RNA, 19 nt, Human
aucuguaugauucuaugga

SEQ ID NO: 3567098 - RNA, 15 nt, Human
aucuguauuuaauuu

SEQ ID NO: 3567099 - RNA, 16 nt, Human
aucugucaaaacacug

SEQ ID NO: 3567100 - RNA, 17 nt, Human
aucugucacaccagcca

SEQ ID NO: 3567101 - RNA, 12 nt, Human
aucugucaguuc

SEQ ID NO: 3567102 - RNA, 21 nt, Human
aucuguccaaaggaggcuggc

SEQ ID NO: 3567103 - RNA, 14 nt, Human
aucuguccucagcc

SEQ ID NO: 3567104 - RNA, 15 nt, Human
aucuguccucagccu

SEQ ID NO: 3567105 - RNA, 17 nt, Human
aucuguccucagccuug

SEQ ID NO: 3567106 - RNA, 21 nt, Human
aucuguccucagccuugccag

SEQ ID NO: 3567107 - RNA, 13 nt, Human
aucugucuaaaga

SEQ ID NO: 3567108 - RNA, 14 nt, Human
aucugucuggaggg

SEQ ID NO: 3567109 - RNA, 15 nt, Human
aucugucuggagggg

SEQ ID NO: 3567110 - RNA, 22 nt, Human
aucugucuggaggggagcucug

SEQ ID NO: 3567111 - RNA, 19 nt, Human
aucugucuguggcaaaagu

SEQ ID NO: 3567112 - RNA, 22 nt, Human
aucugucuguggcaaaaguuua

SEQ ID NO: 3567113 - RNA, 12 nt, Human
aucugucuugua

SEQ ID NO: 3567114 - RNA, 11 nt, Human
aucugucuuuc

SEQ ID NO: 3567115 - RNA, 17 nt, Human
aucugugaaaggaaaga

SEQ ID NO: 3567116 - RNA, 13 nt, Human
aucugugaacuug

SEQ ID NO: 3567117 - RNA, 17 nt, Human
aucugugaacuugaaau

SEQ ID NO: 3567118 - RNA, 17 nt, Human
aucugugaauucagauu

SEQ ID NO: 3567119 - RNA, 21 nt, Human
aucugugaggggcucucucau

SEQ ID NO: 3567120 - RNA, 19 nt, Human
aucugugaugacauucccu

SEQ ID NO: 3567121 - RNA, 12 nt, Human
aucugugaugau

SEQ ID NO: 3567122 - RNA, 14 nt, Human
aucugugcccagag

SEQ ID NO: 3567123 - RNA, 17 nt, Human
aucugugcgugaaacac

SEQ ID NO: 3567124 - RNA, 19 nt, Human
aucugugcgugaaacacac

SEQ ID NO: 3567125 - RNA, 19 nt, Human
aucugugcucaggacucag

SEQ ID NO: 3567126 - RNA, 17 nt, Human
aucugugcuuuccagcu

SEQ ID NO: 3567127 - RNA, 18 nt, Human
aucugugcuuuccagcuc

SEQ ID NO: 3567128 - RNA, 19 nt, Human
aucugugggcauggucaaa

SEQ ID NO: 3567129 - RNA, 17 nt, Human
aucuguguacaaagaaa

SEQ ID NO: 3567130 - RNA, 22 nt, Human
aucuguguacaaagaaauaaca

SEQ ID NO: 3567131 - RNA, 21 nt, Human
aucuguguauauuauuuggca

SEQ ID NO: 3567132 - RNA, 17 nt, Human
aucuguuagaugcuacu

SEQ ID NO: 3567133 - RNA, 19 nt, Human
aucuguuagaugcuacuaa

SEQ ID NO: 3567134 - RNA, 15 nt, Human
aucuguuagggccuu

SEQ ID NO: 3567135 - RNA, 16 nt, Human
aucuguuagggccuug

SEQ ID NO: 3567136 - RNA, 17 nt, Human
aucuguuagggccuugg

SEQ ID NO: 3567137 - RNA, 16 nt, Human
aucuguucuaacaugu

SEQ ID NO: 3567138 - RNA, 15 nt, Human
aucuguuguuuuguu

SEQ ID NO: 3567139 - RNA, 14 nt, Human
aucuguuuaaagca

SEQ ID NO: 3567140 - RNA, 22 nt, Human
aucuguuuaaagcauauagaga

SEQ ID NO: 3567141 - RNA, 24 nt, Human
aucuguuuaaagcauauagagaug

SEQ ID NO: 3567142 - RNA, 15 nt, Human
aucuguuuacagugu

SEQ ID NO: 3567143 - RNA, 16 nt, Human
aucuguuuauuuacaa

SEQ ID NO: 3567144 - RNA, 22 nt, Human
aucuguuuuaaauuuauuucaa

SEQ ID NO: 3567145 - RNA, 14 nt, Human
aucuguuuuacugc

SEQ ID NO: 3567146 - RNA, 17 nt, Human
aucuguuuuacugcuuu

SEQ ID NO: 3567147 - RNA, 18 nt, Human
aucuguuuuacugcuuuu

SEQ ID NO: 3567148 - RNA, 17 nt, Human
aucuguuuugaaggcaa

SEQ ID NO: 3567149 - RNA, 19 nt, Human
aucuuaaaccuuaagauac

SEQ ID NO: 3567150 - RNA, 21 nt, Human
aucuuaaagaaacagcuuuca

SEQ ID NO: 3567151 - RNA, 13 nt, Human
aucuuaacucuuu

SEQ ID NO: 3567152 - RNA, 16 nt, Human
aucuuaaggggcagcu

SEQ ID NO: 3567153 - RNA, 15 nt, Human
aucuuaauacuguua

SEQ ID NO: 3567154 - RNA, 18 nt, Human
aucuuaauacuguuauuc

SEQ ID NO: 3567155 - RNA, 14 nt, Human
aucuuaauauauuu

SEQ ID NO: 3567156 - RNA, 22 nt, Human
aucuuaaucuguuuauuuacaa

SEQ ID NO: 3567157 - RNA, 14 nt, Human
aucuuaauguauau

SEQ ID NO: 3567158 - RNA, 20 nt, Human
aucuuaauguaucaaacugu

SEQ ID NO: 3567159 - RNA, 14 nt, Human
aucuuaauguuccu

SEQ ID NO: 3567160 - RNA, 18 nt, Human
aucuuacaaaguguauuu

SEQ ID NO: 3567161 - RNA, 17 nt, Human
aucuuacaauauugauu

SEQ ID NO: 3567162 - RNA, 14 nt, Human
aucuuacugaaggu

SEQ ID NO: 3567163 - RNA, 12 nt, Human
aucuuacuuugu

SEQ ID NO: 3567164 - RNA, 14 nt, Human
aucuuacuuuguaa

SEQ ID NO: 3567165 - RNA, 17 nt, Human
aucuuacuuuguaaauu

SEQ ID NO: 3567166 - RNA, 22 nt, Human
aucuuacuuuguaaauucugau

SEQ ID NO: 3567167 - RNA, 18 nt, Human
aucuuagauguuucacac

SEQ ID NO: 3567168 - RNA, 23 nt, Human
aucuuagauucucugugucuaag

SEQ ID NO: 3567169 - RNA, 19 nt, Human
aucuuagcauagcuuauua

SEQ ID NO: 3567170 - RNA, 18 nt, Human
aucuuagggugaaccacu

SEQ ID NO: 3567171 - RNA, 16 nt, Human
aucuuaguauuugcau

SEQ ID NO: 3567172 - RNA, 21 nt, Human
aucuuagugccugagaguauu

SEQ ID NO: 3567173 - RNA, 14 nt, Human
aucuuaguguauga

SEQ ID NO: 3567174 - RNA, 15 nt, Human
aucuuaguguaugau

SEQ ID NO: 3567175 - RNA, 22 nt, Human
aucuuaguuuggauucuuaugu

SEQ ID NO: 3567176 - RNA, 16 nt, Human
aucuuauaauuguucu

SEQ ID NO: 3567177 - RNA, 22 nt, Human
aucuuauaauuuaaaauaugcu

SEQ ID NO: 3567178 - RNA, 17 nt, Human
aucuuauacuguacaau

SEQ ID NO: 3567179 - RNA, 19 nt, Human
aucuuauacuguacaauaa

SEQ ID NO: 3567180 - RNA, 21 nt, Human
aucuuauagcacuuugaaaua

SEQ ID NO: 3567181 - RNA, 15 nt, Human
aucuuauaugggaaa

SEQ ID NO: 3567182 - RNA, 22 nt, Human
aucuuauaugggaaaccaugua

SEQ ID NO: 3567183 - RNA, 18 nt, Human
aucuuaucucagauauuu

SEQ ID NO: 3567184 - RNA, 15 nt, Human
aucuuauuaaaguuu

SEQ ID NO: 3567185 - RNA, 16 nt, Human
aucuuauuaaaguuuc

SEQ ID NO: 3567186 - RNA, 18 nt, Human
aucuuauuaaaguuucaa

SEQ ID NO: 3567187 - RNA, 22 nt, Human
aucuuauuaaaguuucaaaaau

SEQ ID NO: 3567188 - RNA, 22 nt, Human
aucuuauuagggagaaaauuca

SEQ ID NO: 3567189 - RNA, 13 nt, Human
aucuuauucacau

SEQ ID NO: 3567190 - RNA, 17 nt, Human
aucuuauuuuucuaaac

SEQ ID NO: 3567191 - RNA, 22 nt, Human
aucuucaaaaguaaugccucug

SEQ ID NO: 3567192 - RNA, 15 nt, Human
aucuucaaagccuuc

SEQ ID NO: 3567193 - RNA, 15 nt, Human
aucuucaaagcuuga

SEQ ID NO: 3567194 - RNA, 12 nt, Human
aucuucaacaaa

SEQ ID NO: 3567195 - RNA, 14 nt, Human
aucuucaauccuug

SEQ ID NO: 3567196 - RNA, 15 nt, Human
aucuucaauggcuuu

SEQ ID NO: 3567197 - RNA, 19 nt, Human
aucuucacauaguucucca

SEQ ID NO: 3567198 - RNA, 13 nt, Human
aucuucacuucua

SEQ ID NO: 3567199 - RNA, 18 nt, Human
aucuucagagcagggguc

SEQ ID NO: 3567200 - RNA, 14 nt, Human
aucuucaguugucu

SEQ ID NO: 3567201 - RNA, 19 nt, Human
aucuucaguugucucugau

SEQ ID NO: 3567202 - RNA, 20 nt, Human
aucuucaguuuuaucuuuaa

SEQ ID NO: 3567203 - RNA, 15 nt, Human
aucuucauuaccaau

SEQ ID NO: 3567204 - RNA, 22 nt, Human
aucuuccaauuuaguuguugua

SEQ ID NO: 3567205 - RNA, 19 nt, Human
aucuuccagaagugugauu

SEQ ID NO: 3567206 - RNA, 18 nt, Human
aucuuccaggugggguga

SEQ ID NO: 3567207 - RNA, 16 nt, Human
aucuuccauauuugga

SEQ ID NO: 3567208 - RNA, 19 nt, Human
aucuuccauauuuggaaga

SEQ ID NO: 3567209 - RNA, 20 nt, Human
aucuuccuggucgaaaguua

SEQ ID NO: 3567210 - RNA, 23 nt, Human
aucuuccuggucgaaaguuagua

SEQ ID NO: 3567211 - RNA, 14 nt, Human
aucuuccugugucc

SEQ ID NO: 3567212 - RNA, 15 nt, Human
aucuucgggaccagg

SEQ ID NO: 3567213 - RNA, 14 nt, Human
aucuucgucuucac

SEQ ID NO: 3567214 - RNA, 15 nt, Human
aucuucgucuucacu

SEQ ID NO: 3567215 - RNA, 22 nt, Human
aucuucgucuucacucuuaggc

SEQ ID NO: 3567216 - RNA, 21 nt, Human
aucuucuauauguuuaaaagu

SEQ ID NO: 3567217 - RNA, 13 nt, Human
aucuucucagcuc

SEQ ID NO: 3567218 - RNA, 15 nt, Human
aucuucucagcuccc

SEQ ID NO: 3567219 - RNA, 15 nt, Human
aucuucuccaggaug

SEQ ID NO: 3567220 - RNA, 15 nt, Human
aucuucuccaucugg

SEQ ID NO: 3567221 - RNA, 19 nt, Human
aucuucuccaucuggcagg

SEQ ID NO: 3567222 - RNA, 22 nt, Human
aucuucuccaucuggcagggug

SEQ ID NO: 3567223 - RNA, 22 nt, Human
aucuucugaacuuggcgcugcc

SEQ ID NO: 3567224 - RNA, 23 nt, Human
aucuucugaacuuggcgcugccc

SEQ ID NO: 3567225 - RNA, 21 nt, Human
aucuucugccuuagucucagu

SEQ ID NO: 3567226 - RNA, 20 nt, Human
aucuucuggagucuccagug

SEQ ID NO: 3567227 - RNA, 17 nt, Human
aucuucuuuauaauucu

SEQ ID NO: 3567228 - RNA, 21 nt, Human
aucuucuuugcagccugggug

SEQ ID NO: 3567229 - RNA, 17 nt, Human
aucuugaaaugaaagua

SEQ ID NO: 3567230 - RNA, 22 nt, Human
aucuugaaauuaagaaggcaaa

SEQ ID NO: 3567231 - RNA, 17 nt, Human
aucuugaagacuuuucu

SEQ ID NO: 3567232 - RNA, 12 nt, Human
aucuugaaggaa

SEQ ID NO: 3567233 - RNA, 15 nt, Human
aucuugaagggccca

SEQ ID NO: 3567234 - RNA, 21 nt, Human
aucuugaauacucugcccucu

SEQ ID NO: 3567235 - RNA, 14 nt, Human
aucuugacagagcc

SEQ ID NO: 3567236 - RNA, 19 nt, Human
aucuugaccaagcaggaag

SEQ ID NO: 3567237 - RNA, 22 nt, Human
aucuugagcaaguuccuucugg

SEQ ID NO: 3567238 - RNA, 19 nt, Human
aucuugaguauaagaaaug

SEQ ID NO: 3567239 - RNA, 21 nt, Human
aucuugauaccaccuauauag

SEQ ID NO: 3567240 - RNA, 16 nt, Human
augaauuccuagaauu

SEQ ID NO: 3567241 - RNA, 13 nt, Human
augaauugcauuu

SEQ ID NO: 3567242 - RNA, 12 nt, Human
augaauuguaaa

SEQ ID NO: 3567243 - RNA, 14 nt, Human
augaauuuaaauau

SEQ ID NO: 3567244 - RNA, 16 nt, Human
augaauuuaaauauaa

SEQ ID NO: 3567245 - RNA, 23 nt, Human
augaauuuaaauauaauucugua

SEQ ID NO: 3567246 - RNA, 21 nt, Human
augaauuuggagacucugugg

SEQ ID NO: 3567247 - RNA, 14 nt, Human
augaauuuuaaagu

SEQ ID NO: 3567248 - RNA, 17 nt, Human
augaauuuuaaaguaug

SEQ ID NO: 3567249 - RNA, 22 nt, Human
augaauuuuaaaguaugcauua

SEQ ID NO: 3567250 - RNA, 16 nt, Human
augaauuuuaaggguu

SEQ ID NO: 3567251 - RNA, 21 nt, Human
augaauuuuuuucaucuucuc

SEQ ID NO: 3567252 - RNA, 23 nt, Human
augaauuuuuuucaucuucucug

SEQ ID NO: 3567253 - RNA, 17 nt, Human
augacaaaaaauguuuu

SEQ ID NO: 3567254 - RNA, 23 nt, Human
augacaaaaauucaacucagacu

SEQ ID NO: 3567255 - RNA, 17 nt, Human
augacaaauaaguggaa

SEQ ID NO: 3567256 - RNA, 16 nt, Human
augacaaauguuucua

SEQ ID NO: 3567257 - RNA, 15 nt, Human
augacaacuuugcca

SEQ ID NO: 3567258 - RNA, 14 nt, Human
augacaagauggua

SEQ ID NO: 3567259 - RNA, 13 nt, Human
augacaagcauuu

SEQ ID NO: 3567260 - RNA, 20 nt, Human
augacaagccccaggcaggc

SEQ ID NO: 3567261 - RNA, 15 nt, Human
augacaaucaugugu

SEQ ID NO: 3567262 - RNA, 18 nt, Human
augacaaucauguguguu

SEQ ID NO: 3567263 - RNA, 19 nt, Human
augacaauuuuuuccacuu

SEQ ID NO: 3567264 - RNA, 20 nt, Human
augacaccaucuuuuauucu

SEQ ID NO: 3567265 - RNA, 23 nt, Human
augacaccaucuuuuauucuuuu

SEQ ID NO: 3567266 - RNA, 18 nt, Human
augacacgaauauugcug

SEQ ID NO: 3567267 - RNA, 20 nt, Human
augacacgaauauugcugau

SEQ ID NO: 3567268 - RNA, 21 nt, Human
augacacuagaaaacuugacu

SEQ ID NO: 3567269 - RNA, 19 nt, Human
augacacucguauaagcau

SEQ ID NO: 3567270 - RNA, 15 nt, Human
augacacugaaaugc

SEQ ID NO: 3567271 - RNA, 12 nt, Human
augacacugacc

SEQ ID NO: 3567272 - RNA, 22 nt, Human
augacacuuguccccaaauccg

SEQ ID NO: 3567273 - RNA, 14 nt, Human
augacagaaaauau

SEQ ID NO: 3567274 - RNA, 23 nt, Human
augacagaaaauauguauuaaca

SEQ ID NO: 3567275 - RNA, 13 nt, Human
augacagagccag

SEQ ID NO: 3567276 - RNA, 18 nt, Human
augacagccucuauccua

SEQ ID NO: 3567277 - RNA, 19 nt, Human
augacagcugucccuguca

SEQ ID NO: 3567278 - RNA, 22 nt, Human
augacaguuauacugucgguuu

SEQ ID NO: 3567279 - RNA, 19 nt, Human
augacauaaaaacaacuuu

SEQ ID NO: 3567280 - RNA, 13 nt, Human
augacauauuuuu

SEQ ID NO: 3567281 - RNA, 18 nt, Human
augacaucaccacaguuu

SEQ ID NO: 3567282 - RNA, 20 nt, Human
augacaucacuuguacaaaa

SEQ ID NO: 3567283 - RNA, 18 nt, Human
augacaucucaggggcca

SEQ ID NO: 3567284 - RNA, 19 nt, Human
augacaucuuuuuaaagcu

SEQ ID NO: 3567285 - RNA, 22 nt, Human
augacaugaauuuuagcuuuug

SEQ ID NO: 3567286 - RNA, 15 nt, Human
augacaugcacugac

SEQ ID NO: 3567287 - RNA, 17 nt, Human
augacauguuauauauu

SEQ ID NO: 3567288 - RNA, 17 nt, Human
augacauucaugccugg

SEQ ID NO: 3567289 - RNA, 19 nt, Human
augacauugacuauuuuug

SEQ ID NO: 3567290 - RNA, 14 nt, Human
augacauugcuaag

SEQ ID NO: 3567291 - RNA, 20 nt, Human
augacauugcuaagaugcuc

SEQ ID NO: 3567292 - RNA, 21 nt, Human
augacauuuuuuuuaacuacu

SEQ ID NO: 3567293 - RNA, 15 nt, Human
augaccaaaguccuu

SEQ ID NO: 3567294 - RNA, 13 nt, Human
augaccaauuuua

SEQ ID NO: 3567295 - RNA, 14 nt, Human
augaccagcaaaua

SEQ ID NO: 3567296 - RNA, 19 nt, Human
augaccaguaauugugaaa

SEQ ID NO: 3567297 - RNA, 13 nt, Human
augacccaccccu

SEQ ID NO: 3567298 - RNA, 12 nt, Human
augacccaggcu

SEQ ID NO: 3567299 - RNA, 13 nt, Human
augacccccccag

SEQ ID NO: 3567300 - RNA, 22 nt, Human
augaccucaccauuuuuguucu

SEQ ID NO: 3567301 - RNA, 14 nt, Human
augaccuggauaac

SEQ ID NO: 3567302 - RNA, 15 nt, Human
augacggaagaacau

SEQ ID NO: 3567303 - RNA, 19 nt, Human
augacggaagaacauagaa

SEQ ID NO: 3567304 - RNA, 17 nt, Human
augacgguauuaugcuu

SEQ ID NO: 3567305 - RNA, 16 nt, Human
augacuaaaaauauua

SEQ ID NO: 3567306 - RNA, 11 nt, Human
augacuaaaga

SEQ ID NO: 3567307 - RNA, 13 nt, Human
augacuaaagaga

SEQ ID NO: 3567308 - RNA, 18 nt, Human
augacuaaagagagaaug

SEQ ID NO: 3567309 - RNA, 21 nt, Human
augacuaaagagagaauguag

SEQ ID NO: 3567310 - RNA, 23 nt, Human
augacuaaagagagaauguagau

SEQ ID NO: 3567311 - RNA, 13 nt, Human
augacuaauuagg

SEQ ID NO: 3567312 - RNA, 23 nt, Human
augacuaauuaggguacauuuau

SEQ ID NO: 3567313 - RNA, 16 nt, Human
augacuaauucuugca

SEQ ID NO: 3567314 - RNA, 23 nt, Human
augacuacuuagcauccuaagaa

SEQ ID NO: 3567315 - RNA, 15 nt, Human
augacuagaggcagg

SEQ ID NO: 3567316 - RNA, 17 nt, Human
augacuauauaauuuau

SEQ ID NO: 3567317 - RNA, 22 nt, Human
augacuauauaauuuauuucca

SEQ ID NO: 3567318 - RNA, 22 nt, Human
augacuaugcguggcuggaacc

SEQ ID NO: 3567319 - RNA, 18 nt, Human
augacuauucaguggcua

SEQ ID NO: 3567320 - RNA, 15 nt, Human
augacucaagauucc

SEQ ID NO: 3567321 - RNA, 22 nt, Human
augacucaagauucccaggagu

SEQ ID NO: 3567322 - RNA, 17 nt, Human
augacucacaugaugca

SEQ ID NO: 3567323 - RNA, 16 nt, Human
augacuccagaauuuc

SEQ ID NO: 3567324 - RNA, 17 nt, Human
augacuccagaauuucc

SEQ ID NO: 3567325 - RNA, 22 nt, Human
augacucccuuaaaauagaaau

SEQ ID NO: 3567326 - RNA, 16 nt, Human
augacucggggguggg

SEQ ID NO: 3567327 - RNA, 18 nt, Human
augacucuucccucaaau

SEQ ID NO: 3567328 - RNA, 14 nt, Human
augacucuuuauug

SEQ ID NO: 3567329 - RNA, 21 nt, Human
augacugccaagacugcugug

SEQ ID NO: 3567330 - RNA, 23 nt, Human
augacugcuccccagcccuggcu

SEQ ID NO: 3567331 - RNA, 22 nt, Human
augacugcuugcccuaagcaga

SEQ ID NO: 3567332 - RNA, 12 nt, Human
augacuggaauu

SEQ ID NO: 3567333 - RNA, 17 nt, Human
augacuggaauuuuuau

SEQ ID NO: 3567334 - RNA, 22 nt, Human
augacuggaauuuuuauuaugc

SEQ ID NO: 3567335 - RNA, 20 nt, Human
augacuggcauuuuauagac

SEQ ID NO: 3567336 - RNA, 17 nt, Human
augacuguagaauuugu

SEQ ID NO: 3567337 - RNA, 22 nt, Human
augacugugcuacugucuuugg

SEQ ID NO: 3567338 - RNA, 22 nt, Human
augacuuaagcacacuugacau

SEQ ID NO: 3567339 - RNA, 14 nt, Human
augacuuacuguac

SEQ ID NO: 3567340 - RNA, 22 nt, Human
augacuuccccaauaucuugcu

SEQ ID NO: 3567341 - RNA, 18 nt, Human
augacuugggcaccccca

SEQ ID NO: 3567342 - RNA, 20 nt, Human
augacuugggcacccccagc

SEQ ID NO: 3567343 - RNA, 23 nt, Human
augacuugggcacccccagccug

SEQ ID NO: 3567344 - RNA, 13 nt, Human
augacuuuauugc

SEQ ID NO: 3567345 - RNA, 20 nt, Human
augacuuucuuuuuguagcu

SEQ ID NO: 3567346 - RNA, 12 nt, Human
augacuuuggac

SEQ ID NO: 3567347 - RNA, 13 nt, Human
augacuuuuuaua

SEQ ID NO: 3567348 - RNA, 14 nt, Human
augacuuuuugaaa

SEQ ID NO: 3567349 - RNA, 22 nt, Human
augagaaacuggcaaagcagaa

SEQ ID NO: 3567350 - RNA, 20 nt, Human
augagaaacuuaaauguuau

SEQ ID NO: 3567351 - RNA, 21 nt, Human
augagaaagguugaagcacca

SEQ ID NO: 3567352 - RNA, 22 nt, Human
augagaaagguugaagcaccaa

SEQ ID NO: 3567353 - RNA, 12 nt, Human
augagaaaugua

SEQ ID NO: 3567354 - RNA, 15 nt, Human
augagaacaaagcug

SEQ ID NO: 3567355 - RNA, 20 nt, Human
augagaacaaagcuguuaaa

SEQ ID NO: 3567356 - RNA, 22 nt, Human
augagaacaaagcuguuaaacu

SEQ ID NO: 3567357 - RNA, 23 nt, Human
augagaacagacuggccugagga

SEQ ID NO: 3567358 - RNA, 21 nt, Human
augagaacauguugguauuua

SEQ ID NO: 3567359 - RNA, 14 nt, Human
augagaacucugag

SEQ ID NO: 3567360 - RNA, 21 nt, Human
augagaagaaaauggaaccag

SEQ ID NO: 3567361 - RNA, 18 nt, Human
augagaagagggccugug

SEQ ID NO: 3567362 - RNA, 21 nt, Human
augagaagagggccuguggga

SEQ ID NO: 3567363 - RNA, 18 nt, Human
augagaaggaauuugagu

SEQ ID NO: 3567364 - RNA, 15 nt, Human
augagaaggcagcca

SEQ ID NO: 3567365 - RNA, 23 nt, Human
augagaaucuacccccagaucca

SEQ ID NO: 3567366 - RNA, 16 nt, Human
augagaauucagcugc

SEQ ID NO: 3567367 - RNA, 21 nt, Human
augagaauuugagugcucuga

SEQ ID NO: 3567368 - RNA, 15 nt, Human
augagacaaacaugc

SEQ ID NO: 3567369 - RNA, 20 nt, Human
augagacaggaccuaggaua

SEQ ID NO: 3567370 - RNA, 21 nt, Human
augagacccauuccuauuucu

SEQ ID NO: 3567371 - RNA, 16 nt, Human
augagacucagugcag

SEQ ID NO: 3567372 - RNA, 18 nt, Human
augagacucuagggucca

SEQ ID NO: 3567373 - RNA, 16 nt, Human
augagacugaacugug

SEQ ID NO: 3567374 - RNA, 14 nt, Human
augagacuugccuu

SEQ ID NO: 3567375 - RNA, 23 nt, Human
augagagacacacugaagaagca

SEQ ID NO: 3567376 - RNA, 13 nt, Human
augagagcccaga

SEQ ID NO: 3567377 - RNA, 16 nt, Human
augagagcccagaggu

SEQ ID NO: 3567378 - RNA, 22 nt, Human
augagagcccagagguaacaga

SEQ ID NO: 3567379 - RNA, 12 nt, Human
augagaggaaau

SEQ ID NO: 3567380 - RNA, 13 nt, Human
augagaggaaauc

SEQ ID NO: 3567381 - RNA, 19 nt, Human
augagagggcaguguuucc

SEQ ID NO: 3567382 - RNA, 13 nt, Human
augagagucacuu

SEQ ID NO: 3567383 - RNA, 17 nt, Human
augagaguuuuggaugc

SEQ ID NO: 3567384 - RNA, 11 nt, Human
augugaucuca

SEQ ID NO: 3567385 - RNA, 17 nt, Human
augugaucugucuugua

SEQ ID NO: 3567386 - RNA, 18 nt, Human
augugaucugucuuguaa

SEQ ID NO: 3567387 - RNA, 20 nt, Human
augugaucugucuuguaaua

SEQ ID NO: 3567388 - RNA, 16 nt, Human
augugaugagaggaaa

SEQ ID NO: 3567389 - RNA, 17 nt, Human
augugaugagaggaaau

SEQ ID NO: 3567390 - RNA, 14 nt, Human
augugaugauguaa

SEQ ID NO: 3567391 - RNA, 21 nt, Human
augugaugauguaauugacgg

SEQ ID NO: 3567392 - RNA, 16 nt, Human
augugauguucuaagg

SEQ ID NO: 3567393 - RNA, 23 nt, Human
augugauuccuuugaagaggaaa

SEQ ID NO: 3567394 - RNA, 15 nt, Human
augugauucuaaugu

SEQ ID NO: 3567395 - RNA, 14 nt, Human
augugauuguggaa

SEQ ID NO: 3567396 - RNA, 17 nt, Human
augugauuuaauagugu

SEQ ID NO: 3567397 - RNA, 15 nt, Human
augugauuuuucuga

SEQ ID NO: 3567398 - RNA, 17 nt, Human
augugcaaaaauuuuug

SEQ ID NO: 3567399 - RNA, 13 nt, Human
augugcaaaacag

SEQ ID NO: 3567400 - RNA, 20 nt, Human
augugcaagcgacgacagau

SEQ ID NO: 3567401 - RNA, 15 nt, Human
augugcaaguuuauc

SEQ ID NO: 3567402 - RNA, 18 nt, Human
augugcaauagaagguga

SEQ ID NO: 3567403 - RNA, 22 nt, Human
augugcacugucacuuugcucu

SEQ ID NO: 3567404 - RNA, 18 nt, Human
augugcagcagauuggaa

SEQ ID NO: 3567405 - RNA, 21 nt, Human
augugcagcagauuggaagga

SEQ ID NO: 3567406 - RNA, 17 nt, Human
augugcagguuuguuac

SEQ ID NO: 3567407 - RNA, 16 nt, Human
augugcauaguuucuu

SEQ ID NO: 3567408 - RNA, 18 nt, Human
augugcauaguuucuuua

SEQ ID NO: 3567409 - RNA, 17 nt, Human
augugcauucuccagcc

SEQ ID NO: 3567410 - RNA, 19 nt, Human
augugcauucuuuuaaaag

SEQ ID NO: 3567411 - RNA, 20 nt, Human
augugcauucuuuuaaaaga

SEQ ID NO: 3567412 - RNA, 22 nt, Human
augugccagguuuuuggucuga

SEQ ID NO: 3567413 - RNA, 19 nt, Human
augugcccaguuaaucuug

SEQ ID NO: 3567414 - RNA, 22 nt, Human
augugccccuucgcagcugaag

SEQ ID NO: 3567415 - RNA, 17 nt, Human
augugccgaaugugcag

SEQ ID NO: 3567416 - RNA, 21 nt, Human
augugccguguuauuguauua

SEQ ID NO: 3567417 - RNA, 20 nt, Human
augugccuauugcuagagcu

SEQ ID NO: 3567418 - RNA, 22 nt, Human
augugccugcaccaggagacag

SEQ ID NO: 3567419 - RNA, 15 nt, Human
augugccugcuucag

SEQ ID NO: 3567420 - RNA, 23 nt, Human
augugccugcuucagccucccac

SEQ ID NO: 3567421 - RNA, 17 nt, Human
augugccuuauguugaa

SEQ ID NO: 3567422 - RNA, 15 nt, Human
augugcgugugugca

SEQ ID NO: 3567423 - RNA, 14 nt, Human
augugcuacugauu

SEQ ID NO: 3567424 - RNA, 19 nt, Human
augugcuaguaauuggaaa

SEQ ID NO: 3567425 - RNA, 17 nt, Human
augugcucaucagaaac

SEQ ID NO: 3567426 - RNA, 12 nt, Human
augugcugauca

SEQ ID NO: 3567427 - RNA, 18 nt, Human
augugcugcgugccugug

SEQ ID NO: 3567428 - RNA, 19 nt, Human
augugcugcuuugauauau

SEQ ID NO: 3567429 - RNA, 15 nt, Human
augugcuguaauuua

SEQ ID NO: 3567430 - RNA, 18 nt, Human
augugcugugaccauuua

SEQ ID NO: 3567431 - RNA, 14 nt, Human
augugcuuugagaa

SEQ ID NO: 3567432 - RNA, 13 nt, Human
augugcuuuucuc

SEQ ID NO: 3567433 - RNA, 16 nt, Human
auguggaaagugaauu

SEQ ID NO: 3567434 - RNA, 19 nt, Human
auguggaaagugaauuuga

SEQ ID NO: 3567435 - RNA, 16 nt, Human
auguggaacugcugcc

SEQ ID NO: 3567436 - RNA, 18 nt, Human
auguggaacugcugccac

SEQ ID NO: 3567437 - RNA, 21 nt, Human
auguggaagaaaaugguuuau

SEQ ID NO: 3567438 - RNA, 13 nt, Human
auguggaagugug

SEQ ID NO: 3567439 - RNA, 23 nt, Human
auguggaagugugggucugugug

SEQ ID NO: 3567440 - RNA, 13 nt, Human
auguggagccagg

SEQ ID NO: 3567441 - RNA, 15 nt, Human
auguggagccaggcg

SEQ ID NO: 3567442 - RNA, 19 nt, Human
auguggagucagccucgca

SEQ ID NO: 3567443 - RNA, 24 nt, Human
auguggaguucaucuugaauugua

SEQ ID NO: 3567444 - RNA, 16 nt, Human
auguggcauuugugau

SEQ ID NO: 3567445 - RNA, 15 nt, Human
auguggcccuggccu

SEQ ID NO: 3567446 - RNA, 14 nt, Human
auguggcguggaga

SEQ ID NO: 3567447 - RNA, 13 nt, Human
auguggcuccucc

SEQ ID NO: 3567448 - RNA, 17 nt, Human
auguggcugcagcagcg

SEQ ID NO: 3567449 - RNA, 13 nt, Human
auguggcugcccc

SEQ ID NO: 3567450 - RNA, 20 nt, Human
auguggcuggaagauccugc

SEQ ID NO: 3567451 - RNA, 22 nt, Human
auguggcuguaucuuguuuuuc

SEQ ID NO: 3567452 - RNA, 16 nt, Human
auguggcuugagaaau

SEQ ID NO: 3567453 - RNA, 15 nt, Human
augugggaagaaaca

SEQ ID NO: 3567454 - RNA, 20 nt, Human
augugggauuaugggucaca

SEQ ID NO: 3567455 - RNA, 22 nt, Human
augugggauuaugggucacagg

SEQ ID NO: 3567456 - RNA, 11 nt, Human
augugggcagc

SEQ ID NO: 3567457 - RNA, 12 nt, Human
augugggcagcu

SEQ ID NO: 3567458 - RNA, 16 nt, Human
augugggggucugugu

SEQ ID NO: 3567459 - RNA, 21 nt, Human
augugggguccccaucauccc

SEQ ID NO: 3567460 - RNA, 17 nt, Human
augugggucuuccaggg

SEQ ID NO: 3567461 - RNA, 16 nt, Human
auguggguugccuggu

SEQ ID NO: 3567462 - RNA, 17 nt, Human
auguggucacagcugua

SEQ ID NO: 3567463 - RNA, 19 nt, Human
auguggucacagcuguaua

SEQ ID NO: 3567464 - RNA, 22 nt, Human
auguggucacagcuguauagcu

SEQ ID NO: 3567465 - RNA, 15 nt, Human
auguggucucaggau

SEQ ID NO: 3567466 - RNA, 13 nt, Human
auguggugaugau

SEQ ID NO: 3567467 - RNA, 18 nt, Human
augugguggcacaggccc

SEQ ID NO: 3567468 - RNA, 18 nt, Human
augugguuauuucucuga

SEQ ID NO: 3567469 - RNA, 13 nt, Human
augugguuuauag

SEQ ID NO: 3567470 - RNA, 17 nt, Human
augugguuugguuccuc

SEQ ID NO: 3567471 - RNA, 16 nt, Human
augugguuuuagauuu

SEQ ID NO: 3567472 - RNA, 17 nt, Human
auguguaagacaaaaag

SEQ ID NO: 3567473 - RNA, 15 nt, Human
auguguaaggugaac

SEQ ID NO: 3567474 - RNA, 14 nt, Human
auguguaaguauuc

SEQ ID NO: 3567475 - RNA, 22 nt, Human
auguguaauaaauauguuucac

SEQ ID NO: 3567476 - RNA, 17 nt, Human
auguguaaucaauaaac

SEQ ID NO: 3567477 - RNA, 22 nt, Human
auguguaaucaauaaacgauuu

SEQ ID NO: 3567478 - RNA, 16 nt, Human
auguguacauggcaga

SEQ ID NO: 3567479 - RNA, 15 nt, Human
auguguagccuaugu

SEQ ID NO: 3567480 - RNA, 15 nt, Human
auguguauaaacaag

SEQ ID NO: 3567481 - RNA, 13 nt, Human
auguguauaaauu

SEQ ID NO: 3567482 - RNA, 15 nt, Human
auguguauauauaca

SEQ ID NO: 3567483 - RNA, 15 nt, Human
auguguaugcacagu

SEQ ID NO: 3567484 - RNA, 16 nt, Human
auguguccaucccagc

SEQ ID NO: 3567485 - RNA, 11 nt, Human
augugucccag

SEQ ID NO: 3567486 - RNA, 12 nt, Human
augugucccaga

SEQ ID NO: 3567487 - RNA, 20 nt, Human
augugucccgaauccacagu

SEQ ID NO: 3567488 - RNA, 17 nt, Human
auguguccucagggagc

SEQ ID NO: 3567489 - RNA, 18 nt, Human
auguguccucagggagca

SEQ ID NO: 3567490 - RNA, 14 nt, Human
auguguccugacac

SEQ ID NO: 3567491 - RNA, 13 nt, Human
auguguccugguu

SEQ ID NO: 3567492 - RNA, 16 nt, Human
augugucuguauuuca

SEQ ID NO: 3567493 - RNA, 18 nt, Human
augugucuguauuucaug

SEQ ID NO: 3567494 - RNA, 13 nt, Human
augugugagugug

SEQ ID NO: 3567495 - RNA, 16 nt, Human
augugugagugugugc

SEQ ID NO: 3567496 - RNA, 17 nt, Human
augugugcaugugugua

SEQ ID NO: 3567497 - RNA, 18 nt, Human
augugugcauguguguau

SEQ ID NO: 3567498 - RNA, 11 nt, Human
augugugccau

SEQ ID NO: 3567499 - RNA, 19 nt, Human
augugugguggccucagcu

SEQ ID NO: 3567500 - RNA, 19 nt, Human
auguguguagacaaauauu

SEQ ID NO: 3567501 - RNA, 13 nt, Human
auguguguauaag

SEQ ID NO: 3567502 - RNA, 14 nt, Human
auguguguauauau

SEQ ID NO: 3567503 - RNA, 15 nt, Human
auguguguauauaug

SEQ ID NO: 3567504 - RNA, 18 nt, Human
auguguguauauaugugu

SEQ ID NO: 3567505 - RNA, 14 nt, Human
auguguguauaugu

SEQ ID NO: 3567506 - RNA, 16 nt, Human
auguguguauguguau

SEQ ID NO: 3567507 - RNA, 16 nt, Human
auguguguaugugugu

SEQ ID NO: 3567508 - RNA, 22 nt, Human
auguguguccacgacugucucc

SEQ ID NO: 3567509 - RNA, 23 nt, Human
auguguguccacgacugucucca

SEQ ID NO: 3567510 - RNA, 13 nt, Human
augugugugaugu

SEQ ID NO: 3567511 - RNA, 15 nt, Human
augugugugcucagg

SEQ ID NO: 3567512 - RNA, 15 nt, Human
auguguguguauguu

SEQ ID NO: 3567513 - RNA, 12 nt, Human
augugugugugc

SEQ ID NO: 3567514 - RNA, 18 nt, Human
auguguguguguugugug

SEQ ID NO: 3567515 - RNA, 22 nt, Human
auguguguguguuguguguggg

SEQ ID NO: 3567516 - RNA, 17 nt, Human
auguguguugauacugu

SEQ ID NO: 3567517 - RNA, 15 nt, Human
auguguguuuaaaua

SEQ ID NO: 3567518 - RNA, 16 nt, Human
auguguguuuaaauaa

SEQ ID NO: 3567519 - RNA, 17 nt, Human
auguguguuuaaauaaa

SEQ ID NO: 3567520 - RNA, 23 nt, Human
auguguguuuuaaaaugagaaau

SEQ ID NO: 3567521 - RNA, 14 nt, Human
auguguguuuuuuc

SEQ ID NO: 3567522 - RNA, 22 nt, Human
auguguuaaucuuaauguauau

SEQ ID NO: 3567523 - RNA, 20 nt, Human
auguguucucggagugugua

SEQ ID NO: 3567524 - RNA, 19 nt, Human
auguguugccacuuuccaa

SEQ ID NO: 3567525 - RNA, 11 nt, Human
auguguuuaga

SEQ ID NO: 3567526 - RNA, 16 nt, Human
auguguuuagaauuga

SEQ ID NO: 3567527 - RNA, 14 nt, Human
auguguuucaaacu

SEQ ID NO: 3567528 - RNA, 20 nt, Human
auguguuucacaguuugaaa

SEQ ID NO: 3567529 - RNA, 15 nt, Human
auguguuugaacuuc

SEQ ID NO: 3567530 - RNA, 14 nt, Human
auuaaaacugaauu

SEQ ID NO: 3567531 - RNA, 21 nt, Human
auuaaaacuucuuaaauaucu

SEQ ID NO: 3567532 - RNA, 23 nt, Human
auuaaaagaaaauaaaaaaaaga

SEQ ID NO: 3567533 - RNA, 23 nt, Human
auuaaaagaugucucugcaaacc

SEQ ID NO: 3567534 - RNA, 19 nt, Human
auuaaaauaaauaaaugca

SEQ ID NO: 3567535 - RNA, 14 nt, Human
auuaaaauaugcac

SEQ ID NO: 3567536 - RNA, 18 nt, Human
auuaaaauaugcacuaag

SEQ ID NO: 3567537 - RNA, 22 nt, Human
auuaaaauauggcuauaaauau

SEQ ID NO: 3567538 - RNA, 13 nt, Human
auuaaaauauuuc

SEQ ID NO: 3567539 - RNA, 17 nt, Human
auuaaaauauuucaggu

SEQ ID NO: 3567540 - RNA, 12 nt, Human
auuaaaaucuua

SEQ ID NO: 3567541 - RNA, 13 nt, Human
auuaaaaucuuaa

SEQ ID NO: 3567542 - RNA, 13 nt, Human
auuaaaaugaaua

SEQ ID NO: 3567543 - RNA, 19 nt, Human
auuaaaauucugaauuuug

SEQ ID NO: 3567544 - RNA, 11 nt, Human
auuaaacaauu

SEQ ID NO: 3567545 - RNA, 18 nt, Human
auuaaacagauuuuuaca

SEQ ID NO: 3567546 - RNA, 16 nt, Human
auuaaacauaaaacaa

SEQ ID NO: 3567547 - RNA, 22 nt, Human
auuaaaccaucucccuggugcu

SEQ ID NO: 3567548 - RNA, 12 nt, Human
auuaaaccuguc

SEQ ID NO: 3567549 - RNA, 17 nt, Human
auuaaacggauuauuuu

SEQ ID NO: 3567550 - RNA, 21 nt, Human
auuaaacggauuauuuuuuca

SEQ ID NO: 3567551 - RNA, 22 nt, Human
auuaaacggauuauuuuuucag

SEQ ID NO: 3567552 - RNA, 23 nt, Human
auuaaacggauuauuuuuucaga

SEQ ID NO: 3567553 - RNA, 18 nt, Human
auuaaacguaugcaugug

SEQ ID NO: 3567554 - RNA, 16 nt, Human
auuaaacuuaaucuaa

SEQ ID NO: 3567555 - RNA, 17 nt, Human
auuaaacuuaaucuaaa

SEQ ID NO: 3567556 - RNA, 19 nt, Human
auuaaacuuaaucuaaaug

SEQ ID NO: 3567557 - RNA, 14 nt, Human
auuaaacuuaugaa

SEQ ID NO: 3567558 - RNA, 16 nt, Human
auuaaacuuaugaaug

SEQ ID NO: 3567559 - RNA, 17 nt, Human
auuaaacuuaugaaugu

SEQ ID NO: 3567560 - RNA, 17 nt, Human
auuaaagaaaaaaaugu

SEQ ID NO: 3567561 - RNA, 19 nt, Human
auuaaagaaaaaaauguau

SEQ ID NO: 3567562 - RNA, 21 nt, Human
auuaaagaaaaaaauguauuu

SEQ ID NO: 3567563 - RNA, 16 nt, Human
auuaaagaaauaauuu

SEQ ID NO: 3567564 - RNA, 19 nt, Human
auuaaagaaauaauuuuau

SEQ ID NO: 3567565 - RNA, 14 nt, Human
auuaaagaagaccu

SEQ ID NO: 3567566 - RNA, 15 nt, Human
auuaaagaagaccug

SEQ ID NO: 3567567 - RNA, 20 nt, Human
auuaaagcauuuacuuugaa

SEQ ID NO: 3567568 - RNA, 15 nt, Human
auuaaagcauuuaga

SEQ ID NO: 3567569 - RNA, 14 nt, Human
auuaaaggaauaaa

SEQ ID NO: 3567570 - RNA, 16 nt, Human
auuaaagucagaaguu

SEQ ID NO: 3567571 - RNA, 19 nt, Human
auuaaagucagaaguuuua

SEQ ID NO: 3567572 - RNA, 14 nt, Human
auuaaagucugaau

SEQ ID NO: 3567573 - RNA, 19 nt, Human
auuaaagugcuaagguucu

SEQ ID NO: 3567574 - RNA, 20 nt, Human
auuaaagugcuaagguucua

SEQ ID NO: 3567575 - RNA, 19 nt, Human
auuaaaguguccauugaca

SEQ ID NO: 3567576 - RNA, 12 nt, Human
auuaaaguuuca

SEQ ID NO: 3567577 - RNA, 23 nt, Human
auuaaaguuucaaaaaucugaag

SEQ ID NO: 3567578 - RNA, 23 nt, Human
auuaaaguuugcuuguuucuugg

SEQ ID NO: 3567579 - RNA, 13 nt, Human
auuaaauaaauuu

SEQ ID NO: 3567580 - RNA, 12 nt, Human
auuaaauacaga

SEQ ID NO: 3567581 - RNA, 17 nt, Human
auuaaauacagacacua

SEQ ID NO: 3567582 - RNA, 20 nt, Human
auuaaauacagacacuaagu

SEQ ID NO: 3567583 - RNA, 15 nt, Human
auuaaaucauacucc

SEQ ID NO: 3567584 - RNA, 18 nt, Human
auuaaaugaauauuuuga

SEQ ID NO: 3567585 - RNA, 24 nt, Human
auuaaauguagcuucagucauuaa

SEQ ID NO: 3567586 - RNA, 18 nt, Human
auuaaauuacauuuguaa

SEQ ID NO: 3567587 - RNA, 11 nt, Human
auuaaauuaug

SEQ ID NO: 3567588 - RNA, 16 nt, Human
auuaaauucacaaacu

SEQ ID NO: 3567589 - RNA, 18 nt, Human
auuaaauucuugcaaagu

SEQ ID NO: 3567590 - RNA, 17 nt, Human
auuaaauuggaaagcag

SEQ ID NO: 3567591 - RNA, 14 nt, Human
auuaaauuuuuccu

SEQ ID NO: 3567592 - RNA, 15 nt, Human
auuaaauuuuuuugu

SEQ ID NO: 3567593 - RNA, 20 nt, Human
auuaaauuuuuuuguaugaa

SEQ ID NO: 3567594 - RNA, 20 nt, Human
auuaaauuuuuuuuacauuu

SEQ ID NO: 3567595 - RNA, 13 nt, Human
auuaacaaauaug

SEQ ID NO: 3567596 - RNA, 21 nt, Human
auuaacaaauaugcuaauuug

SEQ ID NO: 3567597 - RNA, 14 nt, Human
auuaacaaauuaug

SEQ ID NO: 3567598 - RNA, 18 nt, Human
auuaacaauuaauugucu

SEQ ID NO: 3567599 - RNA, 16 nt, Human
auuaacaguuuuccau

SEQ ID NO: 3567600 - RNA, 18 nt, Human
auuaacaguuuuccauga

SEQ ID NO: 3567601 - RNA, 22 nt, Human
auuaacaguuuuccaugaaaac

SEQ ID NO: 3567602 - RNA, 21 nt, Human
auuaacaugaauauuuagugu

SEQ ID NO: 3567603 - RNA, 17 nt, Human
auuaacauguuaaacca

SEQ ID NO: 3567604 - RNA, 19 nt, Human
auuaacauugggaaaucuu

SEQ ID NO: 3567605 - RNA, 11 nt, Human
auuaaccuaga

SEQ ID NO: 3567606 - RNA, 14 nt, Human
auuaaccucugcac

SEQ ID NO: 3567607 - RNA, 18 nt, Human
auuaacuggguaaugaaa

SEQ ID NO: 3567608 - RNA, 15 nt, Human
auuaacuuagcaugu

SEQ ID NO: 3567609 - RNA, 14 nt, Human
auuaacuuauuuag

SEQ ID NO: 3567610 - RNA, 18 nt, Human
auuaacuuauuuagagau

SEQ ID NO: 3567611 - RNA, 20 nt, Human
auuaacuuggaugaguuuug

SEQ ID NO: 3567612 - RNA, 19 nt, Human
auuaacuuuuauaaacuuu

SEQ ID NO: 3567613 - RNA, 20 nt, Human
auuaacuuuuauaaacuuua

SEQ ID NO: 3567614 - RNA, 12 nt, Human
auuaagaaaauc

SEQ ID NO: 3567615 - RNA, 16 nt, Human
auuaagaaaaucauau

SEQ ID NO: 3567616 - RNA, 13 nt, Human
auuaagaaagacu

SEQ ID NO: 3567617 - RNA, 23 nt, Human
auuaagaaaggaagcauuguaaa

SEQ ID NO: 3567618 - RNA, 11 nt, Human
auuaagaaaua

SEQ ID NO: 3567619 - RNA, 20 nt, Human
auuaagaacacuuuuaauaa

SEQ ID NO: 3567620 - RNA, 21 nt, Human
auuaagaauauguuuccuugu

SEQ ID NO: 3567621 - RNA, 16 nt, Human
auuaagaaugaucuga

SEQ ID NO: 3567622 - RNA, 13 nt, Human
auuaagaauguug

SEQ ID NO: 3567623 - RNA, 21 nt, Human
auuaagacaauagcacuuaaa

SEQ ID NO: 3567624 - RNA, 14 nt, Human
auuaagauacaaau

SEQ ID NO: 3567625 - RNA, 24 nt, Human
auuaagauggauucucagauauuu

SEQ ID NO: 3567626 - RNA, 18 nt, Human
auuaagauuauaauuguu

SEQ ID NO: 3567627 - RNA, 15 nt, Human
auuaagauuauuuua

SEQ ID NO: 3567628 - RNA, 20 nt, Human
auuaagauugaggccugccc

SEQ ID NO: 3567629 - RNA, 16 nt, Human
auuaagauuuccaagu

SEQ ID NO: 3567630 - RNA, 14 nt, Human
auuaagcaaauguu

SEQ ID NO: 3567631 - RNA, 21 nt, Human
auuaagcauauauuuuuauau

SEQ ID NO: 3567632 - RNA, 18 nt, Human
auuaagcaucacaaauga

SEQ ID NO: 3567633 - RNA, 17 nt, Human
auuaagccacuuaaaau

SEQ ID NO: 3567634 - RNA, 20 nt, Human
auuaagccacuuaaaauguu

SEQ ID NO: 3567635 - RNA, 18 nt, Human
auuaagcccacaguauau

SEQ ID NO: 3567636 - RNA, 19 nt, Human
auuaagcccacaguauauu

SEQ ID NO: 3567637 - RNA, 22 nt, Human
auuaagcuguuccuguucagua

SEQ ID NO: 3567638 - RNA, 17 nt, Human
auuaagcuuuuuggaau

SEQ ID NO: 3567639 - RNA, 15 nt, Human
auuaaggauuuuaug

SEQ ID NO: 3567640 - RNA, 20 nt, Human
auuaaggauuuuaugcuuua

SEQ ID NO: 3567641 - RNA, 19 nt, Human
auuaaggcaacugaacaaa

SEQ ID NO: 3567642 - RNA, 21 nt, Human
auuaaggcaacugaacaaaaa

SEQ ID NO: 3567643 - RNA, 15 nt, Human
auuaaggggaagaau

SEQ ID NO: 3567644 - RNA, 19 nt, Human
auuaaggggaagaaugaaa

SEQ ID NO: 3567645 - RNA, 15 nt, Human
auuaaggucucucuu

SEQ ID NO: 3567646 - RNA, 19 nt, Human
auuaaggucucucuuugga

SEQ ID NO: 3567647 - RNA, 17 nt, Human
auuaagguguuugaaaa

SEQ ID NO: 3567648 - RNA, 15 nt, Human
auuaaguaaacuaau

SEQ ID NO: 3567649 - RNA, 18 nt, Human
auuaaguaaucaauaaag

SEQ ID NO: 3567650 - RNA, 13 nt, Human
auuaaguaaugau

SEQ ID NO: 3567651 - RNA, 14 nt, Human
auuaaguacuaugu

SEQ ID NO: 3567652 - RNA, 18 nt, Human
auuaaguacuauguauca

SEQ ID NO: 3567653 - RNA, 14 nt, Human
auuaaguuguuaau

SEQ ID NO: 3567654 - RNA, 19 nt, Human
auuaaguuguuaauaaaag

SEQ ID NO: 3567655 - RNA, 19 nt, Human
auuaauaaaaaauggaaag

SEQ ID NO: 3567656 - RNA, 12 nt, Human
auuaauaaaaag

SEQ ID NO: 3567657 - RNA, 13 nt, Human
auuaauacuaaaa

SEQ ID NO: 3567658 - RNA, 17 nt, Human
auuaauagcagccuuuc

SEQ ID NO: 3567659 - RNA, 13 nt, Human
auuaauagcuuuu

SEQ ID NO: 3567660 - RNA, 18 nt, Human
auuaauagcuuuuauugu

SEQ ID NO: 3567661 - RNA, 23 nt, Human
auuaauagcuuuuauuguauaaa

SEQ ID NO: 3567662 - RNA, 20 nt, Human
auuaauaguaauuuguaaag

SEQ ID NO: 3567663 - RNA, 16 nt, Human
auuaauauauguauua

SEQ ID NO: 3567664 - RNA, 14 nt, Human
auuaauauauuaaa

SEQ ID NO: 3567665 - RNA, 15 nt, Human
auuaauauauuucca

SEQ ID NO: 3567666 - RNA, 18 nt, Human
auuaauauuaauuuucua

SEQ ID NO: 3567667 - RNA, 23 nt, Human
auuaauauucaggguaaauagga

SEQ ID NO: 3567668 - RNA, 12 nt, Human
auuaauauucau

SEQ ID NO: 3567669 - RNA, 12 nt, Human
auuaauauuugu

SEQ ID NO: 3567670 - RNA, 17 nt, Human
auuaauauuuguuuagu

SEQ ID NO: 3567671 - RNA, 14 nt, Human
auuaauauuuuaau

SEQ ID NO: 3567672 - RNA, 22 nt, Human
auuaaucacccuaccaacuuua

SEQ ID NO: 3567673 - RNA, 16 nt, Human
auuaaucacuauuguu

SEQ ID NO: 3567674 - RNA, 15 nt, Human
auuaaucacugugua

SEQ ID NO: 3567675 - RNA, 17 nt, Human
auuuaaacauuaaaaau

SEQ ID NO: 3567676 - RNA, 14 nt, Human
auuuaaacccauuu

SEQ ID NO: 3567677 - RNA, 15 nt, Human
auuuaaacccauuuu

SEQ ID NO: 3567678 - RNA, 17 nt, Human
auuuaaacccauuuuag

SEQ ID NO: 3567679 - RNA, 19 nt, Human
auuuaaaccgcuaaaagaa

SEQ ID NO: 3567680 - RNA, 21 nt, Human
auuuaaaccgcuaaaagaaac

SEQ ID NO: 3567681 - RNA, 23 nt, Human
auuuaaaccgcuaaaagaaacuu

SEQ ID NO: 3567682 - RNA, 12 nt, Human
auuuaaacuaua

SEQ ID NO: 3567683 - RNA, 17 nt, Human
auuuaaacuaucuugug

SEQ ID NO: 3567684 - RNA, 18 nt, Human
auuuaaagaaaaaaaugu

SEQ ID NO: 3567685 - RNA, 18 nt, Human
auuuaaagaaauauguau

SEQ ID NO: 3567686 - RNA, 11 nt, Human
auuuaaagcag

SEQ ID NO: 3567687 - RNA, 16 nt, Human
auuuaaagcagguucu

SEQ ID NO: 3567688 - RNA, 20 nt, Human
auuuaaagcagguucuuguu

SEQ ID NO: 3567689 - RNA, 12 nt, Human
auuuaaagcauu

SEQ ID NO: 3567690 - RNA, 18 nt, Human
auuuaaagcauugcuguu

SEQ ID NO: 3567691 - RNA, 21 nt, Human
auuuaaaggcccuaucuguuu

SEQ ID NO: 3567692 - RNA, 20 nt, Human
auuuaaaggguguacuuaua

SEQ ID NO: 3567693 - RNA, 13 nt, Human
auuuaaauauaau

SEQ ID NO: 3567694 - RNA, 19 nt, Human
auuuaaauauaauucugua

SEQ ID NO: 3567695 - RNA, 17 nt, Human
auuuaaaugucuaaugu

SEQ ID NO: 3567696 - RNA, 16 nt, Human
auuuaaauguguacaa

SEQ ID NO: 3567697 - RNA, 21 nt, Human
auuuaaauuacaauuuuaucu

SEQ ID NO: 3567698 - RNA, 15 nt, Human
auuuaaauuuaaaga

SEQ ID NO: 3567699 - RNA, 16 nt, Human
auuuaacaaaaagugc

SEQ ID NO: 3567700 - RNA, 15 nt, Human
auuuaacaaugcgaa

SEQ ID NO: 3567701 - RNA, 15 nt, Human
auuuaacagaaaugu

SEQ ID NO: 3567702 - RNA, 18 nt, Human
auuuaacagaaauuguau

SEQ ID NO: 3567703 - RNA, 22 nt, Human
auuuaacagcugaauuaucuau

SEQ ID NO: 3567704 - RNA, 13 nt, Human
auuuaacaugcaa

SEQ ID NO: 3567705 - RNA, 22 nt, Human
auuuaacaugcaacccgaaggu

SEQ ID NO: 3567706 - RNA, 16 nt, Human
auuuaacauuauuuau

SEQ ID NO: 3567707 - RNA, 20 nt, Human
auuuaacauuauuuauaugg

SEQ ID NO: 3567708 - RNA, 19 nt, Human
auuuaacccauuugucucu

SEQ ID NO: 3567709 - RNA, 19 nt, Human
auuuaaccccccuguacac

SEQ ID NO: 3567710 - RNA, 21 nt, Human
auuuaacuacccuuaauuacu

SEQ ID NO: 3567711 - RNA, 22 nt, Human
auuuaacuacccuuaauuacuu

SEQ ID NO: 3567712 - RNA, 12 nt, Human
auuuaacuucug

SEQ ID NO: 3567713 - RNA, 17 nt, Human
auuuaacuuuuaguaaa

SEQ ID NO: 3567714 - RNA, 20 nt, Human
auuuaagaaaauacaauaaa

SEQ ID NO: 3567715 - RNA, 16 nt, Human
auuuaagagacaguca

SEQ ID NO: 3567716 - RNA, 19 nt, Human
auuuaagagcaguccauuu

SEQ ID NO: 3567717 - RNA, 15 nt, Human
auuuaagcaaauacu

SEQ ID NO: 3567718 - RNA, 17 nt, Human
auuuaagcaaauacuua

SEQ ID NO: 3567719 - RNA, 18 nt, Human
auuuaagcacaaacuuua

SEQ ID NO: 3567720 - RNA, 11 nt, Human
auuuaagcauu

SEQ ID NO: 3567721 - RNA, 13 nt, Human
auuuaagcauugu

SEQ ID NO: 3567722 - RNA, 14 nt, Human
auuuaagcauuguu

SEQ ID NO: 3567723 - RNA, 15 nt, Human
auuuaagccuaaaga

SEQ ID NO: 3567724 - RNA, 16 nt, Human
auuuaagccuaaagau

SEQ ID NO: 3567725 - RNA, 17 nt, Human
auuuaagccucauauuu

SEQ ID NO: 3567726 - RNA, 19 nt, Human
auuuaagccucauauuuaa

SEQ ID NO: 3567727 - RNA, 21 nt, Human
auuuaagccucauauuuaaag

SEQ ID NO: 3567728 - RNA, 18 nt, Human
auuuaagcuuaugucaga

SEQ ID NO: 3567729 - RNA, 13 nt, Human
auuuaagggaaaa

SEQ ID NO: 3567730 - RNA, 20 nt, Human
auuuaaggucuguuugcugu

SEQ ID NO: 3567731 - RNA, 21 nt, Human
auuuaagugcguguguagagu

SEQ ID NO: 3567732 - RNA, 22 nt, Human
auuuaagugcguguguagaguu

SEQ ID NO: 3567733 - RNA, 19 nt, Human
auuuaaguucauauuccau

SEQ ID NO: 3567734 - RNA, 12 nt, Human
auuuaaguuuug

SEQ ID NO: 3567735 - RNA, 22 nt, Human
auuuaauaaaauaauucuaaag

SEQ ID NO: 3567736 - RNA, 12 nt, Human
auuuaauaacau

SEQ ID NO: 3567737 - RNA, 13 nt, Human
auuuaauaacaua

SEQ ID NO: 3567738 - RNA, 17 nt, Human
auuuaauaacauuaccu

SEQ ID NO: 3567739 - RNA, 23 nt, Human
auuuaauaacauuaccuuacugu

SEQ ID NO: 3567740 - RNA, 18 nt, Human
auuuaauaauauacuugu

SEQ ID NO: 3567741 - RNA, 19 nt, Human
auuuaauaauauacuugug

SEQ ID NO: 3567742 - RNA, 15 nt, Human
auuuaauacagcagu

SEQ ID NO: 3567743 - RNA, 18 nt, Human
auuuaauagcaaagaauu

SEQ ID NO: 3567744 - RNA, 20 nt, Human
auuuaauagcaaagaauuga

SEQ ID NO: 3567745 - RNA, 15 nt, Human
auuuaauaguguuaa

SEQ ID NO: 3567746 - RNA, 17 nt, Human
auuuaauaguguuaauc

SEQ ID NO: 3567747 - RNA, 18 nt, Human
auuuaauaguguuaauca

SEQ ID NO: 3567748 - RNA, 22 nt, Human
auuuaauaguguuaaucaauuu

SEQ ID NO: 3567749 - RNA, 17 nt, Human
auuuaauauagcuauuu

SEQ ID NO: 3567750 - RNA, 16 nt, Human
auuuaauauuacagau

SEQ ID NO: 3567751 - RNA, 20 nt, Human
auuuaauccaguuauaagaa

SEQ ID NO: 3567752 - RNA, 23 nt, Human
auuuaauccaguuauaagaagaa

SEQ ID NO: 3567753 - RNA, 17 nt, Human
auuuaaucuuuuaugau

SEQ ID NO: 3567754 - RNA, 16 nt, Human
auuuaaugaaagacug

SEQ ID NO: 3567755 - RNA, 20 nt, Human
auuuaaugaaagacuguaca

SEQ ID NO: 3567756 - RNA, 22 nt, Human
auuuaaugauaaguaaaugcua

SEQ ID NO: 3567757 - RNA, 20 nt, Human
auuuaaugcauuaaaccugu

SEQ ID NO: 3567758 - RNA, 13 nt, Human
auuuaaugcugcc

SEQ ID NO: 3567759 - RNA, 14 nt, Human
auuuaaugcugccu

SEQ ID NO: 3567760 - RNA, 23 nt, Human
auuuaauggaaguguauuuauuu

SEQ ID NO: 3567761 - RNA, 21 nt, Human
auuuaauggccggcuggaaau

SEQ ID NO: 3567762 - RNA, 16 nt, Human
auuuaauguagccaug

SEQ ID NO: 3567763 - RNA, 14 nt, Human
auuuaaugugaguu

SEQ ID NO: 3567764 - RNA, 21 nt, Human
auuuaauuaggaaaaaaacua

SEQ ID NO: 3567765 - RNA, 16 nt, Human
auuuaauuagugcuaa

SEQ ID NO: 3567766 - RNA, 21 nt, Human
auuuaauuagugcuaagugug

SEQ ID NO: 3567767 - RNA, 22 nt, Human
auuuaauuagugcuaaguguga

SEQ ID NO: 3567768 - RNA, 12 nt, Human
auuuaauuauua

SEQ ID NO: 3567769 - RNA, 13 nt, Human
auuuaauuauuaa

SEQ ID NO: 3567770 - RNA, 15 nt, Human
auuuaauuauuaacu

SEQ ID NO: 3567771 - RNA, 19 nt, Human
auuuaauugggcacuauuu

SEQ ID NO: 3567772 - RNA, 13 nt, Human
auuuaauuguaaa

SEQ ID NO: 3567773 - RNA, 18 nt, Human
auuuaauuguaaacugua

SEQ ID NO: 3567774 - RNA, 15 nt, Human
auuuaauuuagugau

SEQ ID NO: 3567775 - RNA, 18 nt, Human
auuuaauuugaaauaugg

SEQ ID NO: 3567776 - RNA, 13 nt, Human
auuuaauuugaag

SEQ ID NO: 3567777 - RNA, 22 nt, Human
auuuaauuugccaaaauaaugu

SEQ ID NO: 3567778 - RNA, 19 nt, Human
auuuaauuuugacacuaua

SEQ ID NO: 3567779 - RNA, 20 nt, Human
auuuaauuuugacacugaaa

SEQ ID NO: 3567780 - RNA, 23 nt, Human
auuuacaaaaauauaaaauauga

SEQ ID NO: 3567781 - RNA, 14 nt, Human
auuuacaaacugaa

SEQ ID NO: 3567782 - RNA, 15 nt, Human
auuuacaaacugaag

SEQ ID NO: 3567783 - RNA, 13 nt, Human
auuuacaaagugu

SEQ ID NO: 3567784 - RNA, 17 nt, Human
auuuacaaaguguguau

SEQ ID NO: 3567785 - RNA, 21 nt, Human
auuuacaagggaagauuuaug

SEQ ID NO: 3567786 - RNA, 16 nt, Human
auuuacaauguauuaa

SEQ ID NO: 3567787 - RNA, 19 nt, Human
auuuacagaugaauguauu

SEQ ID NO: 3567788 - RNA, 23 nt, Human
auuuacagccagugggagauguu

SEQ ID NO: 3567789 - RNA, 21 nt, Human
auuuacagccucacuugaaug

SEQ ID NO: 3567790 - RNA, 15 nt, Human
auuuacaggaacuuc

SEQ ID NO: 3567791 - RNA, 20 nt, Human
auuuacagugaaaauguaag

SEQ ID NO: 3567792 - RNA, 15 nt, Human
auuuacaguuucaaa

SEQ ID NO: 3567793 - RNA, 24 nt, Human
auuuacaguuucaaaaacuguauu

SEQ ID NO: 3567794 - RNA, 14 nt, Human
auuuacauaugaaa

SEQ ID NO: 3567795 - RNA, 21 nt, Human
auuuacauaugaaauuuaaua

SEQ ID NO: 3567796 - RNA, 18 nt, Human
auuuacaugaauugcauu

SEQ ID NO: 3567797 - RNA, 20 nt, Human
auuuacaugaauugcauuuu

SEQ ID NO: 3567798 - RNA, 16 nt, Human
auuuacauguauuauu

SEQ ID NO: 3567799 - RNA, 19 nt, Human
auuuacauguauuauuuca

SEQ ID NO: 3567800 - RNA, 18 nt, Human
auuuaccacagcagcuga

SEQ ID NO: 3567801 - RNA, 12 nt, Human
auuuaccucagc

SEQ ID NO: 3567802 - RNA, 21 nt, Human
auuuaccugcaggcugagcca

SEQ ID NO: 3567803 - RNA, 16 nt, Human
auuuaccuuuuugaaa

SEQ ID NO: 3567804 - RNA, 16 nt, Human
auuuacuaaaauggac

SEQ ID NO: 3567805 - RNA, 14 nt, Human
auuuacuaaacaua

SEQ ID NO: 3567806 - RNA, 15 nt, Human
auuuacuaaacauau

SEQ ID NO: 3567807 - RNA, 18 nt, Human
auuuacuaccuuaucacu

SEQ ID NO: 3567808 - RNA, 16 nt, Human
auuuacucuaaaaacu

SEQ ID NO: 3567809 - RNA, 17 nt, Human
auuuacucuaaaaacug

SEQ ID NO: 3567810 - RNA, 21 nt, Human
auuuacugagcuucucuguga

SEQ ID NO: 3567811 - RNA, 15 nt, Human
auuuacugugucuuu

SEQ ID NO: 3567812 - RNA, 12 nt, Human
auuuacuguuuu

SEQ ID NO: 3567813 - RNA, 17 nt, Human
auuuacuucuuauacau

SEQ ID NO: 3567814 - RNA, 12 nt, Human
auuuacuuguuu

SEQ ID NO: 3567815 - RNA, 13 nt, Human
auuuagaaaaaag

SEQ ID NO: 3567816 - RNA, 20 nt, Human
auuuagaaaaagaacaugca

SEQ ID NO: 3567817 - RNA, 17 nt, Human
auuuagaaaacuuuaaa

SEQ ID NO: 3567818 - RNA, 18 nt, Human
auuuagaaaacuuuaaag

SEQ ID NO: 3567819 - RNA, 21 nt, Human
auuuagaaaagugaauugaag

SEQ ID NO: 3567820 - RNA, 16 nt, Human
auuugagcauaucagu

SEQ ID NO: 3567821 - RNA, 16 nt, Human
auuugaggaguguuaa

SEQ ID NO: 3567822 - RNA, 13 nt, Human
auuugaggucaag

SEQ ID NO: 3567823 - RNA, 18 nt, Human
auuugagugauuauuugu

SEQ ID NO: 3567824 - RNA, 14 nt, Human
auuugagugcucug

SEQ ID NO: 3567825 - RNA, 12 nt, Human
auuugauaauga

SEQ ID NO: 3567826 - RNA, 20 nt, Human
auuugauaaugauaaaacac

SEQ ID NO: 3567827 - RNA, 15 nt, Human
auuugauacuuauau

SEQ ID NO: 3567828 - RNA, 22 nt, Human
auuugauacuuauauuuucgua

SEQ ID NO: 3567829 - RNA, 20 nt, Human
auuugauaguauugugcaua

SEQ ID NO: 3567830 - RNA, 15 nt, Human
auuugauaucacagu

SEQ ID NO: 3567831 - RNA, 18 nt, Human
auuugauaugugaacagu

SEQ ID NO: 3567832 - RNA, 19 nt, Human
auuugauaugugaacaguu

SEQ ID NO: 3567833 - RNA, 17 nt, Human
auuugaucguuccaguu

SEQ ID NO: 3567834 - RNA, 19 nt, Human
auuugaugcuggagagguu

SEQ ID NO: 3567835 - RNA, 16 nt, Human
auuugaugcuguuuga

SEQ ID NO: 3567836 - RNA, 20 nt, Human
auuugauguggugaaaagca

SEQ ID NO: 3567837 - RNA, 20 nt, Human
auuugauguuuacaggugga

SEQ ID NO: 3567838 - RNA, 17 nt, Human
auuugauuaacaaauau

SEQ ID NO: 3567839 - RNA, 16 nt, Human
auuugauucaaaauau

SEQ ID NO: 3567840 - RNA, 23 nt, Human
auuugauucuguguguuuucaua

SEQ ID NO: 3567841 - RNA, 13 nt, Human
auuugauugauuu

SEQ ID NO: 3567842 - RNA, 16 nt, Human
auuugauugauuugaa

SEQ ID NO: 3567843 - RNA, 22 nt, Human
auuugauuuauuaacuuaauaa

SEQ ID NO: 3567844 - RNA, 16 nt, Human
auuugauuuguacaga

SEQ ID NO: 3567845 - RNA, 19 nt, Human
auuugauuuuuauuauuaa

SEQ ID NO: 3567846 - RNA, 16 nt, Human
auuugcaaaguacugu

SEQ ID NO: 3567847 - RNA, 18 nt, Human
auuugcaaaguacuguaa

SEQ ID NO: 3567848 - RNA, 15 nt, Human
auuugcaacauuuac

SEQ ID NO: 3567849 - RNA, 18 nt, Human
auuugcacaaaaagauac

SEQ ID NO: 3567850 - RNA, 14 nt, Human
auuugcaggguccu

SEQ ID NO: 3567851 - RNA, 9 nt, Human
auuugcagu

SEQ ID NO: 3567852 - RNA, 17 nt, Human
auuugcauauguaugac

SEQ ID NO: 3567853 - RNA, 21 nt, Human
auuugcaucugaaauaggaaa

SEQ ID NO: 3567854 - RNA, 13 nt, Human
auuugcauuuguu

SEQ ID NO: 3567855 - RNA, 21 nt, Human
auuugcauuuguuuauguaau

SEQ ID NO: 3567856 - RNA, 16 nt, Human
auuugccaauaauaau

SEQ ID NO: 3567857 - RNA, 24 nt, Human
auuugccaugggcuucacuguaua

SEQ ID NO: 3567858 - RNA, 20 nt, Human
auuugcccauuuacacuuuu

SEQ ID NO: 3567859 - RNA, 15 nt, Human
auuugcccuccuccu

SEQ ID NO: 3567860 - RNA, 16 nt, Human
auuugcccugggaaac

SEQ ID NO: 3567861 - RNA, 22 nt, Human
auuugccuguaacaagccagau

SEQ ID NO: 3567862 - RNA, 23 nt, Human
auuugccuugcagaacugccauu

SEQ ID NO: 3567863 - RNA, 23 nt, Human
auuugccuuuaaaaaaaaaaguu

SEQ ID NO: 3567864 - RNA, 18 nt, Human
auuugcgcacaacuuaaa

SEQ ID NO: 3567865 - RNA, 14 nt, Human
auuugcuaauuuuu

SEQ ID NO: 3567866 - RNA, 16 nt, Human
auuugcuacuguacau

SEQ ID NO: 3567867 - RNA, 17 nt, Human
auuugcuacuguuguaa

SEQ ID NO: 3567868 - RNA, 21 nt, Human
auuugcuagcaguaaaagaug

SEQ ID NO: 3567869 - RNA, 13 nt, Human
auuugcuccuuuc

SEQ ID NO: 3567870 - RNA, 21 nt, Human
auuugcugacaaccauuaaag

SEQ ID NO: 3567871 - RNA, 15 nt, Human
auuugcugccaaaug

SEQ ID NO: 3567872 - RNA, 20 nt, Human
auuugcugccaaaugcguau

SEQ ID NO: 3567873 - RNA, 18 nt, Human
auuugcugggcaguuuuu

SEQ ID NO: 3567874 - RNA, 23 nt, Human
auuugcugggcuuuuuuuuucuc

SEQ ID NO: 3567875 - RNA, 13 nt, Human
auuugcuuuggaa

SEQ ID NO: 3567876 - RNA, 15 nt, Human
auuugcuuuggaagu

SEQ ID NO: 3567877 - RNA, 18 nt, Human
auuugcuuuuucaccaga

SEQ ID NO: 3567878 - RNA, 15 nt, Human
auuuggaaacuaaua

SEQ ID NO: 3567879 - RNA, 20 nt, Human
auuuggaaacuaauaaaaua

SEQ ID NO: 3567880 - RNA, 22 nt, Human
auuuggaaacuaauaaaauauu

SEQ ID NO: 3567881 - RNA, 14 nt, Human
auuuggaaauccua

SEQ ID NO: 3567882 - RNA, 12 nt, Human
auuuggaaaucu

SEQ ID NO: 3567883 - RNA, 13 nt, Human
auuuggaaaucuu

SEQ ID NO: 3567884 - RNA, 17 nt, Human
auuuggaaaucuuuaaa

SEQ ID NO: 3567885 - RNA, 21 nt, Human
auuuggaauaaaaauuccaga

SEQ ID NO: 3567886 - RNA, 14 nt, Human
auuuggaauacuuu

SEQ ID NO: 3567887 - RNA, 11 nt, Human
auuuggaauag

SEQ ID NO: 3567888 - RNA, 16 nt, Human
auuuggagagaaauau

SEQ ID NO: 3567889 - RNA, 21 nt, Human
auuuggaggaaaaaaagcaug

SEQ ID NO: 3567890 - RNA, 17 nt, Human
auuuggagggccugggc

SEQ ID NO: 3567891 - RNA, 15 nt, Human
auuuggauccugugu

SEQ ID NO: 3567892 - RNA, 15 nt, Human
auuuggcaguuuggu

SEQ ID NO: 3567893 - RNA, 16 nt, Human
auuuggcaguuuggua

SEQ ID NO: 3567894 - RNA, 15 nt, Human
auuuggcgugacccg

SEQ ID NO: 3567895 - RNA, 14 nt, Human
auuuggcuuaaaua

SEQ ID NO: 3567896 - RNA, 15 nt, Human
auuuggcuuaaauau

SEQ ID NO: 3567897 - RNA, 17 nt, Human
auuuggcuuaaauauag

SEQ ID NO: 3567898 - RNA, 14 nt, Human
auuugggaagugaa

SEQ ID NO: 3567899 - RNA, 17 nt, Human
auuugggagacauguga

SEQ ID NO: 3567900 - RNA, 21 nt, Human
auuugggagggaaaagggaag

SEQ ID NO: 3567901 - RNA, 23 nt, Human
auuugggccugcuccagaccuga

SEQ ID NO: 3567902 - RNA, 23 nt, Human
auuuggggaaaccuagagaagau

SEQ ID NO: 3567903 - RNA, 16 nt, Human
auuuggggcuuauuuu

SEQ ID NO: 3567904 - RNA, 16 nt, Human
auuuggguaaaucaug

SEQ ID NO: 3567905 - RNA, 15 nt, Human
auuuggguccaggag

SEQ ID NO: 3567906 - RNA, 17 nt, Human
auuuggguccaggagga

SEQ ID NO: 3567907 - RNA, 14 nt, Human
auuugggugggagu

SEQ ID NO: 3567908 - RNA, 17 nt, Human
auuuggguuacuauuuc

SEQ ID NO: 3567909 - RNA, 18 nt, Human
auuugguaauguuuuuaa

SEQ ID NO: 3567910 - RNA, 16 nt, Human
auuugguucauuaauu

SEQ ID NO: 3567911 - RNA, 15 nt, Human
auuugguucuaauag

SEQ ID NO: 3567912 - RNA, 15 nt, Human
auuugguuuucacau

SEQ ID NO: 3567913 - RNA, 16 nt, Human
auuuguaaaaugacaa

SEQ ID NO: 3567914 - RNA, 13 nt, Human
auuuguaaaguug

SEQ ID NO: 3567915 - RNA, 12 nt, Human
auuuguaaaucu

SEQ ID NO: 3567916 - RNA, 13 nt, Human
auuuguaaaugcu

SEQ ID NO: 3567917 - RNA, 14 nt, Human
auuuguaaauuuag

SEQ ID NO: 3567918 - RNA, 16 nt, Human
auuuguaaauuuagug

SEQ ID NO: 3567919 - RNA, 17 nt, Human
auuuguaaauuuagugu

SEQ ID NO: 3567920 - RNA, 20 nt, Human
auuuguaaauuuaguguuuu

SEQ ID NO: 3567921 - RNA, 19 nt, Human
auuuguaaauuuaugugau

SEQ ID NO: 3567922 - RNA, 23 nt, Human
auuuguaacccacugagaggaca

SEQ ID NO: 3567923 - RNA, 20 nt, Human
auuuguaaccucagcucugg

SEQ ID NO: 3567924 - RNA, 13 nt, Human
auuuguaagauau

SEQ ID NO: 3567925 - RNA, 18 nt, Human
auuuguaagauauuugca

SEQ ID NO: 3567926 - RNA, 23 nt, Human
auuuguaaguuuaugucuaaaga

SEQ ID NO: 3567927 - RNA, 14 nt, Human
auuuguaaguuuca

SEQ ID NO: 3567928 - RNA, 18 nt, Human
auuuguaaguuucaggug

SEQ ID NO: 3567929 - RNA, 17 nt, Human
auuuguaauagauguuu

SEQ ID NO: 3567930 - RNA, 20 nt, Human
auuuguaauugcuuacauuu

SEQ ID NO: 3567931 - RNA, 13 nt, Human
auuuguacaaaaa

SEQ ID NO: 3567932 - RNA, 13 nt, Human
auuuguacaguuc

SEQ ID NO: 3567933 - RNA, 15 nt, Human
auuuguacaguucag

SEQ ID NO: 3567934 - RNA, 16 nt, Human
auuuguaccauuucag

SEQ ID NO: 3567935 - RNA, 17 nt, Human
auuuguacuauuuaacu

SEQ ID NO: 3567936 - RNA, 21 nt, Human
auuuguacuguuuaauguucu

SEQ ID NO: 3567937 - RNA, 20 nt, Human
auuuguagaaggguuauauu

SEQ ID NO: 3567938 - RNA, 22 nt, Human
auuuguaggggaacucauuugg

SEQ ID NO: 3567939 - RNA, 16 nt, Human
auuuguaggguuucua

SEQ ID NO: 3567940 - RNA, 14 nt, Human
auuuguauaaaaua

SEQ ID NO: 3567941 - RNA, 19 nt, Human
auuuguauaaaauaauuuu

SEQ ID NO: 3567942 - RNA, 18 nt, Human
auuuguauauauacauaa

SEQ ID NO: 3567943 - RNA, 22 nt, Human
auuuguauauuacacauuugua

SEQ ID NO: 3567944 - RNA, 21 nt, Human
auuuguaucucugaagcaugu

SEQ ID NO: 3567945 - RNA, 22 nt, Human
auuuguaucucugaagcauguu

SEQ ID NO: 3567946 - RNA, 21 nt, Human
auuuguaucugaaggagauuu

SEQ ID NO: 3567947 - RNA, 15 nt, Human
auuuguaugauauuu

SEQ ID NO: 3567948 - RNA, 18 nt, Human
auuuguaugucaaagcuu

SEQ ID NO: 3567949 - RNA, 18 nt, Human
auuuguauuuugugugac

SEQ ID NO: 3567950 - RNA, 23 nt, Human
auuuguauuuugugugaccaacu

SEQ ID NO: 3567951 - RNA, 17 nt, Human
auuuguauuuuuuugca

SEQ ID NO: 3567952 - RNA, 14 nt, Human
auuugucaaauugu

SEQ ID NO: 3567953 - RNA, 13 nt, Human
auuugucaacaaa

SEQ ID NO: 3567954 - RNA, 13 nt, Human
auuugucccaagu

SEQ ID NO: 3567955 - RNA, 14 nt, Human
auuugucccaagug

SEQ ID NO: 3567956 - RNA, 18 nt, Human
auuugucccaagugccaa

SEQ ID NO: 3567957 - RNA, 15 nt, Human
auuugucuggccuuu

SEQ ID NO: 3567958 - RNA, 23 nt, Human
auuugugaaaugauggugaaagu

SEQ ID NO: 3567959 - RNA, 18 nt, Human
auuugugaagguggaaau

SEQ ID NO: 3567960 - RNA, 23 nt, Human
auuugugaagguggaaauaaacu

SEQ ID NO: 3567961 - RNA, 14 nt, Human
auuugugacaaaaa

SEQ ID NO: 3567962 - RNA, 11 nt, Human
auuugugacua

SEQ ID NO: 3567963 - RNA, 22 nt, Human
auuugugacuaauuguauaaca

SEQ ID NO: 3567964 - RNA, 14 nt, Human
auuugugagacugu

SEQ ID NO: 3567965 - RNA, 21 nt, Human
caaccguggcccuuccuggac

SEQ ID NO: 3567966 - RNA, 18 nt, Human
caaccguuggaaacauaa

SEQ ID NO: 3567967 - RNA, 18 nt, Human
caaccuaaccccuuuccu

SEQ ID NO: 3567968 - RNA, 15 nt, Human
caaccuauuuugaag

SEQ ID NO: 3567969 - RNA, 14 nt, Human
caaccucagggcuc

SEQ ID NO: 3567970 - RNA, 15 nt, Human
caaccucaguaauuu

SEQ ID NO: 3567971 - RNA, 17 nt, Human
caaccucccucuuguuu

SEQ ID NO: 3567972 - RNA, 20 nt, Human
caaccuccgcauccgggguu

SEQ ID NO: 3567973 - RNA, 14 nt, Human
caaccuccugggcu

SEQ ID NO: 3567974 - RNA, 16 nt, Human
caaccuccuguggaac

SEQ ID NO: 3567975 - RNA, 23 nt, Human
caaccuccuguggaacccagcag

SEQ ID NO: 3567976 - RNA, 16 nt, Human
caaccucgcuccaacu

SEQ ID NO: 3567977 - RNA, 20 nt, Human
caaccucgcuccaacuccaa

SEQ ID NO: 3567978 - RNA, 19 nt, Human
caaccucuagaauuuuaag

SEQ ID NO: 3567979 - RNA, 13 nt, Human
caaccucuggagc

SEQ ID NO: 3567980 - RNA, 20 nt, Human
caaccucuuccuccugacac

SEQ ID NO: 3567981 - RNA, 16 nt, Human
caaccucuucuggcuc

SEQ ID NO: 3567982 - RNA, 13 nt, Human
caaccucuuggcc

SEQ ID NO: 3567983 - RNA, 16 nt, Human
caaccugauuguaaac

SEQ ID NO: 3567984 - RNA, 21 nt, Human
caaccugauugugucucuugg

SEQ ID NO: 3567985 - RNA, 17 nt, Human
caaccugcaaagaucug

SEQ ID NO: 3567986 - RNA, 21 nt, Human
caaccugccugacauuuggag

SEQ ID NO: 3567987 - RNA, 17 nt, Human
caaccugcucuccucuu

SEQ ID NO: 3567988 - RNA, 12 nt, Human
caaccuguaaau

SEQ ID NO: 3567989 - RNA, 16 nt, Human
caaccuguaauaaaua

SEQ ID NO: 3567990 - RNA, 18 nt, Human
caaccuguaauaaauaug

SEQ ID NO: 3567991 - RNA, 19 nt, Human
caaccuguaauaaauauga

SEQ ID NO: 3567992 - RNA, 22 nt, Human
caaccuguuaccuacuuugacu

SEQ ID NO: 3567993 - RNA, 23 nt, Human
caaccuguuaccuacuuugacuu

SEQ ID NO: 3567994 - RNA, 14 nt, Human
caaccuuacuuaca

SEQ ID NO: 3567995 - RNA, 13 nt, Human
caaccuucauuua

SEQ ID NO: 3567996 - RNA, 16 nt, Human
caaccuucuguggcuc

SEQ ID NO: 3567997 - RNA, 17 nt, Human
caaccuucuguggcuca

SEQ ID NO: 3567998 - RNA, 16 nt, Human
caaccuugagacagcu

SEQ ID NO: 3567999 - RNA, 15 nt, Human
caaccuuggcuuggc

SEQ ID NO: 3568000 - RNA, 13 nt, Human
caaccuuguuuau

SEQ ID NO: 3568001 - RNA, 21 nt, Human
caaccuuguuuauuaaauugc

SEQ ID NO: 3568002 - RNA, 16 nt, Human
caaccuuuauucuuuu

SEQ ID NO: 3568003 - RNA, 21 nt, Human
caaccuuucaccuuuguguau

SEQ ID NO: 3568004 - RNA, 18 nt, Human
caacgaaaagcacaucca

SEQ ID NO: 3568005 - RNA, 22 nt, Human
caacgaaaagcacauccaggca

SEQ ID NO: 3568006 - RNA, 13 nt, Human
caacgaagaaaaa

SEQ ID NO: 3568007 - RNA, 13 nt, Human
caacgaggaagcc

SEQ ID NO: 3568008 - RNA, 19 nt, Human
caacgaucacaaaugacuu

SEQ ID NO: 3568009 - RNA, 13 nt, Human
caacgcagcccug

SEQ ID NO: 3568010 - RNA, 15 nt, Human
caacgcagcccugcu

SEQ ID NO: 3568011 - RNA, 14 nt, Human
caacgcuauuccag

SEQ ID NO: 3568012 - RNA, 21 nt, Human
caacgcuuaaaggugucuucc

SEQ ID NO: 3568013 - RNA, 22 nt, Human
caacgcuuaaaggugucuuccu

SEQ ID NO: 3568014 - RNA, 23 nt, Human
caacgcuuguagaacucacucug

SEQ ID NO: 3568015 - RNA, 21 nt, Human
caacggagagcgccugccccu

SEQ ID NO: 3568016 - RNA, 19 nt, Human
caacggcccugcagccagc

SEQ ID NO: 3568017 - RNA, 13 nt, Human
caacgugcaacug

SEQ ID NO: 3568018 - RNA, 20 nt, Human
caacgugcucuuuguuuugu

SEQ ID NO: 3568019 - RNA, 16 nt, Human
caacguuacucagggc

SEQ ID NO: 3568020 - RNA, 17 nt, Human
caacguuacucagggcu

SEQ ID NO: 3568021 - RNA, 15 nt, Human
caacuacagucuaaa

SEQ ID NO: 3568022 - RNA, 21 nt, Human
caacuacccaaaacaagccug

SEQ ID NO: 3568023 - RNA, 22 nt, Human
caacuacccaaaacaagccugg

SEQ ID NO: 3568024 - RNA, 20 nt, Human
caacuacccccagcugugcu

SEQ ID NO: 3568025 - RNA, 21 nt, Human
caacuaccugagcuaaauaaa

SEQ ID NO: 3568026 - RNA, 15 nt, Human
caacuaggaucagaa

SEQ ID NO: 3568027 - RNA, 16 nt, Human
caacuaguuuuguuua

SEQ ID NO: 3568028 - RNA, 19 nt, Human
caacuauaagcccacuguu

SEQ ID NO: 3568029 - RNA, 17 nt, Human
caacuaugauuuggaaa

SEQ ID NO: 3568030 - RNA, 17 nt, Human
caacuauggaucagaau

SEQ ID NO: 3568031 - RNA, 13 nt, Human
caacuauggccug

SEQ ID NO: 3568032 - RNA, 14 nt, Human
caacuauggccugu

SEQ ID NO: 3568033 - RNA, 22 nt, Human
caacuauuuauugacucugggu

SEQ ID NO: 3568034 - RNA, 21 nt, Human
caacuauuuucagaugugaac

SEQ ID NO: 3568035 - RNA, 17 nt, Human
caacucaccccagcccc

SEQ ID NO: 3568036 - RNA, 23 nt, Human
caacucacuccuuuuaaagaaaa

SEQ ID NO: 3568037 - RNA, 14 nt, Human
caacucauauuuuc

SEQ ID NO: 3568038 - RNA, 17 nt, Human
caacuccaacauccacu

SEQ ID NO: 3568039 - RNA, 23 nt, Human
caacuccaccagauagcagaggg

SEQ ID NO: 3568040 - RNA, 12 nt, Human
caacuccagaaa

SEQ ID NO: 3568041 - RNA, 17 nt, Human
caacuccaguacuggag

SEQ ID NO: 3568042 - RNA, 19 nt, Human
caacuccaguacuggagcu

SEQ ID NO: 3568043 - RNA, 20 nt, Human
caacuccaguacuggagcuu

SEQ ID NO: 3568044 - RNA, 20 nt, Human
caacuccuaguucuagaaaa

SEQ ID NO: 3568045 - RNA, 23 nt, Human
caacuccuaguucuagaaaaaca

SEQ ID NO: 3568046 - RNA, 19 nt, Human
caacuccucgacaucacug

SEQ ID NO: 3568047 - RNA, 14 nt, Human
caacuccuggaagc

SEQ ID NO: 3568048 - RNA, 16 nt, Human
caacucguauagcaug

SEQ ID NO: 3568049 - RNA, 23 nt, Human
caacucuaaagugcuaauaauaa

SEQ ID NO: 3568050 - RNA, 22 nt, Human
caacucugcugaggguccagaa

SEQ ID NO: 3568051 - RNA, 18 nt, Human
caacucuucccugaacuu

SEQ ID NO: 3568052 - RNA, 18 nt, Human
caacucuugauuauccau

SEQ ID NO: 3568053 - RNA, 17 nt, Human
caacucuugcaggucuc

SEQ ID NO: 3568054 - RNA, 13 nt, Human
caacucuuugaga

SEQ ID NO: 3568055 - RNA, 13 nt, Human
caacugaaaagac

SEQ ID NO: 3568056 - RNA, 14 nt, Human
caacugaaaagacu

SEQ ID NO: 3568057 - RNA, 21 nt, Human
caacugaaggcuaaaaagcaa

SEQ ID NO: 3568058 - RNA, 18 nt, Human
caacugaaugaggucagc

SEQ ID NO: 3568059 - RNA, 14 nt, Human
caacugacacagga

SEQ ID NO: 3568060 - RNA, 15 nt, Human
caacugacacaggaa

SEQ ID NO: 3568061 - RNA, 22 nt, Human
caacugacacucccacccaguc

SEQ ID NO: 3568062 - RNA, 19 nt, Human
caacugaccagccuccaug

SEQ ID NO: 3568063 - RNA, 13 nt, Human
caacugaggcaga

SEQ ID NO: 3568064 - RNA, 14 nt, Human
caacugaggcagac

SEQ ID NO: 3568065 - RNA, 20 nt, Human
caacugaggcagacagcagc

SEQ ID NO: 3568066 - RNA, 15 nt, Human
caacugaucuguuau

SEQ ID NO: 3568067 - RNA, 23 nt, Human
caacugcaauaacuucugaccuu

SEQ ID NO: 3568068 - RNA, 15 nt, Human
caacugcuaaucuac

SEQ ID NO: 3568069 - RNA, 14 nt, Human
caacugcucccacc

SEQ ID NO: 3568070 - RNA, 18 nt, Human
caacugcucuuuuauacu

SEQ ID NO: 3568071 - RNA, 19 nt, Human
caacuggacauugucugcg

SEQ ID NO: 3568072 - RNA, 18 nt, Human
caacuggcccuauuuaga

SEQ ID NO: 3568073 - RNA, 23 nt, Human
caacuggcccuauuuagaugaua

SEQ ID NO: 3568074 - RNA, 23 nt, Human
caacuggcccucuucuuacuuga

SEQ ID NO: 3568075 - RNA, 22 nt, Human
caacuggccggucugcaaguca

SEQ ID NO: 3568076 - RNA, 18 nt, Human
caacugucuuauuuaaug

SEQ ID NO: 3568077 - RNA, 15 nt, Human
caacugucuuccuca

SEQ ID NO: 3568078 - RNA, 16 nt, Human
caacugucuuccucaa

SEQ ID NO: 3568079 - RNA, 12 nt, Human
caacuguguugu

SEQ ID NO: 3568080 - RNA, 14 nt, Human
caacuguguuguau

SEQ ID NO: 3568081 - RNA, 17 nt, Human
caacuguguuguauuaa

SEQ ID NO: 3568082 - RNA, 19 nt, Human
caacuguguuguauuaaca

SEQ ID NO: 3568083 - RNA, 19 nt, Human
caacuguuguaacuaggcu

SEQ ID NO: 3568084 - RNA, 14 nt, Human
caacuuaacauggg

SEQ ID NO: 3568085 - RNA, 15 nt, Human
caacuuaauaaaaac

SEQ ID NO: 3568086 - RNA, 14 nt, Human
caacuuacaaaaac

SEQ ID NO: 3568087 - RNA, 17 nt, Human
caacuuacauaugucuu

SEQ ID NO: 3568088 - RNA, 18 nt, Human
caacuucaagugcaugcu

SEQ ID NO: 3568089 - RNA, 15 nt, Human
caacuucaucuggaa

SEQ ID NO: 3568090 - RNA, 19 nt, Human
caacuucucuugcuuucua

SEQ ID NO: 3568091 - RNA, 14 nt, Human
caacuucuggcucc

SEQ ID NO: 3568092 - RNA, 18 nt, Human
caacuucuucagagcuga

SEQ ID NO: 3568093 - RNA, 24 nt, Human
caacuugaaauuauaucugugguc

SEQ ID NO: 3568094 - RNA, 19 nt, Human
caacuugaacuucaccugc

SEQ ID NO: 3568095 - RNA, 16 nt, Human
caacuugagauguaug

SEQ ID NO: 3568096 - RNA, 15 nt, Human
caacuugcaaaauca

SEQ ID NO: 3568097 - RNA, 20 nt, Human
caacuugcaaaaucaguuuu

SEQ ID NO: 3568098 - RNA, 12 nt, Human
caacuugccuuu

SEQ ID NO: 3568099 - RNA, 19 nt, Human
caacuugccuuugaagagu

SEQ ID NO: 3568100 - RNA, 22 nt, Human
caacuuguaaauacaccaccuc

SEQ ID NO: 3568101 - RNA, 16 nt, Human
caacuuguaaaugugg

SEQ ID NO: 3568102 - RNA, 18 nt, Human
caacuuguauccaggccu

SEQ ID NO: 3568103 - RNA, 23 nt, Human
caacuuguauuaaagacagaggc

SEQ ID NO: 3568104 - RNA, 22 nt, Human
caacuugucuuuuucuggacug

SEQ ID NO: 3568105 - RNA, 19 nt, Human
caacuuuagcagaaucaaa

SEQ ID NO: 3568106 - RNA, 21 nt, Human
caacuuuguggaugucuuccu

SEQ ID NO: 3568107 - RNA, 14 nt, Human
caacuuuuguguaa

SEQ ID NO: 3568108 - RNA, 17 nt, Human
caacuuuuuauugccuu

SEQ ID NO: 3568109 - RNA, 19 nt, Human
caaggcugaccaagagaga

SEQ ID NO: 3568110 - RNA, 23 nt, Human
caaggcugaccaagagagaaaga

SEQ ID NO: 3568111 - RNA, 19 nt, Human
caaggcugaugcaggauuu

SEQ ID NO: 3568112 - RNA, 18 nt, Human
caaggcugggggaagaag

SEQ ID NO: 3568113 - RNA, 21 nt, Human
caaggcugucaauuacaggaa

SEQ ID NO: 3568114 - RNA, 18 nt, Human
caaggcuguugcaugggc

SEQ ID NO: 3568115 - RNA, 19 nt, Human
caaggcuuagacccucaug

SEQ ID NO: 3568116 - RNA, 20 nt, Human
caaggcuugcugcagauacu

SEQ ID NO: 3568117 - RNA, 15 nt, Human
caagggaaaagucuc

SEQ ID NO: 3568118 - RNA, 16 nt, Human
caagggaaaagucucu

SEQ ID NO: 3568119 - RNA, 14 nt, Human
caagggaaaggggu

SEQ ID NO: 3568120 - RNA, 15 nt, Human
caagggaaccugugu

SEQ ID NO: 3568121 - RNA, 17 nt, Human
caagggaucugguccua

SEQ ID NO: 3568122 - RNA, 14 nt, Human
caagggauuugagg

SEQ ID NO: 3568123 - RNA, 18 nt, Human
caagggcagcuuugcuca

SEQ ID NO: 3568124 - RNA, 22 nt, Human
caagggcagggggccccuuugc

SEQ ID NO: 3568125 - RNA, 23 nt, Human
caagggcagggggccccuuugcu

SEQ ID NO: 3568126 - RNA, 14 nt, Human
caagggcaguggag

SEQ ID NO: 3568127 - RNA, 16 nt, Human
caagggcaguggaggu

SEQ ID NO: 3568128 - RNA, 16 nt, Human
caagggcauaaaguaa

SEQ ID NO: 3568129 - RNA, 18 nt, Human
caagggcauaaauuauug

SEQ ID NO: 3568130 - RNA, 12 nt, Human
caagggccucuu

SEQ ID NO: 3568131 - RNA, 19 nt, Human
caagggccuggccugagcu

SEQ ID NO: 3568132 - RNA, 23 nt, Human
caagggcuucugcacccuccacc

SEQ ID NO: 3568133 - RNA, 13 nt, Human
caagggcuuuccu

SEQ ID NO: 3568134 - RNA, 18 nt, Human
caagggcuuuccugugcc

SEQ ID NO: 3568135 - RNA, 18 nt, Human
caaggggaaucagaacuc

SEQ ID NO: 3568136 - RNA, 19 nt, Human
caaggggagucaccuuccc

SEQ ID NO: 3568137 - RNA, 20 nt, Human
caaggggagucaccuucccu

SEQ ID NO: 3568138 - RNA, 23 nt, Human
caaggggagucaccuucccuugc

SEQ ID NO: 3568139 - RNA, 21 nt, Human
caagggggaugacaugugacu

SEQ ID NO: 3568140 - RNA, 20 nt, Human
caagggguccccuccaggag

SEQ ID NO: 3568141 - RNA, 14 nt, Human
caaggggugccugg

SEQ ID NO: 3568142 - RNA, 17 nt, Human
caagggguuucuguuuc

SEQ ID NO: 3568143 - RNA, 18 nt, Human
caaggguagggugggccu

SEQ ID NO: 3568144 - RNA, 23 nt, Human
caaggguauccaaguuggacugg

SEQ ID NO: 3568145 - RNA, 16 nt, Human
caaggguggcauccca

SEQ ID NO: 3568146 - RNA, 17 nt, Human
caaggguuaaggccuga

SEQ ID NO: 3568147 - RNA, 16 nt, Human
caagguaaaauucuaa

SEQ ID NO: 3568148 - RNA, 16 nt, Human
caagguaacuguacug

SEQ ID NO: 3568149 - RNA, 22 nt, Human
caagguaacuguacugggccau

SEQ ID NO: 3568150 - RNA, 15 nt, Human
caagguaccauccua

SEQ ID NO: 3568151 - RNA, 18 nt, Human
caagguagaaugaccuug

SEQ ID NO: 3568152 - RNA, 23 nt, Human
caagguagcccuggccagaggcu

SEQ ID NO: 3568153 - RNA, 14 nt, Human
caagguauaauaaa

SEQ ID NO: 3568154 - RNA, 19 nt, Human
caagguauaauaaaauuau

SEQ ID NO: 3568155 - RNA, 20 nt, Human
caaggucacuguuuccuggg

SEQ ID NO: 3568156 - RNA, 17 nt, Human
caaggucauggccacac

SEQ ID NO: 3568157 - RNA, 20 nt, Human
caaggucauggccacacugu

SEQ ID NO: 3568158 - RNA, 20 nt, Human
caaggucauuuuuuuuaaga

SEQ ID NO: 3568159 - RNA, 20 nt, Human
caagguccucugucagucac

SEQ ID NO: 3568160 - RNA, 22 nt, Human
caagguccucugucagucacag

SEQ ID NO: 3568161 - RNA, 16 nt, Human
caaggucgguaaguug

SEQ ID NO: 3568162 - RNA, 21 nt, Human
caaggucuagguggagguggg

SEQ ID NO: 3568163 - RNA, 20 nt, Human
caaggucugagccacagcag

SEQ ID NO: 3568164 - RNA, 21 nt, Human
caaggucugagccacagcagc

SEQ ID NO: 3568165 - RNA, 13 nt, Human
caaggucugcuuu

SEQ ID NO: 3568166 - RNA, 13 nt, Human
caaggucuuuaaa

SEQ ID NO: 3568167 - RNA, 14 nt, Human
caaggugacagaag

SEQ ID NO: 3568168 - RNA, 20 nt, Human
caaggugacagaaggaccag

SEQ ID NO: 3568169 - RNA, 14 nt, Human
caaggugcaggcag

SEQ ID NO: 3568170 - RNA, 19 nt, Human
caaggugcaggcaggcugg

SEQ ID NO: 3568171 - RNA, 13 nt, Human
caaggugcucaca

SEQ ID NO: 3568172 - RNA, 23 nt, Human
caaggugcuguugucauugcuuu

SEQ ID NO: 3568173 - RNA, 13 nt, Human
caagguggagugg

SEQ ID NO: 3568174 - RNA, 18 nt, Human
caagguggaguggaugcc

SEQ ID NO: 3568175 - RNA, 23 nt, Human
caaggugggaggauugcuugagc

SEQ ID NO: 3568176 - RNA, 21 nt, Human
caaggugggcugagcccuggc

SEQ ID NO: 3568177 - RNA, 22 nt, Human
caagguggggggaucacaaggu

SEQ ID NO: 3568178 - RNA, 20 nt, Human
caagguggucugcucgggcc

SEQ ID NO: 3568179 - RNA, 17 nt, Human
caagguggugugaucuu

SEQ ID NO: 3568180 - RNA, 18 nt, Human
caagguggugugaucuua

SEQ ID NO: 3568181 - RNA, 17 nt, Human
caaggugucauuuaugu

SEQ ID NO: 3568182 - RNA, 16 nt, Human
caagguguccuacaga

SEQ ID NO: 3568183 - RNA, 18 nt, Human
caagguguccuacagaaa

SEQ ID NO: 3568184 - RNA, 17 nt, Human
caaggugugccccgugg

SEQ ID NO: 3568185 - RNA, 22 nt, Human
caagguuauaauuuuuuuuaaa

SEQ ID NO: 3568186 - RNA, 18 nt, Human
caagguucaacuuauuaa

SEQ ID NO: 3568187 - RNA, 14 nt, Human
caagguuccacaga

SEQ ID NO: 3568188 - RNA, 15 nt, Human
caagguuccacagag

SEQ ID NO: 3568189 - RNA, 18 nt, Human
caagguuccacagaguaa

SEQ ID NO: 3568190 - RNA, 15 nt, Human
caagguucccucuga

SEQ ID NO: 3568191 - RNA, 19 nt, Human
caagguucccucugagaau

SEQ ID NO: 3568192 - RNA, 16 nt, Human
caagguucccuugugg

SEQ ID NO: 3568193 - RNA, 17 nt, Human
caagguuuaaagagucu

SEQ ID NO: 3568194 - RNA, 15 nt, Human
caagguuuaaguuau

SEQ ID NO: 3568195 - RNA, 20 nt, Human
caagguuuaggcugguggcc

SEQ ID NO: 3568196 - RNA, 19 nt, Human
caagguuuuauaaggcuga

SEQ ID NO: 3568197 - RNA, 15 nt, Human
caaguaaaaaggcua

SEQ ID NO: 3568198 - RNA, 13 nt, Human
caaguaaacauuc

SEQ ID NO: 3568199 - RNA, 17 nt, Human
caaguaacaaaaauaaa

SEQ ID NO: 3568200 - RNA, 22 nt, Human
caaguaagagacucagccugca

SEQ ID NO: 3568201 - RNA, 17 nt, Human
caaguaagaggcuggag

SEQ ID NO: 3568202 - RNA, 23 nt, Human
caaguaauauaauggaagagaaa

SEQ ID NO: 3568203 - RNA, 23 nt, Human
caaguaauucugcugucucagcc

SEQ ID NO: 3568204 - RNA, 24 nt, Human
caaguacaaccacacccacacuca

SEQ ID NO: 3568205 - RNA, 13 nt, Human
caaguacugcugu

SEQ ID NO: 3568206 - RNA, 22 nt, Human
caaguagauaggaagaaagaag

SEQ ID NO: 3568207 - RNA, 18 nt, Human
caaguagaugccugaacu

SEQ ID NO: 3568208 - RNA, 18 nt, Human
caaguaguucuguauuug

SEQ ID NO: 3568209 - RNA, 15 nt, Human
caaguauagaaaauc

SEQ ID NO: 3568210 - RNA, 22 nt, Human
caaguaugugggcagauuuuca

SEQ ID NO: 3568211 - RNA, 24 nt, Human
caaguauuacuaaauugaccuuua

SEQ ID NO: 3568212 - RNA, 20 nt, Human
caaguauuagggguaauaua

SEQ ID NO: 3568213 - RNA, 22 nt, Human
caaguauuauaaacaagaauga

SEQ ID NO: 3568214 - RNA, 22 nt, Human
caaguauuauaccuuuuuuaga

SEQ ID NO: 3568215 - RNA, 22 nt, Human
caaguauuugggaagugaagac

SEQ ID NO: 3568216 - RNA, 20 nt, Human
caaguauuuguuaauuuaga

SEQ ID NO: 3568217 - RNA, 15 nt, Human
caaguauuuuuaauu

SEQ ID NO: 3568218 - RNA, 15 nt, Human
caagucaaauuaaua

SEQ ID NO: 3568219 - RNA, 19 nt, Human
caagucaaccaauguagaa

SEQ ID NO: 3568220 - RNA, 13 nt, Human
caagucaagugaa

SEQ ID NO: 3568221 - RNA, 23 nt, Human
caagucaagugaaaaaggaggaa

SEQ ID NO: 3568222 - RNA, 14 nt, Human
caagucagaggaug

SEQ ID NO: 3568223 - RNA, 19 nt, Human
caagucagaggauggccag

SEQ ID NO: 3568224 - RNA, 22 nt, Human
caagucaguaggacuccuuauu

SEQ ID NO: 3568225 - RNA, 13 nt, Human
caagucaguuucu

SEQ ID NO: 3568226 - RNA, 20 nt, Human
caagucauagccauaaauga

SEQ ID NO: 3568227 - RNA, 14 nt, Human
caagucauggcugu

SEQ ID NO: 3568228 - RNA, 16 nt, Human
caagucaugugcauuu

SEQ ID NO: 3568229 - RNA, 14 nt, Human
caaguccaagcaua

SEQ ID NO: 3568230 - RNA, 18 nt, Human
caaguccaauaagacacu

SEQ ID NO: 3568231 - RNA, 15 nt, Human
caaguccagguccug

SEQ ID NO: 3568232 - RNA, 16 nt, Human
caaguccagguccugg

SEQ ID NO: 3568233 - RNA, 14 nt, Human
caagucccagcgcg

SEQ ID NO: 3568234 - RNA, 18 nt, Human
caagucccugacucucug

SEQ ID NO: 3568235 - RNA, 20 nt, Human
caagucccuguaauuguugu

SEQ ID NO: 3568236 - RNA, 16 nt, Human
caaguccgcagaagcc

SEQ ID NO: 3568237 - RNA, 15 nt, Human
caaguccugaagagg

SEQ ID NO: 3568238 - RNA, 15 nt, Human
caaguccugugaauu

SEQ ID NO: 3568239 - RNA, 18 nt, Human
caaguccuuaccucuucc

SEQ ID NO: 3568240 - RNA, 20 nt, Human
caagucuaugaugcuguugc

SEQ ID NO: 3568241 - RNA, 16 nt, Human
caagucucaguggcuu

SEQ ID NO: 3568242 - RNA, 23 nt, Human
caagucucaguggcuucaucugu

SEQ ID NO: 3568243 - RNA, 18 nt, Human
caagucucugcuggccca

SEQ ID NO: 3568244 - RNA, 19 nt, Human
caagucucugcuggcccag

SEQ ID NO: 3568245 - RNA, 12 nt, Human
caagucugcagg

SEQ ID NO: 3568246 - RNA, 17 nt, Human
caagucugcaggugcac

SEQ ID NO: 3568247 - RNA, 17 nt, Human
caagucugugccuggag

SEQ ID NO: 3568248 - RNA, 20 nt, Human
caagucuuuaggucuuugua

SEQ ID NO: 3568249 - RNA, 21 nt, Human
caagucuuuaggucuuuguaa

SEQ ID NO: 3568250 - RNA, 23 nt, Human
caagucuuucucuuucccugguc

SEQ ID NO: 3568251 - RNA, 19 nt, Human
caagugaaaaaggaggaag

SEQ ID NO: 3568252 - RNA, 18 nt, Human
aggccccgaggacccaga

SEQ ID NO: 3568253 - RNA, 19 nt, Human
aggccccgaggacccagac

SEQ ID NO: 3568254 - RNA, 23 nt, Human
aggccccgaggacccagacccag

SEQ ID NO: 3568255 - RNA, 15 nt, Human
aggccccgcuugucc

SEQ ID NO: 3568256 - RNA, 12 nt, Human
aggccccugcca

SEQ ID NO: 3568257 - RNA, 13 nt, Human
aggccccugccac

SEQ ID NO: 3568258 - RNA, 18 nt, Human
aggccccugccacccugg

SEQ ID NO: 3568259 - RNA, 17 nt, Human
aggccccuggacaagca

SEQ ID NO: 3568260 - RNA, 14 nt, Human
aggccccuggagcc

SEQ ID NO: 3568261 - RNA, 14 nt, Human
aggccccuggccca

SEQ ID NO: 3568262 - RNA, 19 nt, Human
aggccccuucucucccugc

SEQ ID NO: 3568263 - RNA, 15 nt, Human
aggcccgagcagcug

SEQ ID NO: 3568264 - RNA, 22 nt, Human
aggcccgagcagcugagcaggg

SEQ ID NO: 3568265 - RNA, 19 nt, Human
aggcccgcaugcggcccag

SEQ ID NO: 3568266 - RNA, 15 nt, Human
aggcccggcuccagg

SEQ ID NO: 3568267 - RNA, 18 nt, Human
aggcccggcuccaggcuc

SEQ ID NO: 3568268 - RNA, 15 nt, Human
aggcccgucugucca

SEQ ID NO: 3568269 - RNA, 16 nt, Human
aggcccgucuguccau

SEQ ID NO: 3568270 - RNA, 23 nt, Human
aggcccucaagucuuucucuuuc

SEQ ID NO: 3568271 - RNA, 17 nt, Human
aggcccuccacaccugc

SEQ ID NO: 3568272 - RNA, 19 nt, Human
aggcccuccacaccugcgg

SEQ ID NO: 3568273 - RNA, 21 nt, Human
aggcccuccacaccugcggcc

SEQ ID NO: 3568274 - RNA, 23 nt, Human
aggcccuccucucccauccuuga

SEQ ID NO: 3568275 - RNA, 15 nt, Human
aggcccuccugugcu

SEQ ID NO: 3568276 - RNA, 21 nt, Human
aggcccuccugugcuggggga

SEQ ID NO: 3568277 - RNA, 15 nt, Human
aggcccucgcugcca

SEQ ID NO: 3568278 - RNA, 17 nt, Human
aggcccucgcugccagc

SEQ ID NO: 3568279 - RNA, 22 nt, Human
aggcccucgcugccagcucugu

SEQ ID NO: 3568280 - RNA, 15 nt, Human
aggcccucgggccca

SEQ ID NO: 3568281 - RNA, 13 nt, Human
aggcccucugccc

SEQ ID NO: 3568282 - RNA, 14 nt, Human
aggcccucugccca

SEQ ID NO: 3568283 - RNA, 22 nt, Human
aggcccucugcccacucccugc

SEQ ID NO: 3568284 - RNA, 23 nt, Human
aggcccucugcccacucccugca

SEQ ID NO: 3568285 - RNA, 18 nt, Human
aggcccugcacuguccug

SEQ ID NO: 3568286 - RNA, 19 nt, Human
aggcccugcacuguccugc

SEQ ID NO: 3568287 - RNA, 23 nt, Human
aggcccugcacuguccugcucca

SEQ ID NO: 3568288 - RNA, 24 nt, Human
aggcccugcacuguccugcuccac

SEQ ID NO: 3568289 - RNA, 12 nt, Human
aggcccugcagu

SEQ ID NO: 3568290 - RNA, 13 nt, Human
aggcccugcagug

SEQ ID NO: 3568291 - RNA, 11 nt, Human
aggcccugcau

SEQ ID NO: 3568292 - RNA, 17 nt, Human
aggcccugcuccugcag

SEQ ID NO: 3568293 - RNA, 21 nt, Human
aggcccuggccuccccugcca

SEQ ID NO: 3568294 - RNA, 22 nt, Human
aggcccuggccuccccugccac

SEQ ID NO: 3568295 - RNA, 23 nt, Human
aggcccuggccuccccugccacc

SEQ ID NO: 3568296 - RNA, 13 nt, Human
aggcccuuccucu

SEQ ID NO: 3568297 - RNA, 15 nt, Human
aggcccuuccucucc

SEQ ID NO: 3568298 - RNA, 17 nt, Human
aggcccuuccucuccac

SEQ ID NO: 3568299 - RNA, 22 nt, Human
aggcccuuccucuccacugccu

SEQ ID NO: 3568300 - RNA, 12 nt, Human
aggcccuucucu

SEQ ID NO: 3568301 - RNA, 24 nt, Human
aggcccuuugaagccucagcuacc

SEQ ID NO: 3568302 - RNA, 16 nt, Human
aggcccuuugcugucc

SEQ ID NO: 3568303 - RNA, 23 nt, Human
aggccgaagcuaacagggaaggc

SEQ ID NO: 3568304 - RNA, 14 nt, Human
aggccgaagcucug

SEQ ID NO: 3568305 - RNA, 17 nt, Human
aggccgaagcucuggcu

SEQ ID NO: 3568306 - RNA, 15 nt, Human
aggccgagaagcaag

SEQ ID NO: 3568307 - RNA, 17 nt, Human
aggccgagaagccagug

SEQ ID NO: 3568308 - RNA, 19 nt, Human
aggccgaggccaugugcau

SEQ ID NO: 3568309 - RNA, 16 nt, Human
aggccgaggcgggugg

SEQ ID NO: 3568310 - RNA, 16 nt, Human
aggccgcagcucuugc

SEQ ID NO: 3568311 - RNA, 22 nt, Human
aggccgcagcucuugcccuucc

SEQ ID NO: 3568312 - RNA, 19 nt, Human
aggccgccccagccucuga

SEQ ID NO: 3568313 - RNA, 17 nt, Human
aggccgcuagaggccug

SEQ ID NO: 3568314 - RNA, 17 nt, Human
aggccgcuguucaccca

SEQ ID NO: 3568315 - RNA, 16 nt, Human
aggccggcagccccag

SEQ ID NO: 3568316 - RNA, 23 nt, Human
aggccggcagccccagccugcua

SEQ ID NO: 3568317 - RNA, 19 nt, Human
aggccggcuugccacaccc

SEQ ID NO: 3568318 - RNA, 20 nt, Human
aggccggcuugccacacccc

SEQ ID NO: 3568319 - RNA, 14 nt, Human
aggccgggcagagc

SEQ ID NO: 3568320 - RNA, 15 nt, Human
aggccgggccuguac

SEQ ID NO: 3568321 - RNA, 17 nt, Human
aggccgggccuguacag

SEQ ID NO: 3568322 - RNA, 20 nt, Human
aggccgggccuguacagucu

SEQ ID NO: 3568323 - RNA, 16 nt, Human
aggccguccucccggg

SEQ ID NO: 3568324 - RNA, 20 nt, Human
aggccgugacgucugggugg

SEQ ID NO: 3568325 - RNA, 20 nt, Human
aggccguggcugcuguggga

SEQ ID NO: 3568326 - RNA, 21 nt, Human
aggccguugccgcugauguuu

SEQ ID NO: 3568327 - RNA, 19 nt, Human
aggccuaaucucauaccuc

SEQ ID NO: 3568328 - RNA, 22 nt, Human
aggccuaauucuaugccugucu

SEQ ID NO: 3568329 - RNA, 21 nt, Human
aggccuagacucugucuaccu

SEQ ID NO: 3568330 - RNA, 21 nt, Human
aggccuaggaggguccucuga

SEQ ID NO: 3568331 - RNA, 17 nt, Human
aggccuaguccugcgaa

SEQ ID NO: 3568332 - RNA, 16 nt, Human
aggccuauaaccccag

SEQ ID NO: 3568333 - RNA, 22 nt, Human
aggccuauaaugaagcuuuaua

SEQ ID NO: 3568334 - RNA, 14 nt, Human
aggccuauuucauc

SEQ ID NO: 3568335 - RNA, 21 nt, Human
aggccuauuucaucacaagaa

SEQ ID NO: 3568336 - RNA, 18 nt, Human
aggccucaccucuaccca

SEQ ID NO: 3568337 - RNA, 19 nt, Human
aggccucaccucuacccaa

SEQ ID NO: 3568338 - RNA, 18 nt, Human
aggccucagggcuccuug

SEQ ID NO: 3568339 - RNA, 23 nt, Human
aggccucaguggacuuuccaccc

SEQ ID NO: 3568340 - RNA, 17 nt, Human
aggccuccagcucagca

SEQ ID NO: 3568341 - RNA, 15 nt, Human
aggccucccuagcca

SEQ ID NO: 3568342 - RNA, 14 nt, Human
aggccucccugcca

SEQ ID NO: 3568343 - RNA, 23 nt, Human
aggccuccuggcugucugaggcu

SEQ ID NO: 3568344 - RNA, 20 nt, Human
aggccucgaaaaccaucaca

SEQ ID NO: 3568345 - RNA, 21 nt, Human
aggccucucauuccagaggaa

SEQ ID NO: 3568346 - RNA, 16 nt, Human
aggccucuguguccuu

SEQ ID NO: 3568347 - RNA, 23 nt, Human
aggccucuuggaccucugcucug

SEQ ID NO: 3568348 - RNA, 17 nt, Human
aggccucuuggagaccu

SEQ ID NO: 3568349 - RNA, 17 nt, Human
aggccugaaagaggcug

SEQ ID NO: 3568350 - RNA, 18 nt, Human
aggccugaaauccugguu

SEQ ID NO: 3568351 - RNA, 13 nt, Human
aggccugaagcca

SEQ ID NO: 3568352 - RNA, 19 nt, Human
aggccugaagccagcugcc

SEQ ID NO: 3568353 - RNA, 19 nt, Human
aggccugaaucaugagccu

SEQ ID NO: 3568354 - RNA, 20 nt, Human
aggccugaaucaugagccug

SEQ ID NO: 3568355 - RNA, 23 nt, Human
aggccugaauccaaaagaaaaac

SEQ ID NO: 3568356 - RNA, 17 nt, Human
aggccugacugccaagc

SEQ ID NO: 3568357 - RNA, 18 nt, Human
aggccugacugccaagcc

SEQ ID NO: 3568358 - RNA, 22 nt, Human
aggccugacugccaagccaugg

SEQ ID NO: 3568359 - RNA, 17 nt, Human
aggccugagauuucauc

SEQ ID NO: 3568360 - RNA, 20 nt, Human
aggccugaggaugagcugga

SEQ ID NO: 3568361 - RNA, 16 nt, Human
aggccugaucugccca

SEQ ID NO: 3568362 - RNA, 18 nt, Human
aggccugcagccuggagc

SEQ ID NO: 3568363 - RNA, 16 nt, Human
aggccugcccucaggg

SEQ ID NO: 3568364 - RNA, 17 nt, Human
aggccugcccucaggga

SEQ ID NO: 3568365 - RNA, 22 nt, Human
aggccugcccucagggaucuug

SEQ ID NO: 3568366 - RNA, 13 nt, Human
aggccugccuguu

SEQ ID NO: 3568367 - RNA, 17 nt, Human
aggccugcgacccuggg

SEQ ID NO: 3568368 - RNA, 20 nt, Human
aggccugcgacccugggggc

SEQ ID NO: 3568369 - RNA, 23 nt, Human
aggccugcucccuguagggucca

SEQ ID NO: 3568370 - RNA, 13 nt, Human
aggccuggcacag

SEQ ID NO: 3568371 - RNA, 14 nt, Human
aggccuggcacagu

SEQ ID NO: 3568372 - RNA, 21 nt, Human
aggccuggcauggcaccuguc

SEQ ID NO: 3568373 - RNA, 11 nt, Human
aggccuggcca

SEQ ID NO: 3568374 - RNA, 15 nt, Human
aggccuggccagaug

SEQ ID NO: 3568375 - RNA, 16 nt, Human
aggccuggccagaugc

SEQ ID NO: 3568376 - RNA, 13 nt, Human
aggccugggcagu

SEQ ID NO: 3568377 - RNA, 14 nt, Human
aggccugggcagug

SEQ ID NO: 3568378 - RNA, 15 nt, Human
aggccugggcagugg

SEQ ID NO: 3568379 - RNA, 17 nt, Human
aggccugggggcaggga

SEQ ID NO: 3568380 - RNA, 11 nt, Human
aggccuggggu

SEQ ID NO: 3568381 - RNA, 21 nt, Human
aggccugggucugugucucuu

SEQ ID NO: 3568382 - RNA, 17 nt, Human
aggccugggugcuggcu

SEQ ID NO: 3568383 - RNA, 23 nt, Human
aggccugggugcuggcugcccag

SEQ ID NO: 3568384 - RNA, 23 nt, Human
aggccuggguggaucggccuccu

SEQ ID NO: 3568385 - RNA, 22 nt, Human
aggccugucccuggccaucucu

SEQ ID NO: 3568386 - RNA, 13 nt, Human
aggccugucugug

SEQ ID NO: 3568387 - RNA, 20 nt, Human
aggccuguguagcugugacc

SEQ ID NO: 3568388 - RNA, 23 nt, Human
aggccugugugugaaaggaagcu

SEQ ID NO: 3568389 - RNA, 16 nt, Human
aggccuguuuggccuc

SEQ ID NO: 3568390 - RNA, 20 nt, Human
aggccuuaucauucauucuu

SEQ ID NO: 3568391 - RNA, 21 nt, Human
aggccuucaggguucagcagu

SEQ ID NO: 3568392 - RNA, 20 nt, Human
aggccuuccagcugcugucu

SEQ ID NO: 3568393 - RNA, 15 nt, Human
aggccuuccucucuc

SEQ ID NO: 3568394 - RNA, 21 nt, Human
aggccuucuugugaucuugcu

SEQ ID NO: 3568395 - RNA, 20 nt, Human
aggccuugcggcuccucagg

SEQ ID NO: 3568396 - RNA, 22 nt, Human
aggccuugcggcuccucaggga

SEQ ID NO: 3568397 - RNA, 17 nt, Human
aggccuugggcucugcu

SEQ ID NO: 3568398 - RNA, 15 nt, Human
aggccuuuaaaauuu

SEQ ID NO: 3568399 - RNA, 14 nt, Human
aggccuuuaaccau

SEQ ID NO: 3568400 - RNA, 18 nt, Human
aggccuuucccuaagcca

SEQ ID NO: 3568401 - RNA, 20 nt, Human
aggccuuucccuaagccagc

SEQ ID NO: 3568402 - RNA, 22 nt, Human
aggcgaggaggccguugccgcu

SEQ ID NO: 3568403 - RNA, 15 nt, Human
aggcgagugccagga

SEQ ID NO: 3568404 - RNA, 24 nt, Human
aggcgagugccaggacuccccagg

SEQ ID NO: 3568405 - RNA, 23 nt, Human
aggcgauccaccugucucagccu

SEQ ID NO: 3568406 - RNA, 20 nt, Human
aggcgcaagggaggcccagc

SEQ ID NO: 3568407 - RNA, 21 nt, Human
aggcgcacugugacccccagc

SEQ ID NO: 3568408 - RNA, 21 nt, Human
aggcgccccaacccguggagg

SEQ ID NO: 3568409 - RNA, 13 nt, Human
aggcgcuaacuug

SEQ ID NO: 3568410 - RNA, 15 nt, Human
aggcgcuaacuugcu

SEQ ID NO: 3568411 - RNA, 15 nt, Human
aggcggacguuccag

SEQ ID NO: 3568412 - RNA, 12 nt, Human
aggcggccccuc

SEQ ID NO: 3568413 - RNA, 14 nt, Human
aggcggccccuccc

SEQ ID NO: 3568414 - RNA, 21 nt, Human
aggcggccuuuguugcucagc

SEQ ID NO: 3568415 - RNA, 14 nt, Human
aggcgggaggaggu

SEQ ID NO: 3568416 - RNA, 14 nt, Human
aggcgggaguggag

SEQ ID NO: 3568417 - RNA, 17 nt, Human
aggcgggccagccaggc

SEQ ID NO: 3568418 - RNA, 23 nt, Human
aggcgggccagccaggcgggcuc

SEQ ID NO: 3568419 - RNA, 18 nt, Human
aggcggggcuugccuucu

SEQ ID NO: 3568420 - RNA, 17 nt, Human
aggcgggggcugcccuu

SEQ ID NO: 3568421 - RNA, 19 nt, Human
aggcgucccgcaccugucu

SEQ ID NO: 3568422 - RNA, 21 nt, Human
aggcgugagccaccgugccug

SEQ ID NO: 3568423 - RNA, 14 nt, Human
aggcgugaggaugg

SEQ ID NO: 3568424 - RNA, 18 nt, Human
aggcguggagcugccuga

SEQ ID NO: 3568425 - RNA, 17 nt, Human
aggcguugcuuucacuc

SEQ ID NO: 3568426 - RNA, 15 nt, Human
aggcuaaaaagcaac

SEQ ID NO: 3568427 - RNA, 15 nt, Human
aggcuaaaauguuuu

SEQ ID NO: 3568428 - RNA, 16 nt, Human
aggcuaaaauguuuuc

SEQ ID NO: 3568429 - RNA, 17 nt, Human
aggcuaaaauguuuuca

SEQ ID NO: 3568430 - RNA, 14 nt, Human
aggcuaagcugccg

SEQ ID NO: 3568431 - RNA, 15 nt, Human
aggcuaaggcgugga

SEQ ID NO: 3568432 - RNA, 17 nt, Human
aggcuaaguugggaucu

SEQ ID NO: 3568433 - RNA, 22 nt, Human
aggcuaauguuggcagaugcag

SEQ ID NO: 3568434 - RNA, 22 nt, Human
aggcuaauuuuuuuguauuuua

SEQ ID NO: 3568435 - RNA, 23 nt, Human
aggcuacaauuuucucccaggaa

SEQ ID NO: 3568436 - RNA, 13 nt, Human
aggcuacagagaa

SEQ ID NO: 3568437 - RNA, 15 nt, Human
aggcuacagagaagc

SEQ ID NO: 3568438 - RNA, 20 nt, Human
aggcuacagagaagccuuca

SEQ ID NO: 3568439 - RNA, 15 nt, Human
aggcuaccuuuguau

SEQ ID NO: 3568440 - RNA, 17 nt, Human
aggcuacuucggggcug

SEQ ID NO: 3568441 - RNA, 17 nt, Human
aggcuagcuggagccug

SEQ ID NO: 3568442 - RNA, 18 nt, Human
aggcuagcuggagccugg

SEQ ID NO: 3568443 - RNA, 21 nt, Human
aggcuaggggguuggaggugg

SEQ ID NO: 3568444 - RNA, 14 nt, Human
aggcuagggugggg

SEQ ID NO: 3568445 - RNA, 23 nt, Human
aggcuauacuugucuuguucacc

SEQ ID NO: 3568446 - RNA, 16 nt, Human
aggcuaugagugggau

SEQ ID NO: 3568447 - RNA, 15 nt, Human
aggcuauuaaaaaag

SEQ ID NO: 3568448 - RNA, 21 nt, Human
aggcuauuguccccuaaacca

SEQ ID NO: 3568449 - RNA, 11 nt, Human
aggcuauuugu

SEQ ID NO: 3568450 - RNA, 21 nt, Human
aggcuauuuguaaaucugcca

SEQ ID NO: 3568451 - RNA, 23 nt, Human
aggcucaaacaaugacaaagcag

SEQ ID NO: 3568452 - RNA, 14 nt, Human
aggcucaaauuuug

SEQ ID NO: 3568453 - RNA, 19 nt, Human
aggcucaacaauaaaacau

SEQ ID NO: 3568454 - RNA, 14 nt, Human
aggcucacugccag

SEQ ID NO: 3568455 - RNA, 21 nt, Human
aggcucacugccaggccagcc

SEQ ID NO: 3568456 - RNA, 22 nt, Human
aggcucacugccaggccagccu

SEQ ID NO: 3568457 - RNA, 23 nt, Human
aggcucacugccaggccagccuc

SEQ ID NO: 3568458 - RNA, 11 nt, Human
aggcucagaga

SEQ ID NO: 3568459 - RNA, 14 nt, Human
aggcucagagaugu

SEQ ID NO: 3568460 - RNA, 20 nt, Human
aggcucagaggguguccugc

SEQ ID NO: 3568461 - RNA, 18 nt, Human
aggcucagcggcgaccgc

SEQ ID NO: 3568462 - RNA, 16 nt, Human
aggcucaggucccugg

SEQ ID NO: 3568463 - RNA, 16 nt, Human
aggcucagucucagga

SEQ ID NO: 3568464 - RNA, 18 nt, Human
aggcucagucucaggagc

SEQ ID NO: 3568465 - RNA, 17 nt, Human
aggcuccacuuggucug

SEQ ID NO: 3568466 - RNA, 21 nt, Human
aggcuccacuuggucugugag

SEQ ID NO: 3568467 - RNA, 13 nt, Human
aggcuccagaggg

SEQ ID NO: 3568468 - RNA, 14 nt, Human
aggcuccagagggc

SEQ ID NO: 3568469 - RNA, 15 nt, Human
aggcuccagagggca

SEQ ID NO: 3568470 - RNA, 16 nt, Human
aggcuccaggagcagc

SEQ ID NO: 3568471 - RNA, 17 nt, Human
aggcuccaggagcagcc

SEQ ID NO: 3568472 - RNA, 20 nt, Human
aggcucccgaggggaagggg

SEQ ID NO: 3568473 - RNA, 13 nt, Human
aggcuccgcccuu

SEQ ID NO: 3568474 - RNA, 20 nt, Human
aggcuccugccaccacgccc

SEQ ID NO: 3568475 - RNA, 21 nt, Human
aggcuccugccaguguggaac

SEQ ID NO: 3568476 - RNA, 12 nt, Human
aggcucgagcau

SEQ ID NO: 3568477 - RNA, 15 nt, Human
aggcucgagcaugcc

SEQ ID NO: 3568478 - RNA, 18 nt, Human
aggcucgagcaugccugg

SEQ ID NO: 3568479 - RNA, 19 nt, Human
aggcucgagcaugccugga

SEQ ID NO: 3568480 - RNA, 15 nt, Human
aggcucgauuuugua

SEQ ID NO: 3568481 - RNA, 17 nt, Human
aggcucgauuuuguauc

SEQ ID NO: 3568482 - RNA, 19 nt, Human
aggcucgauuuuguaucug

SEQ ID NO: 3568483 - RNA, 18 nt, Human
aggcucgccuucccuccu

SEQ ID NO: 3568484 - RNA, 17 nt, Human
aggcucggccugccccc

SEQ ID NO: 3568485 - RNA, 18 nt, Human
aggcucguggacugagug

SEQ ID NO: 3568486 - RNA, 23 nt, Human
aggcucuaaccacacagccuaca

SEQ ID NO: 3568487 - RNA, 20 nt, Human
aggcucuaugagucuagaug

SEQ ID NO: 3568488 - RNA, 16 nt, Human
aggcucucaggccagc

SEQ ID NO: 3568489 - RNA, 18 nt, Human
aggcucucuuugcccagu

SEQ ID NO: 3568490 - RNA, 21 nt, Human
aggcucugagagucuagauuc

SEQ ID NO: 3568491 - RNA, 22 nt, Human
aggcucugagagucuagauucu

SEQ ID NO: 3568492 - RNA, 17 nt, Human
aggcucugcacagaugg

SEQ ID NO: 3568493 - RNA, 11 nt, Human
aggcucugccc

SEQ ID NO: 3568494 - RNA, 12 nt, Human
aggcucugcccu

SEQ ID NO: 3568495 - RNA, 14 nt, Human
aggcucugcccugc

SEQ ID NO: 3568496 - RNA, 14 nt, Human
aggcucugcccuug

SEQ ID NO: 3568497 - RNA, 15 nt, Human
aggcucugcccuugg

SEQ ID NO: 3568498 - RNA, 16 nt, Human
aggcucugcccuuggu

SEQ ID NO: 3568499 - RNA, 14 nt, Human
aggcucugccuucg

SEQ ID NO: 3568500 - RNA, 22 nt, Human
aggcucugccuucgaggucaga

SEQ ID NO: 3568501 - RNA, 16 nt, Human
aggcucugcuucucca

SEQ ID NO: 3568502 - RNA, 22 nt, Human
aggcucugcuucuccaaggaaa

SEQ ID NO: 3568503 - RNA, 14 nt, Human
aggcucuggagccc

SEQ ID NO: 3568504 - RNA, 21 nt, Human
aggcucugugcugacccuccu

SEQ ID NO: 3568505 - RNA, 17 nt, Human
aggcucuguuccacaua

SEQ ID NO: 3568506 - RNA, 16 nt, Human
aggcucuguuuaugcu

SEQ ID NO: 3568507 - RNA, 23 nt, Human
aggcucuuuggggucagccaggg

SEQ ID NO: 3568508 - RNA, 14 nt, Human
aggcugaaaacaau

SEQ ID NO: 3568509 - RNA, 20 nt, Human
aggcugaacuuguuuucugg

SEQ ID NO: 3568510 - RNA, 15 nt, Human
aggcugaccaagaga

SEQ ID NO: 3568511 - RNA, 17 nt, Human
aggcugaccaagagaga

SEQ ID NO: 3568512 - RNA, 20 nt, Human
aggcugaccaagagagaaag

SEQ ID NO: 3568513 - RNA, 13 nt, Human
aggcugaccacag

SEQ ID NO: 3568514 - RNA, 22 nt, Human
aggcugaccuugaacuccuggg

SEQ ID NO: 3568515 - RNA, 16 nt, Human
aggcugacgugugagg

SEQ ID NO: 3568516 - RNA, 15 nt, Human
aggcugagacaggag

SEQ ID NO: 3568517 - RNA, 18 nt, Human
aggcugagacaggagaau

SEQ ID NO: 3568518 - RNA, 18 nt, Human
aggcugagacagugaauu

SEQ ID NO: 3568519 - RNA, 11 nt, Human
aggcugagcca

SEQ ID NO: 3568520 - RNA, 18 nt, Human
aggcugaggaaaggccag

SEQ ID NO: 3568521 - RNA, 20 nt, Human
aggcugaggaaaggccagcu

SEQ ID NO: 3568522 - RNA, 22 nt, Human
aggcugaggaaaggccagcugg

SEQ ID NO: 3568523 - RNA, 15 nt, Human
aggcugaggcagaag

SEQ ID NO: 3568524 - RNA, 17 nt, Human
aggcugaggcagaagaa

SEQ ID NO: 3568525 - RNA, 15 nt, Human
aggcugaggcaggag

SEQ ID NO: 3568526 - RNA, 16 nt, Human
aggcugaggcaggaga

SEQ ID NO: 3568527 - RNA, 18 nt, Human
aggcugaggcaggagacu

SEQ ID NO: 3568528 - RNA, 17 nt, Human
aggcugaggcaggagga

SEQ ID NO: 3568529 - RNA, 15 nt, Human
aggcugaggccugga

SEQ ID NO: 3568530 - RNA, 16 nt, Human
aggcugaggccuggac

SEQ ID NO: 3568531 - RNA, 16 nt, Human
aggcugaggcgggugg

SEQ ID NO: 3568532 - RNA, 16 nt, Human
aggcugaggcuggcac

SEQ ID NO: 3568533 - RNA, 19 nt, Human
aggcugagguugcgccacu

SEQ ID NO: 3568534 - RNA, 14 nt, Human
aggcugagugcagg

SEQ ID NO: 3568535 - RNA, 15 nt, Human
aggcugagugcaggc

SEQ ID NO: 3568536 - RNA, 23 nt, Human
aggcugagugcaggcccacccug

SEQ ID NO: 3568537 - RNA, 24 nt, Human
aggcugagugcaggcccacccugc

SEQ ID NO: 3568538 - RNA, 15 nt, Human
aggcugauuucuagg

SEQ ID NO: 3568539 - RNA, 20 nt, Human
aggcugcagaaggccaagaa

SEQ ID NO: 3568540 - RNA, 14 nt, Human
aggcugcagcugga

SEQ ID NO: 3568541 - RNA, 21 nt, Human
aggcugcagucagucaugaug

SEQ ID NO: 3568542 - RNA, 13 nt, Human
aggcugcauagaa

SEQ ID NO: 3568543 - RNA, 21 nt, Human
aggcugcauugaaaagagcug

SEQ ID NO: 3568544 - RNA, 11 nt, Human
aggcugccagu

SEQ ID NO: 3568545 - RNA, 13 nt, Human
aggcugccagugc

SEQ ID NO: 3568546 - RNA, 19 nt, Human
aggcugccagugccugggu

SEQ ID NO: 3568547 - RNA, 12 nt, Human
aggcugcccccg

SEQ ID NO: 3568548 - RNA, 14 nt, Human
aggcugcccuccug

SEQ ID NO: 3568549 - RNA, 16 nt, Human
aggcugccguccccua

SEQ ID NO: 3568550 - RNA, 22 nt, Human
aggcugccguccccuagagucc

SEQ ID NO: 3568551 - RNA, 16 nt, Human
aggcugccucccaaca

SEQ ID NO: 3568552 - RNA, 19 nt, Human
aggcugccugagcaccucc

SEQ ID NO: 3568553 - RNA, 16 nt, Human
aggcugcgucuggagg

SEQ ID NO: 3568554 - RNA, 22 nt, Human
aggcugcucggggugcacagga

SEQ ID NO: 3568555 - RNA, 23 nt, Human
aggcugcucuugaacuccugacc

SEQ ID NO: 3568556 - RNA, 15 nt, Human
aggcugcuggcgccu

SEQ ID NO: 3568557 - RNA, 20 nt, Human
aggcugcuggcgccucugca

SEQ ID NO: 3568558 - RNA, 21 nt, Human
aggcugcuggcgccucugcaa

SEQ ID NO: 3568559 - RNA, 22 nt, Human
aggcugcuguacugaaguaaaa

SEQ ID NO: 3568560 - RNA, 14 nt, Human
aggcugcuuagaau

SEQ ID NO: 3568561 - RNA, 13 nt, Human
aggcugcuuggga

SEQ ID NO: 3568562 - RNA, 19 nt, Human
aggcugcuuuccaaagcca

SEQ ID NO: 3568563 - RNA, 22 nt, Human
aggcuggaagauagcugugacu

SEQ ID NO: 3568564 - RNA, 16 nt, Human
aggcuggaaggaggaa

SEQ ID NO: 3568565 - RNA, 18 nt, Human
aggcuggaaggaggaaga

SEQ ID NO: 3568566 - RNA, 14 nt, Human
aggcuggacuccag

SEQ ID NO: 3568567 - RNA, 13 nt, Human
aggcuggagaagc

SEQ ID NO: 3568568 - RNA, 14 nt, Human
aggcuggagcuggc

SEQ ID NO: 3568569 - RNA, 20 nt, Human
aggcuggagugcaguggcgu

SEQ ID NO: 3568570 - RNA, 14 nt, Human
aggcuggcacagga

SEQ ID NO: 3568571 - RNA, 16 nt, Human
aggcuggcacaggaca

SEQ ID NO: 3568572 - RNA, 12 nt, Human
aggcuggcauga

SEQ ID NO: 3568573 - RNA, 13 nt, Human
aggcuggccagcc

SEQ ID NO: 3568574 - RNA, 17 nt, Human
aggcuggccagccccac

SEQ ID NO: 3568575 - RNA, 14 nt, Human
aggcuggccagccg

SEQ ID NO: 3568576 - RNA, 16 nt, Human
aggcuggccagccgcu

SEQ ID NO: 3568577 - RNA, 14 nt, Human
aggcuggcccugcc

SEQ ID NO: 3568578 - RNA, 17 nt, Human
aggcuggcgagagucug

SEQ ID NO: 3568579 - RNA, 22 nt, Human
aggcuggcgagagucuggcccu

SEQ ID NO: 3568580 - RNA, 14 nt, Human
aggcuggcgcagcc

SEQ ID NO: 3568581 - RNA, 13 nt, Human
aggcuggcgugca

SEQ ID NO: 3568582 - RNA, 15 nt, Human
aggcuggcuggggcc

SEQ ID NO: 3568583 - RNA, 22 nt, Human
aggcugggaauggaggggcaga

SEQ ID NO: 3568584 - RNA, 17 nt, Human
aggcugggaccacguga

SEQ ID NO: 3568585 - RNA, 21 nt, Human
aggcugggagagccuuccagg

SEQ ID NO: 3568586 - RNA, 12 nt, Human
aggcugggccau

SEQ ID NO: 3568587 - RNA, 20 nt, Human
aggcugggcccagaggcaca

SEQ ID NO: 3568588 - RNA, 21 nt, Human
aggcugggcccagaggcacag

SEQ ID NO: 3568589 - RNA, 14 nt, Human
aggcugggcucccu

SEQ ID NO: 3568590 - RNA, 21 nt, Human
aggcugggcucccuucccacc

SEQ ID NO: 3568591 - RNA, 23 nt, Human
aggcugggcucccuucccaccuc

SEQ ID NO: 3568592 - RNA, 21 nt, Human
aggcuggggcugaccuuccuc

SEQ ID NO: 3568593 - RNA, 19 nt, Human
aggcugggggagagccgug

SEQ ID NO: 3568594 - RNA, 14 nt, Human
aggcugggucgccc

SEQ ID NO: 3568595 - RNA, 18 nt, Human
aggcugggucgcccugga

SEQ ID NO: 3568596 - RNA, 20 nt, Human
aggcugggucgcccuggacu

SEQ ID NO: 3568597 - RNA, 21 nt, Human
aggcugggucgcccuggacug

SEQ ID NO: 3568598 - RNA, 14 nt, Human
aggcugggugccca

SEQ ID NO: 3568599 - RNA, 16 nt, Human
aggcugggugcccaca

SEQ ID NO: 3568600 - RNA, 22 nt, Human
aggcuggucucaaacuccugac

SEQ ID NO: 3568601 - RNA, 20 nt, Human
aggcuggugcuguggccagg

SEQ ID NO: 3568602 - RNA, 17 nt, Human
aggcugguggcccagga

SEQ ID NO: 3568603 - RNA, 21 nt, Human
aggcugguuuuggcaucucug

SEQ ID NO: 3568604 - RNA, 15 nt, Human
aggcuguaacuacuu

SEQ ID NO: 3568605 - RNA, 23 nt, Human
aggcuguaucccaugagccucag

SEQ ID NO: 3568606 - RNA, 16 nt, Human
aggcuguauucagcaa

SEQ ID NO: 3568607 - RNA, 19 nt, Human
aggcugucaauuacaggaa

SEQ ID NO: 3568608 - RNA, 16 nt, Human
aggcugucuguuguau

SEQ ID NO: 3568609 - RNA, 18 nt, Human
aggcugugcagcgcagcu

SEQ ID NO: 3568610 - RNA, 13 nt, Human
aggcugugcuccc

SEQ ID NO: 3568611 - RNA, 17 nt, Human
aggcugugcugcccuga

SEQ ID NO: 3568612 - RNA, 22 nt, Human
aggcugugcugcccugaagaau

SEQ ID NO: 3568613 - RNA, 19 nt, Human
aggcuguggugagggaaga

SEQ ID NO: 3568614 - RNA, 22 nt, Human
aggcugugucccucuucucuuc

SEQ ID NO: 3568615 - RNA, 18 nt, Human
aggcuguguuuggcuuuc

SEQ ID NO: 3568616 - RNA, 16 nt, Human
aggcuguucugcacug

SEQ ID NO: 3568617 - RNA, 19 nt, Human
aggcuguucugcacugaaa

SEQ ID NO: 3568618 - RNA, 16 nt, Human
aggcuguuuuugggug

SEQ ID NO: 3568619 - RNA, 14 nt, Human
aggcuuaaaaacug

SEQ ID NO: 3568620 - RNA, 17 nt, Human
aggcuuaauaaaaauga

SEQ ID NO: 3568621 - RNA, 19 nt, Human
aggcuuaauaaaaaugaca

SEQ ID NO: 3568622 - RNA, 20 nt, Human
aggcuuaauaaaaaugacag

SEQ ID NO: 3568623 - RNA, 18 nt, Human
aggcuuaauaccugggug

SEQ ID NO: 3568624 - RNA, 24 nt, Human
aggcuuagacccucaugcugccaa

SEQ ID NO: 3568625 - RNA, 15 nt, Human
aggcuuagcuuugcu

SEQ ID NO: 3568626 - RNA, 23 nt, Human
aggcuuagggacaggaccccagc

SEQ ID NO: 3568627 - RNA, 19 nt, Human
aggcuuagugauguaauua

SEQ ID NO: 3568628 - RNA, 17 nt, Human
aggcuuauauucaacca

SEQ ID NO: 3568629 - RNA, 18 nt, Human
aggcuucaauuuauugca

SEQ ID NO: 3568630 - RNA, 12 nt, Human
aggcuucacccu

SEQ ID NO: 3568631 - RNA, 14 nt, Human
aggcuuccagagag

SEQ ID NO: 3568632 - RNA, 21 nt, Human
aggcuuccugcaauuuucuaa

SEQ ID NO: 3568633 - RNA, 20 nt, Human
aggcuuccugcguccuccuc

SEQ ID NO: 3568634 - RNA, 19 nt, Human
aggcuuccuucauuuccuc

SEQ ID NO: 3568635 - RNA, 13 nt, Human
aggcuuccuuggc

SEQ ID NO: 3568636 - RNA, 14 nt, Human
aggcuucuccgcca

SEQ ID NO: 3568637 - RNA, 18 nt, Human
aggcuucuccgccagccu

SEQ ID NO: 3568638 - RNA, 22 nt, Human
aggcuucuccgccagccuccuc

SEQ ID NO: 3568639 - RNA, 23 nt, Human
aggcuucuccgccagccuccucu

SEQ ID NO: 3568640 - RNA, 14 nt, Human
aggcuucucucuca

SEQ ID NO: 3568641 - RNA, 16 nt, Human
aggcuucucucucacc

SEQ ID NO: 3568642 - RNA, 18 nt, Human
aggcuucucucucaccag

SEQ ID NO: 3568643 - RNA, 18 nt, Human
aggcuucugcuggggccu

SEQ ID NO: 3568644 - RNA, 22 nt, Human
aggcuucuucagaucagugcuu

SEQ ID NO: 3568645 - RNA, 19 nt, Human
aggcuugcugagaggggcu

SEQ ID NO: 3568646 - RNA, 22 nt, Human
aggcuugggaccgccagauggg

SEQ ID NO: 3568647 - RNA, 12 nt, Human
aggcuuucagcu

SEQ ID NO: 3568648 - RNA, 20 nt, Human
aggcuuugugauagugacau

SEQ ID NO: 3568649 - RNA, 16 nt, Human
aggcuuuguguuguaa

SEQ ID NO: 3568650 - RNA, 18 nt, Human
aggcuuuuuuaucaugug

SEQ ID NO: 3568651 - RNA, 13 nt, Human
agggaaaaauaua

SEQ ID NO: 3568652 - RNA, 14 nt, Human
agggaaaaauauau

SEQ ID NO: 3568653 - RNA, 15 nt, Human
agggaaaacauucca

SEQ ID NO: 3568654 - RNA, 18 nt, Human
agggaaaacauuccaucc

SEQ ID NO: 3568655 - RNA, 14 nt, Human
agggaaaagggaag

SEQ ID NO: 3568656 - RNA, 20 nt, Human
agggaaaauaggcaggaagc

SEQ ID NO: 3568657 - RNA, 22 nt, Human
agggaaacuaagauucuuuuaa

SEQ ID NO: 3568658 - RNA, 23 nt, Human
agggaaacugccagcaacgcagg

SEQ ID NO: 3568659 - RNA, 23 nt, Human
agggaaagaaaguugcacggcug

SEQ ID NO: 3568660 - RNA, 16 nt, Human
agggaaagcauuuaaa

SEQ ID NO: 3568661 - RNA, 13 nt, Human
agggaaagcccau

SEQ ID NO: 3568662 - RNA, 22 nt, Human
agggaaagcccauaugcuacca

SEQ ID NO: 3568663 - RNA, 18 nt, Human
agggaaaggauauuuucu

SEQ ID NO: 3568664 - RNA, 13 nt, Human
agggaaaggccag

SEQ ID NO: 3568665 - RNA, 19 nt, Human
agggaaaggggugcuuuua

SEQ ID NO: 3568666 - RNA, 15 nt, Human
agggaaaguuuuuuu

SEQ ID NO: 3568667 - RNA, 23 nt, Human
agggaaauagcuaauaauguuaa

SEQ ID NO: 3568668 - RNA, 15 nt, Human
agggaaauaucauuu

SEQ ID NO: 3568669 - RNA, 16 nt, Human
agggaaaugaucaguu

SEQ ID NO: 3568670 - RNA, 13 nt, Human
agggaaauguuuu

SEQ ID NO: 3568671 - RNA, 17 nt, Human
agggaaauguuuuguaa

SEQ ID NO: 3568672 - RNA, 18 nt, Human
agggaaauguuuuguaaa

SEQ ID NO: 3568673 - RNA, 13 nt, Human
agggaaauuucag

SEQ ID NO: 3568674 - RNA, 21 nt, Human
agggaacaauuuggcaauuuu

SEQ ID NO: 3568675 - RNA, 18 nt, Human
agggaacagacaggagaa

SEQ ID NO: 3568676 - RNA, 22 nt, Human
agggaaccguuauuauaauugu

SEQ ID NO: 3568677 - RNA, 15 nt, Human
agggaacucuggggu

SEQ ID NO: 3568678 - RNA, 12 nt, Human
agggaagaaacu

SEQ ID NO: 3568679 - RNA, 15 nt, Human
agggaagagaaagug

SEQ ID NO: 3568680 - RNA, 14 nt, Human
agggaagagacagc

SEQ ID NO: 3568681 - RNA, 13 nt, Human
agggaagagugga

SEQ ID NO: 3568682 - RNA, 16 nt, Human
agggaagaucuaacau

SEQ ID NO: 3568683 - RNA, 12 nt, Human
agggaagcccag

SEQ ID NO: 3568684 - RNA, 24 nt, Human
agggaagcccagcuccagggccag

SEQ ID NO: 3568685 - RNA, 16 nt, Human
agggaagccugaaaaa

SEQ ID NO: 3568686 - RNA, 15 nt, Human
agggaaggacagaaa

SEQ ID NO: 3568687 - RNA, 19 nt, Human
agggaaggaggagccuguc

SEQ ID NO: 3568688 - RNA, 22 nt, Human
agggaaggaucccaugagcucc

SEQ ID NO: 3568689 - RNA, 12 nt, Human
agggaaggcagg

SEQ ID NO: 3568690 - RNA, 18 nt, Human
agggaaggcaggcagggc

SEQ ID NO: 3568691 - RNA, 20 nt, Human
agggaaggcaggcagggcuc

SEQ ID NO: 3568692 - RNA, 17 nt, Human
agggaaggccaccugca

SEQ ID NO: 3568693 - RNA, 16 nt, Human
agggaaggccugacuu

SEQ ID NO: 3568694 - RNA, 13 nt, Human
agggaagggagcc

SEQ ID NO: 3568695 - RNA, 15 nt, Human
agggaagggagccaa

SEQ ID NO: 3568696 - RNA, 19 nt, Human
agggaagggagccaaggga

SEQ ID NO: 3568697 - RNA, 14 nt, Human
agggaagggccugc

SEQ ID NO: 3568698 - RNA, 19 nt, Human
agggaaggggggucagaag

SEQ ID NO: 3568699 - RNA, 16 nt, Human
agggaaguaacaguaa

SEQ ID NO: 3568700 - RNA, 15 nt, Human
agggaaguaguccuu

SEQ ID NO: 3568701 - RNA, 15 nt, Human
agggaaguccccagg

SEQ ID NO: 3568702 - RNA, 20 nt, Human
agggaaguugcuggaaagag

SEQ ID NO: 3568703 - RNA, 15 nt, Human
agggaaucacaucuu

SEQ ID NO: 3568704 - RNA, 16 nt, Human
agggaauccaagccuc

SEQ ID NO: 3568705 - RNA, 18 nt, Human
agggaauccccgaaggug

SEQ ID NO: 3568706 - RNA, 15 nt, Human
agggaauccugaccu

SEQ ID NO: 3568707 - RNA, 22 nt, Human
agggaaucuaauauccccaaau

SEQ ID NO: 3568708 - RNA, 21 nt, Human
agggaaugaaggugucagaau

SEQ ID NO: 3568709 - RNA, 23 nt, Human
agggaaugagacaggaccuagga

SEQ ID NO: 3568710 - RNA, 14 nt, Human
agggaaugccugag

SEQ ID NO: 3568711 - RNA, 22 nt, Human
agggaaugccugagugccuggc

SEQ ID NO: 3568712 - RNA, 13 nt, Human
agggaaugugaaa

SEQ ID NO: 3568713 - RNA, 14 nt, Human
agggaaugugaaau

SEQ ID NO: 3568714 - RNA, 14 nt, Human
agggaauucucuug

SEQ ID NO: 3568715 - RNA, 16 nt, Human
agggaauugcagagua

SEQ ID NO: 3568716 - RNA, 15 nt, Human
agggaauuucaggaa

SEQ ID NO: 3568717 - RNA, 21 nt, Human
agggaauuucuucaacucccu

SEQ ID NO: 3568718 - RNA, 13 nt, Human
agggacaaaacuu

SEQ ID NO: 3568719 - RNA, 13 nt, Human
agggacaaagagg

SEQ ID NO: 3568720 - RNA, 19 nt, Human
agggacaaguggacucagg

SEQ ID NO: 3568721 - RNA, 22 nt, Human
agggacaaguggacucagggca

SEQ ID NO: 3568722 - RNA, 17 nt, Human
agggacacacagccuag

SEQ ID NO: 3568723 - RNA, 18 nt, Human
agggacacacagccuagc

SEQ ID NO: 3568724 - RNA, 19 nt, Human
agggacacacagccuagca

SEQ ID NO: 3568725 - RNA, 20 nt, Human
agggacacgggcagccuggc

SEQ ID NO: 3568726 - RNA, 23 nt, Human
agggacacgggcagccuggcucc

SEQ ID NO: 3568727 - RNA, 16 nt, Human
agggacagaggcccca

SEQ ID NO: 3568728 - RNA, 21 nt, Human
agggacagaggccccagccuc

SEQ ID NO: 3568729 - RNA, 20 nt, Human
agggacagaggggguggccu

SEQ ID NO: 3568730 - RNA, 13 nt, Human
agggacauauuca

SEQ ID NO: 3568731 - RNA, 14 nt, Human
agggacaugcuuag

SEQ ID NO: 3568732 - RNA, 19 nt, Human
agggacaugcuuagcaguc

SEQ ID NO: 3568733 - RNA, 14 nt, Human
agggacauguggaa

SEQ ID NO: 3568734 - RNA, 16 nt, Human
agggaccaacugggcc

SEQ ID NO: 3568735 - RNA, 17 nt, Human
agggaccaacugggccc

SEQ ID NO: 3568736 - RNA, 19 nt, Human
agggaccaaggaccccuca

SEQ ID NO: 3568737 - RNA, 11 nt, Human
agggaccagaa

SEQ ID NO: 3568738 - RNA, 15 nt, Human
agggaccagccaaga

SEQ ID NO: 3568739 - RNA, 20 nt, Human
agggaccagccaagagggcu

SEQ ID NO: 3568740 - RNA, 15 nt, Human
agggaccccuccucc

SEQ ID NO: 3568741 - RNA, 15 nt, Human
agggaccccugcccu

SEQ ID NO: 3568742 - RNA, 23 nt, Human
agggaccccugcccuugucccac

SEQ ID NO: 3568743 - RNA, 16 nt, Human
agggacccuuuggggg

SEQ ID NO: 3568744 - RNA, 14 nt, Human
agggaccggcggac

SEQ ID NO: 3568745 - RNA, 15 nt, Human
agggaccucucccag

SEQ ID NO: 3568746 - RNA, 12 nt, Human
agggaccugggg

SEQ ID NO: 3568747 - RNA, 15 nt, Human
agggacgccuggggg

SEQ ID NO: 3568748 - RNA, 18 nt, Human
agggacgccugggggugc

SEQ ID NO: 3568749 - RNA, 17 nt, Human
agggacgcuuugucugu

SEQ ID NO: 3568750 - RNA, 19 nt, Human
agggacuacccauagacau

SEQ ID NO: 3568751 - RNA, 22 nt, Human
agggacuacccauagacaugaa

SEQ ID NO: 3568752 - RNA, 17 nt, Human
agggacuaggagcacug

SEQ ID NO: 3568753 - RNA, 18 nt, Human
agggacucaucuuucccu

SEQ ID NO: 3568754 - RNA, 14 nt, Human
agggacugagaaau

SEQ ID NO: 3568755 - RNA, 17 nt, Human
agggacugagaaauuua

SEQ ID NO: 3568756 - RNA, 16 nt, Human
agggacuugaaguugu

SEQ ID NO: 3568757 - RNA, 19 nt, Human
agggacuuggaagcuccgc

SEQ ID NO: 3568758 - RNA, 16 nt, Human
agggagaagaaaggug

SEQ ID NO: 3568759 - RNA, 21 nt, Human
agggagaccuggacacaggcc

SEQ ID NO: 3568760 - RNA, 21 nt, Human
agggagacuggguaggaaaga

SEQ ID NO: 3568761 - RNA, 13 nt, Human
agggagagaagau

SEQ ID NO: 3568762 - RNA, 14 nt, Human
agggagagaagaua

SEQ ID NO: 3568763 - RNA, 11 nt, Human
agggagagaga

SEQ ID NO: 3568764 - RNA, 13 nt, Human
agggagagagaga

SEQ ID NO: 3568765 - RNA, 14 nt, Human
agggagagcccagg

SEQ ID NO: 3568766 - RNA, 13 nt, Human
agggagaggagug

SEQ ID NO: 3568767 - RNA, 12 nt, Human
agggagaggccg

SEQ ID NO: 3568768 - RNA, 14 nt, Human
agggagagggaggu

SEQ ID NO: 3568769 - RNA, 21 nt, Human
agggagcaaguccuucccuuu

SEQ ID NO: 3568770 - RNA, 22 nt, Human
agggagcacaacccccagcucc

SEQ ID NO: 3568771 - RNA, 14 nt, Human
agggagcagacagg

SEQ ID NO: 3568772 - RNA, 17 nt, Human
agggagcagacaggagg

SEQ ID NO: 3568773 - RNA, 23 nt, Human
agggagcagagaaggccaggggc

SEQ ID NO: 3568774 - RNA, 17 nt, Human
agggagcauagaaggca

SEQ ID NO: 3568775 - RNA, 19 nt, Human
agggagcauagaaggcagg

SEQ ID NO: 3568776 - RNA, 18 nt, Human
agggagcaucagugcccu

SEQ ID NO: 3568777 - RNA, 14 nt, Human
agggagcauggcug

SEQ ID NO: 3568778 - RNA, 13 nt, Human
agggagccaaggg

SEQ ID NO: 3568779 - RNA, 11 nt, Human
agggagccucc

SEQ ID NO: 3568780 - RNA, 14 nt, Human
agggagccuccugc

SEQ ID NO: 3568781 - RNA, 14 nt, Human
agggagccuggccc

SEQ ID NO: 3568782 - RNA, 18 nt, Human
agggagccuuugguucug

SEQ ID NO: 3568783 - RNA, 17 nt, Human
agggagcggaaagcagc

SEQ ID NO: 3568784 - RNA, 15 nt, Human
agggagcugcagggg

SEQ ID NO: 3568785 - RNA, 13 nt, Human
agggagcugggac

SEQ ID NO: 3568786 - RNA, 15 nt, Human
agggagcugggcccg

SEQ ID NO: 3568787 - RNA, 19 nt, Human
agggaggaaaguuucuuug

SEQ ID NO: 3568788 - RNA, 15 nt, Human
agggaggaagaagcu

SEQ ID NO: 3568789 - RNA, 18 nt, Human
agggaggaccacaggugu

SEQ ID NO: 3568790 - RNA, 22 nt, Human
agggaggaccagggcagggcca

SEQ ID NO: 3568791 - RNA, 13 nt, Human
agggaggaccugg

SEQ ID NO: 3568792 - RNA, 22 nt, Human
agggaggacgcucucuggccuu

SEQ ID NO: 3568793 - RNA, 16 nt, Human
agggaggaggccaccu

SEQ ID NO: 3568794 - RNA, 20 nt, Human
agggaggaggccaccucucc

SEQ ID NO: 3568795 - RNA, 14 nt, Human
agggaggcaagccc

SEQ ID NO: 3568796 - RNA, 14 nt, Human
agggaggccgaagc

SEQ ID NO: 3568797 - RNA, 20 nt, Human
agggaggcgggggcugcccu

SEQ ID NO: 3568798 - RNA, 12 nt, Human
agggagggcaga

SEQ ID NO: 3568799 - RNA, 18 nt, Human
agggagggcagagcuggu

SEQ ID NO: 3568800 - RNA, 15 nt, Human
agggagggccugggc

SEQ ID NO: 3568801 - RNA, 18 nt, Human
agggagggcucugaggcg

SEQ ID NO: 3568802 - RNA, 18 nt, Human
agggaggggccggcccug

SEQ ID NO: 3568803 - RNA, 19 nt, Human
agggaggggccggcccugu

SEQ ID NO: 3568804 - RNA, 15 nt, Human
agggaggggccuagg

SEQ ID NO: 3568805 - RNA, 19 nt, Human
agggaggggccuaggccuc

SEQ ID NO: 3568806 - RNA, 20 nt, Human
agggaggggccuaggccuca

SEQ ID NO: 3568807 - RNA, 18 nt, Human
agggaggucaggcccugg

SEQ ID NO: 3568808 - RNA, 22 nt, Human
agggaggucaggcccuggaacu

SEQ ID NO: 3568809 - RNA, 21 nt, Human
agggagguggggaugagaaga

SEQ ID NO: 3568810 - RNA, 20 nt, Human
agggagguguuuaaagagag

SEQ ID NO: 3568811 - RNA, 15 nt, Human
agggaguccccuccc

SEQ ID NO: 3568812 - RNA, 18 nt, Human
agggagucugccagggcc

SEQ ID NO: 3568813 - RNA, 15 nt, Human
agggagugcuggcuc

SEQ ID NO: 3568814 - RNA, 17 nt, Human
agggaguguucccuauc

SEQ ID NO: 3568815 - RNA, 20 nt, Human
agggauaaagaaaaaaauac

SEQ ID NO: 3568816 - RNA, 16 nt, Human
agggauacaugcucuu

SEQ ID NO: 3568817 - RNA, 16 nt, Human
agggauagaggggggc

SEQ ID NO: 3568818 - RNA, 19 nt, Human
agggauaguacuaagcauu

SEQ ID NO: 3568819 - RNA, 14 nt, Human
agggaucacagggc

SEQ ID NO: 3568820 - RNA, 22 nt, Human
agggaucccucaucugucccuc

SEQ ID NO: 3568821 - RNA, 20 nt, Human
agggaucuugcauucccagu

SEQ ID NO: 3568822 - RNA, 19 nt, Human
agggaugagcauggagcug

SEQ ID NO: 3568823 - RNA, 14 nt, Human
agggaugaggcaac

SEQ ID NO: 3568824 - RNA, 23 nt, Human
agggaugaggugcugggagggau

SEQ ID NO: 3568825 - RNA, 18 nt, Human
agggaugaugccacacca

SEQ ID NO: 3568826 - RNA, 18 nt, Human
agggaugcaggcuccccu

SEQ ID NO: 3568827 - RNA, 20 nt, Human
agggaugcaggcuccccuga

SEQ ID NO: 3568828 - RNA, 15 nt, Human
agggaugcccuggag

SEQ ID NO: 3568829 - RNA, 16 nt, Human
agggaugcugccugag

SEQ ID NO: 3568830 - RNA, 17 nt, Human
agggaugcugccugagu

SEQ ID NO: 3568831 - RNA, 18 nt, Human
agggaugcugccugaguc

SEQ ID NO: 3568832 - RNA, 16 nt, Human
agggauggacaucuug

SEQ ID NO: 3568833 - RNA, 18 nt, Human
agggauggacugaugcuu

SEQ ID NO: 3568834 - RNA, 16 nt, Human
agggauggaggaagaa

SEQ ID NO: 3568835 - RNA, 13 nt, Human
agggauggcgggu

SEQ ID NO: 3568836 - RNA, 18 nt, Human
agggauggcggguggggg

SEQ ID NO: 3568837 - RNA, 16 nt, Human
agggaugggccuggca

SEQ ID NO: 3568838 - RNA, 17 nt, Human
agggaugggccuggcau

SEQ ID NO: 3568839 - RNA, 22 nt, Human
agggaugggccuggcauucuug

SEQ ID NO: 3568840 - RNA, 13 nt, Human
agggauggugccc

SEQ ID NO: 3568841 - RNA, 22 nt, Human
agggaugugaauugccugcaga

SEQ ID NO: 3568842 - RNA, 19 nt, Human
agggauuaaccucugcacu

SEQ ID NO: 3568843 - RNA, 19 nt, Human
agggauuacccaagcaaaa

SEQ ID NO: 3568844 - RNA, 15 nt, Human
agggauuagggagag

SEQ ID NO: 3568845 - RNA, 18 nt, Human
agggauucacaucugcau

SEQ ID NO: 3568846 - RNA, 19 nt, Human
agggauucaggcugcuugg

SEQ ID NO: 3568847 - RNA, 16 nt, Human
agggauucucacaaua

SEQ ID NO: 3568848 - RNA, 20 nt, Human
agggauucugguuccagggu

SEQ ID NO: 3568849 - RNA, 14 nt, Human
agggauugauuuua

SEQ ID NO: 3568850 - RNA, 14 nt, Human
agggauuucuuagg

SEQ ID NO: 3568851 - RNA, 13 nt, Human
agggauuucuuug

SEQ ID NO: 3568852 - RNA, 22 nt, Human
agggauuuucagcccucagaau

SEQ ID NO: 3568853 - RNA, 14 nt, Human
agggcaaagccagg

SEQ ID NO: 3568854 - RNA, 21 nt, Human
agggcaaagccaggucccucu

SEQ ID NO: 3568855 - RNA, 22 nt, Human
agggcaacaauacaugcugcua

SEQ ID NO: 3568856 - RNA, 13 nt, Human
agggcaagggcca

SEQ ID NO: 3568857 - RNA, 20 nt, Human
agggcaaggguuaaggccug

SEQ ID NO: 3568858 - RNA, 22 nt, Human
agggcaauuaauuccuucagca

SEQ ID NO: 3568859 - RNA, 17 nt, Human
agggcaauuggaacaaa

SEQ ID NO: 3568860 - RNA, 22 nt, Human
agggcacagaaaauggaagaca

SEQ ID NO: 3568861 - RNA, 13 nt, Human
agggcacaggagc

SEQ ID NO: 3568862 - RNA, 19 nt, Human
agggcacaggagcuaccug

SEQ ID NO: 3568863 - RNA, 22 nt, Human
agggcacaggagcuaccugugu

SEQ ID NO: 3568864 - RNA, 23 nt, Human
agggcacaggagcuaccugugug

SEQ ID NO: 3568865 - RNA, 21 nt, Human
agggcacauuccuugccugca

SEQ ID NO: 3568866 - RNA, 21 nt, Human
agggcacccuguggcccuggc

SEQ ID NO: 3568867 - RNA, 16 nt, Human
agggcacugcugcugc

SEQ ID NO: 3568868 - RNA, 13 nt, Human
agggcacuggagc

SEQ ID NO: 3568869 - RNA, 15 nt, Human
agggcagaacacuaa

SEQ ID NO: 3568870 - RNA, 14 nt, Human
agggcagaaugaau

SEQ ID NO: 3568871 - RNA, 15 nt, Human
agggcagagccggga

SEQ ID NO: 3568872 - RNA, 14 nt, Human
agggcagagcuggu

SEQ ID NO: 3568873 - RNA, 15 nt, Human
agggcagcagaaggg

SEQ ID NO: 3568874 - RNA, 21 nt, Human
agggcagcagaaggggguggu

SEQ ID NO: 3568875 - RNA, 12 nt, Human
agggcagcagcc

SEQ ID NO: 3568876 - RNA, 13 nt, Human
agggcagcagcca

SEQ ID NO: 3568877 - RNA, 15 nt, Human
agggcagcagccagc

SEQ ID NO: 3568878 - RNA, 16 nt, Human
agggcagcagccagcc

SEQ ID NO: 3568879 - RNA, 20 nt, Human
agggcagcagccagcccugc

SEQ ID NO: 3568880 - RNA, 21 nt, Human
agggcagcagccagcccugcc

SEQ ID NO: 3568881 - RNA, 22 nt, Human
agggcagcagccagcccugccu

SEQ ID NO: 3568882 - RNA, 21 nt, Human
agggcagccagggagagccca

SEQ ID NO: 3568883 - RNA, 13 nt, Human
agggcagccccac

SEQ ID NO: 3568884 - RNA, 18 nt, Human
agggcagccugccuggag

SEQ ID NO: 3568885 - RNA, 16 nt, Human
agggcagcgccaggcu

SEQ ID NO: 3568886 - RNA, 13 nt, Human
agggcagcugcua

SEQ ID NO: 3568887 - RNA, 14 nt, Human
agggcagcugggcc

SEQ ID NO: 3568888 - RNA, 16 nt, Human
agggcagcugggccca

SEQ ID NO: 3568889 - RNA, 13 nt, Human
agggcagcuugcc

SEQ ID NO: 3568890 - RNA, 18 nt, Human
agggcagcuugccccggc

SEQ ID NO: 3568891 - RNA, 16 nt, Human
agggcagcuuugcuca

SEQ ID NO: 3568892 - RNA, 12 nt, Human
agggcaggacca

SEQ ID NO: 3568893 - RNA, 17 nt, Human
agggcaggaccagccca

SEQ ID NO: 3568894 - RNA, 17 nt, Human
agggcagggacaggaua

SEQ ID NO: 3568895 - RNA, 18 nt, Human
agggcagggacagggccg

SEQ ID NO: 3568896 - RNA, 17 nt, Human
agggcagggccccaggc

SEQ ID NO: 3568897 - RNA, 16 nt, Human
agggcagggggccccu

SEQ ID NO: 3568898 - RNA, 11 nt, Human
agggcaggugg

SEQ ID NO: 3568899 - RNA, 20 nt, Human
agggcagucgauagagcugu

SEQ ID NO: 3568900 - RNA, 16 nt, Human
agggcagugcaaggag

SEQ ID NO: 3568901 - RNA, 21 nt, Human
agggcagugcuagugagcugg

SEQ ID NO: 3568902 - RNA, 17 nt, Human
agggcaguguuuccuuu

SEQ ID NO: 3568903 - RNA, 16 nt, Human
agggcaguucgcagcc

SEQ ID NO: 3568904 - RNA, 17 nt, Human
agggcaguucgcagcca

SEQ ID NO: 3568905 - RNA, 21 nt, Human
agggcaguucgcagccacccu

SEQ ID NO: 3568906 - RNA, 15 nt, Human
agggcauaaaacagc

SEQ ID NO: 3568907 - RNA, 15 nt, Human
agggcaucuccagga

SEQ ID NO: 3568908 - RNA, 16 nt, Human
agggcaucuccaggaa

SEQ ID NO: 3568909 - RNA, 16 nt, Human
agggcaucuccugugc

SEQ ID NO: 3568910 - RNA, 21 nt, Human
agggcaucuccugugcauggg

SEQ ID NO: 3568911 - RNA, 16 nt, Human
agggcaucucugggcu

SEQ ID NO: 3568912 - RNA, 18 nt, Human
agggcaucucugggcugg

SEQ ID NO: 3568913 - RNA, 22 nt, Human
agggcaugccccggccaccucu

SEQ ID NO: 3568914 - RNA, 15 nt, Human
agggcaugccuugug

SEQ ID NO: 3568915 - RNA, 16 nt, Human
agggcaugccuugugc

SEQ ID NO: 3568916 - RNA, 17 nt, Human
agggcaugcgcacaagg

SEQ ID NO: 3568917 - RNA, 16 nt, Human
agggcauucaaauggg

SEQ ID NO: 3568918 - RNA, 22 nt, Human
agggcauuugagaaaugcauau

SEQ ID NO: 3568919 - RNA, 19 nt, Human
agggccaaacgcugagcca

SEQ ID NO: 3568920 - RNA, 23 nt, Human
agggccaaacgcugagccaccug

SEQ ID NO: 3568921 - RNA, 23 nt, Human
agggccaaagaaccaaagaagaa

SEQ ID NO: 3568922 - RNA, 15 nt, Human
agggccaacccuucu

SEQ ID NO: 3568923 - RNA, 16 nt, Human
agggccaacccuucuc

SEQ ID NO: 3568924 - RNA, 23 nt, Human
agggccaacuugagggcccagag

SEQ ID NO: 3568925 - RNA, 16 nt, Human
agggccaagucccacc

SEQ ID NO: 3568926 - RNA, 16 nt, Human
agggccaauccccagc

SEQ ID NO: 3568927 - RNA, 17 nt, Human
agggccacgcuccagcu

SEQ ID NO: 3568928 - RNA, 20 nt, Human
agggccacgcuccagcugcc

SEQ ID NO: 3568929 - RNA, 15 nt, Human
agggccacucugccu

SEQ ID NO: 3568930 - RNA, 12 nt, Human
agggccagagcc

SEQ ID NO: 3568931 - RNA, 13 nt, Human
agggccagagcca

SEQ ID NO: 3568932 - RNA, 15 nt, Human
agggccaggagaugg

SEQ ID NO: 3568933 - RNA, 19 nt, Human
agggccagggcccugcaga

SEQ ID NO: 3568934 - RNA, 21 nt, Human
agggccaggggucucccugga

SEQ ID NO: 3568935 - RNA, 16 nt, Human
agggccaguccugccu

SEQ ID NO: 3568936 - RNA, 18 nt, Human
agggccaguccugccugg

SEQ ID NO: 3568937 - RNA, 19 nt, Human
agggccaguccugccuggc

SEQ ID NO: 3568938 - RNA, 23 nt, Human
agggccaguccugccuggccagg

SEQ ID NO: 3568939 - RNA, 15 nt, Human
agggccagucugggc

SEQ ID NO: 3568940 - RNA, 15 nt, Human
agggccaguggggcc

SEQ ID NO: 3568941 - RNA, 22 nt, Human
agggccaugcugaggccugggc

SEQ ID NO: 3568942 - RNA, 14 nt, Human
agggccauggcuca

SEQ ID NO: 3568943 - RNA, 16 nt, Human
agggccauggcucagg

SEQ ID NO: 3568944 - RNA, 11 nt, Human
agggcccagag

SEQ ID NO: 3568945 - RNA, 14 nt, Human
agggcccagagagg

SEQ ID NO: 3568946 - RNA, 12 nt, Human
agggcccagagc

SEQ ID NO: 3568947 - RNA, 17 nt, Human
agggcccagagcaggaa

SEQ ID NO: 3568948 - RNA, 13 nt, Human
agggcccagagcc

SEQ ID NO: 3568949 - RNA, 12 nt, Human
agggcccaggag

SEQ ID NO: 3568950 - RNA, 15 nt, Human
agggcccaggcaggc

SEQ ID NO: 3568951 - RNA, 16 nt, Human
agggcccaugggaggg

SEQ ID NO: 3568952 - RNA, 19 nt, Human
agggcccaugggagggagc

SEQ ID NO: 3568953 - RNA, 18 nt, Human
agggccccagaaggcagg

SEQ ID NO: 3568954 - RNA, 12 nt, Human
agggccccagca

SEQ ID NO: 3568955 - RNA, 13 nt, Human
agggccccucucc

SEQ ID NO: 3568956 - RNA, 18 nt, Human
agggccccucuccccagg

SEQ ID NO: 3568957 - RNA, 13 nt, Human
agggccccucugc

SEQ ID NO: 3568958 - RNA, 18 nt, Human
agggccccucugcccagc

SEQ ID NO: 3568959 - RNA, 13 nt, Human
agggcccugcaga

SEQ ID NO: 3568960 - RNA, 12 nt, Human
agggcccuggag

SEQ ID NO: 3568961 - RNA, 23 nt, Human
agggccgccagggagaccuggac

SEQ ID NO: 3568962 - RNA, 19 nt, Human
agggccgcccgggcccaga

SEQ ID NO: 3568963 - RNA, 20 nt, Human
agggccgggcagaggggcag

SEQ ID NO: 3568964 - RNA, 19 nt, Human
agggccggggaacuggcca

SEQ ID NO: 3568965 - RNA, 22 nt, Human
agggccggggaacuggccaagc

SEQ ID NO: 3568966 - RNA, 16 nt, Human
agggccguaccccacc

SEQ ID NO: 3568967 - RNA, 15 nt, Human
agggccuagcugcua

SEQ ID NO: 3568968 - RNA, 18 nt, Human
agggccuagcugcuacaa

SEQ ID NO: 3568969 - RNA, 21 nt, Human
agggccuagcugcuacaaaga

SEQ ID NO: 3568970 - RNA, 15 nt, Human
agggccugagccugg

SEQ ID NO: 3568971 - RNA, 18 nt, Human
agggccugagccuggcca

SEQ ID NO: 3568972 - RNA, 14 nt, Human
agggccugcaaggg

SEQ ID NO: 3568973 - RNA, 17 nt, Human
agggccugccuggcccc

SEQ ID NO: 3568974 - RNA, 12 nt, Human
agggccugcugg

SEQ ID NO: 3568975 - RNA, 14 nt, Human
agggccugcuggag

SEQ ID NO: 3568976 - RNA, 17 nt, Human
agggccugcuggaggcc

SEQ ID NO: 3568977 - RNA, 19 nt, Human
agggccuggaagacagaga

SEQ ID NO: 3568978 - RNA, 14 nt, Human
agggccuggcccau

SEQ ID NO: 3568979 - RNA, 13 nt, Human
agggccugggccu

SEQ ID NO: 3568980 - RNA, 17 nt, Human
agggccugggccuggcu

SEQ ID NO: 3568981 - RNA, 21 nt, Human
agggccugggccuggcucccu

SEQ ID NO: 3568982 - RNA, 17 nt, Human
agggccuggggccugag

SEQ ID NO: 3568983 - RNA, 18 nt, Human
agggccuggggccugaga

SEQ ID NO: 3568984 - RNA, 20 nt, Human
agggccuggggccugagaga

SEQ ID NO: 3568985 - RNA, 12 nt, Human
agggccugguug

SEQ ID NO: 3568986 - RNA, 12 nt, Human
agggccuguggg

SEQ ID NO: 3568987 - RNA, 18 nt, Human
agggccuuaaaagccauc

SEQ ID NO: 3568988 - RNA, 16 nt, Human
agggccuugcccagag

SEQ ID NO: 3568989 - RNA, 18 nt, Human
agggccuugcccagagau

SEQ ID NO: 3568990 - RNA, 19 nt, Human
agggccuugcccagagaug

SEQ ID NO: 3568991 - RNA, 20 nt, Human
agggcgaacgacaauagcuu

SEQ ID NO: 3568992 - RNA, 13 nt, Human
agggcgagacucc

SEQ ID NO: 3568993 - RNA, 19 nt, Human
agggcgagacucugucuca

SEQ ID NO: 3568994 - RNA, 23 nt, Human
agggcgaggggaggguggcaggu

SEQ ID NO: 3568995 - RNA, 13 nt, Human
agggcgcaggccg

SEQ ID NO: 3568996 - RNA, 23 nt, Human
agggcggcaggggccuggagauc

SEQ ID NO: 3568997 - RNA, 17 nt, Human
agggcggccuccuucug

SEQ ID NO: 3568998 - RNA, 19 nt, Human
agggcgggaggauguucug

SEQ ID NO: 3568999 - RNA, 23 nt, Human
agggcggggugucugucuuccuu

SEQ ID NO: 3569000 - RNA, 15 nt, Human
agggcgugacucacc

SEQ ID NO: 3569001 - RNA, 17 nt, Human
agggcgugacucaccca

SEQ ID NO: 3569002 - RNA, 19 nt, Human
agggcgugacucacccaag

SEQ ID NO: 3569003 - RNA, 13 nt, Human
agggcguggaggg

SEQ ID NO: 3569004 - RNA, 14 nt, Human
agggcgugggagcg

SEQ ID NO: 3569005 - RNA, 20 nt, Human
agggcguucuuaggcugcug

SEQ ID NO: 3569006 - RNA, 14 nt, Human
agggcuaagagcua

SEQ ID NO: 3569007 - RNA, 22 nt, Human
agggcuaagagcuagcgcugcc

SEQ ID NO: 3569008 - RNA, 22 nt, Human
agggcuacccugagcugaggca

SEQ ID NO: 3569009 - RNA, 23 nt, Human
agggcuacccugagcugaggcag

SEQ ID NO: 3569010 - RNA, 22 nt, Human
agggcuagaaccuggaagggcu

SEQ ID NO: 3569011 - RNA, 18 nt, Human
agggcuagaaccuggagg

SEQ ID NO: 3569012 - RNA, 16 nt, Human
agggcuaggaauauag

SEQ ID NO: 3569013 - RNA, 21 nt, Human
agggcuaggaauauagauuaa

SEQ ID NO: 3569014 - RNA, 14 nt, Human
agggcucagccugg

SEQ ID NO: 3569015 - RNA, 23 nt, Human
agggcucaggauuucgugggucu

SEQ ID NO: 3569016 - RNA, 24 nt, Human
agggcucaggauuucgugggucug

SEQ ID NO: 3569017 - RNA, 15 nt, Human
agggcuccagccccu

SEQ ID NO: 3569018 - RNA, 23 nt, Human
agggcuccagccccucuuggaga

SEQ ID NO: 3569019 - RNA, 17 nt, Human
agggcuccucccagcuu

SEQ ID NO: 3569020 - RNA, 12 nt, Human
agggcuccugcc

SEQ ID NO: 3569021 - RNA, 19 nt, Human
agggcuccuugugggccug

SEQ ID NO: 3569022 - RNA, 20 nt, Human
agggcuccuugugggccugg

SEQ ID NO: 3569023 - RNA, 23 nt, Human
agggcucuaaaaaaagccccaaa

SEQ ID NO: 3569024 - RNA, 12 nt, Human
agggcucuccug

SEQ ID NO: 3569025 - RNA, 14 nt, Human
agggcucuccuggc

SEQ ID NO: 3569026 - RNA, 14 nt, Human
agggcucugaggcg

SEQ ID NO: 3569027 - RNA, 16 nt, Human
agggcucugaggcgcc

SEQ ID NO: 3569028 - RNA, 16 nt, Human
agggcucugccccagu

SEQ ID NO: 3569029 - RNA, 18 nt, Human
agggcucugugcugacau

SEQ ID NO: 3569030 - RNA, 16 nt, Human
agggcugaccugccuc

SEQ ID NO: 3569031 - RNA, 17 nt, Human
agggcugagccuggucc

SEQ ID NO: 3569032 - RNA, 17 nt, Human
agggcugagcucucugu

SEQ ID NO: 3569033 - RNA, 11 nt, Human
agggcugcagu

SEQ ID NO: 3569034 - RNA, 13 nt, Human
agggcugccacca

SEQ ID NO: 3569035 - RNA, 16 nt, Human
agggcugcccugagaa

SEQ ID NO: 3569036 - RNA, 23 nt, Human
agggcugcccugagaagcugcuc

SEQ ID NO: 3569037 - RNA, 12 nt, Human
agggcugcuggg

SEQ ID NO: 3569038 - RNA, 20 nt, Human
agggcugcugggggcaacug

SEQ ID NO: 3569039 - RNA, 22 nt, Human
agggcuggaccuauguccuaag

SEQ ID NO: 3569040 - RNA, 14 nt, Human
agggcuggacugag

SEQ ID NO: 3569041 - RNA, 15 nt, Human
agggcuggacugagg

SEQ ID NO: 3569042 - RNA, 17 nt, Human
agggcuggacugaggcc

SEQ ID NO: 3569043 - RNA, 18 nt, Human
agggcuggaggcccaggc

SEQ ID NO: 3569044 - RNA, 14 nt, Human
agggcuggcccagc

SEQ ID NO: 3569045 - RNA, 15 nt, Human
agggcuggcccagcc

SEQ ID NO: 3569046 - RNA, 16 nt, Human
agggcuggcccagccc

SEQ ID NO: 3569047 - RNA, 18 nt, Human
agggcuggccccagggca

SEQ ID NO: 3569048 - RNA, 22 nt, Human
agggcuggccccagggcacccu

SEQ ID NO: 3569049 - RNA, 20 nt, Human
agggcuggcuggccucaccc

SEQ ID NO: 3569050 - RNA, 16 nt, Human
agggcugggaaacacu

SEQ ID NO: 3569051 - RNA, 18 nt, Human
agggcugggaggaaggac

SEQ ID NO: 3569052 - RNA, 16 nt, Human
agggcuggucucugcu

SEQ ID NO: 3569053 - RNA, 20 nt, Human
agggcuguaacugccaggcu

SEQ ID NO: 3569054 - RNA, 18 nt, Human
agggcugucaucugugca

SEQ ID NO: 3569055 - RNA, 15 nt, Human
agggcugucauugca

SEQ ID NO: 3569056 - RNA, 23 nt, Human
agggcugugcuugaaggcccugc

SEQ ID NO: 3569057 - RNA, 18 nt, Human
agggcuuaccuguacacu

SEQ ID NO: 3569058 - RNA, 23 nt, Human
agggcuuaccuguacacugacuu

SEQ ID NO: 3569059 - RNA, 20 nt, Human
agggcuuccucuagaagcca

SEQ ID NO: 3569060 - RNA, 21 nt, Human
agggcuuccucuagaagccaa

SEQ ID NO: 3569061 - RNA, 22 nt, Human
agggcuuccucuagaagccaag

SEQ ID NO: 3569062 - RNA, 16 nt, Human
agggcuucugcacccu

SEQ ID NO: 3569063 - RNA, 14 nt, Human
agggcuugugaaca

SEQ ID NO: 3569064 - RNA, 14 nt, Human
agggcuuuaaaauu

SEQ ID NO: 3569065 - RNA, 18 nt, Human
agggcuuuaaaauucucu

SEQ ID NO: 3569066 - RNA, 19 nt, Human
agggcuuuaaaauucucuu

SEQ ID NO: 3569067 - RNA, 20 nt, Human
agggcuuuaaaauucucuuc

SEQ ID NO: 3569068 - RNA, 14 nt, Human
agggcuuuucaaaa

SEQ ID NO: 3569069 - RNA, 15 nt, Human
aggggaaaacuguua

SEQ ID NO: 3569070 - RNA, 23 nt, Human
aggggaaaccaguguagccuugc

SEQ ID NO: 3569071 - RNA, 14 nt, Human
aggggaaccugcca

SEQ ID NO: 3569072 - RNA, 15 nt, Human
aggggaagaaugaaa

SEQ ID NO: 3569073 - RNA, 22 nt, Human
aggggaagaguguacugggggu

SEQ ID NO: 3569074 - RNA, 15 nt, Human
aggggaagcugcagc

SEQ ID NO: 3569075 - RNA, 20 nt, Human
aggggaagcugcagcuuggg

SEQ ID NO: 3569076 - RNA, 17 nt, Human
aggggaauaauagaaga

SEQ ID NO: 3569077 - RNA, 15 nt, Human
aggggaaucagaacu

SEQ ID NO: 3569078 - RNA, 13 nt, Human
aggggaauguuug

SEQ ID NO: 3569079 - RNA, 23 nt, Human
aggggacacuucccucuguuucu

SEQ ID NO: 3569080 - RNA, 14 nt, Human
aggggacaggccuc

SEQ ID NO: 3569081 - RNA, 21 nt, Human
aggggacaggccucaccucua

SEQ ID NO: 3569082 - RNA, 14 nt, Human
aggggaccaggagu

SEQ ID NO: 3569083 - RNA, 20 nt, Human
aggggaccaggagugggugg

SEQ ID NO: 3569084 - RNA, 22 nt, Human
aggggaccaggagugggugggg

SEQ ID NO: 3569085 - RNA, 13 nt, Human
aggggacugccac

SEQ ID NO: 3569086 - RNA, 15 nt, Human
aggggacugccaccu

SEQ ID NO: 3569087 - RNA, 16 nt, Human
aggggacugccaccuc

SEQ ID NO: 3569088 - RNA, 14 nt, Human
aggggagacagagc

SEQ ID NO: 3569089 - RNA, 16 nt, Human
aggggagagccugcug

SEQ ID NO: 3569090 - RNA, 17 nt, Human
aggggagagggucugga

SEQ ID NO: 3569091 - RNA, 20 nt, Human
aggggagcagaggggcagag

SEQ ID NO: 3569092 - RNA, 22 nt, Human
aggggagcagaggggcagaggc

SEQ ID NO: 3569093 - RNA, 18 nt, Human
aggggagcaugggaagug

SEQ ID NO: 3569094 - RNA, 16 nt, Human
aggggagccaggaggg

SEQ ID NO: 3569095 - RNA, 24 nt, Human
aggggagcccacuguccugggccu

SEQ ID NO: 3569096 - RNA, 16 nt, Human
aggggagcucugucug

SEQ ID NO: 3569097 - RNA, 14 nt, Human
aggggaggagggcg

SEQ ID NO: 3569098 - RNA, 13 nt, Human
aggggaggcagcc

SEQ ID NO: 3569099 - RNA, 17 nt, Human
aggggaggcaucagugu

SEQ ID NO: 3569100 - RNA, 12 nt, Human
aggggaggccaa

SEQ ID NO: 3569101 - RNA, 12 nt, Human
aggggaguagag

SEQ ID NO: 3569102 - RNA, 18 nt, Human
aggggagucaccuucccu

SEQ ID NO: 3569103 - RNA, 16 nt, Human
aggggauagagagaga

SEQ ID NO: 3569104 - RNA, 14 nt, Human
aggggauauuuaag

SEQ ID NO: 3569105 - RNA, 21 nt, Human
aggggauauuuaagguagcuu

SEQ ID NO: 3569106 - RNA, 19 nt, Human
aggggauggaauucuuccu

SEQ ID NO: 3569107 - RNA, 17 nt, Human
aggggaugguagaccuu

SEQ ID NO: 3569108 - RNA, 17 nt, Human
aggggauugaagcccuc

SEQ ID NO: 3569109 - RNA, 14 nt, Human
aggggcagagccag

SEQ ID NO: 3569110 - RNA, 17 nt, Human
aggggcagagccaggaa

SEQ ID NO: 3569111 - RNA, 14 nt, Human
aggggcagccugcc

SEQ ID NO: 3569112 - RNA, 15 nt, Human
aggggcagcuucuau

SEQ ID NO: 3569113 - RNA, 17 nt, Human
aggggcaggagcucaga

SEQ ID NO: 3569114 - RNA, 19 nt, Human
aggggcaggagcucagaug

SEQ ID NO: 3569115 - RNA, 20 nt, Human
aggggcaggagcucagauga

SEQ ID NO: 3569116 - RNA, 13 nt, Human
aggggcaggagga

SEQ ID NO: 3569117 - RNA, 18 nt, Human
aggggcaggaggaagggg

SEQ ID NO: 3569118 - RNA, 16 nt, Human
aggggcaggcacagca

SEQ ID NO: 3569119 - RNA, 13 nt, Human
aggggcaggcuga

SEQ ID NO: 3569120 - RNA, 15 nt, Human
aggggcaucugcccc

SEQ ID NO: 3569121 - RNA, 20 nt, Human
aggggcaucugccccucccc

SEQ ID NO: 3569122 - RNA, 13 nt, Human
aggggcaugggaa

SEQ ID NO: 3569123 - RNA, 19 nt, Human
aggggcauguauuggccug

SEQ ID NO: 3569124 - RNA, 22 nt, Human
aggggcauguauuggccuggag

SEQ ID NO: 3569125 - RNA, 19 nt, Human
aggggccaauucguucucu

SEQ ID NO: 3569126 - RNA, 13 nt, Human
aggggccagaaga

SEQ ID NO: 3569127 - RNA, 19 nt, Human
aggggccagacccugccca

SEQ ID NO: 3569128 - RNA, 12 nt, Human
aggggccagagg

SEQ ID NO: 3569129 - RNA, 16 nt, Human
aggggccauuuggcau

SEQ ID NO: 3569130 - RNA, 17 nt, Human
aggggcccaaggcggcc

SEQ ID NO: 3569131 - RNA, 21 nt, Human
aggggccccccugcccugugg

SEQ ID NO: 3569132 - RNA, 20 nt, Human
aggggccccguguccugccu

SEQ ID NO: 3569133 - RNA, 16 nt, Human
aggggccccuccagcu

SEQ ID NO: 3569134 - RNA, 13 nt, Human
aggggccccugcu

SEQ ID NO: 3569135 - RNA, 21 nt, Human
aggggcccgagcagaagcagg

SEQ ID NO: 3569136 - RNA, 16 nt, Human
aggggcccgcuugccu

SEQ ID NO: 3569137 - RNA, 17 nt, Human
aggggcccggccagcca

SEQ ID NO: 3569138 - RNA, 21 nt, Human
aggggcccggccagccauguc

SEQ ID NO: 3569139 - RNA, 23 nt, Human
aggggcccggccagccaugucug

SEQ ID NO: 3569140 - RNA, 13 nt, Human
aggggcccuugga

SEQ ID NO: 3569141 - RNA, 18 nt, Human
aggggccgaugcccagag

SEQ ID NO: 3569142 - RNA, 15 nt, Human
aggggccgcugccac

SEQ ID NO: 3569143 - RNA, 17 nt, Human
aggggccgcugccaccc

SEQ ID NO: 3569144 - RNA, 22 nt, Human
aggggccgcugccacccaccuc

SEQ ID NO: 3569145 - RNA, 13 nt, Human
aggggccggcccu

SEQ ID NO: 3569146 - RNA, 17 nt, Human
aggggccggcccugugu

SEQ ID NO: 3569147 - RNA, 16 nt, Human
aggggccuaggccuca

SEQ ID NO: 3569148 - RNA, 16 nt, Human
aggggccuccaugggc

SEQ ID NO: 3569149 - RNA, 20 nt, Human
aggggccucuuaugggcugg

SEQ ID NO: 3569150 - RNA, 15 nt, Human
aggggccugccaccu

SEQ ID NO: 3569151 - RNA, 22 nt, Human
aggggccuggagauccuccugc

SEQ ID NO: 3569152 - RNA, 18 nt, Human
aggggccuggcagccgug

SEQ ID NO: 3569153 - RNA, 21 nt, Human
aggggccuuagggcacugggc

SEQ ID NO: 3569154 - RNA, 15 nt, Human
aggggcgcuggccca

SEQ ID NO: 3569155 - RNA, 18 nt, Human
aggggcggcaggagggag

SEQ ID NO: 3569156 - RNA, 17 nt, Human
aggggcgggaauauugu

SEQ ID NO: 3569157 - RNA, 22 nt, Human
aggggcgucuguucccccuuca

SEQ ID NO: 3569158 - RNA, 17 nt, Human
aggggcguguggcucac

SEQ ID NO: 3569159 - RNA, 18 nt, Human
aggggcuacaagagggaa

SEQ ID NO: 3569160 - RNA, 18 nt, Human
aggggcuccaugccagcc

SEQ ID NO: 3569161 - RNA, 14 nt, Human
aggggcucccuccg

SEQ ID NO: 3569162 - RNA, 15 nt, Human
aggggcucccuccgc

SEQ ID NO: 3569163 - RNA, 17 nt, Human
aggggcucucagcucag

SEQ ID NO: 3569164 - RNA, 13 nt, Human
aggggcugacacu

SEQ ID NO: 3569165 - RNA, 12 nt, Human
aggggcugcccg

SEQ ID NO: 3569166 - RNA, 13 nt, Human
aggggcugcccgc

SEQ ID NO: 3569167 - RNA, 16 nt, Human
aggggcugcccgcucc

SEQ ID NO: 3569168 - RNA, 16 nt, Human
aggggcugcuuccucc

SEQ ID NO: 3569169 - RNA, 16 nt, Human
aggggcuggcuucagg

SEQ ID NO: 3569170 - RNA, 13 nt, Human
aggggcugggaac

SEQ ID NO: 3569171 - RNA, 14 nt, Human
aggggcugggaaca

SEQ ID NO: 3569172 - RNA, 10 nt, Human
aggggcuggu

SEQ ID NO: 3569173 - RNA, 14 nt, Human
aggggcuuccuggu

SEQ ID NO: 3569174 - RNA, 16 nt, Human
aggggcuuccuggugc

SEQ ID NO: 3569175 - RNA, 23 nt, Human
aggggcuugacuuuuucaacuuc

SEQ ID NO: 3569176 - RNA, 14 nt, Human
aggggcuuucugga

SEQ ID NO: 3569177 - RNA, 16 nt, Human
aggggcuuucuggaga

SEQ ID NO: 3569178 - RNA, 17 nt, Human
aggggcuuucuggagag

SEQ ID NO: 3569179 - RNA, 19 nt, Human
agggggaaaaagugucaac

SEQ ID NO: 3569180 - RNA, 15 nt, Human
agggggaaggcaggg

SEQ ID NO: 3569181 - RNA, 20 nt, Human
agggggacugcugcugccug

SEQ ID NO: 3569182 - RNA, 21 nt, Human
agggggacugcugcugccugg

SEQ ID NO: 3569183 - RNA, 22 nt, Human
agggggagccccuucugcucag

SEQ ID NO: 3569184 - RNA, 20 nt, Human
agggggaggggguuacaaac

SEQ ID NO: 3569185 - RNA, 17 nt, Human
agggggauaugaaugga

SEQ ID NO: 3569186 - RNA, 19 nt, Human
agggggccaccuccccagg

SEQ ID NO: 3569187 - RNA, 20 nt, Human
agggggcgccugugguucug

SEQ ID NO: 3569188 - RNA, 16 nt, Human
agggggcuaagacuuc

SEQ ID NO: 3569189 - RNA, 14 nt, Human
agggggcuggagga

SEQ ID NO: 3569190 - RNA, 19 nt, Human
agggggcuugaagccaaag

SEQ ID NO: 3569191 - RNA, 18 nt, Human
agggggcuuucuggggcc

SEQ ID NO: 3569192 - RNA, 13 nt, Human
aggggggagggaa

SEQ ID NO: 3569193 - RNA, 12 nt, Human
aggggggagggg

SEQ ID NO: 3569194 - RNA, 18 nt, Human
agggggggcuacauuaua

SEQ ID NO: 3569195 - RNA, 16 nt, Human
agggggggcucccugg

SEQ ID NO: 3569196 - RNA, 20 nt, Human
agggggguugcaguggagag

SEQ ID NO: 3569197 - RNA, 17 nt, Human
agggggucguggagagc

SEQ ID NO: 3569198 - RNA, 18 nt, Human
agggggucguggagagcu

SEQ ID NO: 3569199 - RNA, 19 nt, Human
agggggucguggagagcua

SEQ ID NO: 3569200 - RNA, 11 nt, Human
agggggucugg

SEQ ID NO: 3569201 - RNA, 15 nt, Human
aggggguggccuccc

SEQ ID NO: 3569202 - RNA, 19 nt, Human
aggggguuacaaacugcaa

SEQ ID NO: 3569203 - RNA, 20 nt, Human
aggggguuacaaacugcaau

SEQ ID NO: 3569204 - RNA, 16 nt, Human
agggguaccacugaau

SEQ ID NO: 3569205 - RNA, 19 nt, Human
agggguaccacugaaucug

SEQ ID NO: 3569206 - RNA, 19 nt, Human
agggguaggcagagccuuu

SEQ ID NO: 3569207 - RNA, 15 nt, Human
agggguaggggcugg

SEQ ID NO: 3569208 - RNA, 21 nt, Human
agggguaucauguauggugau

SEQ ID NO: 3569209 - RNA, 20 nt, Human
agggguccccuccaggagua

SEQ ID NO: 3569210 - RNA, 17 nt, Human
aggggucucccuggagu

SEQ ID NO: 3569211 - RNA, 17 nt, Human
aggggucucccuggcuc

SEQ ID NO: 3569212 - RNA, 19 nt, Human
aggggucucccuggcuccc

SEQ ID NO: 3569213 - RNA, 22 nt, Human
aggggucuugcaaaauuccuga

SEQ ID NO: 3569214 - RNA, 14 nt, Human
aggggugacacaga

SEQ ID NO: 3569215 - RNA, 18 nt, Human
aggggugacacagacuca

SEQ ID NO: 3569216 - RNA, 16 nt, Human
aggggugcccccuccu

SEQ ID NO: 3569217 - RNA, 17 nt, Human
aggggugcccccuccuc

SEQ ID NO: 3569218 - RNA, 21 nt, Human
agggguggaggagagccuggu

SEQ ID NO: 3569219 - RNA, 20 nt, Human
aggggugggacacccuguga

SEQ ID NO: 3569220 - RNA, 22 nt, Human
aggggugggacacccugugaug

SEQ ID NO: 3569221 - RNA, 20 nt, Human
agggguggguuccucuuccc

SEQ ID NO: 3569222 - RNA, 24 nt, Human
aggggugucuugggcagagcuggc

SEQ ID NO: 3569223 - RNA, 20 nt, Human
agggguucccuugagggcug

SEQ ID NO: 3569224 - RNA, 15 nt, Human
agggguucgagacca

SEQ ID NO: 3569225 - RNA, 20 nt, Human
agggguugccacaggccucc

SEQ ID NO: 3569226 - RNA, 21 nt, Human
agggguugccacaggccuccc

SEQ ID NO: 3569227 - RNA, 21 nt, Human
agggguuggggugacagucau

SEQ ID NO: 3569228 - RNA, 23 nt, Human
agggguugguugagguggaagcc

SEQ ID NO: 3569229 - RNA, 19 nt, Human
agggguuugccauuugaua

SEQ ID NO: 3569230 - RNA, 17 nt, Human
agggguuuggucuggga

SEQ ID NO: 3569231 - RNA, 13 nt, Human
aggguaaacaaua

SEQ ID NO: 3569232 - RNA, 14 nt, Human
aggguaaacaauau

SEQ ID NO: 3569233 - RNA, 11 nt, Human
aggguaaauca

SEQ ID NO: 3569234 - RNA, 14 nt, Human
aggguaaauuauuc

SEQ ID NO: 3569235 - RNA, 17 nt, Human
aggguaaauuauucagu

SEQ ID NO: 3569236 - RNA, 15 nt, Human
aggguaaggcugugg

SEQ ID NO: 3569237 - RNA, 12 nt, Human
aggguaaguauu

SEQ ID NO: 3569238 - RNA, 22 nt, Human
aggguaauaaccagacacaaac

SEQ ID NO: 3569239 - RNA, 15 nt, Human
aggguacagcugggc

SEQ ID NO: 3569240 - RNA, 12 nt, Human
aggguacaugug

SEQ ID NO: 3569241 - RNA, 15 nt, Human
aggguagcagguacc

SEQ ID NO: 3569242 - RNA, 14 nt, Human
aggguagcccgccu

SEQ ID NO: 3569243 - RNA, 18 nt, Human
aggguaggcagccugaga

SEQ ID NO: 3569244 - RNA, 15 nt, Human
aggguaggcaggauu

SEQ ID NO: 3569245 - RNA, 16 nt, Human
aggguaggcaggauug

SEQ ID NO: 3569246 - RNA, 17 nt, Human
aggguagucugguuucu

SEQ ID NO: 3569247 - RNA, 18 nt, Human
aggguaucaggugcugcc

SEQ ID NO: 3569248 - RNA, 15 nt, Human
aggguaugaagagug

SEQ ID NO: 3569249 - RNA, 16 nt, Human
aggguaugaagagugu

SEQ ID NO: 3569250 - RNA, 19 nt, Human
agggucagacgccugagga

SEQ ID NO: 3569251 - RNA, 21 nt, Human
agggucagaggaccuguauuu

SEQ ID NO: 3569252 - RNA, 18 nt, Human
agggucagccagggccug

SEQ ID NO: 3569253 - RNA, 19 nt, Human
agggucagccagggccugc

SEQ ID NO: 3569254 - RNA, 18 nt, Human
agggucaggagaggggca

SEQ ID NO: 3569255 - RNA, 16 nt, Human
agggucauguuugcag

SEQ ID NO: 3569256 - RNA, 19 nt, Human
aggguccagaaggagacag

SEQ ID NO: 3569257 - RNA, 12 nt, Human
agggucccaagc

SEQ ID NO: 3569258 - RNA, 18 nt, Human
agggucccaagcugggcc

SEQ ID NO: 3569259 - RNA, 14 nt, Human
agggucccucugug

SEQ ID NO: 3569260 - RNA, 18 nt, Human
agggucccucuguguauu

SEQ ID NO: 3569261 - RNA, 20 nt, Human
agggucccucuguguauuug

SEQ ID NO: 3569262 - RNA, 11 nt, Human
agggucccugg

SEQ ID NO: 3569263 - RNA, 14 nt, Human
agggucccuggugg

SEQ ID NO: 3569264 - RNA, 16 nt, Human
agggucccugguggca

SEQ ID NO: 3569265 - RNA, 17 nt, Human
aggguccugcagccugc

SEQ ID NO: 3569266 - RNA, 13 nt, Human
aggguccugggag

SEQ ID NO: 3569267 - RNA, 22 nt, Human
agucuccuuugcacugagggcc

SEQ ID NO: 3569268 - RNA, 19 nt, Human
agucucgcucuguugccca

SEQ ID NO: 3569269 - RNA, 16 nt, Human
agucucuagguucuga

SEQ ID NO: 3569270 - RNA, 23 nt, Human
agucucuagguucugagcucugg

SEQ ID NO: 3569271 - RNA, 19 nt, Human
agucucuaucauuaaaguu

SEQ ID NO: 3569272 - RNA, 19 nt, Human
agucucucucucucucucc

SEQ ID NO: 3569273 - RNA, 22 nt, Human
agucucucuggggccacacaga

SEQ ID NO: 3569274 - RNA, 15 nt, Human
agucucucuuacccu

SEQ ID NO: 3569275 - RNA, 19 nt, Human
agucucucuuacccuucug

SEQ ID NO: 3569276 - RNA, 14 nt, Human
agucucucuucucu

SEQ ID NO: 3569277 - RNA, 15 nt, Human
agucucucuucucuc

SEQ ID NO: 3569278 - RNA, 18 nt, Human
agucucucuucucuccag

SEQ ID NO: 3569279 - RNA, 23 nt, Human
agucucucuucucuccagcugac

SEQ ID NO: 3569280 - RNA, 16 nt, Human
agucucugagcaguga

SEQ ID NO: 3569281 - RNA, 21 nt, Human
agucucuggggcaggcugcuu

SEQ ID NO: 3569282 - RNA, 12 nt, Human
agucucuucaga

SEQ ID NO: 3569283 - RNA, 15 nt, Human
agucucuucuccacu

SEQ ID NO: 3569284 - RNA, 16 nt, Human
agucucuucuccacug

SEQ ID NO: 3569285 - RNA, 17 nt, Human
agucucuucuccacugg

SEQ ID NO: 3569286 - RNA, 16 nt, Human
agucucuugauucaua

SEQ ID NO: 3569287 - RNA, 22 nt, Human
agucucuuuucuuuagagcauu

SEQ ID NO: 3569288 - RNA, 23 nt, Human
agucucuuuuuuuggcccaggcc

SEQ ID NO: 3569289 - RNA, 14 nt, Human
agucugaagcagau

SEQ ID NO: 3569290 - RNA, 13 nt, Human
agucugaaggcug

SEQ ID NO: 3569291 - RNA, 16 nt, Human
agucugaaugcugcca

SEQ ID NO: 3569292 - RNA, 18 nt, Human
agucugagggcuuguagu

SEQ ID NO: 3569293 - RNA, 15 nt, Human
agucugagguccuga

SEQ ID NO: 3569294 - RNA, 19 nt, Human
agucugagguccugagcac

SEQ ID NO: 3569295 - RNA, 16 nt, Human
agucugaguaaaaucu

SEQ ID NO: 3569296 - RNA, 18 nt, Human
agucugaucgugacgcug

SEQ ID NO: 3569297 - RNA, 20 nt, Human
agucugaucgugacgcugaa

SEQ ID NO: 3569298 - RNA, 22 nt, Human
agucugaucgugacgcugaaua

SEQ ID NO: 3569299 - RNA, 23 nt, Human
agucugaucgugacgcugaauaa

SEQ ID NO: 3569300 - RNA, 19 nt, Human
agucugaugauuucuugaa

SEQ ID NO: 3569301 - RNA, 11 nt, Human
agucugauuua

SEQ ID NO: 3569302 - RNA, 12 nt, Human
agucugauuuaa

SEQ ID NO: 3569303 - RNA, 13 nt, Human
agucugcaaaaug

SEQ ID NO: 3569304 - RNA, 23 nt, Human
agucugcaacuuuaagcagcucu

SEQ ID NO: 3569305 - RNA, 15 nt, Human
agucugcaagauucu

SEQ ID NO: 3569306 - RNA, 12 nt, Human
agucugcauaua

SEQ ID NO: 3569307 - RNA, 11 nt, Human
agucugccagg

SEQ ID NO: 3569308 - RNA, 13 nt, Human
agucugccagggc

SEQ ID NO: 3569309 - RNA, 22 nt, Human
agucugccagggccccucuccc

SEQ ID NO: 3569310 - RNA, 18 nt, Human
agucugcugcccuccauc

SEQ ID NO: 3569311 - RNA, 14 nt, Human
agucugcuucugca

SEQ ID NO: 3569312 - RNA, 22 nt, Human
agucuggaggggcauggccagc

SEQ ID NO: 3569313 - RNA, 16 nt, Human
agucuggagugggcag

SEQ ID NO: 3569314 - RNA, 18 nt, Human
agucuggagugggcagag

SEQ ID NO: 3569315 - RNA, 15 nt, Human
agucuggaucuggga

SEQ ID NO: 3569316 - RNA, 22 nt, Human
agucuggcagacuuucuucucu

SEQ ID NO: 3569317 - RNA, 13 nt, Human
agucuggcccuag

SEQ ID NO: 3569318 - RNA, 18 nt, Human
agucuggcccuuccuuuu

SEQ ID NO: 3569319 - RNA, 14 nt, Human
agucugggacacaa

SEQ ID NO: 3569320 - RNA, 17 nt, Human
agucuggugggaggacg

SEQ ID NO: 3569321 - RNA, 22 nt, Human
agucuguacuaaacaguaagau

SEQ ID NO: 3569322 - RNA, 21 nt, Human
agucuguaucaaacccacgau

SEQ ID NO: 3569323 - RNA, 23 nt, Human
agucugucaugaacauguuccug

SEQ ID NO: 3569324 - RNA, 13 nt, Human
agucuguccugug

SEQ ID NO: 3569325 - RNA, 16 nt, Human
agucuguccugugacg

SEQ ID NO: 3569326 - RNA, 13 nt, Human
agucuguccuuga

SEQ ID NO: 3569327 - RNA, 17 nt, Human
agucugucucaaaagaa

SEQ ID NO: 3569328 - RNA, 15 nt, Human
agucugucuucugua

SEQ ID NO: 3569329 - RNA, 16 nt, Human
agucugucuucuguau

SEQ ID NO: 3569330 - RNA, 21 nt, Human
agucugucuuuccugaaccau

SEQ ID NO: 3569331 - RNA, 18 nt, Human
agucugugagauucauuc

SEQ ID NO: 3569332 - RNA, 14 nt, Human
agucugugccugga

SEQ ID NO: 3569333 - RNA, 17 nt, Human
agucugugccuggagcu

SEQ ID NO: 3569334 - RNA, 23 nt, Human
agucugugccuggagcuccuggg

SEQ ID NO: 3569335 - RNA, 17 nt, Human
agucuguggaucagaga

SEQ ID NO: 3569336 - RNA, 12 nt, Human
agucugugugaa

SEQ ID NO: 3569337 - RNA, 21 nt, Human
agucugugugcugugguuccu

SEQ ID NO: 3569338 - RNA, 23 nt, Human
agucugugugcugugguuccugg

SEQ ID NO: 3569339 - RNA, 17 nt, Human
agucuguuuacugcaag

SEQ ID NO: 3569340 - RNA, 22 nt, Human
agucuuacauaaaccauuuuug

SEQ ID NO: 3569341 - RNA, 16 nt, Human
agucuuacuacagaaa

SEQ ID NO: 3569342 - RNA, 13 nt, Human
agucuuagaucau

SEQ ID NO: 3569343 - RNA, 18 nt, Human
agucuuagaucauaguuu

SEQ ID NO: 3569344 - RNA, 16 nt, Human
agucuuagauguauau

SEQ ID NO: 3569345 - RNA, 23 nt, Human
agucuuagauguauauauuuccu

SEQ ID NO: 3569346 - RNA, 22 nt, Human
agucuuagggauuuauuuucaa

SEQ ID NO: 3569347 - RNA, 16 nt, Human
agucuuaugcuuccag

SEQ ID NO: 3569348 - RNA, 22 nt, Human
agucuucaacauaacccacuug

SEQ ID NO: 3569349 - RNA, 16 nt, Human
agucuucacucucuga

SEQ ID NO: 3569350 - RNA, 16 nt, Human
agucuucaugaaaugc

SEQ ID NO: 3569351 - RNA, 18 nt, Human
agucuucaugaaaugcua

SEQ ID NO: 3569352 - RNA, 15 nt, Human
agucuuccaccugga

SEQ ID NO: 3569353 - RNA, 15 nt, Human
agucuuccauuugca

SEQ ID NO: 3569354 - RNA, 16 nt, Human
agucuuccauuugcaa

SEQ ID NO: 3569355 - RNA, 17 nt, Human
agucuuccauuugcaag

SEQ ID NO: 3569356 - RNA, 19 nt, Human
agucuuccauuugcaaggg

SEQ ID NO: 3569357 - RNA, 17 nt, Human
agucuucccuagggcug

SEQ ID NO: 3569358 - RNA, 20 nt, Human
agucuucccuagggcugggu

SEQ ID NO: 3569359 - RNA, 12 nt, Human
agucuuccugac

SEQ ID NO: 3569360 - RNA, 19 nt, Human
agucuuccugacacuuuaa

SEQ ID NO: 3569361 - RNA, 13 nt, Human
agucuucucauag

SEQ ID NO: 3569362 - RNA, 21 nt, Human
agucuucucauagcauuaacu

SEQ ID NO: 3569363 - RNA, 19 nt, Human
agucuucugacaaacugug

SEQ ID NO: 3569364 - RNA, 17 nt, Human
agucuugacgaguguga

SEQ ID NO: 3569365 - RNA, 19 nt, Human
agucuugcagugauuaagg

SEQ ID NO: 3569366 - RNA, 21 nt, Human
agucuugccuauauuuuccug

SEQ ID NO: 3569367 - RNA, 16 nt, Human
agucuugcuguggucu

SEQ ID NO: 3569368 - RNA, 16 nt, Human
agucuuggaagcuguu

SEQ ID NO: 3569369 - RNA, 22 nt, Human
agucuuggaagcuguuuggaaa

SEQ ID NO: 3569370 - RNA, 17 nt, Human
agucuuggggcaggaug

SEQ ID NO: 3569371 - RNA, 22 nt, Human
agucuuguauuaaguuguuaau

SEQ ID NO: 3569372 - RNA, 17 nt, Human
agucuugucucagauuu

SEQ ID NO: 3569373 - RNA, 19 nt, Human
agucuugucucagauuuua

SEQ ID NO: 3569374 - RNA, 17 nt, Human
agucuuuaaaggcccag

SEQ ID NO: 3569375 - RNA, 23 nt, Human
agucuuuaaaggcccagccccua

SEQ ID NO: 3569376 - RNA, 20 nt, Human
agucuuuacagcugagcaca

SEQ ID NO: 3569377 - RNA, 19 nt, Human
agucuuuaggucuuuguaa

SEQ ID NO: 3569378 - RNA, 15 nt, Human
agucuuucauggcug

SEQ ID NO: 3569379 - RNA, 20 nt, Human
agucuuucaugugugccaag

SEQ ID NO: 3569380 - RNA, 14 nt, Human
agucuuucucuuuc

SEQ ID NO: 3569381 - RNA, 17 nt, Human
agucuuucucuuucccu

SEQ ID NO: 3569382 - RNA, 19 nt, Human
agucuuucucuuucccugg

SEQ ID NO: 3569383 - RNA, 16 nt, Human
agucuuugguucuaag

SEQ ID NO: 3569384 - RNA, 17 nt, Human
agucuuugguucuaagg

SEQ ID NO: 3569385 - RNA, 11 nt, Human
agucuuuuaaa

SEQ ID NO: 3569386 - RNA, 18 nt, Human
agucuuuuuuuuuuaagu

SEQ ID NO: 3569387 - RNA, 20 nt, Human
agugaaaaauguuaggacau

SEQ ID NO: 3569388 - RNA, 12 nt, Human
agugaaaacaag

SEQ ID NO: 3569389 - RNA, 16 nt, Human
agugaaaacuuuguag

SEQ ID NO: 3569390 - RNA, 18 nt, Human
agugaaacaucauagaaa

SEQ ID NO: 3569391 - RNA, 21 nt, Human
agugaaaccuuuagggcagcu

SEQ ID NO: 3569392 - RNA, 12 nt, Human
agugaaacuuuu

SEQ ID NO: 3569393 - RNA, 22 nt, Human
agugaaagaggcagcuugaaac

SEQ ID NO: 3569394 - RNA, 14 nt, Human
agugaaagcaucac

SEQ ID NO: 3569395 - RNA, 16 nt, Human
agugaaagcuagagau

SEQ ID NO: 3569396 - RNA, 13 nt, Human
agugaaauaaugu

SEQ ID NO: 3569397 - RNA, 16 nt, Human
agugaaauaaugugua

SEQ ID NO: 3569398 - RNA, 20 nt, Human
agugaaauuucuagccugca

SEQ ID NO: 3569399 - RNA, 20 nt, Human
agugaacaaauuuacagaga

SEQ ID NO: 3569400 - RNA, 23 nt, Human
agugaacaaauuuacagagacag

SEQ ID NO: 3569401 - RNA, 18 nt, Human
agugaacauuuggguaaa

SEQ ID NO: 3569402 - RNA, 13 nt, Human
agugaaccaaaga

SEQ ID NO: 3569403 - RNA, 15 nt, Human
agugaaccaaagaga

SEQ ID NO: 3569404 - RNA, 15 nt, Human
agugaaccuguauaa

SEQ ID NO: 3569405 - RNA, 19 nt, Human
agugaacuauuucuacaca

SEQ ID NO: 3569406 - RNA, 20 nt, Human
agugaacuugggccacugug

SEQ ID NO: 3569407 - RNA, 19 nt, Human
agugaagaaaagugaaugc

SEQ ID NO: 3569408 - RNA, 23 nt, Human
agugaagaaaagugaaugcucaa

SEQ ID NO: 3569409 - RNA, 14 nt, Human
agugaagaauacuu

SEQ ID NO: 3569410 - RNA, 14 nt, Human
agugaagacaauga

SEQ ID NO: 3569411 - RNA, 18 nt, Human
agugcagcugauuuuaac

SEQ ID NO: 3569412 - RNA, 17 nt, Human
agugcaggcccacccug

SEQ ID NO: 3569413 - RNA, 12 nt, Human
agugcaggcugg

SEQ ID NO: 3569414 - RNA, 13 nt, Human
agugcaggcuggc

SEQ ID NO: 3569415 - RNA, 15 nt, Human
agugcaggcuggcac

SEQ ID NO: 3569416 - RNA, 16 nt, Human
agugcaggcuggccag

SEQ ID NO: 3569417 - RNA, 17 nt, Human
agugcaggcuggccagc

SEQ ID NO: 3569418 - RNA, 18 nt, Human
agugcaggcuggccagcc

SEQ ID NO: 3569419 - RNA, 19 nt, Human
agugcaggcuggccagccg

SEQ ID NO: 3569420 - RNA, 16 nt, Human
agugcaguccugauca

SEQ ID NO: 3569421 - RNA, 22 nt, Human
agugcaguccugaucagagccg

SEQ ID NO: 3569422 - RNA, 21 nt, Human
agugcaguggcacaaucuugg

SEQ ID NO: 3569423 - RNA, 22 nt, Human
agugcaguggcgaaaucccugc

SEQ ID NO: 3569424 - RNA, 15 nt, Human
agugcaguuauuugc

SEQ ID NO: 3569425 - RNA, 15 nt, Human
agugcauccaaaggu

SEQ ID NO: 3569426 - RNA, 16 nt, Human
agugcaucucagccca

SEQ ID NO: 3569427 - RNA, 14 nt, Human
agugcaucuggaga

SEQ ID NO: 3569428 - RNA, 21 nt, Human
agugcaucuggagagaacagg

SEQ ID NO: 3569429 - RNA, 15 nt, Human
agugcaugcucucug

SEQ ID NO: 3569430 - RNA, 16 nt, Human
agugcaugcucucugc

SEQ ID NO: 3569431 - RNA, 16 nt, Human
agugcauuguuucugu

SEQ ID NO: 3569432 - RNA, 20 nt, Human
agugcauuguuucugugggc

SEQ ID NO: 3569433 - RNA, 12 nt, Human
agugcauuucug

SEQ ID NO: 3569434 - RNA, 15 nt, Human
agugcauuuucccag

SEQ ID NO: 3569435 - RNA, 17 nt, Human
agugcauuuuuguaaau

SEQ ID NO: 3569436 - RNA, 13 nt, Human
agugccaaagaaa

SEQ ID NO: 3569437 - RNA, 21 nt, Human
agugccaaagaagcagaccau

SEQ ID NO: 3569438 - RNA, 19 nt, Human
agugccacucauuccugua

SEQ ID NO: 3569439 - RNA, 14 nt, Human
agugccacuuaaug

SEQ ID NO: 3569440 - RNA, 16 nt, Human
agugccacuuaaugua

SEQ ID NO: 3569441 - RNA, 18 nt, Human
agugccacuuaauguaug

SEQ ID NO: 3569442 - RNA, 21 nt, Human
agugccacuuaauguauguua

SEQ ID NO: 3569443 - RNA, 20 nt, Human
agugccagaauuuuaggaac

SEQ ID NO: 3569444 - RNA, 15 nt, Human
agugccagagguggg

SEQ ID NO: 3569445 - RNA, 19 nt, Human
agugccagaggugggcagg

SEQ ID NO: 3569446 - RNA, 19 nt, Human
agugccaggacuccccagg

SEQ ID NO: 3569447 - RNA, 23 nt, Human
agugccaguauuuuaaaauagcg

SEQ ID NO: 3569448 - RNA, 15 nt, Human
agugccauugucuuu

SEQ ID NO: 3569449 - RNA, 21 nt, Human
agugccauugucuuuauauga

SEQ ID NO: 3569450 - RNA, 20 nt, Human
agugcccaccaacaucccau

SEQ ID NO: 3569451 - RNA, 18 nt, Human
agugcccacccugggaga

SEQ ID NO: 3569452 - RNA, 14 nt, Human
agugccccaccugc

SEQ ID NO: 3569453 - RNA, 20 nt, Human
agugccccauucuuuuguaa

SEQ ID NO: 3569454 - RNA, 20 nt, Human
agugccccugcugccucccc

SEQ ID NO: 3569455 - RNA, 12 nt, Human
agugcccuccag

SEQ ID NO: 3569456 - RNA, 17 nt, Human
agugcccuccagccccg

SEQ ID NO: 3569457 - RNA, 19 nt, Human
agugccgccgccucgccca

SEQ ID NO: 3569458 - RNA, 22 nt, Human
agugccgccgccucgcccaccg

SEQ ID NO: 3569459 - RNA, 23 nt, Human
agugccgccgccucgcccaccgc

SEQ ID NO: 3569460 - RNA, 16 nt, Human
agugccgcucuugggg

SEQ ID NO: 3569461 - RNA, 18 nt, Human
agugccgcucuuggggac

SEQ ID NO: 3569462 - RNA, 17 nt, Human
agugccguaacaacugu

SEQ ID NO: 3569463 - RNA, 19 nt, Human
agugccucucccugcugcu

SEQ ID NO: 3569464 - RNA, 22 nt, Human
agugccucucccugcugcuccu

SEQ ID NO: 3569465 - RNA, 14 nt, Human
agugccucuggucu

SEQ ID NO: 3569466 - RNA, 13 nt, Human
agugccugggaau

SEQ ID NO: 3569467 - RNA, 22 nt, Human
agugccugggaauguauuauuc

SEQ ID NO: 3569468 - RNA, 21 nt, Human
agugccuguaaucacagcuac

SEQ ID NO: 3569469 - RNA, 20 nt, Human
agugccuuaauaguagggua

SEQ ID NO: 3569470 - RNA, 17 nt, Human
agugccuuacacaaugg

SEQ ID NO: 3569471 - RNA, 17 nt, Human
agugccuuaccuccugc

SEQ ID NO: 3569472 - RNA, 19 nt, Human
agugccuuaccuccugccc

SEQ ID NO: 3569473 - RNA, 23 nt, Human
agugccuuaccuccugcccagga

SEQ ID NO: 3569474 - RNA, 19 nt, Human
agugccuuauggaacacuc

SEQ ID NO: 3569475 - RNA, 20 nt, Human
agugccuuauggaacacucu

SEQ ID NO: 3569476 - RNA, 21 nt, Human
agugccuuauggaacacucug

SEQ ID NO: 3569477 - RNA, 22 nt, Human
agugccuuauggaacacucuga

SEQ ID NO: 3569478 - RNA, 20 nt, Human
agugccuucaauaaauggua

SEQ ID NO: 3569479 - RNA, 19 nt, Human
agugccuuccuguuuuuca

SEQ ID NO: 3569480 - RNA, 16 nt, Human
agugccuucuaaaggu

SEQ ID NO: 3569481 - RNA, 18 nt, Human
agugccuucuguggggac

SEQ ID NO: 3569482 - RNA, 20 nt, Human
agugccuuuugcagaagagg

SEQ ID NO: 3569483 - RNA, 19 nt, Human
agugcgguuuacucacugc

SEQ ID NO: 3569484 - RNA, 14 nt, Human
agugcgugcucagu

SEQ ID NO: 3569485 - RNA, 20 nt, Human
agugcuaaaaaugggacuuc

SEQ ID NO: 3569486 - RNA, 23 nt, Human
agugcuaacaugaagaccuuuuu

SEQ ID NO: 3569487 - RNA, 21 nt, Human
agugcuaagguucuaaggccu

SEQ ID NO: 3569488 - RNA, 17 nt, Human
agugcuaagugugaacu

SEQ ID NO: 3569489 - RNA, 19 nt, Human
agugcuaagugugaacugg

SEQ ID NO: 3569490 - RNA, 22 nt, Human
agugcuacacaccuaacuuaug

SEQ ID NO: 3569491 - RNA, 14 nt, Human
agugcuacauaaau

SEQ ID NO: 3569492 - RNA, 17 nt, Human
agugcuacauaaauugg

SEQ ID NO: 3569493 - RNA, 16 nt, Human
agugcuauauauauaa

SEQ ID NO: 3569494 - RNA, 17 nt, Human
agugcuauauauauaaa

SEQ ID NO: 3569495 - RNA, 23 nt, Human
agugcuauauauauaaauauuug

SEQ ID NO: 3569496 - RNA, 23 nt, Human
agugcuauuacgaaguucaagau

SEQ ID NO: 3569497 - RNA, 14 nt, Human
agugcuauugcaga

SEQ ID NO: 3569498 - RNA, 14 nt, Human
agugcucaaggcca

SEQ ID NO: 3569499 - RNA, 20 nt, Human
agugcuccauaguuuggcau

SEQ ID NO: 3569500 - RNA, 15 nt, Human
agugcucgcuguugc

SEQ ID NO: 3569501 - RNA, 19 nt, Human
agugcucgcuguugcugaa

SEQ ID NO: 3569502 - RNA, 22 nt, Human
agugcucgcuguugcugaauag

SEQ ID NO: 3569503 - RNA, 23 nt, Human
agugcucgcuguugcugaauagg

SEQ ID NO: 3569504 - RNA, 12 nt, Human
agugcucgcuuu

SEQ ID NO: 3569505 - RNA, 15 nt, Human
agugcugaacagugg

SEQ ID NO: 3569506 - RNA, 21 nt, Human
agugcugaagcuuauuaaugc

SEQ ID NO: 3569507 - RNA, 22 nt, Human
agugcugaagcuuauuaaugcu

SEQ ID NO: 3569508 - RNA, 15 nt, Human
agugcugaauuuccc

SEQ ID NO: 3569509 - RNA, 12 nt, Human
agugcugagacc

SEQ ID NO: 3569510 - RNA, 20 nt, Human
agugcugagauuacaggcau

SEQ ID NO: 3569511 - RNA, 17 nt, Human
agugcugcagcucccug

SEQ ID NO: 3569512 - RNA, 21 nt, Human
agugcugcagggcuuuaaaau

SEQ ID NO: 3569513 - RNA, 22 nt, Human
agugcugcauuuaaaagauaca

SEQ ID NO: 3569514 - RNA, 17 nt, Human
agugcugccugucccca

SEQ ID NO: 3569515 - RNA, 13 nt, Human
agugcuggcucac

SEQ ID NO: 3569516 - RNA, 15 nt, Human
agugcuggcucacag

SEQ ID NO: 3569517 - RNA, 16 nt, Human
agugcuggcucacagu

SEQ ID NO: 3569518 - RNA, 19 nt, Human
agugcuggcucacaguaca

SEQ ID NO: 3569519 - RNA, 21 nt, Human
agugcuggcucacaguacagc

SEQ ID NO: 3569520 - RNA, 21 nt, Human
agugcugggauggaggggagu

SEQ ID NO: 3569521 - RNA, 17 nt, Human
agugcugggauuacagg

SEQ ID NO: 3569522 - RNA, 22 nt, Human
agugcugggauuacaggcauga

SEQ ID NO: 3569523 - RNA, 19 nt, Human
agugcugggauuacaggcu

SEQ ID NO: 3569524 - RNA, 16 nt, Human
agugcuguauaaaauc

SEQ ID NO: 3569525 - RNA, 20 nt, Human
agugcuguccaugcuucuca

SEQ ID NO: 3569526 - RNA, 22 nt, Human
agugcuguccaugcuucucauc

SEQ ID NO: 3569527 - RNA, 22 nt, Human
agugcugucugaucugugcuuu

SEQ ID NO: 3569528 - RNA, 23 nt, Human
agugcugucuuaaacuaaaugug

SEQ ID NO: 3569529 - RNA, 17 nt, Human
agugcugugcugugcua

SEQ ID NO: 3569530 - RNA, 20 nt, Human
agugcuguggccugggcaag

SEQ ID NO: 3569531 - RNA, 20 nt, Human
agugcuguuuauuaaucuua

SEQ ID NO: 3569532 - RNA, 22 nt, Human
agugcuguuuauuaaucuuagu

SEQ ID NO: 3569533 - RNA, 22 nt, Human
agugcuguuuuguuauauaauu

SEQ ID NO: 3569534 - RNA, 23 nt, Human
agugcuguuuuguuauauaauuu

SEQ ID NO: 3569535 - RNA, 19 nt, Human
agugcuuaaaaaucauuga

SEQ ID NO: 3569536 - RNA, 16 nt, Human
agugcuucagccugag

SEQ ID NO: 3569537 - RNA, 18 nt, Human
agugcuucagccugaggc

SEQ ID NO: 3569538 - RNA, 21 nt, Human
agugcuucuuaaagaguucuu

SEQ ID NO: 3569539 - RNA, 15 nt, Human
agugcuugccacaga

SEQ ID NO: 3569540 - RNA, 16 nt, Human
agugcuuggcccagga

SEQ ID NO: 3569541 - RNA, 19 nt, Human
agugcuuggcccaggaguu

SEQ ID NO: 3569542 - RNA, 20 nt, Human
agugcuuggcccaggaguuu

SEQ ID NO: 3569543 - RNA, 14 nt, Human
agugcuuguguaau

SEQ ID NO: 3569544 - RNA, 19 nt, Human
agugcuuuccuuuuuuaaa

SEQ ID NO: 3569545 - RNA, 16 nt, Human
agugcuuuucuguuua

SEQ ID NO: 3569546 - RNA, 11 nt, Human
aguggaaaaau

SEQ ID NO: 3569547 - RNA, 22 nt, Human
aguggaaauucaggugaaaaug

SEQ ID NO: 3569548 - RNA, 16 nt, Human
aguggaacgaaaauga

SEQ ID NO: 3569549 - RNA, 16 nt, Human
aguggaagaagaaaac

SEQ ID NO: 3569550 - RNA, 17 nt, Human
aguggaagaagagggag

SEQ ID NO: 3569551 - RNA, 17 nt, Human
aguggaagaagcagaug

SEQ ID NO: 3569552 - RNA, 15 nt, Human
aguggaaggaaagau

SEQ ID NO: 3569553 - RNA, 20 nt, Human
aguggaauaguauccuccag

SEQ ID NO: 3569554 - RNA, 23 nt, Human
aguguacauggaauaacauguaa

SEQ ID NO: 3569555 - RNA, 20 nt, Human
aguguacccccgcccaggcu

SEQ ID NO: 3569556 - RNA, 17 nt, Human
aguguaccuguguacau

SEQ ID NO: 3569557 - RNA, 15 nt, Human
aguguagaaccuaau

SEQ ID NO: 3569558 - RNA, 12 nt, Human
aguguagaagca

SEQ ID NO: 3569559 - RNA, 16 nt, Human
aguguagaagcauucc

SEQ ID NO: 3569560 - RNA, 20 nt, Human
aguguagauuccauuuacug

SEQ ID NO: 3569561 - RNA, 19 nt, Human
aguguagauuuguuuugug

SEQ ID NO: 3569562 - RNA, 18 nt, Human
aguguagcccacacuuga

SEQ ID NO: 3569563 - RNA, 21 nt, Human
aguguagcccacacuugagag

SEQ ID NO: 3569564 - RNA, 21 nt, Human
aguguagccccaagaaggcug

SEQ ID NO: 3569565 - RNA, 22 nt, Human
aguguagccccaagaaggcugg

SEQ ID NO: 3569566 - RNA, 14 nt, Human
aguguaggcagaca

SEQ ID NO: 3569567 - RNA, 22 nt, Human
aguguaggcagacacagggacu

SEQ ID NO: 3569568 - RNA, 22 nt, Human
aguguaggcuuuacuuagcuua

SEQ ID NO: 3569569 - RNA, 17 nt, Human
aguguaguuuacagaaa

SEQ ID NO: 3569570 - RNA, 14 nt, Human
aguguauaucagaa

SEQ ID NO: 3569571 - RNA, 17 nt, Human
aguguaucaaaaugcuc

SEQ ID NO: 3569572 - RNA, 16 nt, Human
aguguauggaaauaaa

SEQ ID NO: 3569573 - RNA, 22 nt, Human
aguguauggaaauaaauguauc

SEQ ID NO: 3569574 - RNA, 17 nt, Human
aguguauguagaagcau

SEQ ID NO: 3569575 - RNA, 13 nt, Human
aguguaugucuug

SEQ ID NO: 3569576 - RNA, 13 nt, Human
aguguauuucagu

SEQ ID NO: 3569577 - RNA, 14 nt, Human
aguguauuucaguu

SEQ ID NO: 3569578 - RNA, 15 nt, Human
aguguauuucaguuc

SEQ ID NO: 3569579 - RNA, 22 nt, Human
aguguauuuuauaaaauuaaag

SEQ ID NO: 3569580 - RNA, 16 nt, Human
aguguauuuugaaauu

SEQ ID NO: 3569581 - RNA, 18 nt, Human
aguguauuuuuuuacuaa

SEQ ID NO: 3569582 - RNA, 17 nt, Human
agugucaaauaaacacu

SEQ ID NO: 3569583 - RNA, 20 nt, Human
agugucaaauaaacacugug

SEQ ID NO: 3569584 - RNA, 13 nt, Human
agugucaaccaga

SEQ ID NO: 3569585 - RNA, 15 nt, Human
agugucaaccagaca

SEQ ID NO: 3569586 - RNA, 16 nt, Human
agugucaaccagacag

SEQ ID NO: 3569587 - RNA, 22 nt, Human
agugucaaguugugcuuguuua

SEQ ID NO: 3569588 - RNA, 19 nt, Human
agugucaaugcagccccca

SEQ ID NO: 3569589 - RNA, 21 nt, Human
agugucacuuaccuagauuua

SEQ ID NO: 3569590 - RNA, 19 nt, Human
agugucauuuaugaaaaga

SEQ ID NO: 3569591 - RNA, 18 nt, Human
agugucauuucucaucca

SEQ ID NO: 3569592 - RNA, 20 nt, Human
agugucauuucucauccaca

SEQ ID NO: 3569593 - RNA, 14 nt, Human
aguguccaaagcag

SEQ ID NO: 3569594 - RNA, 20 nt, Human
aguguccaaagcagggucug

SEQ ID NO: 3569595 - RNA, 20 nt, Human
aguguccauugacauguaca

SEQ ID NO: 3569596 - RNA, 18 nt, Human
aguguccauuuugugaag

SEQ ID NO: 3569597 - RNA, 19 nt, Human
aguguccauuuugugaagc

SEQ ID NO: 3569598 - RNA, 21 nt, Human
aguguccauuuugugaagccc

SEQ ID NO: 3569599 - RNA, 23 nt, Human
aguguccauuuugugaagcccug

SEQ ID NO: 3569600 - RNA, 22 nt, Human
agugucccccagguuccgaaga

SEQ ID NO: 3569601 - RNA, 19 nt, Human
aguguccccuccacuguca

SEQ ID NO: 3569602 - RNA, 16 nt, Human
aguguccgagaacuaa

SEQ ID NO: 3569603 - RNA, 16 nt, Human
aguguccuaugcaaua

SEQ ID NO: 3569604 - RNA, 21 nt, Human
aguguccuccccucaaggaca

SEQ ID NO: 3569605 - RNA, 18 nt, Human
aguguccugagccccagg

SEQ ID NO: 3569606 - RNA, 17 nt, Human
aguguccugagcucagc

SEQ ID NO: 3569607 - RNA, 20 nt, Human
aguguccugagcucagcgug

SEQ ID NO: 3569608 - RNA, 22 nt, Human
aguguccuuggcaggcugauuu

SEQ ID NO: 3569609 - RNA, 17 nt, Human
agugucuauaaaagaaa

SEQ ID NO: 3569610 - RNA, 22 nt, Human
agugucucggagggauuccccu

SEQ ID NO: 3569611 - RNA, 21 nt, Human
agugucuggaucaguaaaauu

SEQ ID NO: 3569612 - RNA, 16 nt, Human
agugucuggcacacag

SEQ ID NO: 3569613 - RNA, 12 nt, Human
agugucuggcug

SEQ ID NO: 3569614 - RNA, 19 nt, Human
agugucugggcugacuggg

SEQ ID NO: 3569615 - RNA, 22 nt, Human
agugucugucccgggguccugu

SEQ ID NO: 3569616 - RNA, 13 nt, Human
agugucugugugc

SEQ ID NO: 3569617 - RNA, 19 nt, Human
agugucuucacggcaggac

SEQ ID NO: 3569618 - RNA, 15 nt, Human
agugucuuccauaau

SEQ ID NO: 3569619 - RNA, 16 nt, Human
agugucuuuccacucc

SEQ ID NO: 3569620 - RNA, 21 nt, Human
agugucuuucuuuggugccuu

SEQ ID NO: 3569621 - RNA, 15 nt, Human
agugucuuuuuuugu

SEQ ID NO: 3569622 - RNA, 19 nt, Human
agugucuuuuuuuguauag

SEQ ID NO: 3569623 - RNA, 22 nt, Human
agugucuuuuuuuguauaguua

SEQ ID NO: 3569624 - RNA, 15 nt, Human
agugugaaauagaca

SEQ ID NO: 3569625 - RNA, 14 nt, Human
agugugaaauauau

SEQ ID NO: 3569626 - RNA, 23 nt, Human
agugugaacuggacccuguugcu

SEQ ID NO: 3569627 - RNA, 18 nt, Human
agugugaaguuagaauuc

SEQ ID NO: 3569628 - RNA, 13 nt, Human
agugugaauacug

SEQ ID NO: 3569629 - RNA, 14 nt, Human
agugugaauacugc

SEQ ID NO: 3569630 - RNA, 21 nt, Human
agugugaauauaaaugugugu

SEQ ID NO: 3569631 - RNA, 20 nt, Human
agugugaauugcaaaaccca

SEQ ID NO: 3569632 - RNA, 11 nt, Human
agugugacagg

SEQ ID NO: 3569633 - RNA, 14 nt, Human
agugugacagggcc

SEQ ID NO: 3569634 - RNA, 22 nt, Human
agugugacagggccaguggggc

SEQ ID NO: 3569635 - RNA, 18 nt, Human
agugugaggccagggcag

SEQ ID NO: 3569636 - RNA, 19 nt, Human
agugugaguaagagcuggu

SEQ ID NO: 3569637 - RNA, 22 nt, Human
agugugauugggaauaaauaug

SEQ ID NO: 3569638 - RNA, 23 nt, Human
agugugauugggaauaaauaugc

SEQ ID NO: 3569639 - RNA, 12 nt, Human
agugugcaaaau

SEQ ID NO: 3569640 - RNA, 13 nt, Human
agugugcaaggca

SEQ ID NO: 3569641 - RNA, 21 nt, Human
agugugcaguucuaguuugca

SEQ ID NO: 3569642 - RNA, 16 nt, Human
agugugcauauuguac

SEQ ID NO: 3569643 - RNA, 19 nt, Human
agugugcauggaggcccuc

SEQ ID NO: 3569644 - RNA, 14 nt, Human
agugugccuucucu

SEQ ID NO: 3569645 - RNA, 18 nt, Human
agugugcuuuaugcugaa

SEQ ID NO: 3569646 - RNA, 17 nt, Human
aguguggaaauuaagaa

SEQ ID NO: 3569647 - RNA, 16 nt, Human
aguguggcaguuuggc

SEQ ID NO: 3569648 - RNA, 21 nt, Human
aguguggcuccccucuauuua

SEQ ID NO: 3569649 - RNA, 14 nt, Human
agugugggaggcuc

SEQ ID NO: 3569650 - RNA, 16 nt, Human
agugugggaggcuccu

SEQ ID NO: 3569651 - RNA, 21 nt, Human
agugugguagggacuuaaaaa

SEQ ID NO: 3569652 - RNA, 17 nt, Human
aguguggucccaacagg

SEQ ID NO: 3569653 - RNA, 17 nt, Human
agugugguguuuccugg

SEQ ID NO: 3569654 - RNA, 21 nt, Human
agugugguuucuuuuugaauc

SEQ ID NO: 3569655 - RNA, 11 nt, Human
aguguguaaag

SEQ ID NO: 3569656 - RNA, 22 nt, Human
aguguguauuaaaaaaaacaaa

SEQ ID NO: 3569657 - RNA, 23 nt, Human
aguguguauuaaaaaaaacaaaa

SEQ ID NO: 3569658 - RNA, 15 nt, Human
aguguguauuguucc

SEQ ID NO: 3569659 - RNA, 16 nt, Human
aguguguauuguuccc

SEQ ID NO: 3569660 - RNA, 14 nt, Human
agugugucuaaauu

SEQ ID NO: 3569661 - RNA, 14 nt, Human
agugugucuccugc

SEQ ID NO: 3569662 - RNA, 15 nt, Human
agugugucuccugca

SEQ ID NO: 3569663 - RNA, 14 nt, Human
agugugugacauuc

SEQ ID NO: 3569664 - RNA, 21 nt, Human
agugugugauuuuuugcauuc

SEQ ID NO: 3569665 - RNA, 17 nt, Human
agugugugcaaguaugu

SEQ ID NO: 3569666 - RNA, 19 nt, Human
agugugugcacaugugugc

SEQ ID NO: 3569667 - RNA, 19 nt, Human
agugugugcauaauagcua

SEQ ID NO: 3569668 - RNA, 14 nt, Human
agugugugcaugug

SEQ ID NO: 3569669 - RNA, 18 nt, Human
agugugugcaugugugug

SEQ ID NO: 3569670 - RNA, 23 nt, Human
agugugugcaugugugugcucag

SEQ ID NO: 3569671 - RNA, 14 nt, Human
agugugugucuuuc

SEQ ID NO: 3569672 - RNA, 18 nt, Human
agugugugugugcaugug

SEQ ID NO: 3569673 - RNA, 17 nt, Human
aguguguucugauuaga

SEQ ID NO: 3569674 - RNA, 20 nt, Human
aguguguucugauuagaaau

SEQ ID NO: 3569675 - RNA, 21 nt, Human
aguguguucugauuagaaaug

SEQ ID NO: 3569676 - RNA, 22 nt, Human
aguguguuguugcuuuaggcuc

SEQ ID NO: 3569677 - RNA, 15 nt, Human
aguguuaaaugugau

SEQ ID NO: 3569678 - RNA, 16 nt, Human
aguguuaauacuaguu

SEQ ID NO: 3569679 - RNA, 23 nt, Human
aguguuagccuuuuuuccccaga

SEQ ID NO: 3569680 - RNA, 17 nt, Human
aguguuaggccuggcac

SEQ ID NO: 3569681 - RNA, 15 nt, Human
aguguuagggaaggg

SEQ ID NO: 3569682 - RNA, 14 nt, Human
aguguuauaugaac

SEQ ID NO: 3569683 - RNA, 22 nt, Human
aguguuauuaguguaugcuuug

SEQ ID NO: 3569684 - RNA, 15 nt, Human
aguguucagaaaaaa

SEQ ID NO: 3569685 - RNA, 16 nt, Human
aguguugaaaauguuc

SEQ ID NO: 3569686 - RNA, 21 nt, Human
aguguugaaacggaugauuuc

SEQ ID NO: 3569687 - RNA, 13 nt, Human
aguguugccuaag

SEQ ID NO: 3569688 - RNA, 16 nt, Human
aguguuggagaagaac

SEQ ID NO: 3569689 - RNA, 18 nt, Human
aguguuguuuguaaauaa

SEQ ID NO: 3569690 - RNA, 20 nt, Human
aguguuguuuguaaauaaga

SEQ ID NO: 3569691 - RNA, 21 nt, Human
aguguuguuuguaaauaagag

SEQ ID NO: 3569692 - RNA, 14 nt, Human
aguguuuaaaacuu

SEQ ID NO: 3569693 - RNA, 16 nt, Human
aguguuuauccuuuca

SEQ ID NO: 3569694 - RNA, 20 nt, Human
aguguuuauccuuucauaua

SEQ ID NO: 3569695 - RNA, 13 nt, Human
aguguuuaugugc

SEQ ID NO: 3569696 - RNA, 16 nt, Human
aguguuuaugugcuau

SEQ ID NO: 3569697 - RNA, 15 nt, Human
aguguuuauuuuuca

SEQ ID NO: 3569698 - RNA, 19 nt, Human
auacaguaagcugcucuau

SEQ ID NO: 3569699 - RNA, 15 nt, Human
auacaguacaggcag

SEQ ID NO: 3569700 - RNA, 15 nt, Human
auacaguacaguggu

SEQ ID NO: 3569701 - RNA, 17 nt, Human
auacagucccuaaagaa

SEQ ID NO: 3569702 - RNA, 18 nt, Human
auacagucccuaaagaaa

SEQ ID NO: 3569703 - RNA, 22 nt, Human
auacagucccuaaagaaaaaaa

SEQ ID NO: 3569704 - RNA, 20 nt, Human
auacagucuuccauuugcaa

SEQ ID NO: 3569705 - RNA, 14 nt, Human
auacaguguuauuu

SEQ ID NO: 3569706 - RNA, 20 nt, Human
auacaguuacucagaauucu

SEQ ID NO: 3569707 - RNA, 17 nt, Human
auacaguuauaaaauua

SEQ ID NO: 3569708 - RNA, 22 nt, Human
auacaguuugucacaugaaaca

SEQ ID NO: 3569709 - RNA, 12 nt, Human
auacaguuuuau

SEQ ID NO: 3569710 - RNA, 15 nt, Human
auacaguuuuaugcu

SEQ ID NO: 3569711 - RNA, 18 nt, Human
auacaguuuuaugcucuu

SEQ ID NO: 3569712 - RNA, 22 nt, Human
auacauaacaggguaaauuauu

SEQ ID NO: 3569713 - RNA, 19 nt, Human
auacauaacuaaauuugau

SEQ ID NO: 3569714 - RNA, 21 nt, Human
auacauaacuaaauuugauac

SEQ ID NO: 3569715 - RNA, 22 nt, Human
auacauaaugggccacugaaau

SEQ ID NO: 3569716 - RNA, 13 nt, Human
auacauacacaua

SEQ ID NO: 3569717 - RNA, 16 nt, Human
auacauacacauauau

SEQ ID NO: 3569718 - RNA, 17 nt, Human
auacauacacauauaua

SEQ ID NO: 3569719 - RNA, 23 nt, Human
auacauacaccagcauuccuuuu

SEQ ID NO: 3569720 - RNA, 22 nt, Human
auacauacacuuguauaaaugu

SEQ ID NO: 3569721 - RNA, 12 nt, Human
auacauacagaa

SEQ ID NO: 3569722 - RNA, 21 nt, Human
auacauacggucagguuuaac

SEQ ID NO: 3569723 - RNA, 18 nt, Human
auacauacuuacaugugu

SEQ ID NO: 3569724 - RNA, 23 nt, Human
auacauauauguauauauaugca

SEQ ID NO: 3569725 - RNA, 13 nt, Human
auacauaucuuua

SEQ ID NO: 3569726 - RNA, 21 nt, Human
auacauaucuuuauuaaucac

SEQ ID NO: 3569727 - RNA, 22 nt, Human
auacauaugaguguggaagccg

SEQ ID NO: 3569728 - RNA, 22 nt, Human
auacauauguagacuauauaca

SEQ ID NO: 3569729 - RNA, 23 nt, Human
auacauauguagacuauauacau

SEQ ID NO: 3569730 - RNA, 21 nt, Human
auacauauuuuauagaacuuc

SEQ ID NO: 3569731 - RNA, 20 nt, Human
auacaucccuuaccugggaa

SEQ ID NO: 3569732 - RNA, 16 nt, Human
auacaugcaaaaagaa

SEQ ID NO: 3569733 - RNA, 18 nt, Human
auacaugcuaagagaagu

SEQ ID NO: 3569734 - RNA, 24 nt, Human
auacauggguagcuucugaccuca

SEQ ID NO: 3569735 - RNA, 22 nt, Human
auacaugguagccaguugaauu

SEQ ID NO: 3569736 - RNA, 20 nt, Human
auacaugguugugaccugag

SEQ ID NO: 3569737 - RNA, 23 nt, Human
auacaugucacauuuagcugugc

SEQ ID NO: 3569738 - RNA, 19 nt, Human
auacaugugauacauuuuu

SEQ ID NO: 3569739 - RNA, 21 nt, Human
auacaugugccgaaugugcag

SEQ ID NO: 3569740 - RNA, 17 nt, Human
auacauguguguauaua

SEQ ID NO: 3569741 - RNA, 19 nt, Human
auacauguguguauauaug

SEQ ID NO: 3569742 - RNA, 21 nt, Human
auacauguguguauauaugug

SEQ ID NO: 3569743 - RNA, 14 nt, Human
auacauguuuaugu

SEQ ID NO: 3569744 - RNA, 12 nt, Human
auacauuaaagc

SEQ ID NO: 3569745 - RNA, 13 nt, Human
auacauuaaagca

SEQ ID NO: 3569746 - RNA, 15 nt, Human
auacauuaaagcagu

SEQ ID NO: 3569747 - RNA, 16 nt, Human
auacauuaguaaaugu

SEQ ID NO: 3569748 - RNA, 22 nt, Human
auacauuaguaaaugucuuugu

SEQ ID NO: 3569749 - RNA, 20 nt, Human
auacauucuucaagauccca

SEQ ID NO: 3569750 - RNA, 12 nt, Human
auacauucuuuu

SEQ ID NO: 3569751 - RNA, 21 nt, Human
auacauugucucuaaauugug

SEQ ID NO: 3569752 - RNA, 17 nt, Human
auacauuuaugaauuaa

SEQ ID NO: 3569753 - RNA, 21 nt, Human
auacauuuguauguugugaag

SEQ ID NO: 3569754 - RNA, 16 nt, Human
auacauuuuuuaagcu

SEQ ID NO: 3569755 - RNA, 20 nt, Human
auacauuuuuuaagcuucag

SEQ ID NO: 3569756 - RNA, 19 nt, Human
auaccaaaauuauuucaga

SEQ ID NO: 3569757 - RNA, 17 nt, Human
auaccaagcauguggau

SEQ ID NO: 3569758 - RNA, 14 nt, Human
auaccaaguauuua

SEQ ID NO: 3569759 - RNA, 15 nt, Human
auaccaauaaaguga

SEQ ID NO: 3569760 - RNA, 21 nt, Human
auaccaauaaagugacccugc

SEQ ID NO: 3569761 - RNA, 13 nt, Human
auaccacaucaaa

SEQ ID NO: 3569762 - RNA, 17 nt, Human
auaccacucuguaauug

SEQ ID NO: 3569763 - RNA, 19 nt, Human
auaccacucuguaauugca

SEQ ID NO: 3569764 - RNA, 16 nt, Human
auaccagacugcaggu

SEQ ID NO: 3569765 - RNA, 22 nt, Human
auaccagcgaggaggcuccaga

SEQ ID NO: 3569766 - RNA, 18 nt, Human
auaccagcuuagauuuua

SEQ ID NO: 3569767 - RNA, 19 nt, Human
auaccagugaaccaaagag

SEQ ID NO: 3569768 - RNA, 19 nt, Human
auaccauggugaauuaauc

SEQ ID NO: 3569769 - RNA, 23 nt, Human
auaccauuauauguucccccugu

SEQ ID NO: 3569770 - RNA, 15 nt, Human
auaccauugacacau

SEQ ID NO: 3569771 - RNA, 18 nt, Human
auaccauuuaguaagaau

SEQ ID NO: 3569772 - RNA, 17 nt, Human
auaccauuuccucagcu

SEQ ID NO: 3569773 - RNA, 13 nt, Human
auacccacccaga

SEQ ID NO: 3569774 - RNA, 13 nt, Human
auacccaccccca

SEQ ID NO: 3569775 - RNA, 20 nt, Human
auacccccugcaaagcccag

SEQ ID NO: 3569776 - RNA, 18 nt, Human
auaccccuuacaaaugaa

SEQ ID NO: 3569777 - RNA, 12 nt, Human
auacccuccccc

SEQ ID NO: 3569778 - RNA, 15 nt, Human
auacccugaccuggc

SEQ ID NO: 3569779 - RNA, 12 nt, Human
auacccugcccu

SEQ ID NO: 3569780 - RNA, 15 nt, Human
auacccuucuuuuau

SEQ ID NO: 3569781 - RNA, 14 nt, Human
auaccuaaaacaua

SEQ ID NO: 3569782 - RNA, 13 nt, Human
auaccuaaaagag

SEQ ID NO: 3569783 - RNA, 21 nt, Human
auaccuaagaaguacauuguu

SEQ ID NO: 3569784 - RNA, 21 nt, Human
auaccuacauguauuuguuug

SEQ ID NO: 3569785 - RNA, 15 nt, Human
auaccucaaccuaug

SEQ ID NO: 3569786 - RNA, 20 nt, Human
auaccucaauuuucacugug

SEQ ID NO: 3569787 - RNA, 22 nt, Human
auaccucauguuuaugaaaaua

SEQ ID NO: 3569788 - RNA, 15 nt, Human
auaccuccaacccug

SEQ ID NO: 3569789 - RNA, 17 nt, Human
auaccuccaacccugcc

SEQ ID NO: 3569790 - RNA, 18 nt, Human
auaccucuaauaguauaa

SEQ ID NO: 3569791 - RNA, 19 nt, Human
auaccucuaauaguauaaa

SEQ ID NO: 3569792 - RNA, 20 nt, Human
auaccucuaauaguauaaac

SEQ ID NO: 3569793 - RNA, 13 nt, Human
auaccucugacca

SEQ ID NO: 3569794 - RNA, 14 nt, Human
auaccucugaccaa

SEQ ID NO: 3569795 - RNA, 12 nt, Human
auaccucugugu

SEQ ID NO: 3569796 - RNA, 14 nt, Human
auaccucugugugc

SEQ ID NO: 3569797 - RNA, 16 nt, Human
auaccucugugugcuc

SEQ ID NO: 3569798 - RNA, 16 nt, Human
auaccucuuagcugag

SEQ ID NO: 3569799 - RNA, 16 nt, Human
auaccucuuugaaaga

SEQ ID NO: 3569800 - RNA, 20 nt, Human
auaccugauuuuuuuuccuu

SEQ ID NO: 3569801 - RNA, 13 nt, Human
auaccuguccccc

SEQ ID NO: 3569802 - RNA, 17 nt, Human
auaccugucccccugac

SEQ ID NO: 3569803 - RNA, 21 nt, Human
auaccuguguuucuugccuca

SEQ ID NO: 3569804 - RNA, 22 nt, Human
auaccuguguuucuugccucau

SEQ ID NO: 3569805 - RNA, 12 nt, Human
auaccuguugcu

SEQ ID NO: 3569806 - RNA, 18 nt, Human
auaccuuaaaauuugaaa

SEQ ID NO: 3569807 - RNA, 22 nt, Human
auaccuuaaaauuugaaacauu

SEQ ID NO: 3569808 - RNA, 18 nt, Human
auaccuuagugcaguuau

SEQ ID NO: 3569809 - RNA, 18 nt, Human
auaccuuauauaugcacu

SEQ ID NO: 3569810 - RNA, 18 nt, Human
auaccuuucacagcuuuu

SEQ ID NO: 3569811 - RNA, 22 nt, Human
auaccuuucacagcuuuuauca

SEQ ID NO: 3569812 - RNA, 15 nt, Human
auaccuuugccuugg

SEQ ID NO: 3569813 - RNA, 14 nt, Human
auaccuuuuuuaga

SEQ ID NO: 3569814 - RNA, 14 nt, Human
auacgaaauaauug

SEQ ID NO: 3569815 - RNA, 15 nt, Human
auacgaaauaauugu

SEQ ID NO: 3569816 - RNA, 18 nt, Human
auacgaaauaauuguugu

SEQ ID NO: 3569817 - RNA, 11 nt, Human
auacgaacaaa

SEQ ID NO: 3569818 - RNA, 16 nt, Human
auacgagagcagaggu

SEQ ID NO: 3569819 - RNA, 19 nt, Human
auacgagagcagaggucuc

SEQ ID NO: 3569820 - RNA, 17 nt, Human
auacgauuuaagguauu

SEQ ID NO: 3569821 - RNA, 16 nt, Human
auacgcacuacaugug

SEQ ID NO: 3569822 - RNA, 24 nt, Human
auacgcuuuucuuuguuauaccau

SEQ ID NO: 3569823 - RNA, 22 nt, Human
auacggucagguuuaacauuug

SEQ ID NO: 3569824 - RNA, 15 nt, Human
auacgguggggguag

SEQ ID NO: 3569825 - RNA, 14 nt, Human
auacguacacauuu

SEQ ID NO: 3569826 - RNA, 15 nt, Human
auacguacacauuuu

SEQ ID NO: 3569827 - RNA, 16 nt, Human
auacguacacauuuua

SEQ ID NO: 3569828 - RNA, 13 nt, Human
auacuaaaaauca

SEQ ID NO: 3569829 - RNA, 21 nt, Human
auacuaaaaguucuucuccaa

SEQ ID NO: 3569830 - RNA, 13 nt, Human
auacuaaccagca

SEQ ID NO: 3569831 - RNA, 19 nt, Human
auacuaaccagcagaaaug

SEQ ID NO: 3569832 - RNA, 15 nt, Human
auacuaacuuauuua

SEQ ID NO: 3569833 - RNA, 14 nt, Human
auacuaagaaaaga

SEQ ID NO: 3569834 - RNA, 20 nt, Human
auacuaagauguucacugug

SEQ ID NO: 3569835 - RNA, 21 nt, Human
auacuaagcauugaauggcua

SEQ ID NO: 3569836 - RNA, 18 nt, Human
auacuaauaaacuaauaa

SEQ ID NO: 3569837 - RNA, 22 nt, Human
auacuaauaaacuaauaauugc

SEQ ID NO: 3569838 - RNA, 21 nt, Human
auacuaaugaaaacagaaugu

SEQ ID NO: 3569839 - RNA, 15 nt, Human
auacuacaguuuguu

SEQ ID NO: 3569840 - RNA, 14 nt, Human
auacuacaucuuua

SEQ ID NO: 3569841 - RNA, 17 nt, Human
auacuaccuugaaaaua

SEQ ID NO: 3569842 - RNA, 13 nt, Human
auagcucuggggu

SEQ ID NO: 3569843 - RNA, 22 nt, Human
auagcucuggggugggcaguuu

SEQ ID NO: 3569844 - RNA, 17 nt, Human
auagcugagauuccugg

SEQ ID NO: 3569845 - RNA, 22 nt, Human
auagcuggucuuauuuguaaag

SEQ ID NO: 3569846 - RNA, 15 nt, Human
auagcuguaaacuuc

SEQ ID NO: 3569847 - RNA, 23 nt, Human
auagcuguacaaauauaagaaua

SEQ ID NO: 3569848 - RNA, 13 nt, Human
auagcuguauuga

SEQ ID NO: 3569849 - RNA, 12 nt, Human
auagcugugacu

SEQ ID NO: 3569850 - RNA, 19 nt, Human
auagcugugauuuuuggua

SEQ ID NO: 3569851 - RNA, 22 nt, Human
auagcugugauuuuugguauuu

SEQ ID NO: 3569852 - RNA, 22 nt, Human
auagcuuacaagccagcuggag

SEQ ID NO: 3569853 - RNA, 21 nt, Human
auagcuucaccccaaucccag

SEQ ID NO: 3569854 - RNA, 14 nt, Human
auagcuugaaacau

SEQ ID NO: 3569855 - RNA, 15 nt, Human
auagcuuuauuucuu

SEQ ID NO: 3569856 - RNA, 23 nt, Human
auagcuuuauuuuuuaaguauuu

SEQ ID NO: 3569857 - RNA, 17 nt, Human
auagcuuuuauuguaua

SEQ ID NO: 3569858 - RNA, 15 nt, Human
auaggaacauaugaa

SEQ ID NO: 3569859 - RNA, 18 nt, Human
auaggaacauaugaaaau

SEQ ID NO: 3569860 - RNA, 15 nt, Human
auaggaaggucauuu

SEQ ID NO: 3569861 - RNA, 21 nt, Human
auaggaaguuagccuuuaucu

SEQ ID NO: 3569862 - RNA, 23 nt, Human
auaggaaguuagccuuuaucuac

SEQ ID NO: 3569863 - RNA, 21 nt, Human
auaggaaucauucagaaaugu

SEQ ID NO: 3569864 - RNA, 13 nt, Human
auaggaauucauc

SEQ ID NO: 3569865 - RNA, 22 nt, Human
auaggaauugacccacaagaaa

SEQ ID NO: 3569866 - RNA, 20 nt, Human
auaggaccuuuccaccacag

SEQ ID NO: 3569867 - RNA, 23 nt, Human
auaggaccuuuccaccacagcca

SEQ ID NO: 3569868 - RNA, 22 nt, Human
auaggacucaaaguuucagaga

SEQ ID NO: 3569869 - RNA, 14 nt, Human
auaggagaggauga

SEQ ID NO: 3569870 - RNA, 23 nt, Human
auaggagaggaugagagcccaga

SEQ ID NO: 3569871 - RNA, 15 nt, Human
auaggagccugcugg

SEQ ID NO: 3569872 - RNA, 21 nt, Human
auaggaguggugauuugaaaa

SEQ ID NO: 3569873 - RNA, 16 nt, Human
auaggauuuauuuaaa

SEQ ID NO: 3569874 - RNA, 19 nt, Human
auaggcaccuuuuacugug

SEQ ID NO: 3569875 - RNA, 17 nt, Human
auaggcacuuuaaaaca

SEQ ID NO: 3569876 - RNA, 12 nt, Human
auaggccagccg

SEQ ID NO: 3569877 - RNA, 14 nt, Human
auaggcccacacac

SEQ ID NO: 3569878 - RNA, 22 nt, Human
auaggccugcuuugucuccucu

SEQ ID NO: 3569879 - RNA, 15 nt, Human
auaggccuucuugug

SEQ ID NO: 3569880 - RNA, 21 nt, Human
auaggcgaucacaacgugcau

SEQ ID NO: 3569881 - RNA, 19 nt, Human
auaggcggggcuugccuuc

SEQ ID NO: 3569882 - RNA, 20 nt, Human
auaggcuauuuucuaaagac

SEQ ID NO: 3569883 - RNA, 19 nt, Human
auaggcucugcacagaugg

SEQ ID NO: 3569884 - RNA, 14 nt, Human
auaggcuggagaag

SEQ ID NO: 3569885 - RNA, 22 nt, Human
auagggaaaauucuaacccagg

SEQ ID NO: 3569886 - RNA, 21 nt, Human
auagggcaauuaauuccuuca

SEQ ID NO: 3569887 - RNA, 22 nt, Human
auagggccuggucccugggagg

SEQ ID NO: 3569888 - RNA, 17 nt, Human
auagggcugagcucucu

SEQ ID NO: 3569889 - RNA, 21 nt, Human
auagggcugggcaaggaaaaa

SEQ ID NO: 3569890 - RNA, 21 nt, Human
auagggucucuucagguucuu

SEQ ID NO: 3569891 - RNA, 23 nt, Human
auagguaaucaaugaauauugaa

SEQ ID NO: 3569892 - RNA, 20 nt, Human
auagguagaauguaaagcuu

SEQ ID NO: 3569893 - RNA, 20 nt, Human
auaggucacuggcucuccaa

SEQ ID NO: 3569894 - RNA, 16 nt, Human
auagguccuuuagaaa

SEQ ID NO: 3569895 - RNA, 14 nt, Human
auaggucucuucuc

SEQ ID NO: 3569896 - RNA, 20 nt, Human
auaggucucuucucccagaa

SEQ ID NO: 3569897 - RNA, 14 nt, Human
auaggucugaaauu

SEQ ID NO: 3569898 - RNA, 22 nt, Human
auagguguccagcauugcugga

SEQ ID NO: 3569899 - RNA, 17 nt, Human
auagguuagauauagag

SEQ ID NO: 3569900 - RNA, 22 nt, Human
auagguucuucuuguucugaga

SEQ ID NO: 3569901 - RNA, 13 nt, Human
auagguugagcaa

SEQ ID NO: 3569902 - RNA, 22 nt, Human
auagguugagcaauuucccccu

SEQ ID NO: 3569903 - RNA, 14 nt, Human
auaguaaaagaaau

SEQ ID NO: 3569904 - RNA, 16 nt, Human
auaguaaccuggguaa

SEQ ID NO: 3569905 - RNA, 16 nt, Human
auaguaacugacauga

SEQ ID NO: 3569906 - RNA, 19 nt, Human
auaguaacuucuuauggaa

SEQ ID NO: 3569907 - RNA, 14 nt, Human
auaguaauucucag

SEQ ID NO: 3569908 - RNA, 20 nt, Human
auaguacaugauaaaugaua

SEQ ID NO: 3569909 - RNA, 14 nt, Human
auaguaccauuuau

SEQ ID NO: 3569910 - RNA, 15 nt, Human
auaguacuaagcauu

SEQ ID NO: 3569911 - RNA, 16 nt, Human
auaguacuaagcauuu

SEQ ID NO: 3569912 - RNA, 23 nt, Human
auaguagaacgcuaucugggaag

SEQ ID NO: 3569913 - RNA, 21 nt, Human
auaguagagugauauggagca

SEQ ID NO: 3569914 - RNA, 13 nt, Human
auaguaguaugau

SEQ ID NO: 3569915 - RNA, 20 nt, Human
auaguauauuaaaaauggua

SEQ ID NO: 3569916 - RNA, 17 nt, Human
auaguauccuccagguu

SEQ ID NO: 3569917 - RNA, 15 nt, Human
auaguaugguggcug

SEQ ID NO: 3569918 - RNA, 21 nt, Human
auaguauuugagaguucuaaa

SEQ ID NO: 3569919 - RNA, 22 nt, Human
auaguauuugauucaaaauauu

SEQ ID NO: 3569920 - RNA, 20 nt, Human
auagucaaagagaguuuuua

SEQ ID NO: 3569921 - RNA, 17 nt, Human
auagucaaauuguguga

SEQ ID NO: 3569922 - RNA, 22 nt, Human
auagucaagaaaaauuauugua

SEQ ID NO: 3569923 - RNA, 19 nt, Human
auagucaauguuucuuuua

SEQ ID NO: 3569924 - RNA, 14 nt, Human
auagucacaagagc

SEQ ID NO: 3569925 - RNA, 15 nt, Human
auagucaccuuuuaa

SEQ ID NO: 3569926 - RNA, 22 nt, Human
auagucauguaagcugaaaaua

SEQ ID NO: 3569927 - RNA, 18 nt, Human
auagucuaagacuauaua

SEQ ID NO: 3569928 - RNA, 21 nt, Human
auagucuaagacuauauauau

SEQ ID NO: 3569929 - RNA, 23 nt, Human
auagucuaagacuauauauauaa

SEQ ID NO: 3569930 - RNA, 20 nt, Human
auagucuagauggcuccucu

SEQ ID NO: 3569931 - RNA, 14 nt, Human
auagucuaguguag

SEQ ID NO: 3569932 - RNA, 14 nt, Human
auagucuuuugcuu

SEQ ID NO: 3569933 - RNA, 18 nt, Human
auagucuuuuucaguucc

SEQ ID NO: 3569934 - RNA, 20 nt, Human
auagugaucaagaagacuuu

SEQ ID NO: 3569935 - RNA, 20 nt, Human
auagugauguaaucuugaau

SEQ ID NO: 3569936 - RNA, 15 nt, Human
auagugcaacuauga

SEQ ID NO: 3569937 - RNA, 15 nt, Human
auagugcaauauauu

SEQ ID NO: 3569938 - RNA, 21 nt, Human
auagugcuaacaugaagaccu

SEQ ID NO: 3569939 - RNA, 17 nt, Human
auaguggcuuaaaacaa

SEQ ID NO: 3569940 - RNA, 21 nt, Human
auagugguguuuuaaagagaa

SEQ ID NO: 3569941 - RNA, 15 nt, Human
auaguguaggcuuua

SEQ ID NO: 3569942 - RNA, 20 nt, Human
auaguguccuaugcaauaaa

SEQ ID NO: 3569943 - RNA, 22 nt, Human
auagugugaaauauauuacuua

SEQ ID NO: 3569944 - RNA, 23 nt, Human
auaguguggaaauuaagaagaaa

SEQ ID NO: 3569945 - RNA, 17 nt, Human
auaguguguucugauua

SEQ ID NO: 3569946 - RNA, 19 nt, Human
auaguguguucugauuaga

SEQ ID NO: 3569947 - RNA, 23 nt, Human
auaguguguucugauuagaaaug

SEQ ID NO: 3569948 - RNA, 16 nt, Human
auaguguuaaucaauu

SEQ ID NO: 3569949 - RNA, 22 nt, Human
auaguguucugcaaaaauauuu

SEQ ID NO: 3569950 - RNA, 14 nt, Human
auaguuaacacacu

SEQ ID NO: 3569951 - RNA, 22 nt, Human
auaguuaacauaguaaguucag

SEQ ID NO: 3569952 - RNA, 18 nt, Human
auaguucagaauuuagug

SEQ ID NO: 3569953 - RNA, 20 nt, Human
auaguucccaggugauauuu

SEQ ID NO: 3569954 - RNA, 16 nt, Human
auaguuccuaagaagc

SEQ ID NO: 3569955 - RNA, 14 nt, Human
auaguucuagacau

SEQ ID NO: 3569956 - RNA, 19 nt, Human
auaguucugagcugccagu

SEQ ID NO: 3569957 - RNA, 14 nt, Human
auaguucugcaggu

SEQ ID NO: 3569958 - RNA, 21 nt, Human
auaguugaauuagugaguaua

SEQ ID NO: 3569959 - RNA, 18 nt, Human
auaguugagccagcagac

SEQ ID NO: 3569960 - RNA, 21 nt, Human
auaguugagccagcagacauu

SEQ ID NO: 3569961 - RNA, 15 nt, Human
auaguugcuuuugaa

SEQ ID NO: 3569962 - RNA, 18 nt, Human
auaguuguagacaaagua

SEQ ID NO: 3569963 - RNA, 22 nt, Human
auaguugucaguauuauucuac

SEQ ID NO: 3569964 - RNA, 19 nt, Human
auaguuuauuuuaaaacaa

SEQ ID NO: 3569965 - RNA, 19 nt, Human
auaguuucugaggcuuuau

SEQ ID NO: 3569966 - RNA, 18 nt, Human
auaguuucuuuauuuugu

SEQ ID NO: 3569967 - RNA, 18 nt, Human
auaguuuggauauguaaa

SEQ ID NO: 3569968 - RNA, 13 nt, Human
auaguuuguacau

SEQ ID NO: 3569969 - RNA, 15 nt, Human
auaguuuguacaugc

SEQ ID NO: 3569970 - RNA, 15 nt, Human
auaguuugucuauuu

SEQ ID NO: 3569971 - RNA, 16 nt, Human
auaguuugucuauuuu

SEQ ID NO: 3569972 - RNA, 17 nt, Human
auaguuugucuauuuua

SEQ ID NO: 3569973 - RNA, 12 nt, Human
auaguuuguuau

SEQ ID NO: 3569974 - RNA, 23 nt, Human
auaguuuuacuuuuaaacugugu

SEQ ID NO: 3569975 - RNA, 16 nt, Human
auaguuuuauuuauau

SEQ ID NO: 3569976 - RNA, 22 nt, Human
auaguuuugaugacuggcauuu

SEQ ID NO: 3569977 - RNA, 18 nt, Human
auaguuuuuaagguuauu

SEQ ID NO: 3569978 - RNA, 14 nt, Human
auauaaaaaacuuu

SEQ ID NO: 3569979 - RNA, 20 nt, Human
auauaaaaagaaaagauaaa

SEQ ID NO: 3569980 - RNA, 15 nt, Human
auauaaaaauggcuu

SEQ ID NO: 3569981 - RNA, 17 nt, Human
auauaaaacuguacuuc

SEQ ID NO: 3569982 - RNA, 14 nt, Human
auauaaaauaaugc

SEQ ID NO: 3569983 - RNA, 21 nt, Human
auauaaaauaguuguccauau

SEQ ID NO: 3569984 - RNA, 14 nt, Human
auaucuccuuugua

SEQ ID NO: 3569985 - RNA, 13 nt, Human
auaucucuauuug

SEQ ID NO: 3569986 - RNA, 16 nt, Human
auaucucuauuugaga

SEQ ID NO: 3569987 - RNA, 17 nt, Human
auaucugaaaacuggaa

SEQ ID NO: 3569988 - RNA, 17 nt, Human
auaucugaaaauguaug

SEQ ID NO: 3569989 - RNA, 15 nt, Human
auaucugaaauguga

SEQ ID NO: 3569990 - RNA, 15 nt, Human
auaucugaggaauuc

SEQ ID NO: 3569991 - RNA, 16 nt, Human
auaucugaggaauucu

SEQ ID NO: 3569992 - RNA, 19 nt, Human
auaucugaggaauucugua

SEQ ID NO: 3569993 - RNA, 22 nt, Human
auaucugaggaauucuguauag

SEQ ID NO: 3569994 - RNA, 23 nt, Human
auaucugaggaauucuguauaga

SEQ ID NO: 3569995 - RNA, 14 nt, Human
auaucugauuguug

SEQ ID NO: 3569996 - RNA, 12 nt, Human
auaucugcaaaa

SEQ ID NO: 3569997 - RNA, 14 nt, Human
auaucugccuuuau

SEQ ID NO: 3569998 - RNA, 18 nt, Human
auaucugcuguccagaca

SEQ ID NO: 3569999 - RNA, 13 nt, Human
auaucugcuucag

SEQ ID NO: 3570000 - RNA, 13 nt, Human
auaucuggccucu

SEQ ID NO: 3570001 - RNA, 15 nt, Human
auaucuguauguauu

SEQ ID NO: 3570002 - RNA, 21 nt, Human
auaucuguauguauuagugau

SEQ ID NO: 3570003 - RNA, 12 nt, Human
auaucugugaaa

SEQ ID NO: 3570004 - RNA, 19 nt, Human
auaucuguuagaugcuacu

SEQ ID NO: 3570005 - RNA, 20 nt, Human
auaucuguuagaugcuacua

SEQ ID NO: 3570006 - RNA, 17 nt, Human
auaucuuaauauauuuc

SEQ ID NO: 3570007 - RNA, 16 nt, Human
auaucuucauuucuaa

SEQ ID NO: 3570008 - RNA, 19 nt, Human
auaucuucugauuuguccc

SEQ ID NO: 3570009 - RNA, 15 nt, Human
auaucuuggcaggua

SEQ ID NO: 3570010 - RNA, 13 nt, Human
auaucuuuauuaa

SEQ ID NO: 3570011 - RNA, 22 nt, Human
auaucuuugugauaauuuaaga

SEQ ID NO: 3570012 - RNA, 21 nt, Human
auaucuuuuauguuugaauau

SEQ ID NO: 3570013 - RNA, 14 nt, Human
auaucuuuuuauug

SEQ ID NO: 3570014 - RNA, 13 nt, Human
auaugaaaacuau

SEQ ID NO: 3570015 - RNA, 20 nt, Human
auaugaaagucuuauuaaaa

SEQ ID NO: 3570016 - RNA, 14 nt, Human
auaugaaauuuaau

SEQ ID NO: 3570017 - RNA, 19 nt, Human
auaugaacauacaaaugca

SEQ ID NO: 3570018 - RNA, 14 nt, Human
auaugaagacauaa

SEQ ID NO: 3570019 - RNA, 17 nt, Human
auaugaagcucaccugu

SEQ ID NO: 3570020 - RNA, 21 nt, Human
auaugaagcucaccuguugcu

SEQ ID NO: 3570021 - RNA, 23 nt, Human
auaugaaguaucuaaaaguguca

SEQ ID NO: 3570022 - RNA, 19 nt, Human
auaugaaguuacuuucuua

SEQ ID NO: 3570023 - RNA, 16 nt, Human
auaugacaaauguuuc

SEQ ID NO: 3570024 - RNA, 15 nt, Human
auaugacagcugucc

SEQ ID NO: 3570025 - RNA, 15 nt, Human
auaugacuuuuuaua

SEQ ID NO: 3570026 - RNA, 15 nt, Human
auaugaguacaaaug

SEQ ID NO: 3570027 - RNA, 13 nt, Human
auaugaguauaca

SEQ ID NO: 3570028 - RNA, 21 nt, Human
auaugaguauacaauauauaa

SEQ ID NO: 3570029 - RNA, 22 nt, Human
auaugaguauacaauauauaaa

SEQ ID NO: 3570030 - RNA, 15 nt, Human
auaugaucugucugu

SEQ ID NO: 3570031 - RNA, 13 nt, Human
auaugaucuguuu

SEQ ID NO: 3570032 - RNA, 15 nt, Human
auaugauguuaaaaa

SEQ ID NO: 3570033 - RNA, 12 nt, Human
auaugauucaaa

SEQ ID NO: 3570034 - RNA, 15 nt, Human
auaugauuggcaaua

SEQ ID NO: 3570035 - RNA, 13 nt, Human
auaugauuuaaaa

SEQ ID NO: 3570036 - RNA, 23 nt, Human
auaugauuucacuagaaaagcug

SEQ ID NO: 3570037 - RNA, 16 nt, Human
auaugauuuuauuuga

SEQ ID NO: 3570038 - RNA, 17 nt, Human
auaugauuuuuuaaaag

SEQ ID NO: 3570039 - RNA, 22 nt, Human
auaugcaaacauaacaaaauca

SEQ ID NO: 3570040 - RNA, 13 nt, Human
auaugcaaagcac

SEQ ID NO: 3570041 - RNA, 16 nt, Human
auaugcaaagcacuga

SEQ ID NO: 3570042 - RNA, 14 nt, Human
auaugcaacauugu

SEQ ID NO: 3570043 - RNA, 15 nt, Human
auaugcacaauagca

SEQ ID NO: 3570044 - RNA, 13 nt, Human
auaugcacacauu

SEQ ID NO: 3570045 - RNA, 14 nt, Human
auaugcacacauuu

SEQ ID NO: 3570046 - RNA, 19 nt, Human
auaugcaccuugugucugu

SEQ ID NO: 3570047 - RNA, 16 nt, Human
auaugcacuauguaua

SEQ ID NO: 3570048 - RNA, 20 nt, Human
auaugcaguaaaagaaagaa

SEQ ID NO: 3570049 - RNA, 16 nt, Human
auaugcaguuuuccuu

SEQ ID NO: 3570050 - RNA, 15 nt, Human
auaugcauauauaua

SEQ ID NO: 3570051 - RNA, 14 nt, Human
auaugcauauuugu

SEQ ID NO: 3570052 - RNA, 15 nt, Human
auaugcuaauuuggg

SEQ ID NO: 3570053 - RNA, 17 nt, Human
auaugcuaauuugggga

SEQ ID NO: 3570054 - RNA, 16 nt, Human
auaugcuaccaccagc

SEQ ID NO: 3570055 - RNA, 15 nt, Human
auaugcugcaacaaa

SEQ ID NO: 3570056 - RNA, 12 nt, Human
auaugcugcuca

SEQ ID NO: 3570057 - RNA, 19 nt, Human
auaugcuuauacacuuaca

SEQ ID NO: 3570058 - RNA, 23 nt, Human
auaugcuucuguuuuauaauuuu

SEQ ID NO: 3570059 - RNA, 20 nt, Human
auaugcuuuauuaauguuuu

SEQ ID NO: 3570060 - RNA, 14 nt, Human
auauggaagaaagu

SEQ ID NO: 3570061 - RNA, 16 nt, Human
auauggaagaaaguaa

SEQ ID NO: 3570062 - RNA, 22 nt, Human
auauggacaaaacaagaaagac

SEQ ID NO: 3570063 - RNA, 15 nt, Human
auauggacacuuaau

SEQ ID NO: 3570064 - RNA, 18 nt, Human
auauggacucaguuuucu

SEQ ID NO: 3570065 - RNA, 16 nt, Human
auauggacucugcaca

SEQ ID NO: 3570066 - RNA, 18 nt, Human
auauggagaauugcugaa

SEQ ID NO: 3570067 - RNA, 21 nt, Human
auauggagaauugcugaaggg

SEQ ID NO: 3570068 - RNA, 18 nt, Human
auauggauauuagucaua

SEQ ID NO: 3570069 - RNA, 12 nt, Human
auauggauguua

SEQ ID NO: 3570070 - RNA, 14 nt, Human
auauggauguuacu

SEQ ID NO: 3570071 - RNA, 22 nt, Human
auauggauguuacucucuugca

SEQ ID NO: 3570072 - RNA, 13 nt, Human
auauggcaagaaa

SEQ ID NO: 3570073 - RNA, 12 nt, Human
auauggcagaag

SEQ ID NO: 3570074 - RNA, 17 nt, Human
auauggcagaagacacc

SEQ ID NO: 3570075 - RNA, 20 nt, Human
auauggcagaguuguaaaua

SEQ ID NO: 3570076 - RNA, 22 nt, Human
auauggcagaguuguaaauaua

SEQ ID NO: 3570077 - RNA, 15 nt, Human
auauggcauuugcag

SEQ ID NO: 3570078 - RNA, 15 nt, Human
auauggccucaagau

SEQ ID NO: 3570079 - RNA, 16 nt, Human
auauggccucaagauc

SEQ ID NO: 3570080 - RNA, 23 nt, Human
auaugggaacacuggcagacugu

SEQ ID NO: 3570081 - RNA, 17 nt, Human
auaugggacauuuuuga

SEQ ID NO: 3570082 - RNA, 20 nt, Human
auauggggaugguaguuuuu

SEQ ID NO: 3570083 - RNA, 16 nt, Human
auauggguaguauuuu

SEQ ID NO: 3570084 - RNA, 23 nt, Human
auauggguuagauguugccaugu

SEQ ID NO: 3570085 - RNA, 18 nt, Human
auaugguauauauacaua

SEQ ID NO: 3570086 - RNA, 19 nt, Human
auaugguauauauacauau

SEQ ID NO: 3570087 - RNA, 13 nt, Human
auauggucuaaug

SEQ ID NO: 3570088 - RNA, 21 nt, Human
auauggugguaauaagggaaa

SEQ ID NO: 3570089 - RNA, 13 nt, Human
auauguaaaacau

SEQ ID NO: 3570090 - RNA, 14 nt, Human
auauguaaaacauu

SEQ ID NO: 3570091 - RNA, 16 nt, Human
auauguaaaacauuua

SEQ ID NO: 3570092 - RNA, 24 nt, Human
auauguaaaacauuuauuuugaca

SEQ ID NO: 3570093 - RNA, 14 nt, Human
auauguaaaauaaa

SEQ ID NO: 3570094 - RNA, 14 nt, Human
auauguaagggaaa

SEQ ID NO: 3570095 - RNA, 14 nt, Human
auauguacaguuau

SEQ ID NO: 3570096 - RNA, 13 nt, Human
auauguacauuuc

SEQ ID NO: 3570097 - RNA, 17 nt, Human
auauguacccucugaaa

SEQ ID NO: 3570098 - RNA, 19 nt, Human
auauguacccucugaaaua

SEQ ID NO: 3570099 - RNA, 20 nt, Human
auauguacccucugaaauac

SEQ ID NO: 3570100 - RNA, 21 nt, Human
auauguacccucugaaauaca

SEQ ID NO: 3570101 - RNA, 20 nt, Human
auauguacuugucaaagaag

SEQ ID NO: 3570102 - RNA, 17 nt, Human
auauguagacuauauac

SEQ ID NO: 3570103 - RNA, 23 nt, Human
auauguagacuauauacaugugu

SEQ ID NO: 3570104 - RNA, 20 nt, Human
auauguagauguaugcacac

SEQ ID NO: 3570105 - RNA, 17 nt, Human
auauguagcagaaaggc

SEQ ID NO: 3570106 - RNA, 17 nt, Human
auauguaggugucugca

SEQ ID NO: 3570107 - RNA, 18 nt, Human
auauguaguauaaagaaa

SEQ ID NO: 3570108 - RNA, 15 nt, Human
auauguaguaucuau

SEQ ID NO: 3570109 - RNA, 23 nt, Human
auauguauauuuuuuuaauuuaa

SEQ ID NO: 3570110 - RNA, 22 nt, Human
auauguauccaguacauuuaau

SEQ ID NO: 3570111 - RNA, 17 nt, Human
auauguauggguagggu

SEQ ID NO: 3570112 - RNA, 14 nt, Human
auauguaugguuuu

SEQ ID NO: 3570113 - RNA, 14 nt, Human
auauguauuaauaa

SEQ ID NO: 3570114 - RNA, 16 nt, Human
auauguauuaauauuc

SEQ ID NO: 3570115 - RNA, 18 nt, Human
auauguauuauuuauaau

SEQ ID NO: 3570116 - RNA, 21 nt, Human
auauguauucuguaaaagaaa

SEQ ID NO: 3570117 - RNA, 14 nt, Human
auauguauucuuuu

SEQ ID NO: 3570118 - RNA, 18 nt, Human
auauguauuuuauguaug

SEQ ID NO: 3570119 - RNA, 14 nt, Human
auaugucagugcug

SEQ ID NO: 3570120 - RNA, 19 nt, Human
auaugugaacauuuaucaa

SEQ ID NO: 3570121 - RNA, 18 nt, Human
auaugugaacgcccagag

SEQ ID NO: 3570122 - RNA, 22 nt, Human
auaugugaaggaccuucacucu

SEQ ID NO: 3570123 - RNA, 20 nt, Human
auaugugagugccuuuugca

SEQ ID NO: 3570124 - RNA, 21 nt, Human
auaugugaucugucuuguaau

SEQ ID NO: 3570125 - RNA, 12 nt, Human
auaugugauuuu

SEQ ID NO: 3570126 - RNA, 20 nt, Human
auauguggaguucaucuuga

SEQ ID NO: 3570127 - RNA, 16 nt, Human
auauguguauauauac

SEQ ID NO: 3570128 - RNA, 19 nt, Human
auauguguauauauacaua

SEQ ID NO: 3570129 - RNA, 22 nt, Human
auauguguauauauacauacac

SEQ ID NO: 3570130 - RNA, 14 nt, Human
agccagauuucacu

SEQ ID NO: 3570131 - RNA, 20 nt, Human
agccagauuucacucuccuu

SEQ ID NO: 3570132 - RNA, 22 nt, Human
agccagauuucacucuccuugg

SEQ ID NO: 3570133 - RNA, 18 nt, Human
agccagauuuuuuaaaau

SEQ ID NO: 3570134 - RNA, 23 nt, Human
agccagauuuuuuaaaauuuaua

SEQ ID NO: 3570135 - RNA, 16 nt, Human
agccagcaccggacca

SEQ ID NO: 3570136 - RNA, 24 nt, Human
agccagcaccggaccagccuggcc

SEQ ID NO: 3570137 - RNA, 16 nt, Human
agccagcagacauugu

SEQ ID NO: 3570138 - RNA, 17 nt, Human
agccagcagacauuguc

SEQ ID NO: 3570139 - RNA, 18 nt, Human
agccagcagcagcccaag

SEQ ID NO: 3570140 - RNA, 11 nt, Human
agccagcagcc

SEQ ID NO: 3570141 - RNA, 14 nt, Human
agccagcaguucag

SEQ ID NO: 3570142 - RNA, 19 nt, Human
agccagcaguucagagcug

SEQ ID NO: 3570143 - RNA, 23 nt, Human
agccagccaaacacacagaaggg

SEQ ID NO: 3570144 - RNA, 24 nt, Human
agccagccaagcuuuaaauuaugu

SEQ ID NO: 3570145 - RNA, 11 nt, Human
agccagccacu

SEQ ID NO: 3570146 - RNA, 16 nt, Human
agccagccccucuucc

SEQ ID NO: 3570147 - RNA, 17 nt, Human
agccagccccucuuccc

SEQ ID NO: 3570148 - RNA, 20 nt, Human
agccagcccucccuguccuc

SEQ ID NO: 3570149 - RNA, 13 nt, Human
agccagcccugcc

SEQ ID NO: 3570150 - RNA, 14 nt, Human
agccagcccugccu

SEQ ID NO: 3570151 - RNA, 15 nt, Human
agccagcccugccug

SEQ ID NO: 3570152 - RNA, 16 nt, Human
agccagcccugccugg

SEQ ID NO: 3570153 - RNA, 23 nt, Human
agccagcccugccuggaggaccu

SEQ ID NO: 3570154 - RNA, 16 nt, Human
agccagccggggcgag

SEQ ID NO: 3570155 - RNA, 10 nt, Human
agccagccuc

SEQ ID NO: 3570156 - RNA, 11 nt, Human
agccagccuga

SEQ ID NO: 3570157 - RNA, 15 nt, Human
agccagccuggcugg

SEQ ID NO: 3570158 - RNA, 12 nt, Human
agccagccuggu

SEQ ID NO: 3570159 - RNA, 13 nt, Human
agccagccugguc

SEQ ID NO: 3570160 - RNA, 14 nt, Human
agccagcgccuccc

SEQ ID NO: 3570161 - RNA, 17 nt, Human
agccagcgccucccucc

SEQ ID NO: 3570162 - RNA, 18 nt, Human
agccagcgccucccucca

SEQ ID NO: 3570163 - RNA, 19 nt, Human
agccagcgccucccuccac

SEQ ID NO: 3570164 - RNA, 15 nt, Human
agccagcucauuuca

SEQ ID NO: 3570165 - RNA, 15 nt, Human
agccagcucccucua

SEQ ID NO: 3570166 - RNA, 13 nt, Human
agccagcucucag

SEQ ID NO: 3570167 - RNA, 16 nt, Human
agccagcucucagcca

SEQ ID NO: 3570168 - RNA, 19 nt, Human
agccagcugcagcugggcu

SEQ ID NO: 3570169 - RNA, 14 nt, Human
agccagcugccccc

SEQ ID NO: 3570170 - RNA, 14 nt, Human
agccagcugcccua

SEQ ID NO: 3570171 - RNA, 12 nt, Human
agccagcugccu

SEQ ID NO: 3570172 - RNA, 16 nt, Human
agccagcugcucccca

SEQ ID NO: 3570173 - RNA, 18 nt, Human
agccagcuuucccugccu

SEQ ID NO: 3570174 - RNA, 16 nt, Human
agcccagcugggucag

SEQ ID NO: 3570175 - RNA, 17 nt, Human
agcccagcugggucagg

SEQ ID NO: 3570176 - RNA, 19 nt, Human
agcccagcugggucaggca

SEQ ID NO: 3570177 - RNA, 24 nt, Human
agcccaggaauuugaagcugcagu

SEQ ID NO: 3570178 - RNA, 12 nt, Human
agcccaggagcc

SEQ ID NO: 3570179 - RNA, 15 nt, Human
agcccaggagcccau

SEQ ID NO: 3570180 - RNA, 15 nt, Human
agcccaggagccuca

SEQ ID NO: 3570181 - RNA, 14 nt, Human
agcccaggagcucc

SEQ ID NO: 3570182 - RNA, 22 nt, Human
agcccaggagucccacuccaag

SEQ ID NO: 3570183 - RNA, 19 nt, Human
agcccaggaguuugaggcu

SEQ ID NO: 3570184 - RNA, 15 nt, Human
agcccaggccaggac

SEQ ID NO: 3570185 - RNA, 22 nt, Human
agcccaggccgggguggagcau

SEQ ID NO: 3570186 - RNA, 18 nt, Human
agcccaggccuccagcuc

SEQ ID NO: 3570187 - RNA, 19 nt, Human
agcccaggccuccagcuca

SEQ ID NO: 3570188 - RNA, 22 nt, Human
agcccaggccuccagcucagca

SEQ ID NO: 3570189 - RNA, 14 nt, Human
agcccaggccuccu

SEQ ID NO: 3570190 - RNA, 19 nt, Human
agcccaggccuccuacagc

SEQ ID NO: 3570191 - RNA, 20 nt, Human
agcccaggcuggagugcaau

SEQ ID NO: 3570192 - RNA, 20 nt, Human
agcccagggagcggaaagca

SEQ ID NO: 3570193 - RNA, 21 nt, Human
agcccagggagcggaaagcag

SEQ ID NO: 3570194 - RNA, 23 nt, Human
agcccagggagcggaaagcagcu

SEQ ID NO: 3570195 - RNA, 19 nt, Human
agcccagggcaucuugcug

SEQ ID NO: 3570196 - RNA, 22 nt, Human
agcccagggcaucuugcuggcu

SEQ ID NO: 3570197 - RNA, 23 nt, Human
agcccagggcuccugcacuuacu

SEQ ID NO: 3570198 - RNA, 23 nt, Human
agcccaggguucccccagcccug

SEQ ID NO: 3570199 - RNA, 18 nt, Human
agcccagugcacugaaag

SEQ ID NO: 3570200 - RNA, 20 nt, Human
agcccauccauuaggccagc

SEQ ID NO: 3570201 - RNA, 23 nt, Human
agcccauccauuaggccagcaac

SEQ ID NO: 3570202 - RNA, 13 nt, Human
agcccaucccugc

SEQ ID NO: 3570203 - RNA, 18 nt, Human
agcccauccuucccuuug

SEQ ID NO: 3570204 - RNA, 18 nt, Human
agcccaucgccacaaacu

SEQ ID NO: 3570205 - RNA, 15 nt, Human
agcccaucucggagc

SEQ ID NO: 3570206 - RNA, 17 nt, Human
agcccaucuugccucca

SEQ ID NO: 3570207 - RNA, 19 nt, Human
agcccaucuugccuccaug

SEQ ID NO: 3570208 - RNA, 19 nt, Human
agcccauggcccucccagu

SEQ ID NO: 3570209 - RNA, 19 nt, Human
agcccauguggcuaaaaaa

SEQ ID NO: 3570210 - RNA, 20 nt, Human
agcccauguucugcccccag

SEQ ID NO: 3570211 - RNA, 23 nt, Human
agcccauucauuccauucuggaa

SEQ ID NO: 3570212 - RNA, 15 nt, Human
agcccauucucucuc

SEQ ID NO: 3570213 - RNA, 21 nt, Human
agcccauucucucuccugucc

SEQ ID NO: 3570214 - RNA, 22 nt, Human
agcccauucucucuccugucca

SEQ ID NO: 3570215 - RNA, 16 nt, Human
agcccauuucuccaga

SEQ ID NO: 3570216 - RNA, 17 nt, Human
agcccauuucuccagaa

SEQ ID NO: 3570217 - RNA, 21 nt, Human
agcccauuucuccagaaccca

SEQ ID NO: 3570218 - RNA, 17 nt, Human
agccccaaaacucuccu

SEQ ID NO: 3570219 - RNA, 20 nt, Human
agccccaaaacucuccucug

SEQ ID NO: 3570220 - RNA, 17 nt, Human
agccccaagaaggcugg

SEQ ID NO: 3570221 - RNA, 22 nt, Human
agccccacaccagggccagccu

SEQ ID NO: 3570222 - RNA, 15 nt, Human
agccccacacggagg

SEQ ID NO: 3570223 - RNA, 17 nt, Human
agccccacauguccagc

SEQ ID NO: 3570224 - RNA, 12 nt, Human
agccccacccag

SEQ ID NO: 3570225 - RNA, 16 nt, Human
agccccacccaggagg

SEQ ID NO: 3570226 - RNA, 14 nt, Human
agccccacccaggc

SEQ ID NO: 3570227 - RNA, 14 nt, Human
agccccaccccagg

SEQ ID NO: 3570228 - RNA, 16 nt, Human
agccccacccuggccu

SEQ ID NO: 3570229 - RNA, 13 nt, Human
agccccacuccuc

SEQ ID NO: 3570230 - RNA, 18 nt, Human
agccccacugccagcagc

SEQ ID NO: 3570231 - RNA, 15 nt, Human
agccccacugcccuu

SEQ ID NO: 3570232 - RNA, 14 nt, Human
agccccagcccagc

SEQ ID NO: 3570233 - RNA, 12 nt, Human
agccccagcccc

SEQ ID NO: 3570234 - RNA, 12 nt, Human
agccccagccug

SEQ ID NO: 3570235 - RNA, 13 nt, Human
agccccagccugc

SEQ ID NO: 3570236 - RNA, 18 nt, Human
agccccaggccucugugu

SEQ ID NO: 3570237 - RNA, 18 nt, Human
agccccagggucuucccu

SEQ ID NO: 3570238 - RNA, 20 nt, Human
agccccagggucuucccuac

SEQ ID NO: 3570239 - RNA, 22 nt, Human
agccccagggucuucccuaccu

SEQ ID NO: 3570240 - RNA, 13 nt, Human
agccccagugcca

SEQ ID NO: 3570241 - RNA, 20 nt, Human
agccccagugccaagcacag

SEQ ID NO: 3570242 - RNA, 14 nt, Human
agccccagugccca

SEQ ID NO: 3570243 - RNA, 15 nt, Human
agccccagugcccac

SEQ ID NO: 3570244 - RNA, 11 nt, Human
agccccauccu

SEQ ID NO: 3570245 - RNA, 12 nt, Human
agccccaucugu

SEQ ID NO: 3570246 - RNA, 15 nt, Human
agccccaucugugca

SEQ ID NO: 3570247 - RNA, 14 nt, Human
agccccaugcugga

SEQ ID NO: 3570248 - RNA, 13 nt, Human
agccccauuccug

SEQ ID NO: 3570249 - RNA, 16 nt, Human
agccccauucugccug

SEQ ID NO: 3570250 - RNA, 17 nt, Human
agccccauucugccugc

SEQ ID NO: 3570251 - RNA, 20 nt, Human
agccccauucugccugccca

SEQ ID NO: 3570252 - RNA, 22 nt, Human
agccccauucugccugcccagg

SEQ ID NO: 3570253 - RNA, 16 nt, Human
agcccccacagugcug

SEQ ID NO: 3570254 - RNA, 19 nt, Human
agcccccacagugcugucu

SEQ ID NO: 3570255 - RNA, 13 nt, Human
agcccccacccug

SEQ ID NO: 3570256 - RNA, 18 nt, Human
agcccccacccuguuccu

SEQ ID NO: 3570257 - RNA, 19 nt, Human
agcccccacccuguuccug

SEQ ID NO: 3570258 - RNA, 12 nt, Human
agcccccagagc

SEQ ID NO: 3570259 - RNA, 18 nt, Human
agcccccagagcccaggc

SEQ ID NO: 3570260 - RNA, 16 nt, Human
agcccccagcuuccag

SEQ ID NO: 3570261 - RNA, 21 nt, Human
agcccccaggaagcccaggag

SEQ ID NO: 3570262 - RNA, 13 nt, Human
agcccccccuucc

SEQ ID NO: 3570263 - RNA, 20 nt, Human
agcccccuccuggugccacc

SEQ ID NO: 3570264 - RNA, 16 nt, Human
agcccccuccuugucu

SEQ ID NO: 3570265 - RNA, 21 nt, Human
agcccccugaccacucagaga

SEQ ID NO: 3570266 - RNA, 14 nt, Human
agcccccugcuuca

SEQ ID NO: 3570267 - RNA, 15 nt, Human
agcccccuggccucu

SEQ ID NO: 3570268 - RNA, 22 nt, Human
agcccccuggucuuugagcucc

SEQ ID NO: 3570269 - RNA, 18 nt, Human
agcccccuuugggcccag

SEQ ID NO: 3570270 - RNA, 19 nt, Human
agcccccuuugggcccagg

SEQ ID NO: 3570271 - RNA, 17 nt, Human
agccccgacuccagcca

SEQ ID NO: 3570272 - RNA, 20 nt, Human
agccccgacuccagccagcg

SEQ ID NO: 3570273 - RNA, 21 nt, Human
agccccgacuccagccagcgc

SEQ ID NO: 3570274 - RNA, 14 nt, Human
agccccgcagaccu

SEQ ID NO: 3570275 - RNA, 16 nt, Human
agccccgcagaccucc

SEQ ID NO: 3570276 - RNA, 19 nt, Human
agccccgcagaccucccca

SEQ ID NO: 3570277 - RNA, 20 nt, Human
agccccgcccucuuccugac

SEQ ID NO: 3570278 - RNA, 22 nt, Human
agccccgcccucuuccugacga

SEQ ID NO: 3570279 - RNA, 15 nt, Human
agccccgcgccuccu

SEQ ID NO: 3570280 - RNA, 17 nt, Human
agccccgguggcugggc

SEQ ID NO: 3570281 - RNA, 22 nt, Human
agccccuaagucaacuuagcau

SEQ ID NO: 3570282 - RNA, 17 nt, Human
agccccuacugcuguga

SEQ ID NO: 3570283 - RNA, 14 nt, Human
agccccuagcccag

SEQ ID NO: 3570284 - RNA, 15 nt, Human
agccccuagcccagg

SEQ ID NO: 3570285 - RNA, 19 nt, Human
agccccuagcccaggagag

SEQ ID NO: 3570286 - RNA, 23 nt, Human
agccccuagcccaggagagagaa

SEQ ID NO: 3570287 - RNA, 13 nt, Human
agccccucccacc

SEQ ID NO: 3570288 - RNA, 14 nt, Human
agccccucccacca

SEQ ID NO: 3570289 - RNA, 17 nt, Human
agccucuguuuugauau

SEQ ID NO: 3570290 - RNA, 20 nt, Human
agccucuucugccaagagag

SEQ ID NO: 3570291 - RNA, 21 nt, Human
agccucuuucccuuccaguuu

SEQ ID NO: 3570292 - RNA, 22 nt, Human
agccugaaauagugguucuugg

SEQ ID NO: 3570293 - RNA, 18 nt, Human
agccugaaccccagggcu

SEQ ID NO: 3570294 - RNA, 17 nt, Human
agccugacaacauuucu

SEQ ID NO: 3570295 - RNA, 18 nt, Human
agccugacagccagaacu

SEQ ID NO: 3570296 - RNA, 18 nt, Human
agccugacccucaucuuu

SEQ ID NO: 3570297 - RNA, 16 nt, Human
agccugaccuuccuuc

SEQ ID NO: 3570298 - RNA, 21 nt, Human
agccugaccuuccuuccuguu

SEQ ID NO: 3570299 - RNA, 18 nt, Human
agccugagcgacagugag

SEQ ID NO: 3570300 - RNA, 11 nt, Human
agccugaggcu

SEQ ID NO: 3570301 - RNA, 19 nt, Human
agccugagggaaaggccag

SEQ ID NO: 3570302 - RNA, 20 nt, Human
agccugagggaaaggccagc

SEQ ID NO: 3570303 - RNA, 17 nt, Human
agccugagucagggccc

SEQ ID NO: 3570304 - RNA, 15 nt, Human
agccugagucuccug

SEQ ID NO: 3570305 - RNA, 16 nt, Human
agccugagucuccugu

SEQ ID NO: 3570306 - RNA, 17 nt, Human
agccugagucuccugug

SEQ ID NO: 3570307 - RNA, 18 nt, Human
agccugaucaccugcccu

SEQ ID NO: 3570308 - RNA, 19 nt, Human
agccugaucaccugcccug

SEQ ID NO: 3570309 - RNA, 18 nt, Human
agccugaucucuuccugu

SEQ ID NO: 3570310 - RNA, 19 nt, Human
agccugaugagauuuuuaa

SEQ ID NO: 3570311 - RNA, 14 nt, Human
agccugauuaaaga

SEQ ID NO: 3570312 - RNA, 16 nt, Human
agccugcacggugaau

SEQ ID NO: 3570313 - RNA, 17 nt, Human
agccugcacuuugaugu

SEQ ID NO: 3570314 - RNA, 23 nt, Human
agccugcacuuugaugucaugug

SEQ ID NO: 3570315 - RNA, 14 nt, Human
agccugcagcagga

SEQ ID NO: 3570316 - RNA, 19 nt, Human
agccugcagggaagcccca

SEQ ID NO: 3570317 - RNA, 19 nt, Human
agccugcaggguggugcug

SEQ ID NO: 3570318 - RNA, 22 nt, Human
agccugcaggguggugcuggga

SEQ ID NO: 3570319 - RNA, 23 nt, Human
agccugcaggguggugcugggac

SEQ ID NO: 3570320 - RNA, 15 nt, Human
agccugcaggugcug

SEQ ID NO: 3570321 - RNA, 23 nt, Human
agccugcaguuauuaacacuaac

SEQ ID NO: 3570322 - RNA, 21 nt, Human
agccugcaucccaggaugcug

SEQ ID NO: 3570323 - RNA, 15 nt, Human
agccugcauugagcu

SEQ ID NO: 3570324 - RNA, 22 nt, Human
agccugcauugagcuugcaugc

SEQ ID NO: 3570325 - RNA, 19 nt, Human
agccugccccagcgcugac

SEQ ID NO: 3570326 - RNA, 12 nt, Human
agccugcccucc

SEQ ID NO: 3570327 - RNA, 23 nt, Human
agccugcccuugucugagaugcu

SEQ ID NO: 3570328 - RNA, 14 nt, Human
agccugccuggagc

SEQ ID NO: 3570329 - RNA, 21 nt, Human
agccugcgccaccgcccagag

SEQ ID NO: 3570330 - RNA, 17 nt, Human
agccugcgccugcugca

SEQ ID NO: 3570331 - RNA, 18 nt, Human
agccugcguggcugaccc

SEQ ID NO: 3570332 - RNA, 21 nt, Human
agccugcguugguccagagcg

SEQ ID NO: 3570333 - RNA, 13 nt, Human
agccugcuagcua

SEQ ID NO: 3570334 - RNA, 18 nt, Human
agccugcuagcuagcuca

SEQ ID NO: 3570335 - RNA, 14 nt, Human
agccugcuccagcu

SEQ ID NO: 3570336 - RNA, 11 nt, Human
agccugcuccc

SEQ ID NO: 3570337 - RNA, 14 nt, Human
agccugcuccccca

SEQ ID NO: 3570338 - RNA, 21 nt, Human
agccugcucccccacccccuc

SEQ ID NO: 3570339 - RNA, 23 nt, Human
agccugcucccccacccccuccc

SEQ ID NO: 3570340 - RNA, 13 nt, Human
agccugcugccca

SEQ ID NO: 3570341 - RNA, 12 nt, Human
agccugcuggaa

SEQ ID NO: 3570342 - RNA, 23 nt, Human
agccugcuggucacagccuccuc

SEQ ID NO: 3570343 - RNA, 19 nt, Human
agccugcuucccaccuccc

SEQ ID NO: 3570344 - RNA, 16 nt, Human
agccuggacccccagc

SEQ ID NO: 3570345 - RNA, 17 nt, Human
agccuggacccccagcu

SEQ ID NO: 3570346 - RNA, 22 nt, Human
agccuggaccucugacagcagc

SEQ ID NO: 3570347 - RNA, 11 nt, Human
agccuggagaa

SEQ ID NO: 3570348 - RNA, 14 nt, Human
agccuggagaagcu

SEQ ID NO: 3570349 - RNA, 18 nt, Human
agccuggagcccuggaga

SEQ ID NO: 3570350 - RNA, 23 nt, Human
agccuggaggccgggugcucagg

SEQ ID NO: 3570351 - RNA, 11 nt, Human
agccuggaugc

SEQ ID NO: 3570352 - RNA, 17 nt, Human
agccuggcacagggcag

SEQ ID NO: 3570353 - RNA, 18 nt, Human
agccuggcacagggcagu

SEQ ID NO: 3570354 - RNA, 20 nt, Human
agccuggccaacauggcgaa

SEQ ID NO: 3570355 - RNA, 14 nt, Human
agccuggccagaca

SEQ ID NO: 3570356 - RNA, 15 nt, Human
agccuggccagacac

SEQ ID NO: 3570357 - RNA, 17 nt, Human
agccuggccccaugguc

SEQ ID NO: 3570358 - RNA, 11 nt, Human
agccuggcucc

SEQ ID NO: 3570359 - RNA, 22 nt, Human
agccuggcucccacaggcagcu

SEQ ID NO: 3570360 - RNA, 23 nt, Human
agccuggcucccacaggcagcuu

SEQ ID NO: 3570361 - RNA, 19 nt, Human
agccuggcucccaggacac

SEQ ID NO: 3570362 - RNA, 12 nt, Human
agccuggcucuu

SEQ ID NO: 3570363 - RNA, 17 nt, Human
agccuggcugcccauca

SEQ ID NO: 3570364 - RNA, 18 nt, Human
agccuggcuucaaauugu

SEQ ID NO: 3570365 - RNA, 19 nt, Human
agccuggcuucuggagccc

SEQ ID NO: 3570366 - RNA, 23 nt, Human
agccuggcuucuggagcccuugg

SEQ ID NO: 3570367 - RNA, 19 nt, Human
agccugggaaagccccugc

SEQ ID NO: 3570368 - RNA, 15 nt, Human
agccugggaaauaag

SEQ ID NO: 3570369 - RNA, 21 nt, Human
agccugggaaauaagcccccu

SEQ ID NO: 3570370 - RNA, 22 nt, Human
agccugggaggcacagcaaacu

SEQ ID NO: 3570371 - RNA, 12 nt, Human
agccugggaggu

SEQ ID NO: 3570372 - RNA, 17 nt, Human
agccugggcaacagagc

SEQ ID NO: 3570373 - RNA, 18 nt, Human
agccugggcaaugugaua

SEQ ID NO: 3570374 - RNA, 17 nt, Human
agccugggcagccaggc

SEQ ID NO: 3570375 - RNA, 11 nt, Human
agccugggccc

SEQ ID NO: 3570376 - RNA, 19 nt, Human
agccugggccuauggagag

SEQ ID NO: 3570377 - RNA, 24 nt, Human
agccugggccuauggagagcccug

SEQ ID NO: 3570378 - RNA, 15 nt, Human
agccuggggccuggc

SEQ ID NO: 3570379 - RNA, 19 nt, Human
agccuggggccuggcaggg

SEQ ID NO: 3570380 - RNA, 13 nt, Human
agccuggggcucu

SEQ ID NO: 3570381 - RNA, 22 nt, Human
agccuggggcucuaacgccuga

SEQ ID NO: 3570382 - RNA, 23 nt, Human
agccuggggcucuaacgccugag

SEQ ID NO: 3570383 - RNA, 20 nt, Human
agccugggggccuggcuggc

SEQ ID NO: 3570384 - RNA, 22 nt, Human
agccugggggccuggcuggcug

SEQ ID NO: 3570385 - RNA, 22 nt, Human
agccuggguguaaaaccuggag

SEQ ID NO: 3570386 - RNA, 16 nt, Human
agccuggucagcccaa

SEQ ID NO: 3570387 - RNA, 14 nt, Human
agccuggugggccu

SEQ ID NO: 3570388 - RNA, 16 nt, Human
agccuggugggccucc

SEQ ID NO: 3570389 - RNA, 22 nt, Human
agccuggugggccuccucuguc

SEQ ID NO: 3570390 - RNA, 18 nt, Human
agccugguuuagccugga

SEQ ID NO: 3570391 - RNA, 15 nt, Human
agccuguaaucccag

SEQ ID NO: 3570392 - RNA, 16 nt, Human
agccuguaucuugggg

SEQ ID NO: 3570393 - RNA, 21 nt, Human
agccugucauccuuggucuuu

SEQ ID NO: 3570394 - RNA, 14 nt, Human
agccuguccugccu

SEQ ID NO: 3570395 - RNA, 16 nt, Human
agccuguccugccugu

SEQ ID NO: 3570396 - RNA, 17 nt, Human
agccuguccugccugug

SEQ ID NO: 3570397 - RNA, 24 nt, Human
agccuguccugccuguggccauga

SEQ ID NO: 3570398 - RNA, 14 nt, Human
agccuguccugggc

SEQ ID NO: 3570399 - RNA, 17 nt, Human
agccuguccugggcugg

SEQ ID NO: 3570400 - RNA, 13 nt, Human
agccuguccuguc

SEQ ID NO: 3570401 - RNA, 18 nt, Human
agccuguccugucaucau

SEQ ID NO: 3570402 - RNA, 20 nt, Human
agccugugaacccaggacaa

SEQ ID NO: 3570403 - RNA, 20 nt, Human
agccugugcaaaaaaauuaa

SEQ ID NO: 3570404 - RNA, 18 nt, Human
agccugugccucugggac

SEQ ID NO: 3570405 - RNA, 19 nt, Human
agccugugccucugggacu

SEQ ID NO: 3570406 - RNA, 16 nt, Human
agccuguggaugauca

SEQ ID NO: 3570407 - RNA, 14 nt, Human
agccuguggcaucu

SEQ ID NO: 3570408 - RNA, 21 nt, Human
agccuguggcaucuuugccuu

SEQ ID NO: 3570409 - RNA, 13 nt, Human
agccuguggccuu

SEQ ID NO: 3570410 - RNA, 16 nt, Human
agccuguggcugugga

SEQ ID NO: 3570411 - RNA, 16 nt, Human
agccuguguaacagcu

SEQ ID NO: 3570412 - RNA, 17 nt, Human
agccuguguaacagcuc

SEQ ID NO: 3570413 - RNA, 16 nt, Human
agacguaugcuuauuu

SEQ ID NO: 3570414 - RNA, 18 nt, Human
agacguaugcuuauuuua

SEQ ID NO: 3570415 - RNA, 19 nt, Human
agacguaugcuuauuuuaa

SEQ ID NO: 3570416 - RNA, 14 nt, Human
agacgucccuccac

SEQ ID NO: 3570417 - RNA, 20 nt, Human
agacguggaaccucugucuc

SEQ ID NO: 3570418 - RNA, 21 nt, Human
agacguuuauaaacagaaaug

SEQ ID NO: 3570419 - RNA, 22 nt, Human
agacuaagaucgguuaacaaau

SEQ ID NO: 3570420 - RNA, 23 nt, Human
agacuaagcccugucgagacacu

SEQ ID NO: 3570421 - RNA, 19 nt, Human
agacuagaauucuagugcu

SEQ ID NO: 3570422 - RNA, 20 nt, Human
agacuagaauucuagugcug

SEQ ID NO: 3570423 - RNA, 12 nt, Human
agacuagagaaa

SEQ ID NO: 3570424 - RNA, 15 nt, Human
agacuagagaaaccg

SEQ ID NO: 3570425 - RNA, 16 nt, Human
agacuagauggaccug

SEQ ID NO: 3570426 - RNA, 12 nt, Human
agacuagaugua

SEQ ID NO: 3570427 - RNA, 19 nt, Human
agacuagauguaguauuuu

SEQ ID NO: 3570428 - RNA, 23 nt, Human
agacuagauguaguauuuuuugu

SEQ ID NO: 3570429 - RNA, 22 nt, Human
agacuaguuuuuauuccuugug

SEQ ID NO: 3570430 - RNA, 15 nt, Human
agacuauauacaugu

SEQ ID NO: 3570431 - RNA, 17 nt, Human
agacuauauacaugugu

SEQ ID NO: 3570432 - RNA, 15 nt, Human
agacuaucuaaaugu

SEQ ID NO: 3570433 - RNA, 20 nt, Human
agacuauggagccuggcaca

SEQ ID NO: 3570434 - RNA, 16 nt, Human
agacuauucaaacagu

SEQ ID NO: 3570435 - RNA, 16 nt, Human
agacuauugacaucag

SEQ ID NO: 3570436 - RNA, 20 nt, Human
agacuauugacaucagcauc

SEQ ID NO: 3570437 - RNA, 19 nt, Human
agacuauuuaaacuuauaa

SEQ ID NO: 3570438 - RNA, 14 nt, Human
agacuauuugcuua

SEQ ID NO: 3570439 - RNA, 16 nt, Human
agacucaaauguucua

SEQ ID NO: 3570440 - RNA, 21 nt, Human
agacucaagguucccagagau

SEQ ID NO: 3570441 - RNA, 16 nt, Human
agacucacaggaagga

SEQ ID NO: 3570442 - RNA, 22 nt, Human
agacucacaggaaggaggagcc

SEQ ID NO: 3570443 - RNA, 18 nt, Human
agacucaccucugccuca

SEQ ID NO: 3570444 - RNA, 19 nt, Human
agacucaccucugccucaa

SEQ ID NO: 3570445 - RNA, 17 nt, Human
agacucagagcucucuc

SEQ ID NO: 3570446 - RNA, 13 nt, Human
agacucagccugc

SEQ ID NO: 3570447 - RNA, 17 nt, Human
agacucagccugcaguu

SEQ ID NO: 3570448 - RNA, 13 nt, Human
agacucagcucug

SEQ ID NO: 3570449 - RNA, 23 nt, Human
agacucaggccaagaaacgucuu

SEQ ID NO: 3570450 - RNA, 16 nt, Human
agacucagggccccag

SEQ ID NO: 3570451 - RNA, 20 nt, Human
agacucagggccccagcacu

SEQ ID NO: 3570452 - RNA, 21 nt, Human
agacucaguuugucagacuuu

SEQ ID NO: 3570453 - RNA, 18 nt, Human
agacucauacagaaggug

SEQ ID NO: 3570454 - RNA, 19 nt, Human
agacucauccugaacagca

SEQ ID NO: 3570455 - RNA, 21 nt, Human
agacucauccugaacagcaug

SEQ ID NO: 3570456 - RNA, 16 nt, Human
agacucaucuuacugu

SEQ ID NO: 3570457 - RNA, 17 nt, Human
agacucaucuuacugua

SEQ ID NO: 3570458 - RNA, 13 nt, Human
agacuccaaagaa

SEQ ID NO: 3570459 - RNA, 19 nt, Human
agacuccaaagaaauguaa

SEQ ID NO: 3570460 - RNA, 12 nt, Human
agacuccaccaa

SEQ ID NO: 3570461 - RNA, 16 nt, Human
agacuccaccaagccu

SEQ ID NO: 3570462 - RNA, 22 nt, Human
agacuccagaaaugucccuuuc

SEQ ID NO: 3570463 - RNA, 18 nt, Human
agacuccagaccugaggc

SEQ ID NO: 3570464 - RNA, 17 nt, Human
agacucccaugaagccu

SEQ ID NO: 3570465 - RNA, 22 nt, Human
agacuccuagcuguccuuuuuc

SEQ ID NO: 3570466 - RNA, 14 nt, Human
agacuccuccucca

SEQ ID NO: 3570467 - RNA, 23 nt, Human
agacuccuccuccaaaggccccc

SEQ ID NO: 3570468 - RNA, 22 nt, Human
agacuccugaggacagcugucc

SEQ ID NO: 3570469 - RNA, 16 nt, Human
agacuccugcaggcag

SEQ ID NO: 3570470 - RNA, 18 nt, Human
agacuccugcaggcagcc

SEQ ID NO: 3570471 - RNA, 15 nt, Human
agacuccugcccugu

SEQ ID NO: 3570472 - RNA, 20 nt, Human
agacucgauucauauugaau

SEQ ID NO: 3570473 - RNA, 23 nt, Human
agacucgauucauauugaauaua

SEQ ID NO: 3570474 - RNA, 18 nt, Human
agacucgcgacaaugcaa

SEQ ID NO: 3570475 - RNA, 18 nt, Human
agacucggaaucuauuuu

SEQ ID NO: 3570476 - RNA, 14 nt, Human
agacucggggugcu

SEQ ID NO: 3570477 - RNA, 16 nt, Human
agacucuaagaaagaa

SEQ ID NO: 3570478 - RNA, 19 nt, Human
agacucuacagaggccaug

SEQ ID NO: 3570479 - RNA, 19 nt, Human
agacucuagaguccaaggu

SEQ ID NO: 3570480 - RNA, 20 nt, Human
agacucuagaguccaagguu

SEQ ID NO: 3570481 - RNA, 15 nt, Human
agacucuagggucca

SEQ ID NO: 3570482 - RNA, 15 nt, Human
agacucuaguauuua

SEQ ID NO: 3570483 - RNA, 11 nt, Human
agacucucagc

SEQ ID NO: 3570484 - RNA, 18 nt, Human
agacucucagcccagaag

SEQ ID NO: 3570485 - RNA, 20 nt, Human
agacucucagcccagaagaa

SEQ ID NO: 3570486 - RNA, 19 nt, Human
agacucucgcaucuuccca

SEQ ID NO: 3570487 - RNA, 20 nt, Human
agacucugaaaucucagaau

SEQ ID NO: 3570488 - RNA, 19 nt, Human
agacucuggucuucuuugg

SEQ ID NO: 3570489 - RNA, 17 nt, Human
agacucuguaacaucac

SEQ ID NO: 3570490 - RNA, 18 nt, Human
agacucugucuaaaaaac

SEQ ID NO: 3570491 - RNA, 15 nt, Human
agacucuuugcauau

SEQ ID NO: 3570492 - RNA, 18 nt, Human
agacucuuuuccuucccu

SEQ ID NO: 3570493 - RNA, 21 nt, Human
agacucuuuuuguaccuggug

SEQ ID NO: 3570494 - RNA, 17 nt, Human
agacugaacauguacac

SEQ ID NO: 3570495 - RNA, 16 nt, Human
agacugaacuguguga

SEQ ID NO: 3570496 - RNA, 22 nt, Human
agacugaauagauaugaaagcu

SEQ ID NO: 3570497 - RNA, 17 nt, Human
agacugaggacaaagug

SEQ ID NO: 3570498 - RNA, 14 nt, Human
agacugaucaggac

SEQ ID NO: 3570499 - RNA, 17 nt, Human
agacugaucaggaccuc

SEQ ID NO: 3570500 - RNA, 11 nt, Human
agacugaucuc

SEQ ID NO: 3570501 - RNA, 23 nt, Human
agagucuaaagauggaguuucua

SEQ ID NO: 3570502 - RNA, 15 nt, Human
agagucuagauucaa

SEQ ID NO: 3570503 - RNA, 22 nt, Human
agagucuagauucaaagguucu

SEQ ID NO: 3570504 - RNA, 15 nt, Human
agagucuagauucuc

SEQ ID NO: 3570505 - RNA, 22 nt, Human
agagucucacuguugcccaggc

SEQ ID NO: 3570506 - RNA, 15 nt, Human
agagucuccauuuaa

SEQ ID NO: 3570507 - RNA, 13 nt, Human
agagucucccagg

SEQ ID NO: 3570508 - RNA, 16 nt, Human
agagucugaaccuauu

SEQ ID NO: 3570509 - RNA, 12 nt, Human
agagucugaggg

SEQ ID NO: 3570510 - RNA, 14 nt, Human
agagucuugcagug

SEQ ID NO: 3570511 - RNA, 14 nt, Human
agagugaacaaauu

SEQ ID NO: 3570512 - RNA, 14 nt, Human
agagugaagggaag

SEQ ID NO: 3570513 - RNA, 22 nt, Human
agagugaagggaagagacagcc

SEQ ID NO: 3570514 - RNA, 19 nt, Human
agagugacuaguacaaauu

SEQ ID NO: 3570515 - RNA, 16 nt, Human
agagugacuccaagaa

SEQ ID NO: 3570516 - RNA, 19 nt, Human
agagugagacucugucuca

SEQ ID NO: 3570517 - RNA, 14 nt, Human
agagugagagggca

SEQ ID NO: 3570518 - RNA, 18 nt, Human
agagugagggccugaggu

SEQ ID NO: 3570519 - RNA, 17 nt, Human
agagugauaauacaagu

SEQ ID NO: 3570520 - RNA, 16 nt, Human
agagugauugcagcuu

SEQ ID NO: 3570521 - RNA, 18 nt, Human
agagugauugcagcuuua

SEQ ID NO: 3570522 - RNA, 21 nt, Human
agagugcaagccccugcucca

SEQ ID NO: 3570523 - RNA, 15 nt, Human
agagugcacagcugu

SEQ ID NO: 3570524 - RNA, 18 nt, Human
agagugcauugugagggu

SEQ ID NO: 3570525 - RNA, 20 nt, Human
agagugccaacuucuuucau

SEQ ID NO: 3570526 - RNA, 12 nt, Human
agagugcccaga

SEQ ID NO: 3570527 - RNA, 13 nt, Human
agagugcccagaa

SEQ ID NO: 3570528 - RNA, 18 nt, Human
agagugccccaccugcca

SEQ ID NO: 3570529 - RNA, 19 nt, Human
agagugccccaccugccac

SEQ ID NO: 3570530 - RNA, 21 nt, Human
agagugcgccgagucugucuc

SEQ ID NO: 3570531 - RNA, 12 nt, Human
agaguggccugg

SEQ ID NO: 3570532 - RNA, 13 nt, Human
agaguggccuggc

SEQ ID NO: 3570533 - RNA, 15 nt, Human
agaguggccuggcca

SEQ ID NO: 3570534 - RNA, 19 nt, Human
agaguggccuggccaggag

SEQ ID NO: 3570535 - RNA, 14 nt, Human
agaguggcuccucc

SEQ ID NO: 3570536 - RNA, 19 nt, Human
agagugggguagguuggga

SEQ ID NO: 3570537 - RNA, 16 nt, Human
agaguggguuucacaa

SEQ ID NO: 3570538 - RNA, 21 nt, Human
agaguggugggggaaggcugu

SEQ ID NO: 3570539 - RNA, 16 nt, Human
agaguguagaagcauu

SEQ ID NO: 3570540 - RNA, 17 nt, Human
agagugucaaccagaca

SEQ ID NO: 3570541 - RNA, 18 nt, Human
agagugucaaccagacag

SEQ ID NO: 3570542 - RNA, 19 nt, Human
agagugucaaccagacaga

SEQ ID NO: 3570543 - RNA, 21 nt, Human
agagugucaaccagacagagg

SEQ ID NO: 3570544 - RNA, 22 nt, Human
agagugucaaccagacagaggg

SEQ ID NO: 3570545 - RNA, 21 nt, Human
agagugucucagggugcagag

SEQ ID NO: 3570546 - RNA, 14 nt, Human
agagugucuuucca

SEQ ID NO: 3570547 - RNA, 20 nt, Human
agagugugauguauguguaa

SEQ ID NO: 3570548 - RNA, 11 nt, Human
agagugugugu

SEQ ID NO: 3570549 - RNA, 14 nt, Human
agaguguugaaacg

SEQ ID NO: 3570550 - RNA, 22 nt, Human
agaguuaacaaugauauaugga

SEQ ID NO: 3570551 - RNA, 16 nt, Human
agaguuaagaagcugu

SEQ ID NO: 3570552 - RNA, 16 nt, Human
agaguuacaguucugu

SEQ ID NO: 3570553 - RNA, 17 nt, Human
agaguuagacuguuggg

SEQ ID NO: 3570554 - RNA, 18 nt, Human
agaguuagguuuaacaua

SEQ ID NO: 3570555 - RNA, 18 nt, Human
agaguucaagaaauaagu

SEQ ID NO: 3570556 - RNA, 21 nt, Human
agaguucaagaaauaaguuuu

SEQ ID NO: 3570557 - RNA, 18 nt, Human
agaguucaauggcugcug

SEQ ID NO: 3570558 - RNA, 13 nt, Human
agaguucaguaag

SEQ ID NO: 3570559 - RNA, 16 nt, Human
agaguuccugcggagu

SEQ ID NO: 3570560 - RNA, 21 nt, Human
agaguucuuuuugaaguauuu

SEQ ID NO: 3570561 - RNA, 13 nt, Human
agaguugaaccua

SEQ ID NO: 3570562 - RNA, 15 nt, Human
agaguugaagacaga

SEQ ID NO: 3570563 - RNA, 17 nt, Human
agaguugauacuacagu

SEQ ID NO: 3570564 - RNA, 15 nt, Human
agaguuggccauauu

SEQ ID NO: 3570565 - RNA, 19 nt, Human
agaguugugcacauggcuu

SEQ ID NO: 3570566 - RNA, 14 nt, Human
agaguuuaacacaa

SEQ ID NO: 3570567 - RNA, 15 nt, Human
agaguuuaacacaag

SEQ ID NO: 3570568 - RNA, 14 nt, Human
agaguuucuguuug

SEQ ID NO: 3570569 - RNA, 15 nt, Human
agaguuucuguuuga

SEQ ID NO: 3570570 - RNA, 18 nt, Human
agaguuucuguuugauuc

SEQ ID NO: 3570571 - RNA, 13 nt, Human
agaguuugaagga

SEQ ID NO: 3570572 - RNA, 19 nt, Human
agaguuugaaggaggugag

SEQ ID NO: 3570573 - RNA, 22 nt, Human
agaguuugaugaggcccuccac

SEQ ID NO: 3570574 - RNA, 13 nt, Human
agaguuuuggaug

SEQ ID NO: 3570575 - RNA, 18 nt, Human
agaguuuuggaugcagug

SEQ ID NO: 3570576 - RNA, 19 nt, Human
agaguuuuggaugcagugc

SEQ ID NO: 3570577 - RNA, 20 nt, Human
agaguuuugucauucagagu

SEQ ID NO: 3570578 - RNA, 17 nt, Human
agaguuuuuaauagaac

SEQ ID NO: 3570579 - RNA, 18 nt, Human
agauaaaaaaacagcuuu

SEQ ID NO: 3570580 - RNA, 21 nt, Human
agauaaaauuauagaugggaa

SEQ ID NO: 3570581 - RNA, 14 nt, Human
agauaaacauuauu

SEQ ID NO: 3570582 - RNA, 13 nt, Human
agauaaacucaga

SEQ ID NO: 3570583 - RNA, 17 nt, Human
agauaaagaccagaaau

SEQ ID NO: 3570584 - RNA, 16 nt, Human
agauaaagaugaucua

SEQ ID NO: 3570585 - RNA, 13 nt, Human
agauaaagauugu

SEQ ID NO: 3570586 - RNA, 16 nt, Human
agauaaagauugugug

SEQ ID NO: 3570587 - RNA, 17 nt, Human
agauaaagauuucuuga

SEQ ID NO: 3570588 - RNA, 18 nt, Human
agauaaagauuucuugag

SEQ ID NO: 3570589 - RNA, 17 nt, Human
agauaaagguucaugca

SEQ ID NO: 3570590 - RNA, 14 nt, Human
agauaaauauuaua

SEQ ID NO: 3570591 - RNA, 21 nt, Human
agauaacaagaucuuucagga

SEQ ID NO: 3570592 - RNA, 15 nt, Human
agauaacauuugugu

SEQ ID NO: 3570593 - RNA, 21 nt, Human
agauaaccagcuguaacacag

SEQ ID NO: 3570594 - RNA, 15 nt, Human
agauaacucuuugga

SEQ ID NO: 3570595 - RNA, 22 nt, Human
agauaacucuuuggauagcaug

SEQ ID NO: 3570596 - RNA, 15 nt, Human
agauaacugaaaauu

SEQ ID NO: 3570597 - RNA, 22 nt, Human
agauaacugaaaauuauuuaaa

SEQ ID NO: 3570598 - RNA, 19 nt, Human
agauaacuguuauuuauaa

SEQ ID NO: 3570599 - RNA, 22 nt, Human
agauaagaaugcugguuuuccu

SEQ ID NO: 3570600 - RNA, 15 nt, Human
agauaaguggccuug

SEQ ID NO: 3570601 - RNA, 14 nt, Human
agauaaguuggaaa

SEQ ID NO: 3570602 - RNA, 13 nt, Human
agauaauaguuua

SEQ ID NO: 3570603 - RNA, 18 nt, Human
agauaauauuaaggaaga

SEQ ID NO: 3570604 - RNA, 22 nt, Human
agauaauauuaaggaagacaau

SEQ ID NO: 3570605 - RNA, 16 nt, Human
agauaaucuagaacac

SEQ ID NO: 3570606 - RNA, 21 nt, Human
agauaauguuagagguuuuaa

SEQ ID NO: 3570607 - RNA, 22 nt, Human
agauaauuaaaaagaugguugc

SEQ ID NO: 3570608 - RNA, 14 nt, Human
agauaauucacugu

SEQ ID NO: 3570609 - RNA, 17 nt, Human
agauaauuguugaaauu

SEQ ID NO: 3570610 - RNA, 18 nt, Human
agauaauuguugaaauuu

SEQ ID NO: 3570611 - RNA, 22 nt, Human
agauaauuguugaaauuuugca

SEQ ID NO: 3570612 - RNA, 15 nt, Human
agauaauuucagggu

SEQ ID NO: 3570613 - RNA, 16 nt, Human
agauacaauguauuua

SEQ ID NO: 3570614 - RNA, 20 nt, Human
agauacagaacucuuucaaa

SEQ ID NO: 3570615 - RNA, 16 nt, Human
agauacauacagaauu

SEQ ID NO: 3570616 - RNA, 18 nt, Human
agauacauaugagugugg

SEQ ID NO: 3570617 - RNA, 20 nt, Human
agauacaucacugcuugaug

SEQ ID NO: 3570618 - RNA, 23 nt, Human
agauacauuuguauguugugaag

SEQ ID NO: 3570619 - RNA, 21 nt, Human
agauaccagcgaggaggcucc

SEQ ID NO: 3570620 - RNA, 20 nt, Human
agauaccaucagcaaagaau

SEQ ID NO: 3570621 - RNA, 22 nt, Human
agauaccaucagcaaagaauuu

SEQ ID NO: 3570622 - RNA, 23 nt, Human
agauacccuacgcuguccagaaa

SEQ ID NO: 3570623 - RNA, 13 nt, Human
agauaccucaccc

SEQ ID NO: 3570624 - RNA, 14 nt, Human
agauaccuccaacc

SEQ ID NO: 3570625 - RNA, 19 nt, Human
agauaccuccaacccugcc

SEQ ID NO: 3570626 - RNA, 20 nt, Human
agauaccuccaacccugccg

SEQ ID NO: 3570627 - RNA, 11 nt, Human
agauacuuugu

SEQ ID NO: 3570628 - RNA, 19 nt, Human
agauacuuuuucuuuugua

SEQ ID NO: 3570629 - RNA, 21 nt, Human
agauacuuuuucuuuuguaag

SEQ ID NO: 3570630 - RNA, 11 nt, Human
agauagaaaua

SEQ ID NO: 3570631 - RNA, 22 nt, Human
agauagaaauaaauagcuauau

SEQ ID NO: 3570632 - RNA, 13 nt, Human
agauagaagaaaa

SEQ ID NO: 3570633 - RNA, 17 nt, Human
agauagaagaaaaaaga

SEQ ID NO: 3570634 - RNA, 14 nt, Human
agauagagagcuau

SEQ ID NO: 3570635 - RNA, 22 nt, Human
agauagagaguuguuguguaca

SEQ ID NO: 3570636 - RNA, 16 nt, Human
agauagauuuggaaua

SEQ ID NO: 3570637 - RNA, 17 nt, Human
agauagauuuggaauag

SEQ ID NO: 3570638 - RNA, 18 nt, Human
agauagcauugugaacug

SEQ ID NO: 3570639 - RNA, 15 nt, Human
agauagccaaggcca

SEQ ID NO: 3570640 - RNA, 19 nt, Human
agauagcccuguccuggug

SEQ ID NO: 3570641 - RNA, 20 nt, Human
agauagcccuguccuggugg

SEQ ID NO: 3570642 - RNA, 15 nt, Human
agauagccuguggcc

SEQ ID NO: 3570643 - RNA, 13 nt, Human
agauagcugcaug

SEQ ID NO: 3570644 - RNA, 16 nt, Human
agauagcugugacuuc

SEQ ID NO: 3570645 - RNA, 21 nt, Human
agauaggaaggucauuuccau

SEQ ID NO: 3570646 - RNA, 15 nt, Human
agauagggaaaaggg

SEQ ID NO: 3570647 - RNA, 18 nt, Human
agauagggcugggcaagg

SEQ ID NO: 3570648 - RNA, 23 nt, Human
agauagggcugggcaaggaaaaa

SEQ ID NO: 3570649 - RNA, 15 nt, Human
agauagguaaauacc

SEQ ID NO: 3570650 - RNA, 11 nt, Human
agauaguuuau

SEQ ID NO: 3570651 - RNA, 13 nt, Human
agauaguuuucau

SEQ ID NO: 3570652 - RNA, 17 nt, Human
agauauaaauggcuggu

SEQ ID NO: 3570653 - RNA, 13 nt, Human
agauauaagugcu

SEQ ID NO: 3570654 - RNA, 15 nt, Human
agauauaagugcugu

SEQ ID NO: 3570655 - RNA, 22 nt, Human
agauauaagugcuguauaaaau

SEQ ID NO: 3570656 - RNA, 23 nt, Human
agauauaagugcuguauaaaauc

SEQ ID NO: 3570657 - RNA, 21 nt, Human
agauauaaugaacaaaauuau

SEQ ID NO: 3570658 - RNA, 20 nt, Human
agauauaucugaaaacugga

SEQ ID NO: 3570659 - RNA, 21 nt, Human
agauauaucugaaaacuggaa

SEQ ID NO: 3570660 - RNA, 14 nt, Human
agauauaugccuuc

SEQ ID NO: 3570661 - RNA, 17 nt, Human
agauauauuuucuuucu

SEQ ID NO: 3570662 - RNA, 15 nt, Human
agauaucucaaugaa

SEQ ID NO: 3570663 - RNA, 17 nt, Human
agauaucuuuuuauuga

SEQ ID NO: 3570664 - RNA, 24 nt, Human
agauaucuuuuuauugaugugcaa

SEQ ID NO: 3570665 - RNA, 20 nt, Human
agauauggagaauugcugaa

SEQ ID NO: 3570666 - RNA, 17 nt, Human
agauauggcagcgaaag

SEQ ID NO: 3570667 - RNA, 14 nt, Human
agauauguauucuu

SEQ ID NO: 3570668 - RNA, 11 nt, Human
agauauuaaug

SEQ ID NO: 3570669 - RNA, 17 nt, Human
agauauuaaugcccaga

SEQ ID NO: 3570670 - RNA, 13 nt, Human
agauauuacuuua

SEQ ID NO: 3570671 - RNA, 14 nt, Human
agauauuacuuuau

SEQ ID NO: 3570672 - RNA, 16 nt, Human
agauauuacuuuauca

SEQ ID NO: 3570673 - RNA, 13 nt, Human
agauauucugcuc

SEQ ID NO: 3570674 - RNA, 14 nt, Human
agauauuguacaua

SEQ ID NO: 3570675 - RNA, 15 nt, Human
agauauuguacauaa

SEQ ID NO: 3570676 - RNA, 16 nt, Human
agauauuguacauaaa

SEQ ID NO: 3570677 - RNA, 18 nt, Human
agauauuguacauaaaag

SEQ ID NO: 3570678 - RNA, 19 nt, Human
agauauuguacauaaaaga

SEQ ID NO: 3570679 - RNA, 23 nt, Human
agauauuuaaguauaaaauacaa

SEQ ID NO: 3570680 - RNA, 23 nt, Human
agauauuuauuguuuauuuauca

SEQ ID NO: 3570681 - RNA, 19 nt, Human
agauauuuggcuuaaauau

SEQ ID NO: 3570682 - RNA, 21 nt, Human
agauauuuggcuuaaauauag

SEQ ID NO: 3570683 - RNA, 17 nt, Human
agauauuuugggcaugu

SEQ ID NO: 3570684 - RNA, 17 nt, Human
agauauuuuuaucuuua

SEQ ID NO: 3570685 - RNA, 19 nt, Human
agauauuuuuaucuuuaua

SEQ ID NO: 3570686 - RNA, 21 nt, Human
agauauuuuuaucuuuauaug

SEQ ID NO: 3570687 - RNA, 19 nt, Human
agauauuuuuucagaaaua

SEQ ID NO: 3570688 - RNA, 21 nt, Human
agauauuuuuucagaaauaug

SEQ ID NO: 3570689 - RNA, 14 nt, Human
agaucaaaaaggcu

SEQ ID NO: 3570690 - RNA, 15 nt, Human
agaucaaaaaggcuu

SEQ ID NO: 3570691 - RNA, 19 nt, Human
agaucaaaaaggcuuauaa

SEQ ID NO: 3570692 - RNA, 12 nt, Human
agaucaaaauaa

SEQ ID NO: 3570693 - RNA, 17 nt, Human
agaucaaaauaaaaagu

SEQ ID NO: 3570694 - RNA, 16 nt, Human
agaucaaauacuuuaa

SEQ ID NO: 3570695 - RNA, 20 nt, Human
agaucaaauacuuuaaagga

SEQ ID NO: 3570696 - RNA, 23 nt, Human
agaucaaauuucacgucgucuuc

SEQ ID NO: 3570697 - RNA, 15 nt, Human
agaucaagagaucaa

SEQ ID NO: 3570698 - RNA, 18 nt, Human
agaucaagcugugagaca

SEQ ID NO: 3570699 - RNA, 21 nt, Human
agaucaauuuguaauugcuua

SEQ ID NO: 3570700 - RNA, 14 nt, Human
agaucaccagcccg

SEQ ID NO: 3570701 - RNA, 15 nt, Human
agaucaccagcccgg

SEQ ID NO: 3570702 - RNA, 16 nt, Human
agaucaccagcccggc

SEQ ID NO: 3570703 - RNA, 21 nt, Human
agaucaccagcccggccugcu

SEQ ID NO: 3570704 - RNA, 13 nt, Human
agaucacgagguc

SEQ ID NO: 3570705 - RNA, 15 nt, Human
agaucacgccacugc

SEQ ID NO: 3570706 - RNA, 21 nt, Human
agaucacgcuccccgccuguu

SEQ ID NO: 3570707 - RNA, 14 nt, Human
agaucacuacugca

SEQ ID NO: 3570708 - RNA, 18 nt, Human
agaucacugaauuuauaa

SEQ ID NO: 3570709 - RNA, 15 nt, Human
agaucacuguuuaga

SEQ ID NO: 3570710 - RNA, 19 nt, Human
agaucacuguuuagauuug

SEQ ID NO: 3570711 - RNA, 18 nt, Human
agaucacuuucucaguuu

SEQ ID NO: 3570712 - RNA, 23 nt, Human
agaucagaugcuccaagauucua

SEQ ID NO: 3570713 - RNA, 19 nt, Human
agaucaggaagagaaggag

SEQ ID NO: 3570714 - RNA, 15 nt, Human
agaucaguaaagaac

SEQ ID NO: 3570715 - RNA, 15 nt, Human
agaucaguguaccau

SEQ ID NO: 3570716 - RNA, 20 nt, Human
agaucauagauuucugauuu

SEQ ID NO: 3570717 - RNA, 14 nt, Human
agaucauaguuuua

SEQ ID NO: 3570718 - RNA, 19 nt, Human
agaucauaguuuuauuuau

SEQ ID NO: 3570719 - RNA, 23 nt, Human
agaucauaguuuuauuuauauuu

SEQ ID NO: 3570720 - RNA, 14 nt, Human
agaucaugcauaga

SEQ ID NO: 3570721 - RNA, 18 nt, Human
agauccaaaagaagcccc

SEQ ID NO: 3570722 - RNA, 21 nt, Human
agauccaaaagaagcccccag

SEQ ID NO: 3570723 - RNA, 13 nt, Human
agauccaaagacu

SEQ ID NO: 3570724 - RNA, 17 nt, Human
agauccacacacagagg

SEQ ID NO: 3570725 - RNA, 16 nt, Human
agauccaggagcucca

SEQ ID NO: 3570726 - RNA, 19 nt, Human
agauccagggacagaggcc

SEQ ID NO: 3570727 - RNA, 22 nt, Human
agauccauuuuuuauauuucaa

SEQ ID NO: 3570728 - RNA, 10 nt, Human
agaucccaaa

SEQ ID NO: 3570729 - RNA, 18 nt, Human
agaucccaacacugccag

SEQ ID NO: 3570730 - RNA, 19 nt, Human
agaucccaacacugccagc

SEQ ID NO: 3570731 - RNA, 20 nt, Human
agaucccaacacugccagca

SEQ ID NO: 3570732 - RNA, 23 nt, Human
agaucccauggguuguguguuua

SEQ ID NO: 3570733 - RNA, 18 nt, Human
agauccccaagccuggca

SEQ ID NO: 3570734 - RNA, 13 nt, Human
agaucccccagaa

SEQ ID NO: 3570735 - RNA, 11 nt, Human
agauccccuca

SEQ ID NO: 3570736 - RNA, 15 nt, Human
agauccccucaggac

SEQ ID NO: 3570737 - RNA, 19 nt, Human
agaucccgccucuucuucu

SEQ ID NO: 3570738 - RNA, 16 nt, Human
agauccuaaaacaaaa

SEQ ID NO: 3570739 - RNA, 16 nt, Human
agauccuagauccuaa

SEQ ID NO: 3570740 - RNA, 14 nt, Human
agauccuggaaauc

SEQ ID NO: 3570741 - RNA, 17 nt, Human
agaucgagaccauccug

SEQ ID NO: 3570742 - RNA, 15 nt, Human
agaucgcccccaccu

SEQ ID NO: 3570743 - RNA, 18 nt, Human
agaucggggccagaggca

SEQ ID NO: 3570744 - RNA, 21 nt, Human
agaucgugccguuacucucca

SEQ ID NO: 3570745 - RNA, 19 nt, Human
agaucgugcuacugcacuc

SEQ ID NO: 3570746 - RNA, 17 nt, Human
agaucguuaguaucuaa

SEQ ID NO: 3570747 - RNA, 16 nt, Human
agaucguucucugccu

SEQ ID NO: 3570748 - RNA, 20 nt, Human
agaucuaagccuuuccauaa

SEQ ID NO: 3570749 - RNA, 11 nt, Human
agaucuacaug

SEQ ID NO: 3570750 - RNA, 14 nt, Human
agaucuacaugaau

SEQ ID NO: 3570751 - RNA, 14 nt, Human
agaucuauaaagcg

SEQ ID NO: 3570752 - RNA, 13 nt, Human
agaucuccaaagc

SEQ ID NO: 3570753 - RNA, 15 nt, Human
agaucuccaaagcuu

SEQ ID NO: 3570754 - RNA, 12 nt, Human
agaucuccagcg

SEQ ID NO: 3570755 - RNA, 14 nt, Human
agaucuccuggcaa

SEQ ID NO: 3570756 - RNA, 16 nt, Human
agaucucgguuugcca

SEQ ID NO: 3570757 - RNA, 16 nt, Human
agaucucugcagggcc

SEQ ID NO: 3570758 - RNA, 17 nt, Human
agaucucugcagggccg

SEQ ID NO: 3570759 - RNA, 23 nt, Human
agaucucugcuuuggaaaucaca

SEQ ID NO: 3570760 - RNA, 21 nt, Human
agaucugacaugauuccuucc

SEQ ID NO: 3570761 - RNA, 14 nt, Human
agaucugcaccgcc

SEQ ID NO: 3570762 - RNA, 18 nt, Human
agaucugccuaaggacuu

SEQ ID NO: 3570763 - RNA, 19 nt, Human
agcacuuucauugccagug

SEQ ID NO: 3570764 - RNA, 17 nt, Human
agcacuuugaaauaccu

SEQ ID NO: 3570765 - RNA, 21 nt, Human
agcacuuugaaauaccucaug

SEQ ID NO: 3570766 - RNA, 20 nt, Human
agcacuuugggaggccaagg

SEQ ID NO: 3570767 - RNA, 23 nt, Human
agcacuuugggaggccaaggugg

SEQ ID NO: 3570768 - RNA, 21 nt, Human
agcacuuugggaggccgaggc

SEQ ID NO: 3570769 - RNA, 21 nt, Human
agcacuuugggaggcugaggc

SEQ ID NO: 3570770 - RNA, 13 nt, Human
agcacuuuucaaa

SEQ ID NO: 3570771 - RNA, 21 nt, Human
agcagaaaacccuugggccag

SEQ ID NO: 3570772 - RNA, 18 nt, Human
agcagaaaauaaaggaag

SEQ ID NO: 3570773 - RNA, 19 nt, Human
agcagaaaauacagcugga

SEQ ID NO: 3570774 - RNA, 18 nt, Human
agcagaaagcugugaaca

SEQ ID NO: 3570775 - RNA, 18 nt, Human
agcagaaaggcacgucca

SEQ ID NO: 3570776 - RNA, 19 nt, Human
agcagaaagugccuuucag

SEQ ID NO: 3570777 - RNA, 13 nt, Human
agcagaaauacau

SEQ ID NO: 3570778 - RNA, 20 nt, Human
agcagaacagugauuaccag

SEQ ID NO: 3570779 - RNA, 16 nt, Human
agcagaaccuuaaaca

SEQ ID NO: 3570780 - RNA, 14 nt, Human
agcagaacugaacc

SEQ ID NO: 3570781 - RNA, 14 nt, Human
agcagaagaaagga

SEQ ID NO: 3570782 - RNA, 13 nt, Human
agcagaagcagca

SEQ ID NO: 3570783 - RNA, 14 nt, Human
agcagaaggaaaca

SEQ ID NO: 3570784 - RNA, 16 nt, Human
agcagaaguggagcug

SEQ ID NO: 3570785 - RNA, 14 nt, Human
agcagaauaaagca

SEQ ID NO: 3570786 - RNA, 15 nt, Human
agcagaauaaagcaa

SEQ ID NO: 3570787 - RNA, 16 nt, Human
agcagaauaaagcaau

SEQ ID NO: 3570788 - RNA, 18 nt, Human
agcagaauugaccgacag

SEQ ID NO: 3570789 - RNA, 19 nt, Human
agcagaauuggaaaagacu

SEQ ID NO: 3570790 - RNA, 17 nt, Human
agcagacacccuuggag

SEQ ID NO: 3570791 - RNA, 16 nt, Human
agcagacagagccagg

SEQ ID NO: 3570792 - RNA, 17 nt, Human
agcagacagagccagga

SEQ ID NO: 3570793 - RNA, 18 nt, Human
agcagacagagccaggag

SEQ ID NO: 3570794 - RNA, 19 nt, Human
agcagacagagccaggaga

SEQ ID NO: 3570795 - RNA, 21 nt, Human
agcagacaguguuuucuggga

SEQ ID NO: 3570796 - RNA, 23 nt, Human
agcagacauugucagcaaauuaa

SEQ ID NO: 3570797 - RNA, 23 nt, Human
agcagacuacagcuggggugcag

SEQ ID NO: 3570798 - RNA, 16 nt, Human
agcagacucagcucug

SEQ ID NO: 3570799 - RNA, 19 nt, Human
agcagacucagcucugaca

SEQ ID NO: 3570800 - RNA, 20 nt, Human
agcagacucagcucugacau

SEQ ID NO: 3570801 - RNA, 19 nt, Human
agcagacugaucaggaccu

SEQ ID NO: 3570802 - RNA, 20 nt, Human
agcagagaauauaacaugaa

SEQ ID NO: 3570803 - RNA, 24 nt, Human
agcagagaauauaacaugaaauga

SEQ ID NO: 3570804 - RNA, 17 nt, Human
agcagagaccaucccug

SEQ ID NO: 3570805 - RNA, 18 nt, Human
agcagagaccaucccuga

SEQ ID NO: 3570806 - RNA, 17 nt, Human
agcagagcaagucugca

SEQ ID NO: 3570807 - RNA, 20 nt, Human
agcagagcaccuuagacagu

SEQ ID NO: 3570808 - RNA, 14 nt, Human
agcagagcaggggc

SEQ ID NO: 3570809 - RNA, 22 nt, Human
agcagagcugauggagaaggaa

SEQ ID NO: 3570810 - RNA, 20 nt, Human
agcagaggauaauuagcauc

SEQ ID NO: 3570811 - RNA, 13 nt, Human
agcagaggcacug

SEQ ID NO: 3570812 - RNA, 17 nt, Human
agcagaggcuggccuca

SEQ ID NO: 3570813 - RNA, 23 nt, Human
agcagagguggccagagcuggga

SEQ ID NO: 3570814 - RNA, 23 nt, Human
agcagagugcacagcuguccacu

SEQ ID NO: 3570815 - RNA, 23 nt, Human
agcagaguuuucauuaaauccuu

SEQ ID NO: 3570816 - RNA, 20 nt, Human
agcagauacauaugagugug

SEQ ID NO: 3570817 - RNA, 19 nt, Human
agcagauaccucacccugc

SEQ ID NO: 3570818 - RNA, 13 nt, Human
agcagaugcaaag

SEQ ID NO: 3570819 - RNA, 14 nt, Human
agcagaugcaaaga

SEQ ID NO: 3570820 - RNA, 17 nt, Human
agcagaugcaaagaggc

SEQ ID NO: 3570821 - RNA, 19 nt, Human
agcagaugcaaugacucag

SEQ ID NO: 3570822 - RNA, 12 nt, Human
agcagaugcaga

SEQ ID NO: 3570823 - RNA, 13 nt, Human
agcagaugcagag

SEQ ID NO: 3570824 - RNA, 16 nt, Human
agcagaugcagagagc

SEQ ID NO: 3570825 - RNA, 14 nt, Human
agcagauuggaagg

SEQ ID NO: 3570826 - RNA, 15 nt, Human
agcagauuggaagga

SEQ ID NO: 3570827 - RNA, 19 nt, Human
agcagauuggaaggagaca

SEQ ID NO: 3570828 - RNA, 21 nt, Human
agcagauuggaaggagacaca

SEQ ID NO: 3570829 - RNA, 20 nt, Human
agcagauuggagaaacccuu

SEQ ID NO: 3570830 - RNA, 22 nt, Human
agcagauuuuaauuuugaauaa

SEQ ID NO: 3570831 - RNA, 20 nt, Human
agcagauuuuaggaaaugaa

SEQ ID NO: 3570832 - RNA, 20 nt, Human
agcagcaaaaauauaaaaua

SEQ ID NO: 3570833 - RNA, 16 nt, Human
agcagcaacacaaugu

SEQ ID NO: 3570834 - RNA, 13 nt, Human
agcagcaagaaaa

SEQ ID NO: 3570835 - RNA, 16 nt, Human
agcagcaagaaaaaaa

SEQ ID NO: 3570836 - RNA, 23 nt, Human
agcagcaagaaaaaaaaaugcca

SEQ ID NO: 3570837 - RNA, 13 nt, Human
agcagcacccauc

SEQ ID NO: 3570838 - RNA, 18 nt, Human
agcagcaccguucugugc

SEQ ID NO: 3570839 - RNA, 20 nt, Human
agcagcaccguucugugcac

SEQ ID NO: 3570840 - RNA, 14 nt, Human
agcagcaccuccuc

SEQ ID NO: 3570841 - RNA, 21 nt, Human
agcagcaccuccucagccuga

SEQ ID NO: 3570842 - RNA, 17 nt, Human
agcagcaccugcccuac

SEQ ID NO: 3570843 - RNA, 14 nt, Human
agcagcagcccaag

SEQ ID NO: 3570844 - RNA, 13 nt, Human
agcagcagcccug

SEQ ID NO: 3570845 - RNA, 15 nt, Human
agcagcaggaggggg

SEQ ID NO: 3570846 - RNA, 17 nt, Human
agcagcaggagggggga

SEQ ID NO: 3570847 - RNA, 13 nt, Human
agcagcagguagc

SEQ ID NO: 3570848 - RNA, 15 nt, Human
agcagcaucuucugg

SEQ ID NO: 3570849 - RNA, 13 nt, Human
agcagcauuuuua

SEQ ID NO: 3570850 - RNA, 20 nt, Human
agcagcauuuuuauuucaga

SEQ ID NO: 3570851 - RNA, 11 nt, Human
agcagccagcc

SEQ ID NO: 3570852 - RNA, 12 nt, Human
agcagccagccc

SEQ ID NO: 3570853 - RNA, 18 nt, Human
agcagccagcccugccug

SEQ ID NO: 3570854 - RNA, 19 nt, Human
agcagccagcccugccugg

SEQ ID NO: 3570855 - RNA, 20 nt, Human
agcagccagcccugccugga

SEQ ID NO: 3570856 - RNA, 13 nt, Human
agcagccagcucu

SEQ ID NO: 3570857 - RNA, 13 nt, Human
agaucuggcaugu

SEQ ID NO: 3570858 - RNA, 15 nt, Human
agaucugguuuugcu

SEQ ID NO: 3570859 - RNA, 18 nt, Human
agaucugguuuugcuauu

SEQ ID NO: 3570860 - RNA, 23 nt, Human
agaucuguccucagccuugccag

SEQ ID NO: 3570861 - RNA, 12 nt, Human
agaucugugccc

SEQ ID NO: 3570862 - RNA, 22 nt, Human
agaucuguuuugugguuuggaa

SEQ ID NO: 3570863 - RNA, 23 nt, Human
agaucuuagguauagaggacccu

SEQ ID NO: 3570864 - RNA, 19 nt, Human
agaucuucaaacagaauaa

SEQ ID NO: 3570865 - RNA, 14 nt, Human
agaucuuucagaaa

SEQ ID NO: 3570866 - RNA, 21 nt, Human
agaucuuucagaaauauaaca

SEQ ID NO: 3570867 - RNA, 16 nt, Human
agaucuuuuauuuugc

SEQ ID NO: 3570868 - RNA, 18 nt, Human
agaucuuuuauuuugcca

SEQ ID NO: 3570869 - RNA, 22 nt, Human
agaugaaaaagcauguacagug

SEQ ID NO: 3570870 - RNA, 15 nt, Human
agaugaaagagcagu

SEQ ID NO: 3570871 - RNA, 19 nt, Human
agaugaacucuuagaaaug

SEQ ID NO: 3570872 - RNA, 18 nt, Human
agaugaagcaaacacauu

SEQ ID NO: 3570873 - RNA, 16 nt, Human
agaugaaggagaggca

SEQ ID NO: 3570874 - RNA, 14 nt, Human
agaugaaguuuuau

SEQ ID NO: 3570875 - RNA, 17 nt, Human
agaugaauguccugaaa

SEQ ID NO: 3570876 - RNA, 17 nt, Human
agaugacaaccuccauu

SEQ ID NO: 3570877 - RNA, 18 nt, Human
agaugacaucugucuagg

SEQ ID NO: 3570878 - RNA, 23 nt, Human
agaugacauugacuauuuuuguu

SEQ ID NO: 3570879 - RNA, 21 nt, Human
agaugacauugcuaagaugcu

SEQ ID NO: 3570880 - RNA, 20 nt, Human
agaugaccacuuuuuagaaa

SEQ ID NO: 3570881 - RNA, 16 nt, Human
agaugaccauaaccac

SEQ ID NO: 3570882 - RNA, 11 nt, Human
agaugagaaca

SEQ ID NO: 3570883 - RNA, 15 nt, Human
agaugagaacaaagc

SEQ ID NO: 3570884 - RNA, 19 nt, Human
agaugagaauucagcugcc

SEQ ID NO: 3570885 - RNA, 20 nt, Human
agaugagaauucagcugccc

SEQ ID NO: 3570886 - RNA, 15 nt, Human
agaugagauuggcau

SEQ ID NO: 3570887 - RNA, 19 nt, Human
agaugagcacuucuaaguu

SEQ ID NO: 3570888 - RNA, 16 nt, Human
agaugaggccagacca

SEQ ID NO: 3570889 - RNA, 21 nt, Human
agaugagggaugggccuggca

SEQ ID NO: 3570890 - RNA, 22 nt, Human
agaugagggaugggccuggcau

SEQ ID NO: 3570891 - RNA, 21 nt, Human
agaugaggucaguuguguuuu

SEQ ID NO: 3570892 - RNA, 17 nt, Human
agaugaguuaucuaaga

SEQ ID NO: 3570893 - RNA, 14 nt, Human
agaugauaaagaga

SEQ ID NO: 3570894 - RNA, 16 nt, Human
agaugaucuacucaga

SEQ ID NO: 3570895 - RNA, 23 nt, Human
agaugaugaaaauauuuaaaggc

SEQ ID NO: 3570896 - RNA, 14 nt, Human
agaugaugagaauu

SEQ ID NO: 3570897 - RNA, 22 nt, Human
agaugauuaaauaagauucuaa

SEQ ID NO: 3570898 - RNA, 12 nt, Human
agaugauucugg

SEQ ID NO: 3570899 - RNA, 18 nt, Human
agaugauuuccccccucc

SEQ ID NO: 3570900 - RNA, 14 nt, Human
agaugauuugcaau

SEQ ID NO: 3570901 - RNA, 16 nt, Human
agaugcaaagaggcaa

SEQ ID NO: 3570902 - RNA, 18 nt, Human
agaugcaaagaggcaaga

SEQ ID NO: 3570903 - RNA, 16 nt, Human
agaugcaagaaggagg

SEQ ID NO: 3570904 - RNA, 15 nt, Human
agaugcaaggaccag

SEQ ID NO: 3570905 - RNA, 20 nt, Human
agaugcaaggaccaggacuc

SEQ ID NO: 3570906 - RNA, 13 nt, Human
agaugcacaugag

SEQ ID NO: 3570907 - RNA, 16 nt, Human
agaugcacaugagcug

SEQ ID NO: 3570908 - RNA, 15 nt, Human
agaugcaccagcccu

SEQ ID NO: 3570909 - RNA, 13 nt, Human
agaugcagagagc

SEQ ID NO: 3570910 - RNA, 20 nt, Human
agaugcagagagccauuuug

SEQ ID NO: 3570911 - RNA, 19 nt, Human
agaugcagcaaaaugugaa

SEQ ID NO: 3570912 - RNA, 17 nt, Human
agaugcaguucugaaga

SEQ ID NO: 3570913 - RNA, 15 nt, Human
agaugcauuguaguu

SEQ ID NO: 3570914 - RNA, 19 nt, Human
agaugcauuuggguccagg

SEQ ID NO: 3570915 - RNA, 21 nt, Human
agaugcauuuggguccaggag

SEQ ID NO: 3570916 - RNA, 23 nt, Human
agaugcauuuggguccaggagga

SEQ ID NO: 3570917 - RNA, 17 nt, Human
agaugccacccuagcca

SEQ ID NO: 3570918 - RNA, 13 nt, Human
agaugccagagca

SEQ ID NO: 3570919 - RNA, 16 nt, Human
agaugccauucauaga

SEQ ID NO: 3570920 - RNA, 11 nt, Human
agaugcccuga

SEQ ID NO: 3570921 - RNA, 13 nt, Human
agaugccuccacc

SEQ ID NO: 3570922 - RNA, 21 nt, Human
agaugccuccaccccccagaa

SEQ ID NO: 3570923 - RNA, 16 nt, Human
agaugccuccaccgcu

SEQ ID NO: 3570924 - RNA, 13 nt, Human
agaugccucccug

SEQ ID NO: 3570925 - RNA, 21 nt, Human
agaugccucccugacccugca

SEQ ID NO: 3570926 - RNA, 15 nt, Human
agaugccugaagcca

SEQ ID NO: 3570927 - RNA, 11 nt, Human
agaugccuggg

SEQ ID NO: 3570928 - RNA, 22 nt, Human
agaugccuuuuuuguaguuuuu

SEQ ID NO: 3570929 - RNA, 22 nt, Human
agaugcgagcgcuaucuucaca

SEQ ID NO: 3570930 - RNA, 20 nt, Human
agaugcgcagccccaucugu

SEQ ID NO: 3570931 - RNA, 19 nt, Human
agaugcuagcacaugcccu

SEQ ID NO: 3570932 - RNA, 21 nt, Human
agaugcucagguacagagaag

SEQ ID NO: 3570933 - RNA, 21 nt, Human
agaugcuccaagauucuagau

SEQ ID NO: 3570934 - RNA, 17 nt, Human
agaugcucuaucuugcu

SEQ ID NO: 3570935 - RNA, 21 nt, Human
agaugcucuaucuugcucugu

SEQ ID NO: 3570936 - RNA, 23 nt, Human
agaugcucuaucuugcucuguaa

SEQ ID NO: 3570937 - RNA, 16 nt, Human
agaugcugaaaauguc

SEQ ID NO: 3570938 - RNA, 22 nt, Human
agaugcugaaacaggagagaaa

SEQ ID NO: 3570939 - RNA, 20 nt, Human
agaugcugacuguacuccuc

SEQ ID NO: 3570940 - RNA, 22 nt, Human
agaugcugacuguacuccuccc

SEQ ID NO: 3570941 - RNA, 16 nt, Human
agaugcugauguucag

SEQ ID NO: 3570942 - RNA, 17 nt, Human
agaugcuggagaagaga

SEQ ID NO: 3570943 - RNA, 21 nt, Human
agaugcuggagaagagaggag

SEQ ID NO: 3570944 - RNA, 14 nt, Human
agaugcuggcccag

SEQ ID NO: 3570945 - RNA, 17 nt, Human
agaugcuggcuugggca

SEQ ID NO: 3570946 - RNA, 13 nt, Human
agaugcuggguug

SEQ ID NO: 3570947 - RNA, 23 nt, Human
agaugcuggguuggugcacagug

SEQ ID NO: 3570948 - RNA, 19 nt, Human
agaugcuuuccuaaaucag

SEQ ID NO: 3570949 - RNA, 18 nt, Human
agaugcuuuuaacagagu

SEQ ID NO: 3570950 - RNA, 17 nt, Human
agaugcuuuuugaucua

SEQ ID NO: 3570951 - RNA, 20 nt, Human
agauggaaaaaccaccccca

SEQ ID NO: 3570952 - RNA, 18 nt, Human
agauggaaaauucauuuu

SEQ ID NO: 3570953 - RNA, 10 nt, Human
agauggaaag

SEQ ID NO: 3570954 - RNA, 18 nt, Human
agauggaaccgcaggaag

SEQ ID NO: 3570955 - RNA, 13 nt, Human
agauggaaugcug

SEQ ID NO: 3570956 - RNA, 16 nt, Human
agauggaggaggaggc

SEQ ID NO: 3570957 - RNA, 13 nt, Human
agauggagucccu

SEQ ID NO: 3570958 - RNA, 14 nt, Human
agauggaguuucua

SEQ ID NO: 3570959 - RNA, 16 nt, Human
agauggauucucagau

SEQ ID NO: 3570960 - RNA, 20 nt, Human
agauggauucucagauauuu

SEQ ID NO: 3570961 - RNA, 23 nt, Human
agauggauucuccacucaguugc

SEQ ID NO: 3570962 - RNA, 15 nt, Human
agauggauuugccug

SEQ ID NO: 3570963 - RNA, 16 nt, Human
agauggcacagggcau

SEQ ID NO: 3570964 - RNA, 23 nt, Human
agauggcacagggcaugaaauga

SEQ ID NO: 3570965 - RNA, 14 nt, Human
agauggcacuuuga

SEQ ID NO: 3570966 - RNA, 12 nt, Human
agauggcagcuu

SEQ ID NO: 3570967 - RNA, 13 nt, Human
agauggcagcuuu

SEQ ID NO: 3570968 - RNA, 20 nt, Human
agauggcaucaaaaaagaua

SEQ ID NO: 3570969 - RNA, 21 nt, Human
agauggcccggaugcugcuuc

SEQ ID NO: 3570970 - RNA, 22 nt, Human
agauggccucuuacuaauguaa

SEQ ID NO: 3570971 - RNA, 20 nt, Human
agauggcgagcauccuggcc

SEQ ID NO: 3570972 - RNA, 23 nt, Human
agauggcucccaggggcucccuc

SEQ ID NO: 3570973 - RNA, 21 nt, Human
agauggcuggaagggguccag

SEQ ID NO: 3570974 - RNA, 17 nt, Human
agauggcugugccucug

SEQ ID NO: 3570975 - RNA, 18 nt, Human
agauggcugugccucugc

SEQ ID NO: 3570976 - RNA, 17 nt, Human
agaugggaaugaagcuu

SEQ ID NO: 3570977 - RNA, 18 nt, Human
agaugggagcuccucucc

SEQ ID NO: 3570978 - RNA, 23 nt, Human
agaugggagcuccucuccuggag

SEQ ID NO: 3570979 - RNA, 16 nt, Human
agaugggaugcuugcc

SEQ ID NO: 3570980 - RNA, 18 nt, Human
agaugggcaucuuuugua

SEQ ID NO: 3570981 - RNA, 21 nt, Human
agaugggcaucuuuuguauua

SEQ ID NO: 3570982 - RNA, 22 nt, Human
agaugggcaucuuuuguauuaa

SEQ ID NO: 3570983 - RNA, 18 nt, Human
agaugggcuuguuuucuu

SEQ ID NO: 3570984 - RNA, 19 nt, Human
agauggggaccagcagccc

SEQ ID NO: 3570985 - RNA, 19 nt, Human
agauggggauaaaaugacu

SEQ ID NO: 3570986 - RNA, 16 nt, Human
agaugggggcaagaag

SEQ ID NO: 3570987 - RNA, 15 nt, Human
agaugggggccucuu

SEQ ID NO: 3570988 - RNA, 18 nt, Human
agauggggucuguaaaau

SEQ ID NO: 3570989 - RNA, 21 nt, Human
agaugggugaaggcuggcaug

SEQ ID NO: 3570990 - RNA, 20 nt, Human
agaugggugcuuggaggaag

SEQ ID NO: 3570991 - RNA, 22 nt, Human
agauggguggaucacuugaggu

SEQ ID NO: 3570992 - RNA, 19 nt, Human
agaugguauauuugguacu

SEQ ID NO: 3570993 - RNA, 19 nt, Human
agauggucacgcaccuggg

SEQ ID NO: 3570994 - RNA, 22 nt, Human
agauggucauauuuaaacagaa

SEQ ID NO: 3570995 - RNA, 14 nt, Human
agaugguggcagua

SEQ ID NO: 3570996 - RNA, 18 nt, Human
agaugguuaaacauuuuc

SEQ ID NO: 3570997 - RNA, 14 nt, Human
agaugguuacacug

SEQ ID NO: 3570998 - RNA, 19 nt, Human
agaugguuacacuguuaga

SEQ ID NO: 3570999 - RNA, 18 nt, Human
agaugguuugagccugag

SEQ ID NO: 3571000 - RNA, 13 nt, Human
agacaauuugaua

SEQ ID NO: 3571001 - RNA, 15 nt, Human
agacacaacaacucc

SEQ ID NO: 3571002 - RNA, 14 nt, Human
agacacaagccuuc

SEQ ID NO: 3571003 - RNA, 22 nt, Human
agacacacacacgcacgcacac

SEQ ID NO: 3571004 - RNA, 15 nt, Human
agacacacaugaagu

SEQ ID NO: 3571005 - RNA, 13 nt, Human
agacacaccugag

SEQ ID NO: 3571006 - RNA, 17 nt, Human
agacacacgcacacaca

SEQ ID NO: 3571007 - RNA, 20 nt, Human
agacacacuaucauaguuaa

SEQ ID NO: 3571008 - RNA, 17 nt, Human
agacacacugaagaagc

SEQ ID NO: 3571009 - RNA, 18 nt, Human
agacacagcgucccuagc

SEQ ID NO: 3571010 - RNA, 20 nt, Human
agacacaggcccggcuccag

SEQ ID NO: 3571011 - RNA, 19 nt, Human
agacacagggacuugaagu

SEQ ID NO: 3571012 - RNA, 22 nt, Human
agacacagggacuugaaguugu

SEQ ID NO: 3571013 - RNA, 21 nt, Human
agacacauacaugucacauuu

SEQ ID NO: 3571014 - RNA, 14 nt, Human
agacacauaugagg

SEQ ID NO: 3571015 - RNA, 17 nt, Human
agacacauccagcaauu

SEQ ID NO: 3571016 - RNA, 13 nt, Human
agacacaugaagg

SEQ ID NO: 3571017 - RNA, 19 nt, Human
agacacaugaagguaaaua

SEQ ID NO: 3571018 - RNA, 21 nt, Human
agacacauguccaagaagccc

SEQ ID NO: 3571019 - RNA, 17 nt, Human
agacacauuuuuuagga

SEQ ID NO: 3571020 - RNA, 13 nt, Human
agacaccaaaguu

SEQ ID NO: 3571021 - RNA, 14 nt, Human
agacaccaaaguuc

SEQ ID NO: 3571022 - RNA, 20 nt, Human
agacaccagagcagaugcag

SEQ ID NO: 3571023 - RNA, 12 nt, Human
agacacccagga

SEQ ID NO: 3571024 - RNA, 16 nt, Human
agacacccaggacuua

SEQ ID NO: 3571025 - RNA, 18 nt, Human
agacacccuaauguggca

SEQ ID NO: 3571026 - RNA, 15 nt, Human
agacacccuggcagc

SEQ ID NO: 3571027 - RNA, 18 nt, Human
agacacccuuggagcucu

SEQ ID NO: 3571028 - RNA, 12 nt, Human
agacaccuucau

SEQ ID NO: 3571029 - RNA, 22 nt, Human
agacaccuugacagggcacacc

SEQ ID NO: 3571030 - RNA, 13 nt, Human
agacacgcacggc

SEQ ID NO: 3571031 - RNA, 15 nt, Human
agacacgcacggcag

SEQ ID NO: 3571032 - RNA, 18 nt, Human
agacacgccuuccccuca

SEQ ID NO: 3571033 - RNA, 18 nt, Human
agacacggaucugagaau

SEQ ID NO: 3571034 - RNA, 22 nt, Human
agacacuaacgacuucagggca

SEQ ID NO: 3571035 - RNA, 15 nt, Human
agacacuaaguuaua

SEQ ID NO: 3571036 - RNA, 22 nt, Human
agacacuccccgaagucuuuug

SEQ ID NO: 3571037 - RNA, 23 nt, Human
agacacuccccgaagucuuuugu

SEQ ID NO: 3571038 - RNA, 12 nt, Human
agacacucugcu

SEQ ID NO: 3571039 - RNA, 18 nt, Human
agacacucugcucugccc

SEQ ID NO: 3571040 - RNA, 21 nt, Human
agacacugaaauauacacaca

SEQ ID NO: 3571041 - RNA, 16 nt, Human
agacacugccugggcu

SEQ ID NO: 3571042 - RNA, 13 nt, Human
agacacuggcccc

SEQ ID NO: 3571043 - RNA, 18 nt, Human
agacacugguuuacacuu

SEQ ID NO: 3571044 - RNA, 14 nt, Human
agacacuguugaua

SEQ ID NO: 3571045 - RNA, 17 nt, Human
agacacuguugauaaaa

SEQ ID NO: 3571046 - RNA, 18 nt, Human
agacacuguugauaaaaa

SEQ ID NO: 3571047 - RNA, 19 nt, Human
agacacuguuuacaagaaa

SEQ ID NO: 3571048 - RNA, 13 nt, Human
agacacuugccuu

SEQ ID NO: 3571049 - RNA, 15 nt, Human
agacacuugccuucu

SEQ ID NO: 3571050 - RNA, 22 nt, Human
agacacuuuuucuuuacaaaca

SEQ ID NO: 3571051 - RNA, 18 nt, Human
agacagaacaccuaugca

SEQ ID NO: 3571052 - RNA, 19 nt, Human
agacagaaccacagggcua

SEQ ID NO: 3571053 - RNA, 17 nt, Human
agacagaaccccuacau

SEQ ID NO: 3571054 - RNA, 15 nt, Human
agacagaagaaacaa

SEQ ID NO: 3571055 - RNA, 16 nt, Human
agacagaagaaacaag

SEQ ID NO: 3571056 - RNA, 14 nt, Human
agacagaauguauc

SEQ ID NO: 3571057 - RNA, 19 nt, Human
agacagaauguaucuguga

SEQ ID NO: 3571058 - RNA, 21 nt, Human
agacagaauguaucugugaag

SEQ ID NO: 3571059 - RNA, 21 nt, Human
agacagagaauaugucugcuc

SEQ ID NO: 3571060 - RNA, 23 nt, Human
agacagagaauaugucugcuccu

SEQ ID NO: 3571061 - RNA, 19 nt, Human
agacagagacccucugcca

SEQ ID NO: 3571062 - RNA, 19 nt, Human
agacagagaccuccugccu

SEQ ID NO: 3571063 - RNA, 20 nt, Human
agacagagcaaccccuggac

SEQ ID NO: 3571064 - RNA, 21 nt, Human
agacagagcugguugggaaga

SEQ ID NO: 3571065 - RNA, 17 nt, Human
agacagagggucacagu

SEQ ID NO: 3571066 - RNA, 21 nt, Human
agacagagucucacuguugcc

SEQ ID NO: 3571067 - RNA, 14 nt, Human
agacagaugcccca

SEQ ID NO: 3571068 - RNA, 14 nt, Human
agacagcagcucag

SEQ ID NO: 3571069 - RNA, 18 nt, Human
agacagcaggcagcgcca

SEQ ID NO: 3571070 - RNA, 20 nt, Human
agacagcauuuguguguuac

SEQ ID NO: 3571071 - RNA, 18 nt, Human
agacagccaaaggcuggc

SEQ ID NO: 3571072 - RNA, 19 nt, Human
agacagccaaaggcuggcg

SEQ ID NO: 3571073 - RNA, 17 nt, Human
agacagcccaggauacu

SEQ ID NO: 3571074 - RNA, 22 nt, Human
agacagcccaggauacuggcac

SEQ ID NO: 3571075 - RNA, 13 nt, Human
agacagccccaga

SEQ ID NO: 3571076 - RNA, 14 nt, Human
agacagcccgggcu

SEQ ID NO: 3571077 - RNA, 20 nt, Human
agacagcccgggcucugccu

SEQ ID NO: 3571078 - RNA, 22 nt, Human
agacagcccgggcucugccucc

SEQ ID NO: 3571079 - RNA, 18 nt, Human
agacagcucccucugccu

SEQ ID NO: 3571080 - RNA, 12 nt, Human
agacagcucuua

SEQ ID NO: 3571081 - RNA, 12 nt, Human
agacagcugccu

SEQ ID NO: 3571082 - RNA, 13 nt, Human
agacagcugccug

SEQ ID NO: 3571083 - RNA, 14 nt, Human
agacaggaaaggga

SEQ ID NO: 3571084 - RNA, 16 nt, Human
agacaggaccagggau

SEQ ID NO: 3571085 - RNA, 18 nt, Human
agacaggcccaagagaug

SEQ ID NO: 3571086 - RNA, 22 nt, Human
agacaggcuggaagauagcugu

SEQ ID NO: 3571087 - RNA, 21 nt, Human
agacagggaauuaggccccca

SEQ ID NO: 3571088 - RNA, 22 nt, Human
agacagggaauuaggcccccau

SEQ ID NO: 3571089 - RNA, 17 nt, Human
agacaggguccugcuau

SEQ ID NO: 3571090 - RNA, 19 nt, Human
agacaggguuucaccaugu

SEQ ID NO: 3571091 - RNA, 22 nt, Human
agacaggguuuggcugugucua

SEQ ID NO: 3571092 - RNA, 15 nt, Human
agacaguauauuuau

SEQ ID NO: 3571093 - RNA, 17 nt, Human
agacaguauauuuauag

SEQ ID NO: 3571094 - RNA, 12 nt, Human
agacaguaugag

SEQ ID NO: 3571095 - RNA, 22 nt, Human
agacaguaugagucaaugugca

SEQ ID NO: 3571096 - RNA, 12 nt, Human
agacagucccug

SEQ ID NO: 3571097 - RNA, 19 nt, Human
agacagucccugccaaugg

SEQ ID NO: 3571098 - RNA, 12 nt, Human
agacagucuugc

SEQ ID NO: 3571099 - RNA, 14 nt, Human
agacagugaauuug

SEQ ID NO: 3571100 - RNA, 13 nt, Human
agacagugauauu

SEQ ID NO: 3571101 - RNA, 15 nt, Human
agacagugaucucca

SEQ ID NO: 3571102 - RNA, 21 nt, Human
agacagugaucuccauauguu

SEQ ID NO: 3571103 - RNA, 15 nt, Human
agacagugcacauga

SEQ ID NO: 3571104 - RNA, 17 nt, Human
agacagugcacaugaac

SEQ ID NO: 3571105 - RNA, 22 nt, Human
agacagugccuauacugccucu

SEQ ID NO: 3571106 - RNA, 15 nt, Human
agacagugggaaaua

SEQ ID NO: 3571107 - RNA, 15 nt, Human
agacaguuucuuagc

SEQ ID NO: 3571108 - RNA, 14 nt, Human
agacaguuuguaaa

SEQ ID NO: 3571109 - RNA, 19 nt, Human
agacaguuuguaaauguua

SEQ ID NO: 3571110 - RNA, 20 nt, Human
agacaguuuugagaacguaa

SEQ ID NO: 3571111 - RNA, 11 nt, Human
agacauaaagc

SEQ ID NO: 3571112 - RNA, 12 nt, Human
agacauaaagcc

SEQ ID NO: 3571113 - RNA, 13 nt, Human
agacauaaagcca

SEQ ID NO: 3571114 - RNA, 15 nt, Human
agacauaaaggaaaa

SEQ ID NO: 3571115 - RNA, 14 nt, Human
agacauaacguuuu

SEQ ID NO: 3571116 - RNA, 19 nt, Human
agacauacuaaccagcaga

SEQ ID NO: 3571117 - RNA, 22 nt, Human
agacauacuccuuccaucaaau

SEQ ID NO: 3571118 - RNA, 17 nt, Human
agacauacuugaagggc

SEQ ID NO: 3571119 - RNA, 14 nt, Human
agacauagaauuaa

SEQ ID NO: 3571120 - RNA, 16 nt, Human
agacauagcauccaag

SEQ ID NO: 3571121 - RNA, 22 nt, Human
agacauagcauccaaguggcau

SEQ ID NO: 3571122 - RNA, 16 nt, Human
agacauauuuaacugg

SEQ ID NO: 3571123 - RNA, 14 nt, Human
agacauauuuacaa

SEQ ID NO: 3571124 - RNA, 17 nt, Human
agacaucaacagauaaa

SEQ ID NO: 3571125 - RNA, 17 nt, Human
agacaucaagcacagaa

SEQ ID NO: 3571126 - RNA, 20 nt, Human
agacaucaagcacagaagga

SEQ ID NO: 3571127 - RNA, 19 nt, Human
agacauccauaaagaagca

SEQ ID NO: 3571128 - RNA, 17 nt, Human
agacauccauguuugua

SEQ ID NO: 3571129 - RNA, 18 nt, Human
agacauccauguuuguaa

SEQ ID NO: 3571130 - RNA, 13 nt, Human
agacaugaagcca

SEQ ID NO: 3571131 - RNA, 20 nt, Human
agacaugagugcgugcucag

SEQ ID NO: 3571132 - RNA, 15 nt, Human
agacaugcagagauu

SEQ ID NO: 3571133 - RNA, 23 nt, Human
acuguuaccugaucaaugacaga

SEQ ID NO: 3571134 - RNA, 14 nt, Human
acuguuagaacacu

SEQ ID NO: 3571135 - RNA, 13 nt, Human
acuguuagcacug

SEQ ID NO: 3571136 - RNA, 20 nt, Human
acuguuagcuuuuuaaaaca

SEQ ID NO: 3571137 - RNA, 21 nt, Human
acuguuagcuuuuuaaaacau

SEQ ID NO: 3571138 - RNA, 14 nt, Human
acuguuaucauuuu

SEQ ID NO: 3571139 - RNA, 19 nt, Human
acuguuaugaaauaaagaa

SEQ ID NO: 3571140 - RNA, 13 nt, Human
acuguuauucuuu

SEQ ID NO: 3571141 - RNA, 15 nt, Human
acuguuauucuuugc

SEQ ID NO: 3571142 - RNA, 16 nt, Human
acuguuauucuuugca

SEQ ID NO: 3571143 - RNA, 18 nt, Human
acuguuauucuuugcacu

SEQ ID NO: 3571144 - RNA, 19 nt, Human
acuguuauuuucagcauga

SEQ ID NO: 3571145 - RNA, 13 nt, Human
acuguucaagagc

SEQ ID NO: 3571146 - RNA, 15 nt, Human
acuguucaagagcac

SEQ ID NO: 3571147 - RNA, 16 nt, Human
acuguucacucacucu

SEQ ID NO: 3571148 - RNA, 22 nt, Human
acuguucagcuguccucccucc

SEQ ID NO: 3571149 - RNA, 17 nt, Human
acuguucagcuuuuauu

SEQ ID NO: 3571150 - RNA, 17 nt, Human
acuguucuaaagcucug

SEQ ID NO: 3571151 - RNA, 21 nt, Human
acuguucuaaagcucugacau

SEQ ID NO: 3571152 - RNA, 17 nt, Human
acuguucucugcccucc

SEQ ID NO: 3571153 - RNA, 21 nt, Human
acuguucucugcccuccaaga

SEQ ID NO: 3571154 - RNA, 18 nt, Human
acuguucucuucuugaac

SEQ ID NO: 3571155 - RNA, 15 nt, Human
acuguucugugucuu

SEQ ID NO: 3571156 - RNA, 19 nt, Human
acuguucuuagcucaauga

SEQ ID NO: 3571157 - RNA, 18 nt, Human
acuguucuucauuuuauu

SEQ ID NO: 3571158 - RNA, 23 nt, Human
acuguugaaaauuauuuuaaaca

SEQ ID NO: 3571159 - RNA, 14 nt, Human
acuguugauaauuc

SEQ ID NO: 3571160 - RNA, 18 nt, Human
acuguugauaauucuuau

SEQ ID NO: 3571161 - RNA, 19 nt, Human
acuguugauaauucuuauu

SEQ ID NO: 3571162 - RNA, 17 nt, Human
acuguugauguaucuga

SEQ ID NO: 3571163 - RNA, 11 nt, Human
acuguugcacg

SEQ ID NO: 3571164 - RNA, 14 nt, Human
acuguugcacgugu

SEQ ID NO: 3571165 - RNA, 18 nt, Human
acuguugcccaggcuggc

SEQ ID NO: 3571166 - RNA, 21 nt, Human
acuguugcucaaaucuauuca

SEQ ID NO: 3571167 - RNA, 14 nt, Human
acuguuguaagaau

SEQ ID NO: 3571168 - RNA, 19 nt, Human
acuguuguauaaauuuauu

SEQ ID NO: 3571169 - RNA, 17 nt, Human
acuguuguuaucuguuu

SEQ ID NO: 3571170 - RNA, 16 nt, Human
acuguuuaagacacuu

SEQ ID NO: 3571171 - RNA, 20 nt, Human
acuguuuaauguucugugau

SEQ ID NO: 3571172 - RNA, 14 nt, Human
acuguuuagaugaa

SEQ ID NO: 3571173 - RNA, 19 nt, Human
acuguuuauacacugugua

SEQ ID NO: 3571174 - RNA, 17 nt, Human
acuguuuauauguguug

SEQ ID NO: 3571175 - RNA, 14 nt, Human
acuguuuauuacuu

SEQ ID NO: 3571176 - RNA, 18 nt, Human
acuguuucaaacuuuacu

SEQ ID NO: 3571177 - RNA, 15 nt, Human
acuguuucucugcug

SEQ ID NO: 3571178 - RNA, 19 nt, Human
acuguuucucuugagcugg

SEQ ID NO: 3571179 - RNA, 22 nt, Human
acuguuucucuugagcuggccu

SEQ ID NO: 3571180 - RNA, 16 nt, Human
acuguuucugucagga

SEQ ID NO: 3571181 - RNA, 14 nt, Human
acuguuucuuuaaa

SEQ ID NO: 3571182 - RNA, 23 nt, Human
acuguuugagguuuuuaagccuu

SEQ ID NO: 3571183 - RNA, 22 nt, Human
acuguuugauauaccaaauuaa

SEQ ID NO: 3571184 - RNA, 21 nt, Human
acuguuugucuucuccccagg

SEQ ID NO: 3571185 - RNA, 22 nt, Human
acuguuuguuccagaaucugua

SEQ ID NO: 3571186 - RNA, 24 nt, Human
acuguuuuaauuuauacuggcaug

SEQ ID NO: 3571187 - RNA, 14 nt, Human
acuguuuuaucugg

SEQ ID NO: 3571188 - RNA, 24 nt, Human
acuguuuucuaguguaucaaaaug

SEQ ID NO: 3571189 - RNA, 23 nt, Human
acuguuuucucucggcuccccau

SEQ ID NO: 3571190 - RNA, 12 nt, Human
acuguuuuuacc

SEQ ID NO: 3571191 - RNA, 14 nt, Human
acuguuuuuaccca

SEQ ID NO: 3571192 - RNA, 21 nt, Human
acuguuuuuacccauaucccc

SEQ ID NO: 3571193 - RNA, 21 nt, Human
acuguuuuuccauaguuuuga

SEQ ID NO: 3571194 - RNA, 19 nt, Human
acuguuuuuuccugagcuu

SEQ ID NO: 3571195 - RNA, 14 nt, Human
acuuaaaaaaauga

SEQ ID NO: 3571196 - RNA, 15 nt, Human
acuuaaaaaaaugac

SEQ ID NO: 3571197 - RNA, 23 nt, Human
acuuaaaaaacuuguaaaugcug

SEQ ID NO: 3571198 - RNA, 14 nt, Human
acuuaaaaaauguc

SEQ ID NO: 3571199 - RNA, 13 nt, Human
acuuaaaaagucu

SEQ ID NO: 3571200 - RNA, 14 nt, Human
acuuaaaaauguaa

SEQ ID NO: 3571201 - RNA, 19 nt, Human
acuuaaaaauguaaauauu

SEQ ID NO: 3571202 - RNA, 14 nt, Human
acuuaaaacacguu

SEQ ID NO: 3571203 - RNA, 18 nt, Human
acuuaaaacacguuuuaa

SEQ ID NO: 3571204 - RNA, 15 nt, Human
acuuaaagaaguauu

SEQ ID NO: 3571205 - RNA, 17 nt, Human
acuuaaaggcuguggua

SEQ ID NO: 3571206 - RNA, 19 nt, Human
acuuaaagggcccaaugaa

SEQ ID NO: 3571207 - RNA, 19 nt, Human
acuuaaauaaaugucauua

SEQ ID NO: 3571208 - RNA, 15 nt, Human
acuuaaauaauguga

SEQ ID NO: 3571209 - RNA, 16 nt, Human
acuuaaauaaugugaa

SEQ ID NO: 3571210 - RNA, 18 nt, Human
acuuaaauaaugugaaac

SEQ ID NO: 3571211 - RNA, 18 nt, Human
acuuaaauaucaaucauu

SEQ ID NO: 3571212 - RNA, 15 nt, Human
acuuaaauuccucaa

SEQ ID NO: 3571213 - RNA, 11 nt, Human
acuuaacaaac

SEQ ID NO: 3571214 - RNA, 20 nt, Human
acuuaacauagccaaaaugu

SEQ ID NO: 3571215 - RNA, 15 nt, Human
acuuaacauuccuaa

SEQ ID NO: 3571216 - RNA, 21 nt, Human
acuuaacauuccuaaaaugcu

SEQ ID NO: 3571217 - RNA, 18 nt, Human
acuuaaccgcaucagaag

SEQ ID NO: 3571218 - RNA, 16 nt, Human
acuuaaccggaguucg

SEQ ID NO: 3571219 - RNA, 15 nt, Human
acuuaacggcuccag

SEQ ID NO: 3571220 - RNA, 12 nt, Human
acuuaacuguuu

SEQ ID NO: 3571221 - RNA, 11 nt, Human
acuuaagacuu

SEQ ID NO: 3571222 - RNA, 13 nt, Human
acuuaagagaaua

SEQ ID NO: 3571223 - RNA, 14 nt, Human
acuuaagagaauau

SEQ ID NO: 3571224 - RNA, 19 nt, Human
acuuaagagaauauuuuaa

SEQ ID NO: 3571225 - RNA, 14 nt, Human
acuuaagcaaaaga

SEQ ID NO: 3571226 - RNA, 16 nt, Human
acuuaagcaaaagaaa

SEQ ID NO: 3571227 - RNA, 20 nt, Human
acuuaagcaucuggcucuaa

SEQ ID NO: 3571228 - RNA, 21 nt, Human
acuuaagcaucuggcucuaau

SEQ ID NO: 3571229 - RNA, 16 nt, Human
acuuaaggcauuuguu

SEQ ID NO: 3571230 - RNA, 13 nt, Human
acuuaauaacugu

SEQ ID NO: 3571231 - RNA, 17 nt, Human
acuuaauaacuguguac

SEQ ID NO: 3571232 - RNA, 15 nt, Human
acuuaauaaucaaga

SEQ ID NO: 3571233 - RNA, 23 nt, Human
acuuaauaaucaagagccuuaaa

SEQ ID NO: 3571234 - RNA, 17 nt, Human
acuuaauaauguguaca

SEQ ID NO: 3571235 - RNA, 14 nt, Human
acuuaauagaaaca

SEQ ID NO: 3571236 - RNA, 17 nt, Human
acuuaaucuaaauggaa

SEQ ID NO: 3571237 - RNA, 22 nt, Human
acuuaaucuaaauggaaccacu

SEQ ID NO: 3571238 - RNA, 13 nt, Human
acuuaauguaugu

SEQ ID NO: 3571239 - RNA, 14 nt, Human
acuuaauucuguuc

SEQ ID NO: 3571240 - RNA, 14 nt, Human
acuuaauugcuaca

SEQ ID NO: 3571241 - RNA, 16 nt, Human
agaaaaauauguacca

SEQ ID NO: 3571242 - RNA, 14 nt, Human
agaaaaaucauguu

SEQ ID NO: 3571243 - RNA, 23 nt, Human
agaaaaaucuugugcuagaauac

SEQ ID NO: 3571244 - RNA, 17 nt, Human
agaaaaaugagccuggc

SEQ ID NO: 3571245 - RNA, 21 nt, Human
agaaaacaaaaccaaaaguua

SEQ ID NO: 3571246 - RNA, 13 nt, Human
agaaaacaaaacu

SEQ ID NO: 3571247 - RNA, 21 nt, Human
agaaaacaaaacugcauuuca

SEQ ID NO: 3571248 - RNA, 13 nt, Human
agaaaacaaaauu

SEQ ID NO: 3571249 - RNA, 22 nt, Human
agaaaacaagcaaguucugaga

SEQ ID NO: 3571250 - RNA, 14 nt, Human
agaaaacaauggaa

SEQ ID NO: 3571251 - RNA, 18 nt, Human
agaaaacacuguuaucau

SEQ ID NO: 3571252 - RNA, 17 nt, Human
agaaaacacuuguaagu

SEQ ID NO: 3571253 - RNA, 19 nt, Human
agaaaacagaaaaaaaaca

SEQ ID NO: 3571254 - RNA, 20 nt, Human
agaaaacaggcacugcccug

SEQ ID NO: 3571255 - RNA, 20 nt, Human
agaaaacaugcagaacaaau

SEQ ID NO: 3571256 - RNA, 13 nt, Human
agaaaacauguuu

SEQ ID NO: 3571257 - RNA, 13 nt, Human
agaaaacauuguu

SEQ ID NO: 3571258 - RNA, 22 nt, Human
agaaaaccaaacaaaaauguua

SEQ ID NO: 3571259 - RNA, 13 nt, Human
agaaaaccacccc

SEQ ID NO: 3571260 - RNA, 15 nt, Human
agaaaaccaccccuu

SEQ ID NO: 3571261 - RNA, 16 nt, Human
agaaaaccagcucagc

SEQ ID NO: 3571262 - RNA, 14 nt, Human
agaaaacccacccc

SEQ ID NO: 3571263 - RNA, 19 nt, Human
agaaaacccuugggccaga

SEQ ID NO: 3571264 - RNA, 20 nt, Human
agaaaacccuugggccagaa

SEQ ID NO: 3571265 - RNA, 15 nt, Human
agaaaacugaaaauc

SEQ ID NO: 3571266 - RNA, 13 nt, Human
agaaaacugugau

SEQ ID NO: 3571267 - RNA, 16 nt, Human
agaaaacugugauuuc

SEQ ID NO: 3571268 - RNA, 22 nt, Human
agaaaacuugaauucauagaaa

SEQ ID NO: 3571269 - RNA, 21 nt, Human
agaaaacuuguauuaugugug

SEQ ID NO: 3571270 - RNA, 12 nt, Human
agaaaacuuugu

SEQ ID NO: 3571271 - RNA, 14 nt, Human
agaaaacuuuguua

SEQ ID NO: 3571272 - RNA, 13 nt, Human
agaaaagaaaaaa

SEQ ID NO: 3571273 - RNA, 17 nt, Human
agaaaagaaaaaaaaag

SEQ ID NO: 3571274 - RNA, 20 nt, Human
agaaaagaacguauuuuaaa

SEQ ID NO: 3571275 - RNA, 21 nt, Human
agaaaagaaucccuguucauu

SEQ ID NO: 3571276 - RNA, 9 nt, Human
agaaaagag

SEQ ID NO: 3571277 - RNA, 13 nt, Human
agaaaagagaaga

SEQ ID NO: 3571278 - RNA, 16 nt, Human
agaaaagagaagaaga

SEQ ID NO: 3571279 - RNA, 15 nt, Human
agaaaagauaaagau

SEQ ID NO: 3571280 - RNA, 13 nt, Human
agaaaagaugcac

SEQ ID NO: 3571281 - RNA, 18 nt, Human
agaaaagauuuuaaucaa

SEQ ID NO: 3571282 - RNA, 16 nt, Human
agaaaagcaccugccg

SEQ ID NO: 3571283 - RNA, 14 nt, Human
agaaaagcuuugaa

SEQ ID NO: 3571284 - RNA, 18 nt, Human
agaaaaggaaaagaaaaa

SEQ ID NO: 3571285 - RNA, 16 nt, Human
agaaaaggugauaaaa

SEQ ID NO: 3571286 - RNA, 15 nt, Human
agaaaaguagacaau

SEQ ID NO: 3571287 - RNA, 13 nt, Human
agaaaaguauuuu

SEQ ID NO: 3571288 - RNA, 16 nt, Human
agaaaaguauuuugaa

SEQ ID NO: 3571289 - RNA, 12 nt, Human
agaaaagugaau

SEQ ID NO: 3571290 - RNA, 15 nt, Human
agaaaagugaauuga

SEQ ID NO: 3571291 - RNA, 11 nt, Human
agaaaaguuau

SEQ ID NO: 3571292 - RNA, 18 nt, Human
agaaaaguugaauuuuac

SEQ ID NO: 3571293 - RNA, 15 nt, Human
agaaaaguuuauaaa

SEQ ID NO: 3571294 - RNA, 17 nt, Human
agaaaauaaaaaaaaga

SEQ ID NO: 3571295 - RNA, 19 nt, Human
agaaaauaaaaaaaagaaa

SEQ ID NO: 3571296 - RNA, 14 nt, Human
agaaaauaaaaagu

SEQ ID NO: 3571297 - RNA, 16 nt, Human
agaaaauaaaaaguua

SEQ ID NO: 3571298 - RNA, 13 nt, Human
agaaaauaaaauu

SEQ ID NO: 3571299 - RNA, 16 nt, Human
agaaaauaaagacaac

SEQ ID NO: 3571300 - RNA, 22 nt, Human
agaaaauaaggcacccaucugu

SEQ ID NO: 3571301 - RNA, 17 nt, Human
agaaaauaaucauucuu

SEQ ID NO: 3571302 - RNA, 15 nt, Human
agaaaauaccaagga

SEQ ID NO: 3571303 - RNA, 17 nt, Human
agaaaauacuuaaaugu

SEQ ID NO: 3571304 - RNA, 12 nt, Human
agaaaauauacu

SEQ ID NO: 3571305 - RNA, 14 nt, Human
agaaaauauucucu

SEQ ID NO: 3571306 - RNA, 16 nt, Human
agaaaauauuuugucu

SEQ ID NO: 3571307 - RNA, 22 nt, Human
agaaaauauuuugucuaaaaug

SEQ ID NO: 3571308 - RNA, 16 nt, Human
agaaaaucaggcuggc

SEQ ID NO: 3571309 - RNA, 19 nt, Human
agaaaaucauauugcuucu

SEQ ID NO: 3571310 - RNA, 19 nt, Human
agaaaaucaucaagaaggg

SEQ ID NO: 3571311 - RNA, 19 nt, Human
agaaaauggaaccaggcuu

SEQ ID NO: 3571312 - RNA, 20 nt, Human
agaaaauggaaccaggcuug

SEQ ID NO: 3571313 - RNA, 15 nt, Human
agaaaauggacacug

SEQ ID NO: 3571314 - RNA, 20 nt, Human
agaaaauggacguguuauga

SEQ ID NO: 3571315 - RNA, 23 nt, Human
agaaaauggacguguuaugacuc

SEQ ID NO: 3571316 - RNA, 20 nt, Human
agaaaaugguuuauuuugua

SEQ ID NO: 3571317 - RNA, 14 nt, Human
agaaaauguucugu

SEQ ID NO: 3571318 - RNA, 18 nt, Human
agaaaauguucuguuugc

SEQ ID NO: 3571319 - RNA, 19 nt, Human
agaaaauuccuauaaggaa

SEQ ID NO: 3571320 - RNA, 13 nt, Human
agaaaauugaauu

SEQ ID NO: 3571321 - RNA, 13 nt, Human
agaaacaaacauc

SEQ ID NO: 3571322 - RNA, 12 nt, Human
agaaacaaaccc

SEQ ID NO: 3571323 - RNA, 13 nt, Human
agaaacaaacuuu

SEQ ID NO: 3571324 - RNA, 14 nt, Human
agaaacaacacugu

SEQ ID NO: 3571325 - RNA, 18 nt, Human
agaaacaagguuuucagu

SEQ ID NO: 3571326 - RNA, 14 nt, Human
agaaacaaugaaug

SEQ ID NO: 3571327 - RNA, 13 nt, Human
agaaacaauuucu

SEQ ID NO: 3571328 - RNA, 14 nt, Human
agaaacaauuucug

SEQ ID NO: 3571329 - RNA, 15 nt, Human
agaaacacacugagg

SEQ ID NO: 3571330 - RNA, 19 nt, Human
agaaacacacugaggcagg

SEQ ID NO: 3571331 - RNA, 17 nt, Human
agaaacaggguguuguc

SEQ ID NO: 3571332 - RNA, 22 nt, Human
agaaacauaaauaaaaugacca

SEQ ID NO: 3571333 - RNA, 14 nt, Human
agaaacaucaguua

SEQ ID NO: 3571334 - RNA, 12 nt, Human
acuguguaaacu

SEQ ID NO: 3571335 - RNA, 13 nt, Human
acuguguaacugc

SEQ ID NO: 3571336 - RNA, 21 nt, Human
acuguguaagggccagaaaua

SEQ ID NO: 3571337 - RNA, 15 nt, Human
acuguguaauauaaa

SEQ ID NO: 3571338 - RNA, 21 nt, Human
acuguguaauauaaaagaucu

SEQ ID NO: 3571339 - RNA, 22 nt, Human
acuguguaauauaaaagaucuu

SEQ ID NO: 3571340 - RNA, 13 nt, Human
acuguguaauuag

SEQ ID NO: 3571341 - RNA, 12 nt, Human
acuguguacaua

SEQ ID NO: 3571342 - RNA, 14 nt, Human
acuguguacauaau

SEQ ID NO: 3571343 - RNA, 13 nt, Human
acuguguauauuu

SEQ ID NO: 3571344 - RNA, 15 nt, Human
acuguguauauuuga

SEQ ID NO: 3571345 - RNA, 16 nt, Human
acuguguauauuugau

SEQ ID NO: 3571346 - RNA, 16 nt, Human
acuguguauuccaaga

SEQ ID NO: 3571347 - RNA, 18 nt, Human
acugugucauaaacagau

SEQ ID NO: 3571348 - RNA, 16 nt, Human
acuguguccuggugcu

SEQ ID NO: 3571349 - RNA, 19 nt, Human
acugugugcagacucaaua

SEQ ID NO: 3571350 - RNA, 15 nt, Human
acugugugcucagga

SEQ ID NO: 3571351 - RNA, 13 nt, Human
acuguguggaacu

SEQ ID NO: 3571352 - RNA, 14 nt, Human
acugugugugcccu

SEQ ID NO: 3571353 - RNA, 17 nt, Human
acugugugugcccucug

SEQ ID NO: 3571354 - RNA, 14 nt, Human
acuguguguugcca

SEQ ID NO: 3571355 - RNA, 20 nt, Human
acuguguguugccacaggac

SEQ ID NO: 3571356 - RNA, 16 nt, Human
acuguguuaugcaaaa

SEQ ID NO: 3571357 - RNA, 21 nt, Human
acuguguuaugcaaaagcaag

SEQ ID NO: 3571358 - RNA, 14 nt, Human
acuguguucauuag

SEQ ID NO: 3571359 - RNA, 21 nt, Human
acuguguuguaccaaaauuca

SEQ ID NO: 3571360 - RNA, 15 nt, Human
acuguguuguauuaa

SEQ ID NO: 3571361 - RNA, 20 nt, Human
acuguguuguauuaacaaaa

SEQ ID NO: 3571362 - RNA, 14 nt, Human
acuguguuucaagu

SEQ ID NO: 3571363 - RNA, 18 nt, Human
acuguguuucaaguucaa

SEQ ID NO: 3571364 - RNA, 18 nt, Human
acuguguuuuauaaaaua

SEQ ID NO: 3571365 - RNA, 19 nt, Human
acuguguuuuauaaaauag

SEQ ID NO: 3571366 - RNA, 17 nt, Human
acuguuaauaguucagg

SEQ ID NO: 3571367 - RNA, 19 nt, Human
acuguuaccauuggaaauu

SEQ ID NO: 3571368 - RNA, 22 nt, Human
acuguuaccauuggaaauuuca

SEQ ID NO: 3571369 - RNA, 21 nt, Human
acuguuaccugaucaaugaca

SEQ ID NO: 3571370 - RNA, 19 nt, Human
acuuagcuuaucaauuugu

SEQ ID NO: 3571371 - RNA, 21 nt, Human
acuuagcuuaucaauuuguca

SEQ ID NO: 3571372 - RNA, 18 nt, Human
acuuaggcccuagcggca

SEQ ID NO: 3571373 - RNA, 16 nt, Human
acuuagggcaccaggg

SEQ ID NO: 3571374 - RNA, 17 nt, Human
acuuaggguuuggagcu

SEQ ID NO: 3571375 - RNA, 20 nt, Human
acuuaguacaaaguuucaau

SEQ ID NO: 3571376 - RNA, 17 nt, Human
acuuaguauauuuucuu

SEQ ID NO: 3571377 - RNA, 20 nt, Human
acuuaguauugcaaagucag

SEQ ID NO: 3571378 - RNA, 18 nt, Human
acuuagugacaaaauaga

SEQ ID NO: 3571379 - RNA, 15 nt, Human
acuuaguuugugaau

SEQ ID NO: 3571380 - RNA, 17 nt, Human
acuuaguuuugcauagu

SEQ ID NO: 3571381 - RNA, 20 nt, Human
acuuauaaaucauauugaug

SEQ ID NO: 3571382 - RNA, 14 nt, Human
acuuauagccucug

SEQ ID NO: 3571383 - RNA, 15 nt, Human
acuuauagccucugu

SEQ ID NO: 3571384 - RNA, 14 nt, Human
acuuauaguacaug

SEQ ID NO: 3571385 - RNA, 18 nt, Human
acuuauaguacaugauaa

SEQ ID NO: 3571386 - RNA, 16 nt, Human
acuuauauuaauagua

SEQ ID NO: 3571387 - RNA, 22 nt, Human
acuuauauuaauaguaauuugu

SEQ ID NO: 3571388 - RNA, 16 nt, Human
acuuauauugaagaca

SEQ ID NO: 3571389 - RNA, 18 nt, Human
acuuauauuguaagaaau

SEQ ID NO: 3571390 - RNA, 21 nt, Human
acuuauauuguaagaaauacu

SEQ ID NO: 3571391 - RNA, 15 nt, Human
acuuauauuucccua

SEQ ID NO: 3571392 - RNA, 15 nt, Human
acuuauauuuucgua

SEQ ID NO: 3571393 - RNA, 21 nt, Human
acuuauauuuucguaugaaaa

SEQ ID NO: 3571394 - RNA, 19 nt, Human
acuuaucauccacauuguu

SEQ ID NO: 3571395 - RNA, 15 nt, Human
acuuaucccucucca

SEQ ID NO: 3571396 - RNA, 17 nt, Human
acuuaucccugcccauu

SEQ ID NO: 3571397 - RNA, 16 nt, Human
acuuaucugaucagaa

SEQ ID NO: 3571398 - RNA, 20 nt, Human
acuuaugaaugauuugcaua

SEQ ID NO: 3571399 - RNA, 17 nt, Human
acuuaugaauguuuccg

SEQ ID NO: 3571400 - RNA, 23 nt, Human
acuuaugaccucuuccuuuagga

SEQ ID NO: 3571401 - RNA, 15 nt, Human
acuuauguagauauu

SEQ ID NO: 3571402 - RNA, 23 nt, Human
acuuauguuacugguguccagcu

SEQ ID NO: 3571403 - RNA, 15 nt, Human
acuuauguuuuuaaa

SEQ ID NO: 3571404 - RNA, 11 nt, Human
acuuauuaaau

SEQ ID NO: 3571405 - RNA, 13 nt, Human
acuuauuacaauu

SEQ ID NO: 3571406 - RNA, 16 nt, Human
acuuauuacugcuaag

SEQ ID NO: 3571407 - RNA, 19 nt, Human
acuuauuacugcuaaguau

SEQ ID NO: 3571408 - RNA, 17 nt, Human
acuuauucaaagagaaa

SEQ ID NO: 3571409 - RNA, 15 nt, Human
acuuauugaauauau

SEQ ID NO: 3571410 - RNA, 17 nt, Human
acuuauugaauauauga

SEQ ID NO: 3571411 - RNA, 15 nt, Human
acuuauugaccauuu

SEQ ID NO: 3571412 - RNA, 18 nt, Human
acuuauugcugauuuuaa

SEQ ID NO: 3571413 - RNA, 20 nt, Human
acuuauugcugauuuuaaug

SEQ ID NO: 3571414 - RNA, 15 nt, Human
acuuauugcuuugaa

SEQ ID NO: 3571415 - RNA, 20 nt, Human
acuuauuguagcauccugga

SEQ ID NO: 3571416 - RNA, 19 nt, Human
acuuauuguggauaacaaa

SEQ ID NO: 3571417 - RNA, 13 nt, Human
acuuauuuaaaua

SEQ ID NO: 3571418 - RNA, 13 nt, Human
acuuauuuaaugc

SEQ ID NO: 3571419 - RNA, 22 nt, Human
acuuauuugagugauuauuugu

SEQ ID NO: 3571420 - RNA, 17 nt, Human
acuuauuuuaaaauauu

SEQ ID NO: 3571421 - RNA, 14 nt, Human
acuuauuuuugaca

SEQ ID NO: 3571422 - RNA, 16 nt, Human
acuuauuuuugacagu

SEQ ID NO: 3571423 - RNA, 15 nt, Human
acuuauuuuuuucug

SEQ ID NO: 3571424 - RNA, 16 nt, Human
acuuauuuuuuucuga

SEQ ID NO: 3571425 - RNA, 18 nt, Human
acuuauuuuuuucugauu

SEQ ID NO: 3571426 - RNA, 17 nt, Human
acuucaaaaguauuuuc

SEQ ID NO: 3571427 - RNA, 19 nt, Human
acuucaaaaguauuuuccu

SEQ ID NO: 3571428 - RNA, 21 nt, Human
acuucaaaaguauuuuccugu

SEQ ID NO: 3571429 - RNA, 16 nt, Human
acuucaaaauauugag

SEQ ID NO: 3571430 - RNA, 21 nt, Human
acuucaaacuacuuugcugcu

SEQ ID NO: 3571431 - RNA, 20 nt, Human
acuucaaauccuugaagauu

SEQ ID NO: 3571432 - RNA, 16 nt, Human
acuucaaguuaaagug

SEQ ID NO: 3571433 - RNA, 17 nt, Human
acuucacacacaggcaa

SEQ ID NO: 3571434 - RNA, 13 nt, Human
acuucacacugca

SEQ ID NO: 3571435 - RNA, 16 nt, Human
acuucacagagugugc

SEQ ID NO: 3571436 - RNA, 18 nt, Human
acuucacagagugugcug

SEQ ID NO: 3571437 - RNA, 19 nt, Human
acuucacauauugauuucc

SEQ ID NO: 3571438 - RNA, 21 nt, Human
acuucacugucaggaagaaau

SEQ ID NO: 3571439 - RNA, 17 nt, Human
acuucacugugcuguug

SEQ ID NO: 3571440 - RNA, 20 nt, Human
acuucacugugcuguuguua

SEQ ID NO: 3571441 - RNA, 21 nt, Human
acuucacugugcuguuguuau

SEQ ID NO: 3571442 - RNA, 15 nt, Human
acuucagaauuccau

SEQ ID NO: 3571443 - RNA, 21 nt, Human
acuucagacauagaauuaaca

SEQ ID NO: 3571444 - RNA, 12 nt, Human
acuucagcaaga

SEQ ID NO: 3571445 - RNA, 17 nt, Human
acuucagcaagagagaa

SEQ ID NO: 3571446 - RNA, 17 nt, Human
acuucagcgguuuauau

SEQ ID NO: 3571447 - RNA, 18 nt, Human
acuucagcgguuuauaua

SEQ ID NO: 3571448 - RNA, 14 nt, Human
acuucagcucuguu

SEQ ID NO: 3571449 - RNA, 17 nt, Human
acuucaggcucuucucc

SEQ ID NO: 3571450 - RNA, 17 nt, Human
acuucagggcagauuuu

SEQ ID NO: 3571451 - RNA, 15 nt, Human
acuucaggggcugcc

SEQ ID NO: 3571452 - RNA, 16 nt, Human
acuucaggggcugccc

SEQ ID NO: 3571453 - RNA, 17 nt, Human
acuucaggggcugcccg

SEQ ID NO: 3571454 - RNA, 19 nt, Human
acuucaggggcugcccgcu

SEQ ID NO: 3571455 - RNA, 22 nt, Human
acuucaggggcugcccgcuccc

SEQ ID NO: 3571456 - RNA, 21 nt, Human
acuucaguauguugucaaaga

SEQ ID NO: 3571457 - RNA, 15 nt, Human
acuucaguuaucuug

SEQ ID NO: 3571458 - RNA, 17 nt, Human
acuucauagauuuccuu

SEQ ID NO: 3571459 - RNA, 22 nt, Human
acuucauauugcugagagaaau

SEQ ID NO: 3571460 - RNA, 16 nt, Human
acuucaucuggaaguu

SEQ ID NO: 3571461 - RNA, 19 nt, Human
acuucaucuucucagcucc

SEQ ID NO: 3571462 - RNA, 22 nt, Human
acuucauggccuuugauaaaug

SEQ ID NO: 3571463 - RNA, 16 nt, Human
acuucauguaaagugu

SEQ ID NO: 3571464 - RNA, 22 nt, Human
acuucauguaauuuuauuuuaa

SEQ ID NO: 3571465 - RNA, 17 nt, Human
acuucauucugcagggu

SEQ ID NO: 3571466 - RNA, 17 nt, Human
acuucauugaaaauaua

SEQ ID NO: 3571467 - RNA, 23 nt, Human
cgggaaaagcagcccuuggccag

SEQ ID NO: 3571468 - RNA, 20 nt, Human
cgggaaaaggagaggaaacu

SEQ ID NO: 3571469 - RNA, 20 nt, Human
cgggaaccucacucuugcca

SEQ ID NO: 3571470 - RNA, 18 nt, Human
cgggaaccuccccagccu

SEQ ID NO: 3571471 - RNA, 20 nt, Human
cgggaaccuccccagccugc

SEQ ID NO: 3571472 - RNA, 18 nt, Human
cgggaagagaggaguuca

SEQ ID NO: 3571473 - RNA, 19 nt, Human
cgggaagagaggaguucaa

SEQ ID NO: 3571474 - RNA, 23 nt, Human
cgggaagagaggaguucaaugau

SEQ ID NO: 3571475 - RNA, 24 nt, Human
cgggaagagaggaguucaaugauc

SEQ ID NO: 3571476 - RNA, 12 nt, Human
cgggaagcggag

SEQ ID NO: 3571477 - RNA, 12 nt, Human
cgggaaggaggg

SEQ ID NO: 3571478 - RNA, 23 nt, Human
cgggaaggaggguuagggagggg

SEQ ID NO: 3571479 - RNA, 20 nt, Human
cgggaagggggcugggacau

SEQ ID NO: 3571480 - RNA, 17 nt, Human
cgggaaggucaccagca

SEQ ID NO: 3571481 - RNA, 15 nt, Human
cgggaauauuguuuc

SEQ ID NO: 3571482 - RNA, 18 nt, Human
cgggacagugcugcagcu

SEQ ID NO: 3571483 - RNA, 19 nt, Human
cgggacaucacaggguggg

SEQ ID NO: 3571484 - RNA, 21 nt, Human
cgggacaucacagggugggcc

SEQ ID NO: 3571485 - RNA, 17 nt, Human
cgggaccacccugagcc

SEQ ID NO: 3571486 - RNA, 18 nt, Human
cgggaccccgagccuggc

SEQ ID NO: 3571487 - RNA, 13 nt, Human
cgggaccuguggc

SEQ ID NO: 3571488 - RNA, 21 nt, Human
cgggacgagacccuacaggag

SEQ ID NO: 3571489 - RNA, 21 nt, Human
cgggacucacuggcagcccca

SEQ ID NO: 3571490 - RNA, 23 nt, Human
cgggacucacuggcagccccagc

SEQ ID NO: 3571491 - RNA, 16 nt, Human
cgggagaaucauguga

SEQ ID NO: 3571492 - RNA, 12 nt, Human
cgggagacagca

SEQ ID NO: 3571493 - RNA, 14 nt, Human
cgggagcagugucu

SEQ ID NO: 3571494 - RNA, 15 nt, Human
cgggagcagugucuu

SEQ ID NO: 3571495 - RNA, 17 nt, Human
cgggagccucccugccu

SEQ ID NO: 3571496 - RNA, 17 nt, Human
cgggagccugacccuca

SEQ ID NO: 3571497 - RNA, 16 nt, Human
cgggagcucaggaacc

SEQ ID NO: 3571498 - RNA, 21 nt, Human
cgggaggauguucugggacac

SEQ ID NO: 3571499 - RNA, 23 nt, Human
cgggaggauguucugggacacag

SEQ ID NO: 3571500 - RNA, 22 nt, Human
cgggaggcagagguugcagugu

SEQ ID NO: 3571501 - RNA, 14 nt, Human
cgggaggcagaguu

SEQ ID NO: 3571502 - RNA, 16 nt, Human
cgggaggcagaguuug

SEQ ID NO: 3571503 - RNA, 16 nt, Human
cgggaggcugagacag

SEQ ID NO: 3571504 - RNA, 19 nt, Human
cgggaggcugagacaggag

SEQ ID NO: 3571505 - RNA, 19 nt, Human
cgggaggggcccgcuugcc

SEQ ID NO: 3571506 - RNA, 16 nt, Human
cgggaggucgaggcag

SEQ ID NO: 3571507 - RNA, 17 nt, Human
cgggaggucgaggcagg

SEQ ID NO: 3571508 - RNA, 16 nt, Human
cgggaguuggagaccc

SEQ ID NO: 3571509 - RNA, 22 nt, Human
cgggcaaaugccagggcccgca

SEQ ID NO: 3571510 - RNA, 15 nt, Human
cgggcacaccuccuc

SEQ ID NO: 3571511 - RNA, 18 nt, Human
cgggcagagggcuggagg

SEQ ID NO: 3571512 - RNA, 12 nt, Human
cgggcagcacag

SEQ ID NO: 3571513 - RNA, 13 nt, Human
cgggcagccuggc

SEQ ID NO: 3571514 - RNA, 15 nt, Human
cgggcagggcuccca

SEQ ID NO: 3571515 - RNA, 23 nt, Human
cgggcaggggagggucagccagg

SEQ ID NO: 3571516 - RNA, 21 nt, Human
cgggcaggguguggggccaug

SEQ ID NO: 3571517 - RNA, 18 nt, Human
cgggccaaggaccugaga

SEQ ID NO: 3571518 - RNA, 14 nt, Human
cgggccaaggacug

SEQ ID NO: 3571519 - RNA, 19 nt, Human
cgggccacagagaaaguac

SEQ ID NO: 3571520 - RNA, 19 nt, Human
cgggccacuccuuccugcc

SEQ ID NO: 3571521 - RNA, 21 nt, Human
cgggccacuccuuccugcccc

SEQ ID NO: 3571522 - RNA, 16 nt, Human
cgggccagccaggcgg

SEQ ID NO: 3571523 - RNA, 17 nt, Human
cgggccagccaggcggg

SEQ ID NO: 3571524 - RNA, 17 nt, Human
cgggccagggcugcccc

SEQ ID NO: 3571525 - RNA, 18 nt, Human
cgggccagggcugccccu

SEQ ID NO: 3571526 - RNA, 11 nt, Human
cgggcccaccu

SEQ ID NO: 3571527 - RNA, 13 nt, Human
cgggcccaccugg

SEQ ID NO: 3571528 - RNA, 17 nt, Human
cgggcccaccuggccac

SEQ ID NO: 3571529 - RNA, 20 nt, Human
cgggcccaccuggccaccug

SEQ ID NO: 3571530 - RNA, 18 nt, Human
cgggcccagcccccacag

SEQ ID NO: 3571531 - RNA, 15 nt, Human
cgggccccaccugca

SEQ ID NO: 3571532 - RNA, 11 nt, Human
cgggcccuccc

SEQ ID NO: 3571533 - RNA, 20 nt, Human
cgggcccuucuugcugcccu

SEQ ID NO: 3571534 - RNA, 19 nt, Human
cgggccgacggagccggga

SEQ ID NO: 3571535 - RNA, 18 nt, Human
cgggccuguacagucugu

SEQ ID NO: 3571536 - RNA, 16 nt, Human
cgggccuguccacagg

SEQ ID NO: 3571537 - RNA, 20 nt, Human
cgggccuugucgcagcgcag

SEQ ID NO: 3571538 - RNA, 15 nt, Human
cgggcgcacugccuc

SEQ ID NO: 3571539 - RNA, 22 nt, Human
cgggcgcacugccucucacagc

SEQ ID NO: 3571540 - RNA, 23 nt, Human
cgggcgccuguagucccagccac

SEQ ID NO: 3571541 - RNA, 20 nt, Human
cgggcgcgaucccacacagg

SEQ ID NO: 3571542 - RNA, 14 nt, Human
cgggcgcgguggcu

SEQ ID NO: 3571543 - RNA, 15 nt, Human
cgggcucagcaaaag

SEQ ID NO: 3571544 - RNA, 16 nt, Human
cgggcuccugugcccu

SEQ ID NO: 3571545 - RNA, 15 nt, Human
cgggcugagggccug

SEQ ID NO: 3571546 - RNA, 19 nt, Human
cgggcugagggccugcugg

SEQ ID NO: 3571547 - RNA, 13 nt, Human
cgggcugccuggg

SEQ ID NO: 3571548 - RNA, 15 nt, Human
cgggcugccugggcu

SEQ ID NO: 3571549 - RNA, 16 nt, Human
cgggcuggccugugcc

SEQ ID NO: 3571550 - RNA, 14 nt, Human
cggggaagccagac

SEQ ID NO: 3571551 - RNA, 22 nt, Human
cggggaggagagagcagcuucu

SEQ ID NO: 3571552 - RNA, 18 nt, Human
cggggaguuucuuuccug

SEQ ID NO: 3571553 - RNA, 19 nt, Human
cggggaguuucuuuccugc

SEQ ID NO: 3571554 - RNA, 23 nt, Human
cggggcacccgccggaugcgcag

SEQ ID NO: 3571555 - RNA, 20 nt, Human
cggggcagcagcagcccugc

SEQ ID NO: 3571556 - RNA, 13 nt, Human
cggggcagccccc

SEQ ID NO: 3571557 - RNA, 19 nt, Human
cggggcagcugccagagaa

SEQ ID NO: 3571558 - RNA, 14 nt, Human
cggggcagggcagc

SEQ ID NO: 3571559 - RNA, 15 nt, Human
cggggcaucuggccu

SEQ ID NO: 3571560 - RNA, 19 nt, Human
cggggcaugcuggggcaag

SEQ ID NO: 3571561 - RNA, 20 nt, Human
cggggcccagggcaagcucc

SEQ ID NO: 3571562 - RNA, 14 nt, Human
cggggccccagggc

SEQ ID NO: 3571563 - RNA, 15 nt, Human
cggggccccagggcu

SEQ ID NO: 3571564 - RNA, 17 nt, Human
cggggccgacauugucu

SEQ ID NO: 3571565 - RNA, 16 nt, Human
cggggccugccuagca

SEQ ID NO: 3571566 - RNA, 22 nt, Human
cggggccuggcgggaugggcca

SEQ ID NO: 3571567 - RNA, 22 nt, Human
cggggccuuaucgggcuccagc

SEQ ID NO: 3571568 - RNA, 19 nt, Human
cggggcugucggcgcugcc

SEQ ID NO: 3571569 - RNA, 15 nt, Human
cggggcuugccuucu

SEQ ID NO: 3571570 - RNA, 19 nt, Human
cgggggaggguaggcagga

SEQ ID NO: 3571571 - RNA, 12 nt, Human
cgggggcagcug

SEQ ID NO: 3571572 - RNA, 22 nt, Human
cgggggcagugcucacccacac

SEQ ID NO: 3571573 - RNA, 14 nt, Human
cgggggcucaagcu

SEQ ID NO: 3571574 - RNA, 16 nt, Human
cgggggcugaggggca

SEQ ID NO: 3571575 - RNA, 13 nt, Human
cgggggcuggccu

SEQ ID NO: 3571576 - RNA, 15 nt, Human
cgggggcuggccuag

SEQ ID NO: 3571577 - RNA, 15 nt, Human
cggggggacagcucc

SEQ ID NO: 3571578 - RNA, 12 nt, Human
cggggggaggga

SEQ ID NO: 3571579 - RNA, 20 nt, Human
cggggggccccagucagccu

SEQ ID NO: 3571580 - RNA, 22 nt, Human
cggggggccccagucagccucu

SEQ ID NO: 3571581 - RNA, 23 nt, Human
cggggggccccagucagccucuc

SEQ ID NO: 3571582 - RNA, 17 nt, Human
cggggguggcggcggcc

SEQ ID NO: 3571583 - RNA, 14 nt, Human
cgggguaugaagag

SEQ ID NO: 3571584 - RNA, 19 nt, Human
cgggguggugggaaccaug

SEQ ID NO: 3571585 - RNA, 18 nt, Human
cgggucgggggcaggugc

SEQ ID NO: 3571586 - RNA, 13 nt, Human
cgggucugcuccc

SEQ ID NO: 3571587 - RNA, 12 nt, Human
cgggucuuccua

SEQ ID NO: 3571588 - RNA, 22 nt, Human
cgggugcagacaaucuucuguu

SEQ ID NO: 3571589 - RNA, 19 nt, Human
cggguggaucaccugaggu

SEQ ID NO: 3571590 - RNA, 19 nt, Human
cgggugggcggcacagccu

SEQ ID NO: 3571591 - RNA, 16 nt, Human
cggguggggcuugggg

SEQ ID NO: 3571592 - RNA, 23 nt, Human
cggguggggguggaauaaaauac

SEQ ID NO: 3571593 - RNA, 14 nt, Human
cgggugguccccgu

SEQ ID NO: 3571594 - RNA, 17 nt, Human
cggguugugugucuguu

SEQ ID NO: 3571595 - RNA, 15 nt, Human
cggguuucucugugg

SEQ ID NO: 3571596 - RNA, 21 nt, Human
cggguuuuauuguuuaaaauc

SEQ ID NO: 3571597 - RNA, 14 nt, Human
cgguaacuguccug

SEQ ID NO: 3571598 - RNA, 15 nt, Human
cgguaacuguccugu

SEQ ID NO: 3571599 - RNA, 18 nt, Human
cgguaacuguccuguccu

SEQ ID NO: 3571600 - RNA, 18 nt, Human
cgguaggcgaccaccgcc

SEQ ID NO: 3571601 - RNA, 15 nt, Human
cgguagggaggcagc

SEQ ID NO: 3571602 - RNA, 17 nt, Human
cgguagggaggcagccu

SEQ ID NO: 3571603 - RNA, 22 nt, Human
cgguauccccccaucuugcuuc

SEQ ID NO: 3571604 - RNA, 17 nt, Human
cgguauuaugcuucuug

SEQ ID NO: 3571605 - RNA, 14 nt, Human
cggucagguuuaac

SEQ ID NO: 3571606 - RNA, 18 nt, Human
cgguccaagccugcaacu

SEQ ID NO: 3571607 - RNA, 15 nt, Human
cgguccacccaggag

SEQ ID NO: 3571608 - RNA, 13 nt, Human
cgguccagcuggc

SEQ ID NO: 3571609 - RNA, 13 nt, Human
cggucccaccccu

SEQ ID NO: 3571610 - RNA, 13 nt, Human
cgguccuggugcc

SEQ ID NO: 3571611 - RNA, 17 nt, Human
cggucggggcaucuggc

SEQ ID NO: 3571612 - RNA, 18 nt, Human
cucauuaugccacuuccu

SEQ ID NO: 3571613 - RNA, 21 nt, Human
cucauuauuuauguccaggug

SEQ ID NO: 3571614 - RNA, 14 nt, Human
cucauucaguauua

SEQ ID NO: 3571615 - RNA, 21 nt, Human
cucauucauuuuauauugaaa

SEQ ID NO: 3571616 - RNA, 15 nt, Human
cucauuccagaggaa

SEQ ID NO: 3571617 - RNA, 17 nt, Human
cucauuccagaggaagg

SEQ ID NO: 3571618 - RNA, 13 nt, Human
cucauuccccagg

SEQ ID NO: 3571619 - RNA, 13 nt, Human
cucauuccccggg

SEQ ID NO: 3571620 - RNA, 14 nt, Human
cucauuccccgggg

SEQ ID NO: 3571621 - RNA, 18 nt, Human
cucauucccuccccagaa

SEQ ID NO: 3571622 - RNA, 21 nt, Human
cucauucccucgucuuuccca

SEQ ID NO: 3571623 - RNA, 12 nt, Human
cucauuccugaa

SEQ ID NO: 3571624 - RNA, 18 nt, Human
cucauuccugccugucuc

SEQ ID NO: 3571625 - RNA, 14 nt, Human
cucauucuaaugau

SEQ ID NO: 3571626 - RNA, 18 nt, Human
cucauucuaaugauggcc

SEQ ID NO: 3571627 - RNA, 18 nt, Human
cucauucuccuuguguua

SEQ ID NO: 3571628 - RNA, 14 nt, Human
cucauucuucugua

SEQ ID NO: 3571629 - RNA, 17 nt, Human
cucauugaauuauaaaa

SEQ ID NO: 3571630 - RNA, 15 nt, Human
cucauugaccugagg

SEQ ID NO: 3571631 - RNA, 17 nt, Human
cucauugaccugaggcc

SEQ ID NO: 3571632 - RNA, 19 nt, Human
cucauugaccugaggcccu

SEQ ID NO: 3571633 - RNA, 14 nt, Human
cucauugacuuuua

SEQ ID NO: 3571634 - RNA, 21 nt, Human
cucauugacuuuuauaaagca

SEQ ID NO: 3571635 - RNA, 21 nt, Human
cucauugcucugaauauguca

SEQ ID NO: 3571636 - RNA, 15 nt, Human
cucauugcugagccu

SEQ ID NO: 3571637 - RNA, 18 nt, Human
cucauugcugagccucug

SEQ ID NO: 3571638 - RNA, 19 nt, Human
cucauugcugagccucugc

SEQ ID NO: 3571639 - RNA, 22 nt, Human
cucauugcuucacaacccaucu

SEQ ID NO: 3571640 - RNA, 22 nt, Human
cucauuggaaauuuagcauugu

SEQ ID NO: 3571641 - RNA, 18 nt, Human
cucauuggacccuuccau

SEQ ID NO: 3571642 - RNA, 22 nt, Human
cucauuuaauccucccuuccuc

SEQ ID NO: 3571643 - RNA, 16 nt, Human
cucauuuagccugucc

SEQ ID NO: 3571644 - RNA, 14 nt, Human
cucauuucaccccu

SEQ ID NO: 3571645 - RNA, 16 nt, Human
cucauuucaucucauu

SEQ ID NO: 3571646 - RNA, 18 nt, Human
cucauuucaucucauuua

SEQ ID NO: 3571647 - RNA, 21 nt, Human
cucauuuuaaugauuguuuaa

SEQ ID NO: 3571648 - RNA, 15 nt, Human
cucauuuuaauguaa

SEQ ID NO: 3571649 - RNA, 18 nt, Human
cucauuuuaggcaaauau

SEQ ID NO: 3571650 - RNA, 22 nt, Human
cucauuuuuccguaaaaaugau

SEQ ID NO: 3571651 - RNA, 23 nt, Human
cucauuuuuuuuuuuguuucuga

SEQ ID NO: 3571652 - RNA, 20 nt, Human
cuccaaaaaucugccugggu

SEQ ID NO: 3571653 - RNA, 21 nt, Human
cuccaaaaaucugccuggguu

SEQ ID NO: 3571654 - RNA, 16 nt, Human
cuccaaaauaaaacuu

SEQ ID NO: 3571655 - RNA, 14 nt, Human
cuccaaaaugugcc

SEQ ID NO: 3571656 - RNA, 22 nt, Human
cuccaaaauguuggucauuuua

SEQ ID NO: 3571657 - RNA, 21 nt, Human
cuccaaacugacucuuaagaa

SEQ ID NO: 3571658 - RNA, 12 nt, Human
cuccaaagaaau

SEQ ID NO: 3571659 - RNA, 13 nt, Human
cuccaaagaaaug

SEQ ID NO: 3571660 - RNA, 22 nt, Human
cuccaaaggaagucuaggagcu

SEQ ID NO: 3571661 - RNA, 12 nt, Human
cuccaaaugcug

SEQ ID NO: 3571662 - RNA, 23 nt, Human
cuccaacacaaggcuccaagacc

SEQ ID NO: 3571663 - RNA, 18 nt, Human
cuccaacaccaagcacag

SEQ ID NO: 3571664 - RNA, 20 nt, Human
cuccaacagaacuaaauguu

SEQ ID NO: 3571665 - RNA, 22 nt, Human
cuccaacagaacuaaauguucu

SEQ ID NO: 3571666 - RNA, 19 nt, Human
cuccaacaucacagcccag

SEQ ID NO: 3571667 - RNA, 22 nt, Human
cuccaaccccccagcacugagg

SEQ ID NO: 3571668 - RNA, 19 nt, Human
cuccaaccccucgcccagu

SEQ ID NO: 3571669 - RNA, 20 nt, Human
cuccaaccccucgcccaguc

SEQ ID NO: 3571670 - RNA, 23 nt, Human
cuccaaccccucgcccaguccca

SEQ ID NO: 3571671 - RNA, 14 nt, Human
cuccaacccugccg

SEQ ID NO: 3571672 - RNA, 15 nt, Human
cuccaacccugccgu

SEQ ID NO: 3571673 - RNA, 22 nt, Human
cuccaaccuaaccugugucugc

SEQ ID NO: 3571674 - RNA, 21 nt, Human
cuccaaccugcaaagaucugu

SEQ ID NO: 3571675 - RNA, 14 nt, Human
cuccaaccuggaca

SEQ ID NO: 3571676 - RNA, 18 nt, Human
cuccaaccuggggggcag

SEQ ID NO: 3571677 - RNA, 21 nt, Human
cuccaagaccuguugguucca

SEQ ID NO: 3571678 - RNA, 15 nt, Human
cuccaagaccuucuc

SEQ ID NO: 3571679 - RNA, 21 nt, Human
cuccaagaccuucuccuucac

SEQ ID NO: 3571680 - RNA, 14 nt, Human
cuccaagagcuaca

SEQ ID NO: 3571681 - RNA, 16 nt, Human
cuccaagauucuagau

SEQ ID NO: 3571682 - RNA, 19 nt, Human
cuccaagcagcuuagaguu

SEQ ID NO: 3571683 - RNA, 24 nt, Human
cuccaagcaggacauggacaagga

SEQ ID NO: 3571684 - RNA, 18 nt, Human
cuccaagcuccaucucca

SEQ ID NO: 3571685 - RNA, 16 nt, Human
cuccaagcucccaggc

SEQ ID NO: 3571686 - RNA, 17 nt, Human
cuccaagcucccaggca

SEQ ID NO: 3571687 - RNA, 20 nt, Human
cuccaaggacagaaggcucc

SEQ ID NO: 3571688 - RNA, 21 nt, Human
cuccaaggaggggcuguaaaa

SEQ ID NO: 3571689 - RNA, 14 nt, Human
cuccaaggccaggc

SEQ ID NO: 3571690 - RNA, 19 nt, Human
cuccaaggccaggccuugg

SEQ ID NO: 3571691 - RNA, 15 nt, Human
cuccaaggugggguc

SEQ ID NO: 3571692 - RNA, 15 nt, Human
cuccaagugccagag

SEQ ID NO: 3571693 - RNA, 19 nt, Human
cuccaagugccagaggugg

SEQ ID NO: 3571694 - RNA, 20 nt, Human
cuccaagugccagagguggg

SEQ ID NO: 3571695 - RNA, 16 nt, Human
cuccaauaucagugcu

SEQ ID NO: 3571696 - RNA, 14 nt, Human
cuccaauccugccc

SEQ ID NO: 3571697 - RNA, 20 nt, Human
cuccaaugucugcugaggag

SEQ ID NO: 3571698 - RNA, 20 nt, Human
cuccaauuaaggauuuuaug

SEQ ID NO: 3571699 - RNA, 20 nt, Human
cuccacacagugcucaaggc

SEQ ID NO: 3571700 - RNA, 18 nt, Human
cuccacaccauucagguc

SEQ ID NO: 3571701 - RNA, 20 nt, Human
cuccacaccauucaggucuu

SEQ ID NO: 3571702 - RNA, 13 nt, Human
cuccacaccugcg

SEQ ID NO: 3571703 - RNA, 15 nt, Human
cuccacaccugcggc

SEQ ID NO: 3571704 - RNA, 19 nt, Human
cuccacagcaaccccaggc

SEQ ID NO: 3571705 - RNA, 15 nt, Human
cuccacagccgcagc

SEQ ID NO: 3571706 - RNA, 20 nt, Human
cuccacagcgagggcagcug

SEQ ID NO: 3571707 - RNA, 22 nt, Human
cuccacagcgagggcagcugcu

SEQ ID NO: 3571708 - RNA, 15 nt, Human
cuccacaguucagug

SEQ ID NO: 3571709 - RNA, 13 nt, Human
cuccacauccucc

SEQ ID NO: 3571710 - RNA, 14 nt, Human
cuccacauccucca

SEQ ID NO: 3571711 - RNA, 15 nt, Human
cuccacauccuccac

SEQ ID NO: 3571712 - RNA, 15 nt, Human
cuccacaucugccuu

SEQ ID NO: 3571713 - RNA, 13 nt, Human
cuccaccaaccca

SEQ ID NO: 3571714 - RNA, 20 nt, Human
cuccaccaacccaucagaag

SEQ ID NO: 3571715 - RNA, 13 nt, Human
cuccaccacaucc

SEQ ID NO: 3571716 - RNA, 13 nt, Human
cuccaccacccaa

SEQ ID NO: 3571717 - RNA, 14 nt, Human
cuccaccacccaaa

SEQ ID NO: 3571718 - RNA, 20 nt, Human
cuccaccagcaucaccugcc

SEQ ID NO: 3571719 - RNA, 14 nt, Human
cuccacccauccua

SEQ ID NO: 3571720 - RNA, 21 nt, Human
cuccacccauccuaucagccu

SEQ ID NO: 3571721 - RNA, 11 nt, Human
cuccaccccag

SEQ ID NO: 3571722 - RNA, 17 nt, Human
cuccaccccagccccca

SEQ ID NO: 3571723 - RNA, 12 nt, Human
cuccaccccagg

SEQ ID NO: 3571724 - RNA, 15 nt, Human
cuccacccccagcug

SEQ ID NO: 3571725 - RNA, 22 nt, Human
cuccacccccagcugcuugugu

SEQ ID NO: 3571726 - RNA, 16 nt, Human
cuccaccccccagaac

SEQ ID NO: 3571727 - RNA, 16 nt, Human
cuccacccuccaccuu

SEQ ID NO: 3571728 - RNA, 14 nt, Human
cuccacccucccag

SEQ ID NO: 3571729 - RNA, 18 nt, Human
cuccacccucccagaccu

SEQ ID NO: 3571730 - RNA, 19 nt, Human
cuccacccucugagcuuug

SEQ ID NO: 3571731 - RNA, 11 nt, Human
cuccacccugc

SEQ ID NO: 3571732 - RNA, 14 nt, Human
cuccacccuggccg

SEQ ID NO: 3571733 - RNA, 14 nt, Human
cuccacccuguccc

SEQ ID NO: 3571734 - RNA, 17 nt, Human
cuccacccuguccccca

SEQ ID NO: 3571735 - RNA, 18 nt, Human
cuccacccugucccccag

SEQ ID NO: 3571736 - RNA, 20 nt, Human
cuccacccugucccccagcu

SEQ ID NO: 3571737 - RNA, 22 nt, Human
cuccacccugucccccagcucu

SEQ ID NO: 3571738 - RNA, 15 nt, Human
cuccacccuuggccu

SEQ ID NO: 3571739 - RNA, 16 nt, Human
cuccacccuuggccug

SEQ ID NO: 3571740 - RNA, 17 nt, Human
cuccacccuuggccugu

SEQ ID NO: 3571741 - RNA, 16 nt, Human
cuccaccgcagaagga

SEQ ID NO: 3571742 - RNA, 16 nt, Human
cuccaccgcugccuaa

SEQ ID NO: 3571743 - RNA, 20 nt, Human
cuccaccuaguggcugucca

SEQ ID NO: 3571744 - RNA, 22 nt, Human
cuccaccuaguggcuguccagu

SEQ ID NO: 3571745 - RNA, 12 nt, Human
cuccaccucagc

SEQ ID NO: 3571746 - RNA, 17 nt, Human
cuccaccucagccuugg

SEQ ID NO: 3571747 - RNA, 16 nt, Human
cuccaccucccugcaa

SEQ ID NO: 3571748 - RNA, 14 nt, Human
cuccaccuccuggg

SEQ ID NO: 3571749 - RNA, 22 nt, Human
cuccaccucuucaccccccacu

SEQ ID NO: 3571750 - RNA, 17 nt, Human
cuccaccuugcagcucu

SEQ ID NO: 3571751 - RNA, 18 nt, Human
cuccacgauccugccacc

SEQ ID NO: 3571752 - RNA, 18 nt, Human
cuccacguucaccccucc

SEQ ID NO: 3571753 - RNA, 15 nt, Human
cuccacguucugcuc

SEQ ID NO: 3571754 - RNA, 16 nt, Human
cuccacguucugcuca

SEQ ID NO: 3571755 - RNA, 18 nt, Human
cuccacucagcuguccug

SEQ ID NO: 3571756 - RNA, 21 nt, Human
cuccacucagcuguccugcag

SEQ ID NO: 3571757 - RNA, 18 nt, Human
cuccaggugcacaagcuc

SEQ ID NO: 3571758 - RNA, 19 nt, Human
cuccaggugcacaagcucc

SEQ ID NO: 3571759 - RNA, 23 nt, Human
cuccaggugcacaagcuccaagc

SEQ ID NO: 3571760 - RNA, 13 nt, Human
cuccaggugcaga

SEQ ID NO: 3571761 - RNA, 17 nt, Human
cuccagguggcucugag

SEQ ID NO: 3571762 - RNA, 12 nt, Human
cuccagguuuuu

SEQ ID NO: 3571763 - RNA, 13 nt, Human
cuccagguuuuuc

SEQ ID NO: 3571764 - RNA, 22 nt, Human
cuccagguuuuucaauuaaacg

SEQ ID NO: 3571765 - RNA, 23 nt, Human
cuccagguuuuucaauuaaacgg

SEQ ID NO: 3571766 - RNA, 20 nt, Human
cuccaguauucuugucaaaa

SEQ ID NO: 3571767 - RNA, 15 nt, Human
cuccagucaggaggc

SEQ ID NO: 3571768 - RNA, 18 nt, Human
cuccagucccccuauccu

SEQ ID NO: 3571769 - RNA, 20 nt, Human
cuccaguccugcucucuacc

SEQ ID NO: 3571770 - RNA, 19 nt, Human
cuccagucugaucugugaa

SEQ ID NO: 3571771 - RNA, 13 nt, Human
cuccagugaaacu

SEQ ID NO: 3571772 - RNA, 21 nt, Human
cuccagugagacagcucugca

SEQ ID NO: 3571773 - RNA, 18 nt, Human
cuccagugccagcaauga

SEQ ID NO: 3571774 - RNA, 19 nt, Human
cuccaguggaagaagaaaa

SEQ ID NO: 3571775 - RNA, 23 nt, Human
cuccaguggggcaagauuuuccu

SEQ ID NO: 3571776 - RNA, 16 nt, Human
cuccagugguugcugu

SEQ ID NO: 3571777 - RNA, 16 nt, Human
cuccaguuugcaccug

SEQ ID NO: 3571778 - RNA, 15 nt, Human
cuccauaaacagacu

SEQ ID NO: 3571779 - RNA, 14 nt, Human
cuccauacucagga

SEQ ID NO: 3571780 - RNA, 15 nt, Human
cuccaucacccucuu

SEQ ID NO: 3571781 - RNA, 20 nt, Human
cuccauccacaugggagccg

SEQ ID NO: 3571782 - RNA, 13 nt, Human
cuccaucccucua

SEQ ID NO: 3571783 - RNA, 11 nt, Human
cuccaucccug

SEQ ID NO: 3571784 - RNA, 12 nt, Human
cuccaucccugg

SEQ ID NO: 3571785 - RNA, 24 nt, Human
cuccaucccuggcccccucccugg

SEQ ID NO: 3571786 - RNA, 20 nt, Human
cuccauccuauccacugggc

SEQ ID NO: 3571787 - RNA, 13 nt, Human
cuccauccugagg

SEQ ID NO: 3571788 - RNA, 14 nt, Human
cuccauccugaggc

SEQ ID NO: 3571789 - RNA, 20 nt, Human
cuccauccugaggcuccacu

SEQ ID NO: 3571790 - RNA, 23 nt, Human
cuccauccugaggcuccacuugg

SEQ ID NO: 3571791 - RNA, 9 nt, Human
cuccaucuc

SEQ ID NO: 3571792 - RNA, 18 nt, Human
cuccaucuccaagaaugc

SEQ ID NO: 3571793 - RNA, 21 nt, Human
cuccaucuccaagaaugcuga

SEQ ID NO: 3571794 - RNA, 13 nt, Human
cuccaucuccacu

SEQ ID NO: 3571795 - RNA, 15 nt, Human
cuccaucucucuggc

SEQ ID NO: 3571796 - RNA, 17 nt, Human
cuccaucucucuggccc

SEQ ID NO: 3571797 - RNA, 16 nt, Human
cuccaucuggcagggu

SEQ ID NO: 3571798 - RNA, 19 nt, Human
cuccaucuucagcuucuuc

SEQ ID NO: 3571799 - RNA, 17 nt, Human
cuccaugaguuuuuucu

SEQ ID NO: 3571800 - RNA, 19 nt, Human
cuccaugcuccucacugcc

SEQ ID NO: 3571801 - RNA, 20 nt, Human
cuccaugcuccucacugccc

SEQ ID NO: 3571802 - RNA, 19 nt, Human
cuccauggcccugccaugc

SEQ ID NO: 3571803 - RNA, 15 nt, Human
cuccauggcuuccuc

SEQ ID NO: 3571804 - RNA, 12 nt, Human
cuccauggugcc

SEQ ID NO: 3571805 - RNA, 15 nt, Human
cuccauggugccucu

SEQ ID NO: 3571806 - RNA, 18 nt, Human
cuccauggugccucugga

SEQ ID NO: 3571807 - RNA, 13 nt, Human
cuccaugucucug

SEQ ID NO: 3571808 - RNA, 22 nt, Human
cuccaugucucugagcauuaga

SEQ ID NO: 3571809 - RNA, 13 nt, Human
cuccaugugggcu

SEQ ID NO: 3571810 - RNA, 24 nt, Human
cuccauucccguggaacguuuuuc

SEQ ID NO: 3571811 - RNA, 17 nt, Human
cuccauucuauuuuaga

SEQ ID NO: 3571812 - RNA, 14 nt, Human
cuccauucugcucc

SEQ ID NO: 3571813 - RNA, 16 nt, Human
cuccauucugcuccuu

SEQ ID NO: 3571814 - RNA, 17 nt, Human
cuccauucugcuccuuc

SEQ ID NO: 3571815 - RNA, 23 nt, Human
cuccauugguccuuuuuuuuucu

SEQ ID NO: 3571816 - RNA, 16 nt, Human
cuccauuucacuggcu

SEQ ID NO: 3571817 - RNA, 13 nt, Human
cuccauuugcucu

SEQ ID NO: 3571818 - RNA, 15 nt, Human
cuccauuugcucuuc

SEQ ID NO: 3571819 - RNA, 22 nt, Human
cuccauuuuggugucuuucucu

SEQ ID NO: 3571820 - RNA, 22 nt, Human
cucccaaaaguaucgggggcug

SEQ ID NO: 3571821 - RNA, 16 nt, Human
cucccaaagugcuggg

SEQ ID NO: 3571822 - RNA, 17 nt, Human
cucccaaagugcuggga

SEQ ID NO: 3571823 - RNA, 14 nt, Human
cucccaacaguggg

SEQ ID NO: 3571824 - RNA, 20 nt, Human
cucccaagcuaucuaaaguu

SEQ ID NO: 3571825 - RNA, 21 nt, Human
cucccaaggcugcgucuggag

SEQ ID NO: 3571826 - RNA, 19 nt, Human
cucccaaggggccugagca

SEQ ID NO: 3571827 - RNA, 16 nt, Human
cucccaaguggugccu

SEQ ID NO: 3571828 - RNA, 17 nt, Human
cucccaaguggugccua

SEQ ID NO: 3571829 - RNA, 13 nt, Human
cucccaauucauc

SEQ ID NO: 3571830 - RNA, 15 nt, Human
cucccacaaaggaga

SEQ ID NO: 3571831 - RNA, 18 nt, Human
cucccacacccaaagcug

SEQ ID NO: 3571832 - RNA, 22 nt, Human
cucccacacccaaagcugagcc

SEQ ID NO: 3571833 - RNA, 15 nt, Human
cucccacagagacaa

SEQ ID NO: 3571834 - RNA, 18 nt, Human
cucccacagcgcuggccg

SEQ ID NO: 3571835 - RNA, 14 nt, Human
cucccacaggcagc

SEQ ID NO: 3571836 - RNA, 15 nt, Human
cucccacaggcagcu

SEQ ID NO: 3571837 - RNA, 16 nt, Human
cucccacaggcagcuu

SEQ ID NO: 3571838 - RNA, 21 nt, Human
cucccacagucccaucugcuu

SEQ ID NO: 3571839 - RNA, 11 nt, Human
cucccacagug

SEQ ID NO: 3571840 - RNA, 12 nt, Human
cucccacaguga

SEQ ID NO: 3571841 - RNA, 20 nt, Human
cucccacagugacucgggcu

SEQ ID NO: 3571842 - RNA, 13 nt, Human
cucccaccacagc

SEQ ID NO: 3571843 - RNA, 17 nt, Human
cucccacccaccgccac

SEQ ID NO: 3571844 - RNA, 21 nt, Human
cucccacccagucucugcucc

SEQ ID NO: 3571845 - RNA, 13 nt, Human
cucccacccccag

SEQ ID NO: 3571846 - RNA, 22 nt, Human
cucccacccccuucucugcucc

SEQ ID NO: 3571847 - RNA, 17 nt, Human
cucccacccgaugcugc

SEQ ID NO: 3571848 - RNA, 16 nt, Human
cucccacccucuuccu

SEQ ID NO: 3571849 - RNA, 12 nt, Human
cucccacccugu

SEQ ID NO: 3571850 - RNA, 18 nt, Human
cucccaccuagcagcacc

SEQ ID NO: 3571851 - RNA, 16 nt, Human
cucccaccucagccuc

SEQ ID NO: 3571852 - RNA, 13 nt, Human
cucccaccuccug

SEQ ID NO: 3571853 - RNA, 14 nt, Human
cucccaccuccuga

SEQ ID NO: 3571854 - RNA, 21 nt, Human
cucccaccuccugacacccuu

SEQ ID NO: 3571855 - RNA, 13 nt, Human
cucccaccucugu

SEQ ID NO: 3571856 - RNA, 18 nt, Human
cucccaccucugugaccu

SEQ ID NO: 3571857 - RNA, 19 nt, Human
cucccaccucugugaccuc

SEQ ID NO: 3571858 - RNA, 20 nt, Human
cucccaccucugugaccuca

SEQ ID NO: 3571859 - RNA, 14 nt, Human
cucccaccugacac

SEQ ID NO: 3571860 - RNA, 15 nt, Human
cucccaccugacaca

SEQ ID NO: 3571861 - RNA, 14 nt, Human
cucccaccuggcuc

SEQ ID NO: 3571862 - RNA, 15 nt, Human
cucccaccuggcucu

SEQ ID NO: 3571863 - RNA, 22 nt, Human
cucccaccuggcucuguggcga

SEQ ID NO: 3571864 - RNA, 13 nt, Human
cucccacgggacc

SEQ ID NO: 3571865 - RNA, 15 nt, Human
cucccacgugggaga

SEQ ID NO: 3571866 - RNA, 14 nt, Human
cucccacugaguuu

SEQ ID NO: 3571867 - RNA, 13 nt, Human
cucccacuuggcc

SEQ ID NO: 3571868 - RNA, 17 nt, Human
cucccagaaucccagcc

SEQ ID NO: 3571869 - RNA, 18 nt, Human
cucccagagcaccugcug

SEQ ID NO: 3571870 - RNA, 20 nt, Human
cucccagagcaccugcuguc

SEQ ID NO: 3571871 - RNA, 22 nt, Human
cucccagagcugguggacccag

SEQ ID NO: 3571872 - RNA, 23 nt, Human
cucccagaggagccaccaguucu

SEQ ID NO: 3571873 - RNA, 14 nt, Human
cucccagaggucca

SEQ ID NO: 3571874 - RNA, 22 nt, Human
cucccagagguccagcccaucu

SEQ ID NO: 3571875 - RNA, 13 nt, Human
cucccagccaggc

SEQ ID NO: 3571876 - RNA, 14 nt, Human
cucccagccaggcc

SEQ ID NO: 3571877 - RNA, 18 nt, Human
cucccagcccuauggaug

SEQ ID NO: 3571878 - RNA, 21 nt, Human
cucccagcccuauggaugugg

SEQ ID NO: 3571879 - RNA, 14 nt, Human
cucccagccucagc

SEQ ID NO: 3571880 - RNA, 18 nt, Human
cucccagcuccaccccgc

SEQ ID NO: 3571881 - RNA, 15 nt, Human
cucccagcucuagac

SEQ ID NO: 3571882 - RNA, 11 nt, Human
cucccagcuga

SEQ ID NO: 3571883 - RNA, 18 nt, Human
cucccagcugacaguccu

SEQ ID NO: 3571884 - RNA, 20 nt, Human
cucccagcuuguaggagcug

SEQ ID NO: 3571885 - RNA, 16 nt, Human
cucccaggaagcccag

SEQ ID NO: 3571886 - RNA, 21 nt, Human
cucccaggaagcccaggagcc

SEQ ID NO: 3571887 - RNA, 11 nt, Human
cucccaggaca

SEQ ID NO: 3571888 - RNA, 21 nt, Human
cucccaggaccacaggcucag

SEQ ID NO: 3571889 - RNA, 17 nt, Human
cucccaggcaaggcugu

SEQ ID NO: 3571890 - RNA, 18 nt, Human
cucccaggcaaggcugug

SEQ ID NO: 3571891 - RNA, 17 nt, Human
cucccaggcacugucuu

SEQ ID NO: 3571892 - RNA, 22 nt, Human
cucccaggcauuccccaggagg

SEQ ID NO: 3571893 - RNA, 17 nt, Human
cucccaggccaggcucc

SEQ ID NO: 3571894 - RNA, 12 nt, Human
cucccaggcccc

SEQ ID NO: 3571895 - RNA, 12 nt, Human
cucccagggcca

SEQ ID NO: 3571896 - RNA, 23 nt, Human
cucccagggccagggcccugcag

SEQ ID NO: 3571897 - RNA, 20 nt, Human
cucccagggccaugaacuuu

SEQ ID NO: 3571898 - RNA, 12 nt, Human
cucccagggcua

SEQ ID NO: 3571899 - RNA, 17 nt, Human
cucccaggggcucccuc

SEQ ID NO: 3571900 - RNA, 21 nt, Human
cucccaggggcucccuccgcc

SEQ ID NO: 3571901 - RNA, 19 nt, Human
cucccaggggucucccugg

SEQ ID NO: 3571902 - RNA, 20 nt, Human
cucccaggggucucccuggc

SEQ ID NO: 3571903 - RNA, 13 nt, Human
cucugaugcagcu

SEQ ID NO: 3571904 - RNA, 22 nt, Human
cucugaugguucuucaccuccu

SEQ ID NO: 3571905 - RNA, 18 nt, Human
cucugauguaaaugaagu

SEQ ID NO: 3571906 - RNA, 18 nt, Human
cucugauuugcaaaaaaa

SEQ ID NO: 3571907 - RNA, 17 nt, Human
cucugcaaucuucucag

SEQ ID NO: 3571908 - RNA, 17 nt, Human
cucugcaaugggcacug

SEQ ID NO: 3571909 - RNA, 23 nt, Human
cucugcaaugggcacugggauga

SEQ ID NO: 3571910 - RNA, 19 nt, Human
cucugcaauuccccucugc

SEQ ID NO: 3571911 - RNA, 21 nt, Human
cucugcaauuccccucugcug

SEQ ID NO: 3571912 - RNA, 17 nt, Human
cucugcacaagcugcac

SEQ ID NO: 3571913 - RNA, 18 nt, Human
cucugcacaagcugcacc

SEQ ID NO: 3571914 - RNA, 21 nt, Human
cucugcacaagcugcacccuc

SEQ ID NO: 3571915 - RNA, 22 nt, Human
cucugcacacccuccagagaca

SEQ ID NO: 3571916 - RNA, 15 nt, Human
cucugcacagaugga

SEQ ID NO: 3571917 - RNA, 14 nt, Human
cucugcacaugucu

SEQ ID NO: 3571918 - RNA, 16 nt, Human
cucugcacaugucuug

SEQ ID NO: 3571919 - RNA, 15 nt, Human
cucugcaccccucug

SEQ ID NO: 3571920 - RNA, 18 nt, Human
cucugcaccguacugugg

SEQ ID NO: 3571921 - RNA, 13 nt, Human
cucugcacuacuc

SEQ ID NO: 3571922 - RNA, 22 nt, Human
cucugcacuacuccucugcagu

SEQ ID NO: 3571923 - RNA, 18 nt, Human
cucugcacuacugacaug

SEQ ID NO: 3571924 - RNA, 16 nt, Human
cucugcagacugcuag

SEQ ID NO: 3571925 - RNA, 22 nt, Human
cucugcagacuucccagcuagg

SEQ ID NO: 3571926 - RNA, 19 nt, Human
cucugcagcaauaaagcag

SEQ ID NO: 3571927 - RNA, 15 nt, Human
cucugcagccagccc

SEQ ID NO: 3571928 - RNA, 18 nt, Human
cucugcagccagcccagc

SEQ ID NO: 3571929 - RNA, 19 nt, Human
cucugcagccagcccagcc

SEQ ID NO: 3571930 - RNA, 14 nt, Human
cucugcagcugacc

SEQ ID NO: 3571931 - RNA, 16 nt, Human
cucugcagcugaccuc

SEQ ID NO: 3571932 - RNA, 13 nt, Human
cucugcagcugcc

SEQ ID NO: 3571933 - RNA, 14 nt, Human
cucugcagcugccg

SEQ ID NO: 3571934 - RNA, 15 nt, Human
cucugcaggucccua

SEQ ID NO: 3571935 - RNA, 20 nt, Human
cucugcaggucccuaauaaa

SEQ ID NO: 3571936 - RNA, 22 nt, Human
cucugcagucucuauaccaaua

SEQ ID NO: 3571937 - RNA, 13 nt, Human
cucugcagugccu

SEQ ID NO: 3571938 - RNA, 15 nt, Human
cucugcagugccuug

SEQ ID NO: 3571939 - RNA, 14 nt, Human
cucugcaucccagc

SEQ ID NO: 3571940 - RNA, 18 nt, Human
cucugcaucccagcaccu

SEQ ID NO: 3571941 - RNA, 20 nt, Human
cucugcaucccagcaccugc

SEQ ID NO: 3571942 - RNA, 23 nt, Human
cucugcaucccagcaccugccuc

SEQ ID NO: 3571943 - RNA, 17 nt, Human
cucugcauccucuggag

SEQ ID NO: 3571944 - RNA, 20 nt, Human
cucugcauccucuggagcca

SEQ ID NO: 3571945 - RNA, 19 nt, Human
cucugcaucuacucccaag

SEQ ID NO: 3571946 - RNA, 13 nt, Human
cucugcaucugac

SEQ ID NO: 3571947 - RNA, 17 nt, Human
cucugcaugcggcccag

SEQ ID NO: 3571948 - RNA, 22 nt, Human
cucugcaugcggcccagcccgg

SEQ ID NO: 3571949 - RNA, 14 nt, Human
cucugcauuugucu

SEQ ID NO: 3571950 - RNA, 22 nt, Human
cucugcauuugucuauucucca

SEQ ID NO: 3571951 - RNA, 16 nt, Human
cucugcauuuuucugc

SEQ ID NO: 3571952 - RNA, 14 nt, Human
cucugccaaaggau

SEQ ID NO: 3571953 - RNA, 21 nt, Human
cucugccaaaggaugugauau

SEQ ID NO: 3571954 - RNA, 15 nt, Human
cucugccacacucug

SEQ ID NO: 3571955 - RNA, 17 nt, Human
cucugccacacucugac

SEQ ID NO: 3571956 - RNA, 17 nt, Human
cucugccaccagagacc

SEQ ID NO: 3571957 - RNA, 18 nt, Human
cucugccaccagagaccg

SEQ ID NO: 3571958 - RNA, 22 nt, Human
cucugccacccuaccuguucag

SEQ ID NO: 3571959 - RNA, 12 nt, Human
cucugccaccuc

SEQ ID NO: 3571960 - RNA, 14 nt, Human
cucugccaccuccc

SEQ ID NO: 3571961 - RNA, 23 nt, Human
cucugccagaagauccccucagg

SEQ ID NO: 3571962 - RNA, 14 nt, Human
cucugccagccaca

SEQ ID NO: 3571963 - RNA, 13 nt, Human
cucugccagggca

SEQ ID NO: 3571964 - RNA, 15 nt, Human
cucugccagggcagu

SEQ ID NO: 3571965 - RNA, 22 nt, Human
cucugccagggcagugcuagug

SEQ ID NO: 3571966 - RNA, 18 nt, Human
cucugccaguccuguccu

SEQ ID NO: 3571967 - RNA, 20 nt, Human
cucugccaugaacuggaggc

SEQ ID NO: 3571968 - RNA, 14 nt, Human
cucugcccaacccu

SEQ ID NO: 3571969 - RNA, 20 nt, Human
cucugcccaacccuucccuc

SEQ ID NO: 3571970 - RNA, 13 nt, Human
cucugcccacucc

SEQ ID NO: 3571971 - RNA, 15 nt, Human
cucugcccacucccu

SEQ ID NO: 3571972 - RNA, 18 nt, Human
cucugcccacucccugca

SEQ ID NO: 3571973 - RNA, 14 nt, Human
cucugcccagagcu

SEQ ID NO: 3571974 - RNA, 16 nt, Human
cucugcccagagcugg

SEQ ID NO: 3571975 - RNA, 19 nt, Human
cucugcccaggcacugcua

SEQ ID NO: 3571976 - RNA, 19 nt, Human
cucugcccauuccccagcc

SEQ ID NO: 3571977 - RNA, 20 nt, Human
cucugccccagaggccucuc

SEQ ID NO: 3571978 - RNA, 22 nt, Human
cucugccccagaggccucucuc

SEQ ID NO: 3571979 - RNA, 18 nt, Human
cucugccccagccagcgc

SEQ ID NO: 3571980 - RNA, 15 nt, Human
cucugccccagcuug

SEQ ID NO: 3571981 - RNA, 21 nt, Human
cucugccccagcuugggcaga

SEQ ID NO: 3571982 - RNA, 12 nt, Human
cucugccccagu

SEQ ID NO: 3571983 - RNA, 15 nt, Human
cucugccccauccuc

SEQ ID NO: 3571984 - RNA, 21 nt, Human
cucugccccauccuccagcag

SEQ ID NO: 3571985 - RNA, 24 nt, Human
cucugccccauccuccagcaggga

SEQ ID NO: 3571986 - RNA, 15 nt, Human
cucugcccuccaaga

SEQ ID NO: 3571987 - RNA, 16 nt, Human
cucugcccucuagagc

SEQ ID NO: 3571988 - RNA, 11 nt, Human
cucugcccugc

SEQ ID NO: 3571989 - RNA, 17 nt, Human
cucugcccugcccuagc

SEQ ID NO: 3571990 - RNA, 14 nt, Human
cucugcccugugua

SEQ ID NO: 3571991 - RNA, 19 nt, Human
cucugccgcuaccucccuc

SEQ ID NO: 3571992 - RNA, 18 nt, Human
cucugccgucucuggagc

SEQ ID NO: 3571993 - RNA, 21 nt, Human
cucugccucccaucacccgcu

SEQ ID NO: 3571994 - RNA, 21 nt, Human
cucugccucccucacccugag

SEQ ID NO: 3571995 - RNA, 15 nt, Human
cucugccuccucuuc

SEQ ID NO: 3571996 - RNA, 16 nt, Human
cucugccuccucuuca

SEQ ID NO: 3571997 - RNA, 10 nt, Human
cucugccuga

SEQ ID NO: 3571998 - RNA, 13 nt, Human
cucugccugcccc

SEQ ID NO: 3571999 - RNA, 19 nt, Human
cucugccugugagccaguc

SEQ ID NO: 3572000 - RNA, 20 nt, Human
cucugccugugagccagucu

SEQ ID NO: 3572001 - RNA, 23 nt, Human
cucugccuuugcaccacgggaca

SEQ ID NO: 3572002 - RNA, 18 nt, Human
cucugccuuugcucuggu

SEQ ID NO: 3572003 - RNA, 22 nt, Human
cucugcgugcagggacaaagag

SEQ ID NO: 3572004 - RNA, 21 nt, Human
cucugcucaccgcccaucagg

SEQ ID NO: 3572005 - RNA, 12 nt, Human
cucugcuccacc

SEQ ID NO: 3572006 - RNA, 15 nt, Human
cucugcuccaccaca

SEQ ID NO: 3572007 - RNA, 16 nt, Human
cucugcuccaccacau

SEQ ID NO: 3572008 - RNA, 14 nt, Human
cucugcuccaccuu

SEQ ID NO: 3572009 - RNA, 18 nt, Human
cucugcuccaccuuucag

SEQ ID NO: 3572010 - RNA, 16 nt, Human
cucugcucccccuuuu

SEQ ID NO: 3572011 - RNA, 14 nt, Human
cucugcuccuggag

SEQ ID NO: 3572012 - RNA, 17 nt, Human
cucugcucgcccuccuu

SEQ ID NO: 3572013 - RNA, 17 nt, Human
cucugcucgccuuagca

SEQ ID NO: 3572014 - RNA, 12 nt, Human
cucugcucugau

SEQ ID NO: 3572015 - RNA, 11 nt, Human
cucugcucugc

SEQ ID NO: 3572016 - RNA, 12 nt, Human
cucugcucugcc

SEQ ID NO: 3572017 - RNA, 15 nt, Human
cucugcucugcccuu

SEQ ID NO: 3572018 - RNA, 16 nt, Human
cucugcugaagacuug

SEQ ID NO: 3572019 - RNA, 14 nt, Human
cucugcugacagac

SEQ ID NO: 3572020 - RNA, 16 nt, Human
cucugcugacagacac

SEQ ID NO: 3572021 - RNA, 17 nt, Human
cucugcugacagacaca

SEQ ID NO: 3572022 - RNA, 19 nt, Human
cucugcugacagacacagg

SEQ ID NO: 3572023 - RNA, 22 nt, Human
cucugcugacagacacaggccc

SEQ ID NO: 3572024 - RNA, 16 nt, Human
cucugcugaccugcug

SEQ ID NO: 3572025 - RNA, 13 nt, Human
cucugcugagggu

SEQ ID NO: 3572026 - RNA, 22 nt, Human
cucugcugccugcccgcacagc

SEQ ID NO: 3572027 - RNA, 14 nt, Human
cucugcuggcccag

SEQ ID NO: 3572028 - RNA, 15 nt, Human
cucugcuggccgggc

SEQ ID NO: 3572029 - RNA, 22 nt, Human
cucugcuggccgggcacagcug

SEQ ID NO: 3572030 - RNA, 13 nt, Human
cucugcuggccug

SEQ ID NO: 3572031 - RNA, 16 nt, Human
cucugcuggccuggcc

SEQ ID NO: 3572032 - RNA, 13 nt, Human
cucugcugucuaa

SEQ ID NO: 3572033 - RNA, 12 nt, Human
cucugcuuccca

SEQ ID NO: 3572034 - RNA, 13 nt, Human
cucugcuucccag

SEQ ID NO: 3572035 - RNA, 14 nt, Human
cucugcuucucacg

SEQ ID NO: 3572036 - RNA, 17 nt, Human
cucugcuucucucaccu

SEQ ID NO: 3572037 - RNA, 13 nt, Human
cucugcuucucug

SEQ ID NO: 3572038 - RNA, 16 nt, Human
cucugcuucucugacu

SEQ ID NO: 3572039 - RNA, 19 nt, Human
cucugcuugacaacaucug

SEQ ID NO: 3572040 - RNA, 20 nt, Human
cucugcuugccgaaacugga

SEQ ID NO: 3572041 - RNA, 13 nt, Human
cucugcuuugaaa

SEQ ID NO: 3572042 - RNA, 20 nt, Human
cucuggaaaaugugacccag

SEQ ID NO: 3572043 - RNA, 22 nt, Human
cucuggaaaggggggagcuggg

SEQ ID NO: 3572044 - RNA, 19 nt, Human
cucuggaagcccuggagac

SEQ ID NO: 3572045 - RNA, 14 nt, Human
cucuggaauuugaa

SEQ ID NO: 3572046 - RNA, 18 nt, Human
cucuggacagccccaccc

SEQ ID NO: 3572047 - RNA, 14 nt, Human
cucuggacaggcau

SEQ ID NO: 3572048 - RNA, 22 nt, Human
cucuggacaggcauguucucug

SEQ ID NO: 3572049 - RNA, 22 nt, Human
cucugugcccacccuccacucu

SEQ ID NO: 3572050 - RNA, 15 nt, Human
cucugugccucccuc

SEQ ID NO: 3572051 - RNA, 16 nt, Human
cucugugccuucuuuu

SEQ ID NO: 3572052 - RNA, 20 nt, Human
cucugugcugacccuccugu

SEQ ID NO: 3572053 - RNA, 15 nt, Human
cucugugcuggccag

SEQ ID NO: 3572054 - RNA, 23 nt, Human
cucugugcuuugacucaccuguu

SEQ ID NO: 3572055 - RNA, 19 nt, Human
cucuguggcauugaaauga

SEQ ID NO: 3572056 - RNA, 13 nt, Human
cucugugggcugc

SEQ ID NO: 3572057 - RNA, 16 nt, Human
cucugugggcugcacu

SEQ ID NO: 3572058 - RNA, 17 nt, Human
cucugugggcugcacuc

SEQ ID NO: 3572059 - RNA, 17 nt, Human
cucugugggcuggcagu

SEQ ID NO: 3572060 - RNA, 17 nt, Human
cucugugucacuggcug

SEQ ID NO: 3572061 - RNA, 20 nt, Human
cucugugucacuggcugccu

SEQ ID NO: 3572062 - RNA, 23 nt, Human
cucugugucacuggcugccucca

SEQ ID NO: 3572063 - RNA, 20 nt, Human
cucugugucagguggggcag

SEQ ID NO: 3572064 - RNA, 22 nt, Human
cucugugucagguggggcagcu

SEQ ID NO: 3572065 - RNA, 23 nt, Human
cucugugucuaagauucuagauc

SEQ ID NO: 3572066 - RNA, 14 nt, Human
cucugugucugagu

SEQ ID NO: 3572067 - RNA, 20 nt, Human
cucuguuaauaaucucacau

SEQ ID NO: 3572068 - RNA, 22 nt, Human
cucuguucaaagcugccugucc

SEQ ID NO: 3572069 - RNA, 14 nt, Human
cucuguucaguaac

SEQ ID NO: 3572070 - RNA, 14 nt, Human
cucuguucagugua

SEQ ID NO: 3572071 - RNA, 15 nt, Human
cucuguucauuccuc

SEQ ID NO: 3572072 - RNA, 17 nt, Human
cucuguucauuccucca

SEQ ID NO: 3572073 - RNA, 15 nt, Human
cucuguuccaugucu

SEQ ID NO: 3572074 - RNA, 14 nt, Human
cucuguuccccuag

SEQ ID NO: 3572075 - RNA, 23 nt, Human
cucuguuccccuaguaagugccu

SEQ ID NO: 3572076 - RNA, 22 nt, Human
cucuguuccuucacauccugug

SEQ ID NO: 3572077 - RNA, 15 nt, Human
cucuguuccuucccu

SEQ ID NO: 3572078 - RNA, 15 nt, Human
cucuguucuuccuca

SEQ ID NO: 3572079 - RNA, 20 nt, Human
cucuguucuuccucagccag

SEQ ID NO: 3572080 - RNA, 21 nt, Human
cucuguucuuccucagccagc

SEQ ID NO: 3572081 - RNA, 22 nt, Human
cucuguucuuccucagccagcc

SEQ ID NO: 3572082 - RNA, 20 nt, Human
cucuguugcaagugcaauaa

SEQ ID NO: 3572083 - RNA, 22 nt, Human
cucuguugcccaggcuggagug

SEQ ID NO: 3572084 - RNA, 20 nt, Human
cucuguuguccuccccuugg

SEQ ID NO: 3572085 - RNA, 22 nt, Human
cucuguuguguucguucuuguu

SEQ ID NO: 3572086 - RNA, 16 nt, Human
cucuguuuguggggug

SEQ ID NO: 3572087 - RNA, 23 nt, Human
cucuguuuuacaaguuggaguca

SEQ ID NO: 3572088 - RNA, 20 nt, Human
cucuuaaaagaggaaaauga

SEQ ID NO: 3572089 - RNA, 20 nt, Human
cucuuaaagaaaacccaccc

SEQ ID NO: 3572090 - RNA, 18 nt, Human
cucuuaaaguuggaauuu

SEQ ID NO: 3572091 - RNA, 22 nt, Human
cucuuaaaguuggaauuuacca

SEQ ID NO: 3572092 - RNA, 19 nt, Human
cucuuaagaagacugcauu

SEQ ID NO: 3572093 - RNA, 12 nt, Human
cucuuaagccau

SEQ ID NO: 3572094 - RNA, 22 nt, Human
cucuuaagcuuccgccgucuca

SEQ ID NO: 3572095 - RNA, 22 nt, Human
cucuuaaguuucucagcuccca

SEQ ID NO: 3572096 - RNA, 12 nt, Human
cucuuaauugcc

SEQ ID NO: 3572097 - RNA, 17 nt, Human
cucuuaauuguucauuu

SEQ ID NO: 3572098 - RNA, 22 nt, Human
cucuuacccuucugugcccagc

SEQ ID NO: 3572099 - RNA, 22 nt, Human
cucuuacgaauauuuucaguaa

SEQ ID NO: 3572100 - RNA, 20 nt, Human
cucuuacgcccaacccuucc

SEQ ID NO: 3572101 - RNA, 15 nt, Human
cucuuacucuuuccu

SEQ ID NO: 3572102 - RNA, 16 nt, Human
cucuuacugcaaaugu

SEQ ID NO: 3572103 - RNA, 13 nt, Human
cucuuagaaaaac

SEQ ID NO: 3572104 - RNA, 15 nt, Human
cucuuagaaaaacca

SEQ ID NO: 3572105 - RNA, 16 nt, Human
cucuuagaaaugaagg

SEQ ID NO: 3572106 - RNA, 20 nt, Human
cucuuagaugcaguucugaa

SEQ ID NO: 3572107 - RNA, 21 nt, Human
cucuuagaugcaguucugaag

SEQ ID NO: 3572108 - RNA, 22 nt, Human
cucuuagaugcaguucugaaga

SEQ ID NO: 3572109 - RNA, 19 nt, Human
cucuuagcagcuuccagau

SEQ ID NO: 3572110 - RNA, 21 nt, Human
cucuuagcauuuuaauuagau

SEQ ID NO: 3572111 - RNA, 17 nt, Human
cucuuagcuccccucca

SEQ ID NO: 3572112 - RNA, 18 nt, Human
cucuuagcuccccuccaa

SEQ ID NO: 3572113 - RNA, 13 nt, Human
cucuuagcugagu

SEQ ID NO: 3572114 - RNA, 18 nt, Human
cucuuagucuagguccuu

SEQ ID NO: 3572115 - RNA, 16 nt, Human
cucuuauagaauauuu

SEQ ID NO: 3572116 - RNA, 17 nt, Human
cucuuauagaauauuua

SEQ ID NO: 3572117 - RNA, 18 nt, Human
cucuuauagaauauuuau

SEQ ID NO: 3572118 - RNA, 21 nt, Human
cucuuauagaauauuuauuac

SEQ ID NO: 3572119 - RNA, 15 nt, Human
cucuuauaucuauau

SEQ ID NO: 3572120 - RNA, 17 nt, Human
cucuuaugcacaccucc

SEQ ID NO: 3572121 - RNA, 13 nt, Human
cucuuaugcugua

SEQ ID NO: 3572122 - RNA, 21 nt, Human
cucuuauggauguccccagca

SEQ ID NO: 3572123 - RNA, 14 nt, Human
cucuuaugggcugg

SEQ ID NO: 3572124 - RNA, 15 nt, Human
cucuuaugggcuggg

SEQ ID NO: 3572125 - RNA, 17 nt, Human
cucuuauguaccucuuu

SEQ ID NO: 3572126 - RNA, 20 nt, Human
cucuuauugcccacgcugga

SEQ ID NO: 3572127 - RNA, 22 nt, Human
cucuuauugccucacuucaggu

SEQ ID NO: 3572128 - RNA, 17 nt, Human
cucuucaaauuagaaga

SEQ ID NO: 3572129 - RNA, 18 nt, Human
cucuucaccccccacuca

SEQ ID NO: 3572130 - RNA, 16 nt, Human
cucuucaccccggcag

SEQ ID NO: 3572131 - RNA, 18 nt, Human
cucuucaccccggcaggc

SEQ ID NO: 3572132 - RNA, 19 nt, Human
cucuucaccccggcaggcc

SEQ ID NO: 3572133 - RNA, 21 nt, Human
cucuucaccccggcaggcccu

SEQ ID NO: 3572134 - RNA, 23 nt, Human
cucuucaccccggcaggcccugc

SEQ ID NO: 3572135 - RNA, 18 nt, Human
cucuucacucuucaaaug

SEQ ID NO: 3572136 - RNA, 21 nt, Human
cucuucagaaagugugcuuua

SEQ ID NO: 3572137 - RNA, 17 nt, Human
cucuucagaggcccucg

SEQ ID NO: 3572138 - RNA, 20 nt, Human
cucuucagaugccacuucua

SEQ ID NO: 3572139 - RNA, 13 nt, Human
cucuucagcacaa

SEQ ID NO: 3572140 - RNA, 19 nt, Human
cucuucaggccucccucuc

SEQ ID NO: 3572141 - RNA, 22 nt, Human
cucuucagguucuuagugucac

SEQ ID NO: 3572142 - RNA, 23 nt, Human
cucuucaguuaagccuuuggaaa

SEQ ID NO: 3572143 - RNA, 15 nt, Human
cucuucauaauucua

SEQ ID NO: 3572144 - RNA, 18 nt, Human
cucuucauuauucucugc

SEQ ID NO: 3572145 - RNA, 14 nt, Human
cucuuccaggcagc

SEQ ID NO: 3572146 - RNA, 22 nt, Human
cucuuccaggcugggagagccu

SEQ ID NO: 3572147 - RNA, 23 nt, Human
cucuuccaggcugggagagccuu

SEQ ID NO: 3572148 - RNA, 19 nt, Human
cucuuccagucuuccugac

SEQ ID NO: 3572149 - RNA, 22 nt, Human
cucuuccagucuuccugacacu

SEQ ID NO: 3572150 - RNA, 14 nt, Human
cucuuccaugcugu

SEQ ID NO: 3572151 - RNA, 12 nt, Human
cucuuccccaga

SEQ ID NO: 3572152 - RNA, 12 nt, Human
cucuuccccucu

SEQ ID NO: 3572153 - RNA, 15 nt, Human
cucuucccucagucc

SEQ ID NO: 3572154 - RNA, 14 nt, Human
cucuucccucuucc

SEQ ID NO: 3572155 - RNA, 20 nt, Human
cucuucccugaacuuccugc

SEQ ID NO: 3572156 - RNA, 17 nt, Human
cucuucccuuuccccag

SEQ ID NO: 3572157 - RNA, 21 nt, Human
cucuucccuuuccccagcauc

SEQ ID NO: 3572158 - RNA, 23 nt, Human
cucuuccgaaaaauccucuuccu

SEQ ID NO: 3572159 - RNA, 18 nt, Human
cucuuccgacucuuucug

SEQ ID NO: 3572160 - RNA, 20 nt, Human
cucuuccgugacgucacugg

SEQ ID NO: 3572161 - RNA, 12 nt, Human
cucuuccuaccc

SEQ ID NO: 3572162 - RNA, 19 nt, Human
cucuuccuacccaaccacu

SEQ ID NO: 3572163 - RNA, 17 nt, Human
cucuuccuacccugccu

SEQ ID NO: 3572164 - RNA, 18 nt, Human
cucuuccuacuggucucu

SEQ ID NO: 3572165 - RNA, 20 nt, Human
cucuuccuacuggucucucu

SEQ ID NO: 3572166 - RNA, 19 nt, Human
cucuuccuaucccauccca

SEQ ID NO: 3572167 - RNA, 12 nt, Human
cucuuccugccc

SEQ ID NO: 3572168 - RNA, 19 nt, Human
cucuuccugccccucuuuc

SEQ ID NO: 3572169 - RNA, 21 nt, Human
cucuuccugccccucuuucuc

SEQ ID NO: 3572170 - RNA, 10 nt, Human
cucuuccugu

SEQ ID NO: 3572171 - RNA, 13 nt, Human
cucuuccugugau

SEQ ID NO: 3572172 - RNA, 17 nt, Human
cucuuccugugauccac

SEQ ID NO: 3572173 - RNA, 18 nt, Human
cucuuccuugcuguguca

SEQ ID NO: 3572174 - RNA, 13 nt, Human
cucuuccuuucuu

SEQ ID NO: 3572175 - RNA, 23 nt, Human
cucuucgcgcccgccccugcagc

SEQ ID NO: 3572176 - RNA, 13 nt, Human
cucuucggcccuc

SEQ ID NO: 3572177 - RNA, 16 nt, Human
cucuucggcccucaga

SEQ ID NO: 3572178 - RNA, 20 nt, Human
cucuucguuucagugucaaa

SEQ ID NO: 3572179 - RNA, 18 nt, Human
cucuucuacucacuuuuc

SEQ ID NO: 3572180 - RNA, 15 nt, Human
cucuucucagccacu

SEQ ID NO: 3572181 - RNA, 14 nt, Human
cucuucucccagaa

SEQ ID NO: 3572182 - RNA, 15 nt, Human
cucuucucccagaau

SEQ ID NO: 3572183 - RNA, 13 nt, Human
cucuucuccccag

SEQ ID NO: 3572184 - RNA, 14 nt, Human
cucuucuccccaga

SEQ ID NO: 3572185 - RNA, 16 nt, Human
cucuucuccccuucca

SEQ ID NO: 3572186 - RNA, 20 nt, Human
cucuucuccccuuccauuuc

SEQ ID NO: 3572187 - RNA, 13 nt, Human
cucuucuccuuuc

SEQ ID NO: 3572188 - RNA, 19 nt, Human
cucuucucuccagcugacu

SEQ ID NO: 3572189 - RNA, 14 nt, Human
cucuucucucugcu

SEQ ID NO: 3572190 - RNA, 19 nt, Human
cucuucucucugcucugac

SEQ ID NO: 3572191 - RNA, 16 nt, Human
cucuucucuuccugua

SEQ ID NO: 3572192 - RNA, 18 nt, Human
cucuuuuccccuuuccug

SEQ ID NO: 3572193 - RNA, 20 nt, Human
cucuuuuccccuuuccuguc

SEQ ID NO: 3572194 - RNA, 21 nt, Human
cucuuuuccccuuuccugucc

SEQ ID NO: 3572195 - RNA, 22 nt, Human
cucuuuuccuuugguccuucaa

SEQ ID NO: 3572196 - RNA, 12 nt, Human
cucuuuucucug

SEQ ID NO: 3572197 - RNA, 13 nt, Human
cucuuuucucuuu

SEQ ID NO: 3572198 - RNA, 10 nt, Human
cucuuuucuu

SEQ ID NO: 3572199 - RNA, 16 nt, Human
cucuuuucuuacuccu

SEQ ID NO: 3572200 - RNA, 18 nt, Human
cucuuuucuuacuccucc

SEQ ID NO: 3572201 - RNA, 20 nt, Human
cucuuuucuuacuccuccuc

SEQ ID NO: 3572202 - RNA, 15 nt, Human
cucuuuuguaaauua

SEQ ID NO: 3572203 - RNA, 18 nt, Human
cucuuuuguuaaauaaua

SEQ ID NO: 3572204 - RNA, 13 nt, Human
cucuuuuguuguu

SEQ ID NO: 3572205 - RNA, 17 nt, Human
cucuuuuguuguuucuu

SEQ ID NO: 3572206 - RNA, 11 nt, Human
cucuuuuuaag

SEQ ID NO: 3572207 - RNA, 19 nt, Human
cucuuuuuguaccugguga

SEQ ID NO: 3572208 - RNA, 17 nt, Human
cucuuuuuuguuuguuu

SEQ ID NO: 3572209 - RNA, 21 nt, Human
cucuuuuuuguuuguuucuuu

SEQ ID NO: 3572210 - RNA, 13 nt, Human
cucuuuuuuuccu

SEQ ID NO: 3572211 - RNA, 19 nt, Human
cucuuuuuuuggcccaggc

SEQ ID NO: 3572212 - RNA, 15 nt, Human
cugaaaaaaaaccug

SEQ ID NO: 3572213 - RNA, 18 nt, Human
cugaaaaaaaguuuacaa

SEQ ID NO: 3572214 - RNA, 21 nt, Human
cugaaaaaacaccuagcuuua

SEQ ID NO: 3572215 - RNA, 12 nt, Human
cugaaaaaucac

SEQ ID NO: 3572216 - RNA, 22 nt, Human
cugaaaacaauggaguauucuc

SEQ ID NO: 3572217 - RNA, 18 nt, Human
cugaaaaccaucuggccu

SEQ ID NO: 3572218 - RNA, 14 nt, Human
cugaaaaccucucc

SEQ ID NO: 3572219 - RNA, 17 nt, Human
cugaaaaccucuccuca

SEQ ID NO: 3572220 - RNA, 13 nt, Human
cugaaaacuggaa

SEQ ID NO: 3572221 - RNA, 19 nt, Human
cugaaaacuggaauaagaa

SEQ ID NO: 3572222 - RNA, 23 nt, Human
cugaaaacuggaauaagaagcaa

SEQ ID NO: 3572223 - RNA, 13 nt, Human
cugaaaagaaaua

SEQ ID NO: 3572224 - RNA, 17 nt, Human
cugaaaagaaauaauaa

SEQ ID NO: 3572225 - RNA, 19 nt, Human
cugaaaagacucaguguuc

SEQ ID NO: 3572226 - RNA, 20 nt, Human
cugaaaauauauaagcucag

SEQ ID NO: 3572227 - RNA, 17 nt, Human
cugaaaauauuguuuua

SEQ ID NO: 3572228 - RNA, 20 nt, Human
cugaaaauauuguuuuacaa

SEQ ID NO: 3572229 - RNA, 20 nt, Human
cugaaaaucgaguuuuuccu

SEQ ID NO: 3572230 - RNA, 18 nt, Human
cugaaaaugguauuuucc

SEQ ID NO: 3572231 - RNA, 16 nt, Human
cugaaaauguaugugu

SEQ ID NO: 3572232 - RNA, 17 nt, Human
cugaaaauguccuugug

SEQ ID NO: 3572233 - RNA, 13 nt, Human
cugaaaaugugcu

SEQ ID NO: 3572234 - RNA, 21 nt, Human
cugaaaauguuguuaugcuau

SEQ ID NO: 3572235 - RNA, 17 nt, Human
cugaaaauuauuuaaac

SEQ ID NO: 3572236 - RNA, 15 nt, Human
cugaaaauugccuuu

SEQ ID NO: 3572237 - RNA, 15 nt, Human
cugaaacaacuugga

SEQ ID NO: 3572238 - RNA, 13 nt, Human
cugaaacagcugc

SEQ ID NO: 3572239 - RNA, 20 nt, Human
cugaaacagcugccuuagcu

SEQ ID NO: 3572240 - RNA, 23 nt, Human
cugaaacagcugccuuagcuuca

SEQ ID NO: 3572241 - RNA, 14 nt, Human
cugaaacaggagag

SEQ ID NO: 3572242 - RNA, 18 nt, Human
cugaaaccuuuaagaaaa

SEQ ID NO: 3572243 - RNA, 12 nt, Human
cugaaacuauau

SEQ ID NO: 3572244 - RNA, 14 nt, Human
cugaaagaaacagu

SEQ ID NO: 3572245 - RNA, 15 nt, Human
cugaaagaaacaguu

SEQ ID NO: 3572246 - RNA, 16 nt, Human
cugaaagaaacaguua

SEQ ID NO: 3572247 - RNA, 19 nt, Human
cugaaagaaacaguuaacu

SEQ ID NO: 3572248 - RNA, 21 nt, Human
cugaaagaaacaguuaacuuu

SEQ ID NO: 3572249 - RNA, 13 nt, Human
cugaaagaggaau

SEQ ID NO: 3572250 - RNA, 17 nt, Human
cugaaagaggaaugaag

SEQ ID NO: 3572251 - RNA, 17 nt, Human
cugaaagagucuuucuu

SEQ ID NO: 3572252 - RNA, 21 nt, Human
cugaaagccacguuccuuacu

SEQ ID NO: 3572253 - RNA, 23 nt, Human
cugaaagccagcugccgaccaga

SEQ ID NO: 3572254 - RNA, 15 nt, Human
cugaaagcccugagc

SEQ ID NO: 3572255 - RNA, 18 nt, Human
cugaaagcugguggcaga

SEQ ID NO: 3572256 - RNA, 17 nt, Human
cugaaaggaaagugcuu

SEQ ID NO: 3572257 - RNA, 22 nt, Human
cugaaaggcaguagucauuuuc

SEQ ID NO: 3572258 - RNA, 17 nt, Human
cugaaagguagacuuuu

SEQ ID NO: 3572259 - RNA, 16 nt, Human
cugaaaguagggggcu

SEQ ID NO: 3572260 - RNA, 23 nt, Human
cugaaagugaaaguccagaaacu

SEQ ID NO: 3572261 - RNA, 12 nt, Human
cugaaagugaug

SEQ ID NO: 3572262 - RNA, 12 nt, Human
cugaaagugugu

SEQ ID NO: 3572263 - RNA, 22 nt, Human
cugaaaguguuuccuucauuuc

SEQ ID NO: 3572264 - RNA, 17 nt, Human
cugaaaguuacccacug

SEQ ID NO: 3572265 - RNA, 14 nt, Human
cugaaaguuguaca

SEQ ID NO: 3572266 - RNA, 18 nt, Human
cugaaaguuuuguaaaag

SEQ ID NO: 3572267 - RNA, 17 nt, Human
cugaaauaacauggccu

SEQ ID NO: 3572268 - RNA, 16 nt, Human
cugaaauaaggaauga

SEQ ID NO: 3572269 - RNA, 13 nt, Human
cugaaauccuggu

SEQ ID NO: 3572270 - RNA, 16 nt, Human
cugaaauccugguucc

SEQ ID NO: 3572271 - RNA, 19 nt, Human
cugaaaucucagaauuccu

SEQ ID NO: 3572272 - RNA, 14 nt, Human
cugaaaucuccuuu

SEQ ID NO: 3572273 - RNA, 22 nt, Human
cugaaaugaaacaaauaaucac

SEQ ID NO: 3572274 - RNA, 21 nt, Human
cugaaaugccuuacuuuguau

SEQ ID NO: 3572275 - RNA, 19 nt, Human
cugaaaugucaguucugau

SEQ ID NO: 3572276 - RNA, 13 nt, Human
cugaaaugugugu

SEQ ID NO: 3572277 - RNA, 17 nt, Human
cugaaauuccaaagucu

SEQ ID NO: 3572278 - RNA, 14 nt, Human
cugaaauucuccug

SEQ ID NO: 3572279 - RNA, 17 nt, Human
cugaaauucuccuggag

SEQ ID NO: 3572280 - RNA, 19 nt, Human
cugaaauucuccuggaggu

SEQ ID NO: 3572281 - RNA, 23 nt, Human
cugaaauuuccugggagcuuuug

SEQ ID NO: 3572282 - RNA, 22 nt, Human
cugaaauuuuagaaauauucac

SEQ ID NO: 3572283 - RNA, 16 nt, Human
cugaacaaaaaauaaa

SEQ ID NO: 3572284 - RNA, 12 nt, Human
cugaacaagaau

SEQ ID NO: 3572285 - RNA, 21 nt, Human
cugaacaauaggcuguuccca

SEQ ID NO: 3572286 - RNA, 14 nt, Human
cugaacacaggcag

SEQ ID NO: 3572287 - RNA, 18 nt, Human
cugaacacaggcagcuuu

SEQ ID NO: 3572288 - RNA, 13 nt, Human
cugaacacauuuc

SEQ ID NO: 3572289 - RNA, 18 nt, Human
cugaacaccauugaaggc

SEQ ID NO: 3572290 - RNA, 18 nt, Human
cugaacacuccaauuaag

SEQ ID NO: 3572291 - RNA, 20 nt, Human
cugaacacuuauugcuuuga

SEQ ID NO: 3572292 - RNA, 14 nt, Human
cugaacagccaaau

SEQ ID NO: 3572293 - RNA, 12 nt, Human
cugaacagcugg

SEQ ID NO: 3572294 - RNA, 13 nt, Human
cugaacagcuggu

SEQ ID NO: 3572295 - RNA, 16 nt, Human
cugaacagcuggugua

SEQ ID NO: 3572296 - RNA, 20 nt, Human
cugaacauccuuccuuccca

SEQ ID NO: 3572297 - RNA, 19 nt, Human
cugaacaucugaguccugg

SEQ ID NO: 3572298 - RNA, 17 nt, Human
cugaaccacuuguagau

SEQ ID NO: 3572299 - RNA, 13 nt, Human
cugaacccugugc

SEQ ID NO: 3572300 - RNA, 14 nt, Human
cugaacccugugcu

SEQ ID NO: 3572301 - RNA, 23 nt, Human
cugaacccugugcugguguccug

SEQ ID NO: 3572302 - RNA, 20 nt, Human
cugaaccggcuuuaccaaac

SEQ ID NO: 3572303 - RNA, 20 nt, Human
cugaaccugggaaagagauu

SEQ ID NO: 3572304 - RNA, 21 nt, Human
cugaaccuggguaacuaggga

SEQ ID NO: 3572305 - RNA, 13 nt, Human
cugaaccugucuu

SEQ ID NO: 3572306 - RNA, 14 nt, Human
cugaaccuuccauc

SEQ ID NO: 3572307 - RNA, 19 nt, Human
cugaacgauccuucaaagu

SEQ ID NO: 3572308 - RNA, 20 nt, Human
cugaacgauccuucaaaguc

SEQ ID NO: 3572309 - RNA, 13 nt, Human
cugaacggggaga

SEQ ID NO: 3572310 - RNA, 22 nt, Human
cugaacuaauaaaucuguugcc

SEQ ID NO: 3572311 - RNA, 13 nt, Human
cugaacucacuuu

SEQ ID NO: 3572312 - RNA, 21 nt, Human
cugaacuccugccauagucuu

SEQ ID NO: 3572313 - RNA, 20 nt, Human
cugaacucgcuucucuguga

SEQ ID NO: 3572314 - RNA, 19 nt, Human
cugaacugauggguuucuc

SEQ ID NO: 3572315 - RNA, 20 nt, Human
cugaacuguguguaauuguu

SEQ ID NO: 3572316 - RNA, 21 nt, Human
cugaacuguuaagaaaucugu

SEQ ID NO: 3572317 - RNA, 16 nt, Human
cugaacuucagagcau

SEQ ID NO: 3572318 - RNA, 13 nt, Human
cugaacuucagcu

SEQ ID NO: 3572319 - RNA, 21 nt, Human
cugaacuuggcgcugccccug

SEQ ID NO: 3572320 - RNA, 18 nt, Human
cugaacuuugaagacccg

SEQ ID NO: 3572321 - RNA, 12 nt, Human
cugaacuuugcu

SEQ ID NO: 3572322 - RNA, 14 nt, Human
cugaacuuugcuga

SEQ ID NO: 3572323 - RNA, 21 nt, Human
cugaacuuugcugagccugua

SEQ ID NO: 3572324 - RNA, 14 nt, Human
cugaacuuuggaga

SEQ ID NO: 3572325 - RNA, 13 nt, Human
cugaagaaagugu

SEQ ID NO: 3572326 - RNA, 14 nt, Human
cugaagaacuauuu

SEQ ID NO: 3572327 - RNA, 15 nt, Human
cugaagaauuaagau

SEQ ID NO: 3572328 - RNA, 13 nt, Human
cugaagaauugaa

SEQ ID NO: 3572329 - RNA, 23 nt, Human
cugaagacgccgucuccauggca

SEQ ID NO: 3572330 - RNA, 19 nt, Human
cugaagacucauucuucug

SEQ ID NO: 3572331 - RNA, 14 nt, Human
cugaagacugagga

SEQ ID NO: 3572332 - RNA, 11 nt, Human
cugaagaggag

SEQ ID NO: 3572333 - RNA, 14 nt, Human
cugaagaggaggag

SEQ ID NO: 3572334 - RNA, 19 nt, Human
cugaagaggcgggccagcc

SEQ ID NO: 3572335 - RNA, 23 nt, Human
cugaagaggcgggccagccaggc

SEQ ID NO: 3572336 - RNA, 14 nt, Human
cugaagaguccucu

SEQ ID NO: 3572337 - RNA, 14 nt, Human
cugaagauagaaga

SEQ ID NO: 3572338 - RNA, 14 nt, Human
cugacacguccacc

SEQ ID NO: 3572339 - RNA, 21 nt, Human
cugacacugcggggcuuggcu

SEQ ID NO: 3572340 - RNA, 16 nt, Human
cugacacuucaaggug

SEQ ID NO: 3572341 - RNA, 13 nt, Human
cugacagaaacca

SEQ ID NO: 3572342 - RNA, 14 nt, Human
cugacagacacagg

SEQ ID NO: 3572343 - RNA, 17 nt, Human
cugacagacacaggccc

SEQ ID NO: 3572344 - RNA, 19 nt, Human
cugacagacacaggcccgg

SEQ ID NO: 3572345 - RNA, 15 nt, Human
cugacagauuuccau

SEQ ID NO: 3572346 - RNA, 16 nt, Human
cugacagcagcaucuc

SEQ ID NO: 3572347 - RNA, 17 nt, Human
cugacagcagcaucucu

SEQ ID NO: 3572348 - RNA, 15 nt, Human
cugacagccagaacu

SEQ ID NO: 3572349 - RNA, 17 nt, Human
cugacagccucccaccc

SEQ ID NO: 3572350 - RNA, 20 nt, Human
cugacagccucccaccccca

SEQ ID NO: 3572351 - RNA, 13 nt, Human
cugacagcugcuc

SEQ ID NO: 3572352 - RNA, 17 nt, Human
cugacagcugcuccuag

SEQ ID NO: 3572353 - RNA, 23 nt, Human
cugacagcugcuccuagagggag

SEQ ID NO: 3572354 - RNA, 11 nt, Human
cugacaggcaa

SEQ ID NO: 3572355 - RNA, 17 nt, Human
cugacaggcaaugcugg

SEQ ID NO: 3572356 - RNA, 18 nt, Human
cugacaggcaaugcuggc

SEQ ID NO: 3572357 - RNA, 23 nt, Human
cugacaggcagccuggacauaga

SEQ ID NO: 3572358 - RNA, 19 nt, Human
cugacaguccucuccaccu

SEQ ID NO: 3572359 - RNA, 15 nt, Human
cugacagucuugugc

SEQ ID NO: 3572360 - RNA, 19 nt, Human
cugacaguuuacagacgcu

SEQ ID NO: 3572361 - RNA, 14 nt, Human
cugacaguuuuucu

SEQ ID NO: 3572362 - RNA, 16 nt, Human
cugacauaucuacacu

SEQ ID NO: 3572363 - RNA, 15 nt, Human
cugacaucaaaaaag

SEQ ID NO: 3572364 - RNA, 18 nt, Human
cugacaucacagcagccu

SEQ ID NO: 3572365 - RNA, 14 nt, Human
cugacauccccacu

SEQ ID NO: 3572366 - RNA, 15 nt, Human
cugacaucucugcaa

SEQ ID NO: 3572367 - RNA, 16 nt, Human
cugacaucucugcaau

SEQ ID NO: 3572368 - RNA, 16 nt, Human
cugacaucuggaaucu

SEQ ID NO: 3572369 - RNA, 16 nt, Human
cugacaucuguguuuc

SEQ ID NO: 3572370 - RNA, 14 nt, Human
cugacauggcucug

SEQ ID NO: 3572371 - RNA, 14 nt, Human
cugacauguggggc

SEQ ID NO: 3572372 - RNA, 19 nt, Human
cugacauguggggccaggu

SEQ ID NO: 3572373 - RNA, 21 nt, Human
cugacauuaacaguuuuccau

SEQ ID NO: 3572374 - RNA, 23 nt, Human
cugacauucaccugccccaacuc

SEQ ID NO: 3572375 - RNA, 16 nt, Human
cugacauuccuugcug

SEQ ID NO: 3572376 - RNA, 17 nt, Human
cugacauugccaaaaag

SEQ ID NO: 3572377 - RNA, 20 nt, Human
cugacauugccaaaaaggau

SEQ ID NO: 3572378 - RNA, 15 nt, Human
cugacauuggagccu

SEQ ID NO: 3572379 - RNA, 21 nt, Human
cugacauuguuggccaaagcc

SEQ ID NO: 3572380 - RNA, 14 nt, Human
cugacauuucuucu

SEQ ID NO: 3572381 - RNA, 21 nt, Human
cugacauuuucuuucaugggc

SEQ ID NO: 3572382 - RNA, 17 nt, Human
cugaccaagagagaaag

SEQ ID NO: 3572383 - RNA, 14 nt, Human
cugaccaaguuucu

SEQ ID NO: 3572384 - RNA, 17 nt, Human
cugaccaauugugcugc

SEQ ID NO: 3572385 - RNA, 18 nt, Human
cugaccaauugugcugcc

SEQ ID NO: 3572386 - RNA, 19 nt, Human
cugaccaauugugcugcca

SEQ ID NO: 3572387 - RNA, 20 nt, Human
cugaccaauugugcugccau

SEQ ID NO: 3572388 - RNA, 13 nt, Human
cugaccacacuuc

SEQ ID NO: 3572389 - RNA, 21 nt, Human
cugaccacacuuccuguccag

SEQ ID NO: 3572390 - RNA, 12 nt, Human
cugaccacagca

SEQ ID NO: 3572391 - RNA, 15 nt, Human
cugaccacagcacag

SEQ ID NO: 3572392 - RNA, 18 nt, Human
cugaccacagcacagcca

SEQ ID NO: 3572393 - RNA, 12 nt, Human
cugaccacccuc

SEQ ID NO: 3572394 - RNA, 14 nt, Human
cugaccacccuccc

SEQ ID NO: 3572395 - RNA, 22 nt, Human
cugaccaccuuuguuucucccc

SEQ ID NO: 3572396 - RNA, 22 nt, Human
cugaccacgcuuucuagcuguu

SEQ ID NO: 3572397 - RNA, 15 nt, Human
cugaccacucagaga

SEQ ID NO: 3572398 - RNA, 23 nt, Human
cugaccacucagagacaugcaga

SEQ ID NO: 3572399 - RNA, 13 nt, Human
cugaccagcagcg

SEQ ID NO: 3572400 - RNA, 14 nt, Human
cugaccagcagcgc

SEQ ID NO: 3572401 - RNA, 22 nt, Human
cugaccagcagcgccuuuccca

SEQ ID NO: 3572402 - RNA, 23 nt, Human
cugaccagccgugagcauguuug

SEQ ID NO: 3572403 - RNA, 21 nt, Human
cugaccagccuccaugcugcc

SEQ ID NO: 3572404 - RNA, 23 nt, Human
cugaccagccuccaugcugccuc

SEQ ID NO: 3572405 - RNA, 20 nt, Human
cugaccagcucccccucccu

SEQ ID NO: 3572406 - RNA, 16 nt, Human
cugaccagcugcuccg

SEQ ID NO: 3572407 - RNA, 23 nt, Human
cugaccaguuuaaccugaugcag

SEQ ID NO: 3572408 - RNA, 15 nt, Human
cugaccauccacucu

SEQ ID NO: 3572409 - RNA, 21 nt, Human
cugaccaugcucaucugcugg

SEQ ID NO: 3572410 - RNA, 14 nt, Human
cugacccacugcuu

SEQ ID NO: 3572411 - RNA, 15 nt, Human
cugacccagccuguu

SEQ ID NO: 3572412 - RNA, 16 nt, Human
cugacccaggccgcag

SEQ ID NO: 3572413 - RNA, 13 nt, Human
cugacccaguccc

SEQ ID NO: 3572414 - RNA, 14 nt, Human
cugacccagucccu

SEQ ID NO: 3572415 - RNA, 13 nt, Human
cugacccaugcug

SEQ ID NO: 3572416 - RNA, 19 nt, Human
cugacccaugcugcccugu

SEQ ID NO: 3572417 - RNA, 20 nt, Human
cugaccccaaagagccugga

SEQ ID NO: 3572418 - RNA, 23 nt, Human
cugaccccaaagagccuggagaa

SEQ ID NO: 3572419 - RNA, 15 nt, Human
cugaccccaucaccu

SEQ ID NO: 3572420 - RNA, 20 nt, Human
cugaccccccucaggacccu

SEQ ID NO: 3572421 - RNA, 20 nt, Human
cugaccccgguggcggcccc

SEQ ID NO: 3572422 - RNA, 14 nt, Human
cugaccccuccuca

SEQ ID NO: 3572423 - RNA, 15 nt, Human
cugaccccuccucac

SEQ ID NO: 3572424 - RNA, 16 nt, Human
cugaccccuccucacu

SEQ ID NO: 3572425 - RNA, 20 nt, Human
cugaccccuccucacuggcc

SEQ ID NO: 3572426 - RNA, 13 nt, Human
cugaccccugcuc

SEQ ID NO: 3572427 - RNA, 13 nt, Human
cugacccuccugu

SEQ ID NO: 3572428 - RNA, 19 nt, Human
cugacccugcuucaaauau

SEQ ID NO: 3572429 - RNA, 20 nt, Human
cugacccuggggcuggcuuu

SEQ ID NO: 3572430 - RNA, 12 nt, Human
cugacccuguau

SEQ ID NO: 3572431 - RNA, 19 nt, Human
cugacccuguauauagccc

SEQ ID NO: 3572432 - RNA, 20 nt, Human
cugacccuguauauagccca

SEQ ID NO: 3572433 - RNA, 22 nt, Human
cugacccuguauauagcccagc

SEQ ID NO: 3572434 - RNA, 13 nt, Human
cugacccugugga

SEQ ID NO: 3572435 - RNA, 13 nt, Human
cugaccgugggcg

SEQ ID NO: 3572436 - RNA, 12 nt, Human
cugaccucaaau

SEQ ID NO: 3572437 - RNA, 13 nt, Human
cugaccucccagc

SEQ ID NO: 3572438 - RNA, 18 nt, Human
cugaccucccagcccuau

SEQ ID NO: 3572439 - RNA, 23 nt, Human
cugaccucccagcccuauggaug

SEQ ID NO: 3572440 - RNA, 21 nt, Human
cugaccucccccuccuuccca

SEQ ID NO: 3572441 - RNA, 20 nt, Human
cugaccucccucuaauuuau

SEQ ID NO: 3572442 - RNA, 14 nt, Human
cugaccuccgccau

SEQ ID NO: 3572443 - RNA, 17 nt, Human
cugaccuccgccaucca

SEQ ID NO: 3572444 - RNA, 16 nt, Human
cugaccucuugcuguc

SEQ ID NO: 3572445 - RNA, 17 nt, Human
cugaccucuugcugucu

SEQ ID NO: 3572446 - RNA, 19 nt, Human
cugaccucuugcugucucu

SEQ ID NO: 3572447 - RNA, 12 nt, Human
cugaccugcagg

SEQ ID NO: 3572448 - RNA, 22 nt, Human
cugaccugccucucacacacau

SEQ ID NO: 3572449 - RNA, 15 nt, Human
cugaccugcugaccu

SEQ ID NO: 3572450 - RNA, 20 nt, Human
cugaccuggcccccucagug

SEQ ID NO: 3572451 - RNA, 18 nt, Human
cugaccugucaugccccc

SEQ ID NO: 3572452 - RNA, 20 nt, Human
cugaccugucaugccccccu

SEQ ID NO: 3572453 - RNA, 20 nt, Human
cugaccugugagcccagcug

SEQ ID NO: 3572454 - RNA, 14 nt, Human
cugaccuucagcuc

SEQ ID NO: 3572455 - RNA, 15 nt, Human
cugaccuucagcuca

SEQ ID NO: 3572456 - RNA, 21 nt, Human
cugaccuuccucgcagagagg

SEQ ID NO: 3572457 - RNA, 15 nt, Human
cugaccuuccuuccu

SEQ ID NO: 3572458 - RNA, 16 nt, Human
cugaccuugaugagcu

SEQ ID NO: 3572459 - RNA, 14 nt, Human
cugaccuuggagag

SEQ ID NO: 3572460 - RNA, 18 nt, Human
cugaccuuugucaucuuu

SEQ ID NO: 3572461 - RNA, 21 nt, Human
cugacgaacuuccauggcccu

SEQ ID NO: 3572462 - RNA, 15 nt, Human
cugacgaggcugggc

SEQ ID NO: 3572463 - RNA, 20 nt, Human
cugacgaggcugggccaagc

SEQ ID NO: 3572464 - RNA, 21 nt, Human
cugacgcaaaaccacuuuccu

SEQ ID NO: 3572465 - RNA, 21 nt, Human
cugacggaagccaacuuggcu

SEQ ID NO: 3572466 - RNA, 15 nt, Human
cugacggccagggag

SEQ ID NO: 3572467 - RNA, 21 nt, Human
cugacggccagggagaagcuc

SEQ ID NO: 3572468 - RNA, 15 nt, Human
cugacggcccugcaa

SEQ ID NO: 3572469 - RNA, 16 nt, Human
cugacggcccugcaau

SEQ ID NO: 3572470 - RNA, 18 nt, Human
cugacguagcugcaaagg

SEQ ID NO: 3572471 - RNA, 13 nt, Human
cugacguccaccu

SEQ ID NO: 3572472 - RNA, 14 nt, Human
cugacgugccuuuu

SEQ ID NO: 3572473 - RNA, 17 nt, Human
cugacgugccuuuugca

SEQ ID NO: 3572474 - RNA, 22 nt, Human
cugacgugccuuuugcaccccu

SEQ ID NO: 3572475 - RNA, 15 nt, Human
cugacuaaacuuuuu

SEQ ID NO: 3572476 - RNA, 22 nt, Human
cugacuaaacuuuuuuucugua

SEQ ID NO: 3572477 - RNA, 18 nt, Human
cugacuaaauuuggggac

SEQ ID NO: 3572478 - RNA, 14 nt, Human
cugacuacagggcc

SEQ ID NO: 3572479 - RNA, 22 nt, Human
cugacuacugggcaaagagugu

SEQ ID NO: 3572480 - RNA, 18 nt, Human
cugacuagugaggaaaga

SEQ ID NO: 3572481 - RNA, 23 nt, Human
cugacuauuauguuguuagagaa

SEQ ID NO: 3572482 - RNA, 21 nt, Human
cugacuauucuugauguaaaa

SEQ ID NO: 3572483 - RNA, 22 nt, Human
cugccuggagacuuagggcacc

SEQ ID NO: 3572484 - RNA, 12 nt, Human
cugccuggagcc

SEQ ID NO: 3572485 - RNA, 21 nt, Human
cugccuggagccccacugccc

SEQ ID NO: 3572486 - RNA, 16 nt, Human
cugccuggaggaccug

SEQ ID NO: 3572487 - RNA, 22 nt, Human
cugccuggaggaccugagccug

SEQ ID NO: 3572488 - RNA, 23 nt, Human
cugccuggaggaccugagccugc

SEQ ID NO: 3572489 - RNA, 15 nt, Human
cugccuggcccccaa

SEQ ID NO: 3572490 - RNA, 22 nt, Human
cugccuggcccccaaccucagg

SEQ ID NO: 3572491 - RNA, 17 nt, Human
cugccuggccggccagc

SEQ ID NO: 3572492 - RNA, 22 nt, Human
cugccuggccggccagccagcc

SEQ ID NO: 3572493 - RNA, 23 nt, Human
cugccugggaucccucauccuca

SEQ ID NO: 3572494 - RNA, 11 nt, Human
cugccugggcu

SEQ ID NO: 3572495 - RNA, 15 nt, Human
cugccugggcuguug

SEQ ID NO: 3572496 - RNA, 21 nt, Human
cugccugggcuguuggcacuc

SEQ ID NO: 3572497 - RNA, 20 nt, Human
cugccugguauauccaaaag

SEQ ID NO: 3572498 - RNA, 16 nt, Human
cugccuggucuccugc

SEQ ID NO: 3572499 - RNA, 19 nt, Human
cugccuggucuccugcccc

SEQ ID NO: 3572500 - RNA, 20 nt, Human
cugccuggugcccagcacau

SEQ ID NO: 3572501 - RNA, 15 nt, Human
cugccuguaguuagg

SEQ ID NO: 3572502 - RNA, 21 nt, Human
cugccuguaguuaggaaauaa

SEQ ID NO: 3572503 - RNA, 19 nt, Human
cugccuguauacuuuagua

SEQ ID NO: 3572504 - RNA, 20 nt, Human
cugccuguauacuuuaguau

SEQ ID NO: 3572505 - RNA, 21 nt, Human
cugccugucccuaccccaugg

SEQ ID NO: 3572506 - RNA, 19 nt, Human
cugccugucccucucaggc

SEQ ID NO: 3572507 - RNA, 14 nt, Human
cugccugucugccc

SEQ ID NO: 3572508 - RNA, 15 nt, Human
cugccugucugcccc

SEQ ID NO: 3572509 - RNA, 15 nt, Human
cugccugucugucuc

SEQ ID NO: 3572510 - RNA, 13 nt, Human
cugccuguggagu

SEQ ID NO: 3572511 - RNA, 21 nt, Human
cugccuguggccaugacccug

SEQ ID NO: 3572512 - RNA, 22 nt, Human
cugccuguggcgccgucuccag

SEQ ID NO: 3572513 - RNA, 22 nt, Human
cugccuguuaggagaagcugca

SEQ ID NO: 3572514 - RNA, 18 nt, Human
cugccuguuauaacucug

SEQ ID NO: 3572515 - RNA, 17 nt, Human
cugccuguucagcucca

SEQ ID NO: 3572516 - RNA, 14 nt, Human
cugccuguugggcc

SEQ ID NO: 3572517 - RNA, 16 nt, Human
cugccuguugggccag

SEQ ID NO: 3572518 - RNA, 21 nt, Human
cugccuguugggccaggagcc

SEQ ID NO: 3572519 - RNA, 18 nt, Human
cugccuuaaaaccaaaga

SEQ ID NO: 3572520 - RNA, 19 nt, Human
cugccuuagagccaggcac

SEQ ID NO: 3572521 - RNA, 15 nt, Human
cugccuuagaggagc

SEQ ID NO: 3572522 - RNA, 16 nt, Human
cugccuuagaggagcc

SEQ ID NO: 3572523 - RNA, 17 nt, Human
cugccuuaggccuaccu

SEQ ID NO: 3572524 - RNA, 19 nt, Human
cugccuuauucagggaagg

SEQ ID NO: 3572525 - RNA, 15 nt, Human
cugccuucccuagcu

SEQ ID NO: 3572526 - RNA, 16 nt, Human
cugccuucccuagcuu

SEQ ID NO: 3572527 - RNA, 17 nt, Human
cugccuucccuagcuuu

SEQ ID NO: 3572528 - RNA, 18 nt, Human
cugccuuccuccugggcc

SEQ ID NO: 3572529 - RNA, 21 nt, Human
cugccuuccuccugggcccuc

SEQ ID NO: 3572530 - RNA, 12 nt, Human
cugccuuccuug

SEQ ID NO: 3572531 - RNA, 13 nt, Human
cugccuuccuugc

SEQ ID NO: 3572532 - RNA, 14 nt, Human
cugccuuccuugcu

SEQ ID NO: 3572533 - RNA, 14 nt, Human
cugccuucgcuucu

SEQ ID NO: 3572534 - RNA, 21 nt, Human
cugccuucguuaacuguguau

SEQ ID NO: 3572535 - RNA, 22 nt, Human
cugccuucugacggcccugcaa

SEQ ID NO: 3572536 - RNA, 14 nt, Human
cugccuucuggccu

SEQ ID NO: 3572537 - RNA, 21 nt, Human
cugccuucuguccugguguca

SEQ ID NO: 3572538 - RNA, 19 nt, Human
cugccuucuucggaaagaa

SEQ ID NO: 3572539 - RNA, 24 nt, Human
cugccuucuucggggaacuccugg

SEQ ID NO: 3572540 - RNA, 15 nt, Human
cugccuucuucuuuu

SEQ ID NO: 3572541 - RNA, 16 nt, Human
cugccuugaagccacu

SEQ ID NO: 3572542 - RNA, 22 nt, Human
cugccuugaagccacugaagcu

SEQ ID NO: 3572543 - RNA, 22 nt, Human
cugccuugcccacuccugcucu

SEQ ID NO: 3572544 - RNA, 14 nt, Human
cugccuuggcucag

SEQ ID NO: 3572545 - RNA, 15 nt, Human
cugccuuggcucaga

SEQ ID NO: 3572546 - RNA, 22 nt, Human
cugccuuggcucagacauguuu

SEQ ID NO: 3572547 - RNA, 22 nt, Human
cugccuuggggucagguugaca

SEQ ID NO: 3572548 - RNA, 17 nt, Human
cugccuuuagaaaauau

SEQ ID NO: 3572549 - RNA, 20 nt, Human
cugccuuuagucgcugagga

SEQ ID NO: 3572550 - RNA, 14 nt, Human
cugccuuugccagg

SEQ ID NO: 3572551 - RNA, 17 nt, Human
cugccuuugccagguga

SEQ ID NO: 3572552 - RNA, 16 nt, Human
cugccuuugccuccag

SEQ ID NO: 3572553 - RNA, 21 nt, Human
cugccuuuggcacucugacuu

SEQ ID NO: 3572554 - RNA, 18 nt, Human
cugccuuuggcagaguuc

SEQ ID NO: 3572555 - RNA, 17 nt, Human
cugccuuugggagcagg

SEQ ID NO: 3572556 - RNA, 19 nt, Human
cugccuuuuaguuccugug

SEQ ID NO: 3572557 - RNA, 21 nt, Human
cugcgaagacccucuugccca

SEQ ID NO: 3572558 - RNA, 17 nt, Human
cugcgaaggggcccugg

SEQ ID NO: 3572559 - RNA, 18 nt, Human
cugcgaaggggcccuggu

SEQ ID NO: 3572560 - RNA, 19 nt, Human
cugcgaaggggcccugguc

SEQ ID NO: 3572561 - RNA, 19 nt, Human
cugcgaccacaagaaggau

SEQ ID NO: 3572562 - RNA, 15 nt, Human
cugcgagggcagcgg

SEQ ID NO: 3572563 - RNA, 12 nt, Human
cugcgcacugug

SEQ ID NO: 3572564 - RNA, 13 nt, Human
cugcgccacugcu

SEQ ID NO: 3572565 - RNA, 20 nt, Human
cugcgccaguccugcuaccu

SEQ ID NO: 3572566 - RNA, 18 nt, Human
cugcgcccaccccgcucu

SEQ ID NO: 3572567 - RNA, 18 nt, Human
cugcgcccaguccuucca

SEQ ID NO: 3572568 - RNA, 23 nt, Human
cugcgcccaguccuuccaccucg

SEQ ID NO: 3572569 - RNA, 13 nt, Human
cugcgcccuuccc

SEQ ID NO: 3572570 - RNA, 13 nt, Human
cugcgccucaggc

SEQ ID NO: 3572571 - RNA, 13 nt, Human
cugcgccugcugc

SEQ ID NO: 3572572 - RNA, 23 nt, Human
cugcgccugcugcaugcccucuc

SEQ ID NO: 3572573 - RNA, 13 nt, Human
cugcgccuuuccu

SEQ ID NO: 3572574 - RNA, 17 nt, Human
cugcgcuuuauuuucuu

SEQ ID NO: 3572575 - RNA, 14 nt, Human
cugcggaaaaggaa

SEQ ID NO: 3572576 - RNA, 23 nt, Human
cugcggaccccagcugugagccu

SEQ ID NO: 3572577 - RNA, 17 nt, Human
cugcggagcaagaggag

SEQ ID NO: 3572578 - RNA, 16 nt, Human
cugcggccccuccccc

SEQ ID NO: 3572579 - RNA, 19 nt, Human
cugcggcugcugugugccu

SEQ ID NO: 3572580 - RNA, 20 nt, Human
cugcgggaugguccuggggc

SEQ ID NO: 3572581 - RNA, 21 nt, Human
cugcgggggcagugcucaccc

SEQ ID NO: 3572582 - RNA, 22 nt, Human
cugcgggucacaggagggaggg

SEQ ID NO: 3572583 - RNA, 16 nt, Human
cugcggucaaggccag

SEQ ID NO: 3572584 - RNA, 16 nt, Human
cugcgguccacccagg

SEQ ID NO: 3572585 - RNA, 20 nt, Human
cugcgguccacccaggagcc

SEQ ID NO: 3572586 - RNA, 18 nt, Human
cugcggugcuaucucccc

SEQ ID NO: 3572587 - RNA, 20 nt, Human
cugcggugcuaucuccccca

SEQ ID NO: 3572588 - RNA, 21 nt, Human
cugcggugcuaucucccccag

SEQ ID NO: 3572589 - RNA, 23 nt, Human
cugcggugcuaucucccccagcc

SEQ ID NO: 3572590 - RNA, 22 nt, Human
cugcgguuuguuggaucuucaa

SEQ ID NO: 3572591 - RNA, 13 nt, Human
cugcguccuccuc

SEQ ID NO: 3572592 - RNA, 18 nt, Human
cugcguccuccucaccuc

SEQ ID NO: 3572593 - RNA, 17 nt, Human
cugcgucgguccuggug

SEQ ID NO: 3572594 - RNA, 18 nt, Human
cugcgucuggaggggccc

SEQ ID NO: 3572595 - RNA, 22 nt, Human
cugcgucuggaggggccccugc

SEQ ID NO: 3572596 - RNA, 20 nt, Human
cugcgugcagggacaaagag

SEQ ID NO: 3572597 - RNA, 18 nt, Human
cugcguucuugugacaga

SEQ ID NO: 3572598 - RNA, 17 nt, Human
cugcguugguccagagc

SEQ ID NO: 3572599 - RNA, 23 nt, Human
cugcuaaauaaaauuuguugcau

SEQ ID NO: 3572600 - RNA, 19 nt, Human
cugcuaaaucuccuauuuu

SEQ ID NO: 3572601 - RNA, 14 nt, Human
cugcuaacaaguca

SEQ ID NO: 3572602 - RNA, 21 nt, Human
cugcuaacuuggagccccagu

SEQ ID NO: 3572603 - RNA, 19 nt, Human
cugcuaaguauuucccagc

SEQ ID NO: 3572604 - RNA, 23 nt, Human
cugcuaauauuuuccuccugagu

SEQ ID NO: 3572605 - RNA, 17 nt, Human
cugcuacaaagaagaca

SEQ ID NO: 3572606 - RNA, 22 nt, Human
cugcuacaaagaagacauguuu

SEQ ID NO: 3572607 - RNA, 20 nt, Human
cugcuacaccuauuauccca

SEQ ID NO: 3572608 - RNA, 17 nt, Human
cugcuacccucccugcu

SEQ ID NO: 3572609 - RNA, 13 nt, Human
cugcuaccucacu

SEQ ID NO: 3572610 - RNA, 17 nt, Human
cugcuaccucacugggg

SEQ ID NO: 3572611 - RNA, 14 nt, Human
cugcuaccuugccc

SEQ ID NO: 3572612 - RNA, 17 nt, Human
cugcuaccuugccccaa

SEQ ID NO: 3572613 - RNA, 18 nt, Human
cugcuaccuuucaaagcu

SEQ ID NO: 3572614 - RNA, 19 nt, Human
cugcuaccuuucaaagcuu

SEQ ID NO: 3572615 - RNA, 20 nt, Human
cugcuaccuuucaaagcuug

SEQ ID NO: 3572616 - RNA, 17 nt, Human
cugcuacucuguuccuu

SEQ ID NO: 3572617 - RNA, 17 nt, Human
cugcuacugccaaccuc

SEQ ID NO: 3572618 - RNA, 18 nt, Human
cugcuacuguaauuuuau

SEQ ID NO: 3572619 - RNA, 13 nt, Human
cugcuacuuauau

SEQ ID NO: 3572620 - RNA, 15 nt, Human
cugcuagaacuuuuu

SEQ ID NO: 3572621 - RNA, 20 nt, Human
cugcuagaacuuuuuuaaau

SEQ ID NO: 3572622 - RNA, 23 nt, Human
cugcuagaacuuuuuuaaauaaa

SEQ ID NO: 3572623 - RNA, 16 nt, Human
cugcuagcaaauggca

SEQ ID NO: 3572624 - RNA, 14 nt, Human
cugcuagcacuugg

SEQ ID NO: 3572625 - RNA, 21 nt, Human
cugcuagcacuuggagccaag

SEQ ID NO: 3572626 - RNA, 20 nt, Human
cugcugagauacauacagaa

SEQ ID NO: 3572627 - RNA, 17 nt, Human
cugcugagauccuggac

SEQ ID NO: 3572628 - RNA, 13 nt, Human
cugcugagccgca

SEQ ID NO: 3572629 - RNA, 15 nt, Human
cugcugagccgcaga

SEQ ID NO: 3572630 - RNA, 18 nt, Human
cugcugagccgcagagaa

SEQ ID NO: 3572631 - RNA, 13 nt, Human
cugcugagcucug

SEQ ID NO: 3572632 - RNA, 14 nt, Human
cugcugagggucca

SEQ ID NO: 3572633 - RNA, 16 nt, Human
cugcugaggguccaga

SEQ ID NO: 3572634 - RNA, 23 nt, Human
cugcugagucccaggcugagccu

SEQ ID NO: 3572635 - RNA, 17 nt, Human
cugcugagucuguucug

SEQ ID NO: 3572636 - RNA, 14 nt, Human
cugcugauauuuuc

SEQ ID NO: 3572637 - RNA, 19 nt, Human
cugcugauauuuucucuag

SEQ ID NO: 3572638 - RNA, 14 nt, Human
cugcugaugcucau

SEQ ID NO: 3572639 - RNA, 15 nt, Human
cugcugaugcucaug

SEQ ID NO: 3572640 - RNA, 16 nt, Human
cugcugaugcucaugg

SEQ ID NO: 3572641 - RNA, 17 nt, Human
cugcugaugcucauggu

SEQ ID NO: 3572642 - RNA, 16 nt, Human
cugcugauuuaaacac

SEQ ID NO: 3572643 - RNA, 13 nt, Human
cugcugcaaggcc

SEQ ID NO: 3572644 - RNA, 19 nt, Human
cugcugcaccaacccagcc

SEQ ID NO: 3572645 - RNA, 18 nt, Human
cugcugcagaggggcagg

SEQ ID NO: 3572646 - RNA, 23 nt, Human
cugcugcagaggggcaggcccug

SEQ ID NO: 3572647 - RNA, 11 nt, Human
cugcugcaggg

SEQ ID NO: 3572648 - RNA, 12 nt, Human
cugcugcagggg

SEQ ID NO: 3572649 - RNA, 14 nt, Human
cugcugcaggggcu

SEQ ID NO: 3572650 - RNA, 17 nt, Human
cugcugcaggggcucug

SEQ ID NO: 3572651 - RNA, 18 nt, Human
cugcugcaggggcucugg

SEQ ID NO: 3572652 - RNA, 13 nt, Human
cugcugcaguugc

SEQ ID NO: 3572653 - RNA, 20 nt, Human
cugcugcauuugugucaucu

SEQ ID NO: 3572654 - RNA, 11 nt, Human
cugcugccacu

SEQ ID NO: 3572655 - RNA, 21 nt, Human
cugcugccaugaacugucaag

SEQ ID NO: 3572656 - RNA, 22 nt, Human
cugcugccauggcgugucccuc

SEQ ID NO: 3572657 - RNA, 16 nt, Human
cugcugccccaaagga

SEQ ID NO: 3572658 - RNA, 18 nt, Human
cugcugccccaaaggaag

SEQ ID NO: 3572659 - RNA, 14 nt, Human
cugcugccccugca

SEQ ID NO: 3572660 - RNA, 14 nt, Human
cugcugccgccucc

SEQ ID NO: 3572661 - RNA, 17 nt, Human
cugcugccgccucccag

SEQ ID NO: 3572662 - RNA, 20 nt, Human
cugcugccgccucccagccu

SEQ ID NO: 3572663 - RNA, 21 nt, Human
cugcugccgccucccagccug

SEQ ID NO: 3572664 - RNA, 15 nt, Human
cugcugccucccucu

SEQ ID NO: 3572665 - RNA, 12 nt, Human
cugcugccucuu

SEQ ID NO: 3572666 - RNA, 21 nt, Human
cugcugcgcccuuaccuuccc

SEQ ID NO: 3572667 - RNA, 21 nt, Human
cugcugcuaaucuucagggca

SEQ ID NO: 3572668 - RNA, 12 nt, Human
cugcugcucccu

SEQ ID NO: 3572669 - RNA, 15 nt, Human
cugcugcucccucag

SEQ ID NO: 3572670 - RNA, 16 nt, Human
cugcugcugagaaccu

SEQ ID NO: 3572671 - RNA, 15 nt, Human
cugcugcugccugcc

SEQ ID NO: 3572672 - RNA, 14 nt, Human
cugcugcugccugg

SEQ ID NO: 3572673 - RNA, 15 nt, Human
cugcugcuggcuggu

SEQ ID NO: 3572674 - RNA, 12 nt, Human
cugcugcugggc

SEQ ID NO: 3572675 - RNA, 16 nt, Human
cugcugcugggcucag

SEQ ID NO: 3572676 - RNA, 15 nt, Human
cugcugcugucaccu

SEQ ID NO: 3572677 - RNA, 17 nt, Human
cugcugcuucauguuug

SEQ ID NO: 3572678 - RNA, 20 nt, Human
cugcuggacaguaucacugu

SEQ ID NO: 3572679 - RNA, 18 nt, Human
cugcuggagaggccccag

SEQ ID NO: 3572680 - RNA, 19 nt, Human
cugcuggagaggccccagc

SEQ ID NO: 3572681 - RNA, 14 nt, Human
cugcuggaggccuc

SEQ ID NO: 3572682 - RNA, 15 nt, Human
cugcuggaggccuca

SEQ ID NO: 3572683 - RNA, 17 nt, Human
cugcuggaggccucagg

SEQ ID NO: 3572684 - RNA, 19 nt, Human
cugcuggaucucccagggc

SEQ ID NO: 3572685 - RNA, 20 nt, Human
cugcuggaucucccagggcu

SEQ ID NO: 3572686 - RNA, 21 nt, Human
cugcuggcacauuuccccaga

SEQ ID NO: 3572687 - RNA, 17 nt, Human
cugcuggccccucaccu

SEQ ID NO: 3572688 - RNA, 20 nt, Human
cugcuggccgccucaccccc

SEQ ID NO: 3572689 - RNA, 16 nt, Human
cugcuggccggagcaa

SEQ ID NO: 3572690 - RNA, 18 nt, Human
cugcuggccgggcacagc

SEQ ID NO: 3572691 - RNA, 14 nt, Human
cugcuggccucugc

SEQ ID NO: 3572692 - RNA, 16 nt, Human
cugcuggccucugcga

SEQ ID NO: 3572693 - RNA, 21 nt, Human
cugcuggccucugcgaguggu

SEQ ID NO: 3572694 - RNA, 12 nt, Human
cugcuggccugg

SEQ ID NO: 3572695 - RNA, 13 nt, Human
cugcuggccuggc

SEQ ID NO: 3572696 - RNA, 16 nt, Human
cugcuggcgccucugc

SEQ ID NO: 3572697 - RNA, 18 nt, Human
cugcuggcgccucugcaa

SEQ ID NO: 3572698 - RNA, 13 nt, Human
cugcuggcugccu

SEQ ID NO: 3572699 - RNA, 15 nt, Human
cugcuggcugccuua

SEQ ID NO: 3572700 - RNA, 22 nt, Human
cugcugggagguuaaaaagaaa

SEQ ID NO: 3572701 - RNA, 23 nt, Human
cugcugggauggugggcuucagg

SEQ ID NO: 3572702 - RNA, 20 nt, Human
cugcugggcuccacuuggcu

SEQ ID NO: 3572703 - RNA, 15 nt, Human
cugcugggcucucca

SEQ ID NO: 3572704 - RNA, 17 nt, Human
cugcugggcucuccacc

SEQ ID NO: 3572705 - RNA, 19 nt, Human
cugcugggcucuccaccuc

SEQ ID NO: 3572706 - RNA, 21 nt, Human
cugcugggcucuccaccucag

SEQ ID NO: 3572707 - RNA, 15 nt, Human
cugcugggcuggggc

SEQ ID NO: 3572708 - RNA, 19 nt, Human
cugcugggcuggggccuga

SEQ ID NO: 3572709 - RNA, 21 nt, Human
cugcugggcuggggccugaug

SEQ ID NO: 3572710 - RNA, 15 nt, Human
cugcuggggaagaca

SEQ ID NO: 3572711 - RNA, 22 nt, Human
cugcuggggaagacaguggccc

SEQ ID NO: 3572712 - RNA, 21 nt, Human
cugcuggggauccccgccugg

SEQ ID NO: 3572713 - RNA, 18 nt, Human
cugcuggggccugggaca

SEQ ID NO: 3572714 - RNA, 19 nt, Human
cugcuggggccugggacaa

SEQ ID NO: 3572715 - RNA, 22 nt, Human
cugcuggggccugggacaacug

SEQ ID NO: 3572716 - RNA, 18 nt, Human
cugcugggggcaacuggc

SEQ ID NO: 3572717 - RNA, 15 nt, Human
cugcuggguggccca

SEQ ID NO: 3572718 - RNA, 18 nt, Human
cugcuggguggcccaucc

SEQ ID NO: 3572719 - RNA, 19 nt, Human
cugcuggguggcccauccc

SEQ ID NO: 3572720 - RNA, 14 nt, Human
cugcuggguguggc

SEQ ID NO: 3572721 - RNA, 17 nt, Human
cugcuggguguggcgca

SEQ ID NO: 3572722 - RNA, 22 nt, Human
cugcugguaauuuguaucugaa

SEQ ID NO: 3572723 - RNA, 15 nt, Human
cugcuggucacagcc

SEQ ID NO: 3572724 - RNA, 16 nt, Human
cugcuggucacagccu

SEQ ID NO: 3572725 - RNA, 17 nt, Human
cugcuggucacagccuc

SEQ ID NO: 3572726 - RNA, 20 nt, Human
cugcuggucacagccuccuc

SEQ ID NO: 3572727 - RNA, 17 nt, Human
cugcuggucacuucuuc

SEQ ID NO: 3572728 - RNA, 20 nt, Human
cugcuggucacuucuucugu

SEQ ID NO: 3572729 - RNA, 17 nt, Human
cugcugguccgugggac

SEQ ID NO: 3572730 - RNA, 14 nt, Human
cugcuggucuucaa

SEQ ID NO: 3572731 - RNA, 15 nt, Human
cugcuggugcacagc

SEQ ID NO: 3572732 - RNA, 23 nt, Human
cugcuggugggcuugucauagcc

SEQ ID NO: 3572733 - RNA, 13 nt, Human
cugcugguucagg

SEQ ID NO: 3572734 - RNA, 15 nt, Human
cugcugguucagggu

SEQ ID NO: 3572735 - RNA, 22 nt, Human
cugcuguaaauuuggcuucugu

SEQ ID NO: 3572736 - RNA, 12 nt, Human
cugcuguacuga

SEQ ID NO: 3572737 - RNA, 20 nt, Human
cugcugucaccucucccacg

SEQ ID NO: 3572738 - RNA, 22 nt, Human
cugcugucauugcuucuucuga

SEQ ID NO: 3572739 - RNA, 16 nt, Human
cugcuguccagacagc

SEQ ID NO: 3572740 - RNA, 16 nt, Human
cugcugucugggugcu

SEQ ID NO: 3572741 - RNA, 21 nt, Human
cugcugucugggugcuacugg

SEQ ID NO: 3572742 - RNA, 19 nt, Human
cugcugucuggguggcuca

SEQ ID NO: 3572743 - RNA, 14 nt, Human
cugcugucuucugg

SEQ ID NO: 3572744 - RNA, 12 nt, Human
cugcugucuugu

SEQ ID NO: 3572745 - RNA, 19 nt, Human
cugcugucuuuucuuugcc

SEQ ID NO: 3572746 - RNA, 19 nt, Human
cugcugugaagcuggaacu

SEQ ID NO: 3572747 - RNA, 23 nt, Human
cugcugugaauuuguguaaggau

SEQ ID NO: 3572748 - RNA, 17 nt, Human
cugcuguggccaggagg

SEQ ID NO: 3572749 - RNA, 22 nt, Human
cugcugugggcacaggucaggc

SEQ ID NO: 3572750 - RNA, 21 nt, Human
cugcuguuccagugguaagcu

SEQ ID NO: 3572751 - RNA, 20 nt, Human
cugcuuacaauucccugcug

SEQ ID NO: 3572752 - RNA, 23 nt, Human
cugcuuaccagauaaugcuacuu

SEQ ID NO: 3572753 - RNA, 21 nt, Human
cugcuuaccuacuuucuucag

SEQ ID NO: 3572754 - RNA, 12 nt, Human
cugcuuagcuug

SEQ ID NO: 3572755 - RNA, 15 nt, Human
cugcuuaggagagac

SEQ ID NO: 3572756 - RNA, 23 nt, Human
cugcuuaguaucucaucaacaaa

SEQ ID NO: 3572757 - RNA, 14 nt, Human
cugcuucaaauauu

SEQ ID NO: 3572758 - RNA, 13 nt, Human
cugcuucaaggau

SEQ ID NO: 3572759 - RNA, 16 nt, Human
cugcuucaaggauccu

SEQ ID NO: 3572760 - RNA, 20 nt, Human
cugcuucaaggauccugagc

SEQ ID NO: 3572761 - RNA, 23 nt, Human
cugcuucaaggauccugagccag

SEQ ID NO: 3572762 - RNA, 19 nt, Human
cugcuucaaggcuuccacu

SEQ ID NO: 3572763 - RNA, 15 nt, Human
cugcuucagccuccc

SEQ ID NO: 3572764 - RNA, 15 nt, Human
cugcuucaugacauu

SEQ ID NO: 3572765 - RNA, 15 nt, Human
cugcuuccagugagg

SEQ ID NO: 3572766 - RNA, 16 nt, Human
cugcuuccagugaggc

SEQ ID NO: 3572767 - RNA, 18 nt, Human
cugcuuccagugaggcuc

SEQ ID NO: 3572768 - RNA, 20 nt, Human
cugcuuccagugaggcucug

SEQ ID NO: 3572769 - RNA, 14 nt, Human
cugcuuccagugua

SEQ ID NO: 3572770 - RNA, 11 nt, Human
cugcuucccac

SEQ ID NO: 3572771 - RNA, 18 nt, Human
cuggaagugacuuuggcu

SEQ ID NO: 3572772 - RNA, 23 nt, Human
cuggaaguuauuuauuuuuuaau

SEQ ID NO: 3572773 - RNA, 18 nt, Human
cuggaauacaugaaauau

SEQ ID NO: 3572774 - RNA, 20 nt, Human
cuggaaucagcucaggacug

SEQ ID NO: 3572775 - RNA, 21 nt, Human
cuggaaucauuguccagagcu

SEQ ID NO: 3572776 - RNA, 17 nt, Human
cuggaaucuggagacca

SEQ ID NO: 3572777 - RNA, 19 nt, Human
cuggaaucuggagagcuag

SEQ ID NO: 3572778 - RNA, 14 nt, Human
cuggaauguaauca

SEQ ID NO: 3572779 - RNA, 17 nt, Human
cuggaauugccagcuga

SEQ ID NO: 3572780 - RNA, 18 nt, Human
cuggaauugccagcugac

SEQ ID NO: 3572781 - RNA, 23 nt, Human
cuggaauuguggcuauccugauu

SEQ ID NO: 3572782 - RNA, 22 nt, Human
cuggaauuugcaagucauggcu

SEQ ID NO: 3572783 - RNA, 13 nt, Human
cuggacaaagaau

SEQ ID NO: 3572784 - RNA, 23 nt, Human
cuggacaagccaacuuguaaaua

SEQ ID NO: 3572785 - RNA, 21 nt, Human
cuggacagaggggacucuggg

SEQ ID NO: 3572786 - RNA, 13 nt, Human
cuggacagcccca

SEQ ID NO: 3572787 - RNA, 16 nt, Human
cuggacagccccaccc

SEQ ID NO: 3572788 - RNA, 18 nt, Human
cuggacagccccacccug

SEQ ID NO: 3572789 - RNA, 19 nt, Human
cuggacagccccacccugg

SEQ ID NO: 3572790 - RNA, 13 nt, Human
cuggacagcugug

SEQ ID NO: 3572791 - RNA, 14 nt, Human
cuggacagcugugc

SEQ ID NO: 3572792 - RNA, 17 nt, Human
cuggacaggcauguucu

SEQ ID NO: 3572793 - RNA, 14 nt, Human
cuggacaggccagg

SEQ ID NO: 3572794 - RNA, 13 nt, Human
cuggacaggcucu

SEQ ID NO: 3572795 - RNA, 15 nt, Human
cuggacaggcucugc

SEQ ID NO: 3572796 - RNA, 14 nt, Human
cuggacaggucugg

SEQ ID NO: 3572797 - RNA, 18 nt, Human
cuggacaggucugggaga

SEQ ID NO: 3572798 - RNA, 18 nt, Human
cuggacaguaucccacau

SEQ ID NO: 3572799 - RNA, 23 nt, Human
cuggacagucacugccacuuugc

SEQ ID NO: 3572800 - RNA, 19 nt, Human
cuggacagucagcucuuca

SEQ ID NO: 3572801 - RNA, 18 nt, Human
cuggacauaacauuuuca

SEQ ID NO: 3572802 - RNA, 23 nt, Human
cuggacaugaagauucuuuccca

SEQ ID NO: 3572803 - RNA, 15 nt, Human
cuggacaugcugacu

SEQ ID NO: 3572804 - RNA, 18 nt, Human
cuggacauucagaacacc

SEQ ID NO: 3572805 - RNA, 18 nt, Human
cuggacauuugccuugcu

SEQ ID NO: 3572806 - RNA, 15 nt, Human
cuggaccaaagcuga

SEQ ID NO: 3572807 - RNA, 15 nt, Human
cuggaccacugggca

SEQ ID NO: 3572808 - RNA, 17 nt, Human
cuggacccagccaggcc

SEQ ID NO: 3572809 - RNA, 19 nt, Human
cuggacccagccaggccca

SEQ ID NO: 3572810 - RNA, 12 nt, Human
cuggaccccagc

SEQ ID NO: 3572811 - RNA, 17 nt, Human
cuggaccccaucuguga

SEQ ID NO: 3572812 - RNA, 14 nt, Human
cuggacccccagcu

SEQ ID NO: 3572813 - RNA, 23 nt, Human
cuggaccccccuuucacaggcag

SEQ ID NO: 3572814 - RNA, 13 nt, Human
cuggaccccugca

SEQ ID NO: 3572815 - RNA, 14 nt, Human
cuggaccccugcau

SEQ ID NO: 3572816 - RNA, 18 nt, Human
cuggaccccugcauugga

SEQ ID NO: 3572817 - RNA, 23 nt, Human
cuggacccguucaugggggaggg

SEQ ID NO: 3572818 - RNA, 14 nt, Human
cuggacccuguugc

SEQ ID NO: 3572819 - RNA, 17 nt, Human
cuggacccuguugcuaa

SEQ ID NO: 3572820 - RNA, 13 nt, Human
cuggaccucacca

SEQ ID NO: 3572821 - RNA, 20 nt, Human
cuggaccuugaacuggguac

SEQ ID NO: 3572822 - RNA, 21 nt, Human
cuggaccuugaacuggguacu

SEQ ID NO: 3572823 - RNA, 19 nt, Human
cuggacggcauuccugcuu

SEQ ID NO: 3572824 - RNA, 15 nt, Human
cuggacuauagcugu

SEQ ID NO: 3572825 - RNA, 20 nt, Human
cuggacucaggaugcccagg

SEQ ID NO: 3572826 - RNA, 18 nt, Human
cuggacuccagaucugca

SEQ ID NO: 3572827 - RNA, 21 nt, Human
cuggacuccagaucugcaccg

SEQ ID NO: 3572828 - RNA, 23 nt, Human
cuggacuccagaucugcaccgcc

SEQ ID NO: 3572829 - RNA, 13 nt, Human
cuggacuccggcc

SEQ ID NO: 3572830 - RNA, 18 nt, Human
cuggacuccggcccuccu

SEQ ID NO: 3572831 - RNA, 19 nt, Human
cuggacuccucuguccagg

SEQ ID NO: 3572832 - RNA, 23 nt, Human
cuggacucuaaagucuguugauu

SEQ ID NO: 3572833 - RNA, 16 nt, Human
cuggacugacagcaug

SEQ ID NO: 3572834 - RNA, 17 nt, Human
cuggacugacagcaugu

SEQ ID NO: 3572835 - RNA, 21 nt, Human
cuggacugacagcaugugccc

SEQ ID NO: 3572836 - RNA, 21 nt, Human
cuggacugaccugguccacag

SEQ ID NO: 3572837 - RNA, 21 nt, Human
cuggacuggcuagaguccuca

SEQ ID NO: 3572838 - RNA, 21 nt, Human
cuggacugguggccccugccu

SEQ ID NO: 3572839 - RNA, 19 nt, Human
cuggacugugugcucagga

SEQ ID NO: 3572840 - RNA, 23 nt, Human
cuggacuucuaccugcccucaag

SEQ ID NO: 3572841 - RNA, 13 nt, Human
cuggacuuggagg

SEQ ID NO: 3572842 - RNA, 19 nt, Human
cuggacuuggccccugcca

SEQ ID NO: 3572843 - RNA, 13 nt, Human
cuggacuuuccug

SEQ ID NO: 3572844 - RNA, 16 nt, Human
cuggacuuuccugcaa

SEQ ID NO: 3572845 - RNA, 18 nt, Human
cuggagaagcucacccaa

SEQ ID NO: 3572846 - RNA, 20 nt, Human
cuggagaagcucccaggaac

SEQ ID NO: 3572847 - RNA, 22 nt, Human
cuggagaagcucccaggaacaa

SEQ ID NO: 3572848 - RNA, 22 nt, Human
cuggagaagucuuagacuugaa

SEQ ID NO: 3572849 - RNA, 15 nt, Human
cuggagacagcccca

SEQ ID NO: 3572850 - RNA, 19 nt, Human
cuggagacagccccagagc

SEQ ID NO: 3572851 - RNA, 21 nt, Human
cuggagacagccccagagcag

SEQ ID NO: 3572852 - RNA, 22 nt, Human
cuggagacagccccagagcagg

SEQ ID NO: 3572853 - RNA, 23 nt, Human
cuggagacagccccagagcaggg

SEQ ID NO: 3572854 - RNA, 19 nt, Human
cuggagaccaccagggcau

SEQ ID NO: 3572855 - RNA, 17 nt, Human
cuggagaccagggagcc

SEQ ID NO: 3572856 - RNA, 20 nt, Human
cuggagacccaccccaccug

SEQ ID NO: 3572857 - RNA, 21 nt, Human
cuggagacccaccccaccugc

SEQ ID NO: 3572858 - RNA, 19 nt, Human
cuggagaccccaccagccu

SEQ ID NO: 3572859 - RNA, 21 nt, Human
cuggagacguggaaccucugu

SEQ ID NO: 3572860 - RNA, 22 nt, Human
cuggagacugugugugcccucu

SEQ ID NO: 3572861 - RNA, 15 nt, Human
cuggagacuuagggc

SEQ ID NO: 3572862 - RNA, 19 nt, Human
cuggagagccagaaccugg

SEQ ID NO: 3572863 - RNA, 17 nt, Human
cuggagagcccagaguc

SEQ ID NO: 3572864 - RNA, 13 nt, Human
cuggagagcuaga

SEQ ID NO: 3572865 - RNA, 23 nt, Human
cuggagagcuagaaccuggaggg

SEQ ID NO: 3572866 - RNA, 18 nt, Human
cuggagaggagcccugcc

SEQ ID NO: 3572867 - RNA, 21 nt, Human
cuggagaggagcccugccucu

SEQ ID NO: 3572868 - RNA, 23 nt, Human
cuggagaggagcccugccucucc

SEQ ID NO: 3572869 - RNA, 21 nt, Human
cuggagagguuauaggucacu

SEQ ID NO: 3572870 - RNA, 16 nt, Human
cuggagagucucacuc

SEQ ID NO: 3572871 - RNA, 23 nt, Human
cuggagaguucaauggcugcuga

SEQ ID NO: 3572872 - RNA, 22 nt, Human
cuggagauacugguggaaguuc

SEQ ID NO: 3572873 - RNA, 20 nt, Human
cuggagauccuccugcagac

SEQ ID NO: 3572874 - RNA, 19 nt, Human
cuggagcaaucacagauga

SEQ ID NO: 3572875 - RNA, 16 nt, Human
cuggagcacaaagacc

SEQ ID NO: 3572876 - RNA, 22 nt, Human
cuggagcacaaagacccuggcu

SEQ ID NO: 3572877 - RNA, 23 nt, Human
cuggagcacaaagacccuggcuu

SEQ ID NO: 3572878 - RNA, 22 nt, Human
cuggagcacaauaaauggcugu

SEQ ID NO: 3572879 - RNA, 14 nt, Human
cuggagcaccaggc

SEQ ID NO: 3572880 - RNA, 23 nt, Human
cuggagcaccaggcacgaaccca

SEQ ID NO: 3572881 - RNA, 20 nt, Human
cuggagcacugggcucccgg

SEQ ID NO: 3572882 - RNA, 15 nt, Human
cuggagcagaccacc

SEQ ID NO: 3572883 - RNA, 22 nt, Human
cuggagcagaccaccccgccug

SEQ ID NO: 3572884 - RNA, 17 nt, Human
cuggagcaucugacuca

SEQ ID NO: 3572885 - RNA, 23 nt, Human
cuggagcaucugacucacaagaa

SEQ ID NO: 3572886 - RNA, 14 nt, Human
cuggagcauuucuc

SEQ ID NO: 3572887 - RNA, 15 nt, Human
cuggagccaagucca

SEQ ID NO: 3572888 - RNA, 17 nt, Human
cuggagccaaguccaga

SEQ ID NO: 3572889 - RNA, 14 nt, Human
cuggagccaccugu

SEQ ID NO: 3572890 - RNA, 15 nt, Human
cuggagccaccuguc

SEQ ID NO: 3572891 - RNA, 16 nt, Human
cuggagccaccugucc

SEQ ID NO: 3572892 - RNA, 19 nt, Human
cuggagccaccugucccac

SEQ ID NO: 3572893 - RNA, 13 nt, Human
cuggagcccacug

SEQ ID NO: 3572894 - RNA, 12 nt, Human
cuggagcccagg

SEQ ID NO: 3572895 - RNA, 13 nt, Human
cuggagcccaggg

SEQ ID NO: 3572896 - RNA, 14 nt, Human
cuggagcccaggga

SEQ ID NO: 3572897 - RNA, 23 nt, Human
cuggagccccacugcccuucuca

SEQ ID NO: 3572898 - RNA, 12 nt, Human
cuggagccccug

SEQ ID NO: 3572899 - RNA, 16 nt, Human
cuggagccccugggug

SEQ ID NO: 3572900 - RNA, 14 nt, Human
cuggagcccuaacc

SEQ ID NO: 3572901 - RNA, 23 nt, Human
cuggagccuccacugccucugga

SEQ ID NO: 3572902 - RNA, 19 nt, Human
cuggagccugagucagggc

SEQ ID NO: 3572903 - RNA, 12 nt, Human
cuggagccugug

SEQ ID NO: 3572904 - RNA, 22 nt, Human
cuggagccuguguaacagcucc

SEQ ID NO: 3572905 - RNA, 24 nt, Human
cuggagccuguguaacagcuccuu

SEQ ID NO: 3572906 - RNA, 16 nt, Human
cuggagcuagaauuug

SEQ ID NO: 3572907 - RNA, 15 nt, Human
cuggagcuccuggga

SEQ ID NO: 3572908 - RNA, 16 nt, Human
cuggagcucugcccau

SEQ ID NO: 3572909 - RNA, 17 nt, Human
cuggaggaaagggagga

SEQ ID NO: 3572910 - RNA, 20 nt, Human
cuggaggaaagggaggagug

SEQ ID NO: 3572911 - RNA, 15 nt, Human
cuggaggaccugagc

SEQ ID NO: 3572912 - RNA, 21 nt, Human
cuggaggaccugagccugccg

SEQ ID NO: 3572913 - RNA, 21 nt, Human
cuggaggacuagaaccuggag

SEQ ID NO: 3572914 - RNA, 18 nt, Human
cuggcaggcaggcuccca

SEQ ID NO: 3572915 - RNA, 21 nt, Human
cuggcaggcaggggcccugca

SEQ ID NO: 3572916 - RNA, 18 nt, Human
cuggcaggucaaccucgc

SEQ ID NO: 3572917 - RNA, 16 nt, Human
cuggcaguccguggga

SEQ ID NO: 3572918 - RNA, 22 nt, Human
cuggcaucgcaccauucugacu

SEQ ID NO: 3572919 - RNA, 18 nt, Human
cuggcaucugacacaaaa

SEQ ID NO: 3572920 - RNA, 14 nt, Human
cuggcaucuuugcu

SEQ ID NO: 3572921 - RNA, 18 nt, Human
cuggcaugcuaaagccuu

SEQ ID NO: 3572922 - RNA, 19 nt, Human
cuggcauggcaccugucgc

SEQ ID NO: 3572923 - RNA, 16 nt, Human
cuggcaugggaaugaa

SEQ ID NO: 3572924 - RNA, 22 nt, Human
cuggcaugggaaugaaugucag

SEQ ID NO: 3572925 - RNA, 18 nt, Human
cuggcauuagaauuauuu

SEQ ID NO: 3572926 - RNA, 16 nt, Human
cuggcauugucccugu

SEQ ID NO: 3572927 - RNA, 16 nt, Human
cuggccaaauagcaaa

SEQ ID NO: 3572928 - RNA, 18 nt, Human
cuggccaaauagcaaaga

SEQ ID NO: 3572929 - RNA, 13 nt, Human
cuggccaagcuga

SEQ ID NO: 3572930 - RNA, 14 nt, Human
cuggccaagcugag

SEQ ID NO: 3572931 - RNA, 16 nt, Human
cuggccaagcugaggu

SEQ ID NO: 3572932 - RNA, 14 nt, Human
cuggccaccacccc

SEQ ID NO: 3572933 - RNA, 13 nt, Human
cuggccaccaggc

SEQ ID NO: 3572934 - RNA, 15 nt, Human
cuggccaccaggcug

SEQ ID NO: 3572935 - RNA, 18 nt, Human
cuggccaccaggcuggcg

SEQ ID NO: 3572936 - RNA, 20 nt, Human
cuggccaccaggcuggcgca

SEQ ID NO: 3572937 - RNA, 23 nt, Human
cuggccaccaggcuggcgcagcc

SEQ ID NO: 3572938 - RNA, 11 nt, Human
cuggccaccug

SEQ ID NO: 3572939 - RNA, 16 nt, Human
cuggccaccugaggug

SEQ ID NO: 3572940 - RNA, 21 nt, Human
cuggccaccugaggugggccc

SEQ ID NO: 3572941 - RNA, 15 nt, Human
cuggccacgcagcca

SEQ ID NO: 3572942 - RNA, 12 nt, Human
cuggccacugca

SEQ ID NO: 3572943 - RNA, 15 nt, Human
cuggccacugcacag

SEQ ID NO: 3572944 - RNA, 18 nt, Human
cuggccacugcacagagc

SEQ ID NO: 3572945 - RNA, 22 nt, Human
cuggccacugcacagagcucuc

SEQ ID NO: 3572946 - RNA, 17 nt, Human
cuggccacugcucccua

SEQ ID NO: 3572947 - RNA, 15 nt, Human
cuggccagacacagg

SEQ ID NO: 3572948 - RNA, 20 nt, Human
cuggccagaugcaccagccc

SEQ ID NO: 3572949 - RNA, 22 nt, Human
cuggccagaugcaccagcccuu

SEQ ID NO: 3572950 - RNA, 17 nt, Human
cuggccagccccacagc

SEQ ID NO: 3572951 - RNA, 19 nt, Human
cuggccagccccacagccc

SEQ ID NO: 3572952 - RNA, 20 nt, Human
cuggccagccccacagccca

SEQ ID NO: 3572953 - RNA, 14 nt, Human
cuggccagccgcuc

SEQ ID NO: 3572954 - RNA, 12 nt, Human
cuggccagccug

SEQ ID NO: 3572955 - RNA, 23 nt, Human
cuggccagccuggggccuggcag

SEQ ID NO: 3572956 - RNA, 20 nt, Human
cuggccagcgagcgcccagc

SEQ ID NO: 3572957 - RNA, 14 nt, Human
cuggccaggagcag

SEQ ID NO: 3572958 - RNA, 15 nt, Human
cuggccaggagcucu

SEQ ID NO: 3572959 - RNA, 17 nt, Human
cuggccagggccacgcu

SEQ ID NO: 3572960 - RNA, 20 nt, Human
cuggccagggccacgcucca

SEQ ID NO: 3572961 - RNA, 15 nt, Human
cuggccagggccugg

SEQ ID NO: 3572962 - RNA, 18 nt, Human
cuggccaguccacccugc

SEQ ID NO: 3572963 - RNA, 18 nt, Human
cuggccaguccaggcugc

SEQ ID NO: 3572964 - RNA, 21 nt, Human
cuggccaguggcuggaucugu

SEQ ID NO: 3572965 - RNA, 13 nt, Human
cuggccaguguuu

SEQ ID NO: 3572966 - RNA, 20 nt, Human
cuggccaguguuuaaaacuu

SEQ ID NO: 3572967 - RNA, 18 nt, Human
cuggccaucccacaagug

SEQ ID NO: 3572968 - RNA, 23 nt, Human
cuggccaucccucguggucccca

SEQ ID NO: 3572969 - RNA, 19 nt, Human
cuggccauggagaaagcug

SEQ ID NO: 3572970 - RNA, 21 nt, Human
cuggccauggagaaagcugac

SEQ ID NO: 3572971 - RNA, 13 nt, Human
cuggccauggccu

SEQ ID NO: 3572972 - RNA, 13 nt, Human
cuggcccaccagg

SEQ ID NO: 3572973 - RNA, 14 nt, Human
cuggcccaccaggg

SEQ ID NO: 3572974 - RNA, 14 nt, Human
cuggcccaccccac

SEQ ID NO: 3572975 - RNA, 13 nt, Human
cuggcccacugca

SEQ ID NO: 3572976 - RNA, 15 nt, Human
cuggcccacugcauc

SEQ ID NO: 3572977 - RNA, 17 nt, Human
cuggcccagccaaaccc

SEQ ID NO: 3572978 - RNA, 23 nt, Human
cuggcccagccaaacccugucug

SEQ ID NO: 3572979 - RNA, 16 nt, Human
cuggcccagcccugcu

SEQ ID NO: 3572980 - RNA, 18 nt, Human
cuggcccagccggccucu

SEQ ID NO: 3572981 - RNA, 22 nt, Human
cuggcccagccggccucucugg

SEQ ID NO: 3572982 - RNA, 13 nt, Human
cuggcccagccuu

SEQ ID NO: 3572983 - RNA, 19 nt, Human
cuggcccagcggccccucc

SEQ ID NO: 3572984 - RNA, 12 nt, Human
cuggcccagcuc

SEQ ID NO: 3572985 - RNA, 13 nt, Human
cuggcccagcucc

SEQ ID NO: 3572986 - RNA, 14 nt, Human
cuggcccagcuccc

SEQ ID NO: 3572987 - RNA, 12 nt, Human
cuggcccagggc

SEQ ID NO: 3572988 - RNA, 18 nt, Human
cuggcccagggcaucugg

SEQ ID NO: 3572989 - RNA, 15 nt, Human
cuggcccagggccca

SEQ ID NO: 3572990 - RNA, 16 nt, Human
cuggcccagggcccag

SEQ ID NO: 3572991 - RNA, 17 nt, Human
cuggcccagggcccaga

SEQ ID NO: 3572992 - RNA, 18 nt, Human
cuggcccagggcccagag

SEQ ID NO: 3572993 - RNA, 23 nt, Human
cuggcccagggcccagagcccag

SEQ ID NO: 3572994 - RNA, 23 nt, Human
cuggcccauagaaacaugacacu

SEQ ID NO: 3572995 - RNA, 13 nt, Human
cuggcccaucagg

SEQ ID NO: 3572996 - RNA, 14 nt, Human
cuggccccagcccu

SEQ ID NO: 3572997 - RNA, 13 nt, Human
cuggccccaggac

SEQ ID NO: 3572998 - RNA, 21 nt, Human
cuggccccaugucucucagaa

SEQ ID NO: 3572999 - RNA, 17 nt, Human
cuggcccccaaccucag

SEQ ID NO: 3573000 - RNA, 18 nt, Human
cuggcccccaaccucagg

SEQ ID NO: 3573001 - RNA, 14 nt, Human
cuggcccccacaug

SEQ ID NO: 3573002 - RNA, 15 nt, Human
cuggcccccacaugg

SEQ ID NO: 3573003 - RNA, 15 nt, Human
cuggcccccacuggc

SEQ ID NO: 3573004 - RNA, 22 nt, Human
cuggcccccacuggcugugggc

SEQ ID NO: 3573005 - RNA, 22 nt, Human
cuggccccccugguccccuccu

SEQ ID NO: 3573006 - RNA, 12 nt, Human
cuggccccgccg

SEQ ID NO: 3573007 - RNA, 20 nt, Human
cuggccccggaucagagcag

SEQ ID NO: 3573008 - RNA, 24 nt, Human
cuggccccggaucagagcaggacc

SEQ ID NO: 3573009 - RNA, 18 nt, Human
cuggccccuagaaucagc

SEQ ID NO: 3573010 - RNA, 12 nt, Human
cuggccccucac

SEQ ID NO: 3573011 - RNA, 21 nt, Human
cuggccccucagggucccugg

SEQ ID NO: 3573012 - RNA, 15 nt, Human
cuggccccucgccug

SEQ ID NO: 3573013 - RNA, 14 nt, Human
cuggccccucuccc

SEQ ID NO: 3573014 - RNA, 13 nt, Human
cuggccccugggu

SEQ ID NO: 3573015 - RNA, 14 nt, Human
cuggccccuggguc

SEQ ID NO: 3573016 - RNA, 21 nt, Human
cuggcccgucauguuccucaa

SEQ ID NO: 3573017 - RNA, 22 nt, Human
cuggcccgucauguuccucaaa

SEQ ID NO: 3573018 - RNA, 15 nt, Human
cuggcccgugacaga

SEQ ID NO: 3573019 - RNA, 23 nt, Human
cuggcccgugacagacuccugag

SEQ ID NO: 3573020 - RNA, 14 nt, Human
cuggcccuauuuag

SEQ ID NO: 3573021 - RNA, 17 nt, Human
cuggcccucaaggccuc

SEQ ID NO: 3573022 - RNA, 23 nt, Human
cuggcccucaccccugcccuggg

SEQ ID NO: 3573023 - RNA, 15 nt, Human
cuggcccucucugaa

SEQ ID NO: 3573024 - RNA, 16 nt, Human
cuggcccucucugaag

SEQ ID NO: 3573025 - RNA, 21 nt, Human
cuggcccucucugaaggaggc

SEQ ID NO: 3573026 - RNA, 13 nt, Human
cuggcccucugug

SEQ ID NO: 3573027 - RNA, 13 nt, Human
cuggcccucuucu

SEQ ID NO: 3573028 - RNA, 11 nt, Human
cuggcccugcc

SEQ ID NO: 3573029 - RNA, 14 nt, Human
cuggcccugcccug

SEQ ID NO: 3573030 - RNA, 15 nt, Human
cuggcccugcccuga

SEQ ID NO: 3573031 - RNA, 12 nt, Human
cuggcccugccu

SEQ ID NO: 3573032 - RNA, 22 nt, Human
cuggcccugcuuccugcuugcc

SEQ ID NO: 3573033 - RNA, 14 nt, Human
cuggcccuggggcc

SEQ ID NO: 3573034 - RNA, 17 nt, Human
cuggcccuggggccugu

SEQ ID NO: 3573035 - RNA, 19 nt, Human
cuggcccuggggccuguac

SEQ ID NO: 3573036 - RNA, 19 nt, Human
cuggccgaggguccuggcu

SEQ ID NO: 3573037 - RNA, 16 nt, Human
cuggccgaguccaagc

SEQ ID NO: 3573038 - RNA, 18 nt, Human
cuggccgaguccaagcug

SEQ ID NO: 3573039 - RNA, 20 nt, Human
cuggccgcgcuccgggcuuu

SEQ ID NO: 3573040 - RNA, 18 nt, Human
cuggccggcaaccccagu

SEQ ID NO: 3573041 - RNA, 13 nt, Human
cuggccgggaccc

SEQ ID NO: 3573042 - RNA, 16 nt, Human
cuggccgggagccuga

SEQ ID NO: 3573043 - RNA, 14 nt, Human
cuggccgggcacag

SEQ ID NO: 3573044 - RNA, 16 nt, Human
cuggccggucugcaag

SEQ ID NO: 3573045 - RNA, 17 nt, Human
cuggccggucugcaagu

SEQ ID NO: 3573046 - RNA, 21 nt, Human
cuggccggucugcaagucaga

SEQ ID NO: 3573047 - RNA, 19 nt, Human
cuggccgucacuugugggg

SEQ ID NO: 3573048 - RNA, 20 nt, Human
cuggccuagaccagcagaca

SEQ ID NO: 3573049 - RNA, 12 nt, Human
cuggccuagucc

SEQ ID NO: 3573050 - RNA, 23 nt, Human
cuggccuagucccuuccacaccc

SEQ ID NO: 3573051 - RNA, 19 nt, Human
cuggccuauccgcugccag

SEQ ID NO: 3573052 - RNA, 22 nt, Human
cuggccucaagugauucuccug

SEQ ID NO: 3573053 - RNA, 20 nt, Human
cuggccuccaggcccgucug

SEQ ID NO: 3573054 - RNA, 16 nt, Human
cuggccuccccugcca

SEQ ID NO: 3573055 - RNA, 17 nt, Human
cuggccuccccugccac

SEQ ID NO: 3573056 - RNA, 21 nt, Human
cuggccuccccugccaccagg

SEQ ID NO: 3573057 - RNA, 20 nt, Human
cuggccuccggcgucagccu

SEQ ID NO: 3573058 - RNA, 16 nt, Human
cuggccuccugccucu

SEQ ID NO: 3573059 - RNA, 12 nt, Human
cuuaagagaaau

SEQ ID NO: 3573060 - RNA, 13 nt, Human
cuuaagagaauau

SEQ ID NO: 3573061 - RNA, 14 nt, Human
cuuaagagaauauu

SEQ ID NO: 3573062 - RNA, 17 nt, Human
cuuaagagaugccucau

SEQ ID NO: 3573063 - RNA, 14 nt, Human
cuuaagcaaaagaa

SEQ ID NO: 3573064 - RNA, 17 nt, Human
cuuaagcaaaagaaaaa

SEQ ID NO: 3573065 - RNA, 12 nt, Human
cuuaagcaaagg

SEQ ID NO: 3573066 - RNA, 19 nt, Human
cuuaagccacugccucucc

SEQ ID NO: 3573067 - RNA, 20 nt, Human
cuuaagccacugccucuccc

SEQ ID NO: 3573068 - RNA, 22 nt, Human
cuuaagccaucuugguaaauuu

SEQ ID NO: 3573069 - RNA, 23 nt, Human
cuuaagccaucuugguaaauuuc

SEQ ID NO: 3573070 - RNA, 19 nt, Human
cuuaagcccagugcacuga

SEQ ID NO: 3573071 - RNA, 22 nt, Human
cuuaagcccagugcacugaaag

SEQ ID NO: 3573072 - RNA, 16 nt, Human
cuuaagcccuggcccc

SEQ ID NO: 3573073 - RNA, 22 nt, Human
cuuaagcuuuggacccaaggaa

SEQ ID NO: 3573074 - RNA, 20 nt, Human
cuuaaggacaaaaaugaacu

SEQ ID NO: 3573075 - RNA, 23 nt, Human
cuuaaggacaaagugccaaagaa

SEQ ID NO: 3573076 - RNA, 21 nt, Human
cuuaaggauggagccagcucu

SEQ ID NO: 3573077 - RNA, 20 nt, Human
cuuaaggauugugauauuuu

SEQ ID NO: 3573078 - RNA, 16 nt, Human
cuuaaggcacucuguu

SEQ ID NO: 3573079 - RNA, 20 nt, Human
cuuaagggguaucauguaug

SEQ ID NO: 3573080 - RNA, 15 nt, Human
cuuaaggugaggccu

SEQ ID NO: 3573081 - RNA, 14 nt, Human
cuuaagguguagcc

SEQ ID NO: 3573082 - RNA, 21 nt, Human
cuuaagguguagccacaccag

SEQ ID NO: 3573083 - RNA, 20 nt, Human
cuuaaguauaucauguaaag

SEQ ID NO: 3573084 - RNA, 17 nt, Human
cuuaagucagaacagca

SEQ ID NO: 3573085 - RNA, 19 nt, Human
cuuaagugaggaaaucaaa

SEQ ID NO: 3573086 - RNA, 20 nt, Human
cuuaagugaggaaaucaaag

SEQ ID NO: 3573087 - RNA, 20 nt, Human
cuuaaguuagccuccaccac

SEQ ID NO: 3573088 - RNA, 16 nt, Human
cuuaaguuuauacucu

SEQ ID NO: 3573089 - RNA, 15 nt, Human
cuuaaguuucucagc

SEQ ID NO: 3573090 - RNA, 20 nt, Human
cuuaaguuucucagcuccca

SEQ ID NO: 3573091 - RNA, 20 nt, Human
cuuaauaaaaacuuacacuc

SEQ ID NO: 3573092 - RNA, 16 nt, Human
cuuaauaaaaaugaca

SEQ ID NO: 3573093 - RNA, 20 nt, Human
cuuaauaaauuguguuuccu

SEQ ID NO: 3573094 - RNA, 20 nt, Human
cuuaauaaucaagagccuua

SEQ ID NO: 3573095 - RNA, 17 nt, Human
cuuaauacacacaguua

SEQ ID NO: 3573096 - RNA, 16 nt, Human
cuuaauacuaccuuga

SEQ ID NO: 3573097 - RNA, 16 nt, Human
cuuaauaguauuuaug

SEQ ID NO: 3573098 - RNA, 13 nt, Human
cuuaauauaaauu

SEQ ID NO: 3573099 - RNA, 14 nt, Human
cuuaauauaaauuc

SEQ ID NO: 3573100 - RNA, 21 nt, Human
cuuaauauaaauucacuuuca

SEQ ID NO: 3573101 - RNA, 19 nt, Human
cuuaauauauagcauuuau

SEQ ID NO: 3573102 - RNA, 19 nt, Human
cuuaauauauauauccaga

SEQ ID NO: 3573103 - RNA, 14 nt, Human
cuuaauauauuuga

SEQ ID NO: 3573104 - RNA, 23 nt, Human
cuuaauaugcugcaacaaaaugu

SEQ ID NO: 3573105 - RNA, 14 nt, Human
cuuaauauguuaac

SEQ ID NO: 3573106 - RNA, 14 nt, Human
cuuaauauucugga

SEQ ID NO: 3573107 - RNA, 14 nt, Human
cuuaauauuuuuac

SEQ ID NO: 3573108 - RNA, 12 nt, Human
cuuaaucauuuu

SEQ ID NO: 3573109 - RNA, 14 nt, Human
cuuaaucauuuuca

SEQ ID NO: 3573110 - RNA, 19 nt, Human
cuuaaucuuuucacaaaua

SEQ ID NO: 3573111 - RNA, 12 nt, Human
cuuaaugaaguu

SEQ ID NO: 3573112 - RNA, 17 nt, Human
cuuaaugaaguuugaau

SEQ ID NO: 3573113 - RNA, 21 nt, Human
cuuaaugaaguuugaauguua

SEQ ID NO: 3573114 - RNA, 22 nt, Human
cuuaaugaaguuugaauguuaa

SEQ ID NO: 3573115 - RNA, 23 nt, Human
cuuaaugagacuuuaaaagcauu

SEQ ID NO: 3573116 - RNA, 20 nt, Human
cuuaaugagcaauaucugcu

SEQ ID NO: 3573117 - RNA, 19 nt, Human
cuuaauggaagguuggauc

SEQ ID NO: 3573118 - RNA, 19 nt, Human
cuuaauggaugaaaucaua

SEQ ID NO: 3573119 - RNA, 18 nt, Human
cuuaauguaucaaacugu

SEQ ID NO: 3573120 - RNA, 20 nt, Human
cuuaaugugauuacugcucu

SEQ ID NO: 3573121 - RNA, 20 nt, Human
cuuaauguucugaauaauuu

SEQ ID NO: 3573122 - RNA, 22 nt, Human
cuuaauguucugaauaauuucu

SEQ ID NO: 3573123 - RNA, 12 nt, Human
cuuaauguuuau

SEQ ID NO: 3573124 - RNA, 16 nt, Human
cuuaauguuuauuccu

SEQ ID NO: 3573125 - RNA, 16 nt, Human
cuuaauuaaaagaaua

SEQ ID NO: 3573126 - RNA, 21 nt, Human
cuuaauuaaguaaacuaauga

SEQ ID NO: 3573127 - RNA, 14 nt, Human
cuuaauuacuuaaa

SEQ ID NO: 3573128 - RNA, 10 nt, Human
cuuaauuauu

SEQ ID NO: 3573129 - RNA, 11 nt, Human
cuuaauuauua

SEQ ID NO: 3573130 - RNA, 17 nt, Human
cuuaauuauuauaaaaa

SEQ ID NO: 3573131 - RNA, 12 nt, Human
cuuaauucuguu

SEQ ID NO: 3573132 - RNA, 18 nt, Human
cuuaauugaugcaaauaa

SEQ ID NO: 3573133 - RNA, 16 nt, Human
cuuaauugccaccucu

SEQ ID NO: 3573134 - RNA, 23 nt, Human
cuuaauuguucauuuugagcuga

SEQ ID NO: 3573135 - RNA, 14 nt, Human
cuuaauuuccuuuu

SEQ ID NO: 3573136 - RNA, 22 nt, Human
cuuaauuuccuuuuugacacug

SEQ ID NO: 3573137 - RNA, 13 nt, Human
cuuaauuuggaaa

SEQ ID NO: 3573138 - RNA, 19 nt, Human
cuuaauuuggaaacuaaua

SEQ ID NO: 3573139 - RNA, 23 nt, Human
cuuaauuuggaaacuaauaaaau

SEQ ID NO: 3573140 - RNA, 14 nt, Human
cuuaauuuucagua

SEQ ID NO: 3573141 - RNA, 16 nt, Human
cuuaauuuugguugua

SEQ ID NO: 3573142 - RNA, 19 nt, Human
cuuaauuuugguuguauuc

SEQ ID NO: 3573143 - RNA, 20 nt, Human
cuuaauuuugguuguauucu

SEQ ID NO: 3573144 - RNA, 21 nt, Human
cuuaauuuugguuguauucuu

SEQ ID NO: 3573145 - RNA, 20 nt, Human
cuuaauuuuuuuuucauaga

SEQ ID NO: 3573146 - RNA, 16 nt, Human
cuuacaaaugauugcu

SEQ ID NO: 3573147 - RNA, 21 nt, Human
cuuacaaaugauugcuuuuaa

SEQ ID NO: 3573148 - RNA, 17 nt, Human
cuuacaagccagcugga

SEQ ID NO: 3573149 - RNA, 18 nt, Human
cuuacaagccuaagaauc

SEQ ID NO: 3573150 - RNA, 15 nt, Human
cuuacaauauugauu

SEQ ID NO: 3573151 - RNA, 17 nt, Human
cuuacaaucgcaaauca

SEQ ID NO: 3573152 - RNA, 20 nt, Human
cuuacaauuuuuuuaauuuu

SEQ ID NO: 3573153 - RNA, 21 nt, Human
cuuacaauuuuuuuaauuuug

SEQ ID NO: 3573154 - RNA, 18 nt, Human
cuuacacaaaggggauca

SEQ ID NO: 3573155 - RNA, 21 nt, Human
cuuacacaaaucuauuuaauu

SEQ ID NO: 3573156 - RNA, 13 nt, Human
cuuacacacaaaa

SEQ ID NO: 3573157 - RNA, 17 nt, Human
cuuacacauacaguuuu

SEQ ID NO: 3573158 - RNA, 19 nt, Human
cuuacacaucucagacccu

SEQ ID NO: 3573159 - RNA, 18 nt, Human
cuuacacaucuuccacag

SEQ ID NO: 3573160 - RNA, 23 nt, Human
cuuacacugccuguauacuuuag

SEQ ID NO: 3573161 - RNA, 23 nt, Human
cuuacagauaggccuucuuguga

SEQ ID NO: 3573162 - RNA, 23 nt, Human
cuuacagcauaagggagcguaga

SEQ ID NO: 3573163 - RNA, 22 nt, Human
cuuacagcuggguggcacugcc

SEQ ID NO: 3573164 - RNA, 23 nt, Human
cuuacagcuggguggcacugcca

SEQ ID NO: 3573165 - RNA, 22 nt, Human
cuuacauaguuuuaaacucauu

SEQ ID NO: 3573166 - RNA, 18 nt, Human
cuuacaugcauuacugca

SEQ ID NO: 3573167 - RNA, 20 nt, Human
cuuacauuagcaguuugcuu

SEQ ID NO: 3573168 - RNA, 12 nt, Human
cuuacauucucu

SEQ ID NO: 3573169 - RNA, 22 nt, Human
cuuacauuuacaaacugaagag

SEQ ID NO: 3573170 - RNA, 12 nt, Human
cuuacauuuccu

SEQ ID NO: 3573171 - RNA, 13 nt, Human
cuuacauuuccug

SEQ ID NO: 3573172 - RNA, 17 nt, Human
cuuacauuuuuacaaua

SEQ ID NO: 3573173 - RNA, 16 nt, Human
cuuaccaacuuucugu

SEQ ID NO: 3573174 - RNA, 21 nt, Human
cuuaccagauaaugcuacuuu

SEQ ID NO: 3573175 - RNA, 16 nt, Human
cuuaccagcagagcac

SEQ ID NO: 3573176 - RNA, 13 nt, Human
cuuaccaggaagc

SEQ ID NO: 3573177 - RNA, 20 nt, Human
cuuaccaggcaccaaaagaa

SEQ ID NO: 3573178 - RNA, 15 nt, Human
cuuaccauaugugcu

SEQ ID NO: 3573179 - RNA, 23 nt, Human
cuuaccauuugcuacuguacaua

SEQ ID NO: 3573180 - RNA, 22 nt, Human
cuuacccaaacuguucaagaaa

SEQ ID NO: 3573181 - RNA, 16 nt, Human
cuuacccaauuuccca

SEQ ID NO: 3573182 - RNA, 22 nt, Human
cuuaccccuggcuguuuggacu

SEQ ID NO: 3573183 - RNA, 17 nt, Human
cuuacccucauguucuu

SEQ ID NO: 3573184 - RNA, 13 nt, Human
cuuacccuuagaa

SEQ ID NO: 3573185 - RNA, 13 nt, Human
cuuacccuucugu

SEQ ID NO: 3573186 - RNA, 17 nt, Human
cuuacccuucugugccc

SEQ ID NO: 3573187 - RNA, 14 nt, Human
cuuaccgacaagca

SEQ ID NO: 3573188 - RNA, 20 nt, Human
cuuaccgugagcgacaaaga

SEQ ID NO: 3573189 - RNA, 18 nt, Human
cuuaccuaaacagauaua

SEQ ID NO: 3573190 - RNA, 18 nt, Human
cuuaccuagugaaacuuu

SEQ ID NO: 3573191 - RNA, 14 nt, Human
cuuaccuccugccc

SEQ ID NO: 3573192 - RNA, 18 nt, Human
cuuaccuccugcccagga

SEQ ID NO: 3573193 - RNA, 19 nt, Human
cuuaccuccugcccaggag

SEQ ID NO: 3573194 - RNA, 21 nt, Human
cuuaccucggugccuuccucu

SEQ ID NO: 3573195 - RNA, 13 nt, Human
cuuaccugacaca

SEQ ID NO: 3573196 - RNA, 20 nt, Human
cuuaccugaccucuugcugu

SEQ ID NO: 3573197 - RNA, 21 nt, Human
cuuaccuggcccaucagggua

SEQ ID NO: 3573198 - RNA, 19 nt, Human
cuuaccugggcauucuugu

SEQ ID NO: 3573199 - RNA, 15 nt, Human
cuuaccuguacacug

SEQ ID NO: 3573200 - RNA, 17 nt, Human
cuuaccuguacacugac

SEQ ID NO: 3573201 - RNA, 15 nt, Human
cuuaccuucaauaaa

SEQ ID NO: 3573202 - RNA, 16 nt, Human
cuuaccuucaauaaag

SEQ ID NO: 3573203 - RNA, 14 nt, Human
cuuauaauuuaaaa

SEQ ID NO: 3573204 - RNA, 14 nt, Human
cuuauacccaugaa

SEQ ID NO: 3573205 - RNA, 16 nt, Human
cuuauacgaaauaauu

SEQ ID NO: 3573206 - RNA, 21 nt, Human
cuuauacgaaauaauuguugu

SEQ ID NO: 3573207 - RNA, 15 nt, Human
cuuauacuguacaau

SEQ ID NO: 3573208 - RNA, 16 nt, Human
cuuauacuguacaaua

SEQ ID NO: 3573209 - RNA, 15 nt, Human
cuuauagaauauuua

SEQ ID NO: 3573210 - RNA, 20 nt, Human
cuuauagaauauuuauuacc

SEQ ID NO: 3573211 - RNA, 17 nt, Human
cuuauaguacaugauaa

SEQ ID NO: 3573212 - RNA, 21 nt, Human
cuuauaguuacuguguaauua

SEQ ID NO: 3573213 - RNA, 16 nt, Human
cuuauaguucuaggca

SEQ ID NO: 3573214 - RNA, 17 nt, Human
cuuauaguuugggcuuc

SEQ ID NO: 3573215 - RNA, 19 nt, Human
cuuauauagcagcaaaaau

SEQ ID NO: 3573216 - RNA, 18 nt, Human
cuuauauaguuuacuauu

SEQ ID NO: 3573217 - RNA, 19 nt, Human
cuuauauaguuuacuauuu

SEQ ID NO: 3573218 - RNA, 17 nt, Human
cuuauauaugcacuuaa

SEQ ID NO: 3573219 - RNA, 22 nt, Human
cuuauauaugcacuuaauuugu

SEQ ID NO: 3573220 - RNA, 17 nt, Human
cuuauaucuauauuuua

SEQ ID NO: 3573221 - RNA, 21 nt, Human
cuuauauuaauaguaauuugu

SEQ ID NO: 3573222 - RNA, 21 nt, Human
cuuauauuaauauuccucagu

SEQ ID NO: 3573223 - RNA, 23 nt, Human
cuuauauugaagacaauuugaua

SEQ ID NO: 3573224 - RNA, 17 nt, Human
cuuauauuguaagaaau

SEQ ID NO: 3573225 - RNA, 16 nt, Human
cuuauauuguucacuu

SEQ ID NO: 3573226 - RNA, 23 nt, Human
cuuauauuucccuaaaauacauu

SEQ ID NO: 3573227 - RNA, 19 nt, Human
cuuauauuuucguaugaaa

SEQ ID NO: 3573228 - RNA, 21 nt, Human
cuuauauuuucguaugaaaau

SEQ ID NO: 3573229 - RNA, 19 nt, Human
cuuaucaaaguagcaaaug

SEQ ID NO: 3573230 - RNA, 11 nt, Human
cuuaucaagug

SEQ ID NO: 3573231 - RNA, 22 nt, Human
cuuaucaauuugucauuuugaa

SEQ ID NO: 3573232 - RNA, 23 nt, Human
cuuaucacaaaaaagaaaaugaa

SEQ ID NO: 3573233 - RNA, 23 nt, Human
cuuaucaccacaguaaguuccua

SEQ ID NO: 3573234 - RNA, 19 nt, Human
cuuaucaccagcugccucu

SEQ ID NO: 3573235 - RNA, 22 nt, Human
cuuaucaccagcugccucuucu

SEQ ID NO: 3573236 - RNA, 15 nt, Human
cuuauccaggacucu

SEQ ID NO: 3573237 - RNA, 12 nt, Human
cuuaucccucuc

SEQ ID NO: 3573238 - RNA, 16 nt, Human
cuuaucccuucuuuuu

SEQ ID NO: 3573239 - RNA, 17 nt, Human
cuuaucccuucuuuuuc

SEQ ID NO: 3573240 - RNA, 17 nt, Human
cuuauccucccuguaac

SEQ ID NO: 3573241 - RNA, 18 nt, Human
cuuauccucccuguaacu

SEQ ID NO: 3573242 - RNA, 18 nt, Human
cuuauccucugaucucca

SEQ ID NO: 3573243 - RNA, 22 nt, Human
cuuauccucugaucuccauggc

SEQ ID NO: 3573244 - RNA, 13 nt, Human
cuuauccugcauu

SEQ ID NO: 3573245 - RNA, 14 nt, Human
cuuauccugcauug

SEQ ID NO: 3573246 - RNA, 19 nt, Human
cuuauccuucaucuuuuaa

SEQ ID NO: 3573247 - RNA, 18 nt, Human
cuuauccuuccucuccuu

SEQ ID NO: 3573248 - RNA, 16 nt, Human
cuuaucgggcuccagc

SEQ ID NO: 3573249 - RNA, 20 nt, Human
cuuaucuagcugcauaucuu

SEQ ID NO: 3573250 - RNA, 19 nt, Human
cuuaucucagauauuugca

SEQ ID NO: 3573251 - RNA, 13 nt, Human
cuuaucuccaaga

SEQ ID NO: 3573252 - RNA, 14 nt, Human
cuuaucuccaagac

SEQ ID NO: 3573253 - RNA, 18 nt, Human
cuuaucuccacaaccucu

SEQ ID NO: 3573254 - RNA, 21 nt, Human
cuuaucucuuuuauauuugua

SEQ ID NO: 3573255 - RNA, 22 nt, Human
cuuaucugagcugagccaggcu

SEQ ID NO: 3573256 - RNA, 22 nt, Human
cuuaucugaucagaacaaaugu

SEQ ID NO: 3573257 - RNA, 17 nt, Human
cuuaucugugcgugaaa

SEQ ID NO: 3573258 - RNA, 21 nt, Human
cuuaucugugcgugaaacaca

SEQ ID NO: 3573259 - RNA, 16 nt, Human
cuuaucuuacaaagug

SEQ ID NO: 3573260 - RNA, 17 nt, Human
cuuaucuuacaaagugu

SEQ ID NO: 3573261 - RNA, 14 nt, Human
cuuaucuuaugcca

SEQ ID NO: 3573262 - RNA, 12 nt, Human
cuuaugaauguu

SEQ ID NO: 3573263 - RNA, 14 nt, Human
cuuaugaauguuuc

SEQ ID NO: 3573264 - RNA, 17 nt, Human
cuuaugaauguuuccgg

SEQ ID NO: 3573265 - RNA, 21 nt, Human
cuuaugacaucacuuguacaa

SEQ ID NO: 3573266 - RNA, 13 nt, Human
cuuaugagaaacu

SEQ ID NO: 3573267 - RNA, 13 nt, Human
cuuaugagauggg

SEQ ID NO: 3573268 - RNA, 20 nt, Human
cuuaugaggguccucuacuu

SEQ ID NO: 3573269 - RNA, 15 nt, Human
cuuaugauugcagau

SEQ ID NO: 3573270 - RNA, 15 nt, Human
cuuaugcaaaaugga

SEQ ID NO: 3573271 - RNA, 16 nt, Human
cuuaugcaaaauggaa

SEQ ID NO: 3573272 - RNA, 23 nt, Human
cuuaugccacccccgcuggagga

SEQ ID NO: 3573273 - RNA, 22 nt, Human
cuuaugccacgggaaguuuaga

SEQ ID NO: 3573274 - RNA, 21 nt, Human
cuuaugccauguuaauuucau

SEQ ID NO: 3573275 - RNA, 18 nt, Human
cuuaugcgguuaauuuug

SEQ ID NO: 3573276 - RNA, 19 nt, Human
cuuaugcucuuaauugcca

SEQ ID NO: 3573277 - RNA, 14 nt, Human
cuuaugcuuaaauu

SEQ ID NO: 3573278 - RNA, 14 nt, Human
cuuaugcuuccaga

SEQ ID NO: 3573279 - RNA, 15 nt, Human
cuuaugcuuccagaa

SEQ ID NO: 3573280 - RNA, 16 nt, Human
cuuaugcuuccagaaa

SEQ ID NO: 3573281 - RNA, 17 nt, Human
cuuauggaacacucuga

SEQ ID NO: 3573282 - RNA, 16 nt, Human
cuuauggaauugauuu

SEQ ID NO: 3573283 - RNA, 23 nt, Human
cuuauggaauugauuugcauuga

SEQ ID NO: 3573284 - RNA, 14 nt, Human
cuuauggauguccc

SEQ ID NO: 3573285 - RNA, 21 nt, Human
cuuauggauguccccagcaga

SEQ ID NO: 3573286 - RNA, 21 nt, Human
cuuaugggcuggguucuaccc

SEQ ID NO: 3573287 - RNA, 23 nt, Human
cuuaugggcuggguucuacccag

SEQ ID NO: 3573288 - RNA, 19 nt, Human
cuuaugguaccagaugcag

SEQ ID NO: 3573289 - RNA, 16 nt, Human
cuuauguagauauuug

SEQ ID NO: 3573290 - RNA, 23 nt, Human
cuuaugugacauuaacaaauaaa

SEQ ID NO: 3573291 - RNA, 18 nt, Human
cuuauguugaaaaaauuu

SEQ ID NO: 3573292 - RNA, 18 nt, Human
cuuauuaaaacacuucau

SEQ ID NO: 3573293 - RNA, 18 nt, Human
cuuauuaaaguucuguaa

SEQ ID NO: 3573294 - RNA, 14 nt, Human
cuuauuaaaguuuc

SEQ ID NO: 3573295 - RNA, 15 nt, Human
cuuauuaaaguuuca

SEQ ID NO: 3573296 - RNA, 19 nt, Human
cuuauuaaaguuucaaaaa

SEQ ID NO: 3573297 - RNA, 23 nt, Human
cuuauuaaaguuucaaaaaucug

SEQ ID NO: 3573298 - RNA, 15 nt, Human
cuuauuaaugcuaag

SEQ ID NO: 3573299 - RNA, 16 nt, Human
cuuauuaaugcuaagg

SEQ ID NO: 3573300 - RNA, 15 nt, Human
cuuauuauugaagga

SEQ ID NO: 3573301 - RNA, 14 nt, Human
cuuauuauuuuuga

SEQ ID NO: 3573302 - RNA, 16 nt, Human
cuuauuauuuuugaga

SEQ ID NO: 3573303 - RNA, 16 nt, Human
cuuauucaaagagaaa

SEQ ID NO: 3573304 - RNA, 16 nt, Human
cuuauucauuuucucu

SEQ ID NO: 3573305 - RNA, 18 nt, Human
cuuauucauuuucucuaa

SEQ ID NO: 3573306 - RNA, 19 nt, Human
cuuauuccaugacugcuug

SEQ ID NO: 3573307 - RNA, 14 nt, Human
cuuauucccuuccu

SEQ ID NO: 3573308 - RNA, 14 nt, Human
cuuauucuguagau

SEQ ID NO: 3573309 - RNA, 12 nt, Human
cuuauugcaaaa

SEQ ID NO: 3573310 - RNA, 12 nt, Human
cuuauugcccac

SEQ ID NO: 3573311 - RNA, 18 nt, Human
cuuauuguaaauuuuaga

SEQ ID NO: 3573312 - RNA, 14 nt, Human
cuuauuguaccucu

SEQ ID NO: 3573313 - RNA, 20 nt, Human
cuuauuguagcauccuggaa

SEQ ID NO: 3573314 - RNA, 13 nt, Human
cuuauuguuccaa

SEQ ID NO: 3573315 - RNA, 14 nt, Human
cuuauuguuccaag

SEQ ID NO: 3573316 - RNA, 22 nt, Human
cuuauuguuccaagacauuguc

SEQ ID NO: 3573317 - RNA, 13 nt, Human
cuuauuuaaauag

SEQ ID NO: 3573318 - RNA, 15 nt, Human
cuuauuuaaucuuuu

SEQ ID NO: 3573319 - RNA, 18 nt, Human
cuuauuuaaugaaagacu

SEQ ID NO: 3573320 - RNA, 23 nt, Human
cuuauuuagauucacuuaacaaa

SEQ ID NO: 3573321 - RNA, 22 nt, Human
cuuauuuaugaaaguauuaaaa

SEQ ID NO: 3573322 - RNA, 16 nt, Human
cuuauuuauuguauuc

SEQ ID NO: 3573323 - RNA, 15 nt, Human
cuuauuucauuucuu

SEQ ID NO: 3573324 - RNA, 12 nt, Human
cuuauuugagug

SEQ ID NO: 3573325 - RNA, 17 nt, Human
cuuauuugcuucauugu

SEQ ID NO: 3573326 - RNA, 16 nt, Human
cuuauuuuaaugugau

SEQ ID NO: 3573327 - RNA, 17 nt, Human
cuuauuuuaaugugaug

SEQ ID NO: 3573328 - RNA, 14 nt, Human
cuuauuuucucugu

SEQ ID NO: 3573329 - RNA, 15 nt, Human
cuuauuuucucugug

SEQ ID NO: 3573330 - RNA, 14 nt, Human
cuuauuuuuuccca

SEQ ID NO: 3573331 - RNA, 16 nt, Human
cuuauuuuuuucugau

SEQ ID NO: 3573332 - RNA, 17 nt, Human
cuuauuuuuuucugauu

SEQ ID NO: 3573333 - RNA, 19 nt, Human
cuuauuuuuuucugauugu

SEQ ID NO: 3573334 - RNA, 15 nt, Human
cuucaaaaguaaugc

SEQ ID NO: 3573335 - RNA, 17 nt, Human
cuucaaaaguaaugccu

SEQ ID NO: 3573336 - RNA, 21 nt, Human
cuucaaaaguuuguuugcuua

SEQ ID NO: 3573337 - RNA, 14 nt, Human
cuucaaaauauuga

SEQ ID NO: 3573338 - RNA, 11 nt, Human
cuucaaacuac

SEQ ID NO: 3573339 - RNA, 21 nt, Human
cuucaaacuaggggacaaagc

SEQ ID NO: 3573340 - RNA, 13 nt, Human
cuucaaagccuuc

SEQ ID NO: 3573341 - RNA, 15 nt, Human
cuucaaagccuucuc

SEQ ID NO: 3573342 - RNA, 14 nt, Human
cuucaaauccaucc

SEQ ID NO: 3573343 - RNA, 16 nt, Human
cuucaaauccauccag

SEQ ID NO: 3573344 - RNA, 13 nt, Human
cuucaaaugccug

SEQ ID NO: 3573345 - RNA, 17 nt, Human
cuucaaauugucuuuug

SEQ ID NO: 3573346 - RNA, 21 nt, Human
cuucaaauuuuuuaaaagaga

SEQ ID NO: 3573347 - RNA, 16 nt, Human
cuucaacagcucccca

SEQ ID NO: 3573348 - RNA, 22 nt, Human
cuuggcccagggggcuuccuga

SEQ ID NO: 3573349 - RNA, 23 nt, Human
cuuggcccagggggcuuccugag

SEQ ID NO: 3573350 - RNA, 18 nt, Human
cuuggcccgcacagagcu

SEQ ID NO: 3573351 - RNA, 14 nt, Human
cuuggcccuuuccu

SEQ ID NO: 3573352 - RNA, 20 nt, Human
cuuggccuagcccacccugc

SEQ ID NO: 3573353 - RNA, 23 nt, Human
cuuggccucagaauucacaaaau

SEQ ID NO: 3573354 - RNA, 12 nt, Human
cuuggccugcug

SEQ ID NO: 3573355 - RNA, 13 nt, Human
cuuggccugcugu

SEQ ID NO: 3573356 - RNA, 13 nt, Human
cuuggccuggagc

SEQ ID NO: 3573357 - RNA, 23 nt, Human
cuuggccugucucauccccaggg

SEQ ID NO: 3573358 - RNA, 16 nt, Human
cuuggccuugggcuuc

SEQ ID NO: 3573359 - RNA, 14 nt, Human
cuuggcggcagcag

SEQ ID NO: 3573360 - RNA, 19 nt, Human
cuuggcggcagcagccauc

SEQ ID NO: 3573361 - RNA, 14 nt, Human
cuuggcguggagcc

SEQ ID NO: 3573362 - RNA, 18 nt, Human
cuuggcguggagccaggg

SEQ ID NO: 3573363 - RNA, 23 nt, Human
cuuggcucaaguccucuuuucug

SEQ ID NO: 3573364 - RNA, 24 nt, Human
cuuggcucacugcaacuucugccu

SEQ ID NO: 3573365 - RNA, 14 nt, Human
cuuggcuccaugcu

SEQ ID NO: 3573366 - RNA, 19 nt, Human
cuuggcucgaaucucugug

SEQ ID NO: 3573367 - RNA, 20 nt, Human
cuuggcucgaaucucugugc

SEQ ID NO: 3573368 - RNA, 15 nt, Human
cuuggcugcagggag

SEQ ID NO: 3573369 - RNA, 16 nt, Human
cuuggcuggugcaccu

SEQ ID NO: 3573370 - RNA, 22 nt, Human
cuuggcuguagaaggagacaga

SEQ ID NO: 3573371 - RNA, 12 nt, Human
cuuggcugugag

SEQ ID NO: 3573372 - RNA, 20 nt, Human
cuuggcuguuggcagugagu

SEQ ID NO: 3573373 - RNA, 24 nt, Human
cuuggcuuaccugaccucuugcug

SEQ ID NO: 3573374 - RNA, 20 nt, Human
cuuggcuucaggggaguccc

SEQ ID NO: 3573375 - RNA, 18 nt, Human
cuuggcuuccuuucuugg

SEQ ID NO: 3573376 - RNA, 23 nt, Human
cuuggcuucucauacguccacca

SEQ ID NO: 3573377 - RNA, 14 nt, Human
cuuggcuucuucuu

SEQ ID NO: 3573378 - RNA, 16 nt, Human
cuuggcuuggcccugg

SEQ ID NO: 3573379 - RNA, 15 nt, Human
cuuggcuuucauguu

SEQ ID NO: 3573380 - RNA, 22 nt, Human
cuugggaaaggugguguuucug

SEQ ID NO: 3573381 - RNA, 11 nt, Human
cuugggaaaua

SEQ ID NO: 3573382 - RNA, 18 nt, Human
cuugggaagacuccuagc

SEQ ID NO: 3573383 - RNA, 22 nt, Human
cuugggaagcugaggcgggaga

SEQ ID NO: 3573384 - RNA, 20 nt, Human
cuugggacuaaaugcccugc

SEQ ID NO: 3573385 - RNA, 18 nt, Human
cuugggagagccccuggg

SEQ ID NO: 3573386 - RNA, 14 nt, Human
cuugggaggaagca

SEQ ID NO: 3573387 - RNA, 15 nt, Human
cuugggaggaagcag

SEQ ID NO: 3573388 - RNA, 19 nt, Human
cuugggaggaagcagaaua

SEQ ID NO: 3573389 - RNA, 22 nt, Human
cuugggaggaagcagaauaaag

SEQ ID NO: 3573390 - RNA, 14 nt, Human
cuugggaggcccca

SEQ ID NO: 3573391 - RNA, 16 nt, Human
cuugggaggcuucccc

SEQ ID NO: 3573392 - RNA, 20 nt, Human
cuugggaugaugccucauga

SEQ ID NO: 3573393 - RNA, 17 nt, Human
cuugggauuugcugugu

SEQ ID NO: 3573394 - RNA, 22 nt, Human
cuugggcaauauucucuguaca

SEQ ID NO: 3573395 - RNA, 14 nt, Human
cuugggcagagcug

SEQ ID NO: 3573396 - RNA, 19 nt, Human
cuugggcagagcuggcucu

SEQ ID NO: 3573397 - RNA, 20 nt, Human
cuugggcagagcuggcucug

SEQ ID NO: 3573398 - RNA, 23 nt, Human
cuugggcagagcuggcucugagc

SEQ ID NO: 3573399 - RNA, 14 nt, Human
cuugggcagaucuc

SEQ ID NO: 3573400 - RNA, 19 nt, Human
cuugggccaaauccgcucu

SEQ ID NO: 3573401 - RNA, 14 nt, Human
cuugggccacugug

SEQ ID NO: 3573402 - RNA, 18 nt, Human
cuugggccacugugaaga

SEQ ID NO: 3573403 - RNA, 20 nt, Human
cuugggccacugugaagaga

SEQ ID NO: 3573404 - RNA, 14 nt, Human
cuugggcccagcug

SEQ ID NO: 3573405 - RNA, 20 nt, Human
cuugggcccagcugggcucu

SEQ ID NO: 3573406 - RNA, 13 nt, Human
cuugggcccuccu

SEQ ID NO: 3573407 - RNA, 14 nt, Human
cuugggcccuccug

SEQ ID NO: 3573408 - RNA, 19 nt, Human
cuugggcccuuugagugca

SEQ ID NO: 3573409 - RNA, 18 nt, Human
cuugggccgagccugccu

SEQ ID NO: 3573410 - RNA, 20 nt, Human
cuugggcgccgugcugggca

SEQ ID NO: 3573411 - RNA, 21 nt, Human
cuugggcgccgugcugggcag

SEQ ID NO: 3573412 - RNA, 22 nt, Human
cuugggcggcugagagccccag

SEQ ID NO: 3573413 - RNA, 21 nt, Human
cuugggcuauuuggacucagg

SEQ ID NO: 3573414 - RNA, 23 nt, Human
cuugggcucagggaccauggcuu

SEQ ID NO: 3573415 - RNA, 17 nt, Human
cuugggcucugaugaaa

SEQ ID NO: 3573416 - RNA, 18 nt, Human
cuugggcucugcugaguc

SEQ ID NO: 3573417 - RNA, 23 nt, Human
cuugggcuuccauuugugugugu

SEQ ID NO: 3573418 - RNA, 21 nt, Human
cuuggggaccagagcugccac

SEQ ID NO: 3573419 - RNA, 19 nt, Human
cuuggggaguuaagaccug

SEQ ID NO: 3573420 - RNA, 21 nt, Human
cuuggggaguuaagaccuggc

SEQ ID NO: 3573421 - RNA, 14 nt, Human
cuuggggcaggcag

SEQ ID NO: 3573422 - RNA, 23 nt, Human
cuuggggccaccaaagcugccca

SEQ ID NO: 3573423 - RNA, 13 nt, Human
cuuggggccaucg

SEQ ID NO: 3573424 - RNA, 16 nt, Human
cuuggggcugaugcag

SEQ ID NO: 3573425 - RNA, 18 nt, Human
cuuggggcugaugcaguu

SEQ ID NO: 3573426 - RNA, 21 nt, Human
cuugggggacagggcuggccc

SEQ ID NO: 3573427 - RNA, 23 nt, Human
cuugggggacagggcuggcccag

SEQ ID NO: 3573428 - RNA, 15 nt, Human
cuugggggcucagca

SEQ ID NO: 3573429 - RNA, 20 nt, Human
cuugggggcucagcaaggcc

SEQ ID NO: 3573430 - RNA, 19 nt, Human
cuugggggcucccagggca

SEQ ID NO: 3573431 - RNA, 23 nt, Human
cuugggggguuuuuacuccagug

SEQ ID NO: 3573432 - RNA, 22 nt, Human
cuuggguagaguuuacagcucu

SEQ ID NO: 3573433 - RNA, 22 nt, Human
cuuggguguaacaggucuccuc

SEQ ID NO: 3573434 - RNA, 15 nt, Human
cuuggguuagaccua

SEQ ID NO: 3573435 - RNA, 19 nt, Human
cuuggguuagaccuacagg

SEQ ID NO: 3573436 - RNA, 22 nt, Human
cuuggguuagaccuacaggggg

SEQ ID NO: 3573437 - RNA, 23 nt, Human
cuuggguucaagugauucuccug

SEQ ID NO: 3573438 - RNA, 22 nt, Human
cuugguagaagcccuucuaccu

SEQ ID NO: 3573439 - RNA, 16 nt, Human
cuugguauuuggauau

SEQ ID NO: 3573440 - RNA, 23 nt, Human
cuugguauuuuucagagauuuau

SEQ ID NO: 3573441 - RNA, 14 nt, Human
cuuggucaccagcu

SEQ ID NO: 3573442 - RNA, 14 nt, Human
cuugguccugcugc

SEQ ID NO: 3573443 - RNA, 17 nt, Human
cuugguccugcugcagu

SEQ ID NO: 3573444 - RNA, 18 nt, Human
cuugguccugcugcaguu

SEQ ID NO: 3573445 - RNA, 20 nt, Human
cuugguccugcugcaguugc

SEQ ID NO: 3573446 - RNA, 22 nt, Human
cuugguccugcugcaguugcca

SEQ ID NO: 3573447 - RNA, 23 nt, Human
cuuggucucagugucaaugcagc

SEQ ID NO: 3573448 - RNA, 20 nt, Human
cuuggucugauuucaggaua

SEQ ID NO: 3573449 - RNA, 14 nt, Human
cuuggucugugaga

SEQ ID NO: 3573450 - RNA, 16 nt, Human
cuuggucugugagaug

SEQ ID NO: 3573451 - RNA, 19 nt, Human
cuuggucugugagaugcua

SEQ ID NO: 3573452 - RNA, 15 nt, Human
cuuggucuucccagg

SEQ ID NO: 3573453 - RNA, 16 nt, Human
cuuggucuucccaggc

SEQ ID NO: 3573454 - RNA, 22 nt, Human
cuuggugaauuuuuuuuuccua

SEQ ID NO: 3573455 - RNA, 16 nt, Human
cuugguggcuuauggg

SEQ ID NO: 3573456 - RNA, 18 nt, Human
cuugguguaauuugaaga

SEQ ID NO: 3573457 - RNA, 15 nt, Human
cuugguguccaccug

SEQ ID NO: 3573458 - RNA, 13 nt, Human
cuugguuauacau

SEQ ID NO: 3573459 - RNA, 13 nt, Human
cuugguuauauuu

SEQ ID NO: 3573460 - RNA, 17 nt, Human
cuugguuccagccugcc

SEQ ID NO: 3573461 - RNA, 19 nt, Human
cuugguuccagccugccac

SEQ ID NO: 3573462 - RNA, 20 nt, Human
cuugguuccagccugccacu

SEQ ID NO: 3573463 - RNA, 20 nt, Human
cuugguucccauuugcuccu

SEQ ID NO: 3573464 - RNA, 18 nt, Human
cuugguuccuggggcauc

SEQ ID NO: 3573465 - RNA, 19 nt, Human
cuugguuccuggggcaucc

SEQ ID NO: 3573466 - RNA, 16 nt, Human
cuugguucugugaaca

SEQ ID NO: 3573467 - RNA, 22 nt, Human
cuugguucuugaggggaccagg

SEQ ID NO: 3573468 - RNA, 15 nt, Human
cuugguugaggaaac

SEQ ID NO: 3573469 - RNA, 19 nt, Human
cuugguuucucucuacagu

SEQ ID NO: 3573470 - RNA, 20 nt, Human
cuugguuucucucuacagug

SEQ ID NO: 3573471 - RNA, 15 nt, Human
cuugguuugccuucc

SEQ ID NO: 3573472 - RNA, 14 nt, Human
cuugguuuuauggu

SEQ ID NO: 3573473 - RNA, 23 nt, Human
cuugguuuuuacugcucugagaa

SEQ ID NO: 3573474 - RNA, 13 nt, Human
cuuguaaauacac

SEQ ID NO: 3573475 - RNA, 12 nt, Human
cuuguaaauacc

SEQ ID NO: 3573476 - RNA, 19 nt, Human
cuuguaaauaccaggauuu

SEQ ID NO: 3573477 - RNA, 12 nt, Human
cuuguaaauaua

SEQ ID NO: 3573478 - RNA, 17 nt, Human
cuuguaaauauaaagac

SEQ ID NO: 3573479 - RNA, 14 nt, Human
cuuguaacuaaaau

SEQ ID NO: 3573480 - RNA, 16 nt, Human
cuuguaacuaaaauaa

SEQ ID NO: 3573481 - RNA, 17 nt, Human
cuuguaacuccaccaac

SEQ ID NO: 3573482 - RNA, 16 nt, Human
cuuguaagauuuugaa

SEQ ID NO: 3573483 - RNA, 18 nt, Human
cuuguaauauuuuguauu

SEQ ID NO: 3573484 - RNA, 20 nt, Human
cuuguaaugauauagccaga

SEQ ID NO: 3573485 - RNA, 20 nt, Human
cuuguaauguaacugcucuu

SEQ ID NO: 3573486 - RNA, 18 nt, Human
cuuguaauuauggaguca

SEQ ID NO: 3573487 - RNA, 15 nt, Human
cuuguaauucuaaau

SEQ ID NO: 3573488 - RNA, 21 nt, Human
cuuguaauuuaaacaggccca

SEQ ID NO: 3573489 - RNA, 23 nt, Human
cuuguaauuuaaacaggcccagc

SEQ ID NO: 3573490 - RNA, 16 nt, Human
cuuguaauuuuuauuu

SEQ ID NO: 3573491 - RNA, 22 nt, Human
cuuguuuaccuuucucucucua

SEQ ID NO: 3573492 - RNA, 21 nt, Human
cuuguuuaucagauacaucac

SEQ ID NO: 3573493 - RNA, 14 nt, Human
cuuguuuaucagca

SEQ ID NO: 3573494 - RNA, 13 nt, Human
cuuguuucagagu

SEQ ID NO: 3573495 - RNA, 14 nt, Human
cuuguuucucaacu

SEQ ID NO: 3573496 - RNA, 19 nt, Human
cuuguuugcucaccugggg

SEQ ID NO: 3573497 - RNA, 18 nt, Human
cuuguuuggggcaggagu

SEQ ID NO: 3573498 - RNA, 19 nt, Human
cuuguuuggggcaggagua

SEQ ID NO: 3573499 - RNA, 13 nt, Human
cuuguuuuauaaa

SEQ ID NO: 3573500 - RNA, 11 nt, Human
cuuguuuucca

SEQ ID NO: 3573501 - RNA, 18 nt, Human
cuuguuuucuugccaaug

SEQ ID NO: 3573502 - RNA, 15 nt, Human
cuuguuuugcuuccc

SEQ ID NO: 3573503 - RNA, 14 nt, Human
cuuguuuuggacag

SEQ ID NO: 3573504 - RNA, 14 nt, Human
cuuguuuuggacuu

SEQ ID NO: 3573505 - RNA, 17 nt, Human
cuuguuuuggauggcuu

SEQ ID NO: 3573506 - RNA, 16 nt, Human
cuuguuuuguuugucu

SEQ ID NO: 3573507 - RNA, 16 nt, Human
cuuguuuuuaaguuug

SEQ ID NO: 3573508 - RNA, 15 nt, Human
cuuguuuuuauaaua

SEQ ID NO: 3573509 - RNA, 18 nt, Human
cuuguuuuuauuaauuua

SEQ ID NO: 3573510 - RNA, 22 nt, Human
cuuguuuuuguaaagaaaaaua

SEQ ID NO: 3573511 - RNA, 17 nt, Human
cuuguuuuuguuuuugu

SEQ ID NO: 3573512 - RNA, 16 nt, Human
cuuuaaaaaaaauccu

SEQ ID NO: 3573513 - RNA, 23 nt, Human
cuuuaaaaaagaaaagugcauau

SEQ ID NO: 3573514 - RNA, 19 nt, Human
cuuuaaaaacuauuuaacu

SEQ ID NO: 3573515 - RNA, 21 nt, Human
cuuuaaaaagggaagaaacug

SEQ ID NO: 3573516 - RNA, 15 nt, Human
cuuuaaaacaaaaca

SEQ ID NO: 3573517 - RNA, 16 nt, Human
cuuuaaaagaaugacu

SEQ ID NO: 3573518 - RNA, 15 nt, Human
cuuuaaaagagagag

SEQ ID NO: 3573519 - RNA, 22 nt, Human
cuuuaaaagagagagagagaaa

SEQ ID NO: 3573520 - RNA, 15 nt, Human
cuuuaaaagcauuuu

SEQ ID NO: 3573521 - RNA, 22 nt, Human
cuuuaaaagcauuuuuuaaccu

SEQ ID NO: 3573522 - RNA, 16 nt, Human
cuuuaaaaggaaagaa

SEQ ID NO: 3573523 - RNA, 19 nt, Human
cuuuaaaauguaaagccau

SEQ ID NO: 3573524 - RNA, 17 nt, Human
cuuuaaaauuacaacua

SEQ ID NO: 3573525 - RNA, 19 nt, Human
cuuuaaaauuacaacuaag

SEQ ID NO: 3573526 - RNA, 22 nt, Human
cuuuaaaccuguagaaucaauu

SEQ ID NO: 3573527 - RNA, 23 nt, Human
cuuuaaaccuguuuuuuuuucau

SEQ ID NO: 3573528 - RNA, 19 nt, Human
cuuuaaacucagggacaga

SEQ ID NO: 3573529 - RNA, 10 nt, Human
cuuuaaagaa

SEQ ID NO: 3573530 - RNA, 14 nt, Human
cuuuaaaggaaaaa

SEQ ID NO: 3573531 - RNA, 19 nt, Human
cuuuaaaggaaaaaauguu

SEQ ID NO: 3573532 - RNA, 18 nt, Human
cuuuaaagggauggcaag

SEQ ID NO: 3573533 - RNA, 19 nt, Human
cuuuaaagggccugccugg

SEQ ID NO: 3573534 - RNA, 23 nt, Human
cuuuaaagugacuaauggcauga

SEQ ID NO: 3573535 - RNA, 19 nt, Human
cuuuaaaguguaauaauau

SEQ ID NO: 3573536 - RNA, 17 nt, Human
cuuuaaauaauuuaacu

SEQ ID NO: 3573537 - RNA, 13 nt, Human
cuuuaaauagaua

SEQ ID NO: 3573538 - RNA, 19 nt, Human
cuuuaaauagauacaaaug

SEQ ID NO: 3573539 - RNA, 13 nt, Human
cuuuaaaugaaua

SEQ ID NO: 3573540 - RNA, 14 nt, Human
cuuuaaaugcugcu

SEQ ID NO: 3573541 - RNA, 15 nt, Human
cuuuaaauguuuuau

SEQ ID NO: 3573542 - RNA, 22 nt, Human
cuuuaaauguuuuauaaguuca

SEQ ID NO: 3573543 - RNA, 19 nt, Human
cuuuaacaacauguuucca

SEQ ID NO: 3573544 - RNA, 12 nt, Human
cuuuaacaugcc

SEQ ID NO: 3573545 - RNA, 18 nt, Human
cuuuaaccagucugaagu

SEQ ID NO: 3573546 - RNA, 18 nt, Human
cuuuaacuuaguuuugca

SEQ ID NO: 3573547 - RNA, 14 nt, Human
cuuuaagacauacu

SEQ ID NO: 3573548 - RNA, 23 nt, Human
cuuuaagacauacuccuuccauc

SEQ ID NO: 3573549 - RNA, 15 nt, Human
cuuuaagacugagca

SEQ ID NO: 3573550 - RNA, 15 nt, Human
cuuuaagcagagaag

SEQ ID NO: 3573551 - RNA, 17 nt, Human
cuuuaagccuucaaaac

SEQ ID NO: 3573552 - RNA, 17 nt, Human
cuuuaagggcaugccuu

SEQ ID NO: 3573553 - RNA, 20 nt, Human
cuuuaaggggaggaaccaga

SEQ ID NO: 3573554 - RNA, 12 nt, Human
cuuuaauauaaa

SEQ ID NO: 3573555 - RNA, 18 nt, Human
cuuuaauauaaaugcaaa

SEQ ID NO: 3573556 - RNA, 20 nt, Human
cuuuaauauaaaugcaaaua

SEQ ID NO: 3573557 - RNA, 19 nt, Human
cuuuaaucagguccugcuc

SEQ ID NO: 3573558 - RNA, 14 nt, Human
cuuuaaucuucagu

SEQ ID NO: 3573559 - RNA, 21 nt, Human
cuuuaaucuucaguuuuaucu

SEQ ID NO: 3573560 - RNA, 22 nt, Human
cuuuaaucuucaguuuuaucuu

SEQ ID NO: 3573561 - RNA, 22 nt, Human
cuuuaaugauaugcuuguaacu

SEQ ID NO: 3573562 - RNA, 13 nt, Human
cuuuaaugcaucu

SEQ ID NO: 3573563 - RNA, 23 nt, Human
cuuuaaugucacaggcaggucca

SEQ ID NO: 3573564 - RNA, 21 nt, Human
cuuuaauguuuuuugccacag

SEQ ID NO: 3573565 - RNA, 23 nt, Human
cuuuaauuccaugaauguuccug

SEQ ID NO: 3573566 - RNA, 18 nt, Human
cuuuaauucuguaucugu

SEQ ID NO: 3573567 - RNA, 21 nt, Human
cuuuaauuucugucagaaugc

SEQ ID NO: 3573568 - RNA, 14 nt, Human
cuuuaauuuuggaa

SEQ ID NO: 3573569 - RNA, 17 nt, Human
cuuuacaugacacagcu

SEQ ID NO: 3573570 - RNA, 17 nt, Human
cuuuacaugcaauuuau

SEQ ID NO: 3573571 - RNA, 19 nt, Human
cuuuacaugcaauuuauua

SEQ ID NO: 3573572 - RNA, 20 nt, Human
cuuuacaugggguuuucaau

SEQ ID NO: 3573573 - RNA, 18 nt, Human
cuuuaccaaacagcaaac

SEQ ID NO: 3573574 - RNA, 16 nt, Human
cuuuaccaaagaugaa

SEQ ID NO: 3573575 - RNA, 19 nt, Human
cuuuaccaaagaugaauga

SEQ ID NO: 3573576 - RNA, 14 nt, Human
cuuuaccaugcuca

SEQ ID NO: 3573577 - RNA, 17 nt, Human
cuuuacccaccuagaac

SEQ ID NO: 3573578 - RNA, 19 nt, Human
cuuuacccaccuagaacac

SEQ ID NO: 3573579 - RNA, 20 nt, Human
cuuuacccuugagcccuccc

SEQ ID NO: 3573580 - RNA, 16 nt, Human
cuuuaccucucuguca

SEQ ID NO: 3573581 - RNA, 16 nt, Human
cuuuaccugagaccag

SEQ ID NO: 3573582 - RNA, 17 nt, Human
cuuuaccugugaagugu

SEQ ID NO: 3573583 - RNA, 20 nt, Human
cuuuaccuuuuuuauacaua

SEQ ID NO: 3573584 - RNA, 16 nt, Human
cuuuacgcccaucuca

SEQ ID NO: 3573585 - RNA, 21 nt, Human
cuuuacguguuuaaaaaaaag

SEQ ID NO: 3573586 - RNA, 18 nt, Human
cuuuacuccucacacuua

SEQ ID NO: 3573587 - RNA, 16 nt, Human
cuuuacugacccuggg

SEQ ID NO: 3573588 - RNA, 14 nt, Human
cuuuacuuagcuua

SEQ ID NO: 3573589 - RNA, 16 nt, Human
cuuuacuugucuuucu

SEQ ID NO: 3573590 - RNA, 18 nt, Human
cuuuacuugucuuucugg

SEQ ID NO: 3573591 - RNA, 13 nt, Human
cuuuacuuucccu

SEQ ID NO: 3573592 - RNA, 14 nt, Human
cuuuacuuucccuu

SEQ ID NO: 3573593 - RNA, 17 nt, Human
cuuuacuuucccuugcu

SEQ ID NO: 3573594 - RNA, 19 nt, Human
cuuuacuuucccuugcuuu

SEQ ID NO: 3573595 - RNA, 12 nt, Human
cuuuagaaaaua

SEQ ID NO: 3573596 - RNA, 13 nt, Human
cuuuagaaaauau

SEQ ID NO: 3573597 - RNA, 18 nt, Human
cuuuagaaaauauaagua

SEQ ID NO: 3573598 - RNA, 20 nt, Human
cuuuagaaagguuuugagca

SEQ ID NO: 3573599 - RNA, 22 nt, Human
cuuuagaaauaaaccuuaauau

SEQ ID NO: 3573600 - RNA, 16 nt, Human
cuuuagaauaugccuu

SEQ ID NO: 3573601 - RNA, 21 nt, Human
cuuuagaaucccagcccccug

SEQ ID NO: 3573602 - RNA, 17 nt, Human
cuuuagaauguuuuccu

SEQ ID NO: 3573603 - RNA, 21 nt, Human
cuuuagaauguuuuccuucua

SEQ ID NO: 3573604 - RNA, 12 nt, Human
cuuuagacuuga

SEQ ID NO: 3573605 - RNA, 13 nt, Human
cuuuagacuugaa

SEQ ID NO: 3573606 - RNA, 21 nt, Human
cuuuagacuugaaaagagaca

SEQ ID NO: 3573607 - RNA, 17 nt, Human
cuuuagagcauugccau

SEQ ID NO: 3573608 - RNA, 20 nt, Human
cuuuagauagcagccuggcu

SEQ ID NO: 3573609 - RNA, 23 nt, Human
cuuuagauagcagccuggcuccc

SEQ ID NO: 3573610 - RNA, 16 nt, Human
cuuuagaucucugaag

SEQ ID NO: 3573611 - RNA, 12 nt, Human
cuuuagaugcug

SEQ ID NO: 3573612 - RNA, 17 nt, Human
cuuuagaugcugaugau

SEQ ID NO: 3573613 - RNA, 16 nt, Human
cuuuagcaaagaacuc

SEQ ID NO: 3573614 - RNA, 19 nt, Human
cuuuagcacguuuaaaguu

SEQ ID NO: 3573615 - RNA, 15 nt, Human
cuuuagccaaacccu

SEQ ID NO: 3573616 - RNA, 14 nt, Human
cuuuagcgcccagu

SEQ ID NO: 3573617 - RNA, 22 nt, Human
cuuuagcgcucaauaggaccag

SEQ ID NO: 3573618 - RNA, 15 nt, Human
cuuuagcuuucugag

SEQ ID NO: 3573619 - RNA, 22 nt, Human
cuuuaggagauuuauuuuuugg

SEQ ID NO: 3573620 - RNA, 21 nt, Human
cuuuagggacucaauuucucc

SEQ ID NO: 3573621 - RNA, 22 nt, Human
cuuuagguuuuuuuaaugauau

SEQ ID NO: 3573622 - RNA, 22 nt, Human
cuuuaguaccugaaaaguaacu

SEQ ID NO: 3573623 - RNA, 15 nt, Human
cuuuagucugcaaaa

SEQ ID NO: 3573624 - RNA, 14 nt, Human
cuuuaguggcuuca

SEQ ID NO: 3573625 - RNA, 17 nt, Human
cuuuagugguggccauu

SEQ ID NO: 3573626 - RNA, 14 nt, Human
cuuuaguuuuuggu

SEQ ID NO: 3573627 - RNA, 15 nt, Human
cuuuaguuuuuguga

SEQ ID NO: 3573628 - RNA, 13 nt, Human
cuuuauaaacuuu

SEQ ID NO: 3573629 - RNA, 11 nt, Human
cuuuauaaaua

SEQ ID NO: 3573630 - RNA, 17 nt, Human
cuuuauaaauccaguga

SEQ ID NO: 3573631 - RNA, 18 nt, Human
cuuuauaacuaacauguc

SEQ ID NO: 3573632 - RNA, 12 nt, Human
cuuuauaagaaa

SEQ ID NO: 3573633 - RNA, 19 nt, Human
cuuuauaagaaagccugag

SEQ ID NO: 3573634 - RNA, 19 nt, Human
cuuuauaauucuacuuuga

SEQ ID NO: 3573635 - RNA, 17 nt, Human
cuuuauacaacagugcu

SEQ ID NO: 3573636 - RNA, 15 nt, Human
cuuucccaaaggcau

SEQ ID NO: 3573637 - RNA, 21 nt, Human
cuuucccaacacuucagacug

SEQ ID NO: 3573638 - RNA, 22 nt, Human
cuuucccaacacuucagacugc

SEQ ID NO: 3573639 - RNA, 19 nt, Human
cuuucccaccgcccucccu

SEQ ID NO: 3573640 - RNA, 20 nt, Human
cuuucccagugagucucugg

SEQ ID NO: 3573641 - RNA, 21 nt, Human
cuuuccccagcaucacucccc

SEQ ID NO: 3573642 - RNA, 14 nt, Human
cuuuccccagccca

SEQ ID NO: 3573643 - RNA, 15 nt, Human
cuuuccccagcccag

SEQ ID NO: 3573644 - RNA, 16 nt, Human
cuuuccccagcccagg

SEQ ID NO: 3573645 - RNA, 17 nt, Human
cuuuccccauacucugu

SEQ ID NO: 3573646 - RNA, 13 nt, Human
cuuuccccauucc

SEQ ID NO: 3573647 - RNA, 19 nt, Human
cuuucccccaccagcuaag

SEQ ID NO: 3573648 - RNA, 14 nt, Human
cuuuccccuguggg

SEQ ID NO: 3573649 - RNA, 15 nt, Human
cuuuccccugugggg

SEQ ID NO: 3573650 - RNA, 17 nt, Human
cuuucccgggcugucca

SEQ ID NO: 3573651 - RNA, 17 nt, Human
cuuucccuaagccagcu

SEQ ID NO: 3573652 - RNA, 18 nt, Human
cuuucccuaagccagcug

SEQ ID NO: 3573653 - RNA, 14 nt, Human
cuuucccucacccc

SEQ ID NO: 3573654 - RNA, 16 nt, Human
cuuucccucacccccu

SEQ ID NO: 3573655 - RNA, 13 nt, Human
cuuucccuccacu

SEQ ID NO: 3573656 - RNA, 14 nt, Human
cuuucccucccuuc

SEQ ID NO: 3573657 - RNA, 18 nt, Human
cuuucccuccuuggugau

SEQ ID NO: 3573658 - RNA, 14 nt, Human
cuuucccuuccagu

SEQ ID NO: 3573659 - RNA, 16 nt, Human
cuuucccuuccucuuc

SEQ ID NO: 3573660 - RNA, 23 nt, Human
cuuucccuugcuuuucccucuuu

SEQ ID NO: 3573661 - RNA, 21 nt, Human
cuuucccuuguagcuccuccc

SEQ ID NO: 3573662 - RNA, 15 nt, Human
cuuuccuaaauguuu

SEQ ID NO: 3573663 - RNA, 21 nt, Human
cuuuccucaggcaaggucugg

SEQ ID NO: 3573664 - RNA, 13 nt, Human
cuuuccuccuucc

SEQ ID NO: 3573665 - RNA, 16 nt, Human
cuuuccuccuuccaug

SEQ ID NO: 3573666 - RNA, 13 nt, Human
cuuuccucgccug

SEQ ID NO: 3573667 - RNA, 13 nt, Human
cuuuccucuuccc

SEQ ID NO: 3573668 - RNA, 19 nt, Human
cuuuccucuuccccuugcc

SEQ ID NO: 3573669 - RNA, 15 nt, Human
cuuuccugaauccaa

SEQ ID NO: 3573670 - RNA, 12 nt, Human
cuuuccugaggc

SEQ ID NO: 3573671 - RNA, 13 nt, Human
cuuuccugaggcu

SEQ ID NO: 3573672 - RNA, 17 nt, Human
cuuuccugaggcugggc

SEQ ID NO: 3573673 - RNA, 22 nt, Human
cuuuccugaugguacaggaaag

SEQ ID NO: 3573674 - RNA, 12 nt, Human
cuuuccugcccc

SEQ ID NO: 3573675 - RNA, 18 nt, Human
cuuuccugccccaggccu

SEQ ID NO: 3573676 - RNA, 20 nt, Human
cuuuccuggacacucagacc

SEQ ID NO: 3573677 - RNA, 16 nt, Human
cuuuccuggaugucug

SEQ ID NO: 3573678 - RNA, 23 nt, Human
cuuuccuggaugucugaacuuug

SEQ ID NO: 3573679 - RNA, 20 nt, Human
cuuuccuguagccuucugua

SEQ ID NO: 3573680 - RNA, 10 nt, Human
cuuuccuguc

SEQ ID NO: 3573681 - RNA, 13 nt, Human
cuuuccuguccca

SEQ ID NO: 3573682 - RNA, 21 nt, Human
cuuuccuguguguacucuguc

SEQ ID NO: 3573683 - RNA, 18 nt, Human
cuuuccuguucagcauuc

SEQ ID NO: 3573684 - RNA, 15 nt, Human
cuuuccuuccauccc

SEQ ID NO: 3573685 - RNA, 11 nt, Human
cuuuccuuccu

SEQ ID NO: 3573686 - RNA, 17 nt, Human
cuuuccuugaguaguuu

SEQ ID NO: 3573687 - RNA, 16 nt, Human
cuuuccuuggcuccca

SEQ ID NO: 3573688 - RNA, 17 nt, Human
cuuuccuuguggcagag

SEQ ID NO: 3573689 - RNA, 18 nt, Human
cuuuccuuguggcagagg

SEQ ID NO: 3573690 - RNA, 20 nt, Human
cuuuccuuuccccagcccag

SEQ ID NO: 3573691 - RNA, 21 nt, Human
cuuuccuuuccccagcccagg

SEQ ID NO: 3573692 - RNA, 17 nt, Human
cuuuccuuuuuuaaaaa

SEQ ID NO: 3573693 - RNA, 15 nt, Human
cuuucgcacagcagu

SEQ ID NO: 3573694 - RNA, 14 nt, Human
cuuucgggccaugu

SEQ ID NO: 3573695 - RNA, 22 nt, Human
cuuucggggagaggcugaggac

SEQ ID NO: 3573696 - RNA, 19 nt, Human
cuuucguccacagcuuccu

SEQ ID NO: 3573697 - RNA, 15 nt, Human
cuuucuaauguuucu

SEQ ID NO: 3573698 - RNA, 18 nt, Human
cuuucuacaaugugaacu

SEQ ID NO: 3573699 - RNA, 19 nt, Human
cuuucuacaguauuaugua

SEQ ID NO: 3573700 - RNA, 23 nt, Human
cuuucuacaguauuauguacucu

SEQ ID NO: 3573701 - RNA, 15 nt, Human
cuuucuacuuccaag

SEQ ID NO: 3573702 - RNA, 22 nt, Human
cuuucuagaaagagaaacaguu

SEQ ID NO: 3573703 - RNA, 16 nt, Human
cuuucuagccagagga

SEQ ID NO: 3573704 - RNA, 16 nt, Human
cuuucuaguggucuuu

SEQ ID NO: 3573705 - RNA, 20 nt, Human
cuuucuaguggucuuuguaa

SEQ ID NO: 3573706 - RNA, 22 nt, Human
cuuucuaguggucuuuguaaga

SEQ ID NO: 3573707 - RNA, 14 nt, Human
cuuucuaguugaaa

SEQ ID NO: 3573708 - RNA, 14 nt, Human
cuuucuauaauuuu

SEQ ID NO: 3573709 - RNA, 18 nt, Human
cuuucuauaauuuuacaa

SEQ ID NO: 3573710 - RNA, 12 nt, Human
cuuucuaucauu

SEQ ID NO: 3573711 - RNA, 16 nt, Human
cuuucuauugaaaaau

SEQ ID NO: 3573712 - RNA, 16 nt, Human
cuuucuauuguacaga

SEQ ID NO: 3573713 - RNA, 18 nt, Human
cuuucuauuugacuugug

SEQ ID NO: 3573714 - RNA, 18 nt, Human
cuuucucaaagaaauauu

SEQ ID NO: 3573715 - RNA, 20 nt, Human
cuuucucagccucugaauau

SEQ ID NO: 3573716 - RNA, 14 nt, Human
cuuucuccaaaguu

SEQ ID NO: 3573717 - RNA, 15 nt, Human
cuuucuccaaaguua

SEQ ID NO: 3573718 - RNA, 15 nt, Human
cuuucuccagccagc

SEQ ID NO: 3573719 - RNA, 18 nt, Human
cuuucucccacugaguuu

SEQ ID NO: 3573720 - RNA, 13 nt, Human
cuuucucccaggc

SEQ ID NO: 3573721 - RNA, 21 nt, Human
cuuucucccaggccaggcucc

SEQ ID NO: 3573722 - RNA, 20 nt, Human
cuuucuccccgcuaaggaag

SEQ ID NO: 3573723 - RNA, 19 nt, Human
cuuucuccccugcccccag

SEQ ID NO: 3573724 - RNA, 22 nt, Human
cuuucuccuguuuauucccauc

SEQ ID NO: 3573725 - RNA, 23 nt, Human
cuuucuccuuagucuucucauag

SEQ ID NO: 3573726 - RNA, 16 nt, Human
cuuucucuaauaauaa

SEQ ID NO: 3573727 - RNA, 20 nt, Human
cuuucucuaauaauaaauag

SEQ ID NO: 3573728 - RNA, 18 nt, Human
cuuucucuccccaacccc

SEQ ID NO: 3573729 - RNA, 15 nt, Human
cuuucucucuucccu

SEQ ID NO: 3573730 - RNA, 12 nt, Human
cuuucucugagg

SEQ ID NO: 3573731 - RNA, 16 nt, Human
cuuucucugccaguga

SEQ ID NO: 3573732 - RNA, 21 nt, Human
cuuucucuucauauucagcuu

SEQ ID NO: 3573733 - RNA, 15 nt, Human
cuuucucuucucugu

SEQ ID NO: 3573734 - RNA, 16 nt, Human
cuuucucuuucccugg

SEQ ID NO: 3573735 - RNA, 15 nt, Human
cuuucucuuucuucc

SEQ ID NO: 3573736 - RNA, 18 nt, Human
cuuucucuuucuuccuuu

SEQ ID NO: 3573737 - RNA, 15 nt, Human
cuuucugaacagcug

SEQ ID NO: 3573738 - RNA, 18 nt, Human
cuuucugaacagcuggug

SEQ ID NO: 3573739 - RNA, 19 nt, Human
cuuucugaacagcuggugu

SEQ ID NO: 3573740 - RNA, 17 nt, Human
cuuucugaauugcacau

SEQ ID NO: 3573741 - RNA, 21 nt, Human
cuuucugagcaagaggauuuu

SEQ ID NO: 3573742 - RNA, 17 nt, Human
cuuucugagcacacuuu

SEQ ID NO: 3573743 - RNA, 20 nt, Human
cuuucugagcacacuuuagu

SEQ ID NO: 3573744 - RNA, 21 nt, Human
cuuucugagcacacuuuagug

SEQ ID NO: 3573745 - RNA, 16 nt, Human
cuuucugagugccuuc

SEQ ID NO: 3573746 - RNA, 21 nt, Human
cuuucugauaacuagauggug

SEQ ID NO: 3573747 - RNA, 16 nt, Human
cuuucugaucaaggcc

SEQ ID NO: 3573748 - RNA, 16 nt, Human
cuuucugcacacaaau

SEQ ID NO: 3573749 - RNA, 15 nt, Human
cuuucugcaguuuuu

SEQ ID NO: 3573750 - RNA, 18 nt, Human
cuuucugccgaccccuag

SEQ ID NO: 3573751 - RNA, 16 nt, Human
cuuucugcucagcuuc

SEQ ID NO: 3573752 - RNA, 14 nt, Human
cuuucugggccaag

SEQ ID NO: 3573753 - RNA, 20 nt, Human
cuuucuggggccuaauaaaa

SEQ ID NO: 3573754 - RNA, 17 nt, Human
cuuucugggguuuuucu

SEQ ID NO: 3573755 - RNA, 19 nt, Human
cuuucugggguuuuucugu

SEQ ID NO: 3573756 - RNA, 20 nt, Human
cuuucugggguuuuucuguu

SEQ ID NO: 3573757 - RNA, 17 nt, Human
cuuucuguaccauuuau

SEQ ID NO: 3573758 - RNA, 19 nt, Human
cuuucuguauauacuuuuu

SEQ ID NO: 3573759 - RNA, 14 nt, Human
cuuucugucucucu

SEQ ID NO: 3573760 - RNA, 22 nt, Human
cuuucugugcccuacucauugg

SEQ ID NO: 3573761 - RNA, 13 nt, Human
cuuucuguguuua

SEQ ID NO: 3573762 - RNA, 14 nt, Human
cuuucuguuccaaa

SEQ ID NO: 3573763 - RNA, 13 nt, Human
cuuucuuagaaau

SEQ ID NO: 3573764 - RNA, 14 nt, Human
cuuucuuagaaauu

SEQ ID NO: 3573765 - RNA, 20 nt, Human
cuuucuuccggccccucccc

SEQ ID NO: 3573766 - RNA, 12 nt, Human
cuuucuuccuca

SEQ ID NO: 3573767 - RNA, 17 nt, Human
cuuucuuccucauuccc

SEQ ID NO: 3573768 - RNA, 12 nt, Human
cuuucuuccuuu

SEQ ID NO: 3573769 - RNA, 15 nt, Human
cuuucuucuauuuua

SEQ ID NO: 3573770 - RNA, 16 nt, Human
cuuucuugcucccuuc

SEQ ID NO: 3573771 - RNA, 19 nt, Human
cuuucuugcucccuucagc

SEQ ID NO: 3573772 - RNA, 13 nt, Human
cuuucuuggccag

SEQ ID NO: 3573773 - RNA, 21 nt, Human
cuuucuugguucauaaaugaa

SEQ ID NO: 3573774 - RNA, 18 nt, Human
cuuucuuuaccugagacc

SEQ ID NO: 3573775 - RNA, 17 nt, Human
cuuucuuucuuagaaau

SEQ ID NO: 3573776 - RNA, 13 nt, Human
cuuucuuucuuua

SEQ ID NO: 3573777 - RNA, 16 nt, Human
cuuucuuucuuucuuu

SEQ ID NO: 3573778 - RNA, 20 nt, Human
cuuucuuugggaauauuuga

SEQ ID NO: 3573779 - RNA, 23 nt, Human
cuuucuuugggaauauuugaauc

SEQ ID NO: 3573780 - RNA, 18 nt, Human
cuuucuuuggugccuuuc

SEQ ID NO: 3573781 - RNA, 20 nt, Human
cuuucuuuggugccuuuccu

SEQ ID NO: 3573782 - RNA, 15 nt, Human
cuuuggcccagggug

SEQ ID NO: 3573783 - RNA, 13 nt, Human
cuuuggcuccccu

SEQ ID NO: 3573784 - RNA, 13 nt, Human
cuuuggcucugga

SEQ ID NO: 3573785 - RNA, 15 nt, Human
cuuuggcucuggaga

SEQ ID NO: 3573786 - RNA, 16 nt, Human
cuuuggcuuaauucca

SEQ ID NO: 3573787 - RNA, 21 nt, Human
cuuuggcuuauaauucuuuca

SEQ ID NO: 3573788 - RNA, 14 nt, Human
cuuugggaagccuu

SEQ ID NO: 3573789 - RNA, 23 nt, Human
cuuugggaauauuugaaucuugu

SEQ ID NO: 3573790 - RNA, 22 nt, Human
cuuugggagaaaacgucuugcu

SEQ ID NO: 3573791 - RNA, 23 nt, Human
cuuugggaggccaaggugggagg

SEQ ID NO: 3573792 - RNA, 18 nt, Human
cuuugggaggcugaggcg

SEQ ID NO: 3573793 - RNA, 20 nt, Human
cuuugggauuuaauuuccag

SEQ ID NO: 3573794 - RNA, 21 nt, Human
cuuugggccagacaugccaca

SEQ ID NO: 3573795 - RNA, 15 nt, Human
cuuugggcccaggga

SEQ ID NO: 3573796 - RNA, 22 nt, Human
cuuugggcccagggacaccagc

SEQ ID NO: 3573797 - RNA, 23 nt, Human
cuuugggcccagggacaccagcc

SEQ ID NO: 3573798 - RNA, 13 nt, Human
cuuugggcccugc

SEQ ID NO: 3573799 - RNA, 17 nt, Human
cuuugggccuggcuccc

SEQ ID NO: 3573800 - RNA, 15 nt, Human
cuuugggcugcccug

SEQ ID NO: 3573801 - RNA, 20 nt, Human
cuuugggcugcccuggugcu

SEQ ID NO: 3573802 - RNA, 21 nt, Human
cuuugggcugcccuggugcug

SEQ ID NO: 3573803 - RNA, 16 nt, Human
cuuugggcuugggccu

SEQ ID NO: 3573804 - RNA, 20 nt, Human
cuuuggggcuuuuacaccag

SEQ ID NO: 3573805 - RNA, 17 nt, Human
cuuuggggucuacacug

SEQ ID NO: 3573806 - RNA, 22 nt, Human
cuuuggggucuacacugcaauc

SEQ ID NO: 3573807 - RNA, 18 nt, Human
cuuuggguaccuauuuuc

SEQ ID NO: 3573808 - RNA, 14 nt, Human
cuuugggugcuguu

SEQ ID NO: 3573809 - RNA, 20 nt, Human
cuuugguaccagauaacuuu

SEQ ID NO: 3573810 - RNA, 16 nt, Human
cuuugguacuaauaau

SEQ ID NO: 3573811 - RNA, 14 nt, Human
cuuugguagaaaag

SEQ ID NO: 3573812 - RNA, 16 nt, Human
cuuuggucuacacugu

SEQ ID NO: 3573813 - RNA, 16 nt, Human
cuuuggucucuugcuu

SEQ ID NO: 3573814 - RNA, 15 nt, Human
cuuuggugaacauug

SEQ ID NO: 3573815 - RNA, 15 nt, Human
cuuuggugccuuucc

SEQ ID NO: 3573816 - RNA, 18 nt, Human
cuuuggugccuuuccugu

SEQ ID NO: 3573817 - RNA, 20 nt, Human
cuuuggugccuuuccuguuc

SEQ ID NO: 3573818 - RNA, 21 nt, Human
cuuuggugcgggcacaauaaa

SEQ ID NO: 3573819 - RNA, 17 nt, Human
cuuugguggagauaaag

SEQ ID NO: 3573820 - RNA, 14 nt, Human
cuuugguggcuuug

SEQ ID NO: 3573821 - RNA, 18 nt, Human
cuuugguggcuuugcauu

SEQ ID NO: 3573822 - RNA, 17 nt, Human
cuuugguuauuuuacuu

SEQ ID NO: 3573823 - RNA, 23 nt, Human
cuuugguuauuuuacuuuuugga

SEQ ID NO: 3573824 - RNA, 13 nt, Human
cuuugguucuaag

SEQ ID NO: 3573825 - RNA, 12 nt, Human
cuuuguaaauuc

SEQ ID NO: 3573826 - RNA, 15 nt, Human
cuuuguaaauucuga

SEQ ID NO: 3573827 - RNA, 16 nt, Human
cuuuguaaauucugau

SEQ ID NO: 3573828 - RNA, 18 nt, Human
cuuuguaagaacuaaaga

SEQ ID NO: 3573829 - RNA, 18 nt, Human
cuuuguaagaguguagaa

SEQ ID NO: 3573830 - RNA, 21 nt, Human
cuuuguaaguaaacugcccug

SEQ ID NO: 3573831 - RNA, 22 nt, Human
cuuuguaaguaaacugcccugu

SEQ ID NO: 3573832 - RNA, 19 nt, Human
cuuuguaaucguuaugugu

SEQ ID NO: 3573833 - RNA, 14 nt, Human
cuuuguaaugaaaa

SEQ ID NO: 3573834 - RNA, 16 nt, Human
cuuuguaaugaaaacc

SEQ ID NO: 3573835 - RNA, 17 nt, Human
cuuuguaaugucaccac

SEQ ID NO: 3573836 - RNA, 22 nt, Human
cuuuguaaugucaccaccuucc

SEQ ID NO: 3573837 - RNA, 13 nt, Human
cuuuguaccaaaa

SEQ ID NO: 3573838 - RNA, 14 nt, Human
cuuuguacuuugug

SEQ ID NO: 3573839 - RNA, 18 nt, Human
cuuuguagcacucaggcu

SEQ ID NO: 3573840 - RNA, 21 nt, Human
cuuuguagcacucaggcucuc

SEQ ID NO: 3573841 - RNA, 17 nt, Human
cuuuguauacaaguacu

SEQ ID NO: 3573842 - RNA, 20 nt, Human
cuuuguauacuuuaaauaau

SEQ ID NO: 3573843 - RNA, 20 nt, Human
cuuuguauagaaccucuuug

SEQ ID NO: 3573844 - RNA, 15 nt, Human
cuuuguauaguuaug

SEQ ID NO: 3573845 - RNA, 19 nt, Human
cuuuguauaguuauguaaa

SEQ ID NO: 3573846 - RNA, 21 nt, Human
cuuuguauaguuauguaaaua

SEQ ID NO: 3573847 - RNA, 10 nt, Human
cuuuguauau

SEQ ID NO: 3573848 - RNA, 12 nt, Human
cuuuguauauua

SEQ ID NO: 3573849 - RNA, 14 nt, Human
cuuuguauauuaca

SEQ ID NO: 3573850 - RNA, 18 nt, Human
cuuuguaucauucaucuu

SEQ ID NO: 3573851 - RNA, 12 nt, Human
cuuuguaugcac

SEQ ID NO: 3573852 - RNA, 19 nt, Human
cuuuguauucugucuucau

SEQ ID NO: 3573853 - RNA, 15 nt, Human
cuuuguauuguccua

SEQ ID NO: 3573854 - RNA, 13 nt, Human
cuuuguauuuuga

SEQ ID NO: 3573855 - RNA, 16 nt, Human
cuuugucccacagcuu

SEQ ID NO: 3573856 - RNA, 14 nt, Human
cuuugucccauuuc

SEQ ID NO: 3573857 - RNA, 14 nt, Human
cuuuguccccaccg

SEQ ID NO: 3573858 - RNA, 22 nt, Human
cuuuguccccaccgcagacagg

SEQ ID NO: 3573859 - RNA, 15 nt, Human
cuuugucccggggcu

SEQ ID NO: 3573860 - RNA, 15 nt, Human
cuuuguccuccugcu

SEQ ID NO: 3573861 - RNA, 17 nt, Human
cuuuguccuuuuuguua

SEQ ID NO: 3573862 - RNA, 15 nt, Human
cuuugucuaaaacaa

SEQ ID NO: 3573863 - RNA, 19 nt, Human
cuuugucuaagaaacauug

SEQ ID NO: 3573864 - RNA, 20 nt, Human
cuuugucuaagaaacauugg

SEQ ID NO: 3573865 - RNA, 15 nt, Human
cuuugugacuguaua

SEQ ID NO: 3573866 - RNA, 15 nt, Human
cuuugugauaauuua

SEQ ID NO: 3573867 - RNA, 17 nt, Human
cuuugugauaauuuaag

SEQ ID NO: 3573868 - RNA, 18 nt, Human
cuuugugauaauuuaaga

SEQ ID NO: 3573869 - RNA, 14 nt, Human
cuuugugauuuuug

SEQ ID NO: 3573870 - RNA, 18 nt, Human
cuuugugcacauuuauuu

SEQ ID NO: 3573871 - RNA, 18 nt, Human
cuuugugcccuaucaccc

SEQ ID NO: 3573872 - RNA, 20 nt, Human
cuuugugcugggguuaucug

SEQ ID NO: 3573873 - RNA, 13 nt, Human
cuuugugcugugg

SEQ ID NO: 3573874 - RNA, 17 nt, Human
cuuuguggaugucuucc

SEQ ID NO: 3573875 - RNA, 14 nt, Human
cuuuguggcacugg

SEQ ID NO: 3573876 - RNA, 18 nt, Human
cuuuguggccaaggagcu

SEQ ID NO: 3573877 - RNA, 13 nt, Human
cuuuguggcuucc

SEQ ID NO: 3573878 - RNA, 12 nt, Human
cuuuguggggcu

SEQ ID NO: 3573879 - RNA, 16 nt, Human
cuuuguggggcuuggc

SEQ ID NO: 3573880 - RNA, 18 nt, Human
cuuuguguagcuuugcuc

SEQ ID NO: 3573881 - RNA, 20 nt, Human
cuuuguguugggagggauua

SEQ ID NO: 3573882 - RNA, 23 nt, Human
cuuuguguuucuauugacuucaa

SEQ ID NO: 3573883 - RNA, 14 nt, Human
cuuuguuaaaaaaa

SEQ ID NO: 3573884 - RNA, 19 nt, Human
cuuuguuaccuuaaaacua

SEQ ID NO: 3573885 - RNA, 20 nt, Human
cuuuguuaccuuaaaacuag

SEQ ID NO: 3573886 - RNA, 20 nt, Human
cuuuguuauuuuuguuucuu

SEQ ID NO: 3573887 - RNA, 22 nt, Human
cuuuguuauuuuuguuucuucc

SEQ ID NO: 3573888 - RNA, 15 nt, Human
cuuuguucagccugc

SEQ ID NO: 3573889 - RNA, 14 nt, Human
cuuuguucccggcu

SEQ ID NO: 3573890 - RNA, 14 nt, Human
cuuuguucucagcu

SEQ ID NO: 3573891 - RNA, 15 nt, Human
cuuuguucuggcucu

SEQ ID NO: 3573892 - RNA, 21 nt, Human
cuuuguucuggcucuuccagg

SEQ ID NO: 3573893 - RNA, 20 nt, Human
cuuuguucuuuaggagauuu

SEQ ID NO: 3573894 - RNA, 16 nt, Human
cuuuguugaaagaaag

SEQ ID NO: 3573895 - RNA, 20 nt, Human
cuuuguugcaagaugugaau

SEQ ID NO: 3573896 - RNA, 15 nt, Human
cuuuguugcacugaa

SEQ ID NO: 3573897 - RNA, 15 nt, Human
cuuuguuggagucaa

SEQ ID NO: 3573898 - RNA, 17 nt, Human
cuuuguuucaaccaagu

SEQ ID NO: 3573899 - RNA, 17 nt, Human
cuuuguuucguggggag

SEQ ID NO: 3573900 - RNA, 14 nt, Human
cuuuguuucucccc

SEQ ID NO: 3573901 - RNA, 21 nt, Human
cuuuguuuggauguaauuuag

SEQ ID NO: 3573902 - RNA, 13 nt, Human
cuuuguuuguucu

SEQ ID NO: 3573903 - RNA, 20 nt, Human
cuuuguuuguugucagcuga

SEQ ID NO: 3573904 - RNA, 17 nt, Human
cuuuguuuucugacuaa

SEQ ID NO: 3573905 - RNA, 23 nt, Human
cuuuguuuugcacacuuugccau

SEQ ID NO: 3573906 - RNA, 11 nt, Human
cuuuguuuugu

SEQ ID NO: 3573907 - RNA, 14 nt, Human
cuuuguuuuguguc

SEQ ID NO: 3573908 - RNA, 17 nt, Human
cuuuguuuugugucucu

SEQ ID NO: 3573909 - RNA, 16 nt, Human
cuuuguuuuuaaauga

SEQ ID NO: 3573910 - RNA, 18 nt, Human
cuuuguuuuuaugaagaa

SEQ ID NO: 3573911 - RNA, 14 nt, Human
cuuuguuuuuauuu

SEQ ID NO: 3573912 - RNA, 14 nt, Human
cuuuuaaaaaguau

SEQ ID NO: 3573913 - RNA, 20 nt, Human
cuuuuaaaccucaccuuugu

SEQ ID NO: 3573914 - RNA, 20 nt, Human
cuuuuaaaguguuacuuuuu

SEQ ID NO: 3573915 - RNA, 18 nt, Human
cuuuuaaauccuguugaa

SEQ ID NO: 3573916 - RNA, 19 nt, Human
cuuuuaacaccugaugugu

SEQ ID NO: 3573917 - RNA, 23 nt, Human
cuuuuaacaccugauguguacau

SEQ ID NO: 3573918 - RNA, 22 nt, Human
cuuuuaacagagucugaaccua

SEQ ID NO: 3573919 - RNA, 10 nt, Human
cuuuuaacau

SEQ ID NO: 3573920 - RNA, 12 nt, Human
cuuuuaacauuu

SEQ ID NO: 3573921 - RNA, 15 nt, Human
cuuuuaacauuuugu

SEQ ID NO: 3573922 - RNA, 20 nt, Human
cuuuuaacauuuuguucuua

SEQ ID NO: 3573923 - RNA, 16 nt, Human
cuuuuaaccaucugau

SEQ ID NO: 3573924 - RNA, 18 nt, Human
cuuuuaaccaucugauau

SEQ ID NO: 3573925 - RNA, 20 nt, Human
cuuuuaacuccucaauucca

SEQ ID NO: 3573926 - RNA, 21 nt, Human
cuuuuaacuccucaauuccaa

SEQ ID NO: 3573927 - RNA, 15 nt, Human
gaaccucugucucau

SEQ ID NO: 3573928 - RNA, 13 nt, Human
gaaccucuucccc

SEQ ID NO: 3573929 - RNA, 14 nt, Human
gaaccucuucccca

SEQ ID NO: 3573930 - RNA, 18 nt, Human
gaaccugaagaacuauuu

SEQ ID NO: 3573931 - RNA, 11 nt, Human
gaaccugaccc

SEQ ID NO: 3573932 - RNA, 12 nt, Human
gaaccugacccc

SEQ ID NO: 3573933 - RNA, 17 nt, Human
gaaccuggaccaaagcu

SEQ ID NO: 3573934 - RNA, 15 nt, Human
gaaccuggagagcua

SEQ ID NO: 3573935 - RNA, 15 nt, Human
gaaccuggagggcua

SEQ ID NO: 3573936 - RNA, 16 nt, Human
gaaccuggagggcuag

SEQ ID NO: 3573937 - RNA, 13 nt, Human
gaaccuggagggg

SEQ ID NO: 3573938 - RNA, 16 nt, Human
gaaccuggaggggcua

SEQ ID NO: 3573939 - RNA, 12 nt, Human
gaaccuguccuu

SEQ ID NO: 3573940 - RNA, 19 nt, Human
gaaccugugagcugcacca

SEQ ID NO: 3573941 - RNA, 12 nt, Human
gaaccugugagu

SEQ ID NO: 3573942 - RNA, 22 nt, Human
gaaccugugaguaaauauugag

SEQ ID NO: 3573943 - RNA, 15 nt, Human
gaaccuuccuuccug

SEQ ID NO: 3573944 - RNA, 18 nt, Human
gaaccuucuggccuccca

SEQ ID NO: 3573945 - RNA, 13 nt, Human
gaaccuugcuguc

SEQ ID NO: 3573946 - RNA, 17 nt, Human
gaaccuuggccugggcc

SEQ ID NO: 3573947 - RNA, 14 nt, Human
gaaccuugugccug

SEQ ID NO: 3573948 - RNA, 18 nt, Human
gaaccuugugccuggcuc

SEQ ID NO: 3573949 - RNA, 13 nt, Human
gaaccuuguuauu

SEQ ID NO: 3573950 - RNA, 16 nt, Human
gaacgaaaaugaaagc

SEQ ID NO: 3573951 - RNA, 21 nt, Human
gaacgaaccuuggccugggcc

SEQ ID NO: 3573952 - RNA, 22 nt, Human
gaacgaaccuuggccugggccg

SEQ ID NO: 3573953 - RNA, 21 nt, Human
gaacgacaauagcuuuacccu

SEQ ID NO: 3573954 - RNA, 12 nt, Human
gaacgcagcccu

SEQ ID NO: 3573955 - RNA, 16 nt, Human
gaacgcagcccuagag

SEQ ID NO: 3573956 - RNA, 16 nt, Human
gaacgcguugaaauug

SEQ ID NO: 3573957 - RNA, 23 nt, Human
gaacggacgagauaaugugaacu

SEQ ID NO: 3573958 - RNA, 22 nt, Human
gaacggagccccaggccucugu

SEQ ID NO: 3573959 - RNA, 17 nt, Human
gaacgguaaauuucugu

SEQ ID NO: 3573960 - RNA, 23 nt, Human
gaacguagucggcacagccuggu

SEQ ID NO: 3573961 - RNA, 14 nt, Human
gaacgugacugccc

SEQ ID NO: 3573962 - RNA, 16 nt, Human
gaacguggcucugcug

SEQ ID NO: 3573963 - RNA, 21 nt, Human
gaacguuugguucaaaugugu

SEQ ID NO: 3573964 - RNA, 16 nt, Human
gaacguuuucuaauug

SEQ ID NO: 3573965 - RNA, 18 nt, Human
gaacguuuucuaauugcu

SEQ ID NO: 3573966 - RNA, 15 nt, Human
gaacguuuuuccugu

SEQ ID NO: 3573967 - RNA, 13 nt, Human
gaacuaaacuagu

SEQ ID NO: 3573968 - RNA, 18 nt, Human
gaacuaaacuuucacacc

SEQ ID NO: 3573969 - RNA, 12 nt, Human
gaacuaaagaag

SEQ ID NO: 3573970 - RNA, 13 nt, Human
gaacuaacacgug

SEQ ID NO: 3573971 - RNA, 17 nt, Human
gaacuaagaaacuuuug

SEQ ID NO: 3573972 - RNA, 16 nt, Human
gaacuaauaaauacau

SEQ ID NO: 3573973 - RNA, 17 nt, Human
gaacuaauaaauacaua

SEQ ID NO: 3573974 - RNA, 20 nt, Human
gaacuaccuugguuccccca

SEQ ID NO: 3573975 - RNA, 22 nt, Human
gaacuacgcuugcucauuuuuu

SEQ ID NO: 3573976 - RNA, 22 nt, Human
gaacuagcauauaauucuauau

SEQ ID NO: 3573977 - RNA, 16 nt, Human
gaacuagggaagcuca

SEQ ID NO: 3573978 - RNA, 17 nt, Human
gaacuagugguggcucu

SEQ ID NO: 3573979 - RNA, 22 nt, Human
gaacuauuggagggugggagag

SEQ ID NO: 3573980 - RNA, 19 nt, Human
gaacucaaacuucuggcuc

SEQ ID NO: 3573981 - RNA, 20 nt, Human
gaacucaaauggggccagau

SEQ ID NO: 3573982 - RNA, 16 nt, Human
gaacucaacuuugaca

SEQ ID NO: 3573983 - RNA, 17 nt, Human
gaacucacucugggcug

SEQ ID NO: 3573984 - RNA, 14 nt, Human
gaacucagauccag

SEQ ID NO: 3573985 - RNA, 15 nt, Human
gaacucagccaagca

SEQ ID NO: 3573986 - RNA, 16 nt, Human
gaacucagcugucugu

SEQ ID NO: 3573987 - RNA, 16 nt, Human
gaacucauuccugccu

SEQ ID NO: 3573988 - RNA, 14 nt, Human
gaacucccaagaac

SEQ ID NO: 3573989 - RNA, 11 nt, Human
gaacucccagc

SEQ ID NO: 3573990 - RNA, 14 nt, Human
gaacucccuuucaa

SEQ ID NO: 3573991 - RNA, 16 nt, Human
gaacucccuuucaaca

SEQ ID NO: 3573992 - RNA, 13 nt, Human
gaacuccugaccu

SEQ ID NO: 3573993 - RNA, 14 nt, Human
gaacuccugaccuu

SEQ ID NO: 3573994 - RNA, 22 nt, Human
gaacuccuugauuuuagccuuc

SEQ ID NO: 3573995 - RNA, 12 nt, Human
gaacuccuuggc

SEQ ID NO: 3573996 - RNA, 20 nt, Human
gaacucugaacuuuggagag

SEQ ID NO: 3573997 - RNA, 20 nt, Human
gaacucugacaacagacuuc

SEQ ID NO: 3573998 - RNA, 13 nt, Human
gaacucugacaag

SEQ ID NO: 3573999 - RNA, 19 nt, Human
gaacucuggcuuccaggua

SEQ ID NO: 3574000 - RNA, 13 nt, Human
gaacucuggcuuu

SEQ ID NO: 3574001 - RNA, 18 nt, Human
gaacucugggcugccaug

SEQ ID NO: 3574002 - RNA, 18 nt, Human
gaacucugguggcacagg

SEQ ID NO: 3574003 - RNA, 18 nt, Human
gaacucuuagaaaugaag

SEQ ID NO: 3574004 - RNA, 14 nt, Human
gaacucuucucauu

SEQ ID NO: 3574005 - RNA, 17 nt, Human
gaacucuucucauuacu

SEQ ID NO: 3574006 - RNA, 15 nt, Human
gaacugaaaacauaa

SEQ ID NO: 3574007 - RNA, 19 nt, Human
gaacugaaaagagagcaga

SEQ ID NO: 3574008 - RNA, 14 nt, Human
gaacugaaaucaua

SEQ ID NO: 3574009 - RNA, 12 nt, Human
gaacugaacuca

SEQ ID NO: 3574010 - RNA, 18 nt, Human
gaacugacauuaaaauaa

SEQ ID NO: 3574011 - RNA, 14 nt, Human
gaacugagcuugga

SEQ ID NO: 3574012 - RNA, 19 nt, Human
gaacugauaguuacuguug

SEQ ID NO: 3574013 - RNA, 21 nt, Human
gaacugauucacaucucauuu

SEQ ID NO: 3574014 - RNA, 17 nt, Human
gaacugcacaugaagaa

SEQ ID NO: 3574015 - RNA, 17 nt, Human
gaacugcagaccugucc

SEQ ID NO: 3574016 - RNA, 19 nt, Human
gaacugcagcaaucuuuga

SEQ ID NO: 3574017 - RNA, 20 nt, Human
gaacugcagcaaucuuugaa

SEQ ID NO: 3574018 - RNA, 12 nt, Human
gaacugcaggcc

SEQ ID NO: 3574019 - RNA, 14 nt, Human
gaacugcaggcccu

SEQ ID NO: 3574020 - RNA, 23 nt, Human
gaacugcaggcccuggccucccc

SEQ ID NO: 3574021 - RNA, 17 nt, Human
gaacugcagucacugca

SEQ ID NO: 3574022 - RNA, 15 nt, Human
gaacugcaugcugcu

SEQ ID NO: 3574023 - RNA, 14 nt, Human
gaacugcauggacc

SEQ ID NO: 3574024 - RNA, 13 nt, Human
gaacugcugccac

SEQ ID NO: 3574025 - RNA, 17 nt, Human
gaacugcugggcuuggc

SEQ ID NO: 3574026 - RNA, 18 nt, Human
gaacuggacccuguugcu

SEQ ID NO: 3574027 - RNA, 23 nt, Human
gaacuggacccuguugcuaagcc

SEQ ID NO: 3574028 - RNA, 17 nt, Human
gaacuggagccaugggc

SEQ ID NO: 3574029 - RNA, 11 nt, Human
gaacuggaggc

SEQ ID NO: 3574030 - RNA, 11 nt, Human
gaacuggcugc

SEQ ID NO: 3574031 - RNA, 12 nt, Human
gaacuggcugca

SEQ ID NO: 3574032 - RNA, 22 nt, Human
gaacuggguacuuguggacaca

SEQ ID NO: 3574033 - RNA, 14 nt, Human
gaacuggucuuccu

SEQ ID NO: 3574034 - RNA, 15 nt, Human
gaacuguccagagag

SEQ ID NO: 3574035 - RNA, 18 nt, Human
gaacugucggaggaaaga

SEQ ID NO: 3574036 - RNA, 18 nt, Human
gaacugugcauagugcug

SEQ ID NO: 3574037 - RNA, 14 nt, Human
gaacuguguguaau

SEQ ID NO: 3574038 - RNA, 18 nt, Human
gaacuguguguaauuguu

SEQ ID NO: 3574039 - RNA, 15 nt, Human
gaacuguuguauaaa

SEQ ID NO: 3574040 - RNA, 16 nt, Human
gaacuguuguauaaau

SEQ ID NO: 3574041 - RNA, 18 nt, Human
gaacuuaaggcauuuguu

SEQ ID NO: 3574042 - RNA, 15 nt, Human
gaacuuacuauucau

SEQ ID NO: 3574043 - RNA, 21 nt, Human
gaacuuacuauucauuaaaug

SEQ ID NO: 3574044 - RNA, 18 nt, Human
gaacuuacuugcauacca

SEQ ID NO: 3574045 - RNA, 16 nt, Human
gaacuuagauuuuaca

SEQ ID NO: 3574046 - RNA, 17 nt, Human
gaacuuagauuuuacau

SEQ ID NO: 3574047 - RNA, 19 nt, Human
gaacuuagauuuuacauga

SEQ ID NO: 3574048 - RNA, 20 nt, Human
gaacuuagauuuuacaugaa

SEQ ID NO: 3574049 - RNA, 22 nt, Human
gaacuuagccauuuuucaaagc

SEQ ID NO: 3574050 - RNA, 20 nt, Human
gaacuuauccuaaaacaaau

SEQ ID NO: 3574051 - RNA, 15 nt, Human
gaacuuauucuguag

SEQ ID NO: 3574052 - RNA, 15 nt, Human
gaacuucaccugcaa

SEQ ID NO: 3574053 - RNA, 14 nt, Human
gaacuucagaaaga

SEQ ID NO: 3574054 - RNA, 13 nt, Human
gaacuucauggau

SEQ ID NO: 3574055 - RNA, 22 nt, Human
gaacuuccagauccuggaaauc

SEQ ID NO: 3574056 - RNA, 23 nt, Human
gaacuuccagguguuacuguaau

SEQ ID NO: 3574057 - RNA, 14 nt, Human
gaacuucuaauaua

SEQ ID NO: 3574058 - RNA, 16 nt, Human
gaacuucuccguccuc

SEQ ID NO: 3574059 - RNA, 19 nt, Human
gaacuucuccguccucgau

SEQ ID NO: 3574060 - RNA, 12 nt, Human
gaacuugaaauu

SEQ ID NO: 3574061 - RNA, 22 nt, Human
gaacuugaaauuugaauuuugu

SEQ ID NO: 3574062 - RNA, 16 nt, Human
gaacuugaagccugcu

SEQ ID NO: 3574063 - RNA, 21 nt, Human
gaacuugaagccugcuccuuc

SEQ ID NO: 3574064 - RNA, 22 nt, Human
gaacuugaagccugcuccuucc

SEQ ID NO: 3574065 - RNA, 13 nt, Human
gaacuugaggaca

SEQ ID NO: 3574066 - RNA, 15 nt, Human
gaacuugaggacaca

SEQ ID NO: 3574067 - RNA, 17 nt, Human
gaacuugaggacacaug

SEQ ID NO: 3574068 - RNA, 21 nt, Human
gaacuugcagcugauguugga

SEQ ID NO: 3574069 - RNA, 15 nt, Human
gaacuugcauuguga

SEQ ID NO: 3574070 - RNA, 17 nt, Human
gaacuugccugccuuuc

SEQ ID NO: 3574071 - RNA, 22 nt, Human
gaacuugccugccuuuccaucc

SEQ ID NO: 3574072 - RNA, 12 nt, Human
gaacuugcugcc

SEQ ID NO: 3574073 - RNA, 22 nt, Human
gaacuugcugcugagugcacca

SEQ ID NO: 3574074 - RNA, 22 nt, Human
gaagagucuugguuucucucua

SEQ ID NO: 3574075 - RNA, 13 nt, Human
gaagagugaaaua

SEQ ID NO: 3574076 - RNA, 16 nt, Human
gaagagugagagggca

SEQ ID NO: 3574077 - RNA, 15 nt, Human
gaagaguguacuggg

SEQ ID NO: 3574078 - RNA, 14 nt, Human
gaagagugugugug

SEQ ID NO: 3574079 - RNA, 21 nt, Human
gaagaguugccccgucucugu

SEQ ID NO: 3574080 - RNA, 14 nt, Human
gaagaguugugcac

SEQ ID NO: 3574081 - RNA, 14 nt, Human
gaagauaaguugga

SEQ ID NO: 3574082 - RNA, 19 nt, Human
gaagauaauuguugaaauu

SEQ ID NO: 3574083 - RNA, 12 nt, Human
gaagauacuuug

SEQ ID NO: 3574084 - RNA, 13 nt, Human
gaagauagaagaa

SEQ ID NO: 3574085 - RNA, 16 nt, Human
gaagauagcugugacu

SEQ ID NO: 3574086 - RNA, 22 nt, Human
gaagauauaacuauugcccagg

SEQ ID NO: 3574087 - RNA, 15 nt, Human
gaagauauacaugaa

SEQ ID NO: 3574088 - RNA, 17 nt, Human
gaagaucacgcuccccg

SEQ ID NO: 3574089 - RNA, 21 nt, Human
gaagaucauauacgugaaaau

SEQ ID NO: 3574090 - RNA, 14 nt, Human
gaagaucccccaga

SEQ ID NO: 3574091 - RNA, 22 nt, Human
gaagauccugcggguggggcuu

SEQ ID NO: 3574092 - RNA, 21 nt, Human
gaagaucucacucugcccccc

SEQ ID NO: 3574093 - RNA, 14 nt, Human
gaagaugcagcuca

SEQ ID NO: 3574094 - RNA, 23 nt, Human
gaagauguugaagaauacaguua

SEQ ID NO: 3574095 - RNA, 18 nt, Human
gaagauguugagaaaccu

SEQ ID NO: 3574096 - RNA, 22 nt, Human
gaagauguuuaacuuaaucaau

SEQ ID NO: 3574097 - RNA, 15 nt, Human
gaagauguuucaaaa

SEQ ID NO: 3574098 - RNA, 19 nt, Human
gaagauuauauauauuuuu

SEQ ID NO: 3574099 - RNA, 17 nt, Human
gaagauucuauguuaau

SEQ ID NO: 3574100 - RNA, 22 nt, Human
gaagauucuucccauucuccau

SEQ ID NO: 3574101 - RNA, 13 nt, Human
gaagauugugaau

SEQ ID NO: 3574102 - RNA, 16 nt, Human
gaagauuguuuaucua

SEQ ID NO: 3574103 - RNA, 22 nt, Human
gaagauuugaugcuggagaggu

SEQ ID NO: 3574104 - RNA, 14 nt, Human
gaagcaaaauuuuu

SEQ ID NO: 3574105 - RNA, 16 nt, Human
gaagcaaagcaccagc

SEQ ID NO: 3574106 - RNA, 17 nt, Human
gaagcaaaucgaaugaa

SEQ ID NO: 3574107 - RNA, 16 nt, Human
gaagcaacagaaaaaa

SEQ ID NO: 3574108 - RNA, 22 nt, Human
gaagcaagaggcaagcugaaau

SEQ ID NO: 3574109 - RNA, 23 nt, Human
gaagcaagaggcaagcugaaauu

SEQ ID NO: 3574110 - RNA, 18 nt, Human
gaagcaaggaagauauac

SEQ ID NO: 3574111 - RNA, 20 nt, Human
gaagcaaggaagauauacau

SEQ ID NO: 3574112 - RNA, 19 nt, Human
gaagcaauaaagaagagug

SEQ ID NO: 3574113 - RNA, 23 nt, Human
gaagcacacucuggucuuggaau

SEQ ID NO: 3574114 - RNA, 14 nt, Human
gaagcacagcuuca

SEQ ID NO: 3574115 - RNA, 20 nt, Human
gaagcacaugcaccuaccca

SEQ ID NO: 3574116 - RNA, 15 nt, Human
gaagcacaugccucu

SEQ ID NO: 3574117 - RNA, 17 nt, Human
gaagcacaugccucucu

SEQ ID NO: 3574118 - RNA, 21 nt, Human
gaagcacaugccucucucagg

SEQ ID NO: 3574119 - RNA, 14 nt, Human
gaagcacauguuua

SEQ ID NO: 3574120 - RNA, 20 nt, Human
gaagcacccauuaugcgcug

SEQ ID NO: 3574121 - RNA, 19 nt, Human
gaagcacgugguaaaacac

SEQ ID NO: 3574122 - RNA, 20 nt, Human
gaagcacuacaccuugccuu

SEQ ID NO: 3574123 - RNA, 21 nt, Human
gaagcacuacaccuugccuug

SEQ ID NO: 3574124 - RNA, 23 nt, Human
gaagcacuuugggauucuuucca

SEQ ID NO: 3574125 - RNA, 19 nt, Human
gaagcagaauaaagcaauu

SEQ ID NO: 3574126 - RNA, 20 nt, Human
gaagcagaauaaagcaauuu

SEQ ID NO: 3574127 - RNA, 21 nt, Human
gaagcagaauaaagcaauuuu

SEQ ID NO: 3574128 - RNA, 12 nt, Human
gaagcagagugg

SEQ ID NO: 3574129 - RNA, 20 nt, Human
gaagcagaugcaaagaggca

SEQ ID NO: 3574130 - RNA, 18 nt, Human
gaagcaggcuacacugac

SEQ ID NO: 3574131 - RNA, 17 nt, Human
gaagcaggguuucuuuu

SEQ ID NO: 3574132 - RNA, 19 nt, Human
gaagcaggugugagggcag

SEQ ID NO: 3574133 - RNA, 16 nt, Human
gaagcagguuaaaugu

SEQ ID NO: 3574134 - RNA, 18 nt, Human
gaagcagguugaggggcu

SEQ ID NO: 3574135 - RNA, 16 nt, Human
gaagcagugagccgca

SEQ ID NO: 3574136 - RNA, 15 nt, Human
gaagcagugcccagg

SEQ ID NO: 3574137 - RNA, 17 nt, Human
gaagcagugccuuccau

SEQ ID NO: 3574138 - RNA, 19 nt, Human
gaagcagugccuuccauaa

SEQ ID NO: 3574139 - RNA, 14 nt, Human
gaagcauccaggca

SEQ ID NO: 3574140 - RNA, 22 nt, Human
gaagcaucuuccagaaguguga

SEQ ID NO: 3574141 - RNA, 12 nt, Human
gaagcauguuuc

SEQ ID NO: 3574142 - RNA, 13 nt, Human
gaagcauguuuca

SEQ ID NO: 3574143 - RNA, 19 nt, Human
gaagcauguuucauguuuu

SEQ ID NO: 3574144 - RNA, 18 nt, Human
gaagcauuaacuucucug

SEQ ID NO: 3574145 - RNA, 21 nt, Human
gaagcauuaacuucucuggaa

SEQ ID NO: 3574146 - RNA, 15 nt, Human
gaagcauucagagag

SEQ ID NO: 3574147 - RNA, 17 nt, Human
gaagcauucagagagca

SEQ ID NO: 3574148 - RNA, 15 nt, Human
gaagcauuccuucuu

SEQ ID NO: 3574149 - RNA, 18 nt, Human
gaagcauuccuucuuuga

SEQ ID NO: 3574150 - RNA, 22 nt, Human
gaagcauuccuucuuugauaau

SEQ ID NO: 3574151 - RNA, 21 nt, Human
gaagcauucucauuggaaauu

SEQ ID NO: 3574152 - RNA, 15 nt, Human
gaagcauucucccca

SEQ ID NO: 3574153 - RNA, 13 nt, Human
gaagcauuguaaa

SEQ ID NO: 3574154 - RNA, 14 nt, Human
gaagcauuuguauu

SEQ ID NO: 3574155 - RNA, 18 nt, Human
gaagccaaaccucuguga

SEQ ID NO: 3574156 - RNA, 16 nt, Human
gaagccaaauuuauca

SEQ ID NO: 3574157 - RNA, 17 nt, Human
gaagccaacuuggcuuu

SEQ ID NO: 3574158 - RNA, 18 nt, Human
gaagccaacuuggcuuuc

SEQ ID NO: 3574159 - RNA, 21 nt, Human
gaagccaagggaaaggggugc

SEQ ID NO: 3574160 - RNA, 21 nt, Human
gaagccaaguggggugcuggg

SEQ ID NO: 3574161 - RNA, 22 nt, Human
gaagccaaguggggugcuggga

SEQ ID NO: 3574162 - RNA, 18 nt, Human
gaagccaauucagacagg

SEQ ID NO: 3574163 - RNA, 17 nt, Human
gaagccacagcccaggc

SEQ ID NO: 3574164 - RNA, 17 nt, Human
gaagccacccucccagc

SEQ ID NO: 3574165 - RNA, 22 nt, Human
gaagccacuuucuacaggccag

SEQ ID NO: 3574166 - RNA, 21 nt, Human
gaagccagcaggcucucaggc

SEQ ID NO: 3574167 - RNA, 22 nt, Human
gaagccagcaggcucucaggcc

SEQ ID NO: 3574168 - RNA, 12 nt, Human
gaagccagcugc

SEQ ID NO: 3574169 - RNA, 23 nt, Human
gaagccagcugccuaggauucac

SEQ ID NO: 3574170 - RNA, 22 nt, Human
gaagccagcuuguuuacaugcu

SEQ ID NO: 3574171 - RNA, 21 nt, Human
gaagccaggaauuucccagga

SEQ ID NO: 3574172 - RNA, 23 nt, Human
gaagccaggaauuucccaggacc

SEQ ID NO: 3574173 - RNA, 12 nt, Human
gaagccaggagc

SEQ ID NO: 3574174 - RNA, 14 nt, Human
gaagccaggagcaa

SEQ ID NO: 3574175 - RNA, 18 nt, Human
gaagccaggagcaaaugu

SEQ ID NO: 3574176 - RNA, 22 nt, Human
gaagccaggagcaaauguuucu

SEQ ID NO: 3574177 - RNA, 15 nt, Human
gaagccaucuuucuu

SEQ ID NO: 3574178 - RNA, 12 nt, Human
gaagcccagaau

SEQ ID NO: 3574179 - RNA, 14 nt, Human
gaagcccagagggu

SEQ ID NO: 3574180 - RNA, 12 nt, Human
gaagcccagcuc

SEQ ID NO: 3574181 - RNA, 13 nt, Human
gaagcccagcucc

SEQ ID NO: 3574182 - RNA, 14 nt, Human
gaagcccagcucca

SEQ ID NO: 3574183 - RNA, 16 nt, Human
gaagcccagcuccagg

SEQ ID NO: 3574184 - RNA, 17 nt, Human
gaagcccagcuccaggg

SEQ ID NO: 3574185 - RNA, 20 nt, Human
gaagcccagcuccagggcca

SEQ ID NO: 3574186 - RNA, 16 nt, Human
gaagcccaggaaaggc

SEQ ID NO: 3574187 - RNA, 19 nt, Human
gaagcccauccugaccagc

SEQ ID NO: 3574188 - RNA, 17 nt, Human
gaagccccacaugucca

SEQ ID NO: 3574189 - RNA, 20 nt, Human
gaagcccccaccgugggcag

SEQ ID NO: 3574190 - RNA, 14 nt, Human
gaagcccccagcua

SEQ ID NO: 3574191 - RNA, 22 nt, Human
gaagcccccagcuaagaaccug

SEQ ID NO: 3574192 - RNA, 14 nt, Human
gaagccccuucccc

SEQ ID NO: 3574193 - RNA, 17 nt, Human
gaagccccuuccccaug

SEQ ID NO: 3574194 - RNA, 19 nt, Human
gaagcccggcuccugguca

SEQ ID NO: 3574195 - RNA, 11 nt, Human
gaagcccuguu

SEQ ID NO: 3574196 - RNA, 13 nt, Human
gaagccgacucug

SEQ ID NO: 3574197 - RNA, 15 nt, Human
gaagccgacucuggc

SEQ ID NO: 3574198 - RNA, 16 nt, Human
gaagccgccaggaccg

SEQ ID NO: 3574199 - RNA, 14 nt, Human
gaagccgcugcugg

SEQ ID NO: 3574200 - RNA, 18 nt, Human
gaagccgcuggggccagu

SEQ ID NO: 3574201 - RNA, 18 nt, Human
gaagccggcggcccaagc

SEQ ID NO: 3574202 - RNA, 20 nt, Human
gaagccggcggcccaagccc

SEQ ID NO: 3574203 - RNA, 16 nt, Human
gaagccgggaacagac

SEQ ID NO: 3574204 - RNA, 16 nt, Human
gaagccgugcccugcc

SEQ ID NO: 3574205 - RNA, 14 nt, Human
gaagccuauuguaa

SEQ ID NO: 3574206 - RNA, 16 nt, Human
gaagccugggggccug

SEQ ID NO: 3574207 - RNA, 17 nt, Human
gaagccugggggccugg

SEQ ID NO: 3574208 - RNA, 22 nt, Human
gaagccuguaacacuccucugc

SEQ ID NO: 3574209 - RNA, 22 nt, Human
gaagccuguuuuguuggaaggu

SEQ ID NO: 3574210 - RNA, 14 nt, Human
gaagccuuagccag

SEQ ID NO: 3574211 - RNA, 19 nt, Human
gaagccuucaagcucugag

SEQ ID NO: 3574212 - RNA, 22 nt, Human
gaagccuucaagcucugaggga

SEQ ID NO: 3574213 - RNA, 10 nt, Human
gaagccuucc

SEQ ID NO: 3574214 - RNA, 21 nt, Human
gaagccuuggggcugaugcag

SEQ ID NO: 3574215 - RNA, 19 nt, Human
gaagccuuuacugacccug

SEQ ID NO: 3574216 - RNA, 22 nt, Human
gaagcgcgccacucgcuucccc

SEQ ID NO: 3574217 - RNA, 14 nt, Human
gaagcggauuucca

SEQ ID NO: 3574218 - RNA, 16 nt, Human
gaaggcuucucucugu

SEQ ID NO: 3574219 - RNA, 15 nt, Human
gaaggcuugggauuu

SEQ ID NO: 3574220 - RNA, 20 nt, Human
gaaggcuugggauuugcugu

SEQ ID NO: 3574221 - RNA, 21 nt, Human
gaaggcuugggauuugcugug

SEQ ID NO: 3574222 - RNA, 19 nt, Human
gaaggcuuguugugcuuuu

SEQ ID NO: 3574223 - RNA, 15 nt, Human
gaagggaagagacag

SEQ ID NO: 3574224 - RNA, 20 nt, Human
gaagggaccaaggcaaggca

SEQ ID NO: 3574225 - RNA, 17 nt, Human
gaagggaccuugaaggg

SEQ ID NO: 3574226 - RNA, 14 nt, Human
gaagggagccaagg

SEQ ID NO: 3574227 - RNA, 16 nt, Human
gaagggaggggcugug

SEQ ID NO: 3574228 - RNA, 10 nt, Human
gaagggaggu

SEQ ID NO: 3574229 - RNA, 13 nt, Human
gaagggagguggc

SEQ ID NO: 3574230 - RNA, 13 nt, Human
gaagggcaaguuu

SEQ ID NO: 3574231 - RNA, 19 nt, Human
gaagggcagggcugaggcc

SEQ ID NO: 3574232 - RNA, 18 nt, Human
gaagggcaucaugcaucu

SEQ ID NO: 3574233 - RNA, 19 nt, Human
gaagggcauccuucugccu

SEQ ID NO: 3574234 - RNA, 13 nt, Human
gaagggccagagc

SEQ ID NO: 3574235 - RNA, 11 nt, Human
gaagggccagu

SEQ ID NO: 3574236 - RNA, 14 nt, Human
gaagggccaguccu

SEQ ID NO: 3574237 - RNA, 19 nt, Human
gaagggcuagaaccuggag

SEQ ID NO: 3574238 - RNA, 22 nt, Human
gaagggcuagaaccuggagagc

SEQ ID NO: 3574239 - RNA, 13 nt, Human
gaagggcugcaug

SEQ ID NO: 3574240 - RNA, 19 nt, Human
gaaggggaagcacucgugu

SEQ ID NO: 3574241 - RNA, 18 nt, Human
gaaggggacccccgcccc

SEQ ID NO: 3574242 - RNA, 20 nt, Human
gaaggggacccccgcccccu

SEQ ID NO: 3574243 - RNA, 19 nt, Human
gaaggggacugccaccucc

SEQ ID NO: 3574244 - RNA, 22 nt, Human
gaaggggagauaaggguaucug

SEQ ID NO: 3574245 - RNA, 22 nt, Human
gaaggggaggaccucugggcuu

SEQ ID NO: 3574246 - RNA, 23 nt, Human
gaaggggcaaauucuuuugaauu

SEQ ID NO: 3574247 - RNA, 17 nt, Human
gaaggggccagaggcuc

SEQ ID NO: 3574248 - RNA, 12 nt, Human
gaaggggcugga

SEQ ID NO: 3574249 - RNA, 16 nt, Human
gaagggggauaugaau

SEQ ID NO: 3574250 - RNA, 19 nt, Human
gaagggggcaucuggccuu

SEQ ID NO: 3574251 - RNA, 14 nt, Human
gaagggggcggccu

SEQ ID NO: 3574252 - RNA, 15 nt, Human
gaagggggcugggac

SEQ ID NO: 3574253 - RNA, 18 nt, Human
gaagggggguugcagugg

SEQ ID NO: 3574254 - RNA, 18 nt, Human
gaaggggguccacccagc

SEQ ID NO: 3574255 - RNA, 13 nt, Human
gaaggguaaacaa

SEQ ID NO: 3574256 - RNA, 21 nt, Human
gaaggguccuucccucucccc

SEQ ID NO: 3574257 - RNA, 16 nt, Human
gaaggguuucucuauu

SEQ ID NO: 3574258 - RNA, 17 nt, Human
gaagguaaauaaaaaga

SEQ ID NO: 3574259 - RNA, 22 nt, Human
gaagguaaauaaaaagaaaggc

SEQ ID NO: 3574260 - RNA, 13 nt, Human
gaagguacuguau

SEQ ID NO: 3574261 - RNA, 15 nt, Human
gaagguagaauguuu

SEQ ID NO: 3574262 - RNA, 17 nt, Human
gaagguagaauguuuuc

SEQ ID NO: 3574263 - RNA, 20 nt, Human
gaagguagaauguuuucaaa

SEQ ID NO: 3574264 - RNA, 19 nt, Human
gaagguagcauucuuugga

SEQ ID NO: 3574265 - RNA, 14 nt, Human
gaaggucaccagca

SEQ ID NO: 3574266 - RNA, 17 nt, Human
gaaggucaccugagccc

SEQ ID NO: 3574267 - RNA, 14 nt, Human
gaaggucauuucca

SEQ ID NO: 3574268 - RNA, 16 nt, Human
gaagguccugcuauua

SEQ ID NO: 3574269 - RNA, 15 nt, Human
gaaggucggaggcuu

SEQ ID NO: 3574270 - RNA, 15 nt, Human
gaaggucucauucuu

SEQ ID NO: 3574271 - RNA, 15 nt, Human
gaaggucuugauuug

SEQ ID NO: 3574272 - RNA, 23 nt, Human
gaaggucuugauuuguuuuagaa

SEQ ID NO: 3574273 - RNA, 14 nt, Human
gaaggugacagcag

SEQ ID NO: 3574274 - RNA, 19 nt, Human
gaaggugauguugccaucc

SEQ ID NO: 3574275 - RNA, 16 nt, Human
gaaggugauuuauucu

SEQ ID NO: 3574276 - RNA, 21 nt, Human
gaaggugcugacggccaggga

SEQ ID NO: 3574277 - RNA, 19 nt, Human
gaaggugcuggagguggga

SEQ ID NO: 3574278 - RNA, 21 nt, Human
gaaggugcuggaggugggagc

SEQ ID NO: 3574279 - RNA, 23 nt, Human
gaagguggaccuuuuaaaguguu

SEQ ID NO: 3574280 - RNA, 23 nt, Human
gaagguggggguuggcuggguac

SEQ ID NO: 3574281 - RNA, 20 nt, Human
gaagguuaucagugcuuccc

SEQ ID NO: 3574282 - RNA, 13 nt, Human
gaagguugaagag

SEQ ID NO: 3574283 - RNA, 20 nt, Human
gaagguuugguguguggaga

SEQ ID NO: 3574284 - RNA, 19 nt, Human
gaagguuuuuguaaagauu

SEQ ID NO: 3574285 - RNA, 14 nt, Human
gaaguaaacugcag

SEQ ID NO: 3574286 - RNA, 13 nt, Human
gaaguaaacuuuu

SEQ ID NO: 3574287 - RNA, 15 nt, Human
gaaguaaagccauua

SEQ ID NO: 3574288 - RNA, 19 nt, Human
gaaguaaagccauuaaaug

SEQ ID NO: 3574289 - RNA, 15 nt, Human
gaaguaaagccucaa

SEQ ID NO: 3574290 - RNA, 19 nt, Human
gaaguaaccauuugcacug

SEQ ID NO: 3574291 - RNA, 15 nt, Human
gaaguaacuacaguu

SEQ ID NO: 3574292 - RNA, 16 nt, Human
gaaguaacuugucuua

SEQ ID NO: 3574293 - RNA, 21 nt, Human
gaaguacccguucacauuuuu

SEQ ID NO: 3574294 - RNA, 21 nt, Human
gaaguacguuauuguugacuu

SEQ ID NO: 3574295 - RNA, 20 nt, Human
gaaguagaaacaaaauacaa

SEQ ID NO: 3574296 - RNA, 13 nt, Human
gaaguagaaaggg

SEQ ID NO: 3574297 - RNA, 16 nt, Human
gaaguagcacaggcug

SEQ ID NO: 3574298 - RNA, 18 nt, Human
gaaguagcacaggcugag

SEQ ID NO: 3574299 - RNA, 18 nt, Human
gaaguagcuugcucccug

SEQ ID NO: 3574300 - RNA, 19 nt, Human
gaaguagcuugcucccugu

SEQ ID NO: 3574301 - RNA, 14 nt, Human
gaaguagcuuugca

SEQ ID NO: 3574302 - RNA, 16 nt, Human
gaaguaggggaagaau

SEQ ID NO: 3574303 - RNA, 14 nt, Human
gaaguaguccuugg

SEQ ID NO: 3574304 - RNA, 16 nt, Human
gaaguaguuaucaugu

SEQ ID NO: 3574305 - RNA, 20 nt, Human
gaaguaguucuguuuggugu

SEQ ID NO: 3574306 - RNA, 19 nt, Human
gaaguaguuuguauaacuu

SEQ ID NO: 3574307 - RNA, 14 nt, Human
gaaguauccuucag

SEQ ID NO: 3574308 - RNA, 17 nt, Human
gaaguaucuaaaagugu

SEQ ID NO: 3574309 - RNA, 19 nt, Human
gaaguaucuaaaaguguca

SEQ ID NO: 3574310 - RNA, 21 nt, Human
gaaguauguauauuaaaaaag

SEQ ID NO: 3574311 - RNA, 19 nt, Human
gaaguauuuugcuggaaua

SEQ ID NO: 3574312 - RNA, 15 nt, Human
gaaguauuuuuagaa

SEQ ID NO: 3574313 - RNA, 20 nt, Human
gaagucaagcccagccacgu

SEQ ID NO: 3574314 - RNA, 16 nt, Human
gaagucacagggcagu

SEQ ID NO: 3574315 - RNA, 20 nt, Human
gaagucacagggcaguaccu

SEQ ID NO: 3574316 - RNA, 22 nt, Human
gaagucaccuuguguguuccaa

SEQ ID NO: 3574317 - RNA, 18 nt, Human
gaagucauaccaaugaaa

SEQ ID NO: 3574318 - RNA, 15 nt, Human
gaagucaugaagccc

SEQ ID NO: 3574319 - RNA, 21 nt, Human
gaagucaugcuccccugugcc

SEQ ID NO: 3574320 - RNA, 17 nt, Human
gaagucauuaaacuggu

SEQ ID NO: 3574321 - RNA, 22 nt, Human
gaaguccaagcauuuagaugua

SEQ ID NO: 3574322 - RNA, 23 nt, Human
gaaguccccaggccccaggaagc

SEQ ID NO: 3574323 - RNA, 22 nt, Human
gaagucguccuuacuccugugg

SEQ ID NO: 3574324 - RNA, 23 nt, Human
gaagucguccuuacuccuguggg

SEQ ID NO: 3574325 - RNA, 18 nt, Human
gaagucgucuuaacucac

SEQ ID NO: 3574326 - RNA, 18 nt, Human
gaagucucuagguucuga

SEQ ID NO: 3574327 - RNA, 21 nt, Human
gaagucucugaagugaaacug

SEQ ID NO: 3574328 - RNA, 15 nt, Human
gaagucuucaugaaa

SEQ ID NO: 3574329 - RNA, 13 nt, Human
gaagucuucuauu

SEQ ID NO: 3574330 - RNA, 16 nt, Human
gaagucuuuguacaga

SEQ ID NO: 3574331 - RNA, 20 nt, Human
gaagucuuuguacagacaac

SEQ ID NO: 3574332 - RNA, 14 nt, Human
gaagugaaacugcu

SEQ ID NO: 3574333 - RNA, 15 nt, Human
gaagugaaugcuggg

SEQ ID NO: 3574334 - RNA, 16 nt, Human
gaagugaaugcuggga

SEQ ID NO: 3574335 - RNA, 18 nt, Human
gaagugacagggaagcua

SEQ ID NO: 3574336 - RNA, 13 nt, Human
gaagugacuuugg

SEQ ID NO: 3574337 - RNA, 20 nt, Human
gaagugacuuuggcugcaug

SEQ ID NO: 3574338 - RNA, 21 nt, Human
gaagugacuuuggcugcaugc

SEQ ID NO: 3574339 - RNA, 16 nt, Human
gaagugagcacagccu

SEQ ID NO: 3574340 - RNA, 16 nt, Human
gaagugaggaagccag

SEQ ID NO: 3574341 - RNA, 14 nt, Human
gaagugaggcauug

SEQ ID NO: 3574342 - RNA, 16 nt, Human
gaagugcauuucugaa

SEQ ID NO: 3574343 - RNA, 23 nt, Human
gaagugcauuucugaauagaaau

SEQ ID NO: 3574344 - RNA, 16 nt, Human
gaagugcccuuccugc

SEQ ID NO: 3574345 - RNA, 22 nt, Human
gaagugcgggguaggggaagaa

SEQ ID NO: 3574346 - RNA, 19 nt, Human
gaagugcuccccucugaaa

SEQ ID NO: 3574347 - RNA, 13 nt, Human
gaagugcuuggaa

SEQ ID NO: 3574348 - RNA, 19 nt, Human
gaagugcuuggaacauacu

SEQ ID NO: 3574349 - RNA, 22 nt, Human
gaaguggaccaggacaggacca

SEQ ID NO: 3574350 - RNA, 18 nt, Human
gaaguggacuggccccug

SEQ ID NO: 3574351 - RNA, 19 nt, Human
gaagugggccaggacaggc

SEQ ID NO: 3574352 - RNA, 21 nt, Human
gaagugggccaggacaggccc

SEQ ID NO: 3574353 - RNA, 18 nt, Human
gaagugguaggaaagccu

SEQ ID NO: 3574354 - RNA, 14 nt, Human
gaaguguaacagcu

SEQ ID NO: 3574355 - RNA, 17 nt, Human
gaaguguaacagcugag

SEQ ID NO: 3574356 - RNA, 17 nt, Human
gaaguguaggcagacac

SEQ ID NO: 3574357 - RNA, 14 nt, Human
gaaguguauaauau

SEQ ID NO: 3574358 - RNA, 17 nt, Human
gaaguguauaauauaaa

SEQ ID NO: 3574359 - RNA, 21 nt, Human
gaaguguauaauauaaaaaau

SEQ ID NO: 3574360 - RNA, 14 nt, Human
gaagugucauguuu

SEQ ID NO: 3574361 - RNA, 20 nt, Human
gaagugugccuucucucucc

SEQ ID NO: 3574362 - RNA, 12 nt, Human
gaauauugagca

SEQ ID NO: 3574363 - RNA, 13 nt, Human
gaauauugccaau

SEQ ID NO: 3574364 - RNA, 11 nt, Human
gaauauugcug

SEQ ID NO: 3574365 - RNA, 13 nt, Human
gaauauugcugau

SEQ ID NO: 3574366 - RNA, 15 nt, Human
gaauauugcugaugg

SEQ ID NO: 3574367 - RNA, 23 nt, Human
gaauauugcugauggugcaauga

SEQ ID NO: 3574368 - RNA, 13 nt, Human
gaauauuguccau

SEQ ID NO: 3574369 - RNA, 12 nt, Human
gaauauuguguu

SEQ ID NO: 3574370 - RNA, 18 nt, Human
gaauauuuauuaccucug

SEQ ID NO: 3574371 - RNA, 21 nt, Human
gaauauuuauuaccucugaua

SEQ ID NO: 3574372 - RNA, 10 nt, Human
gaauauuuga

SEQ ID NO: 3574373 - RNA, 13 nt, Human
gaauauuugaauc

SEQ ID NO: 3574374 - RNA, 20 nt, Human
gaauauuugucgauauuucc

SEQ ID NO: 3574375 - RNA, 16 nt, Human
gaauauuuuaacuucc

SEQ ID NO: 3574376 - RNA, 20 nt, Human
gaauauuuuauucaagguaa

SEQ ID NO: 3574377 - RNA, 21 nt, Human
gaauauuuucaguaauguuau

SEQ ID NO: 3574378 - RNA, 16 nt, Human
gaaucaaagacaugga

SEQ ID NO: 3574379 - RNA, 17 nt, Human
gaaucaaagacauggaa

SEQ ID NO: 3574380 - RNA, 17 nt, Human
gaaucaaagcaaugcau

SEQ ID NO: 3574381 - RNA, 18 nt, Human
gaaucaaagcaaugcauu

SEQ ID NO: 3574382 - RNA, 22 nt, Human
gaaucaaagcaguuaacuuuaa

SEQ ID NO: 3574383 - RNA, 17 nt, Human
gaaucaacagggcagca

SEQ ID NO: 3574384 - RNA, 15 nt, Human
gaaucaagagcugcc

SEQ ID NO: 3574385 - RNA, 16 nt, Human
gaaucaagagcugccc

SEQ ID NO: 3574386 - RNA, 16 nt, Human
gaaucaagggucaggc

SEQ ID NO: 3574387 - RNA, 11 nt, Human
gaaucacaggc

SEQ ID NO: 3574388 - RNA, 14 nt, Human
gaaucacaggcugg

SEQ ID NO: 3574389 - RNA, 15 nt, Human
gaaucacaggcuggg

SEQ ID NO: 3574390 - RNA, 18 nt, Human
gaaucacaggcugggcug

SEQ ID NO: 3574391 - RNA, 20 nt, Human
gaaucaccuaauuaauuuca

SEQ ID NO: 3574392 - RNA, 23 nt, Human
gaaucaccuaauuaauuucagua

SEQ ID NO: 3574393 - RNA, 18 nt, Human
gaaucacucuuguggaug

SEQ ID NO: 3574394 - RNA, 17 nt, Human
gaaucacuguuuuuaga

SEQ ID NO: 3574395 - RNA, 23 nt, Human
gaaucacuguuuuuagacaccuu

SEQ ID NO: 3574396 - RNA, 13 nt, Human
gaaucagaacuca

SEQ ID NO: 3574397 - RNA, 18 nt, Human
gaaucagacccuacccca

SEQ ID NO: 3574398 - RNA, 23 nt, Human
gaaucagacccuaccccaccacg

SEQ ID NO: 3574399 - RNA, 19 nt, Human
gaaucagacuucacacugc

SEQ ID NO: 3574400 - RNA, 16 nt, Human
gaaucagaguagaaau

SEQ ID NO: 3574401 - RNA, 19 nt, Human
gaaucagaucauuucaaaa

SEQ ID NO: 3574402 - RNA, 23 nt, Human
gaaucaggaauauuuuccaaaga

SEQ ID NO: 3574403 - RNA, 19 nt, Human
gaaucaguauaaacaaagu

SEQ ID NO: 3574404 - RNA, 18 nt, Human
gaaucaguccuagaaugu

SEQ ID NO: 3574405 - RNA, 20 nt, Human
gaaucaguccuagaauguuu

SEQ ID NO: 3574406 - RNA, 19 nt, Human
gaaucaguuuccaauuauu

SEQ ID NO: 3574407 - RNA, 17 nt, Human
gaaucaucaggacccug

SEQ ID NO: 3574408 - RNA, 19 nt, Human
gaaucaugugaacccggga

SEQ ID NO: 3574409 - RNA, 21 nt, Human
gaaucaugugcgucaguccaa

SEQ ID NO: 3574410 - RNA, 13 nt, Human
gaaucauguuucu

SEQ ID NO: 3574411 - RNA, 14 nt, Human
gaaucauguuucuu

SEQ ID NO: 3574412 - RNA, 17 nt, Human
gaaucauguuucuuuga

SEQ ID NO: 3574413 - RNA, 17 nt, Human
gaaucauuauuuauuaa

SEQ ID NO: 3574414 - RNA, 20 nt, Human
gaaucauuguauguggucau

SEQ ID NO: 3574415 - RNA, 19 nt, Human
gaaucauuguccagagcug

SEQ ID NO: 3574416 - RNA, 14 nt, Human
gaauccaagccucc

SEQ ID NO: 3574417 - RNA, 15 nt, Human
gaauccaagccucca

SEQ ID NO: 3574418 - RNA, 16 nt, Human
gaauccaagcucccug

SEQ ID NO: 3574419 - RNA, 16 nt, Human
gaauccacauuucuaa

SEQ ID NO: 3574420 - RNA, 14 nt, Human
gaauccaugcuugg

SEQ ID NO: 3574421 - RNA, 15 nt, Human
gaaucccagccggcc

SEQ ID NO: 3574422 - RNA, 14 nt, Human
gaaucccccuugcc

SEQ ID NO: 3574423 - RNA, 18 nt, Human
gaaucccccuugccaccc

SEQ ID NO: 3574424 - RNA, 14 nt, Human
gaauccgcccaucu

SEQ ID NO: 3574425 - RNA, 20 nt, Human
gaauccuaggcuccacccca

SEQ ID NO: 3574426 - RNA, 22 nt, Human
gaauccuauauagaaugcugca

SEQ ID NO: 3574427 - RNA, 17 nt, Human
gaauccuggcagcccag

SEQ ID NO: 3574428 - RNA, 19 nt, Human
gaauccuuuggugccaacu

SEQ ID NO: 3574429 - RNA, 16 nt, Human
gaaucgaggaaccaga

SEQ ID NO: 3574430 - RNA, 21 nt, Human
gaaucgaugggggaugcuuca

SEQ ID NO: 3574431 - RNA, 22 nt, Human
gaaucgaugggggaugcuucau

SEQ ID NO: 3574432 - RNA, 15 nt, Human
gaaucggaaucucug

SEQ ID NO: 3574433 - RNA, 22 nt, Human
gaaucuacccccagauccaagc

SEQ ID NO: 3574434 - RNA, 15 nt, Human
gaaucuagaagaaau

SEQ ID NO: 3574435 - RNA, 18 nt, Human
gaaucuagaagaaaugaa

SEQ ID NO: 3574436 - RNA, 20 nt, Human
gaaucuagaagaaaugaaau

SEQ ID NO: 3574437 - RNA, 18 nt, Human
gaaucuagccagugaaca

SEQ ID NO: 3574438 - RNA, 12 nt, Human
gaaucuaugcca

SEQ ID NO: 3574439 - RNA, 21 nt, Human
gaaucuauuauacuguauuaa

SEQ ID NO: 3574440 - RNA, 19 nt, Human
gaaucuauuuaucuucauu

SEQ ID NO: 3574441 - RNA, 12 nt, Human
gaaucuauuuuc

SEQ ID NO: 3574442 - RNA, 18 nt, Human
gaaucuauuuucuaugua

SEQ ID NO: 3574443 - RNA, 23 nt, Human
gaaucuauuuucuauguacuagu

SEQ ID NO: 3574444 - RNA, 15 nt, Human
gaaucucaaaauuag

SEQ ID NO: 3574445 - RNA, 17 nt, Human
gaaucucaacaugucuc

SEQ ID NO: 3574446 - RNA, 17 nt, Human
gaaucucccacuccagc

SEQ ID NO: 3574447 - RNA, 18 nt, Human
gaaucucugaauuugaga

SEQ ID NO: 3574448 - RNA, 13 nt, Human
gaaucucugugcc

SEQ ID NO: 3574449 - RNA, 13 nt, Human
gaaucugaaugua

SEQ ID NO: 3574450 - RNA, 23 nt, Human
gaaucugagagaugcuguagaca

SEQ ID NO: 3574451 - RNA, 15 nt, Human
gaaucugcucacuuu

SEQ ID NO: 3574452 - RNA, 19 nt, Human
gaaucugugggucugggag

SEQ ID NO: 3574453 - RNA, 21 nt, Human
gaaucuuaagguguagccaca

SEQ ID NO: 3574454 - RNA, 22 nt, Human
gaaucuuaagguguagccacac

SEQ ID NO: 3574455 - RNA, 20 nt, Human
gaaucuugguuugccuucca

SEQ ID NO: 3574456 - RNA, 23 nt, Human
gaaucuugguuugccuuccagaa

SEQ ID NO: 3574457 - RNA, 13 nt, Human
gaaucuugucuca

SEQ ID NO: 3574458 - RNA, 16 nt, Human
gaaucuuguuuugaaa

SEQ ID NO: 3574459 - RNA, 18 nt, Human
gaaucuuuaauuaaaacc

SEQ ID NO: 3574460 - RNA, 22 nt, Human
gaaucuuuagagaaguauacau

SEQ ID NO: 3574461 - RNA, 17 nt, Human
gaaucuuuauugagaaa

SEQ ID NO: 3574462 - RNA, 14 nt, Human
gaaucuuuguuaag

SEQ ID NO: 3574463 - RNA, 23 nt, Human
gaaucuuuuucagaaacagugag

SEQ ID NO: 3574464 - RNA, 15 nt, Human
gaaugaaaaaacagu

SEQ ID NO: 3574465 - RNA, 13 nt, Human
gaaugaaaaauga

SEQ ID NO: 3574466 - RNA, 21 nt, Human
gaaugaaaaaugaaagaugau

SEQ ID NO: 3574467 - RNA, 22 nt, Human
gaaugaaaaaugaaagaugauu

SEQ ID NO: 3574468 - RNA, 22 nt, Human
gaaugaaaaauuuaagcauugu

SEQ ID NO: 3574469 - RNA, 15 nt, Human
gaaugaaaacucauu

SEQ ID NO: 3574470 - RNA, 20 nt, Human
gaaugaaaagacaagaaaau

SEQ ID NO: 3574471 - RNA, 14 nt, Human
gaaugaaaccccca

SEQ ID NO: 3574472 - RNA, 20 nt, Human
gaaugaaacccccacacaca

SEQ ID NO: 3574473 - RNA, 21 nt, Human
gaaugaaacccccacacacac

SEQ ID NO: 3574474 - RNA, 22 nt, Human
gaaugaaagaguaaaggaaaug

SEQ ID NO: 3574475 - RNA, 14 nt, Human
gaaugaaagcuccu

SEQ ID NO: 3574476 - RNA, 15 nt, Human
gaaugaaauacuguu

SEQ ID NO: 3574477 - RNA, 16 nt, Human
gaaugaacaaagacca

SEQ ID NO: 3574478 - RNA, 13 nt, Human
gaaugaacaaauu

SEQ ID NO: 3574479 - RNA, 13 nt, Human
gaaugaacaaccu

SEQ ID NO: 3574480 - RNA, 21 nt, Human
gaaugaagauacugaaauaaa

SEQ ID NO: 3574481 - RNA, 16 nt, Human
gaaugaagcaguauuu

SEQ ID NO: 3574482 - RNA, 16 nt, Human
gaaugaagcuugugua

SEQ ID NO: 3574483 - RNA, 14 nt, Human
gaaugaagguuuuu

SEQ ID NO: 3574484 - RNA, 21 nt, Human
gaaugaagguuuuuguaaaga

SEQ ID NO: 3574485 - RNA, 14 nt, Human
gaaugaauggcuaa

SEQ ID NO: 3574486 - RNA, 14 nt, Human
gaaugaaugucagu

SEQ ID NO: 3574487 - RNA, 16 nt, Human
gaaugacaacagaagc

SEQ ID NO: 3574488 - RNA, 12 nt, Human
gaaugacacugu

SEQ ID NO: 3574489 - RNA, 18 nt, Human
gaaugaccuuguaaugua

SEQ ID NO: 3574490 - RNA, 19 nt, Human
gaaugaccuuguaauguaa

SEQ ID NO: 3574491 - RNA, 20 nt, Human
gaaugacuuccccaauaucu

SEQ ID NO: 3574492 - RNA, 23 nt, Human
gaaugagagacacacugaagaag

SEQ ID NO: 3574493 - RNA, 20 nt, Human
gaaugagauuaauuccuuuc

SEQ ID NO: 3574494 - RNA, 20 nt, Human
gaaugagccuacgcugaaga

SEQ ID NO: 3574495 - RNA, 22 nt, Human
gaaugagccuacgcugaagaug

SEQ ID NO: 3574496 - RNA, 14 nt, Human
gaaugaggaaaauu

SEQ ID NO: 3574497 - RNA, 13 nt, Human
gaaugaggaggaa

SEQ ID NO: 3574498 - RNA, 14 nt, Human
gaaugaggaggaag

SEQ ID NO: 3574499 - RNA, 14 nt, Human
gaaugaggcuugcu

SEQ ID NO: 3574500 - RNA, 19 nt, Human
gaaugaggguuugagagag

SEQ ID NO: 3574501 - RNA, 17 nt, Human
gaaugaggucccaggca

SEQ ID NO: 3574502 - RNA, 15 nt, Human
gaaugaggucugggc

SEQ ID NO: 3574503 - RNA, 15 nt, Human
gaaugauaugcauuu

SEQ ID NO: 3574504 - RNA, 16 nt, Human
gaaugaucucuucuuu

SEQ ID NO: 3574505 - RNA, 17 nt, Human
gaaugaucucuucuuuu

SEQ ID NO: 3574506 - RNA, 16 nt, Human
gaaugaucugauugac

SEQ ID NO: 3574507 - RNA, 18 nt, Human
gacuccaggcccaaggcu

SEQ ID NO: 3574508 - RNA, 19 nt, Human
gacuccaggcccaaggcuc

SEQ ID NO: 3574509 - RNA, 21 nt, Human
gacuccaucucucauccucca

SEQ ID NO: 3574510 - RNA, 17 nt, Human
gacucccaaagagcugc

SEQ ID NO: 3574511 - RNA, 18 nt, Human
gacucccaaagagcugcc

SEQ ID NO: 3574512 - RNA, 19 nt, Human
gacucccaaagagcugccu

SEQ ID NO: 3574513 - RNA, 22 nt, Human
gacucccaaguuuccauagcaa

SEQ ID NO: 3574514 - RNA, 15 nt, Human
gacucccaugaagcc

SEQ ID NO: 3574515 - RNA, 16 nt, Human
gacuccccaggccagg

SEQ ID NO: 3574516 - RNA, 18 nt, Human
gacuccccaggccaggcc

SEQ ID NO: 3574517 - RNA, 19 nt, Human
gacucccuccucaccucug

SEQ ID NO: 3574518 - RNA, 23 nt, Human
gacucccuccucaccucuggacu

SEQ ID NO: 3574519 - RNA, 15 nt, Human
gacuccgcuggaggu

SEQ ID NO: 3574520 - RNA, 15 nt, Human
gacuccggcugugcu

SEQ ID NO: 3574521 - RNA, 16 nt, Human
gacuccggcugugcug

SEQ ID NO: 3574522 - RNA, 21 nt, Human
gacuccggcugugcugggaga

SEQ ID NO: 3574523 - RNA, 23 nt, Human
gacuccggguuugagauggacac

SEQ ID NO: 3574524 - RNA, 16 nt, Human
gacuccguuggccacu

SEQ ID NO: 3574525 - RNA, 16 nt, Human
gacuccuaccugcccu

SEQ ID NO: 3574526 - RNA, 14 nt, Human
gacuccuagcuguc

SEQ ID NO: 3574527 - RNA, 13 nt, Human
gacuccuccccac

SEQ ID NO: 3574528 - RNA, 17 nt, Human
gacuccucggccuggcu

SEQ ID NO: 3574529 - RNA, 14 nt, Human
gacuccugcaggca

SEQ ID NO: 3574530 - RNA, 22 nt, Human
gacuccuggucugaaaauguug

SEQ ID NO: 3574531 - RNA, 22 nt, Human
gacuccuguggagaugacuugg

SEQ ID NO: 3574532 - RNA, 19 nt, Human
gacucggggugcuuccuug

SEQ ID NO: 3574533 - RNA, 15 nt, Human
gacucuaaagaccaa

SEQ ID NO: 3574534 - RNA, 15 nt, Human
gacucuaaagucugu

SEQ ID NO: 3574535 - RNA, 23 nt, Human
gacucuaaauucuuuauuucugu

SEQ ID NO: 3574536 - RNA, 16 nt, Human
gacucuacacugugaa

SEQ ID NO: 3574537 - RNA, 21 nt, Human
gacucuacagaggccaugggc

SEQ ID NO: 3574538 - RNA, 16 nt, Human
gacucuagaguccaag

SEQ ID NO: 3574539 - RNA, 18 nt, Human
gacucuaguacugugaau

SEQ ID NO: 3574540 - RNA, 14 nt, Human
gacucuaguauuua

SEQ ID NO: 3574541 - RNA, 14 nt, Human
gacucucaaaucuu

SEQ ID NO: 3574542 - RNA, 14 nt, Human
gacucucagucucu

SEQ ID NO: 3574543 - RNA, 18 nt, Human
gacucucagucucugagc

SEQ ID NO: 3574544 - RNA, 20 nt, Human
gacucucagucucugagcag

SEQ ID NO: 3574545 - RNA, 14 nt, Human
gacucucugugacc

SEQ ID NO: 3574546 - RNA, 14 nt, Human
gacucugaaaucug

SEQ ID NO: 3574547 - RNA, 18 nt, Human
gacucugaaaucugaaga

SEQ ID NO: 3574548 - RNA, 18 nt, Human
gacucugaagccucuggg

SEQ ID NO: 3574549 - RNA, 23 nt, Human
gacucugaccucuuggccacaga

SEQ ID NO: 3574550 - RNA, 19 nt, Human
gacucugaggcucuuucug

SEQ ID NO: 3574551 - RNA, 20 nt, Human
gacucugcacaugucuugua

SEQ ID NO: 3574552 - RNA, 18 nt, Human
gacucugcagccucagag

SEQ ID NO: 3574553 - RNA, 22 nt, Human
gacucugcaucccagcaccugc

SEQ ID NO: 3574554 - RNA, 18 nt, Human
gacucugcccccugcugg

SEQ ID NO: 3574555 - RNA, 19 nt, Human
gacucugcccccugcuggc

SEQ ID NO: 3574556 - RNA, 21 nt, Human
gacucugcccccugcuggcuc

SEQ ID NO: 3574557 - RNA, 20 nt, Human
gacucuggacuuucucuaau

SEQ ID NO: 3574558 - RNA, 13 nt, Human
gacucuggcccug

SEQ ID NO: 3574559 - RNA, 16 nt, Human
gacucuggcuuggccu

SEQ ID NO: 3574560 - RNA, 17 nt, Human
gacucuggcuuggccua

SEQ ID NO: 3574561 - RNA, 21 nt, Human
gacucugggcuauggacacag

SEQ ID NO: 3574562 - RNA, 22 nt, Human
gacucugggcuauggacacagg

SEQ ID NO: 3574563 - RNA, 13 nt, Human
gacucuggguccu

SEQ ID NO: 3574564 - RNA, 14 nt, Human
gacucuggguccuu

SEQ ID NO: 3574565 - RNA, 19 nt, Human
gacucuggguccuuccuga

SEQ ID NO: 3574566 - RNA, 18 nt, Human
gacucuggugccuccaga

SEQ ID NO: 3574567 - RNA, 24 nt, Human
gacucuguccugaaggccugaggu

SEQ ID NO: 3574568 - RNA, 19 nt, Human
gacucugucuaccuggucu

SEQ ID NO: 3574569 - RNA, 19 nt, Human
gacucugucucaaaaaaac

SEQ ID NO: 3574570 - RNA, 17 nt, Human
gacucugugcuggccag

SEQ ID NO: 3574571 - RNA, 17 nt, Human
gacucuguggggccuug

SEQ ID NO: 3574572 - RNA, 18 nt, Human
gacucuguggggccuugg

SEQ ID NO: 3574573 - RNA, 18 nt, Human
gacucuuaagaagacugc

SEQ ID NO: 3574574 - RNA, 16 nt, Human
gacucuugaguuguuu

SEQ ID NO: 3574575 - RNA, 12 nt, Human
gacucuugcucu

SEQ ID NO: 3574576 - RNA, 16 nt, Human
gacucuuucugagugc

SEQ ID NO: 3574577 - RNA, 18 nt, Human
gacucuuugguggcuuug

SEQ ID NO: 3574578 - RNA, 20 nt, Human
gacucuuugguggcuuugca

SEQ ID NO: 3574579 - RNA, 17 nt, Human
gacucuuuuccuucccu

SEQ ID NO: 3574580 - RNA, 20 nt, Human
gacucuuuuuagggccaggc

SEQ ID NO: 3574581 - RNA, 21 nt, Human
gacucuuuuuguaccugguga

SEQ ID NO: 3574582 - RNA, 18 nt, Human
gacugaaaaccucuccuc

SEQ ID NO: 3574583 - RNA, 20 nt, Human
gacugaaaauauauaagcuc

SEQ ID NO: 3574584 - RNA, 18 nt, Human
gacugaauuguccccagu

SEQ ID NO: 3574585 - RNA, 16 nt, Human
gacugaauuucuuuug

SEQ ID NO: 3574586 - RNA, 21 nt, Human
gacugacaguuuacagacgcu

SEQ ID NO: 3574587 - RNA, 22 nt, Human
gacugaccaauauuguacaguu

SEQ ID NO: 3574588 - RNA, 19 nt, Human
gacugaccuugaugagcug

SEQ ID NO: 3574589 - RNA, 14 nt, Human
gacugacugaggca

SEQ ID NO: 3574590 - RNA, 14 nt, Human
gacugagccagucc

SEQ ID NO: 3574591 - RNA, 23 nt, Human
gacugagccuggcccauagaaac

SEQ ID NO: 3574592 - RNA, 13 nt, Human
gacugaggccuga

SEQ ID NO: 3574593 - RNA, 14 nt, Human
gacugaggccugag

SEQ ID NO: 3574594 - RNA, 19 nt, Human
gacugaguaagaaaugcug

SEQ ID NO: 3574595 - RNA, 21 nt, Human
gacugaguacguugugcauuu

SEQ ID NO: 3574596 - RNA, 22 nt, Human
gacugaguccucguagccaucu

SEQ ID NO: 3574597 - RNA, 13 nt, Human
gacugagucuccc

SEQ ID NO: 3574598 - RNA, 15 nt, Human
gacugagugggaagc

SEQ ID NO: 3574599 - RNA, 14 nt, Human
gacugaugucuccu

SEQ ID NO: 3574600 - RNA, 16 nt, Human
gacugaugucuccuaa

SEQ ID NO: 3574601 - RNA, 18 nt, Human
gacugaugucuccuaagc

SEQ ID NO: 3574602 - RNA, 23 nt, Human
gacugauguuaggcugggcccag

SEQ ID NO: 3574603 - RNA, 16 nt, Human
gacugcacccaggagg

SEQ ID NO: 3574604 - RNA, 21 nt, Human
gacugcauguaccauuugcau

SEQ ID NO: 3574605 - RNA, 13 nt, Human
gacugccaagcca

SEQ ID NO: 3574606 - RNA, 17 nt, Human
gacugccauauuaaauu

SEQ ID NO: 3574607 - RNA, 18 nt, Human
gacugccccaacuccugg

SEQ ID NO: 3574608 - RNA, 19 nt, Human
gacugccccgugcagacug

SEQ ID NO: 3574609 - RNA, 20 nt, Human
gacugccccgugcagacugg

SEQ ID NO: 3574610 - RNA, 22 nt, Human
gacugcgggaugguccuggggc

SEQ ID NO: 3574611 - RNA, 15 nt, Human
gacugcguucugcaa

SEQ ID NO: 3574612 - RNA, 16 nt, Human
gacugcguucugcaag

SEQ ID NO: 3574613 - RNA, 16 nt, Human
gacugcuaguguucug

SEQ ID NO: 3574614 - RNA, 17 nt, Human
gacugcuaguguucugu

SEQ ID NO: 3574615 - RNA, 19 nt, Human
gacugcuccccagcccugg

SEQ ID NO: 3574616 - RNA, 20 nt, Human
gacugcuccccagcccuggc

SEQ ID NO: 3574617 - RNA, 16 nt, Human
gacugcuccugagccc

SEQ ID NO: 3574618 - RNA, 17 nt, Human
gacugcuccugagcccc

SEQ ID NO: 3574619 - RNA, 14 nt, Human
gacugcugcugccu

SEQ ID NO: 3574620 - RNA, 19 nt, Human
gacugcugcugccuggcca

SEQ ID NO: 3574621 - RNA, 21 nt, Human
gacugcugcugccuggccacu

SEQ ID NO: 3574622 - RNA, 12 nt, Human
gacugcugggac

SEQ ID NO: 3574623 - RNA, 19 nt, Human
gacugcugggacuggccag

SEQ ID NO: 3574624 - RNA, 19 nt, Human
gacugcuguggccaggagg

SEQ ID NO: 3574625 - RNA, 18 nt, Human
gacugcuugcccuaagca

SEQ ID NO: 3574626 - RNA, 22 nt, Human
gacugcuugcccuaagcagaaa

SEQ ID NO: 3574627 - RNA, 23 nt, Human
gacugcuugcccuaagcagaaag

SEQ ID NO: 3574628 - RNA, 21 nt, Human
gacugcuuuggaccuaaaugg

SEQ ID NO: 3574629 - RNA, 15 nt, Human
gacuggaaccaggga

SEQ ID NO: 3574630 - RNA, 15 nt, Human
gacuggaagcacagc

SEQ ID NO: 3574631 - RNA, 18 nt, Human
gacuggaagcacagcuuc

SEQ ID NO: 3574632 - RNA, 22 nt, Human
gacuggaauuuuuauuaugcau

SEQ ID NO: 3574633 - RNA, 17 nt, Human
gacuggaccugguggcu

SEQ ID NO: 3574634 - RNA, 23 nt, Human
gacuggagacaaugcagaugcca

SEQ ID NO: 3574635 - RNA, 14 nt, Human
gacuggagcaucug

SEQ ID NO: 3574636 - RNA, 22 nt, Human
gacuggaggccccuggagccag

SEQ ID NO: 3574637 - RNA, 22 nt, Human
gacuggauacugcccggggcag

SEQ ID NO: 3574638 - RNA, 14 nt, Human
gacuggcacaguuu

SEQ ID NO: 3574639 - RNA, 23 nt, Human
gacuggcauacuauguggaugug

SEQ ID NO: 3574640 - RNA, 22 nt, Human
gacuggccccugggucagucug

SEQ ID NO: 3574641 - RNA, 21 nt, Human
gacuggcuagaguccucacuc

SEQ ID NO: 3574642 - RNA, 23 nt, Human
gacuggcuagaguccucacuccc

SEQ ID NO: 3574643 - RNA, 21 nt, Human
gacuggcuuugucccacagcu

SEQ ID NO: 3574644 - RNA, 23 nt, Human
gacugggaagauaggcucugcac

SEQ ID NO: 3574645 - RNA, 22 nt, Human
gacugggagcccccagccuguc

SEQ ID NO: 3574646 - RNA, 23 nt, Human
gacugggagccgcagcagcuccc

SEQ ID NO: 3574647 - RNA, 15 nt, Human
gacugggagggccca

SEQ ID NO: 3574648 - RNA, 13 nt, Human
gacugggagguag

SEQ ID NO: 3574649 - RNA, 15 nt, Human
gacugggcugaggga

SEQ ID NO: 3574650 - RNA, 21 nt, Human
gacuuugcugauuuccccucu

SEQ ID NO: 3574651 - RNA, 15 nt, Human
gacuuugcuucccau

SEQ ID NO: 3574652 - RNA, 12 nt, Human
gacuuugcuugc

SEQ ID NO: 3574653 - RNA, 15 nt, Human
gacuuugcuugcuuu

SEQ ID NO: 3574654 - RNA, 17 nt, Human
gacuuugcuugcuuuga

SEQ ID NO: 3574655 - RNA, 15 nt, Human
gacuuuggaagcagg

SEQ ID NO: 3574656 - RNA, 18 nt, Human
gacuuugggauaggaaaa

SEQ ID NO: 3574657 - RNA, 15 nt, Human
gacuuuguagauccu

SEQ ID NO: 3574658 - RNA, 16 nt, Human
gacuuuguauacuuua

SEQ ID NO: 3574659 - RNA, 18 nt, Human
gacuuuguauacuuuaaa

SEQ ID NO: 3574660 - RNA, 12 nt, Human
gacuuuguuaca

SEQ ID NO: 3574661 - RNA, 22 nt, Human
gacuuuguuaguuucuccaagc

SEQ ID NO: 3574662 - RNA, 18 nt, Human
gacuuuuauuuccaguga

SEQ ID NO: 3574663 - RNA, 19 nt, Human
gacuuuucgaccaauucaa

SEQ ID NO: 3574664 - RNA, 13 nt, Human
gacuuuucuguaa

SEQ ID NO: 3574665 - RNA, 22 nt, Human
gacuuuucuuaacaaccuggcc

SEQ ID NO: 3574666 - RNA, 13 nt, Human
gacuuuugcuuua

SEQ ID NO: 3574667 - RNA, 17 nt, Human
gacuuuugcuuuaauuc

SEQ ID NO: 3574668 - RNA, 21 nt, Human
gacuuuuugguggauguaaau

SEQ ID NO: 3574669 - RNA, 13 nt, Human
gacuuuuuuugua

SEQ ID NO: 3574670 - RNA, 17 nt, Human
gacuuuuuuuguaugug

SEQ ID NO: 3574671 - RNA, 13 nt, Human
gagaaaaaaacaa

SEQ ID NO: 3574672 - RNA, 10 nt, Human
gagaaaaaga

SEQ ID NO: 3574673 - RNA, 15 nt, Human
gagaaaaagaaaugc

SEQ ID NO: 3574674 - RNA, 17 nt, Human
gagaaaaagcuccuguc

SEQ ID NO: 3574675 - RNA, 20 nt, Human
gagaaaacaucucaucaugu

SEQ ID NO: 3574676 - RNA, 12 nt, Human
gagaaaagaaaa

SEQ ID NO: 3574677 - RNA, 19 nt, Human
gagaaaaggaaaagaaaaa

SEQ ID NO: 3574678 - RNA, 17 nt, Human
gagaaaauaaaaaguua

SEQ ID NO: 3574679 - RNA, 11 nt, Human
gagaaaauaua

SEQ ID NO: 3574680 - RNA, 18 nt, Human
gagaaaauauauguauuu

SEQ ID NO: 3574681 - RNA, 19 nt, Human
gagaaaauauauguauuuu

SEQ ID NO: 3574682 - RNA, 15 nt, Human
gagaaaaucaucaag

SEQ ID NO: 3574683 - RNA, 12 nt, Human
gagaaaauugaa

SEQ ID NO: 3574684 - RNA, 13 nt, Human
gagaaaauugaaa

SEQ ID NO: 3574685 - RNA, 14 nt, Human
gagaaaauugaauu

SEQ ID NO: 3574686 - RNA, 19 nt, Human
gagaaaauugaauuuaaca

SEQ ID NO: 3574687 - RNA, 15 nt, Human
gagaaacaaacuuuu

SEQ ID NO: 3574688 - RNA, 14 nt, Human
gagaaacacuugaa

SEQ ID NO: 3574689 - RNA, 18 nt, Human
gagaaacaguugguaacu

SEQ ID NO: 3574690 - RNA, 19 nt, Human
gagaaacaguugguaacuu

SEQ ID NO: 3574691 - RNA, 13 nt, Human
gagaaaccagcuu

SEQ ID NO: 3574692 - RNA, 21 nt, Human
gagaaaccagcuuccuucaga

SEQ ID NO: 3574693 - RNA, 16 nt, Human
gagaaaccuguaucuu

SEQ ID NO: 3574694 - RNA, 21 nt, Human
gagaaaccuguaucuuucuau

SEQ ID NO: 3574695 - RNA, 21 nt, Human
gagaaaccuuauuguaccucu

SEQ ID NO: 3574696 - RNA, 18 nt, Human
gagaaacuggcaaagcag

SEQ ID NO: 3574697 - RNA, 11 nt, Human
gagaaacuucc

SEQ ID NO: 3574698 - RNA, 15 nt, Human
gagaaacuuuauaca

SEQ ID NO: 3574699 - RNA, 17 nt, Human
gagaaacuuuauacauu

SEQ ID NO: 3574700 - RNA, 13 nt, Human
gagaaagaagaga

SEQ ID NO: 3574701 - RNA, 13 nt, Human
gagaaagacuauu

SEQ ID NO: 3574702 - RNA, 15 nt, Human
gagaaagacuauuca

SEQ ID NO: 3574703 - RNA, 15 nt, Human
gagaaagccaggcag

SEQ ID NO: 3574704 - RNA, 15 nt, Human
gagaaagcugacuug

SEQ ID NO: 3574705 - RNA, 19 nt, Human
gagaaaggccugcacacaa

SEQ ID NO: 3574706 - RNA, 16 nt, Human
gagaaagguugaagca

SEQ ID NO: 3574707 - RNA, 20 nt, Human
gagaaagugauuucuagaaa

SEQ ID NO: 3574708 - RNA, 18 nt, Human
gagaaagugugagcaaac

SEQ ID NO: 3574709 - RNA, 14 nt, Human
gagaaauacaaaaa

SEQ ID NO: 3574710 - RNA, 14 nt, Human
gagaaauauuuuaa

SEQ ID NO: 3574711 - RNA, 11 nt, Human
gagaaaugaaa

SEQ ID NO: 3574712 - RNA, 13 nt, Human
gagaaaugaaaac

SEQ ID NO: 3574713 - RNA, 14 nt, Human
gagaaaugagcuug

SEQ ID NO: 3574714 - RNA, 12 nt, Human
gagaaaugcaua

SEQ ID NO: 3574715 - RNA, 23 nt, Human
gagaaauguaaugcgauuuuauu

SEQ ID NO: 3574716 - RNA, 23 nt, Human
gagaaauuucugugaaaccugug

SEQ ID NO: 3574717 - RNA, 15 nt, Human
gagaacaaagcuguu

SEQ ID NO: 3574718 - RNA, 17 nt, Human
gagaacagauaaagauu

SEQ ID NO: 3574719 - RNA, 16 nt, Human
gagaacccaguuuccc

SEQ ID NO: 3574720 - RNA, 19 nt, Human
gagaaccuaacuguaucuu

SEQ ID NO: 3574721 - RNA, 12 nt, Human
gagaaccuggcc

SEQ ID NO: 3574722 - RNA, 15 nt, Human
gagaaccuggccuuc

SEQ ID NO: 3574723 - RNA, 23 nt, Human
gagaaccuggguugcagacagga

SEQ ID NO: 3574724 - RNA, 15 nt, Human
gagaacgcagcccua

SEQ ID NO: 3574725 - RNA, 22 nt, Human
gagaacuagugguggcucugag

SEQ ID NO: 3574726 - RNA, 13 nt, Human
gagaacuccugac

SEQ ID NO: 3574727 - RNA, 11 nt, Human
gagaacugaaa

SEQ ID NO: 3574728 - RNA, 16 nt, Human
gagaacugaaaagaga

SEQ ID NO: 3574729 - RNA, 18 nt, Human
gagaacugcauauguuuc

SEQ ID NO: 3574730 - RNA, 15 nt, Human
gagaacuguggccgu

SEQ ID NO: 3574731 - RNA, 21 nt, Human
gagaacuuaaguggcuaaaga

SEQ ID NO: 3574732 - RNA, 23 nt, Human
gagaacuuccagauccuggaaau

SEQ ID NO: 3574733 - RNA, 16 nt, Human
gagaacuugcugccuc

SEQ ID NO: 3574734 - RNA, 15 nt, Human
gagaacuuucauuuu

SEQ ID NO: 3574735 - RNA, 13 nt, Human
gagaagaacugaa

SEQ ID NO: 3574736 - RNA, 14 nt, Human
gagaagaacugaaa

SEQ ID NO: 3574737 - RNA, 9 nt, Human
gagaagaag

SEQ ID NO: 3574738 - RNA, 20 nt, Human
gagaagaauuuucagacccc

SEQ ID NO: 3574739 - RNA, 11 nt, Human
gagaagagccc

SEQ ID NO: 3574740 - RNA, 15 nt, Human
gagaagagggccugu

SEQ ID NO: 3574741 - RNA, 22 nt, Human
gagaagauaauuguugaaauuu

SEQ ID NO: 3574742 - RNA, 22 nt, Human
gagaagcaaguaaaaaggcuaa

SEQ ID NO: 3574743 - RNA, 18 nt, Human
gagaagcauucucauugg

SEQ ID NO: 3574744 - RNA, 17 nt, Human
gagaagccacaggccug

SEQ ID NO: 3574745 - RNA, 18 nt, Human
gagaagccacaggccuga

SEQ ID NO: 3574746 - RNA, 22 nt, Human
gagaagccacaggccugagauu

SEQ ID NO: 3574747 - RNA, 22 nt, Human
gagaagccagcuuuccucauca

SEQ ID NO: 3574748 - RNA, 22 nt, Human
gagaagccaucaccucagaugg

SEQ ID NO: 3574749 - RNA, 11 nt, Human
gagaagccauu

SEQ ID NO: 3574750 - RNA, 15 nt, Human
gagaagcccguguga

SEQ ID NO: 3574751 - RNA, 16 nt, Human
gagaagcccgugugag

SEQ ID NO: 3574752 - RNA, 13 nt, Human
gagaagccuucaa

SEQ ID NO: 3574753 - RNA, 21 nt, Human
gagaagccuucaagcucugag

SEQ ID NO: 3574754 - RNA, 18 nt, Human
gagaagccuucagcucca

SEQ ID NO: 3574755 - RNA, 13 nt, Human
gagaagcggcugg

SEQ ID NO: 3574756 - RNA, 17 nt, Human
gagaagcucagcugcau

SEQ ID NO: 3574757 - RNA, 17 nt, Human
gagaagcucccaggaac

SEQ ID NO: 3574758 - RNA, 19 nt, Human
gagaagcugcuccaggccu

SEQ ID NO: 3574759 - RNA, 17 nt, Human
gagaagcuuugcccucc

SEQ ID NO: 3574760 - RNA, 21 nt, Human
gagaagcuuuugaauaaaaac

SEQ ID NO: 3574761 - RNA, 20 nt, Human
gagaaggacccggaggggcc

SEQ ID NO: 3574762 - RNA, 22 nt, Human
gagaaggacccggaggggccug

SEQ ID NO: 3574763 - RNA, 12 nt, Human
gagaaggagaga

SEQ ID NO: 3574764 - RNA, 14 nt, Human
gagaaggagagaaa

SEQ ID NO: 3574765 - RNA, 11 nt, Human
gagaaggagcc

SEQ ID NO: 3574766 - RNA, 17 nt, Human
gagaaggggaagcacuc

SEQ ID NO: 3574767 - RNA, 19 nt, Human
gagaagggggucaaagcaa

SEQ ID NO: 3574768 - RNA, 16 nt, Human
gagaaggggugugcau

SEQ ID NO: 3574769 - RNA, 13 nt, Human
gagaagguuuauu

SEQ ID NO: 3574770 - RNA, 16 nt, Human
gagaagguuuauuguu

SEQ ID NO: 3574771 - RNA, 17 nt, Human
gagaagguuuauuguua

SEQ ID NO: 3574772 - RNA, 15 nt, Human
gagaagucacagggc

SEQ ID NO: 3574773 - RNA, 13 nt, Human
gagaagucucagc

SEQ ID NO: 3574774 - RNA, 18 nt, Human
gagaagucuuucaagaau

SEQ ID NO: 3574775 - RNA, 17 nt, Human
gagaagugugccuucuc

SEQ ID NO: 3574776 - RNA, 16 nt, Human
gagaaguuguaaagua

SEQ ID NO: 3574777 - RNA, 21 nt, Human
gagaaguuucuggcccuggcu

SEQ ID NO: 3574778 - RNA, 18 nt, Human
gagaauaggcagccccca

SEQ ID NO: 3574779 - RNA, 19 nt, Human
gagaauauuuuaaguauug

SEQ ID NO: 3574780 - RNA, 14 nt, Human
gagaaucacaggcu

SEQ ID NO: 3574781 - RNA, 21 nt, Human
gagaaucauacuuagcaaagu

SEQ ID NO: 3574782 - RNA, 14 nt, Human
gagaaucaucagga

SEQ ID NO: 3574783 - RNA, 15 nt, Human
gagaaucauguuucu

SEQ ID NO: 3574784 - RNA, 20 nt, Human
gagaaucauguuucuuugau

SEQ ID NO: 3574785 - RNA, 21 nt, Human
gagaaucuacccccagaucca

SEQ ID NO: 3574786 - RNA, 22 nt, Human
gagaaucuauauuuaacaagau

SEQ ID NO: 3574787 - RNA, 17 nt, Human
gagaaucucaacauguc

SEQ ID NO: 3574788 - RNA, 19 nt, Human
gagaaucuuuauugagaaa

SEQ ID NO: 3574789 - RNA, 23 nt, Human
gagaaugaaagggcccagagagg

SEQ ID NO: 3574790 - RNA, 13 nt, Human
gagaaugaacaaa

SEQ ID NO: 3574791 - RNA, 17 nt, Human
gagaaugagggccaaga

SEQ ID NO: 3574792 - RNA, 22 nt, Human
gagaauggaaaccacaacuuuu

SEQ ID NO: 3574793 - RNA, 23 nt, Human
gagaauggcccaguccucuccca

SEQ ID NO: 3574794 - RNA, 21 nt, Human
gagaauggugugaacccggga

SEQ ID NO: 3574795 - RNA, 16 nt, Human
gagaauguaagaacua

SEQ ID NO: 3574796 - RNA, 20 nt, Human
gagagacuuguuuuggaugc

SEQ ID NO: 3574797 - RNA, 12 nt, Human
gagagagaaagc

SEQ ID NO: 3574798 - RNA, 10 nt, Human
gagagagaga

SEQ ID NO: 3574799 - RNA, 15 nt, Human
gagagagagagagaa

SEQ ID NO: 3574800 - RNA, 14 nt, Human
gagagagagagagg

SEQ ID NO: 3574801 - RNA, 14 nt, Human
gagagagagaggac

SEQ ID NO: 3574802 - RNA, 13 nt, Human
gagagagagaggu

SEQ ID NO: 3574803 - RNA, 12 nt, Human
gagagagaggac

SEQ ID NO: 3574804 - RNA, 18 nt, Human
gagagaggcaauggcucc

SEQ ID NO: 3574805 - RNA, 13 nt, Human
gagagaggcagag

SEQ ID NO: 3574806 - RNA, 13 nt, Human
gagagaggccauu

SEQ ID NO: 3574807 - RNA, 16 nt, Human
gagagaguugaaccua

SEQ ID NO: 3574808 - RNA, 21 nt, Human
gagagaguuguuuuaauaacu

SEQ ID NO: 3574809 - RNA, 14 nt, Human
gagagauacucugg

SEQ ID NO: 3574810 - RNA, 14 nt, Human
gagagaucaaagau

SEQ ID NO: 3574811 - RNA, 16 nt, Human
gagagaucugcuguca

SEQ ID NO: 3574812 - RNA, 13 nt, Human
gagagaugugugu

SEQ ID NO: 3574813 - RNA, 15 nt, Human
gagagauucugugau

SEQ ID NO: 3574814 - RNA, 20 nt, Human
gagagcaacucugagaucua

SEQ ID NO: 3574815 - RNA, 17 nt, Human
gagagcagagaauauaa

SEQ ID NO: 3574816 - RNA, 21 nt, Human
gagagcagcuuuaaacucagg

SEQ ID NO: 3574817 - RNA, 23 nt, Human
gagagcagcuuuaaacucaggga

SEQ ID NO: 3574818 - RNA, 13 nt, Human
gagagcaggcugg

SEQ ID NO: 3574819 - RNA, 21 nt, Human
gagagcaggcuggcagcucuc

SEQ ID NO: 3574820 - RNA, 13 nt, Human
gagagcagugcuu

SEQ ID NO: 3574821 - RNA, 16 nt, Human
gagagcauaauuuaaa

SEQ ID NO: 3574822 - RNA, 18 nt, Human
gagagcaucggccuaggg

SEQ ID NO: 3574823 - RNA, 15 nt, Human
gagagccagagaagu

SEQ ID NO: 3574824 - RNA, 17 nt, Human
gagagccauuuugugaa

SEQ ID NO: 3574825 - RNA, 10 nt, Human
gagagcccag

SEQ ID NO: 3574826 - RNA, 14 nt, Human
gagagccccagcug

SEQ ID NO: 3574827 - RNA, 17 nt, Human
gagagccccuggggccu

SEQ ID NO: 3574828 - RNA, 15 nt, Human
gagagcccgggagcu

SEQ ID NO: 3574829 - RNA, 18 nt, Human
gagagcccuagaaagcug

SEQ ID NO: 3574830 - RNA, 13 nt, Human
gagagcccuggga

SEQ ID NO: 3574831 - RNA, 17 nt, Human
gagagccguggucccug

SEQ ID NO: 3574832 - RNA, 17 nt, Human
gagagccugcuccccca

SEQ ID NO: 3574833 - RNA, 14 nt, Human
gagagccugcugca

SEQ ID NO: 3574834 - RNA, 13 nt, Human
gagagccugcugg

SEQ ID NO: 3574835 - RNA, 13 nt, Human
gagagccuggugc

SEQ ID NO: 3574836 - RNA, 20 nt, Human
gagagcuagaacccggcagg

SEQ ID NO: 3574837 - RNA, 13 nt, Human
gagagcuaggagc

SEQ ID NO: 3574838 - RNA, 19 nt, Human
gagagcuaggagcaaagcc

SEQ ID NO: 3574839 - RNA, 16 nt, Human
gagagcuggagccugg

SEQ ID NO: 3574840 - RNA, 21 nt, Human
gagagcuggagccuggugccc

SEQ ID NO: 3574841 - RNA, 13 nt, Human
gagagcuggugcc

SEQ ID NO: 3574842 - RNA, 17 nt, Human
gagagcuggugcccgga

SEQ ID NO: 3574843 - RNA, 15 nt, Human
gagaggacagcuuga

SEQ ID NO: 3574844 - RNA, 18 nt, Human
gagaggacagcuugagcc

SEQ ID NO: 3574845 - RNA, 15 nt, Human
gagaggagaaacaca

SEQ ID NO: 3574846 - RNA, 17 nt, Human
gagaggagacggagggg

SEQ ID NO: 3574847 - RNA, 12 nt, Human
gagaggagagag

SEQ ID NO: 3574848 - RNA, 16 nt, Human
gagaggagagccagag

SEQ ID NO: 3574849 - RNA, 13 nt, Human
gagaggagccaga

SEQ ID NO: 3574850 - RNA, 19 nt, Human
gagaggagccagacagacc

SEQ ID NO: 3574851 - RNA, 17 nt, Human
gagaggaggcagcagga

SEQ ID NO: 3574852 - RNA, 12 nt, Human
gagaggaugaau

SEQ ID NO: 3574853 - RNA, 14 nt, Human
gagaggaugaaugu

SEQ ID NO: 3574854 - RNA, 14 nt, Human
gagaggaugagagc

SEQ ID NO: 3574855 - RNA, 18 nt, Human
gagaggaugagagcccag

SEQ ID NO: 3574856 - RNA, 19 nt, Human
gagaggaugagagcccaga

SEQ ID NO: 3574857 - RNA, 14 nt, Human
gagaggaugugcaa

SEQ ID NO: 3574858 - RNA, 17 nt, Human
gagaggccaaaggcugg

SEQ ID NO: 3574859 - RNA, 14 nt, Human
gagaggccaggugc

SEQ ID NO: 3574860 - RNA, 23 nt, Human
gagaggcccucuggaguggccac

SEQ ID NO: 3574861 - RNA, 24 nt, Human
gagaggcccuggaucagcguggcc

SEQ ID NO: 3574862 - RNA, 13 nt, Human
gagaggccgggac

SEQ ID NO: 3574863 - RNA, 15 nt, Human
gagaggccuuuugga

SEQ ID NO: 3574864 - RNA, 12 nt, Human
gagagggagacc

SEQ ID NO: 3574865 - RNA, 14 nt, Human
gagagggagagaga

SEQ ID NO: 3574866 - RNA, 23 nt, Human
gagagggaggucacuggaaaggg

SEQ ID NO: 3574867 - RNA, 15 nt, Human
gagagggcgcaggcc

SEQ ID NO: 3574868 - RNA, 16 nt, Human
gagagggcgcaggccg

SEQ ID NO: 3574869 - RNA, 13 nt, Human
gagaggggaacag

SEQ ID NO: 3574870 - RNA, 22 nt, Human
gagaggggaagaguguacuggg

SEQ ID NO: 3574871 - RNA, 17 nt, Human
gagaggggaagggccag

SEQ ID NO: 3574872 - RNA, 20 nt, Human
gagaggggccgaugcccaga

SEQ ID NO: 3574873 - RNA, 21 nt, Human
gagaggggccgaugcccagag

SEQ ID NO: 3574874 - RNA, 19 nt, Human
gagagggggcuggugggug

SEQ ID NO: 3574875 - RNA, 13 nt, Human
gagagggugacaa

SEQ ID NO: 3574876 - RNA, 21 nt, Human
gagagggugggagugggccca

SEQ ID NO: 3574877 - RNA, 17 nt, Human
gagaggucuuuuuuaaa

SEQ ID NO: 3574878 - RNA, 22 nt, Human
gagaggugggccagucugugga

SEQ ID NO: 3574879 - RNA, 16 nt, Human
gagagguuaaggugca

SEQ ID NO: 3574880 - RNA, 19 nt, Human
gagagguuauaggucacuc

SEQ ID NO: 3574881 - RNA, 20 nt, Human
gagagguuugcagucccaag

SEQ ID NO: 3574882 - RNA, 17 nt, Human
gagaguaaugaggcuug

SEQ ID NO: 3574883 - RNA, 18 nt, Human
gagaguagccgagagccu

SEQ ID NO: 3574884 - RNA, 21 nt, Human
gagaguagccgagagccugcu

SEQ ID NO: 3574885 - RNA, 17 nt, Human
gagagucauauuuugau

SEQ ID NO: 3574886 - RNA, 21 nt, Human
gagagucccacugccucaggu

SEQ ID NO: 3574887 - RNA, 18 nt, Human
gagagucccagagcagga

SEQ ID NO: 3574888 - RNA, 19 nt, Human
gagagucccagagcaggag

SEQ ID NO: 3574889 - RNA, 15 nt, Human
gagaguccucuggau

SEQ ID NO: 3574890 - RNA, 23 nt, Human
gagagucuagcacucauuuucua

SEQ ID NO: 3574891 - RNA, 15 nt, Human
gagagucucccaggg

SEQ ID NO: 3574892 - RNA, 13 nt, Human
gagagucuggccc

SEQ ID NO: 3574893 - RNA, 15 nt, Human
gagagucuugcagug

SEQ ID NO: 3574894 - RNA, 15 nt, Human
gagagugaacaaauu

SEQ ID NO: 3574895 - RNA, 21 nt, Human
gagaguggcuccucccggugc

SEQ ID NO: 3574896 - RNA, 15 nt, Human
gagaguggggguggg

SEQ ID NO: 3574897 - RNA, 22 nt, Human
gagagugucaaccagacagagg

SEQ ID NO: 3574898 - RNA, 23 nt, Human
gagagugucaaccagacagaggg

SEQ ID NO: 3574899 - RNA, 20 nt, Human
gagaguucaauggcugcuga

SEQ ID NO: 3574900 - RNA, 14 nt, Human
gagaguuuuggaug

SEQ ID NO: 3574901 - RNA, 15 nt, Human
gagauaaaucuagua

SEQ ID NO: 3574902 - RNA, 17 nt, Human
gagauacagaauuuuau

SEQ ID NO: 3574903 - RNA, 14 nt, Human
gagauacuggugga

SEQ ID NO: 3574904 - RNA, 23 nt, Human
gagauacuuuuucuuuuguaagu

SEQ ID NO: 3574905 - RNA, 23 nt, Human
gagauagcauugugaacugacag

SEQ ID NO: 3574906 - RNA, 14 nt, Human
gagauagccaaggc

SEQ ID NO: 3574907 - RNA, 19 nt, Human
gagauagccaaggccaaag

SEQ ID NO: 3574908 - RNA, 21 nt, Human
gagauagccaaggccaaagga

SEQ ID NO: 3574909 - RNA, 17 nt, Human
gagauaguuuucaucca

SEQ ID NO: 3574910 - RNA, 15 nt, Human
gagauauauuuuuaa

SEQ ID NO: 3574911 - RNA, 21 nt, Human
gagauaucugagggaggaggc

SEQ ID NO: 3574912 - RNA, 22 nt, Human
gagauaucugagggaggaggcc

SEQ ID NO: 3574913 - RNA, 18 nt, Human
gagauauuaaugcccaga

SEQ ID NO: 3574914 - RNA, 16 nt, Human
gagauauugugaggac

SEQ ID NO: 3574915 - RNA, 17 nt, Human
gagauauuuuaaaauga

SEQ ID NO: 3574916 - RNA, 20 nt, Human
gagaucaaagaugaaaagua

SEQ ID NO: 3574917 - RNA, 21 nt, Human
gagaucaccaguguguggcuu

SEQ ID NO: 3574918 - RNA, 12 nt, Human
gagaucagaaaa

SEQ ID NO: 3574919 - RNA, 16 nt, Human
gagaucagccugggca

SEQ ID NO: 3574920 - RNA, 20 nt, Human
gagaucaggaagagaaggag

SEQ ID NO: 3574921 - RNA, 18 nt, Human
gagaucaggcucugccuc

SEQ ID NO: 3574922 - RNA, 16 nt, Human
gagaucauccuuucca

SEQ ID NO: 3574923 - RNA, 20 nt, Human
gagaucauccuuuccagcau

SEQ ID NO: 3574924 - RNA, 21 nt, Human
gagauccaaaagaagccccca

SEQ ID NO: 3574925 - RNA, 20 nt, Human
gagaucccaacacugccagc

SEQ ID NO: 3574926 - RNA, 13 nt, Human
gagauccuccugc

SEQ ID NO: 3574927 - RNA, 23 nt, Human
gagauccuccugcagaccacgcc

SEQ ID NO: 3574928 - RNA, 23 nt, Human
gagauccuuguguuuaucagaaa

SEQ ID NO: 3574929 - RNA, 14 nt, Human
gagaucgagaccau

SEQ ID NO: 3574930 - RNA, 18 nt, Human
gagaucgagaccauccug

SEQ ID NO: 3574931 - RNA, 17 nt, Human
gagaucgugccacugca

SEQ ID NO: 3574932 - RNA, 20 nt, Human
gagaucgugccacugcacuc

SEQ ID NO: 3574933 - RNA, 21 nt, Human
gagaucgugccguuacucucc

SEQ ID NO: 3574934 - RNA, 21 nt, Human
gagaugaaaucuuacagcugg

SEQ ID NO: 3574935 - RNA, 21 nt, Human
gagaugaagagugagagggca

SEQ ID NO: 3574936 - RNA, 15 nt, Human
gagaugaagcaaaca

SEQ ID NO: 3574937 - RNA, 18 nt, Human
gagaugaagcaaacacau

SEQ ID NO: 3574938 - RNA, 20 nt, Human
gagaugaagcaaacacauua

SEQ ID NO: 3574939 - RNA, 13 nt, Human
gagaugacugagu

SEQ ID NO: 3574940 - RNA, 16 nt, Human
gagaugaggaguaaaa

SEQ ID NO: 3574941 - RNA, 19 nt, Human
gagaugaggaguaaaauuc

SEQ ID NO: 3574942 - RNA, 22 nt, Human
gagcaucaugccucugaggcca

SEQ ID NO: 3574943 - RNA, 24 nt, Human
gagcaucaugccucugaggccagc

SEQ ID NO: 3574944 - RNA, 15 nt, Human
gagcauccugagccc

SEQ ID NO: 3574945 - RNA, 18 nt, Human
gagcauggaacacuucga

SEQ ID NO: 3574946 - RNA, 15 nt, Human
gagcauggagcuggc

SEQ ID NO: 3574947 - RNA, 17 nt, Human
gagcauggagcuggccg

SEQ ID NO: 3574948 - RNA, 14 nt, Human
gagcauggcuguga

SEQ ID NO: 3574949 - RNA, 16 nt, Human
gagcauggcugugagg

SEQ ID NO: 3574950 - RNA, 17 nt, Human
gagcaugggccuggcca

SEQ ID NO: 3574951 - RNA, 21 nt, Human
gagcauggggauaaaggagaa

SEQ ID NO: 3574952 - RNA, 22 nt, Human
gagcauggggauaaaggagaag

SEQ ID NO: 3574953 - RNA, 14 nt, Human
gagcauuacaggca

SEQ ID NO: 3574954 - RNA, 15 nt, Human
gagcauuagauuucu

SEQ ID NO: 3574955 - RNA, 21 nt, Human
gagcauuagauuucucauuug

SEQ ID NO: 3574956 - RNA, 17 nt, Human
gagcauuuagggcaagg

SEQ ID NO: 3574957 - RNA, 20 nt, Human
gagcauuucucaucaguagu

SEQ ID NO: 3574958 - RNA, 20 nt, Human
gagcauuuugauaccagaag

SEQ ID NO: 3574959 - RNA, 20 nt, Human
gagccaacagaagcuuccau

SEQ ID NO: 3574960 - RNA, 14 nt, Human
gagccaagggaugg

SEQ ID NO: 3574961 - RNA, 15 nt, Human
gagccaagggaugga

SEQ ID NO: 3574962 - RNA, 22 nt, Human
gagccaagggauggacaucuug

SEQ ID NO: 3574963 - RNA, 18 nt, Human
gagccaaggggcuucagg

SEQ ID NO: 3574964 - RNA, 14 nt, Human
gagccaaguccaga

SEQ ID NO: 3574965 - RNA, 19 nt, Human
gagccaauuuaaagaaaac

SEQ ID NO: 3574966 - RNA, 14 nt, Human
gagccacagcagca

SEQ ID NO: 3574967 - RNA, 17 nt, Human
gagccacagcagcauuu

SEQ ID NO: 3574968 - RNA, 20 nt, Human
gagccacagcagcauuuuua

SEQ ID NO: 3574969 - RNA, 19 nt, Human
gagccaccacaccuggcua

SEQ ID NO: 3574970 - RNA, 23 nt, Human
gagccaccacaccuggcuaauuu

SEQ ID NO: 3574971 - RNA, 14 nt, Human
gagccaccaugccc

SEQ ID NO: 3574972 - RNA, 18 nt, Human
gagccaccgcgcccagcc

SEQ ID NO: 3574973 - RNA, 13 nt, Human
gagccaccugucc

SEQ ID NO: 3574974 - RNA, 20 nt, Human
gagccacugcaccgggccac

SEQ ID NO: 3574975 - RNA, 14 nt, Human
gagccagacagacc

SEQ ID NO: 3574976 - RNA, 23 nt, Human
gagccagacucuggucuucuuug

SEQ ID NO: 3574977 - RNA, 13 nt, Human
gagccagauuuca

SEQ ID NO: 3574978 - RNA, 13 nt, Human
gagccagcccucc

SEQ ID NO: 3574979 - RNA, 19 nt, Human
gagccagcccucccugucc

SEQ ID NO: 3574980 - RNA, 19 nt, Human
gagccagccgagcaggagg

SEQ ID NO: 3574981 - RNA, 15 nt, Human
gagccagccugcucc

SEQ ID NO: 3574982 - RNA, 18 nt, Human
gagccagcuaaggggugg

SEQ ID NO: 3574983 - RNA, 20 nt, Human
gagccagcuuggggccacca

SEQ ID NO: 3574984 - RNA, 12 nt, Human
gagccaggccug

SEQ ID NO: 3574985 - RNA, 21 nt, Human
gagccaggccugggucugugu

SEQ ID NO: 3574986 - RNA, 21 nt, Human
gagccaggcuagcuggagccu

SEQ ID NO: 3574987 - RNA, 17 nt, Human
gagccagggucuccaga

SEQ ID NO: 3574988 - RNA, 22 nt, Human
gagccagggucuccagaaagcc

SEQ ID NO: 3574989 - RNA, 19 nt, Human
gagccagguaaugagggac

SEQ ID NO: 3574990 - RNA, 19 nt, Human
gagccaguucaguaccugg

SEQ ID NO: 3574991 - RNA, 19 nt, Human
gagccauauaaguuugaag

SEQ ID NO: 3574992 - RNA, 17 nt, Human
gagccaugcgcccccuc

SEQ ID NO: 3574993 - RNA, 22 nt, Human
gagccauggaccacgcaggaag

SEQ ID NO: 3574994 - RNA, 18 nt, Human
gagccaugggcacaaagg

SEQ ID NO: 3574995 - RNA, 22 nt, Human
gagccaugucuucucccuggaa

SEQ ID NO: 3574996 - RNA, 14 nt, Human
gagcccaagggaau

SEQ ID NO: 3574997 - RNA, 16 nt, Human
gagcccacaaagccuu

SEQ ID NO: 3574998 - RNA, 15 nt, Human
gagcccaccuuggcu

SEQ ID NO: 3574999 - RNA, 20 nt, Human
gagcccacgacacugcagcc

SEQ ID NO: 3575000 - RNA, 18 nt, Human
gagcccacgcccccacug

SEQ ID NO: 3575001 - RNA, 21 nt, Human
gagcccacggcuaagaggcug

SEQ ID NO: 3575002 - RNA, 23 nt, Human
gagcccacggcuaagaggcugcu

SEQ ID NO: 3575003 - RNA, 19 nt, Human
gagcccacugcccaccccc

SEQ ID NO: 3575004 - RNA, 19 nt, Human
gagcccacuguccugggcc

SEQ ID NO: 3575005 - RNA, 13 nt, Human
gagcccacugugc

SEQ ID NO: 3575006 - RNA, 14 nt, Human
gagcccagagaaca

SEQ ID NO: 3575007 - RNA, 22 nt, Human
gagcccagaggagggcagcaga

SEQ ID NO: 3575008 - RNA, 21 nt, Human
gagcccagagguaacagaaca

SEQ ID NO: 3575009 - RNA, 22 nt, Human
gagcccagagguaacagaacag

SEQ ID NO: 3575010 - RNA, 20 nt, Human
gagcccagauugugccacug

SEQ ID NO: 3575011 - RNA, 15 nt, Human
gagcccagcccuccc

SEQ ID NO: 3575012 - RNA, 13 nt, Human
gagcccagcucca

SEQ ID NO: 3575013 - RNA, 12 nt, Human
gagcccagcucu

SEQ ID NO: 3575014 - RNA, 21 nt, Human
gagcccagcucugaaaccagu

SEQ ID NO: 3575015 - RNA, 21 nt, Human
gagcccagcugggucaggcag

SEQ ID NO: 3575016 - RNA, 22 nt, Human
gagcccagcugggucaggcagg

SEQ ID NO: 3575017 - RNA, 21 nt, Human
gagcccaggagucccacucca

SEQ ID NO: 3575018 - RNA, 17 nt, Human
gagcccaggccaggacu

SEQ ID NO: 3575019 - RNA, 13 nt, Human
gagcccaggccuc

SEQ ID NO: 3575020 - RNA, 14 nt, Human
gagcccaggccucc

SEQ ID NO: 3575021 - RNA, 21 nt, Human
gagcccaggcucggccugccc

SEQ ID NO: 3575022 - RNA, 22 nt, Human
gagcccaggcucggccugcccc

SEQ ID NO: 3575023 - RNA, 13 nt, Human
gagcccauacuca

SEQ ID NO: 3575024 - RNA, 20 nt, Human
gagcccauguucugccccca

SEQ ID NO: 3575025 - RNA, 22 nt, Human
gagcccauguucugcccccagc

SEQ ID NO: 3575026 - RNA, 18 nt, Human
gagcccauuuggagggcc

SEQ ID NO: 3575027 - RNA, 17 nt, Human
gagccccaaguccugaa

SEQ ID NO: 3575028 - RNA, 21 nt, Human
gagccccaaguccugaagagg

SEQ ID NO: 3575029 - RNA, 14 nt, Human
gagccccacagccc

SEQ ID NO: 3575030 - RNA, 18 nt, Human
gagccccacucucagagg

SEQ ID NO: 3575031 - RNA, 19 nt, Human
gagccccagcccccuuugg

SEQ ID NO: 3575032 - RNA, 16 nt, Human
gagccccagcuacccu

SEQ ID NO: 3575033 - RNA, 14 nt, Human
gagccccagcugac

SEQ ID NO: 3575034 - RNA, 16 nt, Human
gagccccaggccucug

SEQ ID NO: 3575035 - RNA, 18 nt, Human
gagccccaggccucugug

SEQ ID NO: 3575036 - RNA, 23 nt, Human
gagccccagggagagggggcugg

SEQ ID NO: 3575037 - RNA, 24 nt, Human
gagccccagggucuucccuaccuc

SEQ ID NO: 3575038 - RNA, 19 nt, Human
gagccccaucuucacccag

SEQ ID NO: 3575039 - RNA, 15 nt, Human
gagcccccacccugu

SEQ ID NO: 3575040 - RNA, 20 nt, Human
gagcccccagcuuccagcag

SEQ ID NO: 3575041 - RNA, 13 nt, Human
gagccccgaggcc

SEQ ID NO: 3575042 - RNA, 13 nt, Human
gagccccgcagac

SEQ ID NO: 3575043 - RNA, 23 nt, Human
gagccccgcagaccuccccagcc

SEQ ID NO: 3575044 - RNA, 19 nt, Human
gagccccgcccucuuccug

SEQ ID NO: 3575045 - RNA, 15 nt, Human
gagccccuaccccac

SEQ ID NO: 3575046 - RNA, 17 nt, Human
gagccccuccuccagcc

SEQ ID NO: 3575047 - RNA, 12 nt, Human
gagccccugggu

SEQ ID NO: 3575048 - RNA, 19 nt, Human
gagccccuggguggguggu

SEQ ID NO: 3575049 - RNA, 22 nt, Human
gagccccugucuagagagggag

SEQ ID NO: 3575050 - RNA, 20 nt, Human
gagcccgaggaggugucuca

SEQ ID NO: 3575051 - RNA, 22 nt, Human
gagcccgaggaggugucucagg

SEQ ID NO: 3575052 - RNA, 15 nt, Human
gagcccgggcugccu

SEQ ID NO: 3575053 - RNA, 17 nt, Human
gagcccgggcugccugg

SEQ ID NO: 3575054 - RNA, 19 nt, Human
gagcccgggcugccugggc

SEQ ID NO: 3575055 - RNA, 20 nt, Human
gagcccgggcugccugggcu

SEQ ID NO: 3575056 - RNA, 22 nt, Human
gagcccgggcugccugggcugu

SEQ ID NO: 3575057 - RNA, 20 nt, Human
gagcccuaaccccuuccaga

SEQ ID NO: 3575058 - RNA, 22 nt, Human
gagcccuacucccugcagaugc

SEQ ID NO: 3575059 - RNA, 13 nt, Human
gagcccucagaac

SEQ ID NO: 3575060 - RNA, 12 nt, Human
gagcccucccca

SEQ ID NO: 3575061 - RNA, 22 nt, Human
gagcccugccucuccgccccug

SEQ ID NO: 3575062 - RNA, 13 nt, Human
gagcccuggcagg

SEQ ID NO: 3575063 - RNA, 22 nt, Human
gagcccugggaggcucuggagc

SEQ ID NO: 3575064 - RNA, 21 nt, Human
gagcccuguggaugagcccuc

SEQ ID NO: 3575065 - RNA, 21 nt, Human
gagcccuucuauacccaccca

SEQ ID NO: 3575066 - RNA, 23 nt, Human
gagcccuucuauacccacccaga

SEQ ID NO: 3575067 - RNA, 15 nt, Human
gagcccuugccuccc

SEQ ID NO: 3575068 - RNA, 19 nt, Human
gagccgagaucacgccacu

SEQ ID NO: 3575069 - RNA, 21 nt, Human
gagccgagaucacgccacugc

SEQ ID NO: 3575070 - RNA, 22 nt, Human
gagccgauuguccuaucuccag

SEQ ID NO: 3575071 - RNA, 21 nt, Human
gagccgcaucuucuccaucug

SEQ ID NO: 3575072 - RNA, 22 nt, Human
gagccgcaucuucuccaucugg

SEQ ID NO: 3575073 - RNA, 19 nt, Human
gagccgcuggcagaaggga

SEQ ID NO: 3575074 - RNA, 12 nt, Human
gagccggagccu

SEQ ID NO: 3575075 - RNA, 16 nt, Human
gagccggagccuccag

SEQ ID NO: 3575076 - RNA, 23 nt, Human
gagccggccccaggcucguggac

SEQ ID NO: 3575077 - RNA, 18 nt, Human
gagccggggaguuucuuu

SEQ ID NO: 3575078 - RNA, 20 nt, Human
gagccgggucugccucuucu

SEQ ID NO: 3575079 - RNA, 19 nt, Human
gagccggguguccccaaca

SEQ ID NO: 3575080 - RNA, 17 nt, Human
gagccgguaacuguccu

SEQ ID NO: 3575081 - RNA, 19 nt, Human
gagccgguaacuguccugu

SEQ ID NO: 3575082 - RNA, 17 nt, Human
gagccgugaacugugca

SEQ ID NO: 3575083 - RNA, 18 nt, Human
gagccgugaacugugcau

SEQ ID NO: 3575084 - RNA, 14 nt, Human
gauaaauauuugac

SEQ ID NO: 3575085 - RNA, 16 nt, Human
gauaaauauuugacuu

SEQ ID NO: 3575086 - RNA, 14 nt, Human
gauaaaucauuuua

SEQ ID NO: 3575087 - RNA, 20 nt, Human
gauaaaugauucaaaaaguc

SEQ ID NO: 3575088 - RNA, 16 nt, Human
gauaaauuauuuccag

SEQ ID NO: 3575089 - RNA, 12 nt, Human
gauaacaaagau

SEQ ID NO: 3575090 - RNA, 17 nt, Human
gauaacaaagauaucuu

SEQ ID NO: 3575091 - RNA, 16 nt, Human
gauaacaaccuggaga

SEQ ID NO: 3575092 - RNA, 22 nt, Human
gauaacaauguuuuaacaagaa

SEQ ID NO: 3575093 - RNA, 13 nt, Human
gauaacagcacug

SEQ ID NO: 3575094 - RNA, 17 nt, Human
gauaaccauagcauagg

SEQ ID NO: 3575095 - RNA, 16 nt, Human
gauaaccuugaaaaaa

SEQ ID NO: 3575096 - RNA, 19 nt, Human
gauaacuagauggugcuga

SEQ ID NO: 3575097 - RNA, 20 nt, Human
gauaacugaaaauuauuuaa

SEQ ID NO: 3575098 - RNA, 21 nt, Human
gauaacugcaauuuuaauuga

SEQ ID NO: 3575099 - RNA, 21 nt, Human
gauaacuuagguggcaagcug

SEQ ID NO: 3575100 - RNA, 12 nt, Human
gauaagaaaacc

SEQ ID NO: 3575101 - RNA, 20 nt, Human
gauaagcaguuaugugaccu

SEQ ID NO: 3575102 - RNA, 12 nt, Human
gauaaggaagaa

SEQ ID NO: 3575103 - RNA, 13 nt, Human
gauaaggaagaaa

SEQ ID NO: 3575104 - RNA, 21 nt, Human
gauaaggaagaaacagaagag

SEQ ID NO: 3575105 - RNA, 17 nt, Human
gauaaggaauuauagac

SEQ ID NO: 3575106 - RNA, 14 nt, Human
gauaaggacaugau

SEQ ID NO: 3575107 - RNA, 19 nt, Human
gauaaggacgggaccauuu

SEQ ID NO: 3575108 - RNA, 14 nt, Human
gauaagggaaaaga

SEQ ID NO: 3575109 - RNA, 18 nt, Human
gauaagggacugauguuu

SEQ ID NO: 3575110 - RNA, 16 nt, Human
gauaaguguauuuuuc

SEQ ID NO: 3575111 - RNA, 16 nt, Human
gauaaguucauacauu

SEQ ID NO: 3575112 - RNA, 19 nt, Human
gauaaguuggaaacacuaa

SEQ ID NO: 3575113 - RNA, 12 nt, Human
gauaauaauggg

SEQ ID NO: 3575114 - RNA, 23 nt, Human
gauaauacaccacuacauucugu

SEQ ID NO: 3575115 - RNA, 22 nt, Human
gauaauaguuuuuucuuuuaac

SEQ ID NO: 3575116 - RNA, 23 nt, Human
gauaauaucuuugugauaauuua

SEQ ID NO: 3575117 - RNA, 17 nt, Human
gauaauaugagaaucag

SEQ ID NO: 3575118 - RNA, 21 nt, Human
gauaaucaacugggcugaaca

SEQ ID NO: 3575119 - RNA, 14 nt, Human
gauaaucagccucu

SEQ ID NO: 3575120 - RNA, 16 nt, Human
gauaaucucagugcuu

SEQ ID NO: 3575121 - RNA, 19 nt, Human
gauaaucucagugcuuucc

SEQ ID NO: 3575122 - RNA, 14 nt, Human
gauaaugaacagaa

SEQ ID NO: 3575123 - RNA, 19 nt, Human
gauaaugcuguugccucau

SEQ ID NO: 3575124 - RNA, 21 nt, Human
gauaauguccaacuaaaaaca

SEQ ID NO: 3575125 - RNA, 13 nt, Human
gauaauguuaaau

SEQ ID NO: 3575126 - RNA, 14 nt, Human
gauaauguuaaauu

SEQ ID NO: 3575127 - RNA, 19 nt, Human
gauaauguuaaauuuguaa

SEQ ID NO: 3575128 - RNA, 14 nt, Human
gauaauuauaauau

SEQ ID NO: 3575129 - RNA, 13 nt, Human
gauaauuccagug

SEQ ID NO: 3575130 - RNA, 18 nt, Human
gauaauugcauucaucuu

SEQ ID NO: 3575131 - RNA, 16 nt, Human
gauaauugcuauuuau

SEQ ID NO: 3575132 - RNA, 22 nt, Human
gauaauugcuauuuauuuuuac

SEQ ID NO: 3575133 - RNA, 16 nt, Human
gauaauuguugaaauu

SEQ ID NO: 3575134 - RNA, 12 nt, Human
gauaauuuaaga

SEQ ID NO: 3575135 - RNA, 18 nt, Human
gauaauuuuaaauucucu

SEQ ID NO: 3575136 - RNA, 17 nt, Human
gauaauuuugcauaaaa

SEQ ID NO: 3575137 - RNA, 19 nt, Human
gauacaaccucccucuugu

SEQ ID NO: 3575138 - RNA, 12 nt, Human
gauacaauaaau

SEQ ID NO: 3575139 - RNA, 15 nt, Human
gauacaaucagcugc

SEQ ID NO: 3575140 - RNA, 11 nt, Human
gauacagaaaa

SEQ ID NO: 3575141 - RNA, 23 nt, Human
gauacagcaguagacauuuuaac

SEQ ID NO: 3575142 - RNA, 16 nt, Human
gauacaguuacucaga

SEQ ID NO: 3575143 - RNA, 11 nt, Human
gauacauaaaa

SEQ ID NO: 3575144 - RNA, 20 nt, Human
gauacauaacuaaauuugau

SEQ ID NO: 3575145 - RNA, 23 nt, Human
gauacauaacuaaauuugauacu

SEQ ID NO: 3575146 - RNA, 20 nt, Human
gauacauaugaguguggaag

SEQ ID NO: 3575147 - RNA, 20 nt, Human
gauacauccaaagcagacag

SEQ ID NO: 3575148 - RNA, 15 nt, Human
gauaccagcgaggag

SEQ ID NO: 3575149 - RNA, 13 nt, Human
gauaccagcugga

SEQ ID NO: 3575150 - RNA, 20 nt, Human
gauaccagguugaaagaccu

SEQ ID NO: 3575151 - RNA, 13 nt, Human
gauaccccccucu

SEQ ID NO: 3575152 - RNA, 21 nt, Human
gauaccccccucugucuugug

SEQ ID NO: 3575153 - RNA, 18 nt, Human
gauaccuccaacccugcc

SEQ ID NO: 3575154 - RNA, 14 nt, Human
gauaccuuaaaauu

SEQ ID NO: 3575155 - RNA, 17 nt, Human
gauaccuuaaaauuuga

SEQ ID NO: 3575156 - RNA, 13 nt, Human
gauacgacuuuau

SEQ ID NO: 3575157 - RNA, 16 nt, Human
gauacuacaguuuguu

SEQ ID NO: 3575158 - RNA, 13 nt, Human
gauacuacaucuu

SEQ ID NO: 3575159 - RNA, 13 nt, Human
gauacucugucag

SEQ ID NO: 3575160 - RNA, 12 nt, Human
gauacugaaaua

SEQ ID NO: 3575161 - RNA, 18 nt, Human
gauacugcagggccagga

SEQ ID NO: 3575162 - RNA, 21 nt, Human
gauacugcagggccaggacug

SEQ ID NO: 3575163 - RNA, 17 nt, Human
gauacugcgacuuucug

SEQ ID NO: 3575164 - RNA, 23 nt, Human
gauacugcuacuguaauuuuaua

SEQ ID NO: 3575165 - RNA, 16 nt, Human
gauacuggaaguuuug

SEQ ID NO: 3575166 - RNA, 19 nt, Human
gauacuggaaguuuugcau

SEQ ID NO: 3575167 - RNA, 16 nt, Human
gauacuggauuguacu

SEQ ID NO: 3575168 - RNA, 20 nt, Human
gauacuggcaaagcagaaaa

SEQ ID NO: 3575169 - RNA, 13 nt, Human
gauacuggcacag

SEQ ID NO: 3575170 - RNA, 16 nt, Human
gauacuguaacacuuu

SEQ ID NO: 3575171 - RNA, 17 nt, Human
gauacuguaucaugaca

SEQ ID NO: 3575172 - RNA, 15 nt, Human
gauacuguugcacgu

SEQ ID NO: 3575173 - RNA, 19 nt, Human
gauacuguugcacgugugu

SEQ ID NO: 3575174 - RNA, 21 nt, Human
gauacuguugcacguguguuu

SEQ ID NO: 3575175 - RNA, 20 nt, Human
gauacuuaagugcugcaauu

SEQ ID NO: 3575176 - RNA, 19 nt, Human
gauacuuauauuuucguau

SEQ ID NO: 3575177 - RNA, 16 nt, Human
gauacuuauuuaaaua

SEQ ID NO: 3575178 - RNA, 18 nt, Human
gauacuucauuuaaaaaa

SEQ ID NO: 3575179 - RNA, 19 nt, Human
gauacuucccacaccacaa

SEQ ID NO: 3575180 - RNA, 19 nt, Human
gauacuucgacacuguucu

SEQ ID NO: 3575181 - RNA, 23 nt, Human
gauacuucgacacuguucuuagc

SEQ ID NO: 3575182 - RNA, 16 nt, Human
gauacuugaaaauuaa

SEQ ID NO: 3575183 - RNA, 23 nt, Human
gauacuuggauuuaguuucagua

SEQ ID NO: 3575184 - RNA, 15 nt, Human
gauacuuguuuucaa

SEQ ID NO: 3575185 - RNA, 13 nt, Human
gauacuuuacaug

SEQ ID NO: 3575186 - RNA, 16 nt, Human
gauacuuuguauuguc

SEQ ID NO: 3575187 - RNA, 23 nt, Human
gauacuuuuucuuuuguaagugc

SEQ ID NO: 3575188 - RNA, 14 nt, Human
gauagaaauaaaua

SEQ ID NO: 3575189 - RNA, 19 nt, Human
gauagaaaugccaagcacu

SEQ ID NO: 3575190 - RNA, 16 nt, Human
gauagaagaacugcaa

SEQ ID NO: 3575191 - RNA, 14 nt, Human
gauagaagauguuu

SEQ ID NO: 3575192 - RNA, 12 nt, Human
gauagaaugaca

SEQ ID NO: 3575193 - RNA, 21 nt, Human
gauagacacauaugaggggga

SEQ ID NO: 3575194 - RNA, 21 nt, Human
gauagacgaguugauuuccuc

SEQ ID NO: 3575195 - RNA, 20 nt, Human
gauagaguaaaaagaaaaca

SEQ ID NO: 3575196 - RNA, 18 nt, Human
gauagauaacucuuugga

SEQ ID NO: 3575197 - RNA, 20 nt, Human
gauagaugcuggcccagggc

SEQ ID NO: 3575198 - RNA, 15 nt, Human
gauagauuugaccuc

SEQ ID NO: 3575199 - RNA, 20 nt, Human
gauagcacagacccugcccu

SEQ ID NO: 3575200 - RNA, 21 nt, Human
gauagcacagacccugcccug

SEQ ID NO: 3575201 - RNA, 19 nt, Human
gauagcacugagcaaagca

SEQ ID NO: 3575202 - RNA, 13 nt, Human
gauagcagggcau

SEQ ID NO: 3575203 - RNA, 15 nt, Human
gauagcauuguaagc

SEQ ID NO: 3575204 - RNA, 15 nt, Human
gauagcauugugaac

SEQ ID NO: 3575205 - RNA, 22 nt, Human
gauagcauuuuugauuuaugca

SEQ ID NO: 3575206 - RNA, 15 nt, Human
gauagcccuguccug

SEQ ID NO: 3575207 - RNA, 17 nt, Human
gauagcccuguccuggu

SEQ ID NO: 3575208 - RNA, 17 nt, Human
gauagcgggaaaaggag

SEQ ID NO: 3575209 - RNA, 18 nt, Human
gauagcuaacauuuuaaa

SEQ ID NO: 3575210 - RNA, 22 nt, Human
gauagcuaacauuuuaaauaaa

SEQ ID NO: 3575211 - RNA, 19 nt, Human
gauagcuaacuguaaauca

SEQ ID NO: 3575212 - RNA, 20 nt, Human
gauagcuaacuguaaaucau

SEQ ID NO: 3575213 - RNA, 13 nt, Human
gauagcugcaugu

SEQ ID NO: 3575214 - RNA, 19 nt, Human
gauagcugcauguggcuuu

SEQ ID NO: 3575215 - RNA, 19 nt, Human
gauaggaaaaaugaguaau

SEQ ID NO: 3575216 - RNA, 19 nt, Human
gauaggaagaaagaagaca

SEQ ID NO: 3575217 - RNA, 21 nt, Human
gauaggaaggucauuuccaug

SEQ ID NO: 3575218 - RNA, 18 nt, Human
gauaggaaugugaaagca

SEQ ID NO: 3575219 - RNA, 17 nt, Human
gauaggagccugcuggu

SEQ ID NO: 3575220 - RNA, 13 nt, Human
gauaggcucugca

SEQ ID NO: 3575221 - RNA, 13 nt, Human
gauaguaagcaua

SEQ ID NO: 3575222 - RNA, 16 nt, Human
gauaguauugugcaua

SEQ ID NO: 3575223 - RNA, 23 nt, Human
gauagugggcaccccacugcaau

SEQ ID NO: 3575224 - RNA, 12 nt, Human
gauaguuacugu

SEQ ID NO: 3575225 - RNA, 14 nt, Human
gauaguuuucuccu

SEQ ID NO: 3575226 - RNA, 18 nt, Human
gauauaaaagacugacca

SEQ ID NO: 3575227 - RNA, 21 nt, Human
gauauaaaugcaauauuaaug

SEQ ID NO: 3575228 - RNA, 15 nt, Human
gauauaaauggcugg

SEQ ID NO: 3575229 - RNA, 21 nt, Human
gauccaagcuggucccacuca

SEQ ID NO: 3575230 - RNA, 22 nt, Human
gauccaauguuagagacuuuuu

SEQ ID NO: 3575231 - RNA, 15 nt, Human
gauccacacacagag

SEQ ID NO: 3575232 - RNA, 19 nt, Human
gauccacacacagaggaag

SEQ ID NO: 3575233 - RNA, 16 nt, Human
gauccacccaacccua

SEQ ID NO: 3575234 - RNA, 17 nt, Human
gauccacccaacccuau

SEQ ID NO: 3575235 - RNA, 21 nt, Human
gauccacccgccucagccucc

SEQ ID NO: 3575236 - RNA, 14 nt, Human
gauccaccugucuc

SEQ ID NO: 3575237 - RNA, 18 nt, Human
gauccaccugucucagcc

SEQ ID NO: 3575238 - RNA, 18 nt, Human
gauccacucgccucagcc

SEQ ID NO: 3575239 - RNA, 19 nt, Human
gauccacuggcuggacaaa

SEQ ID NO: 3575240 - RNA, 18 nt, Human
gauccagcagauuauuca

SEQ ID NO: 3575241 - RNA, 12 nt, Human
gauccagccugg

SEQ ID NO: 3575242 - RNA, 19 nt, Human
gauccaggagcuccagugu

SEQ ID NO: 3575243 - RNA, 23 nt, Human
gauccaggagcuccaguguccug

SEQ ID NO: 3575244 - RNA, 15 nt, Human
gauccagggacagag

SEQ ID NO: 3575245 - RNA, 16 nt, Human
gauccagggacugaag

SEQ ID NO: 3575246 - RNA, 20 nt, Human
gauccagggaggcugguccu

SEQ ID NO: 3575247 - RNA, 12 nt, Human
gauccaguuuug

SEQ ID NO: 3575248 - RNA, 17 nt, Human
gauccaguuuuguuugg

SEQ ID NO: 3575249 - RNA, 22 nt, Human
gauccaguuuuguuuggaccaa

SEQ ID NO: 3575250 - RNA, 22 nt, Human
gauccaugaguuugcccugguu

SEQ ID NO: 3575251 - RNA, 14 nt, Human
gauccauguaacug

SEQ ID NO: 3575252 - RNA, 19 nt, Human
gauccauguagcaggacug

SEQ ID NO: 3575253 - RNA, 17 nt, Human
gauccauuuccauugcu

SEQ ID NO: 3575254 - RNA, 23 nt, Human
gauccauuuccauugcuuauuau

SEQ ID NO: 3575255 - RNA, 17 nt, Human
gaucccaacacugccag

SEQ ID NO: 3575256 - RNA, 19 nt, Human
gaucccaacacugccagca

SEQ ID NO: 3575257 - RNA, 22 nt, Human
gaucccaccccauuuucugugg

SEQ ID NO: 3575258 - RNA, 19 nt, Human
gaucccagcucacgucaca

SEQ ID NO: 3575259 - RNA, 24 nt, Human
gaucccaucuugauaagaccacca

SEQ ID NO: 3575260 - RNA, 14 nt, Human
gauccccaagugug

SEQ ID NO: 3575261 - RNA, 17 nt, Human
gauccccacgccacagc

SEQ ID NO: 3575262 - RNA, 19 nt, Human
gauccccacgccacagccc

SEQ ID NO: 3575263 - RNA, 17 nt, Human
gauccccgccuggccag

SEQ ID NO: 3575264 - RNA, 19 nt, Human
gauccccgccuggccagga

SEQ ID NO: 3575265 - RNA, 21 nt, Human
gauccccgccuggccaggagc

SEQ ID NO: 3575266 - RNA, 22 nt, Human
gauccccgccuggccaggagca

SEQ ID NO: 3575267 - RNA, 17 nt, Human
gauccccucaggacugc

SEQ ID NO: 3575268 - RNA, 16 nt, Human
gaucccguuuucccca

SEQ ID NO: 3575269 - RNA, 14 nt, Human
gaucccucaucugu

SEQ ID NO: 3575270 - RNA, 21 nt, Human
gaucccucccccccaugcacu

SEQ ID NO: 3575271 - RNA, 23 nt, Human
gaucccucuacagagcuucccug

SEQ ID NO: 3575272 - RNA, 14 nt, Human
gaucccucucugga

SEQ ID NO: 3575273 - RNA, 21 nt, Human
gaucccuguguugucucuaga

SEQ ID NO: 3575274 - RNA, 14 nt, Human
gauccgacugcuuu

SEQ ID NO: 3575275 - RNA, 20 nt, Human
gauccuaacugaagagacag

SEQ ID NO: 3575276 - RNA, 19 nt, Human
gauccuaagcaucuaaguu

SEQ ID NO: 3575277 - RNA, 18 nt, Human
gauccuaggcauuugcug

SEQ ID NO: 3575278 - RNA, 18 nt, Human
gauccuaguuccaccauc

SEQ ID NO: 3575279 - RNA, 11 nt, Human
gauccuccagg

SEQ ID NO: 3575280 - RNA, 19 nt, Human
gauccucccaccucagccu

SEQ ID NO: 3575281 - RNA, 21 nt, Human
gauccucccaccucagccucc

SEQ ID NO: 3575282 - RNA, 15 nt, Human
gauccuccccuggac

SEQ ID NO: 3575283 - RNA, 18 nt, Human
gauccuccccuggacucc

SEQ ID NO: 3575284 - RNA, 22 nt, Human
gauccuccugcagaccacgccc

SEQ ID NO: 3575285 - RNA, 15 nt, Human
gauccucucaccuca

SEQ ID NO: 3575286 - RNA, 16 nt, Human
gauccucucaccucag

SEQ ID NO: 3575287 - RNA, 12 nt, Human
gauccugagcca

SEQ ID NO: 3575288 - RNA, 14 nt, Human
gauccugagccaga

SEQ ID NO: 3575289 - RNA, 18 nt, Human
gauccugcacugacucug

SEQ ID NO: 3575290 - RNA, 18 nt, Human
gauccugccacccuguag

SEQ ID NO: 3575291 - RNA, 15 nt, Human
gauccuggaggccca

SEQ ID NO: 3575292 - RNA, 19 nt, Human
gauccugggggccuggguu

SEQ ID NO: 3575293 - RNA, 22 nt, Human
gauccuggguacugaaagccuu

SEQ ID NO: 3575294 - RNA, 12 nt, Human
gauccugugaag

SEQ ID NO: 3575295 - RNA, 22 nt, Human
gauccugugaggagccccaucu

SEQ ID NO: 3575296 - RNA, 20 nt, Human
gauccuguguggagagggaa

SEQ ID NO: 3575297 - RNA, 16 nt, Human
gauccuucaaagucuc

SEQ ID NO: 3575298 - RNA, 23 nt, Human
gauccuucaaagucucaaugaaa

SEQ ID NO: 3575299 - RNA, 13 nt, Human
gauccuucacauu

SEQ ID NO: 3575300 - RNA, 12 nt, Human
gauccuuccucc

SEQ ID NO: 3575301 - RNA, 14 nt, Human
gauccuuuuauguu

SEQ ID NO: 3575302 - RNA, 17 nt, Human
gauccuuuuggagucag

SEQ ID NO: 3575303 - RNA, 20 nt, Human
gaucgcaagagccauguaga

SEQ ID NO: 3575304 - RNA, 15 nt, Human
gaucgcaucauugca

SEQ ID NO: 3575305 - RNA, 14 nt, Human
gaucgcccccaccu

SEQ ID NO: 3575306 - RNA, 13 nt, Human
gaucgccuucccc

SEQ ID NO: 3575307 - RNA, 17 nt, Human
gaucgcgccacugcacu

SEQ ID NO: 3575308 - RNA, 22 nt, Human
gaucggaggcuugucagagcug

SEQ ID NO: 3575309 - RNA, 20 nt, Human
gaucgugcuggcgcuguugg

SEQ ID NO: 3575310 - RNA, 14 nt, Human
gaucuaaauaaaau

SEQ ID NO: 3575311 - RNA, 18 nt, Human
gaucuaagccuuuccaua

SEQ ID NO: 3575312 - RNA, 14 nt, Human
gaucuaaggcuguu

SEQ ID NO: 3575313 - RNA, 14 nt, Human
gaucuaccuggagg

SEQ ID NO: 3575314 - RNA, 20 nt, Human
gaucuagaauguguuuucug

SEQ ID NO: 3575315 - RNA, 22 nt, Human
gaucuagaauguguuuucugaa

SEQ ID NO: 3575316 - RNA, 15 nt, Human
gaucuaggagaggag

SEQ ID NO: 3575317 - RNA, 21 nt, Human
gaucuaggagaggagaaccag

SEQ ID NO: 3575318 - RNA, 16 nt, Human
gaucucaccaggcagc

SEQ ID NO: 3575319 - RNA, 19 nt, Human
gaucucaccaggcagccuc

SEQ ID NO: 3575320 - RNA, 12 nt, Human
gaucucagcuca

SEQ ID NO: 3575321 - RNA, 21 nt, Human
gaucucagcuuugagaagccu

SEQ ID NO: 3575322 - RNA, 20 nt, Human
gaucucagggaagcccagcu

SEQ ID NO: 3575323 - RNA, 14 nt, Human
gaucucaggggcug

SEQ ID NO: 3575324 - RNA, 23 nt, Human
gaucucagugguuaagauuccua

SEQ ID NO: 3575325 - RNA, 20 nt, Human
gaucucauucaguauuaaag

SEQ ID NO: 3575326 - RNA, 16 nt, Human
gaucuccaaggaccag

SEQ ID NO: 3575327 - RNA, 13 nt, Human
gaucucccagggc

SEQ ID NO: 3575328 - RNA, 15 nt, Human
gaucucccugccgcc

SEQ ID NO: 3575329 - RNA, 20 nt, Human
gaucucccugccgccucaau

SEQ ID NO: 3575330 - RNA, 17 nt, Human
gaucucccuuuccuaua

SEQ ID NO: 3575331 - RNA, 13 nt, Human
gaucuccugaccu

SEQ ID NO: 3575332 - RNA, 16 nt, Human
gaucucggcucagugc

SEQ ID NO: 3575333 - RNA, 12 nt, Human
gaucucucagga

SEQ ID NO: 3575334 - RNA, 13 nt, Human
gaucucucaggag

SEQ ID NO: 3575335 - RNA, 16 nt, Human
gaucucucaggagcac

SEQ ID NO: 3575336 - RNA, 18 nt, Human
gaucucucaggagcacag

SEQ ID NO: 3575337 - RNA, 14 nt, Human
gaucucugaagcca

SEQ ID NO: 3575338 - RNA, 22 nt, Human
gaucucugggauuuaugcucau

SEQ ID NO: 3575339 - RNA, 12 nt, Human
gaucucuuccug

SEQ ID NO: 3575340 - RNA, 19 nt, Human
gaucucuugagccugggag

SEQ ID NO: 3575341 - RNA, 15 nt, Human
gaucugagaaucuuu

SEQ ID NO: 3575342 - RNA, 13 nt, Human
gaucugagggaga

SEQ ID NO: 3575343 - RNA, 16 nt, Human
gaucugauugaccgug

SEQ ID NO: 3575344 - RNA, 18 nt, Human
gaucugcccaucgugaag

SEQ ID NO: 3575345 - RNA, 19 nt, Human
gaucugcccaucgugaaga

SEQ ID NO: 3575346 - RNA, 14 nt, Human
gaucugccccuccc

SEQ ID NO: 3575347 - RNA, 12 nt, Human
gaucugccuaag

SEQ ID NO: 3575348 - RNA, 17 nt, Human
gaucugcggaucucagc

SEQ ID NO: 3575349 - RNA, 21 nt, Human
gaucugcggaucucagcuuug

SEQ ID NO: 3575350 - RNA, 16 nt, Human
gaucugcugcagagca

SEQ ID NO: 3575351 - RNA, 20 nt, Human
gaucuggaacccagacucag

SEQ ID NO: 3575352 - RNA, 12 nt, Human
gaucuggaaccu

SEQ ID NO: 3575353 - RNA, 16 nt, Human
gaucuggaaccucagc

SEQ ID NO: 3575354 - RNA, 19 nt, Human
gaucuggaaccucagccug

SEQ ID NO: 3575355 - RNA, 20 nt, Human
gaucuggaaccucagccugg

SEQ ID NO: 3575356 - RNA, 23 nt, Human
gaucuggaaccucagccuggcca

SEQ ID NO: 3575357 - RNA, 17 nt, Human
gaucugggaacucccaa

SEQ ID NO: 3575358 - RNA, 19 nt, Human
gaucugggaacucccaaga

SEQ ID NO: 3575359 - RNA, 22 nt, Human
gaucugguggucagcccuagga

SEQ ID NO: 3575360 - RNA, 18 nt, Human
gaucugguuuugcuauua

SEQ ID NO: 3575361 - RNA, 18 nt, Human
gaucugucacaccagcca

SEQ ID NO: 3575362 - RNA, 15 nt, Human
gaucuguccucagcc

SEQ ID NO: 3575363 - RNA, 16 nt, Human
gaucuguccucagccu

SEQ ID NO: 3575364 - RNA, 18 nt, Human
gaucuguccucagccuug

SEQ ID NO: 3575365 - RNA, 14 nt, Human
gaucugucuuguaa

SEQ ID NO: 3575366 - RNA, 19 nt, Human
gaucugugcccagagaugg

SEQ ID NO: 3575367 - RNA, 14 nt, Human
gaucugugccccau

SEQ ID NO: 3575368 - RNA, 23 nt, Human
gaucugugcuuuccagcucaccc

SEQ ID NO: 3575369 - RNA, 14 nt, Human
gaucuguugcaaac

SEQ ID NO: 3575370 - RNA, 20 nt, Human
gaucuguuguguacguggag

SEQ ID NO: 3575371 - RNA, 18 nt, Human
gaucuguuuugaaggcaa

SEQ ID NO: 3575372 - RNA, 23 nt, Human
gaucuguuuuuaaaaaucauaaa

SEQ ID NO: 3575373 - RNA, 19 nt, Human
gaucuuaaauuuugugaua

SEQ ID NO: 3575374 - RNA, 16 nt, Human
gaucuuauuuuucuaa

SEQ ID NO: 3575375 - RNA, 16 nt, Human
gaucuucaauggcuuu

SEQ ID NO: 3575376 - RNA, 14 nt, Human
gaucuucugaaaug

SEQ ID NO: 3575377 - RNA, 22 nt, Human
gaucuucuguggguuucuaaag

SEQ ID NO: 3575378 - RNA, 23 nt, Human
gaucuugaauguggucucaggau

SEQ ID NO: 3575379 - RNA, 19 nt, Human
gaucuugagcaaguuccuu

SEQ ID NO: 3575380 - RNA, 23 nt, Human
gaucuugaguauaagaaaugcau

SEQ ID NO: 3575381 - RNA, 20 nt, Human
gaucuugcucuaucucacag

SEQ ID NO: 3575382 - RNA, 19 nt, Human
gaucuuggcuuacugcagc

SEQ ID NO: 3575383 - RNA, 14 nt, Human
gaucuuuaaaauac

SEQ ID NO: 3575384 - RNA, 19 nt, Human
gaucuuucacccacagaaa

SEQ ID NO: 3575385 - RNA, 20 nt, Human
gaucuuucacccacagaaag

SEQ ID NO: 3575386 - RNA, 23 nt, Human
gaucuuucacccacagaaagaga

SEQ ID NO: 3575387 - RNA, 18 nt, Human
gaucuuucuuuccuuucu

SEQ ID NO: 3575388 - RNA, 11 nt, Human
gaucuuugugg

SEQ ID NO: 3575389 - RNA, 13 nt, Human
gaucuuuuaaagu

SEQ ID NO: 3575390 - RNA, 14 nt, Human
gaucuuuuauuuug

SEQ ID NO: 3575391 - RNA, 16 nt, Human
gaucuuuucaaguuaa

SEQ ID NO: 3575392 - RNA, 18 nt, Human
gaucuuuuguucccaucc

SEQ ID NO: 3575393 - RNA, 17 nt, Human
gaugaaaagcuuuguuu

SEQ ID NO: 3575394 - RNA, 15 nt, Human
gaugaaaauaaagaa

SEQ ID NO: 3575395 - RNA, 16 nt, Human
gaugaaaauaaagaau

SEQ ID NO: 3575396 - RNA, 16 nt, Human
gaugaaaauauuuaaa

SEQ ID NO: 3575397 - RNA, 17 nt, Human
gaugaaaauauuuaaag

SEQ ID NO: 3575398 - RNA, 22 nt, Human
gaugaaacuaaagcaauagaaa

SEQ ID NO: 3575399 - RNA, 17 nt, Human
gaugaaauuccauuugu

SEQ ID NO: 3575400 - RNA, 20 nt, Human
gaugaaccagccggggccuu

SEQ ID NO: 3575401 - RNA, 23 nt, Human
gaugaacccaggacgcuucugaa

SEQ ID NO: 3575402 - RNA, 17 nt, Human
gaugaacuuauucugua

SEQ ID NO: 3575403 - RNA, 19 nt, Human
gaugaagcaaacacauuaa

SEQ ID NO: 3575404 - RNA, 20 nt, Human
gaugaagcaaggaagauaua

SEQ ID NO: 3575405 - RNA, 16 nt, Human
gaugaagggcccgaga

SEQ ID NO: 3575406 - RNA, 15 nt, Human
gaugaaggucuguuu

SEQ ID NO: 3575407 - RNA, 17 nt, Human
gaugaaguuaucuggcu

SEQ ID NO: 3575408 - RNA, 19 nt, Human
gaugaaguuaucuggcuuc

SEQ ID NO: 3575409 - RNA, 14 nt, Human
gaugaauacauuuu

SEQ ID NO: 3575410 - RNA, 21 nt, Human
gaugaauagaaguuuuaaauu

SEQ ID NO: 3575411 - RNA, 15 nt, Human
gaugaaugccgugga

SEQ ID NO: 3575412 - RNA, 13 nt, Human
gaugaauguaugu

SEQ ID NO: 3575413 - RNA, 14 nt, Human
gaugaauguaugug

SEQ ID NO: 3575414 - RNA, 20 nt, Human
gaugacaacuggaauaguuu

SEQ ID NO: 3575415 - RNA, 16 nt, Human
gaugacaauaaagcuu

SEQ ID NO: 3575416 - RNA, 18 nt, Human
gaugacaugugacuccua

SEQ ID NO: 3575417 - RNA, 16 nt, Human
gaugacauugcuaaga

SEQ ID NO: 3575418 - RNA, 18 nt, Human
gaugacauugcuaagaug

SEQ ID NO: 3575419 - RNA, 18 nt, Human
gaugaccaauuuuaacuu

SEQ ID NO: 3575420 - RNA, 18 nt, Human
gaugaccagaacaagguu

SEQ ID NO: 3575421 - RNA, 16 nt, Human
gaugaccccuccccua

SEQ ID NO: 3575422 - RNA, 14 nt, Human
gaugaccccugccc

SEQ ID NO: 3575423 - RNA, 23 nt, Human
gaugacccugcgaaggggcccug

SEQ ID NO: 3575424 - RNA, 15 nt, Human
gaugacccuuuucau

SEQ ID NO: 3575425 - RNA, 15 nt, Human
gaugaccuggauaac

SEQ ID NO: 3575426 - RNA, 20 nt, Human
gaugaccuugaaugaugcca

SEQ ID NO: 3575427 - RNA, 21 nt, Human
gaugacgacgacaacgaugau

SEQ ID NO: 3575428 - RNA, 12 nt, Human
gaugacuaaaau

SEQ ID NO: 3575429 - RNA, 15 nt, Human
gaugacuaaaauauu

SEQ ID NO: 3575430 - RNA, 16 nt, Human
gaugacuagaggcagg

SEQ ID NO: 3575431 - RNA, 13 nt, Human
gaugacucaagau

SEQ ID NO: 3575432 - RNA, 14 nt, Human
gaugacucaagauu

SEQ ID NO: 3575433 - RNA, 21 nt, Human
gaugacucaagauucccagga

SEQ ID NO: 3575434 - RNA, 12 nt, Human
gaugacugaguc

SEQ ID NO: 3575435 - RNA, 13 nt, Human
gaugacuggaauu

SEQ ID NO: 3575436 - RNA, 22 nt, Human
gaugacuggaauuuuuauuaug

SEQ ID NO: 3575437 - RNA, 14 nt, Human
gaugacuggcauuu

SEQ ID NO: 3575438 - RNA, 18 nt, Human
gaugacuggcauuuuaua

SEQ ID NO: 3575439 - RNA, 20 nt, Human
gaugacuggcauuuuauaga

SEQ ID NO: 3575440 - RNA, 15 nt, Human
gaugacuguguugua

SEQ ID NO: 3575441 - RNA, 15 nt, Human
gaugagaacaaagcu

SEQ ID NO: 3575442 - RNA, 20 nt, Human
gaugagaauucagcugcccc

SEQ ID NO: 3575443 - RNA, 22 nt, Human
gaugagaauuucuaaaaagauu

SEQ ID NO: 3575444 - RNA, 23 nt, Human
gaugagacuuccaaaccugacag

SEQ ID NO: 3575445 - RNA, 14 nt, Human
gaugagagcccaga

SEQ ID NO: 3575446 - RNA, 17 nt, Human
gaugagagcccagaggu

SEQ ID NO: 3575447 - RNA, 21 nt, Human
gaugagagcccagagguaaca

SEQ ID NO: 3575448 - RNA, 16 nt, Human
gaugagaggaaaucac

SEQ ID NO: 3575449 - RNA, 21 nt, Human
gaugagcauuuagggcaagga

SEQ ID NO: 3575450 - RNA, 19 nt, Human
gaugagcccucagaacccu

SEQ ID NO: 3575451 - RNA, 22 nt, Human
gaugagcccucagaacccuugg

SEQ ID NO: 3575452 - RNA, 13 nt, Human
gaugagcucccac

SEQ ID NO: 3575453 - RNA, 18 nt, Human
gaugagcucccacaagcc

SEQ ID NO: 3575454 - RNA, 20 nt, Human
gaugagcuggaaggagugag

SEQ ID NO: 3575455 - RNA, 13 nt, Human
gaugaggcaaccc

SEQ ID NO: 3575456 - RNA, 13 nt, Human
gaugaggcagagg

SEQ ID NO: 3575457 - RNA, 13 nt, Human
gaugaggccagac

SEQ ID NO: 3575458 - RNA, 19 nt, Human
gaugaggcccuccacaccu

SEQ ID NO: 3575459 - RNA, 21 nt, Human
gaugaggcccuccacaccugc

SEQ ID NO: 3575460 - RNA, 22 nt, Human
gaugaggccgcuagaggccuga

SEQ ID NO: 3575461 - RNA, 12 nt, Human
gaugagggcagc

SEQ ID NO: 3575462 - RNA, 15 nt, Human
gaugagggcagcagc

SEQ ID NO: 3575463 - RNA, 18 nt, Human
gaugagggcagcagccag

SEQ ID NO: 3575464 - RNA, 14 nt, Human
gaugaggggaggaa

SEQ ID NO: 3575465 - RNA, 19 nt, Human
gaugaggucaguuguguuu

SEQ ID NO: 3575466 - RNA, 16 nt, Human
gaugagugagcaugcc

SEQ ID NO: 3575467 - RNA, 18 nt, Human
gaugaguguaacaagaaa

SEQ ID NO: 3575468 - RNA, 20 nt, Human
gaugaguguaacaagaaagg

SEQ ID NO: 3575469 - RNA, 18 nt, Human
gaugauaaauaugguuaa

SEQ ID NO: 3575470 - RNA, 18 nt, Human
gaugauacauccaaagca

SEQ ID NO: 3575471 - RNA, 19 nt, Human
gaugauacuaauaaacuaa

SEQ ID NO: 3575472 - RNA, 19 nt, Human
gaugaucaauccuuuauua

SEQ ID NO: 3575473 - RNA, 20 nt, Human
gaugaucagcuguuugucau

SEQ ID NO: 3575474 - RNA, 20 nt, Human
gaugauccccacgccacagc

SEQ ID NO: 3575475 - RNA, 21 nt, Human
gaugauccccacgccacagcc

SEQ ID NO: 3575476 - RNA, 16 nt, Human
gaugauccggauuuaa

SEQ ID NO: 3575477 - RNA, 21 nt, Human
gaugaucuacucagaaauuuu

SEQ ID NO: 3575478 - RNA, 14 nt, Human
gaugaucuuugcag

SEQ ID NO: 3575479 - RNA, 20 nt, Human
gaugaucuuugcagacaggc

SEQ ID NO: 3575480 - RNA, 23 nt, Human
gaugaugacgacgacaacgauga

SEQ ID NO: 3575481 - RNA, 14 nt, Human
gaugaugacuaugg

SEQ ID NO: 3575482 - RNA, 19 nt, Human
gaugaugccaaccucugga

SEQ ID NO: 3575483 - RNA, 17 nt, Human
gaugaugggaauugugu

SEQ ID NO: 3575484 - RNA, 22 nt, Human
gaugaugguugcaaaagacuaa

SEQ ID NO: 3575485 - RNA, 19 nt, Human
gaugauugaagaaacagcu

SEQ ID NO: 3575486 - RNA, 12 nt, Human
gaugauuucaga

SEQ ID NO: 3575487 - RNA, 14 nt, Human
gaugauuuccaagc

SEQ ID NO: 3575488 - RNA, 13 nt, Human
gaugauuucuaug

SEQ ID NO: 3575489 - RNA, 18 nt, Human
gaugauuuuuugaaaguu

SEQ ID NO: 3575490 - RNA, 19 nt, Human
gaugcaaggaccaggacuc

SEQ ID NO: 3575491 - RNA, 18 nt, Human
gaugcacagagaagcugg

SEQ ID NO: 3575492 - RNA, 15 nt, Human
gaugcacaucccugg

SEQ ID NO: 3575493 - RNA, 16 nt, Human
gaugcaccaccaagcc

SEQ ID NO: 3575494 - RNA, 13 nt, Human
gaugcaccagccc

SEQ ID NO: 3575495 - RNA, 22 nt, Human
gaugcacuucaaauucaaauaa

SEQ ID NO: 3575496 - RNA, 22 nt, Human
gaugcacuuugcuuuaauauaa

SEQ ID NO: 3575497 - RNA, 23 nt, Human
gaugcacuuugcuuuaauauaaa

SEQ ID NO: 3575498 - RNA, 16 nt, Human
gaugcagcauuaugau

SEQ ID NO: 3575499 - RNA, 12 nt, Human
gaugcagcauuu

SEQ ID NO: 3575500 - RNA, 15 nt, Human
gaugcagcauuugau

SEQ ID NO: 3575501 - RNA, 12 nt, Human
gaugcagccuca

SEQ ID NO: 3575502 - RNA, 22 nt, Human
gaugcaggcacuuauuguaaau

SEQ ID NO: 3575503 - RNA, 19 nt, Human
gaugcaggcuccccugagg

SEQ ID NO: 3575504 - RNA, 15 nt, Human
gaugcagggcaguca

SEQ ID NO: 3575505 - RNA, 17 nt, Human
gaugcagucuccucuuu

SEQ ID NO: 3575506 - RNA, 21 nt, Human
gaugcagucuccucuuuaaaa

SEQ ID NO: 3575507 - RNA, 23 nt, Human
gaugcaugugguuugguuccucu

SEQ ID NO: 3575508 - RNA, 20 nt, Human
gaugcauguugauuaaacuc

SEQ ID NO: 3575509 - RNA, 20 nt, Human
gaugcauguuuuccagcucc

SEQ ID NO: 3575510 - RNA, 21 nt, Human
gaugcauguuuuccagcuccu

SEQ ID NO: 3575511 - RNA, 15 nt, Human
gaugcauuaaaagaa

SEQ ID NO: 3575512 - RNA, 15 nt, Human
gaugcauuugggucc

SEQ ID NO: 3575513 - RNA, 16 nt, Human
gaugcauuugggucca

SEQ ID NO: 3575514 - RNA, 18 nt, Human
gaugcauuuggguccagg

SEQ ID NO: 3575515 - RNA, 21 nt, Human
gaugcauuuggguccaggagg

SEQ ID NO: 3575516 - RNA, 22 nt, Human
gaugccaaccucuggagcaaug

SEQ ID NO: 3575517 - RNA, 21 nt, Human
gaugccaagaaguuuaaggaa

SEQ ID NO: 3575518 - RNA, 22 nt, Human
gaugccaauacuagucacccca

SEQ ID NO: 3575519 - RNA, 17 nt, Human
gaugccacacagagugg

SEQ ID NO: 3575520 - RNA, 12 nt, Human
gaugccacccua

SEQ ID NO: 3575521 - RNA, 12 nt, Human
gaugccagccaa

SEQ ID NO: 3575522 - RNA, 11 nt, Human
gaugccaggac

SEQ ID NO: 3575523 - RNA, 18 nt, Human
gaugccaguuacuugcuu

SEQ ID NO: 3575524 - RNA, 18 nt, Human
gaugccaucuguguccug

SEQ ID NO: 3575525 - RNA, 21 nt, Human
gaugccaucuguguccugguu

SEQ ID NO: 3575526 - RNA, 20 nt, Human
gaugccauucuuccuugcaa

SEQ ID NO: 3575527 - RNA, 17 nt, Human
gaugcccacugaggaau

SEQ ID NO: 3575528 - RNA, 11 nt, Human
gaugcccagag

SEQ ID NO: 3575529 - RNA, 22 nt, Human
gaugcccagagggcccaggcag

SEQ ID NO: 3575530 - RNA, 23 nt, Human
gaugcccagagggcccaggcagg

SEQ ID NO: 3575531 - RNA, 20 nt, Human
gaugcccagggccacucugc

SEQ ID NO: 3575532 - RNA, 21 nt, Human
gaugcccagggccacucugcc

SEQ ID NO: 3575533 - RNA, 16 nt, Human
gaugccccagagcugu

SEQ ID NO: 3575534 - RNA, 16 nt, Human
gaugccccgucccccu

SEQ ID NO: 3575535 - RNA, 12 nt, Human
gaugcccugcua

SEQ ID NO: 3575536 - RNA, 19 nt, Human
gaugccucccugacccugc

SEQ ID NO: 3575537 - RNA, 22 nt, Human
gaugccucccugacccugcaga

SEQ ID NO: 3575538 - RNA, 15 nt, Human
gaugccuccuuccuc

SEQ ID NO: 3575539 - RNA, 14 nt, Human
gaugccugaacuug

SEQ ID NO: 3575540 - RNA, 15 nt, Human
gaugccugauugcca

SEQ ID NO: 3575541 - RNA, 21 nt, Human
gaugccuggcgggguggggug

SEQ ID NO: 3575542 - RNA, 15 nt, Human
gaugccugguggcag

SEQ ID NO: 3575543 - RNA, 16 nt, Human
gaugccugguggcagc

SEQ ID NO: 3575544 - RNA, 17 nt, Human
gaugccugguggcagcu

SEQ ID NO: 3575545 - RNA, 22 nt, Human
gaugccuuuuuuguaguuuuuu

SEQ ID NO: 3575546 - RNA, 22 nt, Human
gaugcgagcgcuaucuucacau

SEQ ID NO: 3575547 - RNA, 22 nt, Human
gaugcggccauucaaggggagc

SEQ ID NO: 3575548 - RNA, 20 nt, Human
gaugcgggccagugcuccag

SEQ ID NO: 3575549 - RNA, 22 nt, Human
gaugcgggccagugcuccagcc

SEQ ID NO: 3575550 - RNA, 18 nt, Human
gaugcguuguuacaggaa

SEQ ID NO: 3575551 - RNA, 20 nt, Human
gaugcguuguuacaggaagu

SEQ ID NO: 3575552 - RNA, 15 nt, Human
gaugcuacuaagaaa

SEQ ID NO: 3575553 - RNA, 16 nt, Human
gaugcuagaacucccu

SEQ ID NO: 3575554 - RNA, 20 nt, Human
gaugcuagaacucccuuuca

SEQ ID NO: 3575555 - RNA, 22 nt, Human
gaugcuagaacucccuuucaac

SEQ ID NO: 3575556 - RNA, 18 nt, Human
gaugcuauggucagguua

SEQ ID NO: 3575557 - RNA, 14 nt, Human
gaugcuauuugcaa

SEQ ID NO: 3575558 - RNA, 14 nt, Human
gaugcucacagggc

SEQ ID NO: 3575559 - RNA, 16 nt, Human
gaugcuccaagauucu

SEQ ID NO: 3575560 - RNA, 19 nt, Human
gaugcuccaagauucuaga

SEQ ID NO: 3575561 - RNA, 22 nt, Human
gaugcuccaagauucuagauga

SEQ ID NO: 3575562 - RNA, 17 nt, Human
gaugcuccagccaaccc

SEQ ID NO: 3575563 - RNA, 14 nt, Human
gaugcucuuuccca

SEQ ID NO: 3575564 - RNA, 20 nt, Human
gaugcugaaacaggagagaa

SEQ ID NO: 3575565 - RNA, 20 nt, Human
gaugcugacauucaccugcc

SEQ ID NO: 3575566 - RNA, 13 nt, Human
gaugcugauguuc

SEQ ID NO: 3575567 - RNA, 12 nt, Human
gaugcugccuga

SEQ ID NO: 3575568 - RNA, 22 nt, Human
gaugcugcuuccgguagggagg

SEQ ID NO: 3575569 - RNA, 20 nt, Human
gaugcuggagaagagaggag

SEQ ID NO: 3575570 - RNA, 21 nt, Human
gaugcuggagaagagaggaga

SEQ ID NO: 3575571 - RNA, 18 nt, Human
gaugcuggaugcuccuuc

SEQ ID NO: 3575572 - RNA, 17 nt, Human
gaugcuggaugucugcc

SEQ ID NO: 3575573 - RNA, 15 nt, Human
gaugcuggcccaggg

SEQ ID NO: 3575574 - RNA, 21 nt, Human
gaugcuggcccagggcccaga

SEQ ID NO: 3575575 - RNA, 19 nt, Human
gaugcugggaguucuaaca

SEQ ID NO: 3575576 - RNA, 21 nt, Human
gaugcugggcacuucaucuga

SEQ ID NO: 3575577 - RNA, 12 nt, Human
gaugcugggcug

SEQ ID NO: 3575578 - RNA, 17 nt, Human
gaugcugggcuggcucc

SEQ ID NO: 3575579 - RNA, 14 nt, Human
gaugcugggcuggg

SEQ ID NO: 3575580 - RNA, 15 nt, Human
gaugcugggcugggu

SEQ ID NO: 3575581 - RNA, 20 nt, Human
gaugcugguaauggccaugg

SEQ ID NO: 3575582 - RNA, 20 nt, Human
gaugcuggucauguguuuga

SEQ ID NO: 3575583 - RNA, 19 nt, Human
gaugcuguaacuuaaaaua

SEQ ID NO: 3575584 - RNA, 18 nt, Human
gaugcuguagacaucugu

SEQ ID NO: 3575585 - RNA, 21 nt, Human
gaugcugucuucguacuggga

SEQ ID NO: 3575586 - RNA, 16 nt, Human
gaugcugugcuaugaa

SEQ ID NO: 3575587 - RNA, 17 nt, Human
gaugcuguguauauggu

SEQ ID NO: 3575588 - RNA, 13 nt, Human
gaugcuguuugac

SEQ ID NO: 3575589 - RNA, 20 nt, Human
gaugcuuagagggauuucuu

SEQ ID NO: 3575590 - RNA, 17 nt, Human
gaugcuucuucagagac

SEQ ID NO: 3575591 - RNA, 21 nt, Human
gaugcuucuucagagacuccu

SEQ ID NO: 3575592 - RNA, 21 nt, Human
gaugcuuguaacaagaaaaca

SEQ ID NO: 3575593 - RNA, 22 nt, Human
gauggaaaaaccacccccaaau

SEQ ID NO: 3575594 - RNA, 18 nt, Human
gauggaaaaacugaggcu

SEQ ID NO: 3575595 - RNA, 17 nt, Human
gauggaaaaggaagacu

SEQ ID NO: 3575596 - RNA, 18 nt, Human
gauggaaaaguguccuuc

SEQ ID NO: 3575597 - RNA, 17 nt, Human
gauggaaaauucauuuu

SEQ ID NO: 3575598 - RNA, 17 nt, Human
gauggaaccgcaggaag

SEQ ID NO: 3575599 - RNA, 19 nt, Human
gauggaaccgcaggaagcu

SEQ ID NO: 3575600 - RNA, 21 nt, Human
gauggaaguugcagugagcug

SEQ ID NO: 3575601 - RNA, 13 nt, Human
gauggaauuuuuu

SEQ ID NO: 3575602 - RNA, 23 nt, Human
gauggagacugguccugugugca

SEQ ID NO: 3575603 - RNA, 14 nt, Human
gauggagagagggg

SEQ ID NO: 3575604 - RNA, 16 nt, Human
gauggagagaggggaa

SEQ ID NO: 3575605 - RNA, 20 nt, Human
gauggagccagcucugcauu

SEQ ID NO: 3575606 - RNA, 14 nt, Human
gauggagcccaggc

SEQ ID NO: 3575607 - RNA, 19 nt, Human
gauggagcccaggcgggag

SEQ ID NO: 3575608 - RNA, 16 nt, Human
gauggagcgcaccugc

SEQ ID NO: 3575609 - RNA, 14 nt, Human
gauggaggagaaga

SEQ ID NO: 3575610 - RNA, 19 nt, Human
gauggagguucucucggag

SEQ ID NO: 3575611 - RNA, 18 nt, Human
gauggaguccagggaaga

SEQ ID NO: 3575612 - RNA, 18 nt, Human
gauggaguucuugugcca

SEQ ID NO: 3575613 - RNA, 15 nt, Human
gauggaguuucuaag

SEQ ID NO: 3575614 - RNA, 19 nt, Human
gauggauauauguuuuuga

SEQ ID NO: 3575615 - RNA, 23 nt, Human
gauggaugccaauauuaaaucug

SEQ ID NO: 3575616 - RNA, 15 nt, Human
gauggauuugaagca

SEQ ID NO: 3575617 - RNA, 16 nt, Human
gauggcaacagaucug

SEQ ID NO: 3575618 - RNA, 22 nt, Human
gauggcaacagaucuggaaccu

SEQ ID NO: 3575619 - RNA, 14 nt, Human
gauggcaccagagg

SEQ ID NO: 3575620 - RNA, 13 nt, Human
gauggcaggaugg

SEQ ID NO: 3575621 - RNA, 17 nt, Human
gauggcaggauggccug

SEQ ID NO: 3575622 - RNA, 18 nt, Human
gauggcaggauggccugg

SEQ ID NO: 3575623 - RNA, 13 nt, Human
gauggccagcccc

SEQ ID NO: 3575624 - RNA, 12 nt, Human
gauggccagugu

SEQ ID NO: 3575625 - RNA, 22 nt, Human
gauggcccauucuacuugcucu

SEQ ID NO: 3575626 - RNA, 12 nt, Human
gauggccccagc

SEQ ID NO: 3575627 - RNA, 14 nt, Human
gauggccccagcac

SEQ ID NO: 3575628 - RNA, 15 nt, Human
gauggccccagcaca

SEQ ID NO: 3575629 - RNA, 21 nt, Human
gauggccgcagggcugugcac

SEQ ID NO: 3575630 - RNA, 18 nt, Human
gauggccggagaggaccg

SEQ ID NO: 3575631 - RNA, 13 nt, Human
gauggccugagaa

SEQ ID NO: 3575632 - RNA, 14 nt, Human
gauggccuggccag

SEQ ID NO: 3575633 - RNA, 17 nt, Human
gauggccuuaauuuccu

SEQ ID NO: 3575634 - RNA, 15 nt, Human
gauggcucagagggg

SEQ ID NO: 3575635 - RNA, 18 nt, Human
gauggcucccaggggcuc

SEQ ID NO: 3575636 - RNA, 12 nt, Human
gauggcuccucu

SEQ ID NO: 3575637 - RNA, 19 nt, Human
gauggcuggaaggggucca

SEQ ID NO: 3575638 - RNA, 13 nt, Human
gauggcugugccu

SEQ ID NO: 3575639 - RNA, 18 nt, Human
gauggcugugccucugcc

SEQ ID NO: 3575640 - RNA, 15 nt, Human
gauggcuugucuaua

SEQ ID NO: 3575641 - RNA, 21 nt, Human
gauggcuuugaaugcggccca

SEQ ID NO: 3575642 - RNA, 20 nt, Human
gaugggagggaggcucaggu

SEQ ID NO: 3575643 - RNA, 20 nt, Human
gaugggcauaugugucagug

SEQ ID NO: 3575644 - RNA, 20 nt, Human
gaugggcaugguguucuccu

SEQ ID NO: 3575645 - RNA, 14 nt, Human
gaugggcuuucucu

SEQ ID NO: 3575646 - RNA, 16 nt, Human
gauggggaccagcagc

SEQ ID NO: 3575647 - RNA, 18 nt, Human
gauggggaccagcagccc

SEQ ID NO: 3575648 - RNA, 11 nt, Human
gauggggaggg

SEQ ID NO: 3575649 - RNA, 22 nt, Human
gauggggauaaaaugacuacuu

SEQ ID NO: 3575650 - RNA, 13 nt, Human
gauggggccacag

SEQ ID NO: 3575651 - RNA, 13 nt, Human
gauggggcccugc

SEQ ID NO: 3575652 - RNA, 13 nt, Human
gauggggccucug

SEQ ID NO: 3575653 - RNA, 12 nt, Human
gauggggcuccc

SEQ ID NO: 3575654 - RNA, 19 nt, Human
gauggggcucccgcccgug

SEQ ID NO: 3575655 - RNA, 13 nt, Human
gauggggcugcac

SEQ ID NO: 3575656 - RNA, 19 nt, Human
gaugggggaacucagaucc

SEQ ID NO: 3575657 - RNA, 15 nt, Human
gaugggggaugcuuc

SEQ ID NO: 3575658 - RNA, 23 nt, Human
gauggggucucacaguguugccc

SEQ ID NO: 3575659 - RNA, 21 nt, Human
gaugggucuggcugagcugaa

SEQ ID NO: 3575660 - RNA, 22 nt, Human
gaugggucugguuugcagagcu

SEQ ID NO: 3575661 - RNA, 21 nt, Human
gauggguucuaauuuuggaug

SEQ ID NO: 3575662 - RNA, 18 nt, Human
gauggguuuuaugagaug

SEQ ID NO: 3575663 - RNA, 19 nt, Human
gaugguacgugacccucug

SEQ ID NO: 3575664 - RNA, 14 nt, Human
gauggucagcuccc

SEQ ID NO: 3575665 - RNA, 13 nt, Human
gauggucauccag

SEQ ID NO: 3575666 - RNA, 13 nt, Human
gauggugggaugu

SEQ ID NO: 3575667 - RNA, 17 nt, Human
gauggugggaugugguu

SEQ ID NO: 3575668 - RNA, 21 nt, Human
gauggugucucuucuuuagaa

SEQ ID NO: 3575669 - RNA, 15 nt, Human
gauggugugccuucc

SEQ ID NO: 3575670 - RNA, 17 nt, Human
gauggugugccuuccag

SEQ ID NO: 3575671 - RNA, 17 nt, Human
gaugguguggguguccu

SEQ ID NO: 3575672 - RNA, 17 nt, Human
gaugguuacacuguuag

SEQ ID NO: 3575673 - RNA, 14 nt, Human
gaugguuucuugca

SEQ ID NO: 3575674 - RNA, 16 nt, Human
gaugguuuuaaacuuu

SEQ ID NO: 3575675 - RNA, 18 nt, Human
gauguaaaagacuuuuuu

SEQ ID NO: 3575676 - RNA, 17 nt, Human
gauguaaaaucuuguca

SEQ ID NO: 3575677 - RNA, 20 nt, Human
gauguaaaaucuugucaugu

SEQ ID NO: 3575678 - RNA, 19 nt, Human
gauguaaacagugccugcu

SEQ ID NO: 3575679 - RNA, 23 nt, Human
gauguaaauaaccccauucuuug

SEQ ID NO: 3575680 - RNA, 13 nt, Human
gauguaauacuuc

SEQ ID NO: 3575681 - RNA, 21 nt, Human
gauguaaucucucugcagcug

SEQ ID NO: 3575682 - RNA, 23 nt, Human
gauguaaucucucugcagcugcc

SEQ ID NO: 3575683 - RNA, 11 nt, Human
gauguaauuga

SEQ ID NO: 3575684 - RNA, 23 nt, Human
gauguaauuuaggguacuaaauu

SEQ ID NO: 3575685 - RNA, 17 nt, Human
gauguacaguugggaaa

SEQ ID NO: 3575686 - RNA, 18 nt, Human
gauguacucuaaauacug

SEQ ID NO: 3575687 - RNA, 15 nt, Human
gauguagauuuauuu

SEQ ID NO: 3575688 - RNA, 13 nt, Human
gauguaggaggga

SEQ ID NO: 3575689 - RNA, 17 nt, Human
gauguaggcauucugga

SEQ ID NO: 3575690 - RNA, 21 nt, Human
gauguaggguaaggugccuuc

SEQ ID NO: 3575691 - RNA, 14 nt, Human
gauguauauuccuu

SEQ ID NO: 3575692 - RNA, 21 nt, Human
gauguauauuccuuugaagau

SEQ ID NO: 3575693 - RNA, 20 nt, Human
gauguaucgggaagauuucu

SEQ ID NO: 3575694 - RNA, 22 nt, Human
gauguaucgggaagauuucuaa

SEQ ID NO: 3575695 - RNA, 21 nt, Human
gauguaucugaguugccaaga

SEQ ID NO: 3575696 - RNA, 22 nt, Human
gauguaugaaggcuuuuggucu

SEQ ID NO: 3575697 - RNA, 20 nt, Human
gauguaugaauacagcagca

SEQ ID NO: 3575698 - RNA, 16 nt, Human
gauguauuuugugagu

SEQ ID NO: 3575699 - RNA, 15 nt, Human
gaugucaauuucugu

SEQ ID NO: 3575700 - RNA, 20 nt, Human
gaugucaucagagcuccucu

SEQ ID NO: 3575701 - RNA, 17 nt, Human
gauguccacagaugccu

SEQ ID NO: 3575702 - RNA, 20 nt, Human
gauguccacagaugccucca

SEQ ID NO: 3575703 - RNA, 20 nt, Human
gauguccagaagaauauuca

SEQ ID NO: 3575704 - RNA, 17 nt, Human
gaugucccaacuuguaa

SEQ ID NO: 3575705 - RNA, 13 nt, Human
gauguccccagca

SEQ ID NO: 3575706 - RNA, 19 nt, Human
gaugucccugggccagggu

SEQ ID NO: 3575707 - RNA, 21 nt, Human
gaugucccugggccagggucu

SEQ ID NO: 3575708 - RNA, 22 nt, Human
gaugucccugggccagggucug

SEQ ID NO: 3575709 - RNA, 20 nt, Human
gaugucccuugaugcacaga

SEQ ID NO: 3575710 - RNA, 21 nt, Human
gaugucccuugaugcacagag

SEQ ID NO: 3575711 - RNA, 22 nt, Human
gaugucccuugaugcacagaga

SEQ ID NO: 3575712 - RNA, 21 nt, Human
gaugucugccaauuuuugccu

SEQ ID NO: 3575713 - RNA, 20 nt, Human
gaugucuguuugcugauggu

SEQ ID NO: 3575714 - RNA, 20 nt, Human
gaugucuuauuuuuagaugg

SEQ ID NO: 3575715 - RNA, 22 nt, Human
gaugucuuggaacauuggaaug

SEQ ID NO: 3575716 - RNA, 12 nt, Human
gaugucuuuguu

SEQ ID NO: 3575717 - RNA, 18 nt, Human
gaugucuuuuauagugga

SEQ ID NO: 3575718 - RNA, 16 nt, Human
gaugucuuuuuauuaa

SEQ ID NO: 3575719 - RNA, 14 nt, Human
gaugugaacacauc

SEQ ID NO: 3575720 - RNA, 13 nt, Human
gaugugaagccaa

SEQ ID NO: 3575721 - RNA, 23 nt, Human
gaugugaagccaauucagacagg

SEQ ID NO: 3575722 - RNA, 23 nt, Human
gaugugaauugccugcagagaga

SEQ ID NO: 3575723 - RNA, 19 nt, Human
gaugugaguugcacagcua

SEQ ID NO: 3575724 - RNA, 19 nt, Human
gaugugauauauuccuaaa

SEQ ID NO: 3575725 - RNA, 15 nt, Human
gaugugauuguggaa

SEQ ID NO: 3575726 - RNA, 16 nt, Human
gaugugcaauugauuu

SEQ ID NO: 3575727 - RNA, 14 nt, Human
gaugugcagcagau

SEQ ID NO: 3575728 - RNA, 21 nt, Human
gaugugcagcagauuggaagg

SEQ ID NO: 3575729 - RNA, 23 nt, Human
gaugugcagcagauuggaaggag

SEQ ID NO: 3575730 - RNA, 18 nt, Human
gaugugcagcauuucacu

SEQ ID NO: 3575731 - RNA, 15 nt, Human
gaugugcaugggagc

SEQ ID NO: 3575732 - RNA, 21 nt, Human
gaugugcauuuuugugaaaug

SEQ ID NO: 3575733 - RNA, 19 nt, Human
gaugugccugcuucagccu

SEQ ID NO: 3575734 - RNA, 15 nt, Human
gaugugcugcagugc

SEQ ID NO: 3575735 - RNA, 15 nt, Human
gaugugcugcuuuga

SEQ ID NO: 3575736 - RNA, 14 nt, Human
gaugugcuuaacag

SEQ ID NO: 3575737 - RNA, 19 nt, Human
gaugugcuuguuaacugag

SEQ ID NO: 3575738 - RNA, 23 nt, Human
gauguggaaaagccaagaggcug

SEQ ID NO: 3575739 - RNA, 21 nt, Human
gauguggaacugcugccacug

SEQ ID NO: 3575740 - RNA, 16 nt, Human
gauguggagccaggcg

SEQ ID NO: 3575741 - RNA, 18 nt, Human
gauguggagccaggcgug

SEQ ID NO: 3575742 - RNA, 21 nt, Human
gauguggcuacugacauaucu

SEQ ID NO: 3575743 - RNA, 16 nt, Human
gaugugggggaagacc

SEQ ID NO: 3575744 - RNA, 18 nt, Human
gauguggucacagcugua

SEQ ID NO: 3575745 - RNA, 15 nt, Human
gauguggugccugag

SEQ ID NO: 3575746 - RNA, 17 nt, Human
gauguguaauuuuucug

SEQ ID NO: 3575747 - RNA, 22 nt, Human
gauguguacaucccauguaaca

SEQ ID NO: 3575748 - RNA, 19 nt, Human
gauguguccugacacugca

SEQ ID NO: 3575749 - RNA, 14 nt, Human
gauguguucuuauu

SEQ ID NO: 3575750 - RNA, 14 nt, Human
gauguguugugaua

SEQ ID NO: 3575751 - RNA, 14 nt, Human
gauguguuugcuuu

SEQ ID NO: 3575752 - RNA, 18 nt, Human
gauguuaacacauuuugu

SEQ ID NO: 3575753 - RNA, 21 nt, Human
gauguuauauuuuucuuaaaa

SEQ ID NO: 3575754 - RNA, 20 nt, Human
gauguuauguaaaaggccaa

SEQ ID NO: 3575755 - RNA, 19 nt, Human
gauguucuaaggcucugag

SEQ ID NO: 3575756 - RNA, 20 nt, Human
gauguucuaaggcucugaga

SEQ ID NO: 3575757 - RNA, 19 nt, Human
gauguucuaagucuuucca

SEQ ID NO: 3575758 - RNA, 19 nt, Human
gauguucucuaucauuuaa

SEQ ID NO: 3575759 - RNA, 14 nt, Human
gauguucugggaca

SEQ ID NO: 3575760 - RNA, 16 nt, Human
gauguucugggacaca

SEQ ID NO: 3575761 - RNA, 20 nt, Human
gauguugaagaauacaguua

SEQ ID NO: 3575762 - RNA, 19 nt, Human
gauguugacaucacuggca

SEQ ID NO: 3575763 - RNA, 14 nt, Human
gauguugaugcaau

SEQ ID NO: 3575764 - RNA, 13 nt, Human
gauguugccaugu

SEQ ID NO: 3575765 - RNA, 17 nt, Human
gauguugccauguguuu

SEQ ID NO: 3575766 - RNA, 14 nt, Human
gauguuggcuggga

SEQ ID NO: 3575767 - RNA, 19 nt, Human
gauguuuauucuucuagag

SEQ ID NO: 3575768 - RNA, 12 nt, Human
gauguuuccaga

SEQ ID NO: 3575769 - RNA, 13 nt, Human
gauguuuccagac

SEQ ID NO: 3575770 - RNA, 19 nt, Human
gauguuuccagacuuccuu

SEQ ID NO: 3575771 - RNA, 18 nt, Human
gauguuucuuuuguaugu

SEQ ID NO: 3575772 - RNA, 14 nt, Human
gauguuugcccaaa

SEQ ID NO: 3575773 - RNA, 14 nt, Human
gauguuugugcagu

SEQ ID NO: 3575774 - RNA, 16 nt, Human
gauguuuguggccuca

SEQ ID NO: 3575775 - RNA, 18 nt, Human
gauguuuguggccucaga

SEQ ID NO: 3575776 - RNA, 13 nt, Human
gauguuuuaauuc

SEQ ID NO: 3575777 - RNA, 18 nt, Human
gauguuuuaauuccauga

SEQ ID NO: 3575778 - RNA, 14 nt, Human
gauguuuuauuauu

SEQ ID NO: 3575779 - RNA, 14 nt, Human
gauguuuuccauga

SEQ ID NO: 3575780 - RNA, 15 nt, Human
gauguuuuccaugag

SEQ ID NO: 3575781 - RNA, 15 nt, Human
gauguuuuucuuacc

SEQ ID NO: 3575782 - RNA, 14 nt, Human
gauuaaacuuauga

SEQ ID NO: 3575783 - RNA, 19 nt, Human
gauuaaauacauauggaug

SEQ ID NO: 3575784 - RNA, 20 nt, Human
gauuaaauacauauggaugu

SEQ ID NO: 3575785 - RNA, 20 nt, Human
gauuaaauauagauuagaaa

SEQ ID NO: 3575786 - RNA, 14 nt, Human
gauuaacaaauaug

SEQ ID NO: 3575787 - RNA, 18 nt, Human
gauuaaccacuucagcug

SEQ ID NO: 3575788 - RNA, 14 nt, Human
gauuaaccucugca

SEQ ID NO: 3575789 - RNA, 17 nt, Human
gauuaaccucugcacua

SEQ ID NO: 3575790 - RNA, 13 nt, Human
gauuaagagccau

SEQ ID NO: 3575791 - RNA, 18 nt, Human
gauuaaggucucucuuug

SEQ ID NO: 3575792 - RNA, 17 nt, Human
gauuaaggugaugugau

SEQ ID NO: 3575793 - RNA, 14 nt, Human
gauuaauaugaaaa

SEQ ID NO: 3575794 - RNA, 18 nt, Human
gauuaauaugaaaacuua

SEQ ID NO: 3575795 - RNA, 14 nt, Human
gauuaauggcacug

SEQ ID NO: 3575796 - RNA, 16 nt, Human
gauuaauggcacugau

SEQ ID NO: 3575797 - RNA, 15 nt, Human
gauuaauuaaaugca

SEQ ID NO: 3575798 - RNA, 21 nt, Human
gauuaauuucugccauuucau

SEQ ID NO: 3575799 - RNA, 19 nt, Human
gauuacaaaucagaaguca

SEQ ID NO: 3575800 - RNA, 20 nt, Human
gauuacaaaucagaagucau

SEQ ID NO: 3575801 - RNA, 13 nt, Human
gauuacaagcgug

SEQ ID NO: 3575802 - RNA, 20 nt, Human
gauuacaggcaugagccacu

SEQ ID NO: 3575803 - RNA, 14 nt, Human
gauuacaggcguga

SEQ ID NO: 3575804 - RNA, 20 nt, Human
gauuacaggugugagccacc

SEQ ID NO: 3575805 - RNA, 22 nt, Human
gauuacaggugugagccaccac

SEQ ID NO: 3575806 - RNA, 22 nt, Human
gauucuuccagaugugaugcuu

SEQ ID NO: 3575807 - RNA, 14 nt, Human
gauucuuccaucug

SEQ ID NO: 3575808 - RNA, 12 nt, Human
gauucuucugcu

SEQ ID NO: 3575809 - RNA, 16 nt, Human
gauucuucuguguuua

SEQ ID NO: 3575810 - RNA, 20 nt, Human
gauucuucuguguuuauaaa

SEQ ID NO: 3575811 - RNA, 21 nt, Human
gauucuuguauuuauuacaac

SEQ ID NO: 3575812 - RNA, 15 nt, Human
gauucuuguuuugcu

SEQ ID NO: 3575813 - RNA, 20 nt, Human
gauucuuguuuugcuucccc

SEQ ID NO: 3575814 - RNA, 19 nt, Human
gauucuuuccauuugcauu

SEQ ID NO: 3575815 - RNA, 22 nt, Human
gauucuuuccauuugcauuugu

SEQ ID NO: 3575816 - RNA, 12 nt, Human
gauucuuuccug

SEQ ID NO: 3575817 - RNA, 18 nt, Human
gauucuuuccugaggcug

SEQ ID NO: 3575818 - RNA, 19 nt, Human
gauucuuuuaaauuagaaa

SEQ ID NO: 3575819 - RNA, 20 nt, Human
gauucuuuuaaauuagaaaa

SEQ ID NO: 3575820 - RNA, 20 nt, Human
gauugaaaacuuuucucaga

SEQ ID NO: 3575821 - RNA, 17 nt, Human
gauugaaaauaaugcug

SEQ ID NO: 3575822 - RNA, 15 nt, Human
gauugaaaauucgcc

SEQ ID NO: 3575823 - RNA, 15 nt, Human
gauugaacuccaaga

SEQ ID NO: 3575824 - RNA, 17 nt, Human
gauugaagaaacagcua

SEQ ID NO: 3575825 - RNA, 21 nt, Human
gauugaaguauuuugcuggaa

SEQ ID NO: 3575826 - RNA, 17 nt, Human
gauugacagcuuugcug

SEQ ID NO: 3575827 - RNA, 20 nt, Human
gauugacaguaacuugguua

SEQ ID NO: 3575828 - RNA, 24 nt, Human
gauugaccguguuggucuguacug

SEQ ID NO: 3575829 - RNA, 18 nt, Human
gauugaccugcuccgcug

SEQ ID NO: 3575830 - RNA, 23 nt, Human
gauugaccugcuccgcugcuccu

SEQ ID NO: 3575831 - RNA, 13 nt, Human
gauugagaaggag

SEQ ID NO: 3575832 - RNA, 17 nt, Human
gauugagaaggagagaa

SEQ ID NO: 3575833 - RNA, 17 nt, Human
gauugagcucucugccc

SEQ ID NO: 3575834 - RNA, 16 nt, Human
gauugagucugugcca

SEQ ID NO: 3575835 - RNA, 22 nt, Human
gauugaucggagccuccucucu

SEQ ID NO: 3575836 - RNA, 17 nt, Human
gauugauuaccuaguag

SEQ ID NO: 3575837 - RNA, 20 nt, Human
gauugauuuuaaaauguaca

SEQ ID NO: 3575838 - RNA, 22 nt, Human
gauugcaauuugcacaaguuuu

SEQ ID NO: 3575839 - RNA, 23 nt, Human
gauugcaccacugcacuccagcc

SEQ ID NO: 3575840 - RNA, 13 nt, Human
gauugcagaauug

SEQ ID NO: 3575841 - RNA, 14 nt, Human
gauugccucugaaa

SEQ ID NO: 3575842 - RNA, 20 nt, Human
gauugcgagagauguguguu

SEQ ID NO: 3575843 - RNA, 19 nt, Human
gauugcgguuuacagcuau

SEQ ID NO: 3575844 - RNA, 13 nt, Human
gauugcuaaaugu

SEQ ID NO: 3575845 - RNA, 22 nt, Human
gauugcugccacuuuuuaacua

SEQ ID NO: 3575846 - RNA, 16 nt, Human
gauugcugccccauca

SEQ ID NO: 3575847 - RNA, 20 nt, Human
gauugcugccccaucagugc

SEQ ID NO: 3575848 - RNA, 23 nt, Human
gauugcuguguguugccugggac

SEQ ID NO: 3575849 - RNA, 19 nt, Human
gauugcuugagcccaggag

SEQ ID NO: 3575850 - RNA, 19 nt, Human
gauuggaaggagacacaga

SEQ ID NO: 3575851 - RNA, 23 nt, Human
gauuggacauaacugacuuaguu

SEQ ID NO: 3575852 - RNA, 22 nt, Human
gauuggagauagggaaagaaag

SEQ ID NO: 3575853 - RNA, 15 nt, Human
gauuggauuauucau

SEQ ID NO: 3575854 - RNA, 13 nt, Human
gauuggauuauuu

SEQ ID NO: 3575855 - RNA, 13 nt, Human
gauuggcauggcu

SEQ ID NO: 3575856 - RNA, 23 nt, Human
gauuggccuguagaguugcugag

SEQ ID NO: 3575857 - RNA, 22 nt, Human
gauuggcucacccaagcaaggc

SEQ ID NO: 3575858 - RNA, 16 nt, Human
gauuggcuuguagaau

SEQ ID NO: 3575859 - RNA, 15 nt, Human
gauugggaauaaaua

SEQ ID NO: 3575860 - RNA, 23 nt, Human
gauugggaauaaauaugccucuc

SEQ ID NO: 3575861 - RNA, 20 nt, Human
gauugggcacaucauuucaa

SEQ ID NO: 3575862 - RNA, 20 nt, Human
gauuggggaagacuguggcu

SEQ ID NO: 3575863 - RNA, 15 nt, Human
gauuggggaauuaaa

SEQ ID NO: 3575864 - RNA, 18 nt, Human
gauuggguuaugaauauu

SEQ ID NO: 3575865 - RNA, 17 nt, Human
gauugguguuuuuuucu

SEQ ID NO: 3575866 - RNA, 20 nt, Human
gauugguguuuuuuucuaug

SEQ ID NO: 3575867 - RNA, 21 nt, Human
gauugguuuuaauugaaggaa

SEQ ID NO: 3575868 - RNA, 13 nt, Human
gauuguauugcug

SEQ ID NO: 3575869 - RNA, 20 nt, Human
gauuguauuguugaaaaagu

SEQ ID NO: 3575870 - RNA, 20 nt, Human
gauuguccuuuaaaaaagaa

SEQ ID NO: 3575871 - RNA, 17 nt, Human
gauugugucccauuccc

SEQ ID NO: 3575872 - RNA, 18 nt, Human
gauugugucccauucccc

SEQ ID NO: 3575873 - RNA, 20 nt, Human
gauugugucccauuccccca

SEQ ID NO: 3575874 - RNA, 20 nt, Human
gauugugucucuugguccug

SEQ ID NO: 3575875 - RNA, 21 nt, Human
gauugugugguguuuuggauu

SEQ ID NO: 3575876 - RNA, 14 nt, Human
gauuguuaaaauaa

SEQ ID NO: 3575877 - RNA, 13 nt, Human
gauuguucaucau

SEQ ID NO: 3575878 - RNA, 13 nt, Human
gauuguuguuugc

SEQ ID NO: 3575879 - RNA, 11 nt, Human
gauuguuuaaa

SEQ ID NO: 3575880 - RNA, 18 nt, Human
gauuguuuccucuuccaa

SEQ ID NO: 3575881 - RNA, 18 nt, Human
gauuguuucuauacaaau

SEQ ID NO: 3575882 - RNA, 11 nt, Human
gauuguuugca

SEQ ID NO: 3575883 - RNA, 15 nt, Human
gauuuaaaacaugua

SEQ ID NO: 3575884 - RNA, 15 nt, Human
gauuuaaaagggaag

SEQ ID NO: 3575885 - RNA, 15 nt, Human
gauuuaaacacacag

SEQ ID NO: 3575886 - RNA, 17 nt, Human
gauuuaaacucugaauu

SEQ ID NO: 3575887 - RNA, 17 nt, Human
gauuuaacagaaaugua

SEQ ID NO: 3575888 - RNA, 22 nt, Human
gauuuaagggauggaaaaggaa

SEQ ID NO: 3575889 - RNA, 20 nt, Human
gauuuaaguuacaauguuuu

SEQ ID NO: 3575890 - RNA, 14 nt, Human
gauuuaauaaaaua

SEQ ID NO: 3575891 - RNA, 15 nt, Human
gauuuaauaaaauaa

SEQ ID NO: 3575892 - RNA, 23 nt, Human
gauuuaauaaaauaauucuaaag

SEQ ID NO: 3575893 - RNA, 16 nt, Human
gauuuaauaguguuaa

SEQ ID NO: 3575894 - RNA, 18 nt, Human
gauuuaauaguguuaauc

SEQ ID NO: 3575895 - RNA, 20 nt, Human
gauuuaauaguguuaaucaa

SEQ ID NO: 3575896 - RNA, 22 nt, Human
gauuuaauaguguuaaucaauu

SEQ ID NO: 3575897 - RNA, 21 nt, Human
gauuuaauauaaaguuuuaua

SEQ ID NO: 3575898 - RNA, 14 nt, Human
gauuuaauuuccag

SEQ ID NO: 3575899 - RNA, 16 nt, Human
gauuuaauuugccaaa

SEQ ID NO: 3575900 - RNA, 21 nt, Human
gauuuacagcaaguagauaaa

SEQ ID NO: 3575901 - RNA, 19 nt, Human
gauuuacagccucacuuga

SEQ ID NO: 3575902 - RNA, 16 nt, Human
gauuuacaguuucaaa

SEQ ID NO: 3575903 - RNA, 20 nt, Human
gauuuaccuguuuucgcacc

SEQ ID NO: 3575904 - RNA, 15 nt, Human
gauuuacgcucauug

SEQ ID NO: 3575905 - RNA, 16 nt, Human
gauuuagauaugcaaa

SEQ ID NO: 3575906 - RNA, 20 nt, Human
gauuuaggagaagccaggaa

SEQ ID NO: 3575907 - RNA, 13 nt, Human
gauuuaguagugu

SEQ ID NO: 3575908 - RNA, 18 nt, Human
gauuuaguguaauaagac

SEQ ID NO: 3575909 - RNA, 17 nt, Human
gauuuauaguuuguaca

SEQ ID NO: 3575910 - RNA, 20 nt, Human
gauuuauaguuuguacaugc

SEQ ID NO: 3575911 - RNA, 21 nt, Human
gauuuauaguuuguacaugca

SEQ ID NO: 3575912 - RNA, 16 nt, Human
gauuuauauaaaugua

SEQ ID NO: 3575913 - RNA, 13 nt, Human
gauuuaucaaauc

SEQ ID NO: 3575914 - RNA, 19 nt, Human
gauuuaucacacaaagcag

SEQ ID NO: 3575915 - RNA, 17 nt, Human
gauuuauguuguauaga

SEQ ID NO: 3575916 - RNA, 13 nt, Human
gauuuauuaaaga

SEQ ID NO: 3575917 - RNA, 14 nt, Human
gauuuauuaaagaa

SEQ ID NO: 3575918 - RNA, 15 nt, Human
gauuuauuaaagaaa

SEQ ID NO: 3575919 - RNA, 20 nt, Human
gauuuauuaacuuaauaauc

SEQ ID NO: 3575920 - RNA, 16 nt, Human
gauuuauuugcuucuu

SEQ ID NO: 3575921 - RNA, 14 nt, Human
gauuuauuuuguua

SEQ ID NO: 3575922 - RNA, 17 nt, Human
gauuuauuuuucaguuc

SEQ ID NO: 3575923 - RNA, 20 nt, Human
gauuuauuuuucaguuccaa

SEQ ID NO: 3575924 - RNA, 12 nt, Human
gauuucaagaaa

SEQ ID NO: 3575925 - RNA, 13 nt, Human
gauuucacaaaua

SEQ ID NO: 3575926 - RNA, 15 nt, Human
gauuucacaaauauu

SEQ ID NO: 3575927 - RNA, 21 nt, Human
gauuucagaaagagcaagucu

SEQ ID NO: 3575928 - RNA, 15 nt, Human
gauuucagaagccua

SEQ ID NO: 3575929 - RNA, 16 nt, Human
gauuucauaccucaga

SEQ ID NO: 3575930 - RNA, 15 nt, Human
gauuucauaguucag

SEQ ID NO: 3575931 - RNA, 12 nt, Human
gauuucaucugc

SEQ ID NO: 3575932 - RNA, 16 nt, Human
gauuucaugcuaucuc

SEQ ID NO: 3575933 - RNA, 13 nt, Human
gauuucauguacu

SEQ ID NO: 3575934 - RNA, 16 nt, Human
gauuucauguacugca

SEQ ID NO: 3575935 - RNA, 20 nt, Human
gauuucauguacugcauuau

SEQ ID NO: 3575936 - RNA, 15 nt, Human
gauuuccaaguaaua

SEQ ID NO: 3575937 - RNA, 20 nt, Human
gauuuccaaguaauauaaug

SEQ ID NO: 3575938 - RNA, 22 nt, Human
gauuuccagaaccacacuugaa

SEQ ID NO: 3575939 - RNA, 18 nt, Human
gauuuccagccagggcug

SEQ ID NO: 3575940 - RNA, 19 nt, Human
gauuuccagccagggcugc

SEQ ID NO: 3575941 - RNA, 20 nt, Human
gauuucccauccccuguggg

SEQ ID NO: 3575942 - RNA, 12 nt, Human
gauuuccccucu

SEQ ID NO: 3575943 - RNA, 16 nt, Human
gauuuccccuuuugca

SEQ ID NO: 3575944 - RNA, 22 nt, Human
gauuuccccuuuugcauucucc

SEQ ID NO: 3575945 - RNA, 21 nt, Human
gauuucccguggccccagccu

SEQ ID NO: 3575946 - RNA, 15 nt, Human
gauuucccuucuucu

SEQ ID NO: 3575947 - RNA, 22 nt, Human
gauuucccuucuucugucaucu

SEQ ID NO: 3575948 - RNA, 15 nt, Human
gauuuccguuaaaau

SEQ ID NO: 3575949 - RNA, 18 nt, Human
gauuuccguuaaaauacc

SEQ ID NO: 3575950 - RNA, 19 nt, Human
gcagcuguugucucuucuc

SEQ ID NO: 3575951 - RNA, 20 nt, Human
gcagcuguugucucuucucc

SEQ ID NO: 3575952 - RNA, 17 nt, Human
gcagcuuagggcccugg

SEQ ID NO: 3575953 - RNA, 18 nt, Human
gcagcuuagggcccugga

SEQ ID NO: 3575954 - RNA, 23 nt, Human
gcagcuuauaaugggcucuccgg

SEQ ID NO: 3575955 - RNA, 13 nt, Human
gcagcuucaguug

SEQ ID NO: 3575956 - RNA, 18 nt, Human
gcagcuucugccacuucc

SEQ ID NO: 3575957 - RNA, 20 nt, Human
gcagcuucugccacuuccca

SEQ ID NO: 3575958 - RNA, 17 nt, Human
gcagcuucugcccccug

SEQ ID NO: 3575959 - RNA, 20 nt, Human
gcagcuucugcccccugcag

SEQ ID NO: 3575960 - RNA, 13 nt, Human
gcagcuugccccg

SEQ ID NO: 3575961 - RNA, 21 nt, Human
gcagcuugcguuagaaugagg

SEQ ID NO: 3575962 - RNA, 22 nt, Human
gcagcuugggagagccccuggg

SEQ ID NO: 3575963 - RNA, 17 nt, Human
gcagcuuguagccagcc

SEQ ID NO: 3575964 - RNA, 18 nt, Human
gcagcuuguagccagccg

SEQ ID NO: 3575965 - RNA, 23 nt, Human
gcagcuuguagccagccggggcg

SEQ ID NO: 3575966 - RNA, 21 nt, Human
gcagcuugugugcaaaagcag

SEQ ID NO: 3575967 - RNA, 18 nt, Human
gcagcuuuaaccauuaaa

SEQ ID NO: 3575968 - RNA, 14 nt, Human
gcagcuuucuagaa

SEQ ID NO: 3575969 - RNA, 21 nt, Human
gcaggaaaugaaaaugucuug

SEQ ID NO: 3575970 - RNA, 15 nt, Human
gcaggaacucccagc

SEQ ID NO: 3575971 - RNA, 18 nt, Human
gcaggaagcaacgaaggg

SEQ ID NO: 3575972 - RNA, 13 nt, Human
gcaggaagcugcu

SEQ ID NO: 3575973 - RNA, 23 nt, Human
gcaggaaggacuaugaaaagcua

SEQ ID NO: 3575974 - RNA, 12 nt, Human
gcaggaaggaga

SEQ ID NO: 3575975 - RNA, 17 nt, Human
gcaggaaggagagccug

SEQ ID NO: 3575976 - RNA, 14 nt, Human
gcaggaaggagcug

SEQ ID NO: 3575977 - RNA, 22 nt, Human
gcaggaaggagcugccuggacc

SEQ ID NO: 3575978 - RNA, 13 nt, Human
gcaggaaggccug

SEQ ID NO: 3575979 - RNA, 19 nt, Human
gcaggaauauaugugugcc

SEQ ID NO: 3575980 - RNA, 21 nt, Human
gcaggaauauaugugugccua

SEQ ID NO: 3575981 - RNA, 19 nt, Human
gcaggaaucaaaaauugaa

SEQ ID NO: 3575982 - RNA, 18 nt, Human
gcaggaauugguggcaga

SEQ ID NO: 3575983 - RNA, 18 nt, Human
gcaggacaacgaggaagc

SEQ ID NO: 3575984 - RNA, 14 nt, Human
gcaggacacugcag

SEQ ID NO: 3575985 - RNA, 13 nt, Human
gcaggacaggaaa

SEQ ID NO: 3575986 - RNA, 14 nt, Human
gcaggaccaggacu

SEQ ID NO: 3575987 - RNA, 15 nt, Human
gcaggaccaggacua

SEQ ID NO: 3575988 - RNA, 23 nt, Human
gcaggaccucagaguccaggccc

SEQ ID NO: 3575989 - RNA, 16 nt, Human
gcaggaccucccuucc

SEQ ID NO: 3575990 - RNA, 21 nt, Human
gcaggaccucccuuccgaccc

SEQ ID NO: 3575991 - RNA, 22 nt, Human
gcaggaccucccuuccgacccu

SEQ ID NO: 3575992 - RNA, 19 nt, Human
gcaggacucagcuccccag

SEQ ID NO: 3575993 - RNA, 18 nt, Human
gcaggacuguccccuuga

SEQ ID NO: 3575994 - RNA, 13 nt, Human
gcaggagaggaga

SEQ ID NO: 3575995 - RNA, 23 nt, Human
gcaggagaggagagccagagaag

SEQ ID NO: 3575996 - RNA, 14 nt, Human
gcaggagauugaga

SEQ ID NO: 3575997 - RNA, 17 nt, Human
gcaggagcacacccagc

SEQ ID NO: 3575998 - RNA, 22 nt, Human
gcaggagcaguaucaugaagcc

SEQ ID NO: 3575999 - RNA, 18 nt, Human
gcaggagcucagaugaag

SEQ ID NO: 3576000 - RNA, 14 nt, Human
gcaggaggauugcu

SEQ ID NO: 3576001 - RNA, 17 nt, Human
gcaggaggccaggccgg

SEQ ID NO: 3576002 - RNA, 16 nt, Human
gcaggaggccccuggc

SEQ ID NO: 3576003 - RNA, 15 nt, Human
gcaggagggaggugc

SEQ ID NO: 3576004 - RNA, 14 nt, Human
gcaggaggggggag

SEQ ID NO: 3576005 - RNA, 18 nt, Human
gcaggaggggggagggaa

SEQ ID NO: 3576006 - RNA, 15 nt, Human
gcaggaguagcugag

SEQ ID NO: 3576007 - RNA, 18 nt, Human
gcaggaguggugcagaca

SEQ ID NO: 3576008 - RNA, 19 nt, Human
gcaggaguggugcagacag

SEQ ID NO: 3576009 - RNA, 14 nt, Human
gcaggauugaaaau

SEQ ID NO: 3576010 - RNA, 22 nt, Human
gcaggauugaaaauguccagga

SEQ ID NO: 3576011 - RNA, 20 nt, Human
gcaggauuggggaagagagc

SEQ ID NO: 3576012 - RNA, 12 nt, Human
gcaggcacagca

SEQ ID NO: 3576013 - RNA, 13 nt, Human
gcaggcacagcac

SEQ ID NO: 3576014 - RNA, 15 nt, Human
gcaggcacauggagg

SEQ ID NO: 3576015 - RNA, 12 nt, Human
gcaggcaccugu

SEQ ID NO: 3576016 - RNA, 15 nt, Human
gcaggcaccuuagug

SEQ ID NO: 3576017 - RNA, 18 nt, Human
gcaggcacgggugguccc

SEQ ID NO: 3576018 - RNA, 19 nt, Human
gcaggcacuuauuguaaau

SEQ ID NO: 3576019 - RNA, 13 nt, Human
gcaggcagacacg

SEQ ID NO: 3576020 - RNA, 20 nt, Human
gcaggcagacacggaucuga

SEQ ID NO: 3576021 - RNA, 20 nt, Human
gcaggcagacuacacaggau

SEQ ID NO: 3576022 - RNA, 15 nt, Human
gcaggcagaggccca

SEQ ID NO: 3576023 - RNA, 16 nt, Human
gcaggcagaucaccug

SEQ ID NO: 3576024 - RNA, 18 nt, Human
gcaggcagaucaccugag

SEQ ID NO: 3576025 - RNA, 12 nt, Human
gcaggcagccag

SEQ ID NO: 3576026 - RNA, 18 nt, Human
gcaggcagccaggccaca

SEQ ID NO: 3576027 - RNA, 16 nt, Human
gcaggcagcgccaagc

SEQ ID NO: 3576028 - RNA, 17 nt, Human
gcaggcaggcucccagg

SEQ ID NO: 3576029 - RNA, 12 nt, Human
gcaggcaggcug

SEQ ID NO: 3576030 - RNA, 12 nt, Human
gcaggcagggcu

SEQ ID NO: 3576031 - RNA, 16 nt, Human
gcaggcagggcucucc

SEQ ID NO: 3576032 - RNA, 9 nt, Human
gcaggcagu

SEQ ID NO: 3576033 - RNA, 13 nt, Human
gcaggcauggccc

SEQ ID NO: 3576034 - RNA, 15 nt, Human
gcaggcauggcccug

SEQ ID NO: 3576035 - RNA, 16 nt, Human
gcaggcauggcccugg

SEQ ID NO: 3576036 - RNA, 16 nt, Human
gcaggcauguccugga

SEQ ID NO: 3576037 - RNA, 22 nt, Human
gcaggccaaggucugagccaca

SEQ ID NO: 3576038 - RNA, 20 nt, Human
gcaggccacacuucaaacua

SEQ ID NO: 3576039 - RNA, 23 nt, Human
gcaggccacacuucaaacuacuu

SEQ ID NO: 3576040 - RNA, 15 nt, Human
gcaggccaggccagc

SEQ ID NO: 3576041 - RNA, 14 nt, Human
gcaggcccacccug

SEQ ID NO: 3576042 - RNA, 15 nt, Human
gcaggcccacccugc

SEQ ID NO: 3576043 - RNA, 19 nt, Human
gcaggcccacccugcuugg

SEQ ID NO: 3576044 - RNA, 22 nt, Human
gcaggcccacccugcuuggccc

SEQ ID NO: 3576045 - RNA, 17 nt, Human
gcaggcccaugggaggc

SEQ ID NO: 3576046 - RNA, 18 nt, Human
gcaggcccugcacugucc

SEQ ID NO: 3576047 - RNA, 19 nt, Human
gcaggcccuuugaagccuc

SEQ ID NO: 3576048 - RNA, 18 nt, Human
gcaggccucccugccagu

SEQ ID NO: 3576049 - RNA, 23 nt, Human
gcaggccucgaaaaccaucacau

SEQ ID NO: 3576050 - RNA, 23 nt, Human
gcaggcggugggcacccacccug

SEQ ID NO: 3576051 - RNA, 20 nt, Human
gcaggcuaaggcguggagcu

SEQ ID NO: 3576052 - RNA, 14 nt, Human
gcaggcucacugcc

SEQ ID NO: 3576053 - RNA, 18 nt, Human
gcaggcucacugccaggc

SEQ ID NO: 3576054 - RNA, 19 nt, Human
gcaggcucacugccaggcc

SEQ ID NO: 3576055 - RNA, 21 nt, Human
gcaggcucacugccaggccag

SEQ ID NO: 3576056 - RNA, 23 nt, Human
gcaggcucccagggacaccuggg

SEQ ID NO: 3576057 - RNA, 14 nt, Human
gcaggcuccccuga

SEQ ID NO: 3576058 - RNA, 14 nt, Human
gcaggcucucaggc

SEQ ID NO: 3576059 - RNA, 23 nt, Human
gcaggcucucaggccagcugcuu

SEQ ID NO: 3576060 - RNA, 16 nt, Human
gcaggcugagccacuc

SEQ ID NO: 3576061 - RNA, 17 nt, Human
gcaggcugccagugccu

SEQ ID NO: 3576062 - RNA, 20 nt, Human
gcaggcuggagguaaggccu

SEQ ID NO: 3576063 - RNA, 16 nt, Human
gcaggcuggcaccgcc

SEQ ID NO: 3576064 - RNA, 19 nt, Human
gcaggcuggcaccgccuuc

SEQ ID NO: 3576065 - RNA, 13 nt, Human
gcaggcuggccag

SEQ ID NO: 3576066 - RNA, 15 nt, Human
gcaggcuggccagcc

SEQ ID NO: 3576067 - RNA, 17 nt, Human
gcaggcuggccagccgc

SEQ ID NO: 3576068 - RNA, 22 nt, Human
gcaggcuggccaguccaggcug

SEQ ID NO: 3576069 - RNA, 13 nt, Human
gcaggcuggcccu

SEQ ID NO: 3576070 - RNA, 15 nt, Human
gcaggcuggcccugc

SEQ ID NO: 3576071 - RNA, 17 nt, Human
gcaggcuggcccugccc

SEQ ID NO: 3576072 - RNA, 21 nt, Human
gcaggcuggcccugcccuggu

SEQ ID NO: 3576073 - RNA, 15 nt, Human
gcaggcugggccaug

SEQ ID NO: 3576074 - RNA, 21 nt, Human
gcagggaaaauuauuugcaua

SEQ ID NO: 3576075 - RNA, 17 nt, Human
gcagggaacauggggag

SEQ ID NO: 3576076 - RNA, 14 nt, Human
gcagggaaggccug

SEQ ID NO: 3576077 - RNA, 20 nt, Human
gcagggaaggggaggcagcc

SEQ ID NO: 3576078 - RNA, 21 nt, Human
gcagggaaguguaagaaacac

SEQ ID NO: 3576079 - RNA, 15 nt, Human
gcagggaauuucuau

SEQ ID NO: 3576080 - RNA, 14 nt, Human
gcagggacaaagag

SEQ ID NO: 3576081 - RNA, 15 nt, Human
gcagggacagggccg

SEQ ID NO: 3576082 - RNA, 21 nt, Human
gcagggagcauggcugugagg

SEQ ID NO: 3576083 - RNA, 14 nt, Human
gcagggagggccug

SEQ ID NO: 3576084 - RNA, 22 nt, Human
gcagggagggccugggccccag

SEQ ID NO: 3576085 - RNA, 15 nt, Human
gcagggaggucaggc

SEQ ID NO: 3576086 - RNA, 14 nt, Human
gcagggauccuggu

SEQ ID NO: 3576087 - RNA, 22 nt, Human
gcagggauuaaccucugcacua

SEQ ID NO: 3576088 - RNA, 15 nt, Human
gcagggauugcugcc

SEQ ID NO: 3576089 - RNA, 19 nt, Human
gcagggauugcugccacuu

SEQ ID NO: 3576090 - RNA, 14 nt, Human
gcagggauuugagg

SEQ ID NO: 3576091 - RNA, 22 nt, Human
gcagggcaaaugacaugcacug

SEQ ID NO: 3576092 - RNA, 12 nt, Human
gcagggcacagg

SEQ ID NO: 3576093 - RNA, 16 nt, Human
gcagggcacagggccu

SEQ ID NO: 3576094 - RNA, 19 nt, Human
gcagggcacagggccuggc

SEQ ID NO: 3576095 - RNA, 19 nt, Human
gcaguuagagaugccuccc

SEQ ID NO: 3576096 - RNA, 17 nt, Human
gcaguuagcugaagaau

SEQ ID NO: 3576097 - RNA, 22 nt, Human
gcaguuagcugaagaauugaaa

SEQ ID NO: 3576098 - RNA, 13 nt, Human
gcaguuauauuuu

SEQ ID NO: 3576099 - RNA, 16 nt, Human
gcaguuauauuuugca

SEQ ID NO: 3576100 - RNA, 22 nt, Human
gcaguuaugugaccucacgugc

SEQ ID NO: 3576101 - RNA, 23 nt, Human
gcaguuaugugaccucacgugca

SEQ ID NO: 3576102 - RNA, 13 nt, Human
gcaguucaccugc

SEQ ID NO: 3576103 - RNA, 19 nt, Human
gcaguucagagcugcccuc

SEQ ID NO: 3576104 - RNA, 23 nt, Human
gcaguucagagcugcccucuccu

SEQ ID NO: 3576105 - RNA, 19 nt, Human
gcaguucccacauuaaaga

SEQ ID NO: 3576106 - RNA, 21 nt, Human
gcaguucccacauuaaagaag

SEQ ID NO: 3576107 - RNA, 22 nt, Human
gcaguucccacauuaaagaaga

SEQ ID NO: 3576108 - RNA, 17 nt, Human
gcaguucgacucugugc

SEQ ID NO: 3576109 - RNA, 15 nt, Human
gcaguucgcagccac

SEQ ID NO: 3576110 - RNA, 18 nt, Human
gcaguucgcagccacccu

SEQ ID NO: 3576111 - RNA, 19 nt, Human
gcaguucgcagccacccug

SEQ ID NO: 3576112 - RNA, 23 nt, Human
gcaguucgcagccacccugagga

SEQ ID NO: 3576113 - RNA, 13 nt, Human
gcaguucugaaga

SEQ ID NO: 3576114 - RNA, 14 nt, Human
gcaguucugaagaa

SEQ ID NO: 3576115 - RNA, 19 nt, Human
gcaguugaaaagacuccaa

SEQ ID NO: 3576116 - RNA, 21 nt, Human
gcaguugaaaagacuccaaag

SEQ ID NO: 3576117 - RNA, 15 nt, Human
gcaguugacagcagg

SEQ ID NO: 3576118 - RNA, 21 nt, Human
gcaguugagaaaauuugaaug

SEQ ID NO: 3576119 - RNA, 14 nt, Human
gcaguugccaguca

SEQ ID NO: 3576120 - RNA, 14 nt, Human
gcaguugcccagcc

SEQ ID NO: 3576121 - RNA, 15 nt, Human
gcaguugcccagccu

SEQ ID NO: 3576122 - RNA, 23 nt, Human
gcaguugcugguaaaaugaagaa

SEQ ID NO: 3576123 - RNA, 14 nt, Human
gcaguuggccagag

SEQ ID NO: 3576124 - RNA, 13 nt, Human
gcaguugucucug

SEQ ID NO: 3576125 - RNA, 13 nt, Human
gcaguuguuaagu

SEQ ID NO: 3576126 - RNA, 13 nt, Human
gcaguuuaaagca

SEQ ID NO: 3576127 - RNA, 17 nt, Human
gcaguuucaauaaaguu

SEQ ID NO: 3576128 - RNA, 13 nt, Human
gcaguuugaaauu

SEQ ID NO: 3576129 - RNA, 22 nt, Human
gcaguuugaaauucugaauuug

SEQ ID NO: 3576130 - RNA, 19 nt, Human
gcaguuugaggauuaguuu

SEQ ID NO: 3576131 - RNA, 16 nt, Human
gcaguuugcaaaaaau

SEQ ID NO: 3576132 - RNA, 21 nt, Human
gcaguuugccuggugcagugg

SEQ ID NO: 3576133 - RNA, 17 nt, Human
gcaguuuucaagucaaa

SEQ ID NO: 3576134 - RNA, 22 nt, Human
gcaguuuugacaucagccagcu

SEQ ID NO: 3576135 - RNA, 14 nt, Human
gcaguuuuucugua

SEQ ID NO: 3576136 - RNA, 12 nt, Human
gcaguuuuuuga

SEQ ID NO: 3576137 - RNA, 15 nt, Human
gcauaaaagaugaaa

SEQ ID NO: 3576138 - RNA, 19 nt, Human
gcauaaagcucaaaugaaa

SEQ ID NO: 3576139 - RNA, 18 nt, Human
gcauaacaagguccaaga

SEQ ID NO: 3576140 - RNA, 15 nt, Human
gcauaacauaaaucu

SEQ ID NO: 3576141 - RNA, 14 nt, Human
gcauaaccugucuc

SEQ ID NO: 3576142 - RNA, 17 nt, Human
gcauaacugacaaauca

SEQ ID NO: 3576143 - RNA, 22 nt, Human
gcauaaguccucuagugaaugu

SEQ ID NO: 3576144 - RNA, 11 nt, Human
gcauaauaaau

SEQ ID NO: 3576145 - RNA, 13 nt, Human
gcauacacacaca

SEQ ID NO: 3576146 - RNA, 21 nt, Human
gcauacacacacacacacagc

SEQ ID NO: 3576147 - RNA, 23 nt, Human
gcauacacacacacacacagcca

SEQ ID NO: 3576148 - RNA, 21 nt, Human
gcauacacccccaccuccugc

SEQ ID NO: 3576149 - RNA, 19 nt, Human
gcauacaugcaaaaagaaa

SEQ ID NO: 3576150 - RNA, 15 nt, Human
gcauaccacuuuugu

SEQ ID NO: 3576151 - RNA, 17 nt, Human
gcauaccacuuuuguuc

SEQ ID NO: 3576152 - RNA, 18 nt, Human
gcauaccuccuauggguu

SEQ ID NO: 3576153 - RNA, 19 nt, Human
gcauaccuuucacagcuuu

SEQ ID NO: 3576154 - RNA, 14 nt, Human
gcauacguacacau

SEQ ID NO: 3576155 - RNA, 17 nt, Human
gcauacuauuaaacaug

SEQ ID NO: 3576156 - RNA, 21 nt, Human
gcauacuauuaaacaugcugu

SEQ ID NO: 3576157 - RNA, 19 nt, Human
gcauacuuaccuagugaaa

SEQ ID NO: 3576158 - RNA, 21 nt, Human
gcauacuuaccuagugaaacu

SEQ ID NO: 3576159 - RNA, 14 nt, Human
gcauacuucaaaag

SEQ ID NO: 3576160 - RNA, 16 nt, Human
gcauacuucaaaagua

SEQ ID NO: 3576161 - RNA, 22 nt, Human
gcauacuucaaaaguauuuucc

SEQ ID NO: 3576162 - RNA, 16 nt, Human
gcauacuuuguaaaua

SEQ ID NO: 3576163 - RNA, 13 nt, Human
gcauacuuuuuaa

SEQ ID NO: 3576164 - RNA, 14 nt, Human
gcauagaaggagga

SEQ ID NO: 3576165 - RNA, 23 nt, Human
gcauagaaggaggagagggaaaa

SEQ ID NO: 3576166 - RNA, 14 nt, Human
gcauagaaggcagg

SEQ ID NO: 3576167 - RNA, 15 nt, Human
gcauagaaggcaggu

SEQ ID NO: 3576168 - RNA, 13 nt, Human
gcauagaaguaaa

SEQ ID NO: 3576169 - RNA, 22 nt, Human
gcauagaggcuucuccgccagc

SEQ ID NO: 3576170 - RNA, 18 nt, Human
gcauagauucccugagca

SEQ ID NO: 3576171 - RNA, 14 nt, Human
gcauagcaaacaga

SEQ ID NO: 3576172 - RNA, 22 nt, Human
gcauagcccagacacagaagag

SEQ ID NO: 3576173 - RNA, 18 nt, Human
gcauagcuacguggcacu

SEQ ID NO: 3576174 - RNA, 22 nt, Human
gcauagcuacuaaaaucaguga

SEQ ID NO: 3576175 - RNA, 14 nt, Human
gcauagcucugggg

SEQ ID NO: 3576176 - RNA, 21 nt, Human
gcauaggaguuuggaggaagu

SEQ ID NO: 3576177 - RNA, 20 nt, Human
gcauaguauuccauugugug

SEQ ID NO: 3576178 - RNA, 21 nt, Human
gcauaguauuccauuguguga

SEQ ID NO: 3576179 - RNA, 22 nt, Human
gcauaguauuccauugugugag

SEQ ID NO: 3576180 - RNA, 23 nt, Human
gcauaguauuccauugugugagu

SEQ ID NO: 3576181 - RNA, 12 nt, Human
gcauagugcugg

SEQ ID NO: 3576182 - RNA, 11 nt, Human
gcauaguuccc

SEQ ID NO: 3576183 - RNA, 21 nt, Human
gcauaguuguagacaaaguac

SEQ ID NO: 3576184 - RNA, 12 nt, Human
gcauaguuucuu

SEQ ID NO: 3576185 - RNA, 17 nt, Human
gcauaguuucuuuauuu

SEQ ID NO: 3576186 - RNA, 14 nt, Human
gcauauagagauga

SEQ ID NO: 3576187 - RNA, 19 nt, Human
gcauauaggugauguuugc

SEQ ID NO: 3576188 - RNA, 14 nt, Human
gcauauauauaugu

SEQ ID NO: 3576189 - RNA, 18 nt, Human
gcauauauauaugugugu

SEQ ID NO: 3576190 - RNA, 23 nt, Human
gcauauauuggguuccauucuca

SEQ ID NO: 3576191 - RNA, 15 nt, Human
gcauauauuuuuaua

SEQ ID NO: 3576192 - RNA, 22 nt, Human
gcauaucagucucugagggcuu

SEQ ID NO: 3576193 - RNA, 13 nt, Human
gcauaucauaaug

SEQ ID NO: 3576194 - RNA, 20 nt, Human
gcauaucaugcuuugaaaaa

SEQ ID NO: 3576195 - RNA, 16 nt, Human
gcauauccugagccau

SEQ ID NO: 3576196 - RNA, 14 nt, Human
gcauauccuuuuag

SEQ ID NO: 3576197 - RNA, 12 nt, Human
gcauaucugccu

SEQ ID NO: 3576198 - RNA, 16 nt, Human
gcauaugacaaauguu

SEQ ID NO: 3576199 - RNA, 17 nt, Human
gcauaugacaaauguuu

SEQ ID NO: 3576200 - RNA, 19 nt, Human
gcauaugacaaauguuucu

SEQ ID NO: 3576201 - RNA, 20 nt, Human
gcauaugacaaauguuucua

SEQ ID NO: 3576202 - RNA, 13 nt, Human
gcauaugucuaua

SEQ ID NO: 3576203 - RNA, 21 nt, Human
gcauauguugaauacuuuuua

SEQ ID NO: 3576204 - RNA, 16 nt, Human
gcauauuauaaaggau

SEQ ID NO: 3576205 - RNA, 23 nt, Human
gcauauuauaaaggauaaagaag

SEQ ID NO: 3576206 - RNA, 15 nt, Human
gcauauucaggaagc

SEQ ID NO: 3576207 - RNA, 21 nt, Human
gcauauucuaguaauaaagac

SEQ ID NO: 3576208 - RNA, 17 nt, Human
gcauauuguacacuuuu

SEQ ID NO: 3576209 - RNA, 15 nt, Human
gcauauuguuauuau

SEQ ID NO: 3576210 - RNA, 14 nt, Human
gcauauuuguauag

SEQ ID NO: 3576211 - RNA, 14 nt, Human
gcaucaaaagacaa

SEQ ID NO: 3576212 - RNA, 18 nt, Human
gcaucaagaugugacaug

SEQ ID NO: 3576213 - RNA, 21 nt, Human
gcaucaagaugugacauguuu

SEQ ID NO: 3576214 - RNA, 18 nt, Human
gcaucaaggggucacuua

SEQ ID NO: 3576215 - RNA, 21 nt, Human
gcaucaaggucagcaugagga

SEQ ID NO: 3576216 - RNA, 13 nt, Human
gcaucaauccugu

SEQ ID NO: 3576217 - RNA, 17 nt, Human
gcaucaauccugugugg

SEQ ID NO: 3576218 - RNA, 14 nt, Human
gcaucacagggcag

SEQ ID NO: 3576219 - RNA, 16 nt, Human
gcaucacagggcagag

SEQ ID NO: 3576220 - RNA, 22 nt, Human
gcaucacagggcagagccggga

SEQ ID NO: 3576221 - RNA, 21 nt, Human
gcaucaccuagaaacuuguua

SEQ ID NO: 3576222 - RNA, 13 nt, Human
gcaucaccucagg

SEQ ID NO: 3576223 - RNA, 20 nt, Human
gcaucaccuuaggcagggaa

SEQ ID NO: 3576224 - RNA, 20 nt, Human
gcaucacuccccaaggaaga

SEQ ID NO: 3576225 - RNA, 20 nt, Human
gcaucacuuaaaacacguuu

SEQ ID NO: 3576226 - RNA, 13 nt, Human
gcaucagaaagag

SEQ ID NO: 3576227 - RNA, 17 nt, Human
gcaucagaaagaggcag

SEQ ID NO: 3576228 - RNA, 11 nt, Human
gcaucagaaau

SEQ ID NO: 3576229 - RNA, 13 nt, Human
gcaucagaaaugu

SEQ ID NO: 3576230 - RNA, 22 nt, Human
gcaucagcugcugaaacaacaa

SEQ ID NO: 3576231 - RNA, 13 nt, Human
gcaucaggccagg

SEQ ID NO: 3576232 - RNA, 15 nt, Human
gcaucaggccaggcc

SEQ ID NO: 3576233 - RNA, 18 nt, Human
gcaucagggggaagaagc

SEQ ID NO: 3576234 - RNA, 20 nt, Human
gcaucagggggaagaagcag

SEQ ID NO: 3576235 - RNA, 19 nt, Human
gcaucagucccuauguauu

SEQ ID NO: 3576236 - RNA, 15 nt, Human
gcaucagugcccucc

SEQ ID NO: 3576237 - RNA, 23 nt, Human
gcaucagugcccuccaggauaga

SEQ ID NO: 3576238 - RNA, 15 nt, Human
gcaucaguucuacgg

SEQ ID NO: 3576239 - RNA, 14 nt, Human
gcaucaucuguaga

SEQ ID NO: 3576240 - RNA, 13 nt, Human
gcauggaaaucag

SEQ ID NO: 3576241 - RNA, 17 nt, Human
gcauggaaauuuaaagc

SEQ ID NO: 3576242 - RNA, 19 nt, Human
gcauggaaauuuaaagcag

SEQ ID NO: 3576243 - RNA, 21 nt, Human
gcauggaaggcaagauugugu

SEQ ID NO: 3576244 - RNA, 20 nt, Human
gcauggacauuuagaagaaa

SEQ ID NO: 3576245 - RNA, 18 nt, Human
gcauggaccuaacauucg

SEQ ID NO: 3576246 - RNA, 16 nt, Human
gcauggagacgcauuu

SEQ ID NO: 3576247 - RNA, 16 nt, Human
gcauggaggcccuccu

SEQ ID NO: 3576248 - RNA, 17 nt, Human
gcauggaguguguauug

SEQ ID NO: 3576249 - RNA, 21 nt, Human
gcauggauguuuuagccauug

SEQ ID NO: 3576250 - RNA, 15 nt, Human
gcauggauuucuguc

SEQ ID NO: 3576251 - RNA, 16 nt, Human
gcauggauuucuuuga

SEQ ID NO: 3576252 - RNA, 14 nt, Human
gcauggcaccuguc

SEQ ID NO: 3576253 - RNA, 14 nt, Human
gcauggcacucccu

SEQ ID NO: 3576254 - RNA, 20 nt, Human
gcauggcacucccuccagca

SEQ ID NO: 3576255 - RNA, 21 nt, Human
gcauggcacucccuccagcac

SEQ ID NO: 3576256 - RNA, 14 nt, Human
gcauggcagcaggc

SEQ ID NO: 3576257 - RNA, 18 nt, Human
gcauggcagcaggccugu

SEQ ID NO: 3576258 - RNA, 20 nt, Human
gcauggcagcaggccuguug

SEQ ID NO: 3576259 - RNA, 20 nt, Human
gcauggcagggggcugcugc

SEQ ID NO: 3576260 - RNA, 21 nt, Human
gcauggcagggggcugcugcu

SEQ ID NO: 3576261 - RNA, 18 nt, Human
gcauggcaucaccuccac

SEQ ID NO: 3576262 - RNA, 13 nt, Human
gcauggccaggug

SEQ ID NO: 3576263 - RNA, 16 nt, Human
gcauggcccugggguc

SEQ ID NO: 3576264 - RNA, 23 nt, Human
gcauggcguagagggugcugccc

SEQ ID NO: 3576265 - RNA, 17 nt, Human
gcauggcuccagaaaug

SEQ ID NO: 3576266 - RNA, 19 nt, Human
gcauggcuccagaaauguc

SEQ ID NO: 3576267 - RNA, 22 nt, Human
gcauggcuccagucugcugccc

SEQ ID NO: 3576268 - RNA, 21 nt, Human
gcauggcugccaaugggagcu

SEQ ID NO: 3576269 - RNA, 18 nt, Human
gcaugggaaagccaccuc

SEQ ID NO: 3576270 - RNA, 19 nt, Human
gcaugggaaagccaccucu

SEQ ID NO: 3576271 - RNA, 16 nt, Human
gcaugggaaugaaugu

SEQ ID NO: 3576272 - RNA, 15 nt, Human
gcaugggccagcccc

SEQ ID NO: 3576273 - RNA, 18 nt, Human
gcaugguaccagcccugg

SEQ ID NO: 3576274 - RNA, 19 nt, Human
gcaugguaccagcccuggg

SEQ ID NO: 3576275 - RNA, 22 nt, Human
gcaugguauuugagacauucca

SEQ ID NO: 3576276 - RNA, 23 nt, Human
gcauggucccacaucccugggcc

SEQ ID NO: 3576277 - RNA, 15 nt, Human
gcauggugccccagg

SEQ ID NO: 3576278 - RNA, 16 nt, Human
gcauggugccccagga

SEQ ID NO: 3576279 - RNA, 17 nt, Human
gcauggugccccaggac

SEQ ID NO: 3576280 - RNA, 21 nt, Human
gcauggugccccaggaccagc

SEQ ID NO: 3576281 - RNA, 18 nt, Human
gcauggugcgggcaccug

SEQ ID NO: 3576282 - RNA, 15 nt, Human
gcaugguggcaccag

SEQ ID NO: 3576283 - RNA, 13 nt, Human
gcaugguggcaug

SEQ ID NO: 3576284 - RNA, 16 nt, Human
gcaugguuuggagcug

SEQ ID NO: 3576285 - RNA, 17 nt, Human
gcauguaaauguaaacu

SEQ ID NO: 3576286 - RNA, 21 nt, Human
gcauguaacgcaaguucccag

SEQ ID NO: 3576287 - RNA, 23 nt, Human
gcauguacaguguucuguuuaau

SEQ ID NO: 3576288 - RNA, 18 nt, Human
gcauguaccauuugcaug

SEQ ID NO: 3576289 - RNA, 21 nt, Human
gcauguacggauuuucaguua

SEQ ID NO: 3576290 - RNA, 20 nt, Human
gcauguagaggcuuguuuac

SEQ ID NO: 3576291 - RNA, 16 nt, Human
gcauguauaguugcuu

SEQ ID NO: 3576292 - RNA, 18 nt, Human
gcauguauaguugcuuuu

SEQ ID NO: 3576293 - RNA, 19 nt, Human
gcauguauuggccuggagg

SEQ ID NO: 3576294 - RNA, 23 nt, Human
gcauguauugugucuuuugcaug

SEQ ID NO: 3576295 - RNA, 20 nt, Human
gcaugucaaacaugagaugu

SEQ ID NO: 3576296 - RNA, 16 nt, Human
gcaugucuuauuuaaa

SEQ ID NO: 3576297 - RNA, 17 nt, Human
gcaugucuuuuaaaaug

SEQ ID NO: 3576298 - RNA, 15 nt, Human
gcaugugacucugaa

SEQ ID NO: 3576299 - RNA, 19 nt, Human
gcaugugaucacgccuggc

SEQ ID NO: 3576300 - RNA, 17 nt, Human
gcaugugaugagaggaa

SEQ ID NO: 3576301 - RNA, 18 nt, Human
gcaugugaugagaggaaa

SEQ ID NO: 3576302 - RNA, 19 nt, Human
gcaugugcccuccugaggg

SEQ ID NO: 3576303 - RNA, 17 nt, Human
gcauguggccuguggcc

SEQ ID NO: 3576304 - RNA, 17 nt, Human
gcauguggcuuuuuuaa

SEQ ID NO: 3576305 - RNA, 19 nt, Human
gcaugugguuugguuccuc

SEQ ID NO: 3576306 - RNA, 23 nt, Human
gcaugugguuugguuccucucug

SEQ ID NO: 3576307 - RNA, 12 nt, Human
gcauguguauuu

SEQ ID NO: 3576308 - RNA, 11 nt, Human
gcaugugugua

SEQ ID NO: 3576309 - RNA, 13 nt, Human
gcauguguguaua

SEQ ID NO: 3576310 - RNA, 19 nt, Human
gcauguguuugguucuggg

SEQ ID NO: 3576311 - RNA, 18 nt, Human
gcauguuaccuccuauaa

SEQ ID NO: 3576312 - RNA, 16 nt, Human
gcauguuauguuuaau

SEQ ID NO: 3576313 - RNA, 18 nt, Human
gcauguuauguuuaauaa

SEQ ID NO: 3576314 - RNA, 20 nt, Human
gcauguucacccuuauaguc

SEQ ID NO: 3576315 - RNA, 18 nt, Human
gcauguugagccaggccu

SEQ ID NO: 3576316 - RNA, 22 nt, Human
gcauguuuagacuuuaacauaa

SEQ ID NO: 3576317 - RNA, 12 nt, Human
gcauguuugcug

SEQ ID NO: 3576318 - RNA, 17 nt, Human
gcauguuugugauugac

SEQ ID NO: 3576319 - RNA, 15 nt, Human
gcauguuuuguauac

SEQ ID NO: 3576320 - RNA, 16 nt, Human
gcauguuuuguauaca

SEQ ID NO: 3576321 - RNA, 12 nt, Human
gcauuaaaccug

SEQ ID NO: 3576322 - RNA, 13 nt, Human
gcauuaaaccugu

SEQ ID NO: 3576323 - RNA, 14 nt, Human
gcauuaaaccuguc

SEQ ID NO: 3576324 - RNA, 15 nt, Human
gcauuaaaccugucu

SEQ ID NO: 3576325 - RNA, 22 nt, Human
gcauuaaaccugucuccacugu

SEQ ID NO: 3576326 - RNA, 15 nt, Human
gcauuaaauuacaga

SEQ ID NO: 3576327 - RNA, 18 nt, Human
gcauuaaauucacaaacu

SEQ ID NO: 3576328 - RNA, 14 nt, Human
gcauuaacuaaucu

SEQ ID NO: 3576329 - RNA, 22 nt, Human
gcauuaacuaaucuauuggguu

SEQ ID NO: 3576330 - RNA, 14 nt, Human
gcauuaacuucucu

SEQ ID NO: 3576331 - RNA, 13 nt, Human
gcauuaauguuuc

SEQ ID NO: 3576332 - RNA, 14 nt, Human
gcauuaauguuucu

SEQ ID NO: 3576333 - RNA, 13 nt, Human
gcauuacaggcaa

SEQ ID NO: 3576334 - RNA, 15 nt, Human
gcauuacccccaacc

SEQ ID NO: 3576335 - RNA, 15 nt, Human
gcauuacgugagcca

SEQ ID NO: 3576336 - RNA, 14 nt, Human
gcauuacucuugua

SEQ ID NO: 3576337 - RNA, 20 nt, Human
gcauuagauuucucauuugc

SEQ ID NO: 3576338 - RNA, 21 nt, Human
gcauuagcacagauuuuaauu

SEQ ID NO: 3576339 - RNA, 15 nt, Human
gcauuauaaaaagaa

SEQ ID NO: 3576340 - RNA, 13 nt, Human
gcauuauauuuau

SEQ ID NO: 3576341 - RNA, 22 nt, Human
gcauuaucuagauacuguauca

SEQ ID NO: 3576342 - RNA, 13 nt, Human
gcauuaugcaauu

SEQ ID NO: 3576343 - RNA, 14 nt, Human
gcauuaugcaauua

SEQ ID NO: 3576344 - RNA, 23 nt, Human
gcauuauguccacuguguauaga

SEQ ID NO: 3576345 - RNA, 13 nt, Human
gcauuauucauuu

SEQ ID NO: 3576346 - RNA, 16 nt, Human
gcauuauucauuuagu

SEQ ID NO: 3576347 - RNA, 14 nt, Human
gcauuauucucuuu

SEQ ID NO: 3576348 - RNA, 21 nt, Human
gcauuauucucuuuuaucugu

SEQ ID NO: 3576349 - RNA, 23 nt, Human
gcauuauucucuuuuaucuguuu

SEQ ID NO: 3576350 - RNA, 15 nt, Human
gcauuauugcauuau

SEQ ID NO: 3576351 - RNA, 22 nt, Human
gcauuauuggaauauaauuguu

SEQ ID NO: 3576352 - RNA, 21 nt, Human
gcauuauuugagaagcugcuc

SEQ ID NO: 3576353 - RNA, 19 nt, Human
gcauucaaauguauuacag

SEQ ID NO: 3576354 - RNA, 12 nt, Human
gcauucacccag

SEQ ID NO: 3576355 - RNA, 14 nt, Human
gcauucauuuuuau

SEQ ID NO: 3576356 - RNA, 17 nt, Human
gcauucauuuuuauagc

SEQ ID NO: 3576357 - RNA, 19 nt, Human
gcauucauuuuuauagcaa

SEQ ID NO: 3576358 - RNA, 16 nt, Human
gcauuccagccccucu

SEQ ID NO: 3576359 - RNA, 20 nt, Human
gcauucccagguaggccaag

SEQ ID NO: 3576360 - RNA, 21 nt, Human
gcauucccagguaggccaagg

SEQ ID NO: 3576361 - RNA, 14 nt, Human
gcauuccccaggag

SEQ ID NO: 3576362 - RNA, 20 nt, Human
gcauuccccaggaggccagc

SEQ ID NO: 3576363 - RNA, 15 nt, Human
gcauuccuucuuuga

SEQ ID NO: 3576364 - RNA, 16 nt, Human
gcauucuauugccuuc

SEQ ID NO: 3576365 - RNA, 20 nt, Human
gcauucuauugccuucuuug

SEQ ID NO: 3576366 - RNA, 14 nt, Human
gcauucucauggag

SEQ ID NO: 3576367 - RNA, 23 nt, Human
gcauucucuccauuucacuggcu

SEQ ID NO: 3576368 - RNA, 14 nt, Human
gcauucucucucca

SEQ ID NO: 3576369 - RNA, 14 nt, Human
gcauucucugaaga

SEQ ID NO: 3576370 - RNA, 20 nt, Human
gcauucugccgugugcccuc

SEQ ID NO: 3576371 - RNA, 16 nt, Human
gcauucuggaccucug

SEQ ID NO: 3576372 - RNA, 14 nt, Human
gcauucuucucugu

SEQ ID NO: 3576373 - RNA, 21 nt, Human
gcauucuugguuggcuggccu

SEQ ID NO: 3576374 - RNA, 15 nt, Human
gcauucuuguacagu

SEQ ID NO: 3576375 - RNA, 21 nt, Human
gcauucuugucacaauaaaug

SEQ ID NO: 3576376 - RNA, 22 nt, Human
gcauucuugucacaauaaaugu

SEQ ID NO: 3576377 - RNA, 16 nt, Human
gcauucuuuuaaaaga

SEQ ID NO: 3576378 - RNA, 21 nt, Human
gcauucuuuuaaaagacaaga

SEQ ID NO: 3576379 - RNA, 16 nt, Human
gcauugaaaagagcug

SEQ ID NO: 3576380 - RNA, 23 nt, Human
gcauugaacacaaacuguaaaua

SEQ ID NO: 3576381 - RNA, 22 nt, Human
gcauugaccgcgacuaauuuca

SEQ ID NO: 3576382 - RNA, 23 nt, Human
gcauugacugguuuacaggcccu

SEQ ID NO: 3576383 - RNA, 12 nt, Human
gcauugacuuuc

SEQ ID NO: 3576384 - RNA, 22 nt, Human
gcccgccugccaguccuagcug

SEQ ID NO: 3576385 - RNA, 15 nt, Human
gcccgccugcccacc

SEQ ID NO: 3576386 - RNA, 18 nt, Human
gcccgccugcccaccugc

SEQ ID NO: 3576387 - RNA, 22 nt, Human
gcccgccugcccaccugccugg

SEQ ID NO: 3576388 - RNA, 24 nt, Human
gcccgcgauguggaacugcugcca

SEQ ID NO: 3576389 - RNA, 19 nt, Human
gcccgcuugccucggcucc

SEQ ID NO: 3576390 - RNA, 21 nt, Human
gcccgcuugccucggcuccug

SEQ ID NO: 3576391 - RNA, 19 nt, Human
gcccggacgcccaggaccc

SEQ ID NO: 3576392 - RNA, 21 nt, Human
gcccggagauuggacggccug

SEQ ID NO: 3576393 - RNA, 14 nt, Human
gcccggcgcccucu

SEQ ID NO: 3576394 - RNA, 20 nt, Human
gcccggcgcccucuguccug

SEQ ID NO: 3576395 - RNA, 18 nt, Human
gcccggcgccuggccucc

SEQ ID NO: 3576396 - RNA, 21 nt, Human
gcccggcgccuggccuccagg

SEQ ID NO: 3576397 - RNA, 22 nt, Human
gcccggcgccuggccuccaggc

SEQ ID NO: 3576398 - RNA, 18 nt, Human
gcccggcuaauuuuugua

SEQ ID NO: 3576399 - RNA, 16 nt, Human
gcccggcuccaggcuc

SEQ ID NO: 3576400 - RNA, 20 nt, Human
gcccgggaaggucaccagca

SEQ ID NO: 3576401 - RNA, 17 nt, Human
gcccgggagcucaggaa

SEQ ID NO: 3576402 - RNA, 19 nt, Human
gcccgggagcucaggaacc

SEQ ID NO: 3576403 - RNA, 18 nt, Human
gcccgggcgcggccagcc

SEQ ID NO: 3576404 - RNA, 14 nt, Human
gcccgggcucugcc

SEQ ID NO: 3576405 - RNA, 18 nt, Human
gcccgggcucugccuccc

SEQ ID NO: 3576406 - RNA, 19 nt, Human
gcccgggcucugccuccca

SEQ ID NO: 3576407 - RNA, 14 nt, Human
gcccgggcugccug

SEQ ID NO: 3576408 - RNA, 17 nt, Human
gcccgggcugccugggc

SEQ ID NO: 3576409 - RNA, 18 nt, Human
gcccgggcugccugggcu

SEQ ID NO: 3576410 - RNA, 13 nt, Human
gcccggggcagca

SEQ ID NO: 3576411 - RNA, 18 nt, Human
gcccggggcagcugccag

SEQ ID NO: 3576412 - RNA, 16 nt, Human
gcccgggguggccaca

SEQ ID NO: 3576413 - RNA, 16 nt, Human
gcccggucccaccccu

SEQ ID NO: 3576414 - RNA, 19 nt, Human
gcccggugggggggcagag

SEQ ID NO: 3576415 - RNA, 13 nt, Human
gcccgucucagug

SEQ ID NO: 3576416 - RNA, 16 nt, Human
gcccgucucucuccca

SEQ ID NO: 3576417 - RNA, 19 nt, Human
gcccgucucucucccaugg

SEQ ID NO: 3576418 - RNA, 14 nt, Human
gcccgucuguccau

SEQ ID NO: 3576419 - RNA, 22 nt, Human
gcccgucugugugugaccccuc

SEQ ID NO: 3576420 - RNA, 14 nt, Human
gcccgucuucagcc

SEQ ID NO: 3576421 - RNA, 17 nt, Human
gcccgucuucagccuag

SEQ ID NO: 3576422 - RNA, 20 nt, Human
gcccgugacauccccacccu

SEQ ID NO: 3576423 - RNA, 19 nt, Human
gcccguguacauagugcau

SEQ ID NO: 3576424 - RNA, 18 nt, Human
gcccguguggccccuuca

SEQ ID NO: 3576425 - RNA, 17 nt, Human
gcccguugucucccugg

SEQ ID NO: 3576426 - RNA, 18 nt, Human
gcccguugucucccuggc

SEQ ID NO: 3576427 - RNA, 15 nt, Human
gcccuaaaagcacac

SEQ ID NO: 3576428 - RNA, 12 nt, Human
gcccuaagcaga

SEQ ID NO: 3576429 - RNA, 16 nt, Human
gcccuaagcagaaagu

SEQ ID NO: 3576430 - RNA, 18 nt, Human
gcccuaagcagaaagugc

SEQ ID NO: 3576431 - RNA, 16 nt, Human
gcccuaaguuuguacu

SEQ ID NO: 3576432 - RNA, 17 nt, Human
gcccuaaugcgcaggcu

SEQ ID NO: 3576433 - RNA, 17 nt, Human
gcccuacagagcugugg

SEQ ID NO: 3576434 - RNA, 20 nt, Human
gcccuacagaggucucugcc

SEQ ID NO: 3576435 - RNA, 15 nt, Human
gcccuacagcacccu

SEQ ID NO: 3576436 - RNA, 18 nt, Human
gcccuaccugccccacuu

SEQ ID NO: 3576437 - RNA, 21 nt, Human
gcccuaccugccccacuuguc

SEQ ID NO: 3576438 - RNA, 22 nt, Human
gcccuacucccugcagaugcca

SEQ ID NO: 3576439 - RNA, 17 nt, Human
gcccuagacuggugcua

SEQ ID NO: 3576440 - RNA, 17 nt, Human
gcccuagagcacacugu

SEQ ID NO: 3576441 - RNA, 19 nt, Human
gcccuagagcacacuguag

SEQ ID NO: 3576442 - RNA, 16 nt, Human
gcccuagagccugccu

SEQ ID NO: 3576443 - RNA, 18 nt, Human
gcccuagagccugccugg

SEQ ID NO: 3576444 - RNA, 13 nt, Human
gcccuaugggccu

SEQ ID NO: 3576445 - RNA, 14 nt, Human
gcccuaugggccug

SEQ ID NO: 3576446 - RNA, 17 nt, Human
gcccuauuuuugcaaug

SEQ ID NO: 3576447 - RNA, 16 nt, Human
gcccucaaggccuccc

SEQ ID NO: 3576448 - RNA, 18 nt, Human
gcccucaaggccucccac

SEQ ID NO: 3576449 - RNA, 20 nt, Human
gcccucaaggccucccacag

SEQ ID NO: 3576450 - RNA, 13 nt, Human
gcccucaagggug

SEQ ID NO: 3576451 - RNA, 15 nt, Human
gcccucacccugggg

SEQ ID NO: 3576452 - RNA, 17 nt, Human
gcccucacccuggggcu

SEQ ID NO: 3576453 - RNA, 18 nt, Human
gcccucagaugucccuug

SEQ ID NO: 3576454 - RNA, 19 nt, Human
gcccucaguagucccugca

SEQ ID NO: 3576455 - RNA, 23 nt, Human
gcccucaguagucccugcacagu

SEQ ID NO: 3576456 - RNA, 23 nt, Human
gcccucaucuugaagggcccagg

SEQ ID NO: 3576457 - RNA, 21 nt, Human
gcccucauuacugggccuuag

SEQ ID NO: 3576458 - RNA, 14 nt, Human
gcccuccaaaagca

SEQ ID NO: 3576459 - RNA, 21 nt, Human
gcccuccaagaccuucuccuu

SEQ ID NO: 3576460 - RNA, 23 nt, Human
gcccuccaagaccuucuccuuca

SEQ ID NO: 3576461 - RNA, 15 nt, Human
gcccuccacacccgc

SEQ ID NO: 3576462 - RNA, 15 nt, Human
gcccuccacaccugc

SEQ ID NO: 3576463 - RNA, 17 nt, Human
gcccuccacaucccuga

SEQ ID NO: 3576464 - RNA, 12 nt, Human
gcccuccagagc

SEQ ID NO: 3576465 - RNA, 14 nt, Human
gcccuccagagccc

SEQ ID NO: 3576466 - RNA, 15 nt, Human
gcccuccccagagca

SEQ ID NO: 3576467 - RNA, 16 nt, Human
gcccuccccagagcac

SEQ ID NO: 3576468 - RNA, 17 nt, Human
gcccuccccagagcacu

SEQ ID NO: 3576469 - RNA, 19 nt, Human
gcccuccccagagcacugg

SEQ ID NO: 3576470 - RNA, 17 nt, Human
gcccuccccuccccugc

SEQ ID NO: 3576471 - RNA, 19 nt, Human
gcccuccccuccccugcug

SEQ ID NO: 3576472 - RNA, 20 nt, Human
gcccuccccuccccugcugc

SEQ ID NO: 3576473 - RNA, 21 nt, Human
gcccuccccuccccugcugca

SEQ ID NO: 3576474 - RNA, 22 nt, Human
gcccuccccuccccugcugcag

SEQ ID NO: 3576475 - RNA, 22 nt, Human
gcccuccccuccggacuggugc

SEQ ID NO: 3576476 - RNA, 15 nt, Human
gcccuccccucucug

SEQ ID NO: 3576477 - RNA, 18 nt, Human
gcccuccccucucugcac

SEQ ID NO: 3576478 - RNA, 15 nt, Human
gcccucccugccccu

SEQ ID NO: 3576479 - RNA, 21 nt, Human
gcccucccugccccucccuuc

SEQ ID NO: 3576480 - RNA, 14 nt, Human
gcccucccuguccu

SEQ ID NO: 3576481 - RNA, 19 nt, Human
gcccucccuucucccugga

SEQ ID NO: 3576482 - RNA, 16 nt, Human
gcccuccgccuucaca

SEQ ID NO: 3576483 - RNA, 13 nt, Human
gcccuccucaccc

SEQ ID NO: 3576484 - RNA, 14 nt, Human
gcccuccucacccc

SEQ ID NO: 3576485 - RNA, 21 nt, Human
gcccuccucaccccgucuggg

SEQ ID NO: 3576486 - RNA, 18 nt, Human
gcccuccucccucccagc

SEQ ID NO: 3576487 - RNA, 23 nt, Human
gcccuccugaaacuuacacacaa

SEQ ID NO: 3576488 - RNA, 17 nt, Human
gcccuccugugcucagc

SEQ ID NO: 3576489 - RNA, 20 nt, Human
gcccuccugugcucagcccu

SEQ ID NO: 3576490 - RNA, 18 nt, Human
gcccuccugugcuggggg

SEQ ID NO: 3576491 - RNA, 10 nt, Human
gcccuccuuc

SEQ ID NO: 3576492 - RNA, 17 nt, Human
gcccuccuuccuaaauu

SEQ ID NO: 3576493 - RNA, 18 nt, Human
gcccuccuuucugugccc

SEQ ID NO: 3576494 - RNA, 21 nt, Human
gcccucgcacggccccgaagg

SEQ ID NO: 3576495 - RNA, 15 nt, Human
gcccucgcugccagc

SEQ ID NO: 3576496 - RNA, 15 nt, Human
gcccucgcugcuucu

SEQ ID NO: 3576497 - RNA, 17 nt, Human
gcccucgggcccagccc

SEQ ID NO: 3576498 - RNA, 20 nt, Human
gcccucgggcccagccccca

SEQ ID NO: 3576499 - RNA, 19 nt, Human
gcccucguggccagcccgg

SEQ ID NO: 3576500 - RNA, 23 nt, Human
gcccucgugguggaaacuuuucu

SEQ ID NO: 3576501 - RNA, 20 nt, Human
gcccucuccccaccccuacc

SEQ ID NO: 3576502 - RNA, 23 nt, Human
gcccucuccccaccccuaccccu

SEQ ID NO: 3576503 - RNA, 15 nt, Human
gcccucuccccugcc

SEQ ID NO: 3576504 - RNA, 24 nt, Human
gcccucucccucuaggcucugccu

SEQ ID NO: 3576505 - RNA, 19 nt, Human
gcccucuccugggcagcug

SEQ ID NO: 3576506 - RNA, 21 nt, Human
gcccucuccugggcagcugcc

SEQ ID NO: 3576507 - RNA, 16 nt, Human
gcccucuccuuuguuc

SEQ ID NO: 3576508 - RNA, 13 nt, Human
gcccucugcccac

SEQ ID NO: 3576509 - RNA, 19 nt, Human
gcccucuggaguggccacu

SEQ ID NO: 3576510 - RNA, 14 nt, Human
gcccucugggcucu

SEQ ID NO: 3576511 - RNA, 17 nt, Human
gcccucugggcucugag

SEQ ID NO: 3576512 - RNA, 18 nt, Human
gcccucugggcucugagu

SEQ ID NO: 3576513 - RNA, 11 nt, Human
gcccucuucca

SEQ ID NO: 3576514 - RNA, 13 nt, Human
gcccucuuccuga

SEQ ID NO: 3576515 - RNA, 16 nt, Human
gcccucuuccugacga

SEQ ID NO: 3576516 - RNA, 12 nt, Human
gcccucuucucg

SEQ ID NO: 3576517 - RNA, 14 nt, Human
gcccucuucuuacu

SEQ ID NO: 3576518 - RNA, 17 nt, Human
gcccugacccuguggaa

SEQ ID NO: 3576519 - RNA, 17 nt, Human
gcccugaccucccagcc

SEQ ID NO: 3576520 - RNA, 19 nt, Human
gcccugaccucccagcccu

SEQ ID NO: 3576521 - RNA, 19 nt, Human
gcccugagccagggucucc

SEQ ID NO: 3576522 - RNA, 22 nt, Human
gcccugagccagggucuccaga

SEQ ID NO: 3576523 - RNA, 22 nt, Human
gcccugagcucgguggacccag

SEQ ID NO: 3576524 - RNA, 14 nt, Human
gcccugagcuuucu

SEQ ID NO: 3576525 - RNA, 17 nt, Human
gcccugaggacagaugc

SEQ ID NO: 3576526 - RNA, 21 nt, Human
gcccugaggacagaugccucc

SEQ ID NO: 3576527 - RNA, 20 nt, Human
gcccugaggccuagacucug

SEQ ID NO: 3576528 - RNA, 12 nt, Human
gcccuuccaugu

SEQ ID NO: 3576529 - RNA, 16 nt, Human
gcccuucccacuggag

SEQ ID NO: 3576530 - RNA, 13 nt, Human
gcccuucccuguc

SEQ ID NO: 3576531 - RNA, 17 nt, Human
gcccuucccugucccuc

SEQ ID NO: 3576532 - RNA, 18 nt, Human
gcccuucccugucccucu

SEQ ID NO: 3576533 - RNA, 18 nt, Human
gcccuuccuccuccacca

SEQ ID NO: 3576534 - RNA, 12 nt, Human
gcccuuccucuc

SEQ ID NO: 3576535 - RNA, 14 nt, Human
gcccuuccucucca

SEQ ID NO: 3576536 - RNA, 18 nt, Human
gcccuuccucuccacugc

SEQ ID NO: 3576537 - RNA, 22 nt, Human
gcccuuccucuccacugccuuc

SEQ ID NO: 3576538 - RNA, 14 nt, Human
gcccuuccucugcu

SEQ ID NO: 3576539 - RNA, 15 nt, Human
gcccuuccucugcuc

SEQ ID NO: 3576540 - RNA, 23 nt, Human
gcccuuccuggacagcugugccu

SEQ ID NO: 3576541 - RNA, 20 nt, Human
gcccuucuauacccacccag

SEQ ID NO: 3576542 - RNA, 13 nt, Human
gcccuucucucca

SEQ ID NO: 3576543 - RNA, 19 nt, Human
gcccuucucuccagccccu

SEQ ID NO: 3576544 - RNA, 16 nt, Human
gcccuucuugcugccc

SEQ ID NO: 3576545 - RNA, 19 nt, Human
gcccuucuuuccacagaag

SEQ ID NO: 3576546 - RNA, 16 nt, Human
gcccuucuuucuaccc

SEQ ID NO: 3576547 - RNA, 22 nt, Human
gcccuugagcuccccaaaaacc

SEQ ID NO: 3576548 - RNA, 14 nt, Human
gcccuugagggaga

SEQ ID NO: 3576549 - RNA, 19 nt, Human
gcccuugcaguucagcacc

SEQ ID NO: 3576550 - RNA, 22 nt, Human
gcccuugcaguucagcaccacc

SEQ ID NO: 3576551 - RNA, 15 nt, Human
gcccuugcccugacc

SEQ ID NO: 3576552 - RNA, 12 nt, Human
gcccuuggccag

SEQ ID NO: 3576553 - RNA, 12 nt, Human
gcccuugggcca

SEQ ID NO: 3576554 - RNA, 14 nt, Human
gcccuugggccacc

SEQ ID NO: 3576555 - RNA, 22 nt, Human
gcccuuggggguccuccuccag

SEQ ID NO: 3576556 - RNA, 12 nt, Human
gcccuuguccca

SEQ ID NO: 3576557 - RNA, 13 nt, Human
gcccuugucugag

SEQ ID NO: 3576558 - RNA, 23 nt, Human
gcccuuguuuggggcaggaguag

SEQ ID NO: 3576559 - RNA, 23 nt, Human
gcccuuuacuugucuuucugggg

SEQ ID NO: 3576560 - RNA, 14 nt, Human
gcccuuuccucagg

SEQ ID NO: 3576561 - RNA, 17 nt, Human
gcccuuugaagccucag

SEQ ID NO: 3576562 - RNA, 18 nt, Human
gcccuuugaagccucagc

SEQ ID NO: 3576563 - RNA, 19 nt, Human
gcccuuugaagccucagcu

SEQ ID NO: 3576564 - RNA, 18 nt, Human
gcccuuuguccuccugcu

SEQ ID NO: 3576565 - RNA, 22 nt, Human
gcccuuuguccuccugcugcca

SEQ ID NO: 3576566 - RNA, 18 nt, Human
gcccuuuuucaauaacug

SEQ ID NO: 3576567 - RNA, 22 nt, Human
gcccuuuuuucugccuccuuua

SEQ ID NO: 3576568 - RNA, 19 nt, Human
gccgaaccaggagcugcuc

SEQ ID NO: 3576569 - RNA, 19 nt, Human
gccgaagaaggguccuucc

SEQ ID NO: 3576570 - RNA, 14 nt, Human
gccgaagcuaacag

SEQ ID NO: 3576571 - RNA, 15 nt, Human
gccgaagcuaacagg

SEQ ID NO: 3576572 - RNA, 14 nt, Human
gccgaagcucuggc

SEQ ID NO: 3576573 - RNA, 19 nt, Human
gccgaagcucuggcugaac

SEQ ID NO: 3576574 - RNA, 12 nt, Human
gccgacacuguu

SEQ ID NO: 3576575 - RNA, 16 nt, Human
gccgacauugucuccc

SEQ ID NO: 3576576 - RNA, 20 nt, Human
gccgacccccucucccugca

SEQ ID NO: 3576577 - RNA, 24 nt, Human
gccgacccccucucccugcauggc

SEQ ID NO: 3576578 - RNA, 22 nt, Human
gccgaccgaggcuggagcuggc

SEQ ID NO: 3576579 - RNA, 11 nt, Human
gccgaccucag

SEQ ID NO: 3576580 - RNA, 21 nt, Human
gccgaccucguccucccccug

SEQ ID NO: 3576581 - RNA, 13 nt, Human
gccgacuccuggg

SEQ ID NO: 3576582 - RNA, 17 nt, Human
gccgagagccugcuccc

SEQ ID NO: 3576583 - RNA, 16 nt, Human
gccgagaucacgccac

SEQ ID NO: 3576584 - RNA, 17 nt, Human
gccgagauugcaccacu

SEQ ID NO: 3576585 - RNA, 19 nt, Human
gccgagcaaccguggcccu

SEQ ID NO: 3576586 - RNA, 21 nt, Human
gccgagcccuugcccaugcug

SEQ ID NO: 3576587 - RNA, 20 nt, Human
gccgagccgggccuggggcu

SEQ ID NO: 3576588 - RNA, 15 nt, Human
gccgaggacuuugau

SEQ ID NO: 3576589 - RNA, 16 nt, Human
gccgaggguccuggcu

SEQ ID NO: 3576590 - RNA, 18 nt, Human
gccgaggguccuggcucc

SEQ ID NO: 3576591 - RNA, 14 nt, Human
gccgagucugucuc

SEQ ID NO: 3576592 - RNA, 21 nt, Human
gccgaguggauagaugcccug

SEQ ID NO: 3576593 - RNA, 14 nt, Human
gccgauagagggac

SEQ ID NO: 3576594 - RNA, 21 nt, Human
gccgcaaaccacacuggacuc

SEQ ID NO: 3576595 - RNA, 22 nt, Human
gccgcaaaccacacuggacucc

SEQ ID NO: 3576596 - RNA, 22 nt, Human
gccgcaaauuguaccuuuuuug

SEQ ID NO: 3576597 - RNA, 17 nt, Human
gccgcaagucugcagcc

SEQ ID NO: 3576598 - RNA, 23 nt, Human
gccgcaccccagagugugggaag

SEQ ID NO: 3576599 - RNA, 12 nt, Human
gccgcagagcug

SEQ ID NO: 3576600 - RNA, 19 nt, Human
gccgcagcccugcagaggg

SEQ ID NO: 3576601 - RNA, 18 nt, Human
gccgcagccucccucuga

SEQ ID NO: 3576602 - RNA, 15 nt, Human
gccgcagcucuugcc

SEQ ID NO: 3576603 - RNA, 17 nt, Human
gccgcaucuucuccauc

SEQ ID NO: 3576604 - RNA, 20 nt, Human
gccgccaguacuugucauau

SEQ ID NO: 3576605 - RNA, 13 nt, Human
gccgcccaaggcc

SEQ ID NO: 3576606 - RNA, 14 nt, Human
gccgcccaaggccc

SEQ ID NO: 3576607 - RNA, 15 nt, Human
gccgccccacccaga

SEQ ID NO: 3576608 - RNA, 19 nt, Human
gccgccccagccucugagc

SEQ ID NO: 3576609 - RNA, 15 nt, Human
gccgcccccuccuga

SEQ ID NO: 3576610 - RNA, 23 nt, Human
gccgcccccugccccccagccuc

SEQ ID NO: 3576611 - RNA, 11 nt, Human
gccgcccugua

SEQ ID NO: 3576612 - RNA, 15 nt, Human
gccgccgccucgccc

SEQ ID NO: 3576613 - RNA, 20 nt, Human
gccgccgcuagguagagucu

SEQ ID NO: 3576614 - RNA, 22 nt, Human
gccgccuccgggacccccagga

SEQ ID NO: 3576615 - RNA, 13 nt, Human
gccgccucgccca

SEQ ID NO: 3576616 - RNA, 15 nt, Human
gccgccucgcccacc

SEQ ID NO: 3576617 - RNA, 18 nt, Human
gccgccugcacuccucag

SEQ ID NO: 3576618 - RNA, 22 nt, Human
gccgccugcacuccucagggca

SEQ ID NO: 3576619 - RNA, 19 nt, Human
gccgccugcgggcugcccc

SEQ ID NO: 3576620 - RNA, 17 nt, Human
gccgcgucgcccuccca

SEQ ID NO: 3576621 - RNA, 20 nt, Human
gccgcguuuagaccaaggaa

SEQ ID NO: 3576622 - RNA, 13 nt, Human
gccgcuagaggcc

SEQ ID NO: 3576623 - RNA, 16 nt, Human
gccgcuagaggccuga

SEQ ID NO: 3576624 - RNA, 18 nt, Human
gccgcuagaugggcaugg

SEQ ID NO: 3576625 - RNA, 13 nt, Human
gccgcuagguaga

SEQ ID NO: 3576626 - RNA, 15 nt, Human
gccgcuccaccagca

SEQ ID NO: 3576627 - RNA, 12 nt, Human
gccgcuccaggg

SEQ ID NO: 3576628 - RNA, 19 nt, Human
gccgcuccugucugccagc

SEQ ID NO: 3576629 - RNA, 22 nt, Human
gccgcuccugucugccagccag

SEQ ID NO: 3576630 - RNA, 23 nt, Human
gccgcuccugucugccagccagc

SEQ ID NO: 3576631 - RNA, 17 nt, Human
gccgcucggaggcccca

SEQ ID NO: 3576632 - RNA, 18 nt, Human
gccgcucggaggccccaa

SEQ ID NO: 3576633 - RNA, 20 nt, Human
gccgcucggaggccccaaag

SEQ ID NO: 3576634 - RNA, 22 nt, Human
gccgcucggaggccccaaagga

SEQ ID NO: 3576635 - RNA, 17 nt, Human
gccgcugagcgaggaga

SEQ ID NO: 3576636 - RNA, 16 nt, Human
gccgcugaguggcagg

SEQ ID NO: 3576637 - RNA, 12 nt, Human
gccgcugccacg

SEQ ID NO: 3576638 - RNA, 19 nt, Human
gccgcugcccggcgcccuc

SEQ ID NO: 3576639 - RNA, 12 nt, Human
gccgcugugagc

SEQ ID NO: 3576640 - RNA, 16 nt, Human
gccgcuuuucuccucu

SEQ ID NO: 3576641 - RNA, 14 nt, Human
gccggagaggaaga

SEQ ID NO: 3576642 - RNA, 15 nt, Human
gccggaucugaggga

SEQ ID NO: 3576643 - RNA, 16 nt, Human
gccggaugugcuuuuc

SEQ ID NO: 3576644 - RNA, 19 nt, Human
gccggcaaccccaguucug

SEQ ID NO: 3576645 - RNA, 19 nt, Human
gccggcaauaaaagcccag

SEQ ID NO: 3576646 - RNA, 21 nt, Human
gccggcacagggucugcucuu

SEQ ID NO: 3576647 - RNA, 16 nt, Human
gccggcagccccagcc

SEQ ID NO: 3576648 - RNA, 19 nt, Human
gccggcagccccagccugc

SEQ ID NO: 3576649 - RNA, 17 nt, Human
gccggccagccagccac

SEQ ID NO: 3576650 - RNA, 15 nt, Human
gccggccagcuggga

SEQ ID NO: 3576651 - RNA, 18 nt, Human
gccggccaggugggcggg

SEQ ID NO: 3576652 - RNA, 12 nt, Human
gccggccucucu

SEQ ID NO: 3576653 - RNA, 13 nt, Human
gccggccucucug

SEQ ID NO: 3576654 - RNA, 14 nt, Human
gccggccucucugg

SEQ ID NO: 3576655 - RNA, 17 nt, Human
gccggcggcccaagccc

SEQ ID NO: 3576656 - RNA, 23 nt, Human
gccggcguggcaaauauaaaacu

SEQ ID NO: 3576657 - RNA, 16 nt, Human
gccggcuuucaggagc

SEQ ID NO: 3576658 - RNA, 20 nt, Human
gccgggaacagacaacagaa

SEQ ID NO: 3576659 - RNA, 20 nt, Human
gccgggaccacccugagccg

SEQ ID NO: 3576660 - RNA, 22 nt, Human
gccgggaccacccugagccggc

SEQ ID NO: 3576661 - RNA, 13 nt, Human
gccgggagccuga

SEQ ID NO: 3576662 - RNA, 19 nt, Human
gccgggagccugacccuca

SEQ ID NO: 3576663 - RNA, 23 nt, Human
gccgggcaugguggcgcaagccu

SEQ ID NO: 3576664 - RNA, 19 nt, Human
gccgggccgaauccccucc

SEQ ID NO: 3576665 - RNA, 15 nt, Human
gccgggccgcagacu

SEQ ID NO: 3576666 - RNA, 14 nt, Human
gccgggcgcggugg

SEQ ID NO: 3576667 - RNA, 21 nt, Human
gccgggcgugguggcaggcac

SEQ ID NO: 3576668 - RNA, 17 nt, Human
gccggggaacuggccaa

SEQ ID NO: 3576669 - RNA, 17 nt, Human
gccggggcgaguggcac

SEQ ID NO: 3576670 - RNA, 21 nt, Human
gccggggcuucugugcaccug

SEQ ID NO: 3576671 - RNA, 20 nt, Human
gccggggugggguggcugca

SEQ ID NO: 3576672 - RNA, 23 nt, Human
gccggggugggguggcugcagcc

SEQ ID NO: 3576673 - RNA, 23 nt, Human
gccugagcaguccuuggccugcu

SEQ ID NO: 3576674 - RNA, 12 nt, Human
gccugagcccag

SEQ ID NO: 3576675 - RNA, 14 nt, Human
gccugagcccaggg

SEQ ID NO: 3576676 - RNA, 14 nt, Human
gccugagccuggcc

SEQ ID NO: 3576677 - RNA, 17 nt, Human
gccugagccuggccagc

SEQ ID NO: 3576678 - RNA, 17 nt, Human
gccugagcgacagugag

SEQ ID NO: 3576679 - RNA, 23 nt, Human
gccugagcucacucggcacccug

SEQ ID NO: 3576680 - RNA, 18 nt, Human
gccugaggaugagcugga

SEQ ID NO: 3576681 - RNA, 20 nt, Human
gccugaggaugagcuggaag

SEQ ID NO: 3576682 - RNA, 13 nt, Human
gccugaggcuccu

SEQ ID NO: 3576683 - RNA, 14 nt, Human
gccugagggaaagg

SEQ ID NO: 3576684 - RNA, 15 nt, Human
gccugagggaaaggc

SEQ ID NO: 3576685 - RNA, 17 nt, Human
gccugagggaaaggcca

SEQ ID NO: 3576686 - RNA, 20 nt, Human
gccugagggccccucugccc

SEQ ID NO: 3576687 - RNA, 13 nt, Human
gccugaggggcag

SEQ ID NO: 3576688 - RNA, 20 nt, Human
gccugaggggcagccugccu

SEQ ID NO: 3576689 - RNA, 21 nt, Human
gccugaggucaggaguucaag

SEQ ID NO: 3576690 - RNA, 17 nt, Human
gccugaggucucgcuga

SEQ ID NO: 3576691 - RNA, 13 nt, Human
gccugagucaccu

SEQ ID NO: 3576692 - RNA, 15 nt, Human
gccugauauaaaugc

SEQ ID NO: 3576693 - RNA, 16 nt, Human
gccugaucagaccacg

SEQ ID NO: 3576694 - RNA, 21 nt, Human
gccugauccagccucuccccu

SEQ ID NO: 3576695 - RNA, 15 nt, Human
gccugaucucuuccu

SEQ ID NO: 3576696 - RNA, 23 nt, Human
gccugaucugcccaucgugaaga

SEQ ID NO: 3576697 - RNA, 21 nt, Human
gccugaugacaauaaagcuug

SEQ ID NO: 3576698 - RNA, 19 nt, Human
gccugaugaccaauuuuaa

SEQ ID NO: 3576699 - RNA, 19 nt, Human
gccugaugcucccuccccu

SEQ ID NO: 3576700 - RNA, 13 nt, Human
gccugauggaccu

SEQ ID NO: 3576701 - RNA, 13 nt, Human
gccugcaaacugg

SEQ ID NO: 3576702 - RNA, 23 nt, Human
gccugcaaacugggaaccccuuu

SEQ ID NO: 3576703 - RNA, 15 nt, Human
gccugcaauuucaua

SEQ ID NO: 3576704 - RNA, 18 nt, Human
gccugcaauuucauaugc

SEQ ID NO: 3576705 - RNA, 13 nt, Human
gccugcacacaag

SEQ ID NO: 3576706 - RNA, 21 nt, Human
gccugcaccaggagacagaca

SEQ ID NO: 3576707 - RNA, 21 nt, Human
gccugcacuugggggcucagc

SEQ ID NO: 3576708 - RNA, 16 nt, Human
gccugcagacucacug

SEQ ID NO: 3576709 - RNA, 11 nt, Human
gccugcagaga

SEQ ID NO: 3576710 - RNA, 14 nt, Human
gccugcagagagaa

SEQ ID NO: 3576711 - RNA, 16 nt, Human
gccugcagagagaagc

SEQ ID NO: 3576712 - RNA, 13 nt, Human
gccugcagcagga

SEQ ID NO: 3576713 - RNA, 10 nt, Human
gccugcagcc

SEQ ID NO: 3576714 - RNA, 22 nt, Human
gccugcaggaccugccuguagc

SEQ ID NO: 3576715 - RNA, 15 nt, Human
gccugcagggaagcc

SEQ ID NO: 3576716 - RNA, 22 nt, Human
gccugcagggaagccccacaug

SEQ ID NO: 3576717 - RNA, 21 nt, Human
gccugcagggccauggcucag

SEQ ID NO: 3576718 - RNA, 21 nt, Human
gccugcaggguggugcuggga

SEQ ID NO: 3576719 - RNA, 23 nt, Human
gccugcaggguggugcugggacu

SEQ ID NO: 3576720 - RNA, 24 nt, Human
gccugcaggguggugcugggacug

SEQ ID NO: 3576721 - RNA, 16 nt, Human
gccugcaggugcugcu

SEQ ID NO: 3576722 - RNA, 17 nt, Human
gccugcaguccuggaag

SEQ ID NO: 3576723 - RNA, 22 nt, Human
gccugcauccauucuccugagg

SEQ ID NO: 3576724 - RNA, 21 nt, Human
gccugcaugcuggguucugca

SEQ ID NO: 3576725 - RNA, 16 nt, Human
gccugcauguaaacac

SEQ ID NO: 3576726 - RNA, 14 nt, Human
gccugcauuuccuc

SEQ ID NO: 3576727 - RNA, 19 nt, Human
gccugcauuuccucgcagc

SEQ ID NO: 3576728 - RNA, 13 nt, Human
gccugccaccucc

SEQ ID NO: 3576729 - RNA, 13 nt, Human
gccugccaccugg

SEQ ID NO: 3576730 - RNA, 14 nt, Human
gccugccaccugga

SEQ ID NO: 3576731 - RNA, 16 nt, Human
gccugccaccuggacc

SEQ ID NO: 3576732 - RNA, 22 nt, Human
gccugccaccuggaccccugca

SEQ ID NO: 3576733 - RNA, 23 nt, Human
gccugccacucaggcccaaagcc

SEQ ID NO: 3576734 - RNA, 14 nt, Human
gccugccaguccua

SEQ ID NO: 3576735 - RNA, 18 nt, Human
gccugccaguccuagcug

SEQ ID NO: 3576736 - RNA, 10 nt, Human
gccugccaug

SEQ ID NO: 3576737 - RNA, 15 nt, Human
gccugccauguaccu

SEQ ID NO: 3576738 - RNA, 21 nt, Human
gccugcccaagcccaggccac

SEQ ID NO: 3576739 - RNA, 16 nt, Human
gccugcccaccugccu

SEQ ID NO: 3576740 - RNA, 17 nt, Human
gccugcccaccugccug

SEQ ID NO: 3576741 - RNA, 18 nt, Human
gccugcccaccugccugg

SEQ ID NO: 3576742 - RNA, 11 nt, Human
gccugcccagg

SEQ ID NO: 3576743 - RNA, 20 nt, Human
gccugcccaggccccugcca

SEQ ID NO: 3576744 - RNA, 21 nt, Human
gccugccccuacccuggacuu

SEQ ID NO: 3576745 - RNA, 18 nt, Human
gccugccccucccagaac

SEQ ID NO: 3576746 - RNA, 17 nt, Human
gccugcccgcacagcag

SEQ ID NO: 3576747 - RNA, 20 nt, Human
gccugcccgcacagcagccu

SEQ ID NO: 3576748 - RNA, 21 nt, Human
gccugcccguaaacacgccug

SEQ ID NO: 3576749 - RNA, 19 nt, Human
gccugcccugucaggaggc

SEQ ID NO: 3576750 - RNA, 13 nt, Human
gccugcccuuguc

SEQ ID NO: 3576751 - RNA, 20 nt, Human
gccugccgagcaaccguggc

SEQ ID NO: 3576752 - RNA, 16 nt, Human
gccugccgguaaacac

SEQ ID NO: 3576753 - RNA, 16 nt, Human
gccugccuccagggcu

SEQ ID NO: 3576754 - RNA, 17 nt, Human
gccugccuccagggcug

SEQ ID NO: 3576755 - RNA, 13 nt, Human
gccugccucccac

SEQ ID NO: 3576756 - RNA, 12 nt, Human
gccugccuggag

SEQ ID NO: 3576757 - RNA, 22 nt, Human
gccugccugucugucucuccau

SEQ ID NO: 3576758 - RNA, 17 nt, Human
gccugccuguucccauu

SEQ ID NO: 3576759 - RNA, 21 nt, Human
gccugccuuaagugaggaaau

SEQ ID NO: 3576760 - RNA, 14 nt, Human
gccugccuuuccau

SEQ ID NO: 3576761 - RNA, 15 nt, Human
gccugcgacccuggg

SEQ ID NO: 3576762 - RNA, 13 nt, Human
gccugcgccugcu

SEQ ID NO: 3576763 - RNA, 16 nt, Human
gccugcgccugcugca

SEQ ID NO: 3576764 - RNA, 16 nt, Human
gccugcguggcugacc

SEQ ID NO: 3576765 - RNA, 22 nt, Human
gccugcguggcugaccccccuc

SEQ ID NO: 3576766 - RNA, 23 nt, Human
gccugcuaauuccccagauugca

SEQ ID NO: 3576767 - RNA, 12 nt, Human
gccugcuccaga

SEQ ID NO: 3576768 - RNA, 15 nt, Human
gccugcuccagcugu

SEQ ID NO: 3576769 - RNA, 16 nt, Human
gccugcuccagcuguu

SEQ ID NO: 3576770 - RNA, 18 nt, Human
gccugcuccagcuguuca

SEQ ID NO: 3576771 - RNA, 11 nt, Human
gccugcucccc

SEQ ID NO: 3576772 - RNA, 16 nt, Human
gccugcucccccaccc

SEQ ID NO: 3576773 - RNA, 17 nt, Human
gccugcucccccacccc

SEQ ID NO: 3576774 - RNA, 13 nt, Human
gccugcuccuucc

SEQ ID NO: 3576775 - RNA, 14 nt, Human
gccugcuccuuccc

SEQ ID NO: 3576776 - RNA, 19 nt, Human
gccugcucuagugggacag

SEQ ID NO: 3576777 - RNA, 10 nt, Human
gccugcugca

SEQ ID NO: 3576778 - RNA, 14 nt, Human
gccugcugcaugcc

SEQ ID NO: 3576779 - RNA, 18 nt, Human
gccugcugcauggggugg

SEQ ID NO: 3576780 - RNA, 18 nt, Human
gccugcugcccaggcugu

SEQ ID NO: 3576781 - RNA, 19 nt, Human
gccugcugcugagaaccug

SEQ ID NO: 3576782 - RNA, 20 nt, Human
gccugcugcugagaaccugg

SEQ ID NO: 3576783 - RNA, 23 nt, Human
gccugcugcugagaaccuggccu

SEQ ID NO: 3576784 - RNA, 15 nt, Human
gccugcuggaggccu

SEQ ID NO: 3576785 - RNA, 17 nt, Human
gccugcuggaggccuca

SEQ ID NO: 3576786 - RNA, 18 nt, Human
gccugcuggaggccucag

SEQ ID NO: 3576787 - RNA, 13 nt, Human
gccugcuggcacc

SEQ ID NO: 3576788 - RNA, 16 nt, Human
gccugcuggcacccac

SEQ ID NO: 3576789 - RNA, 17 nt, Human
gccugcuggcacccacc

SEQ ID NO: 3576790 - RNA, 22 nt, Human
gccugcuggcucccuuacuuua

SEQ ID NO: 3576791 - RNA, 17 nt, Human
gccugcugggcucucca

SEQ ID NO: 3576792 - RNA, 18 nt, Human
gccugcugggcucuccac

SEQ ID NO: 3576793 - RNA, 24 nt, Human
gccugcugggcucuccaccucagc

SEQ ID NO: 3576794 - RNA, 13 nt, Human
gccugcuucccac

SEQ ID NO: 3576795 - RNA, 21 nt, Human
gccugcuucccaccucccugc

SEQ ID NO: 3576796 - RNA, 22 nt, Human
gccugcuuuagaauguuuuccu

SEQ ID NO: 3576797 - RNA, 17 nt, Human
gccugcuuugucuccuc

SEQ ID NO: 3576798 - RNA, 21 nt, Human
gccugcuuuucacugcugcaa

SEQ ID NO: 3576799 - RNA, 22 nt, Human
gccugcuuuuuauggccuguga

SEQ ID NO: 3576800 - RNA, 16 nt, Human
gccugcuuuuuggaaa

SEQ ID NO: 3576801 - RNA, 18 nt, Human
gccuggaaaccugucuga

SEQ ID NO: 3576802 - RNA, 21 nt, Human
gccuggacaguaucccacauc

SEQ ID NO: 3576803 - RNA, 22 nt, Human
gccuggacaguaucccacaucc

SEQ ID NO: 3576804 - RNA, 16 nt, Human
gccuggaccagccucu

SEQ ID NO: 3576805 - RNA, 17 nt, Human
gccuggaccagccucuc

SEQ ID NO: 3576806 - RNA, 13 nt, Human
gccuggaccccca

SEQ ID NO: 3576807 - RNA, 14 nt, Human
gccuggacccugug

SEQ ID NO: 3576808 - RNA, 18 nt, Human
gccuggaccucugacagc

SEQ ID NO: 3576809 - RNA, 18 nt, Human
gccuggaccugccuccug

SEQ ID NO: 3576810 - RNA, 19 nt, Human
gccuggaccugccuccugc

SEQ ID NO: 3576811 - RNA, 14 nt, Human
gccuggacuuuccu

SEQ ID NO: 3576812 - RNA, 15 nt, Human
gccuggacuuuccug

SEQ ID NO: 3576813 - RNA, 18 nt, Human
gccuggacuuuccugcaa

SEQ ID NO: 3576814 - RNA, 13 nt, Human
gccuggagaagcu

SEQ ID NO: 3576815 - RNA, 19 nt, Human
gccuggagacuuagggcac

SEQ ID NO: 3576816 - RNA, 21 nt, Human
gccuggagaugacuugaggcc

SEQ ID NO: 3576817 - RNA, 11 nt, Human
gccuggagccc

SEQ ID NO: 3576818 - RNA, 15 nt, Human
gcucugcccagagcu

SEQ ID NO: 3576819 - RNA, 21 nt, Human
gcucugcccauccugccccug

SEQ ID NO: 3576820 - RNA, 20 nt, Human
gcucugccccagaggccucu

SEQ ID NO: 3576821 - RNA, 20 nt, Human
gcucugccccagcucuggcu

SEQ ID NO: 3576822 - RNA, 22 nt, Human
gcucugccccagcuugggcaga

SEQ ID NO: 3576823 - RNA, 11 nt, Human
gcucugcccuu

SEQ ID NO: 3576824 - RNA, 18 nt, Human
gcucugcccuuguucccu

SEQ ID NO: 3576825 - RNA, 21 nt, Human
gcucugcccuuguucccuagg

SEQ ID NO: 3576826 - RNA, 18 nt, Human
gcucugccgucucuggag

SEQ ID NO: 3576827 - RNA, 11 nt, Human
gcucugccucc

SEQ ID NO: 3576828 - RNA, 14 nt, Human
gcucugccucccau

SEQ ID NO: 3576829 - RNA, 17 nt, Human
gcucugcgugucaccug

SEQ ID NO: 3576830 - RNA, 22 nt, Human
gcucugcgugucaccugugcuu

SEQ ID NO: 3576831 - RNA, 22 nt, Human
gcucugcuccccuaaagccuca

SEQ ID NO: 3576832 - RNA, 14 nt, Human
gcucugcuccucuc

SEQ ID NO: 3576833 - RNA, 19 nt, Human
gcucugcuccucuccccag

SEQ ID NO: 3576834 - RNA, 13 nt, Human
gcucugcucgccu

SEQ ID NO: 3576835 - RNA, 13 nt, Human
gcucugcugacag

SEQ ID NO: 3576836 - RNA, 18 nt, Human
gcucugcugacagacaca

SEQ ID NO: 3576837 - RNA, 20 nt, Human
gcucugcugacagacacagg

SEQ ID NO: 3576838 - RNA, 22 nt, Human
gcucugcugaugacccccccag

SEQ ID NO: 3576839 - RNA, 13 nt, Human
gcucugcuugccg

SEQ ID NO: 3576840 - RNA, 15 nt, Human
gcucuggaagagagg

SEQ ID NO: 3576841 - RNA, 22 nt, Human
gcucuggacagccccacccugg

SEQ ID NO: 3576842 - RNA, 15 nt, Human
gcucuggacaggcau

SEQ ID NO: 3576843 - RNA, 16 nt, Human
gcucuggacaggcaug

SEQ ID NO: 3576844 - RNA, 22 nt, Human
gcucuggacaggcauguucucu

SEQ ID NO: 3576845 - RNA, 22 nt, Human
gcucuggaccaacccuguuucc

SEQ ID NO: 3576846 - RNA, 16 nt, Human
gcucuggaccagccug

SEQ ID NO: 3576847 - RNA, 16 nt, Human
gcucuggacucuaaag

SEQ ID NO: 3576848 - RNA, 14 nt, Human
gcucuggagacagc

SEQ ID NO: 3576849 - RNA, 18 nt, Human
gcucuggagacagcccca

SEQ ID NO: 3576850 - RNA, 20 nt, Human
gcucuggagacagccccaga

SEQ ID NO: 3576851 - RNA, 13 nt, Human
gcucuggagagaa

SEQ ID NO: 3576852 - RNA, 14 nt, Human
gcucuggagagaaa

SEQ ID NO: 3576853 - RNA, 17 nt, Human
gcucuggagccaccugu

SEQ ID NO: 3576854 - RNA, 23 nt, Human
gcucuggagccaccugucccacc

SEQ ID NO: 3576855 - RNA, 17 nt, Human
gcucuggagcccacugu

SEQ ID NO: 3576856 - RNA, 23 nt, Human
gcucuggagcccacuguacuugc

SEQ ID NO: 3576857 - RNA, 15 nt, Human
gcucuggaggggagg

SEQ ID NO: 3576858 - RNA, 16 nt, Human
gcucuggaggggaggg

SEQ ID NO: 3576859 - RNA, 15 nt, Human
gcucuggcucacaga

SEQ ID NO: 3576860 - RNA, 19 nt, Human
gcucuggcugaacccugug

SEQ ID NO: 3576861 - RNA, 20 nt, Human
gcucuggcugaacccugugc

SEQ ID NO: 3576862 - RNA, 20 nt, Human
gcucugggccauucuccaca

SEQ ID NO: 3576863 - RNA, 16 nt, Human
gcucugguccauagag

SEQ ID NO: 3576864 - RNA, 20 nt, Human
gcucuggugacaccagccuu

SEQ ID NO: 3576865 - RNA, 19 nt, Human
gcucuggugauaaggacau

SEQ ID NO: 3576866 - RNA, 19 nt, Human
gcucugguuguuucuguuc

SEQ ID NO: 3576867 - RNA, 18 nt, Human
gcucuguaaucucguuuc

SEQ ID NO: 3576868 - RNA, 18 nt, Human
gcucuguaucaggaccca

SEQ ID NO: 3576869 - RNA, 19 nt, Human
gcucuguaucaggacccag

SEQ ID NO: 3576870 - RNA, 22 nt, Human
gcucuguaucaggacccagagg

SEQ ID NO: 3576871 - RNA, 23 nt, Human
gcucuguaucaggacccagagga

SEQ ID NO: 3576872 - RNA, 14 nt, Human
gcucugucccccug

SEQ ID NO: 3576873 - RNA, 13 nt, Human
gcucugucuacuu

SEQ ID NO: 3576874 - RNA, 11 nt, Human
gcucugugcug

SEQ ID NO: 3576875 - RNA, 22 nt, Human
gcucugugcugacccuccuguu

SEQ ID NO: 3576876 - RNA, 14 nt, Human
gcucuguucuuccu

SEQ ID NO: 3576877 - RNA, 15 nt, Human
gcucuguugcccagg

SEQ ID NO: 3576878 - RNA, 23 nt, Human
gcucuguugcccaggcuggagug

SEQ ID NO: 3576879 - RNA, 14 nt, Human
gcucuuacucuuuc

SEQ ID NO: 3576880 - RNA, 23 nt, Human
gcucuuagcaaaaacauguaugu

SEQ ID NO: 3576881 - RNA, 14 nt, Human
gcucuuauuucauc

SEQ ID NO: 3576882 - RNA, 12 nt, Human
gcucuucaggcc

SEQ ID NO: 3576883 - RNA, 17 nt, Human
gcucuucauaauucuaa

SEQ ID NO: 3576884 - RNA, 19 nt, Human
gcucuucauaauucuaaga

SEQ ID NO: 3576885 - RNA, 18 nt, Human
gcucuucaucccauucca

SEQ ID NO: 3576886 - RNA, 12 nt, Human
gcucuuccaggc

SEQ ID NO: 3576887 - RNA, 19 nt, Human
gcucuuccaggcugggaga

SEQ ID NO: 3576888 - RNA, 20 nt, Human
gcucuuccgaaaaccaggcc

SEQ ID NO: 3576889 - RNA, 19 nt, Human
gcucuuccuaucccucucc

SEQ ID NO: 3576890 - RNA, 14 nt, Human
gcucuucucauuuc

SEQ ID NO: 3576891 - RNA, 12 nt, Human
gcucuucuccag

SEQ ID NO: 3576892 - RNA, 14 nt, Human
gcucuucuccaggc

SEQ ID NO: 3576893 - RNA, 23 nt, Human
gcucuucuccuuucacaaccuuc

SEQ ID NO: 3576894 - RNA, 21 nt, Human
gcucuucugacuacugggcaa

SEQ ID NO: 3576895 - RNA, 16 nt, Human
gcucuugaacuccuga

SEQ ID NO: 3576896 - RNA, 21 nt, Human
gcucuugaacuccugaccuca

SEQ ID NO: 3576897 - RNA, 19 nt, Human
gcucuugauaccccccucu

SEQ ID NO: 3576898 - RNA, 14 nt, Human
gcucuugaugccug

SEQ ID NO: 3576899 - RNA, 15 nt, Human
gcucuugcagagaag

SEQ ID NO: 3576900 - RNA, 22 nt, Human
gcucuugcccuucccugucccu

SEQ ID NO: 3576901 - RNA, 23 nt, Human
gcucuugcccuucccugucccuc

SEQ ID NO: 3576902 - RNA, 18 nt, Human
gcucuuggcuggacccag

SEQ ID NO: 3576903 - RNA, 23 nt, Human
gcucuuggcuggacccagccagg

SEQ ID NO: 3576904 - RNA, 17 nt, Human
gcucuugugaggaaagu

SEQ ID NO: 3576905 - RNA, 19 nt, Human
gcucuugugaggaaaguca

SEQ ID NO: 3576906 - RNA, 22 nt, Human
gcucuugugguacacacagauu

SEQ ID NO: 3576907 - RNA, 22 nt, Human
gcucuuguuuuuauuaauuuau

SEQ ID NO: 3576908 - RNA, 13 nt, Human
gcucuuucagggg

SEQ ID NO: 3576909 - RNA, 20 nt, Human
gcucuuucccacccagccug

SEQ ID NO: 3576910 - RNA, 15 nt, Human
gcucuuuccuugcuc

SEQ ID NO: 3576911 - RNA, 13 nt, Human
gcucuuucugggc

SEQ ID NO: 3576912 - RNA, 14 nt, Human
gcucuuucugggcc

SEQ ID NO: 3576913 - RNA, 10 nt, Human
gcucuuucuu

SEQ ID NO: 3576914 - RNA, 21 nt, Human
gcucuuucuucuuccacacau

SEQ ID NO: 3576915 - RNA, 21 nt, Human
gcucuuuggggucagccaggg

SEQ ID NO: 3576916 - RNA, 23 nt, Human
gcucuuuggggucagccagggcc

SEQ ID NO: 3576917 - RNA, 21 nt, Human
gcucuuuguuuugugucucuu

SEQ ID NO: 3576918 - RNA, 15 nt, Human
gcucuuuucacagcu

SEQ ID NO: 3576919 - RNA, 17 nt, Human
gcucuuuuuuacucauu

SEQ ID NO: 3576920 - RNA, 23 nt, Human
gcucuuuuuuacucauugaaaug

SEQ ID NO: 3576921 - RNA, 20 nt, Human
gcucuuuuuuguuuguuucu

SEQ ID NO: 3576922 - RNA, 14 nt, Human
gcugaaaaaaaauu

SEQ ID NO: 3576923 - RNA, 12 nt, Human
gcugaaaacaau

SEQ ID NO: 3576924 - RNA, 19 nt, Human
gcugaaaaccaucuggccu

SEQ ID NO: 3576925 - RNA, 16 nt, Human
gcugaaacaacaaaua

SEQ ID NO: 3576926 - RNA, 18 nt, Human
gcugaaacaggagagaaa

SEQ ID NO: 3576927 - RNA, 23 nt, Human
gcugaaagaacauggacuuguau

SEQ ID NO: 3576928 - RNA, 14 nt, Human
gcugaaauucuccu

SEQ ID NO: 3576929 - RNA, 15 nt, Human
gcugaaauucuccug

SEQ ID NO: 3576930 - RNA, 19 nt, Human
gcugaaauugaaaaguuau

SEQ ID NO: 3576931 - RNA, 22 nt, Human
gcugaacaguggaggaagaggg

SEQ ID NO: 3576932 - RNA, 12 nt, Human
gcugaacaucac

SEQ ID NO: 3576933 - RNA, 22 nt, Human
gcugaacccauuuugagugacu

SEQ ID NO: 3576934 - RNA, 13 nt, Human
gcugaacccugug

SEQ ID NO: 3576935 - RNA, 17 nt, Human
gcugaacggggagaaaa

SEQ ID NO: 3576936 - RNA, 20 nt, Human
gcugaacuuguuuucuggga

SEQ ID NO: 3576937 - RNA, 18 nt, Human
gcugaagauggcauccug

SEQ ID NO: 3576938 - RNA, 19 nt, Human
gcugaagccgccaggaccg

SEQ ID NO: 3576939 - RNA, 16 nt, Human
gcugaagcugccugcu

SEQ ID NO: 3576940 - RNA, 23 nt, Human
gcugaaggacugugacaggcagc

SEQ ID NO: 3576941 - RNA, 18 nt, Human
gcugaauaaaugucuuuu

SEQ ID NO: 3576942 - RNA, 14 nt, Human
gcugaaugccuccu

SEQ ID NO: 3576943 - RNA, 17 nt, Human
gcugaaugguuuucaaa

SEQ ID NO: 3576944 - RNA, 17 nt, Human
gcugaauguugggacug

SEQ ID NO: 3576945 - RNA, 23 nt, Human
gcugaauguugggacugcuaaau

SEQ ID NO: 3576946 - RNA, 15 nt, Human
gcugaauguuuuucu

SEQ ID NO: 3576947 - RNA, 17 nt, Human
gcugaauuucccucucu

SEQ ID NO: 3576948 - RNA, 14 nt, Human
gcugaauuuucaca

SEQ ID NO: 3576949 - RNA, 19 nt, Human
gcugacaaccaccgcuccc

SEQ ID NO: 3576950 - RNA, 21 nt, Human
gcugacaaccaccgcucccca

SEQ ID NO: 3576951 - RNA, 23 nt, Human
gcugacaaccaccgcuccccagc

SEQ ID NO: 3576952 - RNA, 19 nt, Human
gcugacaaccauuaaaguc

SEQ ID NO: 3576953 - RNA, 20 nt, Human
gcugacaaccauuaaaguca

SEQ ID NO: 3576954 - RNA, 20 nt, Human
gcugacacaaaccugccugg

SEQ ID NO: 3576955 - RNA, 19 nt, Human
gcugacacguccaccccag

SEQ ID NO: 3576956 - RNA, 17 nt, Human
gcugacagacacaggcc

SEQ ID NO: 3576957 - RNA, 18 nt, Human
gcugacagacacaggccc

SEQ ID NO: 3576958 - RNA, 20 nt, Human
gcugacagacacaggcccgg

SEQ ID NO: 3576959 - RNA, 13 nt, Human
gcugacagcugcu

SEQ ID NO: 3576960 - RNA, 14 nt, Human
gcugacagcugcuc

SEQ ID NO: 3576961 - RNA, 17 nt, Human
gcugacagcugcuccua

SEQ ID NO: 3576962 - RNA, 15 nt, Human
gcugcuccaggccug

SEQ ID NO: 3576963 - RNA, 12 nt, Human
gcugcuccagug

SEQ ID NO: 3576964 - RNA, 17 nt, Human
gcugcuccagugcagga

SEQ ID NO: 3576965 - RNA, 10 nt, Human
gcugcuccca

SEQ ID NO: 3576966 - RNA, 22 nt, Human
gcugcucccaccuggcucugug

SEQ ID NO: 3576967 - RNA, 19 nt, Human
gcugcuccccagcagcgga

SEQ ID NO: 3576968 - RNA, 15 nt, Human
gcugcucccucagac

SEQ ID NO: 3576969 - RNA, 13 nt, Human
gcugcucccuggc

SEQ ID NO: 3576970 - RNA, 18 nt, Human
gcugcuccuagagggagg

SEQ ID NO: 3576971 - RNA, 22 nt, Human
gcugcuccuaggacccgucucc

SEQ ID NO: 3576972 - RNA, 12 nt, Human
gcugcuccucca

SEQ ID NO: 3576973 - RNA, 18 nt, Human
gcugcuccuccagggcca

SEQ ID NO: 3576974 - RNA, 17 nt, Human
gcugcuccuuagcugcc

SEQ ID NO: 3576975 - RNA, 15 nt, Human
gcugcuccuuggcuu

SEQ ID NO: 3576976 - RNA, 22 nt, Human
gcugcucggggugcacaggagg

SEQ ID NO: 3576977 - RNA, 12 nt, Human
gcugcucugccc

SEQ ID NO: 3576978 - RNA, 16 nt, Human
gcugcucugcccagag

SEQ ID NO: 3576979 - RNA, 18 nt, Human
gcugcucugcccagagcu

SEQ ID NO: 3576980 - RNA, 21 nt, Human
gcugcucugcccagagcuggg

SEQ ID NO: 3576981 - RNA, 17 nt, Human
gcugcucugccccagcu

SEQ ID NO: 3576982 - RNA, 15 nt, Human
gcugcucuuggcugg

SEQ ID NO: 3576983 - RNA, 13 nt, Human
gcugcugaagcug

SEQ ID NO: 3576984 - RNA, 20 nt, Human
gcugcugaagcugccugcuu

SEQ ID NO: 3576985 - RNA, 15 nt, Human
gcugcugaaggcuca

SEQ ID NO: 3576986 - RNA, 22 nt, Human
gcugcugaccaauugugcugcc

SEQ ID NO: 3576987 - RNA, 19 nt, Human
gcugcugaccuccacagcu

SEQ ID NO: 3576988 - RNA, 16 nt, Human
gcugcugacugauguu

SEQ ID NO: 3576989 - RNA, 13 nt, Human
gcugcugagaacc

SEQ ID NO: 3576990 - RNA, 18 nt, Human
gcugcugagaaccuggcc

SEQ ID NO: 3576991 - RNA, 20 nt, Human
gcugcugagauccuggacug

SEQ ID NO: 3576992 - RNA, 12 nt, Human
gcugcugagccg

SEQ ID NO: 3576993 - RNA, 16 nt, Human
gcugcugagccgcaga

SEQ ID NO: 3576994 - RNA, 18 nt, Human
gcugcugagccgcagaga

SEQ ID NO: 3576995 - RNA, 14 nt, Human
gcugcugccccugc

SEQ ID NO: 3576996 - RNA, 15 nt, Human
gcugcugccccugca

SEQ ID NO: 3576997 - RNA, 23 nt, Human
gcugcugccccugcacagcaggc

SEQ ID NO: 3576998 - RNA, 13 nt, Human
gcugcugcccugc

SEQ ID NO: 3576999 - RNA, 18 nt, Human
gcugcugccuggccacug

SEQ ID NO: 3577000 - RNA, 15 nt, Human
gcugcugcugcgccc

SEQ ID NO: 3577001 - RNA, 14 nt, Human
gcugcugcugcugc

SEQ ID NO: 3577002 - RNA, 18 nt, Human
gcugcuggaucacagcug

SEQ ID NO: 3577003 - RNA, 11 nt, Human
gcugcuggcca

SEQ ID NO: 3577004 - RNA, 21 nt, Human
gcugcuggccaaauagcaaag

SEQ ID NO: 3577005 - RNA, 17 nt, Human
gcugcuggcgccucugc

SEQ ID NO: 3577006 - RNA, 21 nt, Human
gcugcugggggcaacuggcca

SEQ ID NO: 3577007 - RNA, 15 nt, Human
gcugcuggugcacag

SEQ ID NO: 3577008 - RNA, 16 nt, Human
gcugcuguacugaagu

SEQ ID NO: 3577009 - RNA, 22 nt, Human
gcugcugucccucccccuuguc

SEQ ID NO: 3577010 - RNA, 23 nt, Human
gcugcugucccucccccuugucc

SEQ ID NO: 3577011 - RNA, 21 nt, Human
gcugcugugugcuuuuuuugu

SEQ ID NO: 3577012 - RNA, 22 nt, Human
gcugcugugugcuuuuuuugug

SEQ ID NO: 3577013 - RNA, 20 nt, Human
gcugcuuagaauccaaacuu

SEQ ID NO: 3577014 - RNA, 13 nt, Human
gcugcuucaagga

SEQ ID NO: 3577015 - RNA, 22 nt, Human
gcugcuucaaggauccugagcc

SEQ ID NO: 3577016 - RNA, 23 nt, Human
gcugcuucaaggauccugagcca

SEQ ID NO: 3577017 - RNA, 14 nt, Human
gcugcuucccucug

SEQ ID NO: 3577018 - RNA, 22 nt, Human
gcugcuucccucugccuguccc

SEQ ID NO: 3577019 - RNA, 18 nt, Human
gcugcuucucccaggcaa

SEQ ID NO: 3577020 - RNA, 21 nt, Human
gcugcuucucccaggcaaggc

SEQ ID NO: 3577021 - RNA, 23 nt, Human
gcugcuucucccaggcaaggcug

SEQ ID NO: 3577022 - RNA, 21 nt, Human
gcugcuucuuaaccccaguaa

SEQ ID NO: 3577023 - RNA, 16 nt, Human
gcugcuugggcuucau

SEQ ID NO: 3577024 - RNA, 22 nt, Human
gcugcuugggcuucauccuccu

SEQ ID NO: 3577025 - RNA, 18 nt, Human
gcugcuuuccccuguggg

SEQ ID NO: 3577026 - RNA, 19 nt, Human
gcugcuuuguuaccuuaaa

SEQ ID NO: 3577027 - RNA, 22 nt, Human
gcugcuuuguuaccuuaaaacu

SEQ ID NO: 3577028 - RNA, 19 nt, Human
gcugcuuuuauaucuguau

SEQ ID NO: 3577029 - RNA, 22 nt, Human
gcugcuuuucccuaagccaagg

SEQ ID NO: 3577030 - RNA, 19 nt, Human
gcugcuuuucuuuucuaac

SEQ ID NO: 3577031 - RNA, 19 nt, Human
gcugcuuuuugagguggca

SEQ ID NO: 3577032 - RNA, 14 nt, Human
gcugcuuuuuuuga

SEQ ID NO: 3577033 - RNA, 15 nt, Human
gcuggaaaagggucu

SEQ ID NO: 3577034 - RNA, 22 nt, Human
gcuggaaaagggucuugggaaa

SEQ ID NO: 3577035 - RNA, 21 nt, Human
gcuggaacagauucacacugu

SEQ ID NO: 3577036 - RNA, 21 nt, Human
gcuggaagacgcaagggccug

SEQ ID NO: 3577037 - RNA, 23 nt, Human
gcuggaagacgcaagggccugau

SEQ ID NO: 3577038 - RNA, 18 nt, Human
gcuggaagauagcuguga

SEQ ID NO: 3577039 - RNA, 17 nt, Human
gcuggaagauccugcgg

SEQ ID NO: 3577040 - RNA, 14 nt, Human
gcuggacagagggg

SEQ ID NO: 3577041 - RNA, 21 nt, Human
gcuggacagaggggacucugg

SEQ ID NO: 3577042 - RNA, 12 nt, Human
gcuggacccagc

SEQ ID NO: 3577043 - RNA, 14 nt, Human
gcuggacccugacc

SEQ ID NO: 3577044 - RNA, 15 nt, Human
gcuggacccugacca

SEQ ID NO: 3577045 - RNA, 16 nt, Human
gcuggacggcauuccu

SEQ ID NO: 3577046 - RNA, 21 nt, Human
gcuggacuccagaucugcacc

SEQ ID NO: 3577047 - RNA, 16 nt, Human
gcuggacucugcaucc

SEQ ID NO: 3577048 - RNA, 14 nt, Human
gcuggacugaggcc

SEQ ID NO: 3577049 - RNA, 23 nt, Human
gcuggacuggaggccccuggagc

SEQ ID NO: 3577050 - RNA, 12 nt, Human
gcuggacuggcu

SEQ ID NO: 3577051 - RNA, 14 nt, Human
gcuggacuggcugu

SEQ ID NO: 3577052 - RNA, 21 nt, Human
gcuggacuucuaccugcccuc

SEQ ID NO: 3577053 - RNA, 12 nt, Human
gcuggagaagag

SEQ ID NO: 3577054 - RNA, 16 nt, Human
gcuggagaagcucacc

SEQ ID NO: 3577055 - RNA, 16 nt, Human
gcuggagaggagcccu

SEQ ID NO: 3577056 - RNA, 21 nt, Human
gcuggagaggagcccugccuc

SEQ ID NO: 3577057 - RNA, 22 nt, Human
gcuggagauacuuggucacagc

SEQ ID NO: 3577058 - RNA, 15 nt, Human
gcuggagauguuuua

SEQ ID NO: 3577059 - RNA, 14 nt, Human
gcuggagcacuggg

SEQ ID NO: 3577060 - RNA, 15 nt, Human
gcuggagcacugggc

SEQ ID NO: 3577061 - RNA, 16 nt, Human
gcuggagcacugggcu

SEQ ID NO: 3577062 - RNA, 18 nt, Human
gcuggagcacugggcucc

SEQ ID NO: 3577063 - RNA, 21 nt, Human
gcuggagccuagaacaggccu

SEQ ID NO: 3577064 - RNA, 13 nt, Human
gcuggagccugag

SEQ ID NO: 3577065 - RNA, 19 nt, Human
gcuggagccugagucaggg

SEQ ID NO: 3577066 - RNA, 21 nt, Human
gcuggagccuguguaacagcu

SEQ ID NO: 3577067 - RNA, 21 nt, Human
gcuggaggacuagaaccugga

SEQ ID NO: 3577068 - RNA, 16 nt, Human
gcuggaggagcccagg

SEQ ID NO: 3577069 - RNA, 22 nt, Human
gcuggaggagcccaggccagga

SEQ ID NO: 3577070 - RNA, 17 nt, Human
gcuggaggaugugggca

SEQ ID NO: 3577071 - RNA, 19 nt, Human
gcuggaggaugugggcagc

SEQ ID NO: 3577072 - RNA, 22 nt, Human
gcuggaggcaggggcuuccugg

SEQ ID NO: 3577073 - RNA, 23 nt, Human
gcuggaggcaggggcuuccuggu

SEQ ID NO: 3577074 - RNA, 16 nt, Human
gcuggaggcccaggcu

SEQ ID NO: 3577075 - RNA, 16 nt, Human
gcuggagguggggccu

SEQ ID NO: 3577076 - RNA, 23 nt, Human
gcuggagguggggcgaggcaggc

SEQ ID NO: 3577077 - RNA, 12 nt, Human
gcuggagugagg

SEQ ID NO: 3577078 - RNA, 15 nt, Human
gcuggagugcaguga

SEQ ID NO: 3577079 - RNA, 15 nt, Human
gcuggagugugaggg

SEQ ID NO: 3577080 - RNA, 15 nt, Human
gcuggaguugucacu

SEQ ID NO: 3577081 - RNA, 16 nt, Human
gcuggaguuucaugua

SEQ ID NO: 3577082 - RNA, 16 nt, Human
gcuggauauuuuacua

SEQ ID NO: 3577083 - RNA, 19 nt, Human
gcuggaucacagcugcuuu

SEQ ID NO: 3577084 - RNA, 13 nt, Human
gcuggaucuguga

SEQ ID NO: 3577085 - RNA, 20 nt, Human
gcuggaugagaauuugagug

SEQ ID NO: 3577086 - RNA, 14 nt, Human
gcuggaugagcucc

SEQ ID NO: 3577087 - RNA, 15 nt, Human
gcuggaugagcuccc

SEQ ID NO: 3577088 - RNA, 22 nt, Human
gcuggaugucugccaauuuuug

SEQ ID NO: 3577089 - RNA, 22 nt, Human
gcuggauuggguuaugaauauu

SEQ ID NO: 3577090 - RNA, 21 nt, Human
gcuggcaacacagaggcagcc

SEQ ID NO: 3577091 - RNA, 23 nt, Human
gcuggcacauuuccccagaccug

SEQ ID NO: 3577092 - RNA, 21 nt, Human
gcuggcacccaccguggagga

SEQ ID NO: 3577093 - RNA, 23 nt, Human
gcuggcacccaccguggaggagg

SEQ ID NO: 3577094 - RNA, 23 nt, Human
gcuggcagcucuccagucaggag

SEQ ID NO: 3577095 - RNA, 18 nt, Human
gcuggccagccccacagc

SEQ ID NO: 3577096 - RNA, 21 nt, Human
gcuggccagccccacagccca

SEQ ID NO: 3577097 - RNA, 14 nt, Human
gcuggccagccgcu

SEQ ID NO: 3577098 - RNA, 12 nt, Human
gcuggccagccu

SEQ ID NO: 3577099 - RNA, 14 nt, Human
gcuggccagccugg

SEQ ID NO: 3577100 - RNA, 16 nt, Human
gcuggccagccugggg

SEQ ID NO: 3577101 - RNA, 23 nt, Human
gcuggccagccuggggccuggca

SEQ ID NO: 3577102 - RNA, 15 nt, Human
gcuggccaguccagg

SEQ ID NO: 3577103 - RNA, 16 nt, Human
gcuggccaguccaggc

SEQ ID NO: 3577104 - RNA, 23 nt, Human
gcuggccaucugguuaggauggc

SEQ ID NO: 3577105 - RNA, 20 nt, Human
gcuggccauggagaaagcug

SEQ ID NO: 3577106 - RNA, 16 nt, Human
ggacuggccccugggu

SEQ ID NO: 3577107 - RNA, 23 nt, Human
ggacugggagcccccagccuguc

SEQ ID NO: 3577108 - RNA, 11 nt, Human
ggacugggagg

SEQ ID NO: 3577109 - RNA, 23 nt, Human
ggacugggccacuucuggguggg

SEQ ID NO: 3577110 - RNA, 17 nt, Human
ggacuggggauguggga

SEQ ID NO: 3577111 - RNA, 20 nt, Human
ggacuggguugcguccugac

SEQ ID NO: 3577112 - RNA, 21 nt, Human
ggacuggguuuggaccccagc

SEQ ID NO: 3577113 - RNA, 14 nt, Human
ggacuggugcccuc

SEQ ID NO: 3577114 - RNA, 22 nt, Human
ggacuguacacacuuuauuuac

SEQ ID NO: 3577115 - RNA, 15 nt, Human
ggacuguauuuguga

SEQ ID NO: 3577116 - RNA, 15 nt, Human
ggacugucauagaaa

SEQ ID NO: 3577117 - RNA, 19 nt, Human
ggacugugacaggcagcag

SEQ ID NO: 3577118 - RNA, 15 nt, Human
ggacugugugcucag

SEQ ID NO: 3577119 - RNA, 20 nt, Human
ggacuguuuuuuccugagcu

SEQ ID NO: 3577120 - RNA, 15 nt, Human
ggacuuaacggcucc

SEQ ID NO: 3577121 - RNA, 22 nt, Human
ggacuuagaaaaccagcucagc

SEQ ID NO: 3577122 - RNA, 12 nt, Human
ggacuuaggaag

SEQ ID NO: 3577123 - RNA, 11 nt, Human
ggacuuccugu

SEQ ID NO: 3577124 - RNA, 18 nt, Human
ggacuuccuguccagcuc

SEQ ID NO: 3577125 - RNA, 15 nt, Human
ggacuuccuugcucu

SEQ ID NO: 3577126 - RNA, 17 nt, Human
ggacuucuaccugcccu

SEQ ID NO: 3577127 - RNA, 22 nt, Human
ggacuucugggguaaguggucu

SEQ ID NO: 3577128 - RNA, 11 nt, Human
ggacuucuuuu

SEQ ID NO: 3577129 - RNA, 17 nt, Human
ggacuucuuuucacauu

SEQ ID NO: 3577130 - RNA, 23 nt, Human
ggacuugaaagcauccaugugug

SEQ ID NO: 3577131 - RNA, 12 nt, Human
ggacuugaaguu

SEQ ID NO: 3577132 - RNA, 15 nt, Human
ggacuuggccucucu

SEQ ID NO: 3577133 - RNA, 17 nt, Human
ggacuuggccucucucu

SEQ ID NO: 3577134 - RNA, 12 nt, Human
ggacuugugucu

SEQ ID NO: 3577135 - RNA, 16 nt, Human
ggacuugugucucugu

SEQ ID NO: 3577136 - RNA, 20 nt, Human
ggacuuuccuaaauguuuaa

SEQ ID NO: 3577137 - RNA, 17 nt, Human
ggacuuucucuaauaau

SEQ ID NO: 3577138 - RNA, 23 nt, Human
ggacuuucuuuucgccguggcug

SEQ ID NO: 3577139 - RNA, 16 nt, Human
ggacuuugcagccggc

SEQ ID NO: 3577140 - RNA, 9 nt, Human
ggacuuugu

SEQ ID NO: 3577141 - RNA, 20 nt, Human
ggacuuuguauacuuuaaau

SEQ ID NO: 3577142 - RNA, 20 nt, Human
ggagaaaaaaagcauguguc

SEQ ID NO: 3577143 - RNA, 12 nt, Human
ggagaaaaacaa

SEQ ID NO: 3577144 - RNA, 22 nt, Human
ggagaaaaggaaaagaaaaaaa

SEQ ID NO: 3577145 - RNA, 18 nt, Human
ggagaaaaucaucaagaa

SEQ ID NO: 3577146 - RNA, 14 nt, Human
ggagaaacagagac

SEQ ID NO: 3577147 - RNA, 24 nt, Human
ggagaaagcuugguucugugaaca

SEQ ID NO: 3577148 - RNA, 16 nt, Human
ggagaaaggaagggcu

SEQ ID NO: 3577149 - RNA, 11 nt, Human
ggagaaaguac

SEQ ID NO: 3577150 - RNA, 22 nt, Human
ggagaaaucuggcuucuggcca

SEQ ID NO: 3577151 - RNA, 20 nt, Human
ggagaaaugcauccauuccu

SEQ ID NO: 3577152 - RNA, 23 nt, Human
ggagaacaucuuugacacucugc

SEQ ID NO: 3577153 - RNA, 23 nt, Human
ggagaacaugaaucaaaagugcc

SEQ ID NO: 3577154 - RNA, 17 nt, Human
ggagaaccuugugccug

SEQ ID NO: 3577155 - RNA, 22 nt, Human
ggagaacuagaaccuggagggc

SEQ ID NO: 3577156 - RNA, 11 nt, Human
ggagaagaacu

SEQ ID NO: 3577157 - RNA, 14 nt, Human
ggagaagaacugaa

SEQ ID NO: 3577158 - RNA, 22 nt, Human
ggagaagaauuuucagacccca

SEQ ID NO: 3577159 - RNA, 22 nt, Human
ggagaagagaggagaggagaga

SEQ ID NO: 3577160 - RNA, 13 nt, Human
ggagaagccagga

SEQ ID NO: 3577161 - RNA, 18 nt, Human
ggagaagcggcuggcagc

SEQ ID NO: 3577162 - RNA, 14 nt, Human
ggagaagcugcagg

SEQ ID NO: 3577163 - RNA, 22 nt, Human
ggagaaggaaggagacucaccu

SEQ ID NO: 3577164 - RNA, 20 nt, Human
ggagaaggaucuagaaugug

SEQ ID NO: 3577165 - RNA, 17 nt, Human
ggagaagggaaguugaa

SEQ ID NO: 3577166 - RNA, 21 nt, Human
ggagaagggauggaggucaca

SEQ ID NO: 3577167 - RNA, 21 nt, Human
ggagaagucuuucaagaauga

SEQ ID NO: 3577168 - RNA, 18 nt, Human
ggagaagugacauugcau

SEQ ID NO: 3577169 - RNA, 18 nt, Human
ggagaaucacaggcuggg

SEQ ID NO: 3577170 - RNA, 19 nt, Human
ggagaaucacaggcugggc

SEQ ID NO: 3577171 - RNA, 19 nt, Human
ggagaaucacuugaacccg

SEQ ID NO: 3577172 - RNA, 22 nt, Human
ggagaaucaucaggacccugga

SEQ ID NO: 3577173 - RNA, 19 nt, Human
ggagaaucaugugaacccg

SEQ ID NO: 3577174 - RNA, 20 nt, Human
ggagaaucauguuucuuuga

SEQ ID NO: 3577175 - RNA, 19 nt, Human
ggagaaucgcuccugcagc

SEQ ID NO: 3577176 - RNA, 22 nt, Human
ggagaauggugugaacccggga

SEQ ID NO: 3577177 - RNA, 15 nt, Human
ggagacaagaaaucc

SEQ ID NO: 3577178 - RNA, 19 nt, Human
ggagacaaugcagaugcca

SEQ ID NO: 3577179 - RNA, 9 nt, Human
ggagacaga

SEQ ID NO: 3577180 - RNA, 18 nt, Human
ggagacagcaucaggguu

SEQ ID NO: 3577181 - RNA, 17 nt, Human
ggagacagccccagagc

SEQ ID NO: 3577182 - RNA, 22 nt, Human
ggagacauaaccacugcuucca

SEQ ID NO: 3577183 - RNA, 15 nt, Human
ggagacaugugacau

SEQ ID NO: 3577184 - RNA, 20 nt, Human
ggagacauuccugggcacag

SEQ ID NO: 3577185 - RNA, 13 nt, Human
ggagacccugcaa

SEQ ID NO: 3577186 - RNA, 20 nt, Human
ggagaccgggguauccuggg

SEQ ID NO: 3577187 - RNA, 17 nt, Human
ggagaccucagaaguaa

SEQ ID NO: 3577188 - RNA, 19 nt, Human
ggagacgguuuccagggag

SEQ ID NO: 3577189 - RNA, 22 nt, Human
ggagacguacguaucagcggcc

SEQ ID NO: 3577190 - RNA, 14 nt, Human
ggagacuagauugc

SEQ ID NO: 3577191 - RNA, 22 nt, Human
ggagacuagauuuaugaauaca

SEQ ID NO: 3577192 - RNA, 18 nt, Human
ggagacucaccucugccu

SEQ ID NO: 3577193 - RNA, 21 nt, Human
ggagacugcuccugagccccc

SEQ ID NO: 3577194 - RNA, 19 nt, Human
ggagacugcuucccauccu

SEQ ID NO: 3577195 - RNA, 23 nt, Human
ggagacugcuucccauccuaccc

SEQ ID NO: 3577196 - RNA, 17 nt, Human
ggagacugggcugaggg

SEQ ID NO: 3577197 - RNA, 20 nt, Human
ggagacugggcugagggagc

SEQ ID NO: 3577198 - RNA, 23 nt, Human
ggagacugggcugagggagccug

SEQ ID NO: 3577199 - RNA, 19 nt, Human
ggagacugugugugcccuc

SEQ ID NO: 3577200 - RNA, 21 nt, Human
ggagacugugugugcccucug

SEQ ID NO: 3577201 - RNA, 12 nt, Human
ggagagaaaaaa

SEQ ID NO: 3577202 - RNA, 14 nt, Human
ggagagaaaauaua

SEQ ID NO: 3577203 - RNA, 16 nt, Human
ggagagaaagugggug

SEQ ID NO: 3577204 - RNA, 18 nt, Human
ggagagaaggggaggagg

SEQ ID NO: 3577205 - RNA, 21 nt, Human
ggagagaaggggaggagggcg

SEQ ID NO: 3577206 - RNA, 14 nt, Human
ggagagacacagcg

SEQ ID NO: 3577207 - RNA, 12 nt, Human
ggagagacagcu

SEQ ID NO: 3577208 - RNA, 11 nt, Human
ggagagaccuc

SEQ ID NO: 3577209 - RNA, 17 nt, Human
ggagagacucccaugaa

SEQ ID NO: 3577210 - RNA, 18 nt, Human
ggagagacucccaugaag

SEQ ID NO: 3577211 - RNA, 21 nt, Human
ggagagacucccaugaagccu

SEQ ID NO: 3577212 - RNA, 22 nt, Human
ggagagacucccaugaagccuu

SEQ ID NO: 3577213 - RNA, 12 nt, Human
ggagagacuugu

SEQ ID NO: 3577214 - RNA, 14 nt, Human
ggagagagaaagcc

SEQ ID NO: 3577215 - RNA, 22 nt, Human
ggagagagcagcuucugccacu

SEQ ID NO: 3577216 - RNA, 16 nt, Human
ggagagaggcagagag

SEQ ID NO: 3577217 - RNA, 20 nt, Human
ggagagaguugaaccuaaac

SEQ ID NO: 3577218 - RNA, 13 nt, Human
ggagagcaggcug

SEQ ID NO: 3577219 - RNA, 16 nt, Human
ggagagcaggcuggca

SEQ ID NO: 3577220 - RNA, 18 nt, Human
ggagagcaucggccuagg

SEQ ID NO: 3577221 - RNA, 13 nt, Human
ggagagccagaga

SEQ ID NO: 3577222 - RNA, 15 nt, Human
ggagagccagagaag

SEQ ID NO: 3577223 - RNA, 16 nt, Human
ggagagccagagaagu

SEQ ID NO: 3577224 - RNA, 21 nt, Human
ggagagccagagaagugacag

SEQ ID NO: 3577225 - RNA, 21 nt, Human
ggagagccagcccucccuguc

SEQ ID NO: 3577226 - RNA, 21 nt, Human
ggagagccagcuaaggggugg

SEQ ID NO: 3577227 - RNA, 11 nt, Human
ggagagcccag

SEQ ID NO: 3577228 - RNA, 12 nt, Human
ggagagcccagc

SEQ ID NO: 3577229 - RNA, 13 nt, Human
ggagagcccagga

SEQ ID NO: 3577230 - RNA, 20 nt, Human
ggagagcccaggagcucccc

SEQ ID NO: 3577231 - RNA, 17 nt, Human
ggagagccuuccagggg

SEQ ID NO: 3577232 - RNA, 18 nt, Human
ggagagccuuccaggggu

SEQ ID NO: 3577233 - RNA, 16 nt, Human
ggagagcgccugcccc

SEQ ID NO: 3577234 - RNA, 22 nt, Human
ggagagcuagaacccggcaggc

SEQ ID NO: 3577235 - RNA, 19 nt, Human
ggagagcuagaaccuggag

SEQ ID NO: 3577236 - RNA, 20 nt, Human
ggagagcuagaaccuggaga

SEQ ID NO: 3577237 - RNA, 15 nt, Human
ggagagcuaggagca

SEQ ID NO: 3577238 - RNA, 17 nt, Human
ggagagcuggagccugg

SEQ ID NO: 3577239 - RNA, 12 nt, Human
ggagaggaaaga

SEQ ID NO: 3577240 - RNA, 15 nt, Human
ggagaggaagagaca

SEQ ID NO: 3577241 - RNA, 12 nt, Human
ggagaggagagc

SEQ ID NO: 3577242 - RNA, 13 nt, Human
ggagaggagagcc

SEQ ID NO: 3577243 - RNA, 16 nt, Human
ggagaggagcccugcc

SEQ ID NO: 3577244 - RNA, 16 nt, Human
ggagaggcagagugcc

SEQ ID NO: 3577245 - RNA, 13 nt, Human
ggagaggccauga

SEQ ID NO: 3577246 - RNA, 23 nt, Human
ggagagggaaacgugcccucugu

SEQ ID NO: 3577247 - RNA, 14 nt, Human
ggagagggaugagg

SEQ ID NO: 3577248 - RNA, 15 nt, Human
ggagaggggcacagg

SEQ ID NO: 3577249 - RNA, 18 nt, Human
ggagagggggcugguggg

SEQ ID NO: 3577250 - RNA, 19 nt, Human
ggagcggccgccugcgggc

SEQ ID NO: 3577251 - RNA, 20 nt, Human
ggagcggccggccagccccu

SEQ ID NO: 3577252 - RNA, 18 nt, Human
ggagcgggucugcuccca

SEQ ID NO: 3577253 - RNA, 17 nt, Human
ggagcuaacacuggccc

SEQ ID NO: 3577254 - RNA, 18 nt, Human
ggagcuaacacuggcccc

SEQ ID NO: 3577255 - RNA, 12 nt, Human
ggagcuaaggcu

SEQ ID NO: 3577256 - RNA, 19 nt, Human
ggagcuaccuguguggaca

SEQ ID NO: 3577257 - RNA, 23 nt, Human
ggagcuaccuguguggacaggac

SEQ ID NO: 3577258 - RNA, 14 nt, Human
ggagcucagagagg

SEQ ID NO: 3577259 - RNA, 19 nt, Human
ggagcuccucuccuggagg

SEQ ID NO: 3577260 - RNA, 21 nt, Human
ggagcuccucuccuggaggau

SEQ ID NO: 3577261 - RNA, 12 nt, Human
ggagcuccuggg

SEQ ID NO: 3577262 - RNA, 20 nt, Human
ggagcucuucaggccucccu

SEQ ID NO: 3577263 - RNA, 12 nt, Human
ggagcugagaau

SEQ ID NO: 3577264 - RNA, 20 nt, Human
ggagcugagaauagaaggaa

SEQ ID NO: 3577265 - RNA, 15 nt, Human
ggagcugccccucuc

SEQ ID NO: 3577266 - RNA, 13 nt, Human
ggagcugccugga

SEQ ID NO: 3577267 - RNA, 15 nt, Human
ggagcugccuggacc

SEQ ID NO: 3577268 - RNA, 22 nt, Human
ggagcugccuguucagcuccag

SEQ ID NO: 3577269 - RNA, 18 nt, Human
ggagcugccuuggcucag

SEQ ID NO: 3577270 - RNA, 21 nt, Human
ggagcugccuuggcucagaca

SEQ ID NO: 3577271 - RNA, 24 nt, Human
ggagcugcucacuaccuccucagg

SEQ ID NO: 3577272 - RNA, 12 nt, Human
ggagcuggcccc

SEQ ID NO: 3577273 - RNA, 20 nt, Human
ggagcuggcuccagccugga

SEQ ID NO: 3577274 - RNA, 13 nt, Human
ggagcugggccug

SEQ ID NO: 3577275 - RNA, 18 nt, Human
ggagcuguaaaccagaga

SEQ ID NO: 3577276 - RNA, 18 nt, Human
ggagcugucaccaaggaa

SEQ ID NO: 3577277 - RNA, 19 nt, Human
ggagcugucaccaaggaaa

SEQ ID NO: 3577278 - RNA, 17 nt, Human
ggagcuuaagccacugc

SEQ ID NO: 3577279 - RNA, 15 nt, Human
ggagcuuaccuccca

SEQ ID NO: 3577280 - RNA, 18 nt, Human
ggagcuuaccucccaccu

SEQ ID NO: 3577281 - RNA, 17 nt, Human
ggagcuucucuuuaacu

SEQ ID NO: 3577282 - RNA, 23 nt, Human
ggagcuucugggguccccagggc

SEQ ID NO: 3577283 - RNA, 16 nt, Human
ggagcuuugacucagg

SEQ ID NO: 3577284 - RNA, 22 nt, Human
ggaggaaaaccaagccguggcu

SEQ ID NO: 3577285 - RNA, 13 nt, Human
ggaggaaagacaa

SEQ ID NO: 3577286 - RNA, 18 nt, Human
ggaggaacacugcacucu

SEQ ID NO: 3577287 - RNA, 22 nt, Human
ggaggaacagggaagggggagc

SEQ ID NO: 3577288 - RNA, 20 nt, Human
ggaggaaccgaaaggccaaa

SEQ ID NO: 3577289 - RNA, 20 nt, Human
ggaggaaccgagggggcugc

SEQ ID NO: 3577290 - RNA, 11 nt, Human
ggaggaagcag

SEQ ID NO: 3577291 - RNA, 12 nt, Human
ggaggaagcaga

SEQ ID NO: 3577292 - RNA, 20 nt, Human
ggaggaagcagaauaaagca

SEQ ID NO: 3577293 - RNA, 19 nt, Human
ggaggaagcagguugaggg

SEQ ID NO: 3577294 - RNA, 18 nt, Human
ggaggaaggaggacccag

SEQ ID NO: 3577295 - RNA, 21 nt, Human
ggaggaaggcuuacacccaca

SEQ ID NO: 3577296 - RNA, 20 nt, Human
ggaggaaucgaggaaccaga

SEQ ID NO: 3577297 - RNA, 22 nt, Human
ggaggaaucgaggaaccagagc

SEQ ID NO: 3577298 - RNA, 15 nt, Human
ggaggaaugcucccc

SEQ ID NO: 3577299 - RNA, 17 nt, Human
ggaggaccacaggugug

SEQ ID NO: 3577300 - RNA, 20 nt, Human
ggaggaccacaggugugagc

SEQ ID NO: 3577301 - RNA, 12 nt, Human
ggaggaccaggg

SEQ ID NO: 3577302 - RNA, 13 nt, Human
ggaggacccagga

SEQ ID NO: 3577303 - RNA, 14 nt, Human
ggaggacccaggac

SEQ ID NO: 3577304 - RNA, 15 nt, Human
ggaggaccucugggc

SEQ ID NO: 3577305 - RNA, 19 nt, Human
ggaggacuagaaccuggag

SEQ ID NO: 3577306 - RNA, 22 nt, Human
ggaggacuagaaccuggagggc

SEQ ID NO: 3577307 - RNA, 21 nt, Human
ggaggacugccccgugcagac

SEQ ID NO: 3577308 - RNA, 13 nt, Human
ggaggagaaugag

SEQ ID NO: 3577309 - RNA, 22 nt, Human
ggaggagagacacuggugggga

SEQ ID NO: 3577310 - RNA, 15 nt, Human
ggaggagagccuggu

SEQ ID NO: 3577311 - RNA, 15 nt, Human
ggaggagcuucuggg

SEQ ID NO: 3577312 - RNA, 17 nt, Human
ggaggagcuugggggau

SEQ ID NO: 3577313 - RNA, 22 nt, Human
ggaggagcuuuguuuugggggu

SEQ ID NO: 3577314 - RNA, 15 nt, Human
ggaggaggaaauccc

SEQ ID NO: 3577315 - RNA, 15 nt, Human
ggaggaggaaggcaa

SEQ ID NO: 3577316 - RNA, 14 nt, Human
ggaggaggaggcaa

SEQ ID NO: 3577317 - RNA, 12 nt, Human
ggaggaggaggg

SEQ ID NO: 3577318 - RNA, 13 nt, Human
ggaggaggagggu

SEQ ID NO: 3577319 - RNA, 14 nt, Human
ggaggaggccaccu

SEQ ID NO: 3577320 - RNA, 15 nt, Human
ggaggaggccaccuc

SEQ ID NO: 3577321 - RNA, 19 nt, Human
ggaggaggccaccucucca

SEQ ID NO: 3577322 - RNA, 13 nt, Human
ggaggagggagag

SEQ ID NO: 3577323 - RNA, 15 nt, Human
ggaggaggguugugc

SEQ ID NO: 3577324 - RNA, 20 nt, Human
ggaggaucacuggagcccag

SEQ ID NO: 3577325 - RNA, 13 nt, Human
ggaggaugggcuc

SEQ ID NO: 3577326 - RNA, 16 nt, Human
ggaggaugugggcagc

SEQ ID NO: 3577327 - RNA, 15 nt, Human
ggaggauguucuggg

SEQ ID NO: 3577328 - RNA, 21 nt, Human
ggaggauguucugggacacag

SEQ ID NO: 3577329 - RNA, 17 nt, Human
ggaggauucuaugaggc

SEQ ID NO: 3577330 - RNA, 22 nt, Human
ggaggauugcuugagcccagga

SEQ ID NO: 3577331 - RNA, 14 nt, Human
ggaggcagagaaga

SEQ ID NO: 3577332 - RNA, 20 nt, Human
ggaggcagagguugcaguga

SEQ ID NO: 3577333 - RNA, 21 nt, Human
ggaggcagaguuugccuuccu

SEQ ID NO: 3577334 - RNA, 17 nt, Human
ggaggcagccagggcuu

SEQ ID NO: 3577335 - RNA, 13 nt, Human
ggaggcagccgcc

SEQ ID NO: 3577336 - RNA, 13 nt, Human
ggaggcagggccu

SEQ ID NO: 3577337 - RNA, 21 nt, Human
ggaggcagggccuugcccaga

SEQ ID NO: 3577338 - RNA, 16 nt, Human
ggaggcaucagugucc

SEQ ID NO: 3577339 - RNA, 11 nt, Human
ggaggccaaga

SEQ ID NO: 3577340 - RNA, 22 nt, Human
ggaggccaagaguggccccacc

SEQ ID NO: 3577341 - RNA, 18 nt, Human
ggaggccaaggugggagg

SEQ ID NO: 3577342 - RNA, 20 nt, Human
ggaggccaaggugggaggau

SEQ ID NO: 3577343 - RNA, 20 nt, Human
ggaggccaagugcaggcugg

SEQ ID NO: 3577344 - RNA, 18 nt, Human
ggaggccaccucuccaag

SEQ ID NO: 3577345 - RNA, 11 nt, Human
ggaggccagcc

SEQ ID NO: 3577346 - RNA, 14 nt, Human
ggaggccaggccgg

SEQ ID NO: 3577347 - RNA, 16 nt, Human
ggaggcccaggcuggg

SEQ ID NO: 3577348 - RNA, 20 nt, Human
ggaggcccaggcugggaacu

SEQ ID NO: 3577349 - RNA, 15 nt, Human
ggaggccccaaagga

SEQ ID NO: 3577350 - RNA, 14 nt, Human
ggaggccccacuga

SEQ ID NO: 3577351 - RNA, 18 nt, Human
ggaggccccacugaugcu

SEQ ID NO: 3577352 - RNA, 15 nt, Human
ggaggccccaggggg

SEQ ID NO: 3577353 - RNA, 22 nt, Human
ggaggccccuggcccagcggcc

SEQ ID NO: 3577354 - RNA, 23 nt, Human
ggaggccccuggcccagcggccc

SEQ ID NO: 3577355 - RNA, 23 nt, Human
ggaggcccugugccccuugacaa

SEQ ID NO: 3577356 - RNA, 12 nt, Human
ggaggccgaagc

SEQ ID NO: 3577357 - RNA, 20 nt, Human
ggaggccuaggaggguccuc

SEQ ID NO: 3577358 - RNA, 15 nt, Human
ggaggccucugggcc

SEQ ID NO: 3577359 - RNA, 22 nt, Human
ggaggcgcacuuuccuccuggc

SEQ ID NO: 3577360 - RNA, 20 nt, Human
ggaggcgggggcugcccuug

SEQ ID NO: 3577361 - RNA, 20 nt, Human
ggaggcuaaagcccagagac

SEQ ID NO: 3577362 - RNA, 16 nt, Human
ggaggcuccaggcagc

SEQ ID NO: 3577363 - RNA, 20 nt, Human
ggaggcucccgaggggaagg

SEQ ID NO: 3577364 - RNA, 17 nt, Human
ggaggcugacuccuggu

SEQ ID NO: 3577365 - RNA, 15 nt, Human
ggaggcugagacagg

SEQ ID NO: 3577366 - RNA, 15 nt, Human
ggaggcugagauggg

SEQ ID NO: 3577367 - RNA, 19 nt, Human
ggaggcugagaugggagaa

SEQ ID NO: 3577368 - RNA, 16 nt, Human
ggaggcugaggcagaa

SEQ ID NO: 3577369 - RNA, 15 nt, Human
ggaggcugaggcagg

SEQ ID NO: 3577370 - RNA, 19 nt, Human
ggaggcugaggcaggagga

SEQ ID NO: 3577371 - RNA, 13 nt, Human
ggaggcugccccc

SEQ ID NO: 3577372 - RNA, 17 nt, Human
ggaggcugcccccggcc

SEQ ID NO: 3577373 - RNA, 16 nt, Human
ggaggcugccucccaa

SEQ ID NO: 3577374 - RNA, 10 nt, Human
ggaggcugcg

SEQ ID NO: 3577375 - RNA, 18 nt, Human
ggaggcugcugcugcucu

SEQ ID NO: 3577376 - RNA, 16 nt, Human
ggaggcuugggaccgc

SEQ ID NO: 3577377 - RNA, 16 nt, Human
ggaggcuugucagagc

SEQ ID NO: 3577378 - RNA, 18 nt, Human
ggaggcuugucagagcug

SEQ ID NO: 3577379 - RNA, 19 nt, Human
ggaggcuugucagagcugg

SEQ ID NO: 3577380 - RNA, 19 nt, Human
ggagggaagaguggaggug

SEQ ID NO: 3577381 - RNA, 17 nt, Human
ggagggacaaaggagcc

SEQ ID NO: 3577382 - RNA, 18 nt, Human
ggagggacaaaggagccu

SEQ ID NO: 3577383 - RNA, 22 nt, Human
ggagggacaaaggagccuguga

SEQ ID NO: 3577384 - RNA, 13 nt, Human
ggagggacagucu

SEQ ID NO: 3577385 - RNA, 23 nt, Human
ggagggagaagaaagaaagaagu

SEQ ID NO: 3577386 - RNA, 22 nt, Human
ggagggagagucucccagggag

SEQ ID NO: 3577387 - RNA, 11 nt, Human
ggagggaggcc

SEQ ID NO: 3577388 - RNA, 13 nt, Human
ggagggaggcccc

SEQ ID NO: 3577389 - RNA, 12 nt, Human
ggagggagggcu

SEQ ID NO: 3577390 - RNA, 17 nt, Human
ggagggagggcuccaga

SEQ ID NO: 3577391 - RNA, 21 nt, Human
ggagggcaagggguucccuug

SEQ ID NO: 3577392 - RNA, 10 nt, Human
ggagggcaga

SEQ ID NO: 3577393 - RNA, 16 nt, Human
ggagggcagagcuggu

SEQ ID NO: 3577394 - RNA, 17 nt, Human
ggagggcagagcuggug

SEQ ID NO: 3577395 - RNA, 12 nt, Human
ggauaacaccac

SEQ ID NO: 3577396 - RNA, 21 nt, Human
ggauaagguaccuuucacaua

SEQ ID NO: 3577397 - RNA, 22 nt, Human
ggauacaaccucccucuuguuu

SEQ ID NO: 3577398 - RNA, 21 nt, Human
ggauacgcaucagacagaugg

SEQ ID NO: 3577399 - RNA, 15 nt, Human
ggauacgugucaaug

SEQ ID NO: 3577400 - RNA, 18 nt, Human
ggauacucugucagaugg

SEQ ID NO: 3577401 - RNA, 15 nt, Human
ggauacugcagggcc

SEQ ID NO: 3577402 - RNA, 15 nt, Human
ggauacuggcaaagc

SEQ ID NO: 3577403 - RNA, 18 nt, Human
ggauacuggcacagaggu

SEQ ID NO: 3577404 - RNA, 17 nt, Human
ggauagauaacucuuug

SEQ ID NO: 3577405 - RNA, 13 nt, Human
ggauagaugcugg

SEQ ID NO: 3577406 - RNA, 19 nt, Human
ggauagaugcuggcccagg

SEQ ID NO: 3577407 - RNA, 13 nt, Human
ggauagaugugug

SEQ ID NO: 3577408 - RNA, 20 nt, Human
ggauauaguuuuacuuuuaa

SEQ ID NO: 3577409 - RNA, 22 nt, Human
ggauauccuuaucagagcuaag

SEQ ID NO: 3577410 - RNA, 15 nt, Human
ggauaugaaaaauga

SEQ ID NO: 3577411 - RNA, 13 nt, Human
ggauaugaccagu

SEQ ID NO: 3577412 - RNA, 16 nt, Human
ggauaugcuuaguaau

SEQ ID NO: 3577413 - RNA, 18 nt, Human
ggauauugaauguuaaag

SEQ ID NO: 3577414 - RNA, 11 nt, Human
ggauauuuaag

SEQ ID NO: 3577415 - RNA, 18 nt, Human
ggaucaaguauuacuaaa

SEQ ID NO: 3577416 - RNA, 13 nt, Human
ggaucacagggcc

SEQ ID NO: 3577417 - RNA, 19 nt, Human
ggaucacgacgcugcagag

SEQ ID NO: 3577418 - RNA, 14 nt, Human
ggaucacuggagcc

SEQ ID NO: 3577419 - RNA, 22 nt, Human
ggaucagaaagaguucaguaag

SEQ ID NO: 3577420 - RNA, 12 nt, Human
ggaucagaaagu

SEQ ID NO: 3577421 - RNA, 14 nt, Human
ggaucagaaauaca

SEQ ID NO: 3577422 - RNA, 16 nt, Human
ggaucagaaauacaga

SEQ ID NO: 3577423 - RNA, 17 nt, Human
ggaucagagcaggaccu

SEQ ID NO: 3577424 - RNA, 22 nt, Human
ggaucagagcaggaccucccuu

SEQ ID NO: 3577425 - RNA, 21 nt, Human
ggaucagaucuggggcagcac

SEQ ID NO: 3577426 - RNA, 15 nt, Human
ggaucagcguggccu

SEQ ID NO: 3577427 - RNA, 16 nt, Human
ggaucagcguggccuu

SEQ ID NO: 3577428 - RNA, 19 nt, Human
ggaucagcguggccuuguu

SEQ ID NO: 3577429 - RNA, 13 nt, Human
ggaucagcugagc

SEQ ID NO: 3577430 - RNA, 13 nt, Human
ggaucaggaagcc

SEQ ID NO: 3577431 - RNA, 18 nt, Human
ggaucaggcucccaggag

SEQ ID NO: 3577432 - RNA, 21 nt, Human
ggaucaguuaacuauugcauu

SEQ ID NO: 3577433 - RNA, 21 nt, Human
ggaucaugguguaauaagaca

SEQ ID NO: 3577434 - RNA, 13 nt, Human
ggauccagaaggg

SEQ ID NO: 3577435 - RNA, 13 nt, Human
ggauccagggagg

SEQ ID NO: 3577436 - RNA, 19 nt, Human
ggauccccgccuggccagg

SEQ ID NO: 3577437 - RNA, 13 nt, Human
ggaucccucaucc

SEQ ID NO: 3577438 - RNA, 18 nt, Human
ggaucccucaucuguccc

SEQ ID NO: 3577439 - RNA, 22 nt, Human
ggaucccucaucugucccuccg

SEQ ID NO: 3577440 - RNA, 19 nt, Human
ggauccgacugcuuuggac

SEQ ID NO: 3577441 - RNA, 14 nt, Human
ggauccuauucuca

SEQ ID NO: 3577442 - RNA, 13 nt, Human
ggauccuccaggu

SEQ ID NO: 3577443 - RNA, 14 nt, Human
ggauccuccaggug

SEQ ID NO: 3577444 - RNA, 19 nt, Human
ggauccugagccagauuuc

SEQ ID NO: 3577445 - RNA, 20 nt, Human
ggauccugcacugacucugg

SEQ ID NO: 3577446 - RNA, 23 nt, Human
ggaucggaggcuugucagagcug

SEQ ID NO: 3577447 - RNA, 12 nt, Human
ggaucuaccagc

SEQ ID NO: 3577448 - RNA, 15 nt, Human
ggaucuaccuggagg

SEQ ID NO: 3577449 - RNA, 18 nt, Human
ggaucuauacuugcuuug

SEQ ID NO: 3577450 - RNA, 21 nt, Human
ggaucuauuucauguuuuuga

SEQ ID NO: 3577451 - RNA, 15 nt, Human
ggaucucaccaggca

SEQ ID NO: 3577452 - RNA, 16 nt, Human
ggaucucaccaggcag

SEQ ID NO: 3577453 - RNA, 17 nt, Human
ggaucucagcuuugaga

SEQ ID NO: 3577454 - RNA, 22 nt, Human
ggaucucagcuuugagaagccu

SEQ ID NO: 3577455 - RNA, 13 nt, Human
ggaucuccaagga

SEQ ID NO: 3577456 - RNA, 14 nt, Human
ggaucuccaaggac

SEQ ID NO: 3577457 - RNA, 17 nt, Human
ggaucucccagggcuac

SEQ ID NO: 3577458 - RNA, 18 nt, Human
ggaucucuuaagacagca

SEQ ID NO: 3577459 - RNA, 22 nt, Human
ggaucucuucuuaauguacaua

SEQ ID NO: 3577460 - RNA, 15 nt, Human
ggaucugacugcacg

SEQ ID NO: 3577461 - RNA, 14 nt, Human
ggaucugccccucc

SEQ ID NO: 3577462 - RNA, 15 nt, Human
ggaucugccccuccc

SEQ ID NO: 3577463 - RNA, 17 nt, Human
ggaucugguccuaccca

SEQ ID NO: 3577464 - RNA, 19 nt, Human
ggaucuguauguguucuau

SEQ ID NO: 3577465 - RNA, 16 nt, Human
ggaucuguccaaggaa

SEQ ID NO: 3577466 - RNA, 16 nt, Human
ggaucugugcccagag

SEQ ID NO: 3577467 - RNA, 22 nt, Human
ggaucuucaucugacuaugaca

SEQ ID NO: 3577468 - RNA, 23 nt, Human
ggaucuucaucugacuaugacau

SEQ ID NO: 3577469 - RNA, 15 nt, Human
ggaucuugaaugugg

SEQ ID NO: 3577470 - RNA, 22 nt, Human
ggaucuugaauguggucucagg

SEQ ID NO: 3577471 - RNA, 17 nt, Human
ggaucuugcauucccag

SEQ ID NO: 3577472 - RNA, 14 nt, Human
ggaugaaaaaauaa

SEQ ID NO: 3577473 - RNA, 17 nt, Human
ggaugaaauuuucuaga

SEQ ID NO: 3577474 - RNA, 22 nt, Human
ggaugaaugaggucccaggcag

SEQ ID NO: 3577475 - RNA, 23 nt, Human
ggaugaauguaugugcacuguca

SEQ ID NO: 3577476 - RNA, 21 nt, Human
ggaugacaugcacucagcucu

SEQ ID NO: 3577477 - RNA, 14 nt, Human
ggaugaccagaaca

SEQ ID NO: 3577478 - RNA, 18 nt, Human
ggaugacuagaggcaggg

SEQ ID NO: 3577479 - RNA, 12 nt, Human
ggaugagaaagg

SEQ ID NO: 3577480 - RNA, 22 nt, Human
ggaugagaaagguugaagcacc

SEQ ID NO: 3577481 - RNA, 16 nt, Human
ggaugagagcccagag

SEQ ID NO: 3577482 - RNA, 18 nt, Human
ggaugagagcccagaggu

SEQ ID NO: 3577483 - RNA, 19 nt, Human
ggaugagagcccagaggua

SEQ ID NO: 3577484 - RNA, 22 nt, Human
ggaugagaguuuuggaugcagu

SEQ ID NO: 3577485 - RNA, 17 nt, Human
ggaugagcauggagcug

SEQ ID NO: 3577486 - RNA, 19 nt, Human
ggaugagcauggagcuggc

SEQ ID NO: 3577487 - RNA, 21 nt, Human
ggaugagcucccacaagccug

SEQ ID NO: 3577488 - RNA, 15 nt, Human
ggaugagcuggaagg

SEQ ID NO: 3577489 - RNA, 21 nt, Human
ggaugaggccgcuagaggccu

SEQ ID NO: 3577490 - RNA, 20 nt, Human
ggaugaggugguggagugga

SEQ ID NO: 3577491 - RNA, 23 nt, Human
ggaugaguacccaaaagcucagc

SEQ ID NO: 3577492 - RNA, 23 nt, Human
ggaugaugucuuuuuauuaaaau

SEQ ID NO: 3577493 - RNA, 21 nt, Human
ggaugauucagaaauuggaac

SEQ ID NO: 3577494 - RNA, 14 nt, Human
ggaugauugaagaa

SEQ ID NO: 3577495 - RNA, 15 nt, Human
ggaugauugaagaaa

SEQ ID NO: 3577496 - RNA, 16 nt, Human
ggaugauugaagaaac

SEQ ID NO: 3577497 - RNA, 14 nt, Human
ggaugcagugcucg

SEQ ID NO: 3577498 - RNA, 20 nt, Human
ggaugccacuccucccuccg

SEQ ID NO: 3577499 - RNA, 18 nt, Human
ggaugccugguggcagcu

SEQ ID NO: 3577500 - RNA, 21 nt, Human
ggaugccuuccccugggcccu

SEQ ID NO: 3577501 - RNA, 14 nt, Human
ggaugcugccugag

SEQ ID NO: 3577502 - RNA, 11 nt, Human
ggaugcuucau

SEQ ID NO: 3577503 - RNA, 22 nt, Human
ggauggaccacacagaggcugc

SEQ ID NO: 3577504 - RNA, 16 nt, Human
ggauggagagagggga

SEQ ID NO: 3577505 - RNA, 14 nt, Human
ggauggaggagaag

SEQ ID NO: 3577506 - RNA, 15 nt, Human
ggauggccagugucu

SEQ ID NO: 3577507 - RNA, 22 nt, Human
ggauggccagugucugucccgg

SEQ ID NO: 3577508 - RNA, 14 nt, Human
ggauggccccagca

SEQ ID NO: 3577509 - RNA, 20 nt, Human
ggauggcccuuccuccucca

SEQ ID NO: 3577510 - RNA, 18 nt, Human
ggauggcgggugggggug

SEQ ID NO: 3577511 - RNA, 23 nt, Human
ggauggcggguggggguggaaua

SEQ ID NO: 3577512 - RNA, 12 nt, Human
ggaugggaagga

SEQ ID NO: 3577513 - RNA, 17 nt, Human
ggaugggaaggagggag

SEQ ID NO: 3577514 - RNA, 13 nt, Human
ggaugggccuggc

SEQ ID NO: 3577515 - RNA, 14 nt, Human
ggauggggccacag

SEQ ID NO: 3577516 - RNA, 16 nt, Human
ggauggggcugcaccg

SEQ ID NO: 3577517 - RNA, 17 nt, Human
ggaugggggaacucaga

SEQ ID NO: 3577518 - RNA, 21 nt, Human
ggaugggggaacucagaucca

SEQ ID NO: 3577519 - RNA, 23 nt, Human
ggaugggggaacucagauccagg

SEQ ID NO: 3577520 - RNA, 21 nt, Human
ggaugggguauggauucuaaa

SEQ ID NO: 3577521 - RNA, 20 nt, Human
ggaugguccuggggcucugu

SEQ ID NO: 3577522 - RNA, 22 nt, Human
ggaugguccuggggcucugugc

SEQ ID NO: 3577523 - RNA, 21 nt, Human
ggauggucuuacagcaggcag

SEQ ID NO: 3577524 - RNA, 19 nt, Human
ggauguaaacagugccugc

SEQ ID NO: 3577525 - RNA, 21 nt, Human
ggauguaaacagugccugcug

SEQ ID NO: 3577526 - RNA, 19 nt, Human
ggauguagcuuuucaccuu

SEQ ID NO: 3577527 - RNA, 22 nt, Human
ggauguauccaugggggcaggg

SEQ ID NO: 3577528 - RNA, 16 nt, Human
ggauguauggggaauc

SEQ ID NO: 3577529 - RNA, 16 nt, Human
ggaugucacagggcca

SEQ ID NO: 3577530 - RNA, 23 nt, Human
ggaugucauguccuccaggcugg

SEQ ID NO: 3577531 - RNA, 17 nt, Human
ggauguccacagaugcc

SEQ ID NO: 3577532 - RNA, 16 nt, Human
ggauguccccagcaga

SEQ ID NO: 3577533 - RNA, 12 nt, Human
ggaugucccugg

SEQ ID NO: 3577534 - RNA, 18 nt, Human
ggaugucccugggccagg

SEQ ID NO: 3577535 - RNA, 23 nt, Human
ggauguggcugcagcagcggugg

SEQ ID NO: 3577536 - RNA, 23 nt, Human
ggaugugggagggagcagacagg

SEQ ID NO: 3577537 - RNA, 19 nt, Human
ggauguggguuccacagac

SEQ ID NO: 3577538 - RNA, 17 nt, Human
ggaugugguuuucuuaa

SEQ ID NO: 3577539 - RNA, 20 nt, Human
ggcacagcaacucuaagacu

SEQ ID NO: 3577540 - RNA, 12 nt, Human
ggcacagccugc

SEQ ID NO: 3577541 - RNA, 15 nt, Human
ggcacagccugcacu

SEQ ID NO: 3577542 - RNA, 22 nt, Human
ggcacagcggagucuguccugu

SEQ ID NO: 3577543 - RNA, 13 nt, Human
ggcacaggacuga

SEQ ID NO: 3577544 - RNA, 20 nt, Human
ggcacaggaguguccucuuc

SEQ ID NO: 3577545 - RNA, 14 nt, Human
ggcacaggcagggc

SEQ ID NO: 3577546 - RNA, 16 nt, Human
ggcacaggcagggcag

SEQ ID NO: 3577547 - RNA, 15 nt, Human
ggcacaggcccccuu

SEQ ID NO: 3577548 - RNA, 16 nt, Human
ggcacagggcaugaaa

SEQ ID NO: 3577549 - RNA, 18 nt, Human
ggcacagggccuggccca

SEQ ID NO: 3577550 - RNA, 17 nt, Human
ggcacagggucugcucu

SEQ ID NO: 3577551 - RNA, 19 nt, Human
ggcacagggucugcucuuu

SEQ ID NO: 3577552 - RNA, 22 nt, Human
ggcacaggucaggggugacaca

SEQ ID NO: 3577553 - RNA, 17 nt, Human
ggcacaggucgggcgca

SEQ ID NO: 3577554 - RNA, 15 nt, Human
ggcacaguccaggaa

SEQ ID NO: 3577555 - RNA, 22 nt, Human
ggcacaguccaggaacaagcua

SEQ ID NO: 3577556 - RNA, 19 nt, Human
ggcacagugucugggcuga

SEQ ID NO: 3577557 - RNA, 17 nt, Human
ggcacaucagaaaggaa

SEQ ID NO: 3577558 - RNA, 13 nt, Human
ggcacaucagcac

SEQ ID NO: 3577559 - RNA, 14 nt, Human
ggcacauggaggag

SEQ ID NO: 3577560 - RNA, 13 nt, Human
ggcacauuuuuuu

SEQ ID NO: 3577561 - RNA, 23 nt, Human
ggcacauuuuuuuuuuuaauuuu

SEQ ID NO: 3577562 - RNA, 16 nt, Human
ggcaccaaagaugcag

SEQ ID NO: 3577563 - RNA, 17 nt, Human
ggcaccaaagaugcagc

SEQ ID NO: 3577564 - RNA, 16 nt, Human
ggcaccaaagccacca

SEQ ID NO: 3577565 - RNA, 16 nt, Human
ggcaccaagcccacag

SEQ ID NO: 3577566 - RNA, 16 nt, Human
ggcaccagacacccag

SEQ ID NO: 3577567 - RNA, 14 nt, Human
ggcaccaggaagcc

SEQ ID NO: 3577568 - RNA, 15 nt, Human
ggcaccaggaagccg

SEQ ID NO: 3577569 - RNA, 20 nt, Human
ggcacccacaagugccacug

SEQ ID NO: 3577570 - RNA, 23 nt, Human
ggcacccaccaucaugucuggcu

SEQ ID NO: 3577571 - RNA, 21 nt, Human
ggcacccaccguggaggagga

SEQ ID NO: 3577572 - RNA, 16 nt, Human
ggcacccauccuagag

SEQ ID NO: 3577573 - RNA, 15 nt, Human
ggcacccccagccug

SEQ ID NO: 3577574 - RNA, 16 nt, Human
ggcacccccugcagcu

SEQ ID NO: 3577575 - RNA, 18 nt, Human
ggcacccccugcagcuug

SEQ ID NO: 3577576 - RNA, 19 nt, Human
ggcacccccugcagcuugu

SEQ ID NO: 3577577 - RNA, 20 nt, Human
ggcacccccuggagagaagu

SEQ ID NO: 3577578 - RNA, 16 nt, Human
ggcacccggccccugc

SEQ ID NO: 3577579 - RNA, 20 nt, Human
ggcacccggccccugcuggu

SEQ ID NO: 3577580 - RNA, 12 nt, Human
ggcacccuccca

SEQ ID NO: 3577581 - RNA, 15 nt, Human
ggcacccucuggccg

SEQ ID NO: 3577582 - RNA, 22 nt, Human
ggcaccgaagcccagagggucu

SEQ ID NO: 3577583 - RNA, 21 nt, Human
ggcaccuacacucaccugcac

SEQ ID NO: 3577584 - RNA, 18 nt, Human
ggcaccuauagucccagc

SEQ ID NO: 3577585 - RNA, 22 nt, Human
ggcaccuauagucccagcuacu

SEQ ID NO: 3577586 - RNA, 12 nt, Human
ggcaccucuucc

SEQ ID NO: 3577587 - RNA, 13 nt, Human
ggcaccugggccc

SEQ ID NO: 3577588 - RNA, 17 nt, Human
ggcaccugggcccuggg

SEQ ID NO: 3577589 - RNA, 19 nt, Human
ggcaccugggcccuggggc

SEQ ID NO: 3577590 - RNA, 14 nt, Human
ggcaccuggggagu

SEQ ID NO: 3577591 - RNA, 21 nt, Human
ggcaccugucugcuccagcuc

SEQ ID NO: 3577592 - RNA, 20 nt, Human
ggcacgaacccaccugcuga

SEQ ID NO: 3577593 - RNA, 18 nt, Human
ggcacgcugugggcaggu

SEQ ID NO: 3577594 - RNA, 23 nt, Human
ggcacuaacguugagccccugga

SEQ ID NO: 3577595 - RNA, 21 nt, Human
ggcacuagccuuuggcucugg

SEQ ID NO: 3577596 - RNA, 18 nt, Human
ggcacuauuuauuuacaa

SEQ ID NO: 3577597 - RNA, 18 nt, Human
ggcacucaaugcagccag

SEQ ID NO: 3577598 - RNA, 20 nt, Human
ggcacuccaaccuaaccugu

SEQ ID NO: 3577599 - RNA, 16 nt, Human
ggcacucccuccagca

SEQ ID NO: 3577600 - RNA, 23 nt, Human
ggcacugaagggauaugugaaac

SEQ ID NO: 3577601 - RNA, 21 nt, Human
ggcacugccgccgcuagguag

SEQ ID NO: 3577602 - RNA, 14 nt, Human
ggcacugcuaggcu

SEQ ID NO: 3577603 - RNA, 11 nt, Human
ggcacugcucu

SEQ ID NO: 3577604 - RNA, 20 nt, Human
ggcacugcuggguggcccau

SEQ ID NO: 3577605 - RNA, 21 nt, Human
ggcacugcuggguggcccauc

SEQ ID NO: 3577606 - RNA, 22 nt, Human
ggcacugcuggguggcccaucc

SEQ ID NO: 3577607 - RNA, 16 nt, Human
ggcacugcugugcugu

SEQ ID NO: 3577608 - RNA, 20 nt, Human
ggcacugcuuccagugaggc

SEQ ID NO: 3577609 - RNA, 21 nt, Human
ggcacuggcauugucccugug

SEQ ID NO: 3577610 - RNA, 21 nt, Human
ggcacugggaugagccgcugu

SEQ ID NO: 3577611 - RNA, 21 nt, Human
ggcacugguagguugggacac

SEQ ID NO: 3577612 - RNA, 18 nt, Human
ggcacuguaguucuaaga

SEQ ID NO: 3577613 - RNA, 20 nt, Human
ggcacuguaguucuaagacu

SEQ ID NO: 3577614 - RNA, 18 nt, Human
ggcacuucccugcugccu

SEQ ID NO: 3577615 - RNA, 16 nt, Human
ggcacuugauuccuug

SEQ ID NO: 3577616 - RNA, 17 nt, Human
ggcacuuggcagccuug

SEQ ID NO: 3577617 - RNA, 11 nt, Human
ggcagaaaauu

SEQ ID NO: 3577618 - RNA, 17 nt, Human
ggcagaaagcaaaauua

SEQ ID NO: 3577619 - RNA, 14 nt, Human
ggcagaaagcaaau

SEQ ID NO: 3577620 - RNA, 17 nt, Human
ggcagaaagcagaggcu

SEQ ID NO: 3577621 - RNA, 19 nt, Human
ggcagaaagcagaggcugg

SEQ ID NO: 3577622 - RNA, 20 nt, Human
ggcagaaagguucugcccgg

SEQ ID NO: 3577623 - RNA, 16 nt, Human
ggcagaaaguggccau

SEQ ID NO: 3577624 - RNA, 21 nt, Human
ggcagaacaucgcgaugggaa

SEQ ID NO: 3577625 - RNA, 14 nt, Human
ggcagaacccuggu

SEQ ID NO: 3577626 - RNA, 13 nt, Human
ggcagaacugagc

SEQ ID NO: 3577627 - RNA, 15 nt, Human
ggcagaacugagcuc

SEQ ID NO: 3577628 - RNA, 21 nt, Human
ggcagaacugagcuccucugg

SEQ ID NO: 3577629 - RNA, 19 nt, Human
ggcagaagacaccagagca

SEQ ID NO: 3577630 - RNA, 17 nt, Human
ggcagaaguguuuuuua

SEQ ID NO: 3577631 - RNA, 18 nt, Human
ggcagaauaagaaaacaa

SEQ ID NO: 3577632 - RNA, 19 nt, Human
ggcagaauaaucuuugggu

SEQ ID NO: 3577633 - RNA, 21 nt, Human
ggcagaaugcuagcucugagc

SEQ ID NO: 3577634 - RNA, 23 nt, Human
ggcagaaugcuagcucugagcca

SEQ ID NO: 3577635 - RNA, 15 nt, Human
ggcagacagcagcuc

SEQ ID NO: 3577636 - RNA, 18 nt, Human
ggcagacagcagcucagg

SEQ ID NO: 3577637 - RNA, 16 nt, Human
ggcagacauggugggg

SEQ ID NO: 3577638 - RNA, 20 nt, Human
ggcagacauugugcuagugc

SEQ ID NO: 3577639 - RNA, 18 nt, Human
ggcagagaaagaagagac

SEQ ID NO: 3577640 - RNA, 21 nt, Human
ggcagagaaagaagagacagg

SEQ ID NO: 3577641 - RNA, 14 nt, Human
ggcagagagagaga

SEQ ID NO: 3577642 - RNA, 10 nt, Human
ggcagagagc

SEQ ID NO: 3577643 - RNA, 18 nt, Human
ggcagagaugccucccug

SEQ ID NO: 3577644 - RNA, 23 nt, Human
ggcagagauuggaaugggcagcu

SEQ ID NO: 3577645 - RNA, 16 nt, Human
ggcagagcagagacca

SEQ ID NO: 3577646 - RNA, 14 nt, Human
ggcagagccaggaa

SEQ ID NO: 3577647 - RNA, 16 nt, Human
ggcagagccaggaaga

SEQ ID NO: 3577648 - RNA, 14 nt, Human
ggcagagcugcauc

SEQ ID NO: 3577649 - RNA, 18 nt, Human
ggcagagcugcuccccuc

SEQ ID NO: 3577650 - RNA, 17 nt, Human
ggcagagcuggcucuga

SEQ ID NO: 3577651 - RNA, 19 nt, Human
ggcagagcuggcucugagc

SEQ ID NO: 3577652 - RNA, 15 nt, Human
ggcagagcuggugcg

SEQ ID NO: 3577653 - RNA, 17 nt, Human
ggcagagcuuggacugg

SEQ ID NO: 3577654 - RNA, 17 nt, Human
ggcagaggaaagcaaag

SEQ ID NO: 3577655 - RNA, 18 nt, Human
ggcagaggaugucucaaa

SEQ ID NO: 3577656 - RNA, 16 nt, Human
ggcagaggcccaggcu

SEQ ID NO: 3577657 - RNA, 19 nt, Human
ggcagaggcccaggcugcc

SEQ ID NO: 3577658 - RNA, 22 nt, Human
ggcagaggccugggcugggaaa

SEQ ID NO: 3577659 - RNA, 16 nt, Human
ggcagagggcagaggc

SEQ ID NO: 3577660 - RNA, 20 nt, Human
ggcagagggcagaggcugga

SEQ ID NO: 3577661 - RNA, 22 nt, Human
ggcagagguuguagugagccca

SEQ ID NO: 3577662 - RNA, 13 nt, Human
ggcagaguuacag

SEQ ID NO: 3577663 - RNA, 13 nt, Human
ggcagaguuacuu

SEQ ID NO: 3577664 - RNA, 21 nt, Human
ggcagaguucuauaauguaaa

SEQ ID NO: 3577665 - RNA, 16 nt, Human
ggcagaguuguaaaua

SEQ ID NO: 3577666 - RNA, 21 nt, Human
ggcagaguuuguguguugucu

SEQ ID NO: 3577667 - RNA, 15 nt, Human
ggcagauaaucagcc

SEQ ID NO: 3577668 - RNA, 14 nt, Human
ggcagaucaccuga

SEQ ID NO: 3577669 - RNA, 18 nt, Human
ggcagaucaccugagguc

SEQ ID NO: 3577670 - RNA, 16 nt, Human
ggcagauccaggacua

SEQ ID NO: 3577671 - RNA, 15 nt, Human
ggcagaucugugccc

SEQ ID NO: 3577672 - RNA, 17 nt, Human
ggcagaucugugcccca

SEQ ID NO: 3577673 - RNA, 21 nt, Human
ggcagaugcagcucuuccugg

SEQ ID NO: 3577674 - RNA, 17 nt, Human
ggcagauguaggaggga

SEQ ID NO: 3577675 - RNA, 13 nt, Human
ggcagauugaaaa

SEQ ID NO: 3577676 - RNA, 15 nt, Human
ggcagcaacaauaaa

SEQ ID NO: 3577677 - RNA, 15 nt, Human
ggcagcaauuuaaau

SEQ ID NO: 3577678 - RNA, 22 nt, Human
ggcagcacaaguguaaugaaua

SEQ ID NO: 3577679 - RNA, 17 nt, Human
ggcagcacccuauaaau

SEQ ID NO: 3577680 - RNA, 19 nt, Human
ggcagcacccuauaaauca

SEQ ID NO: 3577681 - RNA, 19 nt, Human
ggcagcaccgccucuuccc

SEQ ID NO: 3577682 - RNA, 13 nt, Human
ggcagcagaaaac

SEQ ID NO: 3577683 - RNA, 20 nt, Human
ggcugcacucugugcccaug

SEQ ID NO: 3577684 - RNA, 21 nt, Human
ggcugcacucugugcccaugg

SEQ ID NO: 3577685 - RNA, 13 nt, Human
ggcugcagcagcg

SEQ ID NO: 3577686 - RNA, 22 nt, Human
ggcugcagcagcgguggccucu

SEQ ID NO: 3577687 - RNA, 21 nt, Human
ggcugcagcauguugcugagg

SEQ ID NO: 3577688 - RNA, 17 nt, Human
ggcugcagccucaggac

SEQ ID NO: 3577689 - RNA, 19 nt, Human
ggcugcagccucaggacug

SEQ ID NO: 3577690 - RNA, 22 nt, Human
ggcugcagccucaggacuggga

SEQ ID NO: 3577691 - RNA, 21 nt, Human
ggcugcagccugcgccaccgc

SEQ ID NO: 3577692 - RNA, 15 nt, Human
ggcugcagcuggaca

SEQ ID NO: 3577693 - RNA, 13 nt, Human
ggcugcagggagu

SEQ ID NO: 3577694 - RNA, 17 nt, Human
ggcugcagggaguccga

SEQ ID NO: 3577695 - RNA, 23 nt, Human
ggcugcaguucgacucugugcug

SEQ ID NO: 3577696 - RNA, 23 nt, Human
ggcugcaucugggauucccacca

SEQ ID NO: 3577697 - RNA, 17 nt, Human
ggcugccaaggccagag

SEQ ID NO: 3577698 - RNA, 14 nt, Human
ggcugccagugccu

SEQ ID NO: 3577699 - RNA, 21 nt, Human
ggcugccaucucaccuccugc

SEQ ID NO: 3577700 - RNA, 22 nt, Human
ggcugccaucucaccuccugcu

SEQ ID NO: 3577701 - RNA, 17 nt, Human
ggcugcccacacacccc

SEQ ID NO: 3577702 - RNA, 19 nt, Human
ggcugcccacacaccccaa

SEQ ID NO: 3577703 - RNA, 19 nt, Human
ggcugcccaucauguggcc

SEQ ID NO: 3577704 - RNA, 19 nt, Human
ggcugccccaaccugcuga

SEQ ID NO: 3577705 - RNA, 20 nt, Human
ggcugcccccggcccccugg

SEQ ID NO: 3577706 - RNA, 18 nt, Human
ggcugccccgccuggagg

SEQ ID NO: 3577707 - RNA, 22 nt, Human
ggcugccccuaaucucuguagg

SEQ ID NO: 3577708 - RNA, 21 nt, Human
ggcugcccgcucccagugucu

SEQ ID NO: 3577709 - RNA, 22 nt, Human
ggcugcccgcucccagugucuu

SEQ ID NO: 3577710 - RNA, 18 nt, Human
ggcugcccuccugugcuc

SEQ ID NO: 3577711 - RNA, 23 nt, Human
ggcugcccuccugugcucagccc

SEQ ID NO: 3577712 - RNA, 13 nt, Human
ggcugcccugcca

SEQ ID NO: 3577713 - RNA, 22 nt, Human
ggcugcccuggaggaaccgaaa

SEQ ID NO: 3577714 - RNA, 14 nt, Human
ggcugcccuggccc

SEQ ID NO: 3577715 - RNA, 15 nt, Human
ggcugcccuggcccu

SEQ ID NO: 3577716 - RNA, 12 nt, Human
ggcugcccuggu

SEQ ID NO: 3577717 - RNA, 15 nt, Human
ggcugcccuggugcu

SEQ ID NO: 3577718 - RNA, 19 nt, Human
ggcugcccuggugcugcca

SEQ ID NO: 3577719 - RNA, 10 nt, Human
ggcugcccuu

SEQ ID NO: 3577720 - RNA, 14 nt, Human
ggcugcccuuucug

SEQ ID NO: 3577721 - RNA, 18 nt, Human
ggcugcccuuucugggca

SEQ ID NO: 3577722 - RNA, 16 nt, Human
ggcugccguggggccg

SEQ ID NO: 3577723 - RNA, 12 nt, Human
ggcugccuccac

SEQ ID NO: 3577724 - RNA, 16 nt, Human
ggcugccuccacuccc

SEQ ID NO: 3577725 - RNA, 17 nt, Human
ggcugccuccacuccca

SEQ ID NO: 3577726 - RNA, 14 nt, Human
ggcugccuggagcc

SEQ ID NO: 3577727 - RNA, 14 nt, Human
ggcugccugggcug

SEQ ID NO: 3577728 - RNA, 16 nt, Human
ggcugccuuagaaccu

SEQ ID NO: 3577729 - RNA, 15 nt, Human
ggcugcgcuuccuau

SEQ ID NO: 3577730 - RNA, 22 nt, Human
ggcugcggaaugaaccacaucu

SEQ ID NO: 3577731 - RNA, 12 nt, Human
ggcugcggcccc

SEQ ID NO: 3577732 - RNA, 18 nt, Human
ggcugcggccccuccccc

SEQ ID NO: 3577733 - RNA, 15 nt, Human
ggcugcucagggcug

SEQ ID NO: 3577734 - RNA, 11 nt, Human
ggcugcuccca

SEQ ID NO: 3577735 - RNA, 18 nt, Human
ggcugcucccaccuggcu

SEQ ID NO: 3577736 - RNA, 19 nt, Human
ggcugcucccaccuggcuc

SEQ ID NO: 3577737 - RNA, 23 nt, Human
ggcugcuccuccagggccacgug

SEQ ID NO: 3577738 - RNA, 23 nt, Human
ggcugcugaaaaccaucuggccu

SEQ ID NO: 3577739 - RNA, 13 nt, Human
ggcugcugaaggc

SEQ ID NO: 3577740 - RNA, 21 nt, Human
ggcugcugaucgccuucccca

SEQ ID NO: 3577741 - RNA, 17 nt, Human
ggcugcugcccccaccc

SEQ ID NO: 3577742 - RNA, 23 nt, Human
ggcugcugcugcucuuggcugga

SEQ ID NO: 3577743 - RNA, 16 nt, Human
ggcugcugcugggcuc

SEQ ID NO: 3577744 - RNA, 20 nt, Human
ggcugcugcugggcucagug

SEQ ID NO: 3577745 - RNA, 13 nt, Human
ggcugcuggagga

SEQ ID NO: 3577746 - RNA, 16 nt, Human
ggcugcuggaggaaaa

SEQ ID NO: 3577747 - RNA, 21 nt, Human
ggcugcuggggccucagacga

SEQ ID NO: 3577748 - RNA, 14 nt, Human
ggcugcugugaagc

SEQ ID NO: 3577749 - RNA, 17 nt, Human
ggcugcugugugccuuc

SEQ ID NO: 3577750 - RNA, 12 nt, Human
ggcugcuucaag

SEQ ID NO: 3577751 - RNA, 15 nt, Human
ggcugcuucaaggau

SEQ ID NO: 3577752 - RNA, 20 nt, Human
ggcugcuucaaggauccuga

SEQ ID NO: 3577753 - RNA, 17 nt, Human
ggcugcuuccuccugga

SEQ ID NO: 3577754 - RNA, 18 nt, Human
ggcugcuuccuccuggaa

SEQ ID NO: 3577755 - RNA, 23 nt, Human
ggcuggaacagauucacacuguc

SEQ ID NO: 3577756 - RNA, 22 nt, Human
ggcuggaagauccugcgggugg

SEQ ID NO: 3577757 - RNA, 16 nt, Human
ggcuggaaggggucca

SEQ ID NO: 3577758 - RNA, 12 nt, Human
ggcuggacccag

SEQ ID NO: 3577759 - RNA, 19 nt, Human
ggcuggacccagccaggcc

SEQ ID NO: 3577760 - RNA, 21 nt, Human
ggcuggacccagccaggccca

SEQ ID NO: 3577761 - RNA, 15 nt, Human
ggcuggacuccagau

SEQ ID NO: 3577762 - RNA, 13 nt, Human
ggcuggacugagg

SEQ ID NO: 3577763 - RNA, 14 nt, Human
ggcuggacuggcug

SEQ ID NO: 3577764 - RNA, 13 nt, Human
ggcuggacuugga

SEQ ID NO: 3577765 - RNA, 18 nt, Human
ggcuggacuuggagguag

SEQ ID NO: 3577766 - RNA, 19 nt, Human
ggcuggagacgggugggcg

SEQ ID NO: 3577767 - RNA, 13 nt, Human
ggcuggagcuggc

SEQ ID NO: 3577768 - RNA, 11 nt, Human
ggcuggaggag

SEQ ID NO: 3577769 - RNA, 14 nt, Human
ggcuggaggagccc

SEQ ID NO: 3577770 - RNA, 17 nt, Human
ggcuggaggagcccagg

SEQ ID NO: 3577771 - RNA, 19 nt, Human
ggcuggaggcagggccuug

SEQ ID NO: 3577772 - RNA, 14 nt, Human
ggcuggaggcccag

SEQ ID NO: 3577773 - RNA, 17 nt, Human
ggcuggaguaaucagau

SEQ ID NO: 3577774 - RNA, 20 nt, Human
ggcuggagugcaguggugca

SEQ ID NO: 3577775 - RNA, 19 nt, Human
ggcuggaguggaguggcgu

SEQ ID NO: 3577776 - RNA, 13 nt, Human
ggcuggaugagcu

SEQ ID NO: 3577777 - RNA, 15 nt, Human
ggcuggauguggugg

SEQ ID NO: 3577778 - RNA, 18 nt, Human
ggcuggaugugguggcau

SEQ ID NO: 3577779 - RNA, 13 nt, Human
ggcuggcacagga

SEQ ID NO: 3577780 - RNA, 15 nt, Human
ggcuggcagcucucc

SEQ ID NO: 3577781 - RNA, 16 nt, Human
ggcuggcagcucucca

SEQ ID NO: 3577782 - RNA, 20 nt, Human
ggcuggcagcucuccaguca

SEQ ID NO: 3577783 - RNA, 14 nt, Human
ggcuggcagguaug

SEQ ID NO: 3577784 - RNA, 17 nt, Human
ggcuggccacugcacag

SEQ ID NO: 3577785 - RNA, 19 nt, Human
ggcuggccacugcacagag

SEQ ID NO: 3577786 - RNA, 13 nt, Human
ggcuggccagccc

SEQ ID NO: 3577787 - RNA, 14 nt, Human
ggcuggccagcccc

SEQ ID NO: 3577788 - RNA, 16 nt, Human
ggcuggccagccgcuc

SEQ ID NO: 3577789 - RNA, 13 nt, Human
ggcuggccaugga

SEQ ID NO: 3577790 - RNA, 18 nt, Human
ggcuggccauggagaaag

SEQ ID NO: 3577791 - RNA, 21 nt, Human
ggcuggcccagcccugcuggc

SEQ ID NO: 3577792 - RNA, 17 nt, Human
ggcuggccccagggcac

SEQ ID NO: 3577793 - RNA, 20 nt, Human
ggcuggccccagggcacccu

SEQ ID NO: 3577794 - RNA, 17 nt, Human
ggcuggcccugcccugg

SEQ ID NO: 3577795 - RNA, 21 nt, Human
ggcuggcgcagccaaggccga

SEQ ID NO: 3577796 - RNA, 17 nt, Human
ggcuggcuaacuggaag

SEQ ID NO: 3577797 - RNA, 22 nt, Human
ggcuggcuccagaugcagggca

SEQ ID NO: 3577798 - RNA, 15 nt, Human
ggcuggcuccccugc

SEQ ID NO: 3577799 - RNA, 16 nt, Human
ggcuggcuccccugca

SEQ ID NO: 3577800 - RNA, 14 nt, Human
ggcuggcugagggc

SEQ ID NO: 3577801 - RNA, 10 nt, Human
ggcuggcugg

SEQ ID NO: 3577802 - RNA, 12 nt, Human
ggcuggcugggg

SEQ ID NO: 3577803 - RNA, 16 nt, Human
ggcuggcuucaggagg

SEQ ID NO: 3577804 - RNA, 23 nt, Human
ggcuggcuuuucuguuuccugua

SEQ ID NO: 3577805 - RNA, 11 nt, Human
ggcugggaaau

SEQ ID NO: 3577806 - RNA, 19 nt, Human
ggcugggaacucaccuggg

SEQ ID NO: 3577807 - RNA, 21 nt, Human
ggcugggaacugcagaccugu

SEQ ID NO: 3577808 - RNA, 23 nt, Human
ggcugggaacugcagaccugucc

SEQ ID NO: 3577809 - RNA, 18 nt, Human
ggcugggacguggcucag

SEQ ID NO: 3577810 - RNA, 14 nt, Human
ggcugggagagccu

SEQ ID NO: 3577811 - RNA, 15 nt, Human
ggcugggagagccuu

SEQ ID NO: 3577812 - RNA, 20 nt, Human
ggcugggagagccuuccagg

SEQ ID NO: 3577813 - RNA, 23 nt, Human
ggcugggaguaguugucuuuccu

SEQ ID NO: 3577814 - RNA, 15 nt, Human
ggcugggaguggugg

SEQ ID NO: 3577815 - RNA, 16 nt, Human
ggcugggaugggccug

SEQ ID NO: 3577816 - RNA, 19 nt, Human
ggcugggcagaggaaagca

SEQ ID NO: 3577817 - RNA, 13 nt, Human
ggcugggcagcug

SEQ ID NO: 3577818 - RNA, 17 nt, Human
ggcugggcucccuuccc

SEQ ID NO: 3577819 - RNA, 21 nt, Human
ggcugggcucccuucccaccu

SEQ ID NO: 3577820 - RNA, 21 nt, Human
ggcuggggaaguccucugggu

SEQ ID NO: 3577821 - RNA, 16 nt, Human
ggcuggggaggaccug

SEQ ID NO: 3577822 - RNA, 23 nt, Human
ggcuggggcagccucugggccca

SEQ ID NO: 3577823 - RNA, 16 nt, Human
ggcugggggaagaagc

SEQ ID NO: 3577824 - RNA, 15 nt, Human
ggcugggggagagcc

SEQ ID NO: 3577825 - RNA, 19 nt, Human
ggcugggggagagccgugg

SEQ ID NO: 3577826 - RNA, 14 nt, Human
ggcugggggcagga

SEQ ID NO: 3577827 - RNA, 17 nt, Human
ggcugggggcaggaggg

SEQ ID NO: 3577828 - RNA, 19 nt, Human
gggaccaggaguggguggg

SEQ ID NO: 3577829 - RNA, 14 nt, Human
gggaccaggcacca

SEQ ID NO: 3577830 - RNA, 18 nt, Human
gggacccaggcaccugca

SEQ ID NO: 3577831 - RNA, 15 nt, Human
gggacccagugcaga

SEQ ID NO: 3577832 - RNA, 15 nt, Human
gggacccaguggcag

SEQ ID NO: 3577833 - RNA, 14 nt, Human
gggacccccgcccc

SEQ ID NO: 3577834 - RNA, 18 nt, Human
gggacccccgcccccugc

SEQ ID NO: 3577835 - RNA, 24 nt, Human
gggacccccgcccccugcccuccc

SEQ ID NO: 3577836 - RNA, 20 nt, Human
gggaccccuggugguucacu

SEQ ID NO: 3577837 - RNA, 24 nt, Human
gggacccuccaaggccaggccuug

SEQ ID NO: 3577838 - RNA, 22 nt, Human
gggaccgcuacaccacucuggc

SEQ ID NO: 3577839 - RNA, 20 nt, Human
gggaccuagggaggcauggu

SEQ ID NO: 3577840 - RNA, 12 nt, Human
gggaccucuccc

SEQ ID NO: 3577841 - RNA, 16 nt, Human
gggaccucucccaggg

SEQ ID NO: 3577842 - RNA, 23 nt, Human
gggaccucucccagggucccugg

SEQ ID NO: 3577843 - RNA, 21 nt, Human
gggaccugguacccuccuggc

SEQ ID NO: 3577844 - RNA, 21 nt, Human
gggacgccugggggugccagg

SEQ ID NO: 3577845 - RNA, 20 nt, Human
gggacgcggccggcggccuc

SEQ ID NO: 3577846 - RNA, 14 nt, Human
gggacguggcucag

SEQ ID NO: 3577847 - RNA, 20 nt, Human
gggacuacccauagacauga

SEQ ID NO: 3577848 - RNA, 18 nt, Human
gggacuagccuggcuugg

SEQ ID NO: 3577849 - RNA, 19 nt, Human
gggacucaaugcacugaca

SEQ ID NO: 3577850 - RNA, 23 nt, Human
gggacucaaugcacugacauugu

SEQ ID NO: 3577851 - RNA, 18 nt, Human
gggacucacuggcagccc

SEQ ID NO: 3577852 - RNA, 16 nt, Human
gggacucagcccugag

SEQ ID NO: 3577853 - RNA, 22 nt, Human
gggacucagccuucagacagag

SEQ ID NO: 3577854 - RNA, 18 nt, Human
gggacuccggcugugcug

SEQ ID NO: 3577855 - RNA, 19 nt, Human
gggacuccggcugugcugg

SEQ ID NO: 3577856 - RNA, 19 nt, Human
gggacucugagcgggaggc

SEQ ID NO: 3577857 - RNA, 21 nt, Human
gggacucugagcgggaggcag

SEQ ID NO: 3577858 - RNA, 22 nt, Human
gggacucugagcgggaggcaga

SEQ ID NO: 3577859 - RNA, 23 nt, Human
gggacucugagcgggaggcagag

SEQ ID NO: 3577860 - RNA, 18 nt, Human
gggacugaaaaccucucc

SEQ ID NO: 3577861 - RNA, 15 nt, Human
gggacugaagccaaa

SEQ ID NO: 3577862 - RNA, 13 nt, Human
gggacugagaaau

SEQ ID NO: 3577863 - RNA, 12 nt, Human
gggacugagaga

SEQ ID NO: 3577864 - RNA, 23 nt, Human
gggacugagagaugcagaaauau

SEQ ID NO: 3577865 - RNA, 19 nt, Human
gggacugagccagucccag

SEQ ID NO: 3577866 - RNA, 21 nt, Human
gggacugaggggaggggagca

SEQ ID NO: 3577867 - RNA, 23 nt, Human
gggacugccagucccccugcccc

SEQ ID NO: 3577868 - RNA, 17 nt, Human
gggacugccucugccac

SEQ ID NO: 3577869 - RNA, 15 nt, Human
gggacugcugcugcc

SEQ ID NO: 3577870 - RNA, 21 nt, Human
gggacugcugcugccuggcca

SEQ ID NO: 3577871 - RNA, 14 nt, Human
gggacugggagggc

SEQ ID NO: 3577872 - RNA, 20 nt, Human
gggacuggggaugugggagg

SEQ ID NO: 3577873 - RNA, 15 nt, Human
gggacugucgcugcu

SEQ ID NO: 3577874 - RNA, 17 nt, Human
gggacugucgcugcuuc

SEQ ID NO: 3577875 - RNA, 21 nt, Human
gggacugucuuucagauacau

SEQ ID NO: 3577876 - RNA, 12 nt, Human
gggacugugugu

SEQ ID NO: 3577877 - RNA, 15 nt, Human
gggacuuccuugcuc

SEQ ID NO: 3577878 - RNA, 19 nt, Human
gggacuuccuugcucuccc

SEQ ID NO: 3577879 - RNA, 14 nt, Human
gggacuucuuuuca

SEQ ID NO: 3577880 - RNA, 15 nt, Human
gggacuuggaagcuc

SEQ ID NO: 3577881 - RNA, 21 nt, Human
gggagaaaaggaaaagaaaaa

SEQ ID NO: 3577882 - RNA, 16 nt, Human
gggagaaauugacaga

SEQ ID NO: 3577883 - RNA, 16 nt, Human
gggagaaccucaggcu

SEQ ID NO: 3577884 - RNA, 22 nt, Human
gggagaagaaaggugaguuuga

SEQ ID NO: 3577885 - RNA, 15 nt, Human
gggagaaucauguga

SEQ ID NO: 3577886 - RNA, 15 nt, Human
gggagacaccucaga

SEQ ID NO: 3577887 - RNA, 17 nt, Human
gggagacaccucagagc

SEQ ID NO: 3577888 - RNA, 21 nt, Human
gggagacgguuuccagggagg

SEQ ID NO: 3577889 - RNA, 15 nt, Human
gggagagccagcucc

SEQ ID NO: 3577890 - RNA, 18 nt, Human
gggagagcccaggagcuc

SEQ ID NO: 3577891 - RNA, 20 nt, Human
gggagagcccaggagcuccc

SEQ ID NO: 3577892 - RNA, 12 nt, Human
gggagagccugc

SEQ ID NO: 3577893 - RNA, 16 nt, Human
gggagagccugcuggc

SEQ ID NO: 3577894 - RNA, 15 nt, Human
gggagagccuuccag

SEQ ID NO: 3577895 - RNA, 19 nt, Human
gggagagccuuccaggggu

SEQ ID NO: 3577896 - RNA, 12 nt, Human
gggagagcugaa

SEQ ID NO: 3577897 - RNA, 13 nt, Human
gggagaggaacuc

SEQ ID NO: 3577898 - RNA, 12 nt, Human
gggagaggcagc

SEQ ID NO: 3577899 - RNA, 15 nt, Human
gggagagggucugga

SEQ ID NO: 3577900 - RNA, 20 nt, Human
gggagagugucaaccagaca

SEQ ID NO: 3577901 - RNA, 21 nt, Human
gggagagugucaaccagacag

SEQ ID NO: 3577902 - RNA, 16 nt, Human
gggagaguuccagagg

SEQ ID NO: 3577903 - RNA, 19 nt, Human
gggagcaaacugcaugccc

SEQ ID NO: 3577904 - RNA, 16 nt, Human
gggagcagacaggagg

SEQ ID NO: 3577905 - RNA, 24 nt, Human
gggagcaggcggugggcacccacc

SEQ ID NO: 3577906 - RNA, 15 nt, Human
gggagcagggagguc

SEQ ID NO: 3577907 - RNA, 13 nt, Human
gggagccaggagg

SEQ ID NO: 3577908 - RNA, 12 nt, Human
gggagccagggc

SEQ ID NO: 3577909 - RNA, 13 nt, Human
gggagccccaggg

SEQ ID NO: 3577910 - RNA, 14 nt, Human
gggagccccagggu

SEQ ID NO: 3577911 - RNA, 16 nt, Human
gggagcccccagccug

SEQ ID NO: 3577912 - RNA, 19 nt, Human
gggagccccuucugcucag

SEQ ID NO: 3577913 - RNA, 23 nt, Human
gggagcccucaggcaccugcacu

SEQ ID NO: 3577914 - RNA, 16 nt, Human
gggagccgcuggcaga

SEQ ID NO: 3577915 - RNA, 21 nt, Human
gggagccucccugccucaggc

SEQ ID NO: 3577916 - RNA, 11 nt, Human
gggagccuccu

SEQ ID NO: 3577917 - RNA, 21 nt, Human
gggagccucgcaacccgugcc

SEQ ID NO: 3577918 - RNA, 18 nt, Human
gggagccuuagccgccca

SEQ ID NO: 3577919 - RNA, 21 nt, Human
gggagccuuugguucuggcca

SEQ ID NO: 3577920 - RNA, 22 nt, Human
gggagcgggucugcucccaagg

SEQ ID NO: 3577921 - RNA, 21 nt, Human
gggagcuccaacucagaaggg

SEQ ID NO: 3577922 - RNA, 23 nt, Human
gggagcuccacucugcuucucug

SEQ ID NO: 3577923 - RNA, 20 nt, Human
gggagcuccucuccuggagg

SEQ ID NO: 3577924 - RNA, 14 nt, Human
gggagcugagaaga

SEQ ID NO: 3577925 - RNA, 12 nt, Human
gggagcugaggc

SEQ ID NO: 3577926 - RNA, 13 nt, Human
gggagcugccugu

SEQ ID NO: 3577927 - RNA, 15 nt, Human
gggagcugcugcccu

SEQ ID NO: 3577928 - RNA, 14 nt, Human
gggagcugggcuuc

SEQ ID NO: 3577929 - RNA, 19 nt, Human
gggagcugguuagaaaugc

SEQ ID NO: 3577930 - RNA, 16 nt, Human
gggaggaaaagaaaag

SEQ ID NO: 3577931 - RNA, 18 nt, Human
gggaggaacacugcacuc

SEQ ID NO: 3577932 - RNA, 12 nt, Human
gggaggaagcag

SEQ ID NO: 3577933 - RNA, 14 nt, Human
gggaggaagcagaa

SEQ ID NO: 3577934 - RNA, 18 nt, Human
gggaggaagcagaauaaa

SEQ ID NO: 3577935 - RNA, 23 nt, Human
gggaggacaaaacuucuugucag

SEQ ID NO: 3577936 - RNA, 12 nt, Human
gggaggacaggc

SEQ ID NO: 3577937 - RNA, 16 nt, Human
gggaggaccuggggca

SEQ ID NO: 3577938 - RNA, 23 nt, Human
gggaggagaagaaaauguucuuc

SEQ ID NO: 3577939 - RNA, 11 nt, Human
gggaggcagcc

SEQ ID NO: 3577940 - RNA, 13 nt, Human
gggaggcagccgg

SEQ ID NO: 3577941 - RNA, 17 nt, Human
gggaggcauggcccugg

SEQ ID NO: 3577942 - RNA, 18 nt, Human
gggaggccccacugggga

SEQ ID NO: 3577943 - RNA, 20 nt, Human
gggaggcggagaguacagug

SEQ ID NO: 3577944 - RNA, 13 nt, Human
gggaggcucaggu

SEQ ID NO: 3577945 - RNA, 15 nt, Human
gggaggcugagacag

SEQ ID NO: 3577946 - RNA, 17 nt, Human
gggaggcugagacagga

SEQ ID NO: 3577947 - RNA, 16 nt, Human
gggaggcugaggcaca

SEQ ID NO: 3577948 - RNA, 14 nt, Human
gggaggcugaggcg

SEQ ID NO: 3577949 - RNA, 18 nt, Human
gggagggagcugagaaga

SEQ ID NO: 3577950 - RNA, 15 nt, Human
gggagggcccacuuc

SEQ ID NO: 3577951 - RNA, 22 nt, Human
gggagggcggcaggggccugga

SEQ ID NO: 3577952 - RNA, 11 nt, Human
gggagggcucc

SEQ ID NO: 3577953 - RNA, 13 nt, Human
gggagggcuccag

SEQ ID NO: 3577954 - RNA, 15 nt, Human
gggagggcuccagac

SEQ ID NO: 3577955 - RNA, 18 nt, Human
gggagggcuccagacaca

SEQ ID NO: 3577956 - RNA, 12 nt, Human
gggagggcucug

SEQ ID NO: 3577957 - RNA, 13 nt, Human
gggagggcugcga

SEQ ID NO: 3577958 - RNA, 14 nt, Human
gggagggcugcgac

SEQ ID NO: 3577959 - RNA, 14 nt, Human
gggaggggcaggcu

SEQ ID NO: 3577960 - RNA, 16 nt, Human
gggaggggcaggcuga

SEQ ID NO: 3577961 - RNA, 17 nt, Human
gggaggggcaggcugac

SEQ ID NO: 3577962 - RNA, 13 nt, Human
gggaggggcccgc

SEQ ID NO: 3577963 - RNA, 17 nt, Human
gggaggggccggcccug

SEQ ID NO: 3577964 - RNA, 18 nt, Human
gggaggggcgcccaccuc

SEQ ID NO: 3577965 - RNA, 18 nt, Human
gggaggggcgcuggccca

SEQ ID NO: 3577966 - RNA, 20 nt, Human
gggaggggcgcuggcccagc

SEQ ID NO: 3577967 - RNA, 15 nt, Human
gggaggggcuccuuu

SEQ ID NO: 3577968 - RNA, 14 nt, Human
gggagggggcagaa

SEQ ID NO: 3577969 - RNA, 19 nt, Human
gggagggguugccacaggc

SEQ ID NO: 3577970 - RNA, 17 nt, Human
gggagggucagccaggg

SEQ ID NO: 3577971 - RNA, 15 nt, Human
gggaggucacuggaa

SEQ ID NO: 3577972 - RNA, 15 nt, Human
gggaggucgaggcag

SEQ ID NO: 3577973 - RNA, 17 nt, Human
gggaggucgaggcagga

SEQ ID NO: 3577974 - RNA, 15 nt, Human
gggaggucgagguag

SEQ ID NO: 3577975 - RNA, 23 nt, Human
gggagguggaagaagggagaaga

SEQ ID NO: 3577976 - RNA, 15 nt, Human
gggaguccaggcaca

SEQ ID NO: 3577977 - RNA, 17 nt, Human
gggaguccaggcacagg

SEQ ID NO: 3577978 - RNA, 16 nt, Human
gggaguccccuccccg

SEQ ID NO: 3577979 - RNA, 17 nt, Human
gggagucugaagcagau

SEQ ID NO: 3577980 - RNA, 17 nt, Human
gggagucugccagggcc

SEQ ID NO: 3577981 - RNA, 23 nt, Human
gggagugacucaagaagugaaga

SEQ ID NO: 3577982 - RNA, 19 nt, Human
gggagugaggcaggugaca

SEQ ID NO: 3577983 - RNA, 21 nt, Human
gggagugaguugauagcacag

SEQ ID NO: 3577984 - RNA, 15 nt, Human
gggagugcuggcuca

SEQ ID NO: 3577985 - RNA, 16 nt, Human
gggagugcuggcucac

SEQ ID NO: 3577986 - RNA, 17 nt, Human
gggaguguacucccagg

SEQ ID NO: 3577987 - RNA, 18 nt, Human
gggaguguacucccaggg

SEQ ID NO: 3577988 - RNA, 21 nt, Human
gggaguuucuuuccugccuuc

SEQ ID NO: 3577989 - RNA, 15 nt, Human
gggauauaggagagg

SEQ ID NO: 3577990 - RNA, 21 nt, Human
gggauaugauuuaaaucagcc

SEQ ID NO: 3577991 - RNA, 12 nt, Human
gggauaugcuua

SEQ ID NO: 3577992 - RNA, 17 nt, Human
gggaucacaggugucag

SEQ ID NO: 3577993 - RNA, 18 nt, Human
gggaucagggguaggaau

SEQ ID NO: 3577994 - RNA, 23 nt, Human
gggauccccgccuggccaggagc

SEQ ID NO: 3577995 - RNA, 20 nt, Human
gggaucccucccccccaugc

SEQ ID NO: 3577996 - RNA, 14 nt, Human
gggaucucaggggc

SEQ ID NO: 3577997 - RNA, 15 nt, Human
gggaucugccccucc

SEQ ID NO: 3577998 - RNA, 17 nt, Human
gggaucugugcccagag

SEQ ID NO: 3577999 - RNA, 18 nt, Human
gggaucuugcauucccag

SEQ ID NO: 3578000 - RNA, 20 nt, Human
gggaugacuaaaauauuuau

SEQ ID NO: 3578001 - RNA, 15 nt, Human
gggaugacugugauu

SEQ ID NO: 3578002 - RNA, 15 nt, Human
gggaugagaguuuug

SEQ ID NO: 3578003 - RNA, 15 nt, Human
gggauggaaaaggaa

SEQ ID NO: 3578004 - RNA, 14 nt, Human
gggauggaggagaa

SEQ ID NO: 3578005 - RNA, 15 nt, Human
gggaugggagccggg

SEQ ID NO: 3578006 - RNA, 13 nt, Human
gggaugggccacc

SEQ ID NO: 3578007 - RNA, 16 nt, Human
gggaugggccaccgcc

SEQ ID NO: 3578008 - RNA, 14 nt, Human
gggaugggccuggc

SEQ ID NO: 3578009 - RNA, 16 nt, Human
gggaugguccuggggc

SEQ ID NO: 3578010 - RNA, 13 nt, Human
gggauggugcccu

SEQ ID NO: 3578011 - RNA, 17 nt, Human
gggaugguggagggcca

SEQ ID NO: 3578012 - RNA, 19 nt, Human
gggauggugggcuucaggg

SEQ ID NO: 3578013 - RNA, 14 nt, Human
gggaugucucucau

SEQ ID NO: 3578014 - RNA, 12 nt, Human
gggauguguccu

SEQ ID NO: 3578015 - RNA, 18 nt, Human
gggauguguccugacacu

SEQ ID NO: 3578016 - RNA, 16 nt, Human
gggauuacaggcuccu

SEQ ID NO: 3578017 - RNA, 21 nt, Human
gggauuacaggcuccugccac

SEQ ID NO: 3578018 - RNA, 15 nt, Human
gggauuacccaagca

SEQ ID NO: 3578019 - RNA, 20 nt, Human
gggauuaugggucacaggaa

SEQ ID NO: 3578020 - RNA, 15 nt, Human
gggauucaggcugcu

SEQ ID NO: 3578021 - RNA, 16 nt, Human
gggauucaggcugcuu

SEQ ID NO: 3578022 - RNA, 13 nt, Human
gggauuccugacc

SEQ ID NO: 3578023 - RNA, 17 nt, Human
gggauuccugacccagg

SEQ ID NO: 3578024 - RNA, 19 nt, Human
gggauuccugacccaggcc

SEQ ID NO: 3578025 - RNA, 15 nt, Human
gggauucuuaaaguu

SEQ ID NO: 3578026 - RNA, 20 nt, Human
gggauucuuaaaguugaauu

SEQ ID NO: 3578027 - RNA, 18 nt, Human
gggauugauuuuaaaaug

SEQ ID NO: 3578028 - RNA, 19 nt, Human
gggauuuguccuuggggac

SEQ ID NO: 3578029 - RNA, 21 nt, Human
gggcaaaaaacucgaggacug

SEQ ID NO: 3578030 - RNA, 18 nt, Human
gggcaaacaccugcugau

SEQ ID NO: 3578031 - RNA, 12 nt, Human
gggcaaagccag

SEQ ID NO: 3578032 - RNA, 13 nt, Human
gggcaaagccagg

SEQ ID NO: 3578033 - RNA, 20 nt, Human
gggcaaagccaggucccucu

SEQ ID NO: 3578034 - RNA, 21 nt, Human
gggcaaaugacaugcacugac

SEQ ID NO: 3578035 - RNA, 22 nt, Human
gggcaaaugacaugcacugacc

SEQ ID NO: 3578036 - RNA, 16 nt, Human
gggcaaauuggagaaa

SEQ ID NO: 3578037 - RNA, 15 nt, Human
gggcaacgaagaaaa

SEQ ID NO: 3578038 - RNA, 17 nt, Human
gggcaacgaagaaaaaa

SEQ ID NO: 3578039 - RNA, 14 nt, Human
gggcaaggaaaaag

SEQ ID NO: 3578040 - RNA, 20 nt, Human
gggcaaggaaaaagaaaaua

SEQ ID NO: 3578041 - RNA, 13 nt, Human
gggcaaggagacc

SEQ ID NO: 3578042 - RNA, 24 nt, Human
gggcaagucccugacucucuguga

SEQ ID NO: 3578043 - RNA, 22 nt, Human
gggcaagucuuuaggucuuugu

SEQ ID NO: 3578044 - RNA, 21 nt, Human
gggcaauauaaccaauguuua

SEQ ID NO: 3578045 - RNA, 16 nt, Human
gggcacaaagggccca

SEQ ID NO: 3578046 - RNA, 13 nt, Human
gggcacacucugc

SEQ ID NO: 3578047 - RNA, 15 nt, Human
gggcacacucugcca

SEQ ID NO: 3578048 - RNA, 15 nt, Human
gggcacagcaucugu

SEQ ID NO: 3578049 - RNA, 13 nt, Human
gggcacaggagcu

SEQ ID NO: 3578050 - RNA, 14 nt, Human
gggcacaggagcua

SEQ ID NO: 3578051 - RNA, 15 nt, Human
gggcacaggagcuac

SEQ ID NO: 3578052 - RNA, 21 nt, Human
gggcacaggagcuaccugugu

SEQ ID NO: 3578053 - RNA, 18 nt, Human
gggcacaggaggcaggca

SEQ ID NO: 3578054 - RNA, 14 nt, Human
gggcacaggccaug

SEQ ID NO: 3578055 - RNA, 16 nt, Human
gggcacaggccaugga

SEQ ID NO: 3578056 - RNA, 14 nt, Human
gggcacagggccug

SEQ ID NO: 3578057 - RNA, 13 nt, Human
gggcacaggucag

SEQ ID NO: 3578058 - RNA, 15 nt, Human
gggcacaguccagga

SEQ ID NO: 3578059 - RNA, 23 nt, Human
gggcacaugcugagucucccaag

SEQ ID NO: 3578060 - RNA, 17 nt, Human
gggcaccaagcccacag

SEQ ID NO: 3578061 - RNA, 18 nt, Human
gggcacccccagccuggg

SEQ ID NO: 3578062 - RNA, 14 nt, Human
gggcaccggggccu

SEQ ID NO: 3578063 - RNA, 17 nt, Human
gggcacgcugugggcag

SEQ ID NO: 3578064 - RNA, 19 nt, Human
gggcacgugguugaguggg

SEQ ID NO: 3578065 - RNA, 17 nt, Human
gggcacugcucucaccu

SEQ ID NO: 3578066 - RNA, 13 nt, Human
gggcacugcuggg

SEQ ID NO: 3578067 - RNA, 21 nt, Human
gggcacugcuggguggcccau

SEQ ID NO: 3578068 - RNA, 14 nt, Human
gggcacuggcccag

SEQ ID NO: 3578069 - RNA, 14 nt, Human
gggcacugggcugu

SEQ ID NO: 3578070 - RNA, 16 nt, Human
gggcacugguggcccg

SEQ ID NO: 3578071 - RNA, 15 nt, Human
gggcacuucacagag

SEQ ID NO: 3578072 - RNA, 16 nt, Human
gggcacuucacagagu

SEQ ID NO: 3578073 - RNA, 17 nt, Human
gggcacuucacagagug

SEQ ID NO: 3578074 - RNA, 18 nt, Human
gggcacuucacagagugu

SEQ ID NO: 3578075 - RNA, 14 nt, Human
gggcagaagggaga

SEQ ID NO: 3578076 - RNA, 14 nt, Human
gggcagagaggcug

SEQ ID NO: 3578077 - RNA, 22 nt, Human
gggcagagcagagaccaucccu

SEQ ID NO: 3578078 - RNA, 23 nt, Human
gggcagagcagagaccaucccug

SEQ ID NO: 3578079 - RNA, 21 nt, Human
gggcagagcccccaggaagcc

SEQ ID NO: 3578080 - RNA, 14 nt, Human
gggcagagccggga

SEQ ID NO: 3578081 - RNA, 17 nt, Human
gggcagagcuggcucug

SEQ ID NO: 3578082 - RNA, 13 nt, Human
gggcagagcuggu

SEQ ID NO: 3578083 - RNA, 15 nt, Human
gggcagaggagaacu

SEQ ID NO: 3578084 - RNA, 21 nt, Human
gggcagaggagaacuugcugc

SEQ ID NO: 3578085 - RNA, 14 nt, Human
gggcagagggcaga

SEQ ID NO: 3578086 - RNA, 14 nt, Human
gggcagagggcugg

SEQ ID NO: 3578087 - RNA, 18 nt, Human
gggcagaucuuggacuca

SEQ ID NO: 3578088 - RNA, 16 nt, Human
gggcagcaauuuaaau

SEQ ID NO: 3578089 - RNA, 17 nt, Human
gggcagcagcagcccug

SEQ ID NO: 3578090 - RNA, 14 nt, Human
gggcagcagggcua

SEQ ID NO: 3578091 - RNA, 11 nt, Human
gggcagccagg

SEQ ID NO: 3578092 - RNA, 16 nt, Human
gggcagccaggcugcc

SEQ ID NO: 3578093 - RNA, 18 nt, Human
gggcagccagggagagcc

SEQ ID NO: 3578094 - RNA, 20 nt, Human
gggcagccagggagagccca

SEQ ID NO: 3578095 - RNA, 13 nt, Human
gggcagccccagg

SEQ ID NO: 3578096 - RNA, 14 nt, Human
gggcagcccuugcu

SEQ ID NO: 3578097 - RNA, 19 nt, Human
gggcagcccuugcuuguug

SEQ ID NO: 3578098 - RNA, 18 nt, Human
gggcagccuggcucccag

SEQ ID NO: 3578099 - RNA, 16 nt, Human
gggcagcgccaggcug

SEQ ID NO: 3578100 - RNA, 20 nt, Human
gggcagcgcccuuccucucc

SEQ ID NO: 3578101 - RNA, 21 nt, Human
gggcagcgcccuuccucucca

SEQ ID NO: 3578102 - RNA, 17 nt, Human
gggcagcuccucugucu

SEQ ID NO: 3578103 - RNA, 22 nt, Human
gggcagcuccucugucucgagc

SEQ ID NO: 3578104 - RNA, 15 nt, Human
gggcagcugcaggac

SEQ ID NO: 3578105 - RNA, 16 nt, Human
gggcagcugccagaga

SEQ ID NO: 3578106 - RNA, 18 nt, Human
gggcagcugccagagaag

SEQ ID NO: 3578107 - RNA, 13 nt, Human
gggcagcugccuc

SEQ ID NO: 3578108 - RNA, 20 nt, Human
gggcagcugccuccccuccu

SEQ ID NO: 3578109 - RNA, 18 nt, Human
gggcagcugggcccaacc

SEQ ID NO: 3578110 - RNA, 19 nt, Human
gggcagcuuagggcccugg

SEQ ID NO: 3578111 - RNA, 19 nt, Human
gggcagcuugccccggccc

SEQ ID NO: 3578112 - RNA, 16 nt, Human
gggcaggaaggagagc

SEQ ID NO: 3578113 - RNA, 13 nt, Human
gggcaggaccagc

SEQ ID NO: 3578114 - RNA, 18 nt, Human
gggcaggaccagcccacg

SEQ ID NO: 3578115 - RNA, 23 nt, Human
gggcaggacucagcuccccagag

SEQ ID NO: 3578116 - RNA, 18 nt, Human
gggcaggagggcccuacc

SEQ ID NO: 3578117 - RNA, 13 nt, Human
gggcaggcacagc

SEQ ID NO: 3578118 - RNA, 15 nt, Human
gggcaggcacagcac

SEQ ID NO: 3578119 - RNA, 13 nt, Human
gguuuuuuuccuu

SEQ ID NO: 3578120 - RNA, 23 nt, Human
guaaaaaaaaaugccuuugagac

SEQ ID NO: 3578121 - RNA, 13 nt, Human
guaaaaaaaccac

SEQ ID NO: 3578122 - RNA, 15 nt, Human
guaaaaacugaaguu

SEQ ID NO: 3578123 - RNA, 11 nt, Human
guaaaaagaaa

SEQ ID NO: 3578124 - RNA, 20 nt, Human
guaaaaauaaaauacuuuga

SEQ ID NO: 3578125 - RNA, 14 nt, Human
guaaaaauaaaauu

SEQ ID NO: 3578126 - RNA, 12 nt, Human
guaaaaauacaa

SEQ ID NO: 3578127 - RNA, 12 nt, Human
guaaaaaugaga

SEQ ID NO: 3578128 - RNA, 16 nt, Human
guaaaaaugagaacau

SEQ ID NO: 3578129 - RNA, 15 nt, Human
guaaaacaaaacaaa

SEQ ID NO: 3578130 - RNA, 11 nt, Human
guaaaacauuu

SEQ ID NO: 3578131 - RNA, 18 nt, Human
guaaaacauuuauuuuga

SEQ ID NO: 3578132 - RNA, 20 nt, Human
guaaaacauuuauuuugaca

SEQ ID NO: 3578133 - RNA, 21 nt, Human
guaaaacgcugucaaaaguug

SEQ ID NO: 3578134 - RNA, 18 nt, Human
guaaaacuuuauuuuaua

SEQ ID NO: 3578135 - RNA, 20 nt, Human
guaaaagaaaucauguccau

SEQ ID NO: 3578136 - RNA, 18 nt, Human
guaaaagaacaguaaaca

SEQ ID NO: 3578137 - RNA, 21 nt, Human
guaaaagacaguguauguaga

SEQ ID NO: 3578138 - RNA, 17 nt, Human
guaaaagauuaaacugc

SEQ ID NO: 3578139 - RNA, 12 nt, Human
guaaaagcaaaa

SEQ ID NO: 3578140 - RNA, 18 nt, Human
guaaaagcaaaaaagaaa

SEQ ID NO: 3578141 - RNA, 19 nt, Human
guaaaagcaaaaaagaaaa

SEQ ID NO: 3578142 - RNA, 22 nt, Human
guaaaaggccaaaccucuguuc

SEQ ID NO: 3578143 - RNA, 14 nt, Human
guaaaauaaaauua

SEQ ID NO: 3578144 - RNA, 15 nt, Human
guaaaauauagcugu

SEQ ID NO: 3578145 - RNA, 18 nt, Human
guaaaauauagcuguaca

SEQ ID NO: 3578146 - RNA, 20 nt, Human
guaaaauauagcuguacaaa

SEQ ID NO: 3578147 - RNA, 15 nt, Human
guaaaauauuuugaa

SEQ ID NO: 3578148 - RNA, 22 nt, Human
guaaaaucuugucauguguaua

SEQ ID NO: 3578149 - RNA, 14 nt, Human
guaaaaugaagaau

SEQ ID NO: 3578150 - RNA, 16 nt, Human
guaaaaugacaaucau

SEQ ID NO: 3578151 - RNA, 15 nt, Human
guaaaauggaggugg

SEQ ID NO: 3578152 - RNA, 14 nt, Human
guaaaauguauuau

SEQ ID NO: 3578153 - RNA, 18 nt, Human
guaaaauguauuuuucua

SEQ ID NO: 3578154 - RNA, 20 nt, Human
guaaaaugugaagugaauga

SEQ ID NO: 3578155 - RNA, 22 nt, Human
guaaaaugugaagugaaugaaa

SEQ ID NO: 3578156 - RNA, 15 nt, Human
guaaaauugccauau

SEQ ID NO: 3578157 - RNA, 18 nt, Human
guaaaauugccauauugc

SEQ ID NO: 3578158 - RNA, 19 nt, Human
guaaaauugccauauugca

SEQ ID NO: 3578159 - RNA, 20 nt, Human
guaaaauugccauauugcac

SEQ ID NO: 3578160 - RNA, 15 nt, Human
guaaaauuguauaga

SEQ ID NO: 3578161 - RNA, 13 nt, Human
guaaaauuuauuu

SEQ ID NO: 3578162 - RNA, 17 nt, Human
guaaacaaaauuuaguu

SEQ ID NO: 3578163 - RNA, 23 nt, Human
guaaacaaaauuuaguuuuuguu

SEQ ID NO: 3578164 - RNA, 20 nt, Human
guaaacaaacuguguaacug

SEQ ID NO: 3578165 - RNA, 19 nt, Human
guaaacacagucaaaauaa

SEQ ID NO: 3578166 - RNA, 13 nt, Human
guaaacacaucua

SEQ ID NO: 3578167 - RNA, 22 nt, Human
guaaacacgccugcaaacgcug

SEQ ID NO: 3578168 - RNA, 15 nt, Human
guaaacacucagcug

SEQ ID NO: 3578169 - RNA, 20 nt, Human
guaaacagauggcacuuuga

SEQ ID NO: 3578170 - RNA, 15 nt, Human
guaaacagugccugc

SEQ ID NO: 3578171 - RNA, 23 nt, Human
guaaacauaauucuuguauauua

SEQ ID NO: 3578172 - RNA, 19 nt, Human
guaaacauaccaacauguu

SEQ ID NO: 3578173 - RNA, 18 nt, Human
guaaaccacugaaaaaau

SEQ ID NO: 3578174 - RNA, 22 nt, Human
guaaaccccuuuaguggcuuca

SEQ ID NO: 3578175 - RNA, 14 nt, Human
guaaaccugucuga

SEQ ID NO: 3578176 - RNA, 13 nt, Human
guaaaccuuuuau

SEQ ID NO: 3578177 - RNA, 21 nt, Human
guaaacguuucaguaauaaaa

SEQ ID NO: 3578178 - RNA, 23 nt, Human
guaaacguuucaguaauaaaaca

SEQ ID NO: 3578179 - RNA, 23 nt, Human
guaaacuaaugaguuucuuuuau

SEQ ID NO: 3578180 - RNA, 15 nt, Human
guaaacuauuuaucu

SEQ ID NO: 3578181 - RNA, 17 nt, Human
guaaacuggaauuaaaa

SEQ ID NO: 3578182 - RNA, 20 nt, Human
guaaacuguguauuccaaga

SEQ ID NO: 3578183 - RNA, 13 nt, Human
guaaacuguuucu

SEQ ID NO: 3578184 - RNA, 17 nt, Human
guaaacuuuaucacuua

SEQ ID NO: 3578185 - RNA, 14 nt, Human
guaaagaaaaauau

SEQ ID NO: 3578186 - RNA, 15 nt, Human
guaaagaaaaauauu

SEQ ID NO: 3578187 - RNA, 16 nt, Human
guaaagaaagagagaa

SEQ ID NO: 3578188 - RNA, 20 nt, Human
guaaagaaagagagaaaaua

SEQ ID NO: 3578189 - RNA, 13 nt, Human
guaaagaaauguc

SEQ ID NO: 3578190 - RNA, 22 nt, Human
guaaagaacugcacaugaagaa

SEQ ID NO: 3578191 - RNA, 17 nt, Human
guaaagaacuuuuucuu

SEQ ID NO: 3578192 - RNA, 13 nt, Human
guaaagaauuauu

SEQ ID NO: 3578193 - RNA, 14 nt, Human
guaaagaauuauuu

SEQ ID NO: 3578194 - RNA, 19 nt, Human
guaaagacuggcuuuuauu

SEQ ID NO: 3578195 - RNA, 18 nt, Human
guaaagacugguuuucug

SEQ ID NO: 3578196 - RNA, 19 nt, Human
guaaagauauuuuuaucuu

SEQ ID NO: 3578197 - RNA, 16 nt, Human
guaaagauuucuguuc

SEQ ID NO: 3578198 - RNA, 19 nt, Human
guaaagcaaccaaaaagaa

SEQ ID NO: 3578199 - RNA, 12 nt, Human
guaaagccaugc

SEQ ID NO: 3578200 - RNA, 20 nt, Human
guaaagcuaaaaugauuuua

SEQ ID NO: 3578201 - RNA, 20 nt, Human
guaaagcuauuuaugggccc

SEQ ID NO: 3578202 - RNA, 23 nt, Human
guaaagcuauuuaugggccccug

SEQ ID NO: 3578203 - RNA, 23 nt, Human
guaaagguuuauuuuucuguuac

SEQ ID NO: 3578204 - RNA, 14 nt, Human
guaaaguacuugua

SEQ ID NO: 3578205 - RNA, 16 nt, Human
guaaaguacuuguagu

SEQ ID NO: 3578206 - RNA, 22 nt, Human
guaaaguauguauuauuuacau

SEQ ID NO: 3578207 - RNA, 15 nt, Human
guaaagucaaggaga

SEQ ID NO: 3578208 - RNA, 23 nt, Human
guaaaguccccagagaaagcgca

SEQ ID NO: 3578209 - RNA, 20 nt, Human
guaaaguccuuuucuugcuu

SEQ ID NO: 3578210 - RNA, 18 nt, Human
guaaaguugguuggauaa

SEQ ID NO: 3578211 - RNA, 14 nt, Human
guaaauaaaccacu

SEQ ID NO: 3578212 - RNA, 13 nt, Human
guaaauaaagccc

SEQ ID NO: 3578213 - RNA, 14 nt, Human
guaaauaaauuguu

SEQ ID NO: 3578214 - RNA, 11 nt, Human
guaaauaagag

SEQ ID NO: 3578215 - RNA, 13 nt, Human
guaaauaagagau

SEQ ID NO: 3578216 - RNA, 16 nt, Human
guaaauaagagauuug

SEQ ID NO: 3578217 - RNA, 16 nt, Human
guaaauaaugcuuuga

SEQ ID NO: 3578218 - RNA, 22 nt, Human
guaaauacaauuuuguuucugu

SEQ ID NO: 3578219 - RNA, 19 nt, Human
guaaauacacaacacacac

SEQ ID NO: 3578220 - RNA, 14 nt, Human
guaaauacagguag

SEQ ID NO: 3578221 - RNA, 16 nt, Human
guaaauacaugcauau

SEQ ID NO: 3578222 - RNA, 11 nt, Human
guaaauauaaa

SEQ ID NO: 3578223 - RNA, 12 nt, Human
guaaauauaaag

SEQ ID NO: 3578224 - RNA, 13 nt, Human
guaaauauaaaga

SEQ ID NO: 3578225 - RNA, 14 nt, Human
guaaauauaaagac

SEQ ID NO: 3578226 - RNA, 23 nt, Human
guaaauauaaagacguuuuauaa

SEQ ID NO: 3578227 - RNA, 19 nt, Human
guaaauauugaggcuuugu

SEQ ID NO: 3578228 - RNA, 11 nt, Human
guaaauauuua

SEQ ID NO: 3578229 - RNA, 17 nt, Human
guaaaucacauccuuau

SEQ ID NO: 3578230 - RNA, 18 nt, Human
guaaaucagauguugaau

SEQ ID NO: 3578231 - RNA, 17 nt, Human
guaaaucaguaagaggu

SEQ ID NO: 3578232 - RNA, 15 nt, Human
guaaaucccauuauu

SEQ ID NO: 3578233 - RNA, 17 nt, Human
guaaaucccauuauuca

SEQ ID NO: 3578234 - RNA, 19 nt, Human
guaaaucccauuauucaaa

SEQ ID NO: 3578235 - RNA, 19 nt, Human
guaaauccugccauuuaaa

SEQ ID NO: 3578236 - RNA, 15 nt, Human
guaaauccuuuuucu

SEQ ID NO: 3578237 - RNA, 22 nt, Human
guaaauccuuuuucuuuauaaa

SEQ ID NO: 3578238 - RNA, 20 nt, Human
guaaaucuaacauuauuacu

SEQ ID NO: 3578239 - RNA, 14 nt, Human
guaaaucugccaca

SEQ ID NO: 3578240 - RNA, 15 nt, Human
guaaaucugccacaa

SEQ ID NO: 3578241 - RNA, 22 nt, Human
guaaauggcuuauccagcuggu

SEQ ID NO: 3578242 - RNA, 17 nt, Human
guaaaugucucacugag

SEQ ID NO: 3578243 - RNA, 12 nt, Human
guaaauguguac

SEQ ID NO: 3578244 - RNA, 20 nt, Human
guaaauguguuggacaaaug

SEQ ID NO: 3578245 - RNA, 16 nt, Human
guaaauguuauuucug

SEQ ID NO: 3578246 - RNA, 11 nt, Human
guaaauguuuc

SEQ ID NO: 3578247 - RNA, 13 nt, Human
guaaauguuucuu

SEQ ID NO: 3578248 - RNA, 20 nt, Human
guaaauuauauuugugcuau

SEQ ID NO: 3578249 - RNA, 14 nt, Human
guaaauuauucagu

SEQ ID NO: 3578250 - RNA, 13 nt, Human
guaaauucugauu

SEQ ID NO: 3578251 - RNA, 19 nt, Human
guaaauugaaucaguauaa

SEQ ID NO: 3578252 - RNA, 19 nt, Human
guaaauuggcauggaaauu

SEQ ID NO: 3578253 - RNA, 23 nt, Human
guaaauuuccccaacagugugaa

SEQ ID NO: 3578254 - RNA, 18 nt, Human
guaaauuuuguaugaaaa

SEQ ID NO: 3578255 - RNA, 15 nt, Human
guaacaagaaaacau

SEQ ID NO: 3578256 - RNA, 16 nt, Human
guaacaagaaaggaga

SEQ ID NO: 3578257 - RNA, 14 nt, Human
guaacaagagugau

SEQ ID NO: 3578258 - RNA, 16 nt, Human
guaacaagccacccca

SEQ ID NO: 3578259 - RNA, 14 nt, Human
guaacaauacaaau

SEQ ID NO: 3578260 - RNA, 21 nt, Human
guaacaauuguguagccuuuu

SEQ ID NO: 3578261 - RNA, 17 nt, Human
guaacacaagccacaga

SEQ ID NO: 3578262 - RNA, 20 nt, Human
guaacacaagccacagaagc

SEQ ID NO: 3578263 - RNA, 22 nt, Human
guaacacagugccuucaauaaa

SEQ ID NO: 3578264 - RNA, 20 nt, Human
guaauuaaguacuauguauc

SEQ ID NO: 3578265 - RNA, 13 nt, Human
guaauuauaucug

SEQ ID NO: 3578266 - RNA, 14 nt, Human
guaauuaugauuug

SEQ ID NO: 3578267 - RNA, 21 nt, Human
guaauuaugcacuaaauauga

SEQ ID NO: 3578268 - RNA, 23 nt, Human
guaauuauuuauguauggugcaa

SEQ ID NO: 3578269 - RNA, 17 nt, Human
guaauuauuuugguacu

SEQ ID NO: 3578270 - RNA, 14 nt, Human
guaauucaagaaaa

SEQ ID NO: 3578271 - RNA, 21 nt, Human
guaauuccucucacuaaacuu

SEQ ID NO: 3578272 - RNA, 14 nt, Human
guaauucuaaauga

SEQ ID NO: 3578273 - RNA, 16 nt, Human
guaauucuuauuccau

SEQ ID NO: 3578274 - RNA, 17 nt, Human
guaauugcuuacauuuu

SEQ ID NO: 3578275 - RNA, 23 nt, Human
guaauugcuuacauuuuuacaau

SEQ ID NO: 3578276 - RNA, 23 nt, Human
guaauuguuguuuguauguauaa

SEQ ID NO: 3578277 - RNA, 21 nt, Human
guaauuuaaaauaauuauaua

SEQ ID NO: 3578278 - RNA, 16 nt, Human
guaauuuaaacaggcc

SEQ ID NO: 3578279 - RNA, 14 nt, Human
guaauuucuuugcc

SEQ ID NO: 3578280 - RNA, 23 nt, Human
guaauuugagagaaauaugaaga

SEQ ID NO: 3578281 - RNA, 18 nt, Human
guaauuuggaucucuucu

SEQ ID NO: 3578282 - RNA, 14 nt, Human
guaauuuguaucug

SEQ ID NO: 3578283 - RNA, 15 nt, Human
guaauuuguaucuga

SEQ ID NO: 3578284 - RNA, 20 nt, Human
guaauuuguguaauaaagug

SEQ ID NO: 3578285 - RNA, 22 nt, Human
guaauuuguguaauaaaguguu

SEQ ID NO: 3578286 - RNA, 20 nt, Human
guaauuuuaugagcugugag

SEQ ID NO: 3578287 - RNA, 14 nt, Human
guaauuuuggauuu

SEQ ID NO: 3578288 - RNA, 20 nt, Human
guaauuuuguguaagaaaua

SEQ ID NO: 3578289 - RNA, 13 nt, Human
guaauuuuucugu

SEQ ID NO: 3578290 - RNA, 15 nt, Human
guaauuuuucuguau

SEQ ID NO: 3578291 - RNA, 21 nt, Human
guaauuuuucuguauagacag

SEQ ID NO: 3578292 - RNA, 22 nt, Human
guacaaaaaauucagugaugug

SEQ ID NO: 3578293 - RNA, 12 nt, Human
guacaaaauaaa

SEQ ID NO: 3578294 - RNA, 21 nt, Human
guacaaaauaaaguuacauug

SEQ ID NO: 3578295 - RNA, 20 nt, Human
guacaaauaaagucccaggu

SEQ ID NO: 3578296 - RNA, 22 nt, Human
guacaaaugccuuaaaauggaa

SEQ ID NO: 3578297 - RNA, 23 nt, Human
guacaaccacacccacacucaga

SEQ ID NO: 3578298 - RNA, 15 nt, Human
guacaagaucucagg

SEQ ID NO: 3578299 - RNA, 17 nt, Human
guacaaguaguucugua

SEQ ID NO: 3578300 - RNA, 11 nt, Human
guacaauaaaa

SEQ ID NO: 3578301 - RNA, 18 nt, Human
guacaauauuuaaaauuu

SEQ ID NO: 3578302 - RNA, 14 nt, Human
guacaauauuuuaa

SEQ ID NO: 3578303 - RNA, 17 nt, Human
guacaauauuuuaagca

SEQ ID NO: 3578304 - RNA, 18 nt, Human
guacaauauuuuaagcau

SEQ ID NO: 3578305 - RNA, 24 nt, Human
guacaauauuuuaagcauuacucu

SEQ ID NO: 3578306 - RNA, 20 nt, Human
guacaaugacuuuauugcau

SEQ ID NO: 3578307 - RNA, 21 nt, Human
guacaaugacuuuauugcauc

SEQ ID NO: 3578308 - RNA, 17 nt, Human
guacaauguguuuuucu

SEQ ID NO: 3578309 - RNA, 21 nt, Human
guacaauugugggcauaaacu

SEQ ID NO: 3578310 - RNA, 14 nt, Human
guacacacuuuauu

SEQ ID NO: 3578311 - RNA, 15 nt, Human
guacacagacuauug

SEQ ID NO: 3578312 - RNA, 14 nt, Human
guacacauaagcca

SEQ ID NO: 3578313 - RNA, 17 nt, Human
guacacccaugaaagaa

SEQ ID NO: 3578314 - RNA, 15 nt, Human
guacaccccaccucu

SEQ ID NO: 3578315 - RNA, 14 nt, Human
guacacguguccug

SEQ ID NO: 3578316 - RNA, 17 nt, Human
guacacguguccuguag

SEQ ID NO: 3578317 - RNA, 13 nt, Human
guacacucugcug

SEQ ID NO: 3578318 - RNA, 19 nt, Human
guacacuguuucaaacuuu

SEQ ID NO: 3578319 - RNA, 20 nt, Human
guacacuguuucaaacuuua

SEQ ID NO: 3578320 - RNA, 12 nt, Human
guacacuuuuuu

SEQ ID NO: 3578321 - RNA, 18 nt, Human
guacagaauuugaauuau

SEQ ID NO: 3578322 - RNA, 15 nt, Human
guacagacagaaaaa

SEQ ID NO: 3578323 - RNA, 16 nt, Human
guacagacuuguugug

SEQ ID NO: 3578324 - RNA, 11 nt, Human
guacagagaag

SEQ ID NO: 3578325 - RNA, 13 nt, Human
guacagagaagcc

SEQ ID NO: 3578326 - RNA, 21 nt, Human
guacagagaagccagcuuguu

SEQ ID NO: 3578327 - RNA, 17 nt, Human
guacagagaagccauca

SEQ ID NO: 3578328 - RNA, 22 nt, Human
guacagagcccacgcccccacu

SEQ ID NO: 3578329 - RNA, 23 nt, Human
guacagcccagaggccaacacug

SEQ ID NO: 3578330 - RNA, 12 nt, Human
guacagcuggcu

SEQ ID NO: 3578331 - RNA, 14 nt, Human
guacagcuggcucu

SEQ ID NO: 3578332 - RNA, 23 nt, Human
guacaguauggggguuguaaauu

SEQ ID NO: 3578333 - RNA, 12 nt, Human
guacagucuguc

SEQ ID NO: 3578334 - RNA, 14 nt, Human
guacagucugucau

SEQ ID NO: 3578335 - RNA, 13 nt, Human
guacagucugucu

SEQ ID NO: 3578336 - RNA, 14 nt, Human
guacagucugucuu

SEQ ID NO: 3578337 - RNA, 19 nt, Human
guacagucugucuucugua

SEQ ID NO: 3578338 - RNA, 20 nt, Human
guacagucugucuucuguau

SEQ ID NO: 3578339 - RNA, 19 nt, Human
guacagucuugcagcagga

SEQ ID NO: 3578340 - RNA, 14 nt, Human
guacagucuuguau

SEQ ID NO: 3578341 - RNA, 16 nt, Human
guacagucuuguauua

SEQ ID NO: 3578342 - RNA, 20 nt, Human
guacaguuaucuaaguuaau

SEQ ID NO: 3578343 - RNA, 14 nt, Human
guacaguucaguuc

SEQ ID NO: 3578344 - RNA, 16 nt, Human
guacaguucuucggga

SEQ ID NO: 3578345 - RNA, 23 nt, Human
guacaguucuucgggaagagagg

SEQ ID NO: 3578346 - RNA, 14 nt, Human
guacaguuugcugu

SEQ ID NO: 3578347 - RNA, 16 nt, Human
guacaguuugcuguac

SEQ ID NO: 3578348 - RNA, 14 nt, Human
guacaguuuuauuu

SEQ ID NO: 3578349 - RNA, 16 nt, Human
guacauaaaagaauuu

SEQ ID NO: 3578350 - RNA, 23 nt, Human
guacauaaauugcauaaagcaua

SEQ ID NO: 3578351 - RNA, 14 nt, Human
guacauaacugaaa

SEQ ID NO: 3578352 - RNA, 15 nt, Human
guacauaauacugaa

SEQ ID NO: 3578353 - RNA, 16 nt, Human
guacauaauacugaac

SEQ ID NO: 3578354 - RNA, 14 nt, Human
guacauagccuaua

SEQ ID NO: 3578355 - RNA, 22 nt, Human
guacauagugcuaacaugaaga

SEQ ID NO: 3578356 - RNA, 17 nt, Human
guacauaguuauuuauu

SEQ ID NO: 3578357 - RNA, 17 nt, Human
guacauauguaaacaua

SEQ ID NO: 3578358 - RNA, 22 nt, Human
guacauauuagcgacaacagau

SEQ ID NO: 3578359 - RNA, 17 nt, Human
guacauauuuguggaau

SEQ ID NO: 3578360 - RNA, 19 nt, Human
guacauauuuguggaauaa

SEQ ID NO: 3578361 - RNA, 20 nt, Human
guacaucuauuuuggauugu

SEQ ID NO: 3578362 - RNA, 14 nt, Human
guacaucuggcuua

SEQ ID NO: 3578363 - RNA, 16 nt, Human
guacaucuggcuuauu

SEQ ID NO: 3578364 - RNA, 18 nt, Human
guacaucuggcuuauuuu

SEQ ID NO: 3578365 - RNA, 19 nt, Human
guacaucuggcuuauuuua

SEQ ID NO: 3578366 - RNA, 23 nt, Human
guacaucuggcuuauuuuaaugu

SEQ ID NO: 3578367 - RNA, 20 nt, Human
guacaugaaauuuuuguaaa

SEQ ID NO: 3578368 - RNA, 12 nt, Human
guacaugggacu

SEQ ID NO: 3578369 - RNA, 22 nt, Human
guacaugggacuaugcuuuucu

SEQ ID NO: 3578370 - RNA, 17 nt, Human
guacauggugcugggag

SEQ ID NO: 3578371 - RNA, 10 nt, Human
guacauguau

SEQ ID NO: 3578372 - RNA, 13 nt, Human
guacauguauuaa

SEQ ID NO: 3578373 - RNA, 16 nt, Human
guacauguauuaaauu

SEQ ID NO: 3578374 - RNA, 20 nt, Human
guacauguguagccugugca

SEQ ID NO: 3578375 - RNA, 13 nt, Human
guacauuuauaau

SEQ ID NO: 3578376 - RNA, 22 nt, Human
guacauuugggaguuuuuauga

SEQ ID NO: 3578377 - RNA, 20 nt, Human
guaccaaaauuuuaaaaaag

SEQ ID NO: 3578378 - RNA, 16 nt, Human
guaccaaaugcuuuaa

SEQ ID NO: 3578379 - RNA, 14 nt, Human
guaccaagaaagga

SEQ ID NO: 3578380 - RNA, 14 nt, Human
guaccaaucauuuu

SEQ ID NO: 3578381 - RNA, 15 nt, Human
guaccaaucauuuua

SEQ ID NO: 3578382 - RNA, 15 nt, Human
guaccaccaaaaaag

SEQ ID NO: 3578383 - RNA, 17 nt, Human
guaccacugaaucugua

SEQ ID NO: 3578384 - RNA, 16 nt, Human
guaccagauaaaauua

SEQ ID NO: 3578385 - RNA, 17 nt, Human
guaccagaugcagcuca

SEQ ID NO: 3578386 - RNA, 16 nt, Human
guaccagcaauaugua

SEQ ID NO: 3578387 - RNA, 22 nt, Human
guaccagcgcucuaaaagcacc

SEQ ID NO: 3578388 - RNA, 23 nt, Human
guaccaggaaaggauuuuauaau

SEQ ID NO: 3578389 - RNA, 21 nt, Human
guaccagguauuauuaucuuu

SEQ ID NO: 3578390 - RNA, 19 nt, Human
guaccaggucuccuccacc

SEQ ID NO: 3578391 - RNA, 15 nt, Human
guaccagugaauuuu

SEQ ID NO: 3578392 - RNA, 16 nt, Human
guaccagugaauuuuu

SEQ ID NO: 3578393 - RNA, 19 nt, Human
guaccagugaauuuuugca

SEQ ID NO: 3578394 - RNA, 22 nt, Human
guaccagugaauuuuugcaaua

SEQ ID NO: 3578395 - RNA, 10 nt, Human
guaccaguua

SEQ ID NO: 3578396 - RNA, 23 nt, Human
guaccaguuaauuuuuccaacua

SEQ ID NO: 3578397 - RNA, 20 nt, Human
guaccauaguaccauuuaua

SEQ ID NO: 3578398 - RNA, 16 nt, Human
guaccauuaaaauaug

SEQ ID NO: 3578399 - RNA, 17 nt, Human
guaccauuaaaauaugc

SEQ ID NO: 3578400 - RNA, 14 nt, Human
guaccauuugcaug

SEQ ID NO: 3578401 - RNA, 13 nt, Human
guaccauuuuaaa

SEQ ID NO: 3578402 - RNA, 19 nt, Human
guacccaccgggccacucc

SEQ ID NO: 3578403 - RNA, 16 nt, Human
guacccaccugagcuu

SEQ ID NO: 3578404 - RNA, 22 nt, Human
guaccccacccucagcaccccu

SEQ ID NO: 3578405 - RNA, 14 nt, Human
guaccccccaaccc

SEQ ID NO: 3578406 - RNA, 13 nt, Human
guacccugggugu

SEQ ID NO: 3578407 - RNA, 15 nt, Human
guaccgcaaugugac

SEQ ID NO: 3578408 - RNA, 17 nt, Human
guaccuagcuggcucug

SEQ ID NO: 3578409 - RNA, 20 nt, Human
guagacgugcacgcacacug

SEQ ID NO: 3578410 - RNA, 23 nt, Human
guagacgugcacgcacacugucu

SEQ ID NO: 3578411 - RNA, 14 nt, Human
guagacuacuguuc

SEQ ID NO: 3578412 - RNA, 15 nt, Human
guagagauggaggag

SEQ ID NO: 3578413 - RNA, 16 nt, Human
guagagauggaggagg

SEQ ID NO: 3578414 - RNA, 14 nt, Human
guagagccagcuug

SEQ ID NO: 3578415 - RNA, 23 nt, Human
guagagcccuguaucaacccaga

SEQ ID NO: 3578416 - RNA, 14 nt, Human
guagaggcuuguuu

SEQ ID NO: 3578417 - RNA, 15 nt, Human
guagagguacacuug

SEQ ID NO: 3578418 - RNA, 17 nt, Human
guagagguacacuugug

SEQ ID NO: 3578419 - RNA, 17 nt, Human
guagaguuaagaagcug

SEQ ID NO: 3578420 - RNA, 19 nt, Human
guagaguugaucaaaauca

SEQ ID NO: 3578421 - RNA, 20 nt, Human
guagaguuugaaggagguga

SEQ ID NO: 3578422 - RNA, 17 nt, Human
guagauacaaucagcug

SEQ ID NO: 3578423 - RNA, 14 nt, Human
guagauagaaauaa

SEQ ID NO: 3578424 - RNA, 21 nt, Human
guagauauccucugcuuaaaa

SEQ ID NO: 3578425 - RNA, 21 nt, Human
guagauauuuggcuuaaauau

SEQ ID NO: 3578426 - RNA, 22 nt, Human
guagaugaaaaagcauguacag

SEQ ID NO: 3578427 - RNA, 15 nt, Human
guagaugcgcagccc

SEQ ID NO: 3578428 - RNA, 21 nt, Human
guagaugggagggaggcucag

SEQ ID NO: 3578429 - RNA, 20 nt, Human
guagauguaugcacacacau

SEQ ID NO: 3578430 - RNA, 18 nt, Human
guagauucagguaauaca

SEQ ID NO: 3578431 - RNA, 22 nt, Human
guagauuccauuuacugcauuc

SEQ ID NO: 3578432 - RNA, 12 nt, Human
guagauuuauuu

SEQ ID NO: 3578433 - RNA, 21 nt, Human
guagauuuauuucaucauauu

SEQ ID NO: 3578434 - RNA, 12 nt, Human
guagauuugauu

SEQ ID NO: 3578435 - RNA, 18 nt, Human
guagcaaacccugucaaa

SEQ ID NO: 3578436 - RNA, 21 nt, Human
guagcaaacccugucaaacau

SEQ ID NO: 3578437 - RNA, 21 nt, Human
guagcaaucagauuuuccugu

SEQ ID NO: 3578438 - RNA, 23 nt, Human
guagcacaaguuauuuaaaucug

SEQ ID NO: 3578439 - RNA, 20 nt, Human
guagcacaggcugagugcag

SEQ ID NO: 3578440 - RNA, 14 nt, Human
guagcacucaggcu

SEQ ID NO: 3578441 - RNA, 17 nt, Human
guagcagaguuaaaucu

SEQ ID NO: 3578442 - RNA, 12 nt, Human
guagcagcugga

SEQ ID NO: 3578443 - RNA, 13 nt, Human
guagcagcuggac

SEQ ID NO: 3578444 - RNA, 15 nt, Human
guagcagggaaaaua

SEQ ID NO: 3578445 - RNA, 15 nt, Human
guagcauuacagugg

SEQ ID NO: 3578446 - RNA, 13 nt, Human
guagcauuuuaaa

SEQ ID NO: 3578447 - RNA, 19 nt, Human
guagccagcacacagggca

SEQ ID NO: 3578448 - RNA, 19 nt, Human
guagccagggggacuagcc

SEQ ID NO: 3578449 - RNA, 23 nt, Human
guagccaggguguggcccugcca

SEQ ID NO: 3578450 - RNA, 18 nt, Human
guagccagguauggcucu

SEQ ID NO: 3578451 - RNA, 20 nt, Human
guagccaggucccccugcag

SEQ ID NO: 3578452 - RNA, 20 nt, Human
guagccaucccaugaacaca

SEQ ID NO: 3578453 - RNA, 23 nt, Human
guagccccaagaaggcuggggcu

SEQ ID NO: 3578454 - RNA, 15 nt, Human
guagccccagugaca

SEQ ID NO: 3578455 - RNA, 19 nt, Human
guagccccagugacagcua

SEQ ID NO: 3578456 - RNA, 18 nt, Human
guagcccccuggccucug

SEQ ID NO: 3578457 - RNA, 20 nt, Human
guagcccgccugccaguccu

SEQ ID NO: 3578458 - RNA, 17 nt, Human
guagcccuggccagagg

SEQ ID NO: 3578459 - RNA, 12 nt, Human
guagccugugca

SEQ ID NO: 3578460 - RNA, 13 nt, Human
guagcguuuuuua

SEQ ID NO: 3578461 - RNA, 13 nt, Human
guagcuacagaga

SEQ ID NO: 3578462 - RNA, 12 nt, Human
guagcuccuccc

SEQ ID NO: 3578463 - RNA, 19 nt, Human
guagcucuuugucagggag

SEQ ID NO: 3578464 - RNA, 11 nt, Human
guagcugagcu

SEQ ID NO: 3578465 - RNA, 13 nt, Human
guagcugagcuca

SEQ ID NO: 3578466 - RNA, 16 nt, Human
guagcugcaaaaauaa

SEQ ID NO: 3578467 - RNA, 21 nt, Human
guagcugggacuacaggcacc

SEQ ID NO: 3578468 - RNA, 18 nt, Human
guagcugggauuacaggc

SEQ ID NO: 3578469 - RNA, 16 nt, Human
guagcugggauuuuaa

SEQ ID NO: 3578470 - RNA, 15 nt, Human
guagcugugaccugc

SEQ ID NO: 3578471 - RNA, 20 nt, Human
guagcugugaccugcugagc

SEQ ID NO: 3578472 - RNA, 22 nt, Human
guagcuuaccugacacaagagg

SEQ ID NO: 3578473 - RNA, 21 nt, Human
guagcuucagucauuaaauua

SEQ ID NO: 3578474 - RNA, 19 nt, Human
guaggaaaaauaaaaacag

SEQ ID NO: 3578475 - RNA, 18 nt, Human
guaggaacgguaaauuuc

SEQ ID NO: 3578476 - RNA, 21 nt, Human
guaggaacgguaaauuucugu

SEQ ID NO: 3578477 - RNA, 17 nt, Human
guaggaagaguagcauu

SEQ ID NO: 3578478 - RNA, 17 nt, Human
guaggaagguacuguau

SEQ ID NO: 3578479 - RNA, 22 nt, Human
guaggaagguacuguaugauca

SEQ ID NO: 3578480 - RNA, 18 nt, Human
guaggaagguuaauguuc

SEQ ID NO: 3578481 - RNA, 21 nt, Human
guaggaauauuauauuuggau

SEQ ID NO: 3578482 - RNA, 22 nt, Human
guaggacuuuggugguuuaaaa

SEQ ID NO: 3578483 - RNA, 19 nt, Human
guaggagacuguuuggaaa

SEQ ID NO: 3578484 - RNA, 17 nt, Human
guaggaggaugggcucg

SEQ ID NO: 3578485 - RNA, 21 nt, Human
guaggagggacugucgcugcu

SEQ ID NO: 3578486 - RNA, 15 nt, Human
guaggaguucuauuu

SEQ ID NO: 3578487 - RNA, 14 nt, Human
guaggauaugccug

SEQ ID NO: 3578488 - RNA, 22 nt, Human
guaggauaugccugcucuuugg

SEQ ID NO: 3578489 - RNA, 17 nt, Human
guaggaucuaaggcugu

SEQ ID NO: 3578490 - RNA, 13 nt, Human
guaggauuacuag

SEQ ID NO: 3578491 - RNA, 14 nt, Human
guaggauuuuuguu

SEQ ID NO: 3578492 - RNA, 13 nt, Human
guaggcagagccu

SEQ ID NO: 3578493 - RNA, 12 nt, Human
guaggccaaggu

SEQ ID NO: 3578494 - RNA, 20 nt, Human
guaggccaagguguccuaca

SEQ ID NO: 3578495 - RNA, 20 nt, Human
guaggccuuuuaacauuuug

SEQ ID NO: 3578496 - RNA, 14 nt, Human
guaggcuacagaga

SEQ ID NO: 3578497 - RNA, 16 nt, Human
guaggcuacagagaag

SEQ ID NO: 3578498 - RNA, 19 nt, Human
guaggcuacagagaagccu

SEQ ID NO: 3578499 - RNA, 21 nt, Human
guaggcuacagagaagccuuc

SEQ ID NO: 3578500 - RNA, 22 nt, Human
guaggcuacagagaagccuuca

SEQ ID NO: 3578501 - RNA, 23 nt, Human
guaggcuccugccaguguggaac

SEQ ID NO: 3578502 - RNA, 13 nt, Human
guagggaggcagc

SEQ ID NO: 3578503 - RNA, 15 nt, Human
guagggaguuguggg

SEQ ID NO: 3578504 - RNA, 21 nt, Human
guagggcugccaccaagguga

SEQ ID NO: 3578505 - RNA, 13 nt, Human
guaggggaagaau

SEQ ID NO: 3578506 - RNA, 22 nt, Human
guaggggagggguugccacagg

SEQ ID NO: 3578507 - RNA, 13 nt, Human
guaggggccccuc

SEQ ID NO: 3578508 - RNA, 15 nt, Human
guaggggcugggaac

SEQ ID NO: 3578509 - RNA, 16 nt, Human
guaggggcugggaaca

SEQ ID NO: 3578510 - RNA, 18 nt, Human
guaggggcuuagaggcau

SEQ ID NO: 3578511 - RNA, 19 nt, Human
guagggggcuggaggagcc

SEQ ID NO: 3578512 - RNA, 20 nt, Human
guagggggcuggaggagccc

SEQ ID NO: 3578513 - RNA, 12 nt, Human
guagggugggag

SEQ ID NO: 3578514 - RNA, 22 nt, Human
guagggugggccuucagggagu

SEQ ID NO: 3578515 - RNA, 14 nt, Human
guagguaaaaugua

SEQ ID NO: 3578516 - RNA, 20 nt, Human
guagguaaaauguauuuuuc

SEQ ID NO: 3578517 - RNA, 13 nt, Human
guagguaagacug

SEQ ID NO: 3578518 - RNA, 23 nt, Human
guagguaucauuuucugcauuua

SEQ ID NO: 3578519 - RNA, 21 nt, Human
guagguuauuaugauuagcuu

SEQ ID NO: 3578520 - RNA, 15 nt, Human
guagguucagccaag

SEQ ID NO: 3578521 - RNA, 16 nt, Human
guagguucagccaagg

SEQ ID NO: 3578522 - RNA, 19 nt, Human
guaguaaaaauuaaaaaaa

SEQ ID NO: 3578523 - RNA, 15 nt, Human
guaguaaaacacaga

SEQ ID NO: 3578524 - RNA, 17 nt, Human
guaguaaaacacagagg

SEQ ID NO: 3578525 - RNA, 15 nt, Human
guaguaauugacaug

SEQ ID NO: 3578526 - RNA, 15 nt, Human
guaguaccaaaauaa

SEQ ID NO: 3578527 - RNA, 16 nt, Human
guaguaccaaaauaaa

SEQ ID NO: 3578528 - RNA, 21 nt, Human
guaguacuccugcaaaauuuu

SEQ ID NO: 3578529 - RNA, 17 nt, Human
guaguagcccuuucugu

SEQ ID NO: 3578530 - RNA, 16 nt, Human
guaguauaaagaaaag

SEQ ID NO: 3578531 - RNA, 14 nt, Human
guaguaucaaauau

SEQ ID NO: 3578532 - RNA, 22 nt, Human
guaguaugauagguuauuuuga

SEQ ID NO: 3578533 - RNA, 20 nt, Human
guaguauuuuuuguauaauu

SEQ ID NO: 3578534 - RNA, 22 nt, Human
guagucagaauuagcugcuucu

SEQ ID NO: 3578535 - RNA, 13 nt, Human
guagucccagcua

SEQ ID NO: 3578536 - RNA, 12 nt, Human
guaguccccaac

SEQ ID NO: 3578537 - RNA, 23 nt, Human
guaguccgugcugacagcugcuc

SEQ ID NO: 3578538 - RNA, 22 nt, Human
guaguccucauaaaaagcaaaa

SEQ ID NO: 3578539 - RNA, 14 nt, Human
guaguccuuggcau

SEQ ID NO: 3578540 - RNA, 16 nt, Human
guagucuaaccaaaug

SEQ ID NO: 3578541 - RNA, 19 nt, Human
guagucucacugcuugaac

SEQ ID NO: 3578542 - RNA, 13 nt, Human
guagucugcucac

SEQ ID NO: 3578543 - RNA, 14 nt, Human
guagugagaagaau

SEQ ID NO: 3578544 - RNA, 15 nt, Human
guagugagaagaaua

SEQ ID NO: 3578545 - RNA, 13 nt, Human
guagugagccgag

SEQ ID NO: 3578546 - RNA, 17 nt, Human
guaguguucagaaaaaa

SEQ ID NO: 3578547 - RNA, 11 nt, Human
guaguuaggaa

SEQ ID NO: 3578548 - RNA, 22 nt, Human
guaguuaggaaauaaaaccuuu

SEQ ID NO: 3578549 - RNA, 16 nt, Human
guaguuaguagcaugu

SEQ ID NO: 3578550 - RNA, 16 nt, Human
guaguuaucauguuag

SEQ ID NO: 3578551 - RNA, 14 nt, Human
guaguuauuuugca

SEQ ID NO: 3578552 - RNA, 13 nt, Human
guaguucccugaa

SEQ ID NO: 3578553 - RNA, 15 nt, Human
guaguuccugcuaca

SEQ ID NO: 3578554 - RNA, 13 nt, Human
guauccuccaggu

SEQ ID NO: 3578555 - RNA, 16 nt, Human
guauccuccagguuuu

SEQ ID NO: 3578556 - RNA, 19 nt, Human
guauccuccagguuuuuca

SEQ ID NO: 3578557 - RNA, 17 nt, Human
guauccugcccaguguu

SEQ ID NO: 3578558 - RNA, 17 nt, Human
guauccuggaacaauau

SEQ ID NO: 3578559 - RNA, 21 nt, Human
guauccuggaacaauauuuua

SEQ ID NO: 3578560 - RNA, 22 nt, Human
guauccuggaacaauauuuuau

SEQ ID NO: 3578561 - RNA, 20 nt, Human
guauccugugacauguaaca

SEQ ID NO: 3578562 - RNA, 15 nt, Human
guaucggcacuguac

SEQ ID NO: 3578563 - RNA, 21 nt, Human
guaucuaagaauaauaaaauc

SEQ ID NO: 3578564 - RNA, 18 nt, Human
guaucuacuuuaauaaau

SEQ ID NO: 3578565 - RNA, 22 nt, Human
guaucuagagcuuaaugcuaca

SEQ ID NO: 3578566 - RNA, 17 nt, Human
guaucuagugcagcuga

SEQ ID NO: 3578567 - RNA, 18 nt, Human
guaucuagugcagcugau

SEQ ID NO: 3578568 - RNA, 13 nt, Human
guaucucacacuc

SEQ ID NO: 3578569 - RNA, 13 nt, Human
guaucucagaaag

SEQ ID NO: 3578570 - RNA, 18 nt, Human
guaucucagaaagugccu

SEQ ID NO: 3578571 - RNA, 13 nt, Human
guaucuccaggau

SEQ ID NO: 3578572 - RNA, 16 nt, Human
guaucuccggcuccca

SEQ ID NO: 3578573 - RNA, 20 nt, Human
guaucuccggcucccagccu

SEQ ID NO: 3578574 - RNA, 12 nt, Human
guaucucuucag

SEQ ID NO: 3578575 - RNA, 13 nt, Human
guaucucuucagu

SEQ ID NO: 3578576 - RNA, 17 nt, Human
guaucucuucagucucu

SEQ ID NO: 3578577 - RNA, 20 nt, Human
guaucucuuucacauuguuu

SEQ ID NO: 3578578 - RNA, 11 nt, Human
guaucugaagg

SEQ ID NO: 3578579 - RNA, 22 nt, Human
guaucugaguugccaagacaaa

SEQ ID NO: 3578580 - RNA, 23 nt, Human
guaucugaguugccaagacaaau

SEQ ID NO: 3578581 - RNA, 16 nt, Human
guaucugcaggcagac

SEQ ID NO: 3578582 - RNA, 18 nt, Human
guaucugcaggcagacac

SEQ ID NO: 3578583 - RNA, 19 nt, Human
guaucugcaggcagacacg

SEQ ID NO: 3578584 - RNA, 14 nt, Human
guaucugggaacug

SEQ ID NO: 3578585 - RNA, 15 nt, Human
guaucugucuuucca

SEQ ID NO: 3578586 - RNA, 15 nt, Human
guaucugugaacuga

SEQ ID NO: 3578587 - RNA, 15 nt, Human
guaucuguucuuuaa

SEQ ID NO: 3578588 - RNA, 17 nt, Human
guaucuuacuuuccucu

SEQ ID NO: 3578589 - RNA, 14 nt, Human
guaucuucauguau

SEQ ID NO: 3578590 - RNA, 17 nt, Human
guaucuuccauauuugg

SEQ ID NO: 3578591 - RNA, 13 nt, Human
guaugaaaacaug

SEQ ID NO: 3578592 - RNA, 17 nt, Human
guaugaaaacauggaac

SEQ ID NO: 3578593 - RNA, 20 nt, Human
guaugaaaaugaguugugaa

SEQ ID NO: 3578594 - RNA, 23 nt, Human
guaugaaauuauauaaguauucu

SEQ ID NO: 3578595 - RNA, 15 nt, Human
guaugaacuugagga

SEQ ID NO: 3578596 - RNA, 23 nt, Human
guaugaacuugaggacacauguc

SEQ ID NO: 3578597 - RNA, 19 nt, Human
guaugaauaaagacaccua

SEQ ID NO: 3578598 - RNA, 19 nt, Human
guaugacgcugauacauaa

SEQ ID NO: 3578599 - RNA, 14 nt, Human
guaugacuaaagag

SEQ ID NO: 3578600 - RNA, 18 nt, Human
guaugacuaaagagagaa

SEQ ID NO: 3578601 - RNA, 20 nt, Human
guaugacuaaagagagaaug

SEQ ID NO: 3578602 - RNA, 13 nt, Human
guaugaggcauuu

SEQ ID NO: 3578603 - RNA, 15 nt, Human
guaugaucaaauguu

SEQ ID NO: 3578604 - RNA, 17 nt, Human
guaugaucaaauguuua

SEQ ID NO: 3578605 - RNA, 22 nt, Human
guaugaucaaauguuuaaucau

SEQ ID NO: 3578606 - RNA, 20 nt, Human
guaugaucacggcucacugc

SEQ ID NO: 3578607 - RNA, 21 nt, Human
guaugaucacggcucacugca

SEQ ID NO: 3578608 - RNA, 13 nt, Human
guaugauguguug

SEQ ID NO: 3578609 - RNA, 16 nt, Human
guaugauguguuguga

SEQ ID NO: 3578610 - RNA, 14 nt, Human
guaugauucccagc

SEQ ID NO: 3578611 - RNA, 19 nt, Human
guaugcaguguagauuuua

SEQ ID NO: 3578612 - RNA, 12 nt, Human
guaugcauguga

SEQ ID NO: 3578613 - RNA, 16 nt, Human
guaugcauuauuaaau

SEQ ID NO: 3578614 - RNA, 22 nt, Human
guaugccuuuaaaucugugaug

SEQ ID NO: 3578615 - RNA, 19 nt, Human
guaugcugaucaucgccag

SEQ ID NO: 3578616 - RNA, 21 nt, Human
guaugcuucauacagggaugg

SEQ ID NO: 3578617 - RNA, 18 nt, Human
guauggacuaucugucug

SEQ ID NO: 3578618 - RNA, 22 nt, Human
guauggcacuggcauugucccu

SEQ ID NO: 3578619 - RNA, 18 nt, Human
guauggcguaaguacaga

SEQ ID NO: 3578620 - RNA, 19 nt, Human
guauggcguaaguacagag

SEQ ID NO: 3578621 - RNA, 20 nt, Human
guauggcguaaguacagaga

SEQ ID NO: 3578622 - RNA, 24 nt, Human
guauggcguaaguacagagaagcc

SEQ ID NO: 3578623 - RNA, 20 nt, Human
guauggcucugcaccccucu

SEQ ID NO: 3578624 - RNA, 17 nt, Human
guauggguuucucccag

SEQ ID NO: 3578625 - RNA, 14 nt, Human
guaugguggcuggg

SEQ ID NO: 3578626 - RNA, 16 nt, Human
guaugguuuuguggau

SEQ ID NO: 3578627 - RNA, 16 nt, Human
guauguaaauagguuu

SEQ ID NO: 3578628 - RNA, 12 nt, Human
guauguaaaugu

SEQ ID NO: 3578629 - RNA, 15 nt, Human
guauguaaaugugca

SEQ ID NO: 3578630 - RNA, 16 nt, Human
guauguaacaauuguu

SEQ ID NO: 3578631 - RNA, 18 nt, Human
guauguacuucaugcugu

SEQ ID NO: 3578632 - RNA, 13 nt, Human
guauguauuauuu

SEQ ID NO: 3578633 - RNA, 22 nt, Human
guaugucaauaaacaacagcug

SEQ ID NO: 3578634 - RNA, 14 nt, Human
guaugucauuuccu

SEQ ID NO: 3578635 - RNA, 22 nt, Human
guaugucugguucucaauucca

SEQ ID NO: 3578636 - RNA, 21 nt, Human
guaugugacaccaaagccacc

SEQ ID NO: 3578637 - RNA, 15 nt, Human
guauguggaagugug

SEQ ID NO: 3578638 - RNA, 16 nt, Human
guauguggaagugugg

SEQ ID NO: 3578639 - RNA, 15 nt, Human
guauguggcaaaaug

SEQ ID NO: 3578640 - RNA, 20 nt, Human
guaugugggauauugaaugu

SEQ ID NO: 3578641 - RNA, 16 nt, Human
guaugugguuuuguaa

SEQ ID NO: 3578642 - RNA, 13 nt, Human
guaugugugaagu

SEQ ID NO: 3578643 - RNA, 15 nt, Human
guauguguguguaug

SEQ ID NO: 3578644 - RNA, 18 nt, Human
guauguguguguaugcua

SEQ ID NO: 3578645 - RNA, 22 nt, Human
guauguguuuagaauugaaggu

SEQ ID NO: 3578646 - RNA, 22 nt, Human
guauguucaacuaggaucagaa

SEQ ID NO: 3578647 - RNA, 18 nt, Human
guauguuguccaauuguu

SEQ ID NO: 3578648 - RNA, 21 nt, Human
guauguuguccaauuguugac

SEQ ID NO: 3578649 - RNA, 21 nt, Human
guauguugugaagauguuugc

SEQ ID NO: 3578650 - RNA, 20 nt, Human
guauguuucucuuugauuau

SEQ ID NO: 3578651 - RNA, 14 nt, Human
guauguuugcacac

SEQ ID NO: 3578652 - RNA, 14 nt, Human
guauguuuuagcau

SEQ ID NO: 3578653 - RNA, 23 nt, Human
guauguuuuuguguauuuguuaa

SEQ ID NO: 3578654 - RNA, 19 nt, Human
guauuaaaaaaaacaaaaa

SEQ ID NO: 3578655 - RNA, 22 nt, Human
guauuaaaaaaaacaaaaagaa

SEQ ID NO: 3578656 - RNA, 12 nt, Human
guauuaaaacau

SEQ ID NO: 3578657 - RNA, 13 nt, Human
guauuaaaacauu

SEQ ID NO: 3578658 - RNA, 15 nt, Human
guauuaaauuacauu

SEQ ID NO: 3578659 - RNA, 16 nt, Human
guauuaagcauauauu

SEQ ID NO: 3578660 - RNA, 19 nt, Human
guauuaagcccacaguaua

SEQ ID NO: 3578661 - RNA, 22 nt, Human
guauuaaguuguuaauaaaagu

SEQ ID NO: 3578662 - RNA, 12 nt, Human
guauuaauaaaa

SEQ ID NO: 3578663 - RNA, 13 nt, Human
guauuaauaaaaa

SEQ ID NO: 3578664 - RNA, 14 nt, Human
guauuaauaaaaag

SEQ ID NO: 3578665 - RNA, 15 nt, Human
guauuaauaaaaaga

SEQ ID NO: 3578666 - RNA, 18 nt, Human
guauuaauaaaaagacaa

SEQ ID NO: 3578667 - RNA, 15 nt, Human
guauuaauaaauaga

SEQ ID NO: 3578668 - RNA, 16 nt, Human
guauuaauacuaaaau

SEQ ID NO: 3578669 - RNA, 23 nt, Human
guauuacacaagaccagugcuua

SEQ ID NO: 3578670 - RNA, 16 nt, Human
guauuacacucuguaa

SEQ ID NO: 3578671 - RNA, 22 nt, Human
guauuacacuguauuuguaucu

SEQ ID NO: 3578672 - RNA, 22 nt, Human
guauuacaguggggaaugaaga

SEQ ID NO: 3578673 - RNA, 12 nt, Human
guauuagauguu

SEQ ID NO: 3578674 - RNA, 21 nt, Human
guauuagauguucucuaucau

SEQ ID NO: 3578675 - RNA, 12 nt, Human
guauuauaaauu

SEQ ID NO: 3578676 - RNA, 20 nt, Human
guauuauacaugugauacau

SEQ ID NO: 3578677 - RNA, 14 nt, Human
guauuauaccuuuu

SEQ ID NO: 3578678 - RNA, 19 nt, Human
guauuauaggccaaacugg

SEQ ID NO: 3578679 - RNA, 20 nt, Human
guauuaucuuguucaggaaa

SEQ ID NO: 3578680 - RNA, 12 nt, Human
guauuaugcuuc

SEQ ID NO: 3578681 - RNA, 14 nt, Human
guauuaugcuucuu

SEQ ID NO: 3578682 - RNA, 21 nt, Human
guauuauguacucuacugaua

SEQ ID NO: 3578683 - RNA, 23 nt, Human
guauuauguccugugagaugugu

SEQ ID NO: 3578684 - RNA, 15 nt, Human
guauuauguguguuu

SEQ ID NO: 3578685 - RNA, 14 nt, Human
guauuauucuacua

SEQ ID NO: 3578686 - RNA, 14 nt, Human
guauuauugcuguu

SEQ ID NO: 3578687 - RNA, 20 nt, Human
guauuauugcuguugcuuga

SEQ ID NO: 3578688 - RNA, 14 nt, Human
guauuauuuuccaa

SEQ ID NO: 3578689 - RNA, 19 nt, Human
guauucaaaaauuaucuau

SEQ ID NO: 3578690 - RNA, 18 nt, Human
guauucaagaaagccagu

SEQ ID NO: 3578691 - RNA, 17 nt, Human
guauucauauuuguacu

SEQ ID NO: 3578692 - RNA, 22 nt, Human
guauucauccaaguuaaaugua

SEQ ID NO: 3578693 - RNA, 19 nt, Human
guauuccagaccugaagaa

SEQ ID NO: 3578694 - RNA, 15 nt, Human
guauuccaguuuguu

SEQ ID NO: 3578695 - RNA, 18 nt, Human
guauuccaguuuguuuau

SEQ ID NO: 3578696 - RNA, 12 nt, Human
guauuccccuuc

SEQ ID NO: 3578697 - RNA, 21 nt, Human
guauucuaaauuuuauaucuu

SEQ ID NO: 3578698 - RNA, 24 nt, Human
guauucuaaauuuuauaucuugua

SEQ ID NO: 3578699 - RNA, 23 nt, Human
gucuugcuauauugcccaggcug

SEQ ID NO: 3578700 - RNA, 22 nt, Human
gucuugcuauggggagaaaaga

SEQ ID NO: 3578701 - RNA, 15 nt, Human
gucuugcuguugaca

SEQ ID NO: 3578702 - RNA, 22 nt, Human
gucuuggaagcuguuuggaaaa

SEQ ID NO: 3578703 - RNA, 22 nt, Human
gucuuggcagcaccugucuccu

SEQ ID NO: 3578704 - RNA, 14 nt, Human
gucuuggccagcca

SEQ ID NO: 3578705 - RNA, 21 nt, Human
gucuugggaaauaugaaugcc

SEQ ID NO: 3578706 - RNA, 19 nt, Human
gucuugggcagagcuggcu

SEQ ID NO: 3578707 - RNA, 22 nt, Human
gucuugggcagagcuggcucug

SEQ ID NO: 3578708 - RNA, 21 nt, Human
gucuugguacuugcugcuauu

SEQ ID NO: 3578709 - RNA, 15 nt, Human
gucuugguauucuua

SEQ ID NO: 3578710 - RNA, 17 nt, Human
gucuugguuccagccug

SEQ ID NO: 3578711 - RNA, 19 nt, Human
gucuugguuccagccugcc

SEQ ID NO: 3578712 - RNA, 16 nt, Human
gucuuguaauauuuug

SEQ ID NO: 3578713 - RNA, 20 nt, Human
gucuugucucagauuuuauu

SEQ ID NO: 3578714 - RNA, 22 nt, Human
gucuugucucagauuuuauuau

SEQ ID NO: 3578715 - RNA, 19 nt, Human
gucuugugacuagugcuga

SEQ ID NO: 3578716 - RNA, 21 nt, Human
gucuugugacuagugcugaag

SEQ ID NO: 3578717 - RNA, 20 nt, Human
gucuuguguuucuuuaguuu

SEQ ID NO: 3578718 - RNA, 16 nt, Human
gucuuguuaauauucu

SEQ ID NO: 3578719 - RNA, 13 nt, Human
gucuuguuagaaa

SEQ ID NO: 3578720 - RNA, 12 nt, Human
gucuuguucugu

SEQ ID NO: 3578721 - RNA, 23 nt, Human
gucuuguucugucacucaggcug

SEQ ID NO: 3578722 - RNA, 20 nt, Human
gucuuguugcggauggaugg

SEQ ID NO: 3578723 - RNA, 22 nt, Human
gucuuguuuuuuuuuuccacuu

SEQ ID NO: 3578724 - RNA, 19 nt, Human
gucuuuaaaaacuguuuua

SEQ ID NO: 3578725 - RNA, 15 nt, Human
gucuuuaaaagagag

SEQ ID NO: 3578726 - RNA, 18 nt, Human
gucuuuaaaggcccagcc

SEQ ID NO: 3578727 - RNA, 15 nt, Human
gucuuuaaaugcugc

SEQ ID NO: 3578728 - RNA, 18 nt, Human
gucuuuacuccucacacu

SEQ ID NO: 3578729 - RNA, 16 nt, Human
gucuuuagauagcccu

SEQ ID NO: 3578730 - RNA, 24 nt, Human
gucuuuagauagcccuguccuggu

SEQ ID NO: 3578731 - RNA, 16 nt, Human
gucuuucacauuuaaa

SEQ ID NO: 3578732 - RNA, 15 nt, Human
gucuuucaguacuuu

SEQ ID NO: 3578733 - RNA, 16 nt, Human
gucuuucaguacuuuu

SEQ ID NO: 3578734 - RNA, 19 nt, Human
gucuuucauggcugcuguu

SEQ ID NO: 3578735 - RNA, 23 nt, Human
gucuuucauggcugcuguugcuu

SEQ ID NO: 3578736 - RNA, 22 nt, Human
gucuuuccaaauuauuucuuaa

SEQ ID NO: 3578737 - RNA, 13 nt, Human
gucuuuccacucu

SEQ ID NO: 3578738 - RNA, 12 nt, Human
gucuuuccuaga

SEQ ID NO: 3578739 - RNA, 16 nt, Human
gucuuuccuggcacua

SEQ ID NO: 3578740 - RNA, 21 nt, Human
gucuuucucuuucccuggucc

SEQ ID NO: 3578741 - RNA, 19 nt, Human
gucuuucugggguuuuucu

SEQ ID NO: 3578742 - RNA, 18 nt, Human
gucuuuggaaaaauguuu

SEQ ID NO: 3578743 - RNA, 14 nt, Human
gucuuuggacccug

SEQ ID NO: 3578744 - RNA, 22 nt, Human
gucuuuggggucuacacugcaa

SEQ ID NO: 3578745 - RNA, 22 nt, Human
gucuuuggguaccuauuuucau

SEQ ID NO: 3578746 - RNA, 15 nt, Human
gucuuuguaagucag

SEQ ID NO: 3578747 - RNA, 18 nt, Human
gucuuuguaaugucacca

SEQ ID NO: 3578748 - RNA, 19 nt, Human
gucuuuguuaaguucuauu

SEQ ID NO: 3578749 - RNA, 14 nt, Human
gucuuuuaaaaagu

SEQ ID NO: 3578750 - RNA, 22 nt, Human
gucuuuuauaguggaaaaacac

SEQ ID NO: 3578751 - RNA, 16 nt, Human
gucuuuucagguuugu

SEQ ID NO: 3578752 - RNA, 11 nt, Human
gucuuuucauc

SEQ ID NO: 3578753 - RNA, 15 nt, Human
gucuuuucuuugcca

SEQ ID NO: 3578754 - RNA, 19 nt, Human
gucuuuucuuugccaucuc

SEQ ID NO: 3578755 - RNA, 19 nt, Human
gucuuuugacauguggaaa

SEQ ID NO: 3578756 - RNA, 14 nt, Human
gucuuuugcuuuug

SEQ ID NO: 3578757 - RNA, 22 nt, Human
gucuuuugcuuuugcccauuuu

SEQ ID NO: 3578758 - RNA, 12 nt, Human
gucuuuuggagg

SEQ ID NO: 3578759 - RNA, 11 nt, Human
gucuuuuugua

SEQ ID NO: 3578760 - RNA, 16 nt, Human
gucuuuuuucacuaca

SEQ ID NO: 3578761 - RNA, 14 nt, Human
gucuuuuuuucugu

SEQ ID NO: 3578762 - RNA, 19 nt, Human
gucuuuuuuucuguuaauu

SEQ ID NO: 3578763 - RNA, 23 nt, Human
gucuuuuuuuggugauucaaaug

SEQ ID NO: 3578764 - RNA, 21 nt, Human
gucuuuuuuuguauuauaaaa

SEQ ID NO: 3578765 - RNA, 18 nt, Human
gugaaaaauguuaggaca

SEQ ID NO: 3578766 - RNA, 12 nt, Human
gugaaaagaaua

SEQ ID NO: 3578767 - RNA, 20 nt, Human
gugaaaagagaggauauguu

SEQ ID NO: 3578768 - RNA, 17 nt, Human
gugaaaaugguccagga

SEQ ID NO: 3578769 - RNA, 16 nt, Human
gugaaaaugugugugu

SEQ ID NO: 3578770 - RNA, 12 nt, Human
gugaaaauuauu

SEQ ID NO: 3578771 - RNA, 15 nt, Human
gugaaaauuauuuug

SEQ ID NO: 3578772 - RNA, 16 nt, Human
gugaaacacaccaggc

SEQ ID NO: 3578773 - RNA, 17 nt, Human
gugaaacacaccaggcu

SEQ ID NO: 3578774 - RNA, 16 nt, Human
gugaaacacagcuguu

SEQ ID NO: 3578775 - RNA, 15 nt, Human
gugaaacauuuucuc

SEQ ID NO: 3578776 - RNA, 20 nt, Human
gugaaaccuuuagggcagcu

SEQ ID NO: 3578777 - RNA, 20 nt, Human
gugaaacucguuaauuugua

SEQ ID NO: 3578778 - RNA, 13 nt, Human
gugaaagaaaaua

SEQ ID NO: 3578779 - RNA, 13 nt, Human
gugaaagaaauca

SEQ ID NO: 3578780 - RNA, 14 nt, Human
gugaaagaaaucau

SEQ ID NO: 3578781 - RNA, 16 nt, Human
gugaaagaaaucaugu

SEQ ID NO: 3578782 - RNA, 17 nt, Human
gugaaagcauauggguu

SEQ ID NO: 3578783 - RNA, 17 nt, Human
gugaaaguacauuugga

SEQ ID NO: 3578784 - RNA, 22 nt, Human
gugaaagugcauuuuuguaaau

SEQ ID NO: 3578785 - RNA, 12 nt, Human
gugaaauaucau

SEQ ID NO: 3578786 - RNA, 13 nt, Human
gugaaaucauuca

SEQ ID NO: 3578787 - RNA, 15 nt, Human
gugaaauggauacua

SEQ ID NO: 3578788 - RNA, 19 nt, Human
gugaaauggauacuacauc

SEQ ID NO: 3578789 - RNA, 20 nt, Human
gugaaauuauucauaauuau

SEQ ID NO: 3578790 - RNA, 22 nt, Human
gugaaauuuacaucauuucuuu

SEQ ID NO: 3578791 - RNA, 13 nt, Human
gugaacacaucag

SEQ ID NO: 3578792 - RNA, 17 nt, Human
gugaacagagagacccu

SEQ ID NO: 3578793 - RNA, 22 nt, Human
gugaaccaaagagacuggagca

SEQ ID NO: 3578794 - RNA, 15 nt, Human
gugaaccaaugcaag

SEQ ID NO: 3578795 - RNA, 13 nt, Human
gugaacccaggac

SEQ ID NO: 3578796 - RNA, 19 nt, Human
gugaacccuggggccugac

SEQ ID NO: 3578797 - RNA, 21 nt, Human
gugaacguccacaugaaaccu

SEQ ID NO: 3578798 - RNA, 19 nt, Human
gugaacuauuucuacacag

SEQ ID NO: 3578799 - RNA, 14 nt, Human
gugaacucagccaa

SEQ ID NO: 3578800 - RNA, 17 nt, Human
gugaacucagccaagca

SEQ ID NO: 3578801 - RNA, 21 nt, Human
gugaacucagccaagcacagu

SEQ ID NO: 3578802 - RNA, 23 nt, Human
gugaacucagccaagcacagugg

SEQ ID NO: 3578803 - RNA, 20 nt, Human
gugaacuggacccuguugcu

SEQ ID NO: 3578804 - RNA, 21 nt, Human
gugaacuggacccuguugcua

SEQ ID NO: 3578805 - RNA, 22 nt, Human
gugaacuggacccuguugcuaa

SEQ ID NO: 3578806 - RNA, 14 nt, Human
gugaacuugaaauu

SEQ ID NO: 3578807 - RNA, 17 nt, Human
gugaacuugggccacug

SEQ ID NO: 3578808 - RNA, 21 nt, Human
gugaacuuggugccuaauguu

SEQ ID NO: 3578809 - RNA, 12 nt, Human
gugaacuuguag

SEQ ID NO: 3578810 - RNA, 23 nt, Human
gugaagacaaugacuuacuguac

SEQ ID NO: 3578811 - RNA, 16 nt, Human
gugaagagcaagagag

SEQ ID NO: 3578812 - RNA, 15 nt, Human
gugaagaggggcagc

SEQ ID NO: 3578813 - RNA, 13 nt, Human
gugaagauacuuu

SEQ ID NO: 3578814 - RNA, 15 nt, Human
gugaagauacuuugu

SEQ ID NO: 3578815 - RNA, 19 nt, Human
gugaagaugcauuguaguu

SEQ ID NO: 3578816 - RNA, 15 nt, Human
gugaagauguuugca

SEQ ID NO: 3578817 - RNA, 18 nt, Human
gugaagcaccaagcucaa

SEQ ID NO: 3578818 - RNA, 12 nt, Human
gugaagcccugu

SEQ ID NO: 3578819 - RNA, 10 nt, Human
gugaagccuu

SEQ ID NO: 3578820 - RNA, 21 nt, Human
gugaaggauuauggaaaaaua

SEQ ID NO: 3578821 - RNA, 22 nt, Human
gugaaggauuauggaaaaauaa

SEQ ID NO: 3578822 - RNA, 12 nt, Human
gugaaggccucg

SEQ ID NO: 3578823 - RNA, 14 nt, Human
gugaaggcuggcau

SEQ ID NO: 3578824 - RNA, 20 nt, Human
gugaagguccugcuauuacu

SEQ ID NO: 3578825 - RNA, 14 nt, Human
gugaagugaagaca

SEQ ID NO: 3578826 - RNA, 18 nt, Human
gugaaguuagaauuccuu

SEQ ID NO: 3578827 - RNA, 12 nt, Human
gugaaguuaggu

SEQ ID NO: 3578828 - RNA, 16 nt, Human
gugaaguuagguucuu

SEQ ID NO: 3578829 - RNA, 15 nt, Human
gugaaguugcugcuu

SEQ ID NO: 3578830 - RNA, 19 nt, Human
gugaaguuuaauugacuua

SEQ ID NO: 3578831 - RNA, 18 nt, Human
gugaaguuuuacugucua

SEQ ID NO: 3578832 - RNA, 13 nt, Human
gugaauaaauguc

SEQ ID NO: 3578833 - RNA, 12 nt, Human
gugaauaauaau

SEQ ID NO: 3578834 - RNA, 23 nt, Human
gugaauaauacaguaucucaggg

SEQ ID NO: 3578835 - RNA, 19 nt, Human
gugaauacugcuacagcaa

SEQ ID NO: 3578836 - RNA, 22 nt, Human
gugaauacugcuugaauaaaca

SEQ ID NO: 3578837 - RNA, 18 nt, Human
gugaauaugccuguaauu

SEQ ID NO: 3578838 - RNA, 13 nt, Human
gugaauauuuuca

SEQ ID NO: 3578839 - RNA, 15 nt, Human
gugaaucagacccua

SEQ ID NO: 3578840 - RNA, 23 nt, Human
gugaaucugcauuuucuggguuc

SEQ ID NO: 3578841 - RNA, 17 nt, Human
gugaaugaaagauuaaa

SEQ ID NO: 3578842 - RNA, 19 nt, Human
gugaaugauucauguuaua

SEQ ID NO: 3578843 - RNA, 14 nt, Human
gugaauggauugga

SEQ ID NO: 3578844 - RNA, 20 nt, Human
gugcaaguaugugagugugu

SEQ ID NO: 3578845 - RNA, 20 nt, Human
gugcaaguugaggacuucuu

SEQ ID NO: 3578846 - RNA, 23 nt, Human
gugcaauaaaucugacccagugc

SEQ ID NO: 3578847 - RNA, 22 nt, Human
gugcaaugaccuuucaauagga

SEQ ID NO: 3578848 - RNA, 22 nt, Human
gugcaauguaaauauuuuaaag

SEQ ID NO: 3578849 - RNA, 15 nt, Human
gugcaauguguauaa

SEQ ID NO: 3578850 - RNA, 23 nt, Human
gugcaauguguauaaacaagaaa

SEQ ID NO: 3578851 - RNA, 22 nt, Human
gugcaauuguaggggugugugu

SEQ ID NO: 3578852 - RNA, 17 nt, Human
gugcaauuuguuugugc

SEQ ID NO: 3578853 - RNA, 18 nt, Human
gugcacaaaacccagacc

SEQ ID NO: 3578854 - RNA, 13 nt, Human
gugcacaaaauga

SEQ ID NO: 3578855 - RNA, 16 nt, Human
gugcacaagcuccaag

SEQ ID NO: 3578856 - RNA, 13 nt, Human
gugcacaaggauu

SEQ ID NO: 3578857 - RNA, 12 nt, Human
gugcacacacca

SEQ ID NO: 3578858 - RNA, 21 nt, Human
gugcacacagaaauauauaua

SEQ ID NO: 3578859 - RNA, 22 nt, Human
gugcacacagaaauauauauac

SEQ ID NO: 3578860 - RNA, 23 nt, Human
gugcacacagaaauauauauaca

SEQ ID NO: 3578861 - RNA, 22 nt, Human
gugcacagacgucccuccacgu

SEQ ID NO: 3578862 - RNA, 11 nt, Human
gugcacagccc

SEQ ID NO: 3578863 - RNA, 11 nt, Human
gugcacagcug

SEQ ID NO: 3578864 - RNA, 12 nt, Human
gugcacaggagg

SEQ ID NO: 3578865 - RNA, 13 nt, Human
gugcacaggaggg

SEQ ID NO: 3578866 - RNA, 21 nt, Human
gugcacaugcacgugugugca

SEQ ID NO: 3578867 - RNA, 23 nt, Human
gugcaccugggacagggagcagc

SEQ ID NO: 3578868 - RNA, 18 nt, Human
gugcaccuguacucagga

SEQ ID NO: 3578869 - RNA, 18 nt, Human
gugcacgcacacugucug

SEQ ID NO: 3578870 - RNA, 18 nt, Human
gugcacgcagauuagcag

SEQ ID NO: 3578871 - RNA, 18 nt, Human
gugcacguggcauguggc

SEQ ID NO: 3578872 - RNA, 12 nt, Human
gugcacguugcu

SEQ ID NO: 3578873 - RNA, 20 nt, Human
gugcacuaauguguaagaca

SEQ ID NO: 3578874 - RNA, 19 nt, Human
gugcacugcccauggacag

SEQ ID NO: 3578875 - RNA, 21 nt, Human
gugcacugcccauggacaggc

SEQ ID NO: 3578876 - RNA, 17 nt, Human
gugcacuggccccaccc

SEQ ID NO: 3578877 - RNA, 15 nt, Human
gugcacugucacuuu

SEQ ID NO: 3578878 - RNA, 17 nt, Human
gugcacuuucuaauguu

SEQ ID NO: 3578879 - RNA, 22 nt, Human
gugcagaacugcagucacugca

SEQ ID NO: 3578880 - RNA, 12 nt, Human
gugcagaaugua

SEQ ID NO: 3578881 - RNA, 20 nt, Human
gugcagaccccuuggccagc

SEQ ID NO: 3578882 - RNA, 14 nt, Human
gugcagacuggagg

SEQ ID NO: 3578883 - RNA, 23 nt, Human
gugcagacuggaggggacgcugg

SEQ ID NO: 3578884 - RNA, 16 nt, Human
gugcagagccuucuca

SEQ ID NO: 3578885 - RNA, 23 nt, Human
gugcagagccuucucagaagcac

SEQ ID NO: 3578886 - RNA, 22 nt, Human
gugcagaggucagacuaagaaa

SEQ ID NO: 3578887 - RNA, 15 nt, Human
gugcagauggagaga

SEQ ID NO: 3578888 - RNA, 18 nt, Human
gugcagcaaccagagcac

SEQ ID NO: 3578889 - RNA, 14 nt, Human
gugcagcagauugg

SEQ ID NO: 3578890 - RNA, 15 nt, Human
gugcagcauaugagg

SEQ ID NO: 3578891 - RNA, 16 nt, Human
gugcagcauuucacuu

SEQ ID NO: 3578892 - RNA, 13 nt, Human
gugcagccagagg

SEQ ID NO: 3578893 - RNA, 19 nt, Human
gugcagcccccacugccuu

SEQ ID NO: 3578894 - RNA, 12 nt, Human
gugcagcugauu

SEQ ID NO: 3578895 - RNA, 23 nt, Human
gugcagcugauuuuaacaauaac

SEQ ID NO: 3578896 - RNA, 15 nt, Human
gugcagcuucugucc

SEQ ID NO: 3578897 - RNA, 17 nt, Human
gugcagcuucuguccug

SEQ ID NO: 3578898 - RNA, 15 nt, Human
gugcaggagcgcucc

SEQ ID NO: 3578899 - RNA, 18 nt, Human
gugcaggcaggcuggccu

SEQ ID NO: 3578900 - RNA, 12 nt, Human
gugcaggcccac

SEQ ID NO: 3578901 - RNA, 13 nt, Human
gugcaggcccacc

SEQ ID NO: 3578902 - RNA, 16 nt, Human
gugcaggcccacccug

SEQ ID NO: 3578903 - RNA, 19 nt, Human
gugcaggcccacccugcuu

SEQ ID NO: 3578904 - RNA, 17 nt, Human
gugcaggcuggccagcc

SEQ ID NO: 3578905 - RNA, 20 nt, Human
gugcagggagggcaguuuuc

SEQ ID NO: 3578906 - RNA, 23 nt, Human
gugcagggccuguaaucccagca

SEQ ID NO: 3578907 - RNA, 15 nt, Human
gugcagguagaccug

SEQ ID NO: 3578908 - RNA, 18 nt, Human
gugcaguaacuugggagu

SEQ ID NO: 3578909 - RNA, 20 nt, Human
gugcaguauagaauaggcac

SEQ ID NO: 3578910 - RNA, 14 nt, Human
gugcagucacugga

SEQ ID NO: 3578911 - RNA, 14 nt, Human
gugcagucugggug

SEQ ID NO: 3578912 - RNA, 24 nt, Human
gugcaguggcaucaucucagcuca

SEQ ID NO: 3578913 - RNA, 19 nt, Human
gugcaguucuaguuugcau

SEQ ID NO: 3578914 - RNA, 13 nt, Human
gugcauaccacuu

SEQ ID NO: 3578915 - RNA, 16 nt, Human
gugcauagugcuggga

SEQ ID NO: 3578916 - RNA, 14 nt, Human
gugcauaguuucuu

SEQ ID NO: 3578917 - RNA, 15 nt, Human
gugcauauuguacac

SEQ ID NO: 3578918 - RNA, 20 nt, Human
gugcauccgggggcagcucu

SEQ ID NO: 3578919 - RNA, 14 nt, Human
gugcaucucagccc

SEQ ID NO: 3578920 - RNA, 22 nt, Human
gugcaugaagguuucugaaaau

SEQ ID NO: 3578921 - RNA, 18 nt, Human
gugcaugaucuugagcaa

SEQ ID NO: 3578922 - RNA, 16 nt, Human
gugcauggaggcccuc

SEQ ID NO: 3578923 - RNA, 14 nt, Human
gugcaugguggcac

SEQ ID NO: 3578924 - RNA, 16 nt, Human
gugcaugguggccaga

SEQ ID NO: 3578925 - RNA, 13 nt, Human
gugcaugugugug

SEQ ID NO: 3578926 - RNA, 14 nt, Human
gugcauuacagaga

SEQ ID NO: 3578927 - RNA, 16 nt, Human
gugcauuacagagagg

SEQ ID NO: 3578928 - RNA, 21 nt, Human
gugcauuagcacagauuuuaa

SEQ ID NO: 3578929 - RNA, 23 nt, Human
gugcauuaucuagauacuguauc

SEQ ID NO: 3578930 - RNA, 14 nt, Human
gugcauucuccagc

SEQ ID NO: 3578931 - RNA, 22 nt, Human
gugcauucuuuuaaaagacaag

SEQ ID NO: 3578932 - RNA, 20 nt, Human
gugcauuggaagaccccacc

SEQ ID NO: 3578933 - RNA, 22 nt, Human
gugcauuguauagauauaauga

SEQ ID NO: 3578934 - RNA, 15 nt, Human
gugcauuguuucugu

SEQ ID NO: 3578935 - RNA, 14 nt, Human
gugcauuucugaau

SEQ ID NO: 3578936 - RNA, 17 nt, Human
gugcauuugaggucugu

SEQ ID NO: 3578937 - RNA, 15 nt, Human
gugcauuuggugguu

SEQ ID NO: 3578938 - RNA, 16 nt, Human
gugcauuuuugugaaa

SEQ ID NO: 3578939 - RNA, 11 nt, Human
gugccaaagaa

SEQ ID NO: 3578940 - RNA, 15 nt, Human
gugccaaaugcucuc

SEQ ID NO: 3578941 - RNA, 20 nt, Human
gugccaacaauccuagugcu

SEQ ID NO: 3578942 - RNA, 15 nt, Human
gugccaacuguggcu

SEQ ID NO: 3578943 - RNA, 16 nt, Human
gugccaacuguggcug

SEQ ID NO: 3578944 - RNA, 14 nt, Human
gugccaagcacagu

SEQ ID NO: 3578945 - RNA, 17 nt, Human
gugccaagcacagugcc

SEQ ID NO: 3578946 - RNA, 14 nt, Human
gugccaagcagagg

SEQ ID NO: 3578947 - RNA, 19 nt, Human
gugccaaguccagguccug

SEQ ID NO: 3578948 - RNA, 20 nt, Human
gugccaaguccagguccugg

SEQ ID NO: 3578949 - RNA, 22 nt, Human
gugccaaguccagguccuggug

SEQ ID NO: 3578950 - RNA, 15 nt, Human
gugccaauauguauu

SEQ ID NO: 3578951 - RNA, 19 nt, Human
gugccacagaguguagcca

SEQ ID NO: 3578952 - RNA, 11 nt, Human
gugccacccug

SEQ ID NO: 3578953 - RNA, 16 nt, Human
gugccacccugggcuc

SEQ ID NO: 3578954 - RNA, 17 nt, Human
gugccacugcccgagcu

SEQ ID NO: 3578955 - RNA, 21 nt, Human
gugccacugcccgagcuggug

SEQ ID NO: 3578956 - RNA, 18 nt, Human
gugccacuuaauguaugu

SEQ ID NO: 3578957 - RNA, 18 nt, Human
gugccagagaacccagcc

SEQ ID NO: 3578958 - RNA, 21 nt, Human
gugccagaggugggcaggugg

SEQ ID NO: 3578959 - RNA, 14 nt, Human
gugccagcaaagcc

SEQ ID NO: 3578960 - RNA, 18 nt, Human
gugccagcaacugaauaa

SEQ ID NO: 3578961 - RNA, 14 nt, Human
gugccagcccagag

SEQ ID NO: 3578962 - RNA, 18 nt, Human
gugccagcccagaggccg

SEQ ID NO: 3578963 - RNA, 18 nt, Human
gugccagccuuccucugc

SEQ ID NO: 3578964 - RNA, 18 nt, Human
gugccaggaaacucuugc

SEQ ID NO: 3578965 - RNA, 17 nt, Human
gugccaggacuccccag

SEQ ID NO: 3578966 - RNA, 20 nt, Human
gugccagguuuucugggugu

SEQ ID NO: 3578967 - RNA, 22 nt, Human
gugccagguuuuuggucugacc

SEQ ID NO: 3578968 - RNA, 16 nt, Human
gugccagucgcgcugc

SEQ ID NO: 3578969 - RNA, 21 nt, Human
gugccagucgcgcugccugug

SEQ ID NO: 3578970 - RNA, 23 nt, Human
gugccauagaguuuaacacaagu

SEQ ID NO: 3578971 - RNA, 22 nt, Human
gugccaucauugcugucugcag

SEQ ID NO: 3578972 - RNA, 11 nt, Human
gugccauggaa

SEQ ID NO: 3578973 - RNA, 19 nt, Human
gugccaugucaaacaaaua

SEQ ID NO: 3578974 - RNA, 14 nt, Human
gugccaugugccag

SEQ ID NO: 3578975 - RNA, 16 nt, Human
gugccaugugccaggu

SEQ ID NO: 3578976 - RNA, 15 nt, Human
gugccauugucuuua

SEQ ID NO: 3578977 - RNA, 23 nt, Human
gugcccaagaauagaugcugacu

SEQ ID NO: 3578978 - RNA, 23 nt, Human
gugcccaaguuguggugcugaca

SEQ ID NO: 3578979 - RNA, 19 nt, Human
gugcccacagcccgcaugc

SEQ ID NO: 3578980 - RNA, 20 nt, Human
gugcccacaggaucagucug

SEQ ID NO: 3578981 - RNA, 13 nt, Human
gugcccacaggcc

SEQ ID NO: 3578982 - RNA, 20 nt, Human
gugcccagaacuucccugau

SEQ ID NO: 3578983 - RNA, 21 nt, Human
gugcccagcuauaccugugcc

SEQ ID NO: 3578984 - RNA, 22 nt, Human
gugcccagcuauaccugugccu

SEQ ID NO: 3578985 - RNA, 23 nt, Human
gugcccagcuauaccugugccuc

SEQ ID NO: 3578986 - RNA, 13 nt, Human
gugcccagcucag

SEQ ID NO: 3578987 - RNA, 17 nt, Human
gugcccaguuaaucuug

SEQ ID NO: 3578988 - RNA, 21 nt, Human
gugcugccacacuucaggcuc

SEQ ID NO: 3578989 - RNA, 13 nt, Human
gugcugcccugcc

SEQ ID NO: 3578990 - RNA, 15 nt, Human
gugcugcccugccca

SEQ ID NO: 3578991 - RNA, 19 nt, Human
gugcugcccugcccaccug

SEQ ID NO: 3578992 - RNA, 20 nt, Human
gugcugcccugcccaccugg

SEQ ID NO: 3578993 - RNA, 19 nt, Human
gugcugcggagcaagagga

SEQ ID NO: 3578994 - RNA, 18 nt, Human
gugcugcuacccucccug

SEQ ID NO: 3578995 - RNA, 13 nt, Human
gugcugcugaaga

SEQ ID NO: 3578996 - RNA, 15 nt, Human
gugcugcugugugcu

SEQ ID NO: 3578997 - RNA, 12 nt, Human
gugcugcuuuga

SEQ ID NO: 3578998 - RNA, 16 nt, Human
gugcuggaggacugag

SEQ ID NO: 3578999 - RNA, 19 nt, Human
gugcuggaggugggagcag

SEQ ID NO: 3579000 - RNA, 21 nt, Human
gugcuggaggugggagcagga

SEQ ID NO: 3579001 - RNA, 17 nt, Human
gugcuggagucuccuga

SEQ ID NO: 3579002 - RNA, 23 nt, Human
gugcuggagucuccugaggacac

SEQ ID NO: 3579003 - RNA, 20 nt, Human
gugcuggauggagcccaggc

SEQ ID NO: 3579004 - RNA, 15 nt, Human
gugcuggccagcgag

SEQ ID NO: 3579005 - RNA, 19 nt, Human
gugcuggcucacaguacag

SEQ ID NO: 3579006 - RNA, 21 nt, Human
gugcuggcucacaguacagca

SEQ ID NO: 3579007 - RNA, 22 nt, Human
gugcuggcucacaguacagcau

SEQ ID NO: 3579008 - RNA, 18 nt, Human
gugcuggcugcccagacc

SEQ ID NO: 3579009 - RNA, 13 nt, Human
gugcugggacuga

SEQ ID NO: 3579010 - RNA, 17 nt, Human
gugcugggagaaauacu

SEQ ID NO: 3579011 - RNA, 12 nt, Human
gugcugggcagc

SEQ ID NO: 3579012 - RNA, 11 nt, Human
gugcugggccc

SEQ ID NO: 3579013 - RNA, 18 nt, Human
gugcugggcggcugugcu

SEQ ID NO: 3579014 - RNA, 23 nt, Human
gugcugggggaaugagcccagag

SEQ ID NO: 3579015 - RNA, 22 nt, Human
gugcugggguuaucugaaguca

SEQ ID NO: 3579016 - RNA, 16 nt, Human
gugcugguguccugac

SEQ ID NO: 3579017 - RNA, 20 nt, Human
gugcugguguccugaccacc

SEQ ID NO: 3579018 - RNA, 13 nt, Human
gugcuguauaaaa

SEQ ID NO: 3579019 - RNA, 18 nt, Human
gugcuguccaugcuucuc

SEQ ID NO: 3579020 - RNA, 18 nt, Human
gugcuguccucagguggc

SEQ ID NO: 3579021 - RNA, 12 nt, Human
gugcugugaaaa

SEQ ID NO: 3579022 - RNA, 13 nt, Human
gugcugugaggga

SEQ ID NO: 3579023 - RNA, 16 nt, Human
gugcugugagggaggg

SEQ ID NO: 3579024 - RNA, 15 nt, Human
gugcuguggccaggg

SEQ ID NO: 3579025 - RNA, 16 nt, Human
gugcuguggccagggu

SEQ ID NO: 3579026 - RNA, 18 nt, Human
gugcuguggccaggguga

SEQ ID NO: 3579027 - RNA, 16 nt, Human
gugcuguggccugggc

SEQ ID NO: 3579028 - RNA, 19 nt, Human
gugcuguggccugggcaag

SEQ ID NO: 3579029 - RNA, 14 nt, Human
gugcuguggggcug

SEQ ID NO: 3579030 - RNA, 12 nt, Human
gugcuguguaaa

SEQ ID NO: 3579031 - RNA, 22 nt, Human
gugcuguguaaaguuagucuac

SEQ ID NO: 3579032 - RNA, 12 nt, Human
gugcugugugcc

SEQ ID NO: 3579033 - RNA, 17 nt, Human
gugcuuaagcagaagca

SEQ ID NO: 3579034 - RNA, 22 nt, Human
gugcuuaagcagaagcauuaac

SEQ ID NO: 3579035 - RNA, 22 nt, Human
gugcuuagcaaaaaauaaugac

SEQ ID NO: 3579036 - RNA, 19 nt, Human
gugcuuauucucaaagcag

SEQ ID NO: 3579037 - RNA, 21 nt, Human
gugcuuauucucaaagcagga

SEQ ID NO: 3579038 - RNA, 22 nt, Human
gugcuucacaguagagccagcu

SEQ ID NO: 3579039 - RNA, 17 nt, Human
gugcuucgggcccuucc

SEQ ID NO: 3579040 - RNA, 20 nt, Human
gugcuucuaguucugccagg

SEQ ID NO: 3579041 - RNA, 17 nt, Human
gugcuucuccccagaau

SEQ ID NO: 3579042 - RNA, 21 nt, Human
gugcuucugccacccugcuga

SEQ ID NO: 3579043 - RNA, 13 nt, Human
gugcuucuuucuu

SEQ ID NO: 3579044 - RNA, 14 nt, Human
gugcuugaaggccc

SEQ ID NO: 3579045 - RNA, 18 nt, Human
gugcuugugaaagagguc

SEQ ID NO: 3579046 - RNA, 17 nt, Human
gugcuuguguaauuuau

SEQ ID NO: 3579047 - RNA, 15 nt, Human
gugcuuuaugcugaa

SEQ ID NO: 3579048 - RNA, 20 nt, Human
gugcuuuccagcucaccccc

SEQ ID NO: 3579049 - RNA, 20 nt, Human
gugcuuuccauucgugaaaa

SEQ ID NO: 3579050 - RNA, 20 nt, Human
gugcuuuccuuuuuuaaaaa

SEQ ID NO: 3579051 - RNA, 13 nt, Human
gugcuuucuauug

SEQ ID NO: 3579052 - RNA, 19 nt, Human
gugcuuucuauuguacaga

SEQ ID NO: 3579053 - RNA, 23 nt, Human
gugcuuucuucucccaauucauc

SEQ ID NO: 3579054 - RNA, 18 nt, Human
gugcuuuuauagaggcua

SEQ ID NO: 3579055 - RNA, 12 nt, Human
guggaaaaauau

SEQ ID NO: 3579056 - RNA, 15 nt, Human
guggaaaaauauuua

SEQ ID NO: 3579057 - RNA, 16 nt, Human
guggaaaacuuaugcu

SEQ ID NO: 3579058 - RNA, 23 nt, Human
guggaaaagccaagaggcugcag

SEQ ID NO: 3579059 - RNA, 23 nt, Human
guggaaagccucugcugccaugg

SEQ ID NO: 3579060 - RNA, 13 nt, Human
guggaaagggugc

SEQ ID NO: 3579061 - RNA, 22 nt, Human
guggaaagggugcugcuucccu

SEQ ID NO: 3579062 - RNA, 19 nt, Human
guggaaagugaauuugaau

SEQ ID NO: 3579063 - RNA, 13 nt, Human
guggaaaguguaa

SEQ ID NO: 3579064 - RNA, 15 nt, Human
guggaaaguguaaag

SEQ ID NO: 3579065 - RNA, 18 nt, Human
guggaaaguguaaagcau

SEQ ID NO: 3579066 - RNA, 21 nt, Human
guggaaaguguaaagcauucc

SEQ ID NO: 3579067 - RNA, 23 nt, Human
guggaaaguguaaagcauuccaa

SEQ ID NO: 3579068 - RNA, 18 nt, Human
guggaaauuaagaagaaa

SEQ ID NO: 3579069 - RNA, 20 nt, Human
guggaaauuaagacuuuaug

SEQ ID NO: 3579070 - RNA, 21 nt, Human
guggaacauaaaaaggacauc

SEQ ID NO: 3579071 - RNA, 21 nt, Human
guggaaccacugacuacuggc

SEQ ID NO: 3579072 - RNA, 13 nt, Human
guggaacccagca

SEQ ID NO: 3579073 - RNA, 17 nt, Human
guggaaccucugucuca

SEQ ID NO: 3579074 - RNA, 20 nt, Human
guggaaccucugucucaucc

SEQ ID NO: 3579075 - RNA, 16 nt, Human
guggaacgaaaaugaa

SEQ ID NO: 3579076 - RNA, 16 nt, Human
guggaacuaauaaaua

SEQ ID NO: 3579077 - RNA, 18 nt, Human
guggaacugcguuaugaa

SEQ ID NO: 3579078 - RNA, 16 nt, Human
guggaacugcugccac

SEQ ID NO: 3579079 - RNA, 20 nt, Human
guggaagaaaaugguuuauu

SEQ ID NO: 3579080 - RNA, 16 nt, Human
guggaagaagagggag

SEQ ID NO: 3579081 - RNA, 15 nt, Human
guggaagaagggaga

SEQ ID NO: 3579082 - RNA, 14 nt, Human
guggaagcccuccu

SEQ ID NO: 3579083 - RNA, 18 nt, Human
guggaagcccuccuucca

SEQ ID NO: 3579084 - RNA, 14 nt, Human
guggaagcuugggg

SEQ ID NO: 3579085 - RNA, 11 nt, Human
guggaaggaaa

SEQ ID NO: 3579086 - RNA, 17 nt, Human
guggaaggcagagaaau

SEQ ID NO: 3579087 - RNA, 20 nt, Human
guggaaggcaucagucccua

SEQ ID NO: 3579088 - RNA, 14 nt, Human
guggaauaaaauac

SEQ ID NO: 3579089 - RNA, 18 nt, Human
guggaauaguauccucca

SEQ ID NO: 3579090 - RNA, 19 nt, Human
guggaauaguauccuccag

SEQ ID NO: 3579091 - RNA, 18 nt, Human
guggaaugagugugcaug

SEQ ID NO: 3579092 - RNA, 20 nt, Human
guggaauguuggauaaggaa

SEQ ID NO: 3579093 - RNA, 15 nt, Human
guggaauuauuuuaa

SEQ ID NO: 3579094 - RNA, 19 nt, Human
guggaauuauuuuaaaaga

SEQ ID NO: 3579095 - RNA, 18 nt, Human
guggaauuucuuguuucu

SEQ ID NO: 3579096 - RNA, 17 nt, Human
guggacacagcucuucu

SEQ ID NO: 3579097 - RNA, 18 nt, Human
guggacacagcucuucuc

SEQ ID NO: 3579098 - RNA, 22 nt, Human
guggacacagcucuucuccagg

SEQ ID NO: 3579099 - RNA, 21 nt, Human
guggacaccaggagucccugg

SEQ ID NO: 3579100 - RNA, 22 nt, Human
guggacaccaggagucccuggu

SEQ ID NO: 3579101 - RNA, 11 nt, Human
guggacaccug

SEQ ID NO: 3579102 - RNA, 14 nt, Human
guggacaccugccc

SEQ ID NO: 3579103 - RNA, 19 nt, Human
guggacaccugcccugccc

SEQ ID NO: 3579104 - RNA, 13 nt, Human
guggacaguccug

SEQ ID NO: 3579105 - RNA, 14 nt, Human
guggacaguccugg

SEQ ID NO: 3579106 - RNA, 18 nt, Human
guggacccugaaaugugu

SEQ ID NO: 3579107 - RNA, 21 nt, Human
guggaccuuaggccuuccucu

SEQ ID NO: 3579108 - RNA, 14 nt, Human
guggaccuuccugc

SEQ ID NO: 3579109 - RNA, 15 nt, Human
guggaccuuccugcc

SEQ ID NO: 3579110 - RNA, 14 nt, Human
guggacuaaaagau

SEQ ID NO: 3579111 - RNA, 23 nt, Human
guggacuaaaagauauaagugcu

SEQ ID NO: 3579112 - RNA, 21 nt, Human
guggacuagaccuccagcugu

SEQ ID NO: 3579113 - RNA, 18 nt, Human
guggacucagaaagccaa

SEQ ID NO: 3579114 - RNA, 21 nt, Human
guggacuccagacucucugug

SEQ ID NO: 3579115 - RNA, 23 nt, Human
guggacucuuugguggcuuugca

SEQ ID NO: 3579116 - RNA, 21 nt, Human
guggacugaccuuguaaaaga

SEQ ID NO: 3579117 - RNA, 17 nt, Human
guggacuggccccuggg

SEQ ID NO: 3579118 - RNA, 14 nt, Human
guggacuguggcac

SEQ ID NO: 3579119 - RNA, 16 nt, Human
guggacuuagaaagca

SEQ ID NO: 3579120 - RNA, 23 nt, Human
guggacuuaggaagguggccuuc

SEQ ID NO: 3579121 - RNA, 16 nt, Human
guggacuugaacuuuc

SEQ ID NO: 3579122 - RNA, 20 nt, Human
guggagaaagcacugaccug

SEQ ID NO: 3579123 - RNA, 24 nt, Human
guggagaagcacacucuggucuug

SEQ ID NO: 3579124 - RNA, 13 nt, Human
guggagaagccau

SEQ ID NO: 3579125 - RNA, 15 nt, Human
guggagaagccauug

SEQ ID NO: 3579126 - RNA, 19 nt, Human
guggagacaaugucugcag

SEQ ID NO: 3579127 - RNA, 22 nt, Human
guggagacaaugucugcagccc

SEQ ID NO: 3579128 - RNA, 11 nt, Human
guggagacugc

SEQ ID NO: 3579129 - RNA, 12 nt, Human
guggagagcugg

SEQ ID NO: 3579130 - RNA, 14 nt, Human
guggagagcuggug

SEQ ID NO: 3579131 - RNA, 12 nt, Human
guggagagggaa

SEQ ID NO: 3579132 - RNA, 19 nt, Human
guggcuagucaagcuccuc

SEQ ID NO: 3579133 - RNA, 23 nt, Human
guggcuagucaagcuccuccucc

SEQ ID NO: 3579134 - RNA, 19 nt, Human
guggcuagucagagagagu

SEQ ID NO: 3579135 - RNA, 15 nt, Human
guggcuauccugauu

SEQ ID NO: 3579136 - RNA, 15 nt, Human
guggcucagccagca

SEQ ID NO: 3579137 - RNA, 19 nt, Human
guggcucaugccuguaauc

SEQ ID NO: 3579138 - RNA, 18 nt, Human
guggcuccuaucuguguu

SEQ ID NO: 3579139 - RNA, 15 nt, Human
guggcuccucccagc

SEQ ID NO: 3579140 - RNA, 20 nt, Human
guggcuccucccggugccca

SEQ ID NO: 3579141 - RNA, 13 nt, Human
guggcuccuuccc

SEQ ID NO: 3579142 - RNA, 18 nt, Human
guggcucgggaggcgaag

SEQ ID NO: 3579143 - RNA, 21 nt, Human
guggcucugaggugccugucc

SEQ ID NO: 3579144 - RNA, 15 nt, Human
guggcugagccccug

SEQ ID NO: 3579145 - RNA, 18 nt, Human
guggcugaggaggccucc

SEQ ID NO: 3579146 - RNA, 15 nt, Human
guggcugcagcagcg

SEQ ID NO: 3579147 - RNA, 15 nt, Human
guggcugcagccuca

SEQ ID NO: 3579148 - RNA, 17 nt, Human
guggcugcagccucagg

SEQ ID NO: 3579149 - RNA, 16 nt, Human
guggcugcccacacac

SEQ ID NO: 3579150 - RNA, 20 nt, Human
guggcugccucauuuagaga

SEQ ID NO: 3579151 - RNA, 16 nt, Human
guggcugccuggagcc

SEQ ID NO: 3579152 - RNA, 13 nt, Human
guggcugcugccc

SEQ ID NO: 3579153 - RNA, 16 nt, Human
guggcugcugcccagg

SEQ ID NO: 3579154 - RNA, 23 nt, Human
guggcugcuucaaggauccugag

SEQ ID NO: 3579155 - RNA, 22 nt, Human
guggcuggaaccacauugaaga

SEQ ID NO: 3579156 - RNA, 17 nt, Human
guggcuggaucugugag

SEQ ID NO: 3579157 - RNA, 13 nt, Human
guggcuggggcau

SEQ ID NO: 3579158 - RNA, 15 nt, Human
guggcugucagcagg

SEQ ID NO: 3579159 - RNA, 19 nt, Human
guggcugucagcaggaagc

SEQ ID NO: 3579160 - RNA, 15 nt, Human
guggcuguccagugc

SEQ ID NO: 3579161 - RNA, 12 nt, Human
guggcugucugg

SEQ ID NO: 3579162 - RNA, 13 nt, Human
guggcugucugga

SEQ ID NO: 3579163 - RNA, 22 nt, Human
guggcuguggaauaggaacgcu

SEQ ID NO: 3579164 - RNA, 21 nt, Human
guggcuguugacgcaccugug

SEQ ID NO: 3579165 - RNA, 16 nt, Human
guggcuucacuccugc

SEQ ID NO: 3579166 - RNA, 20 nt, Human
guggcuucauuagagcaggc

SEQ ID NO: 3579167 - RNA, 21 nt, Human
guggcuucauuagagcaggcg

SEQ ID NO: 3579168 - RNA, 18 nt, Human
guggcuucccgcucagcc

SEQ ID NO: 3579169 - RNA, 13 nt, Human
guggcuucugaug

SEQ ID NO: 3579170 - RNA, 14 nt, Human
guggcuucuuaauc

SEQ ID NO: 3579171 - RNA, 20 nt, Human
guggcuucuuuucuuuguau

SEQ ID NO: 3579172 - RNA, 21 nt, Human
guggcuuuccuuguggcagag

SEQ ID NO: 3579173 - RNA, 16 nt, Human
guggcuuugccaucgu

SEQ ID NO: 3579174 - RNA, 17 nt, Human
gugggaacgugacugcc

SEQ ID NO: 3579175 - RNA, 21 nt, Human
gugggaagaaacaaacccguu

SEQ ID NO: 3579176 - RNA, 15 nt, Human
gugggaaggacuugg

SEQ ID NO: 3579177 - RNA, 13 nt, Human
gugggaaggccag

SEQ ID NO: 3579178 - RNA, 17 nt, Human
gugggaagggcuacacc

SEQ ID NO: 3579179 - RNA, 21 nt, Human
gugggacagcccagagccugg

SEQ ID NO: 3579180 - RNA, 13 nt, Human
gugggaccccagg

SEQ ID NO: 3579181 - RNA, 19 nt, Human
gugggacggugcccaagcc

SEQ ID NO: 3579182 - RNA, 13 nt, Human
gugggagagccca

SEQ ID NO: 3579183 - RNA, 20 nt, Human
gugggagcaaacugcaugcc

SEQ ID NO: 3579184 - RNA, 14 nt, Human
gugggagcaggaga

SEQ ID NO: 3579185 - RNA, 17 nt, Human
gugggagccagggcugu

SEQ ID NO: 3579186 - RNA, 11 nt, Human
gugggagccuc

SEQ ID NO: 3579187 - RNA, 16 nt, Human
gugggagcgugggagg

SEQ ID NO: 3579188 - RNA, 23 nt, Human
gugggaggaucucuugagccugg

SEQ ID NO: 3579189 - RNA, 19 nt, Human
gugggagggagcagacagg

SEQ ID NO: 3579190 - RNA, 13 nt, Human
gugggaggggcag

SEQ ID NO: 3579191 - RNA, 20 nt, Human
gugggaggguaccagcagaa

SEQ ID NO: 3579192 - RNA, 17 nt, Human
gugggaggugagaccac

SEQ ID NO: 3579193 - RNA, 17 nt, Human
gugggagguggaagaag

SEQ ID NO: 3579194 - RNA, 14 nt, Human
gugggaguguguaa

SEQ ID NO: 3579195 - RNA, 17 nt, Human
gugggauaucccuaugc

SEQ ID NO: 3579196 - RNA, 16 nt, Human
gugggaugaaccagcc

SEQ ID NO: 3579197 - RNA, 14 nt, Human
gugggauggaggag

SEQ ID NO: 3579198 - RNA, 20 nt, Human
gugggaugugguuuucuuaa

SEQ ID NO: 3579199 - RNA, 23 nt, Human
gugggauguucagcacugucccu

SEQ ID NO: 3579200 - RNA, 20 nt, Human
gugggauuuccagaaccaca

SEQ ID NO: 3579201 - RNA, 16 nt, Human
gugggcacccacccug

SEQ ID NO: 3579202 - RNA, 23 nt, Human
gugggcacgcugugggcaggugg

SEQ ID NO: 3579203 - RNA, 13 nt, Human
gugggcaggaaaa

SEQ ID NO: 3579204 - RNA, 20 nt, Human
gugggcaggugggagcuuga

SEQ ID NO: 3579205 - RNA, 15 nt, Human
gugggcauucaaaug

SEQ ID NO: 3579206 - RNA, 20 nt, Human
gugggcauugauggggaagg

SEQ ID NO: 3579207 - RNA, 15 nt, Human
gugggccagccccuc

SEQ ID NO: 3579208 - RNA, 14 nt, Human
gugggccagggcug

SEQ ID NO: 3579209 - RNA, 15 nt, Human
gugggccagucugug

SEQ ID NO: 3579210 - RNA, 18 nt, Human
gugggccagucuguggau

SEQ ID NO: 3579211 - RNA, 17 nt, Human
gugggccagugugggaa

SEQ ID NO: 3579212 - RNA, 17 nt, Human
gugggcccaaugcacuu

SEQ ID NO: 3579213 - RNA, 22 nt, Human
gugggcccacccggugggaccc

SEQ ID NO: 3579214 - RNA, 14 nt, Human
gugggcccaggacc

SEQ ID NO: 3579215 - RNA, 15 nt, Human
gugggccuccucugu

SEQ ID NO: 3579216 - RNA, 12 nt, Human
gugggccucugg

SEQ ID NO: 3579217 - RNA, 13 nt, Human
gugggccugggcu

SEQ ID NO: 3579218 - RNA, 17 nt, Human
gugggccugggcuccug

SEQ ID NO: 3579219 - RNA, 21 nt, Human
gugggccugggcuccuggacc

SEQ ID NO: 3579220 - RNA, 15 nt, Human
gugggccuugcuggg

SEQ ID NO: 3579221 - RNA, 19 nt, Human
gugggcgggcagcacagca

SEQ ID NO: 3579222 - RNA, 18 nt, Human
gugggcgugagaccugcc

SEQ ID NO: 3579223 - RNA, 19 nt, Human
gugggcuacaugcuggggu

SEQ ID NO: 3579224 - RNA, 14 nt, Human
gugggcucccugac

SEQ ID NO: 3579225 - RNA, 15 nt, Human
gugggcucccugacu

SEQ ID NO: 3579226 - RNA, 13 nt, Human
gugggcuccuggc

SEQ ID NO: 3579227 - RNA, 13 nt, Human
gugggcugagccc

SEQ ID NO: 3579228 - RNA, 18 nt, Human
gugggcugagcccuggca

SEQ ID NO: 3579229 - RNA, 15 nt, Human
gugggcugcaucugg

SEQ ID NO: 3579230 - RNA, 19 nt, Human
gugggcuggacuucuaccu

SEQ ID NO: 3579231 - RNA, 16 nt, Human
gugggcuucagggcag

SEQ ID NO: 3579232 - RNA, 17 nt, Human
guggggaagugaucuuu

SEQ ID NO: 3579233 - RNA, 18 nt, Human
guggggacccaggcuccg

SEQ ID NO: 3579234 - RNA, 15 nt, Human
guggggaccucaggc

SEQ ID NO: 3579235 - RNA, 18 nt, Human
guggggaccucaggccug

SEQ ID NO: 3579236 - RNA, 22 nt, Human
guggggacguccugccaccugg

SEQ ID NO: 3579237 - RNA, 17 nt, Human
guggggagacugggcug

SEQ ID NO: 3579238 - RNA, 21 nt, Human
guggggagagacgggcccugg

SEQ ID NO: 3579239 - RNA, 16 nt, Human
guggggaggaaauaga

SEQ ID NO: 3579240 - RNA, 11 nt, Human
guggggagggg

SEQ ID NO: 3579241 - RNA, 19 nt, Human
guggggauaggccagccgc

SEQ ID NO: 3579242 - RNA, 14 nt, Human
guggggcagcacag

SEQ ID NO: 3579243 - RNA, 14 nt, Human
guggggccagguca

SEQ ID NO: 3579244 - RNA, 22 nt, Human
guggggccaugccuccucagga

SEQ ID NO: 3579245 - RNA, 14 nt, Human
guggggccugggag

SEQ ID NO: 3579246 - RNA, 13 nt, Human
guggggccuuggu

SEQ ID NO: 3579247 - RNA, 14 nt, Human
guggggcugcuccu

SEQ ID NO: 3579248 - RNA, 16 nt, Human
guggggcugcuccucc

SEQ ID NO: 3579249 - RNA, 20 nt, Human
guggggcugguagcucaggu

SEQ ID NO: 3579250 - RNA, 17 nt, Human
guggggcuuggcgugga

SEQ ID NO: 3579251 - RNA, 15 nt, Human
gugggggaaaaauaa

SEQ ID NO: 3579252 - RNA, 22 nt, Human
gugggggaagagcacagcccuc

SEQ ID NO: 3579253 - RNA, 17 nt, Human
gugggggcagagggcag

SEQ ID NO: 3579254 - RNA, 19 nt, Human
gugggggccaccugccugc

SEQ ID NO: 3579255 - RNA, 15 nt, Human
guggggggcuucaua

SEQ ID NO: 3579256 - RNA, 16 nt, Human
guggggggcuucauac

SEQ ID NO: 3579257 - RNA, 23 nt, Human
gugggggugcagaugagguugcu

SEQ ID NO: 3579258 - RNA, 10 nt, Human
gugggggugg

SEQ ID NO: 3579259 - RNA, 22 nt, Human
guggggguggaauaaaauacua

SEQ ID NO: 3579260 - RNA, 16 nt, Human
guggggguuggcuggg

SEQ ID NO: 3579261 - RNA, 19 nt, Human
guggggguuggcuggguac

SEQ ID NO: 3579262 - RNA, 17 nt, Human
guggggucucccucucc

SEQ ID NO: 3579263 - RNA, 22 nt, Human
guggggucucccucuccugccu

SEQ ID NO: 3579264 - RNA, 17 nt, Human
guggggugaggaccacu

SEQ ID NO: 3579265 - RNA, 19 nt, Human
gugggguggcugcagccuc

SEQ ID NO: 3579266 - RNA, 22 nt, Human
gugggguguguuccaacugccc

SEQ ID NO: 3579267 - RNA, 14 nt, Human
guggguagacacac

SEQ ID NO: 3579268 - RNA, 12 nt, Human
guggguauaaaa

SEQ ID NO: 3579269 - RNA, 13 nt, Human
guggguauaaaag

SEQ ID NO: 3579270 - RNA, 21 nt, Human
gugggucaugaugcucuuucc

SEQ ID NO: 3579271 - RNA, 16 nt, Human
guggguccaggggccc

SEQ ID NO: 3579272 - RNA, 20 nt, Human
guggguccaggggccccucc

SEQ ID NO: 3579273 - RNA, 14 nt, Human
gugggucuggagga

SEQ ID NO: 3579274 - RNA, 17 nt, Human
gugggucuucagggggc

SEQ ID NO: 3579275 - RNA, 18 nt, Human
gugggugaaagaaaucau

SEQ ID NO: 3579276 - RNA, 15 nt, Human
gugggugagaugcug

SEQ ID NO: 3579277 - RNA, 13 nt, Human
gugggugcucaga

SEQ ID NO: 3579278 - RNA, 14 nt, Human
uuuuuuuuguuugu

SEQ ID NO: 3579279 - RNA, 15 nt, Human
uuaaaaaaucuuaau

SEQ ID NO: 3579280 - RNA, 16 nt, Human
uuaaaaaaugaaaaua

SEQ ID NO: 3579281 - RNA, 18 nt, Human
uuaaaaaccgaauaaaug

SEQ ID NO: 3579282 - RNA, 21 nt, Human
uuaaaaaccuguucaagucua

SEQ ID NO: 3579283 - RNA, 22 nt, Human
uuaaaaacuaguaguucucuug

SEQ ID NO: 3579284 - RNA, 16 nt, Human
uuaaaaacuauuuaac

SEQ ID NO: 3579285 - RNA, 18 nt, Human
uuaaaaacugaaaaaucu

SEQ ID NO: 3579286 - RNA, 14 nt, Human
uuaaaaacugagug

SEQ ID NO: 3579287 - RNA, 20 nt, Human
uuaaaaagaaaaguuuauaa

SEQ ID NO: 3579288 - RNA, 20 nt, Human
uuaaaaagaaacaagaugcu

SEQ ID NO: 3579289 - RNA, 18 nt, Human
uuaaaaagauucuuuuuc

SEQ ID NO: 3579290 - RNA, 17 nt, Human
uuaaaaagcccaaccuc

SEQ ID NO: 3579291 - RNA, 15 nt, Human
uuaaaaaggaacugc

SEQ ID NO: 3579292 - RNA, 21 nt, Human
uuaaaaagggaagaaacugcu

SEQ ID NO: 3579293 - RNA, 20 nt, Human
uuaaaaaguaauaaaauuca

SEQ ID NO: 3579294 - RNA, 12 nt, Human
uuaaaaaguauu

SEQ ID NO: 3579295 - RNA, 21 nt, Human
uuaaaaaguauugccaaacau

SEQ ID NO: 3579296 - RNA, 22 nt, Human
uuaaaaaguauugccaaacauu

SEQ ID NO: 3579297 - RNA, 16 nt, Human
uuaaaaagucugcauu

SEQ ID NO: 3579298 - RNA, 22 nt, Human
uuaaaaagucugcauuacauuc

SEQ ID NO: 3579299 - RNA, 16 nt, Human
uuaaaaagucuuuuaa

SEQ ID NO: 3579300 - RNA, 18 nt, Human
uuaaaaaguggaaaaaua

SEQ ID NO: 3579301 - RNA, 17 nt, Human
uuaaaaaguuguucaac

SEQ ID NO: 3579302 - RNA, 15 nt, Human
uuaaaaauaaagcaa

SEQ ID NO: 3579303 - RNA, 21 nt, Human
uuaaaaauaagucaacaguaa

SEQ ID NO: 3579304 - RNA, 20 nt, Human
uuaaaaauaauagagcccca

SEQ ID NO: 3579305 - RNA, 14 nt, Human
uuaaaaauacauau

SEQ ID NO: 3579306 - RNA, 15 nt, Human
uuaaaaauagaaaca

SEQ ID NO: 3579307 - RNA, 15 nt, Human
uuaaaaauauaaaac

SEQ ID NO: 3579308 - RNA, 16 nt, Human
uuaaaaauauaaaacu

SEQ ID NO: 3579309 - RNA, 15 nt, Human
uuaaaaaucaacuuu

SEQ ID NO: 3579310 - RNA, 15 nt, Human
uuaaaaaucucaaau

SEQ ID NO: 3579311 - RNA, 17 nt, Human
uuaaaaaucucaaauuu

SEQ ID NO: 3579312 - RNA, 20 nt, Human
uuaaaaaucucaaauuucua

SEQ ID NO: 3579313 - RNA, 17 nt, Human
uuaaaaauggaacugug

SEQ ID NO: 3579314 - RNA, 13 nt, Human
uuaaaaaugguaa

SEQ ID NO: 3579315 - RNA, 24 nt, Human
uuaaaaaugguaucaaaauuacau

SEQ ID NO: 3579316 - RNA, 18 nt, Human
uuaaaaaugguggcuuca

SEQ ID NO: 3579317 - RNA, 20 nt, Human
uuaaaaaugguuuaaauggu

SEQ ID NO: 3579318 - RNA, 20 nt, Human
uuaaaaauugucuucaugua

SEQ ID NO: 3579319 - RNA, 17 nt, Human
uuaaaacaacacucaca

SEQ ID NO: 3579320 - RNA, 19 nt, Human
uuaaaacaagaaaguuucc

SEQ ID NO: 3579321 - RNA, 12 nt, Human
uuaaaacaaugu

SEQ ID NO: 3579322 - RNA, 20 nt, Human
uuaaaacacauguuuuuaua

SEQ ID NO: 3579323 - RNA, 13 nt, Human
uuaaaacacguuu

SEQ ID NO: 3579324 - RNA, 22 nt, Human
uuaaaacacguuuuaaggacug

SEQ ID NO: 3579325 - RNA, 13 nt, Human
uuaaaacaguauu

SEQ ID NO: 3579326 - RNA, 20 nt, Human
uuaaaacaguauuuauuuug

SEQ ID NO: 3579327 - RNA, 15 nt, Human
uuaaaacauuaaaau

SEQ ID NO: 3579328 - RNA, 14 nt, Human
uuaaaacccaagug

SEQ ID NO: 3579329 - RNA, 18 nt, Human
uuaaaaccugcuuuucaa

SEQ ID NO: 3579330 - RNA, 16 nt, Human
uuaaaacuacuuagca

SEQ ID NO: 3579331 - RNA, 21 nt, Human
uuaaaacuaggcauuuguaaa

SEQ ID NO: 3579332 - RNA, 22 nt, Human
uuaaaacuaguuagauucacuu

SEQ ID NO: 3579333 - RNA, 20 nt, Human
uuaaaacugcaguuuucaga

SEQ ID NO: 3579334 - RNA, 16 nt, Human
uuaaaacuggaccugu

SEQ ID NO: 3579335 - RNA, 14 nt, Human
uuaaaacuuuaauc

SEQ ID NO: 3579336 - RNA, 16 nt, Human
uuaaaagaaaaaauga

SEQ ID NO: 3579337 - RNA, 23 nt, Human
uuaaaagaaaauaaaaaaaagaa

SEQ ID NO: 3579338 - RNA, 21 nt, Human
uuaaaagaaaggguucuguaa

SEQ ID NO: 3579339 - RNA, 22 nt, Human
uuaaaagaaaggguucuguaaa

SEQ ID NO: 3579340 - RNA, 16 nt, Human
uuaaaagaaauuuauu

SEQ ID NO: 3579341 - RNA, 20 nt, Human
uuaaaagaaugggcaguuac

SEQ ID NO: 3579342 - RNA, 16 nt, Human
uuaaaagacaagacuu

SEQ ID NO: 3579343 - RNA, 17 nt, Human
uuaaaagacaagacuuc

SEQ ID NO: 3579344 - RNA, 18 nt, Human
uuaaaagacucauccguc

SEQ ID NO: 3579345 - RNA, 11 nt, Human
uuaaaagagag

SEQ ID NO: 3579346 - RNA, 14 nt, Human
uuaaaagauacagu

SEQ ID NO: 3579347 - RNA, 20 nt, Human
uuaaaagaugcuuuuaacag

SEQ ID NO: 3579348 - RNA, 16 nt, Human
uuaaaagauucauuuu

SEQ ID NO: 3579349 - RNA, 21 nt, Human
uuaaaagcaaaucauuuguuu

SEQ ID NO: 3579350 - RNA, 23 nt, Human
uuaaaagcuaucuucauguaaau

SEQ ID NO: 3579351 - RNA, 17 nt, Human
uuaaaaggauuuuuauc

SEQ ID NO: 3579352 - RNA, 20 nt, Human
uuaaaaggauuuuuaucuuu

SEQ ID NO: 3579353 - RNA, 21 nt, Human
uuaaaagggauuacccaagca

SEQ ID NO: 3579354 - RNA, 15 nt, Human
uuaaaaguaaaagag

SEQ ID NO: 3579355 - RNA, 17 nt, Human
uuaaaaguaaaaugucu

SEQ ID NO: 3579356 - RNA, 12 nt, Human
uuaaaaguaucc

SEQ ID NO: 3579357 - RNA, 17 nt, Human
uuaaaaguugaauuuuu

SEQ ID NO: 3579358 - RNA, 13 nt, Human
uuaaaauaaacuu

SEQ ID NO: 3579359 - RNA, 14 nt, Human
uuaaaauaaauggu

SEQ ID NO: 3579360 - RNA, 15 nt, Human
uuaaaauaacuagug

SEQ ID NO: 3579361 - RNA, 12 nt, Human
uuaaaauaauau

SEQ ID NO: 3579362 - RNA, 17 nt, Human
uuaaaauacaagacugc

SEQ ID NO: 3579363 - RNA, 12 nt, Human
uuaaaauacugu

SEQ ID NO: 3579364 - RNA, 17 nt, Human
uuaaaauacuguagaua

SEQ ID NO: 3579365 - RNA, 20 nt, Human
uuaaaauagaaauuuuguaa

SEQ ID NO: 3579366 - RNA, 19 nt, Human
uuaaaauagcaaaagaaga

SEQ ID NO: 3579367 - RNA, 21 nt, Human
uuaaaauagcaaaagaagaag

SEQ ID NO: 3579368 - RNA, 22 nt, Human
uuaaaauagcaaaagaagaagu

SEQ ID NO: 3579369 - RNA, 23 nt, Human
uuaaaauagcaaaagaagaaguu

SEQ ID NO: 3579370 - RNA, 20 nt, Human
uuaaaauagcguucuuguaa

SEQ ID NO: 3579371 - RNA, 22 nt, Human
uuaaaauagcguucuuguaauu

SEQ ID NO: 3579372 - RNA, 23 nt, Human
uuaaaauagcguucuuguaauuu

SEQ ID NO: 3579373 - RNA, 22 nt, Human
uuaaaauaggggauauuuaagg

SEQ ID NO: 3579374 - RNA, 14 nt, Human
uuaaaauauggcua

SEQ ID NO: 3579375 - RNA, 12 nt, Human
uuaaaauauuuu

SEQ ID NO: 3579376 - RNA, 23 nt, Human
uuaaaaucacuaacauuauauug

SEQ ID NO: 3579377 - RNA, 16 nt, Human
uuaaaaucagcuauuu

SEQ ID NO: 3579378 - RNA, 14 nt, Human
uuaaaaucauuucu

SEQ ID NO: 3579379 - RNA, 22 nt, Human
uuaaaaucauuucugcaucagc

SEQ ID NO: 3579380 - RNA, 19 nt, Human
uuaaaaucuauucuguguu

SEQ ID NO: 3579381 - RNA, 23 nt, Human
uuaaaaucuauucuguguugcau

SEQ ID NO: 3579382 - RNA, 21 nt, Human
uuaaaaucugagggaaauguu

SEQ ID NO: 3579383 - RNA, 22 nt, Human
uuaaaaucugagggaaauguuu

SEQ ID NO: 3579384 - RNA, 19 nt, Human
uuaaaaucuuauuaaaguu

SEQ ID NO: 3579385 - RNA, 18 nt, Human
uuaaaaugcaaaauaaug

SEQ ID NO: 3579386 - RNA, 12 nt, Human
uuaaaaugcaau

SEQ ID NO: 3579387 - RNA, 14 nt, Human
uuaaaauguacaug

SEQ ID NO: 3579388 - RNA, 17 nt, Human
uuaaaauguacauguau

SEQ ID NO: 3579389 - RNA, 17 nt, Human
uuaaaauguaugcaugu

SEQ ID NO: 3579390 - RNA, 23 nt, Human
uuaaaauucucuuccaaccauuu

SEQ ID NO: 3579391 - RNA, 19 nt, Human
uuaaaauuucuuagaaaac

SEQ ID NO: 3579392 - RNA, 12 nt, Human
uuaaaauuuuaa

SEQ ID NO: 3579393 - RNA, 16 nt, Human
uuaaaauuuuguaugu

SEQ ID NO: 3579394 - RNA, 20 nt, Human
uuaaacaaaauagaagcugu

SEQ ID NO: 3579395 - RNA, 17 nt, Human
uuaaacaaaguuucaga

SEQ ID NO: 3579396 - RNA, 23 nt, Human
uuaaacacacagauacacacaca

SEQ ID NO: 3579397 - RNA, 13 nt, Human
uuaaacagaggau

SEQ ID NO: 3579398 - RNA, 22 nt, Human
uuaaacagaugaugagaauuuc

SEQ ID NO: 3579399 - RNA, 12 nt, Human
uuaaacagcagu

SEQ ID NO: 3579400 - RNA, 21 nt, Human
uuaaacagggcaucuccagga

SEQ ID NO: 3579401 - RNA, 19 nt, Human
uuaaacaguauuucauugc

SEQ ID NO: 3579402 - RNA, 18 nt, Human
uuaaacagugagccugaa

SEQ ID NO: 3579403 - RNA, 23 nt, Human
uuaaacagugagccugaauuuug

SEQ ID NO: 3579404 - RNA, 13 nt, Human
uuaaacaguugca

SEQ ID NO: 3579405 - RNA, 21 nt, Human
uuaaacaguugcacagcaucu

SEQ ID NO: 3579406 - RNA, 23 nt, Human
uuaaacaguugcacagcaucuca

SEQ ID NO: 3579407 - RNA, 19 nt, Human
uuaaacaugcuguacauac

SEQ ID NO: 3579408 - RNA, 23 nt, Human
uuaaacaugcuguacauacuuuu

SEQ ID NO: 3579409 - RNA, 13 nt, Human
uuaaacauuaaaa

SEQ ID NO: 3579410 - RNA, 18 nt, Human
uuaaacauuaaaaaugga

SEQ ID NO: 3579411 - RNA, 21 nt, Human
uuaaacauuaaaaauggaacu

SEQ ID NO: 3579412 - RNA, 22 nt, Human
uuaaacauugguucuuguauua

SEQ ID NO: 3579413 - RNA, 21 nt, Human
uuaaaccaguuuagauuucaa

SEQ ID NO: 3579414 - RNA, 19 nt, Human
uuaaaccauaaaaagcuga

SEQ ID NO: 3579415 - RNA, 17 nt, Human
uuaaaccaucucccugg

SEQ ID NO: 3579416 - RNA, 21 nt, Human
uuaaaccaugggauaaaugcc

SEQ ID NO: 3579417 - RNA, 16 nt, Human
uuaaacccauuuuagu

SEQ ID NO: 3579418 - RNA, 20 nt, Human
uuaaacccuggaucaguccu

SEQ ID NO: 3579419 - RNA, 16 nt, Human
uuaaaccgcuaaaaga

SEQ ID NO: 3579420 - RNA, 14 nt, Human
uuaaaccuauacuc

SEQ ID NO: 3579421 - RNA, 22 nt, Human
uuaaaccuguuuuuuuuucauu

SEQ ID NO: 3579422 - RNA, 17 nt, Human
uuaaauuacauuuguaa

SEQ ID NO: 3579423 - RNA, 18 nt, Human
uuaaauuacauuuguaau

SEQ ID NO: 3579424 - RNA, 11 nt, Human
uuaaauuaccu

SEQ ID NO: 3579425 - RNA, 12 nt, Human
uuaaauuauaag

SEQ ID NO: 3579426 - RNA, 16 nt, Human
uuaaauuauguuuuua

SEQ ID NO: 3579427 - RNA, 19 nt, Human
uuaaauucccguuuuguca

SEQ ID NO: 3579428 - RNA, 18 nt, Human
uuaaauucugagacaugu

SEQ ID NO: 3579429 - RNA, 16 nt, Human
uuaaauucuugcaaag

SEQ ID NO: 3579430 - RNA, 20 nt, Human
uuaaauucuuuuuuaaauuu

SEQ ID NO: 3579431 - RNA, 22 nt, Human
uuaaauucuuuuuuaaauuuuc

SEQ ID NO: 3579432 - RNA, 21 nt, Human
uuaaauugcucacaguuauua

SEQ ID NO: 3579433 - RNA, 16 nt, Human
uuaaauugcuguguau

SEQ ID NO: 3579434 - RNA, 22 nt, Human
uuaaauuggguucaugaugcag

SEQ ID NO: 3579435 - RNA, 15 nt, Human
uuaaauuguguuuua

SEQ ID NO: 3579436 - RNA, 18 nt, Human
uuaaauuuaaagauauug

SEQ ID NO: 3579437 - RNA, 15 nt, Human
uuaaauuucuaccgc

SEQ ID NO: 3579438 - RNA, 14 nt, Human
uuaaauuucuuaug

SEQ ID NO: 3579439 - RNA, 18 nt, Human
uuaaauuucuuaugugac

SEQ ID NO: 3579440 - RNA, 21 nt, Human
uuaaauuuguaaguuucaggu

SEQ ID NO: 3579441 - RNA, 15 nt, Human
uuaaauuuuaauuua

SEQ ID NO: 3579442 - RNA, 16 nt, Human
uuaaauuuuaauuuau

SEQ ID NO: 3579443 - RNA, 16 nt, Human
uuaaauuuuacccuuu

SEQ ID NO: 3579444 - RNA, 15 nt, Human
uuaaauuuucuucag

SEQ ID NO: 3579445 - RNA, 16 nt, Human
uuaaauuuuguaauga

SEQ ID NO: 3579446 - RNA, 14 nt, Human
uuaaauuuuguguc

SEQ ID NO: 3579447 - RNA, 18 nt, Human
uuaaauuuuuuguugaca

SEQ ID NO: 3579448 - RNA, 20 nt, Human
uuaaauuuuuuuuacauuuu

SEQ ID NO: 3579449 - RNA, 15 nt, Human
uuaacaaaagcaaga

SEQ ID NO: 3579450 - RNA, 23 nt, Human
uuaacaaacaucacucugcugcu

SEQ ID NO: 3579451 - RNA, 19 nt, Human
uuaacaaacccucguuucu

SEQ ID NO: 3579452 - RNA, 18 nt, Human
uuaacaaauaugcuaauu

SEQ ID NO: 3579453 - RNA, 20 nt, Human
uuaacaaaugcuauuaaagu

SEQ ID NO: 3579454 - RNA, 21 nt, Human
uuaacaacaauaacacugucu

SEQ ID NO: 3579455 - RNA, 14 nt, Human
uuaacaacauguuu

SEQ ID NO: 3579456 - RNA, 16 nt, Human
uuaacaagaagaugaa

SEQ ID NO: 3579457 - RNA, 18 nt, Human
uuaacaauaacuacugug

SEQ ID NO: 3579458 - RNA, 20 nt, Human
uuaacaaugccuauuguaau

SEQ ID NO: 3579459 - RNA, 17 nt, Human
uuaacaauuaggcagac

SEQ ID NO: 3579460 - RNA, 15 nt, Human
uuaacaauuucuguc

SEQ ID NO: 3579461 - RNA, 14 nt, Human
uuaacacacauaaa

SEQ ID NO: 3579462 - RNA, 16 nt, Human
uuaacacacauaaagg

SEQ ID NO: 3579463 - RNA, 14 nt, Human
uuaacacauuuugu

SEQ ID NO: 3579464 - RNA, 22 nt, Human
uuaacacauuuuguauaauugu

SEQ ID NO: 3579465 - RNA, 17 nt, Human
uuaacaccugaugugua

SEQ ID NO: 3579466 - RNA, 12 nt, Human
uuaacagaaaug

SEQ ID NO: 3579467 - RNA, 13 nt, Human
uuaacagaaaugu

SEQ ID NO: 3579468 - RNA, 19 nt, Human
uuaacagaaauguacagca

SEQ ID NO: 3579469 - RNA, 13 nt, Human
uuaacagaaauug

SEQ ID NO: 3579470 - RNA, 17 nt, Human
uuaacagaaauuguaua

SEQ ID NO: 3579471 - RNA, 19 nt, Human
uuaacagagucugaaccua

SEQ ID NO: 3579472 - RNA, 17 nt, Human
uuaacaggcaaacauuu

SEQ ID NO: 3579473 - RNA, 18 nt, Human
uuaacaggcaaacauuuu

SEQ ID NO: 3579474 - RNA, 16 nt, Human
uuaacaguaucucaaa

SEQ ID NO: 3579475 - RNA, 17 nt, Human
uuaacagucauuuaaaa

SEQ ID NO: 3579476 - RNA, 13 nt, Human
uuaacaguuguau

SEQ ID NO: 3579477 - RNA, 13 nt, Human
uuaacaguuuucc

SEQ ID NO: 3579478 - RNA, 14 nt, Human
uuaacauaagcuau

SEQ ID NO: 3579479 - RNA, 16 nt, Human
uuaacauaagcuauuu

SEQ ID NO: 3579480 - RNA, 18 nt, Human
uuaacauaagcuauuuuu

SEQ ID NO: 3579481 - RNA, 21 nt, Human
uuaacauaagcuauuuuucua

SEQ ID NO: 3579482 - RNA, 14 nt, Human
uuaacaucaugaau

SEQ ID NO: 3579483 - RNA, 16 nt, Human
uuaacauggaacucua

SEQ ID NO: 3579484 - RNA, 20 nt, Human
uuaacaugggcucuucacua

SEQ ID NO: 3579485 - RNA, 19 nt, Human
uuaacauguuaaaccaugg

SEQ ID NO: 3579486 - RNA, 11 nt, Human
uuaacauuccu

SEQ ID NO: 3579487 - RNA, 21 nt, Human
uuaacauugaccaagaacugc

SEQ ID NO: 3579488 - RNA, 22 nt, Human
uuaacauugaccaagaacugca

SEQ ID NO: 3579489 - RNA, 14 nt, Human
uuaacauuucaagg

SEQ ID NO: 3579490 - RNA, 14 nt, Human
uuaacauuuuguuc

SEQ ID NO: 3579491 - RNA, 13 nt, Human
uuaaccaaaggug

SEQ ID NO: 3579492 - RNA, 13 nt, Human
uuaaccagaauaa

SEQ ID NO: 3579493 - RNA, 22 nt, Human
uuaaccagaucuagucaaucaa

SEQ ID NO: 3579494 - RNA, 16 nt, Human
uuaaccagucugaagu

SEQ ID NO: 3579495 - RNA, 16 nt, Human
uuaaccauuaaaacug

SEQ ID NO: 3579496 - RNA, 18 nt, Human
uuaaccccauaauuagau

SEQ ID NO: 3579497 - RNA, 17 nt, Human
uuaaccccauguccuca

SEQ ID NO: 3579498 - RNA, 14 nt, Human
uuaaccccccugua

SEQ ID NO: 3579499 - RNA, 17 nt, Human
uuaaccccccuguacac

SEQ ID NO: 3579500 - RNA, 19 nt, Human
uuaaccccgucaacaaauc

SEQ ID NO: 3579501 - RNA, 21 nt, Human
uuaaccgguaagaguuucagu

SEQ ID NO: 3579502 - RNA, 19 nt, Human
uuaaccucagugucauuua

SEQ ID NO: 3579503 - RNA, 15 nt, Human
uuaaccucugcacua

SEQ ID NO: 3579504 - RNA, 13 nt, Human
uuaaccugaugca

SEQ ID NO: 3579505 - RNA, 21 nt, Human
uuaaccuuacuaauuauacua

SEQ ID NO: 3579506 - RNA, 17 nt, Human
uuaacggcuccaggauu

SEQ ID NO: 3579507 - RNA, 19 nt, Human
uuaacggcuccaggauuuu

SEQ ID NO: 3579508 - RNA, 23 nt, Human
uuaacuaaucuauuggguucauu

SEQ ID NO: 3579509 - RNA, 14 nt, Human
uuaacuacauuuau

SEQ ID NO: 3579510 - RNA, 21 nt, Human
uuaacuacccuuaauuacuua

SEQ ID NO: 3579511 - RNA, 18 nt, Human
uuaacuacuauauugauu

SEQ ID NO: 3579512 - RNA, 16 nt, Human
uuaacuagaauuuauu

SEQ ID NO: 3579513 - RNA, 14 nt, Human
uuaacuauguacaa

SEQ ID NO: 3579514 - RNA, 12 nt, Human
uuaacucaauau

SEQ ID NO: 3579515 - RNA, 15 nt, Human
uuaacucauuagacu

SEQ ID NO: 3579516 - RNA, 23 nt, Human
uuaacucccauuaccauguaaug

SEQ ID NO: 3579517 - RNA, 13 nt, Human
uuaacucugucuu

SEQ ID NO: 3579518 - RNA, 16 nt, Human
uuaacugaauaccacu

SEQ ID NO: 3579519 - RNA, 21 nt, Human
uuaacugacaagccaucuuga

SEQ ID NO: 3579520 - RNA, 24 nt, Human
uuaacugcuuccuauaauuuugau

SEQ ID NO: 3579521 - RNA, 20 nt, Human
uuaacuggugcacuuuguaa

SEQ ID NO: 3579522 - RNA, 16 nt, Human
uuaacuuaauaaucaa

SEQ ID NO: 3579523 - RNA, 17 nt, Human
uuaacuuaauaaucaag

SEQ ID NO: 3579524 - RNA, 18 nt, Human
uuaacuuagcuugaagga

SEQ ID NO: 3579525 - RNA, 17 nt, Human
uuaacuuauuuagagau

SEQ ID NO: 3579526 - RNA, 22 nt, Human
uuaacuugaggguaauaaacuu

SEQ ID NO: 3579527 - RNA, 23 nt, Human
uuaacuuuaucacauuauuugca

SEQ ID NO: 3579528 - RNA, 14 nt, Human
uuaacuuuguuuua

SEQ ID NO: 3579529 - RNA, 16 nt, Human
uuaacuuuuauaaacu

SEQ ID NO: 3579530 - RNA, 17 nt, Human
uuaacuuuuauaaacuu

SEQ ID NO: 3579531 - RNA, 22 nt, Human
uuaacuuuuuuucuucuacuuu

SEQ ID NO: 3579532 - RNA, 11 nt, Human
uuaagaaaaaa

SEQ ID NO: 3579533 - RNA, 14 nt, Human
uuaagaaaagagau

SEQ ID NO: 3579534 - RNA, 14 nt, Human
uuaagaaaaguauu

SEQ ID NO: 3579535 - RNA, 15 nt, Human
uuaagaaaaguauuu

SEQ ID NO: 3579536 - RNA, 19 nt, Human
uuaagaaaauacaauaaac

SEQ ID NO: 3579537 - RNA, 11 nt, Human
uuaagaaaauc

SEQ ID NO: 3579538 - RNA, 12 nt, Human
uuaagaaacacu

SEQ ID NO: 3579539 - RNA, 14 nt, Human
uuaagaaacacuga

SEQ ID NO: 3579540 - RNA, 12 nt, Human
uuaagaaauaaa

SEQ ID NO: 3579541 - RNA, 23 nt, Human
uuaagaaauuuugccuuuaaguu

SEQ ID NO: 3579542 - RNA, 19 nt, Human
uuaagaacuaaaauguucu

SEQ ID NO: 3579543 - RNA, 16 nt, Human
uuaagaagcuguugua

SEQ ID NO: 3579544 - RNA, 21 nt, Human
uuaagaagcuguuguacauuu

SEQ ID NO: 3579545 - RNA, 23 nt, Human
uuaagaagcuguuguacauuuau

SEQ ID NO: 3579546 - RNA, 14 nt, Human
uuaagaaugaaaua

SEQ ID NO: 3579547 - RNA, 23 nt, Human
uuaagaaugaguuucuuagacuu

SEQ ID NO: 3579548 - RNA, 16 nt, Human
uuaagaauuucacaag

SEQ ID NO: 3579549 - RNA, 19 nt, Human
uuaagacaagccuggcaac

SEQ ID NO: 3579550 - RNA, 20 nt, Human
uuaagacacugaaaaaucua

SEQ ID NO: 3579551 - RNA, 22 nt, Human
uuaagacacuuccgucacaucc

SEQ ID NO: 3579552 - RNA, 18 nt, Human
uuaagacaugauuuccuu

SEQ ID NO: 3579553 - RNA, 22 nt, Human
uuaagaccuacuguucuaaagc

SEQ ID NO: 3579554 - RNA, 11 nt, Human
uuaagaccugg

SEQ ID NO: 3579555 - RNA, 18 nt, Human
uuaagaccuggcagcucu

SEQ ID NO: 3579556 - RNA, 22 nt, Human
uuaagacgaaacauuuguucua

SEQ ID NO: 3579557 - RNA, 14 nt, Human
uuaagacugauuuu

SEQ ID NO: 3579558 - RNA, 19 nt, Human
uuaagacuuugguuauuuu

SEQ ID NO: 3579559 - RNA, 12 nt, Human
uuaagagaaacu

SEQ ID NO: 3579560 - RNA, 15 nt, Human
uuaagagagaaaucu

SEQ ID NO: 3579561 - RNA, 22 nt, Human
uuaagagagucuauuuacggaa

SEQ ID NO: 3579562 - RNA, 24 nt, Human
uuaagagcaaaucaauucuaguca

SEQ ID NO: 3579563 - RNA, 15 nt, Human
uuaagagcaguccau

SEQ ID NO: 3579564 - RNA, 22 nt, Human
uuaagagccauauaaguuugaa

SEQ ID NO: 3579565 - RNA, 17 nt, Human
uuaagagcuaaccaguu

SEQ ID NO: 3579566 - RNA, 13 nt, Human
uuaagaggcaggg

SEQ ID NO: 3579567 - RNA, 12 nt, Human
uuaauauuuccu

SEQ ID NO: 3579568 - RNA, 20 nt, Human
uuaauauuugcugacagcug

SEQ ID NO: 3579569 - RNA, 12 nt, Human
uuaauauuuguu

SEQ ID NO: 3579570 - RNA, 17 nt, Human
uuaaucacuauuguucc

SEQ ID NO: 3579571 - RNA, 13 nt, Human
uuaaucauauaaa

SEQ ID NO: 3579572 - RNA, 15 nt, Human
uuaaucaucaagaga

SEQ ID NO: 3579573 - RNA, 16 nt, Human
uuaaucaucaagagaa

SEQ ID NO: 3579574 - RNA, 17 nt, Human
uuaaucaucaagagaau

SEQ ID NO: 3579575 - RNA, 15 nt, Human
uuaaucaucuauaaa

SEQ ID NO: 3579576 - RNA, 21 nt, Human
uuaaucaucuauaaagaagaa

SEQ ID NO: 3579577 - RNA, 13 nt, Human
uuaaucauuaggu

SEQ ID NO: 3579578 - RNA, 22 nt, Human
uuaaucauuuugccucuuuucu

SEQ ID NO: 3579579 - RNA, 21 nt, Human
uuaauccguaguuauuuugca

SEQ ID NO: 3579580 - RNA, 21 nt, Human
uuaauccuagcugugugcagu

SEQ ID NO: 3579581 - RNA, 14 nt, Human
uuaauccuucuagu

SEQ ID NO: 3579582 - RNA, 22 nt, Human
uuaauccuuuguuuucugacua

SEQ ID NO: 3579583 - RNA, 15 nt, Human
uuaaucuaaauggaa

SEQ ID NO: 3579584 - RNA, 14 nt, Human
uuaaucuacugcau

SEQ ID NO: 3579585 - RNA, 22 nt, Human
uuaaucuccaccagucauuuuu

SEQ ID NO: 3579586 - RNA, 14 nt, Human
uuaaucucuguuau

SEQ ID NO: 3579587 - RNA, 19 nt, Human
uuaaucucuguuauguacu

SEQ ID NO: 3579588 - RNA, 20 nt, Human
uuaaucucuguuauguacug

SEQ ID NO: 3579589 - RNA, 21 nt, Human
uuaaucucuguuauguacugu

SEQ ID NO: 3579590 - RNA, 18 nt, Human
uuaaucugaaauucuaaa

SEQ ID NO: 3579591 - RNA, 21 nt, Human
uuaaucugggccagaauuuca

SEQ ID NO: 3579592 - RNA, 17 nt, Human
uuaaucuuaauguauau

SEQ ID NO: 3579593 - RNA, 14 nt, Human
uuaaucuuagugua

SEQ ID NO: 3579594 - RNA, 12 nt, Human
uuaaucuuggau

SEQ ID NO: 3579595 - RNA, 13 nt, Human
uuaaucuuuaauu

SEQ ID NO: 3579596 - RNA, 14 nt, Human
uuaaucuuuccuga

SEQ ID NO: 3579597 - RNA, 17 nt, Human
uuaaucuuucuuuaccu

SEQ ID NO: 3579598 - RNA, 21 nt, Human
uuaaucuuucuuuaccugaga

SEQ ID NO: 3579599 - RNA, 23 nt, Human
uuaaucuuucuuuaccugagacc

SEQ ID NO: 3579600 - RNA, 24 nt, Human
uuaaucuuucuuuaccugagacca

SEQ ID NO: 3579601 - RNA, 19 nt, Human
uuaaucuuuucacaaauaa

SEQ ID NO: 3579602 - RNA, 20 nt, Human
uuaaucuuuucuuauuuuug

SEQ ID NO: 3579603 - RNA, 16 nt, Human
uuaaugaaaaggaauc

SEQ ID NO: 3579604 - RNA, 15 nt, Human
uuaaugaaaauguca

SEQ ID NO: 3579605 - RNA, 19 nt, Human
uuaaugaaagacuguacaa

SEQ ID NO: 3579606 - RNA, 23 nt, Human
uuaaugaaagacuguacaaagua

SEQ ID NO: 3579607 - RNA, 22 nt, Human
uuaaugaaauaucuguauuuaa

SEQ ID NO: 3579608 - RNA, 18 nt, Human
uuaaugaagaaaguggaa

SEQ ID NO: 3579609 - RNA, 18 nt, Human
uuaaugaaguuugaaugu

SEQ ID NO: 3579610 - RNA, 22 nt, Human
uuaaugaaguuugaauguuaaa

SEQ ID NO: 3579611 - RNA, 23 nt, Human
uuaaugaaguuugaauguuaaau

SEQ ID NO: 3579612 - RNA, 13 nt, Human
uuaaugaaugcuu

SEQ ID NO: 3579613 - RNA, 15 nt, Human
uuaaugaaugcuuaa

SEQ ID NO: 3579614 - RNA, 14 nt, Human
uuaaugacaauauu

SEQ ID NO: 3579615 - RNA, 23 nt, Human
uuaaugacacuuguccccaaauc

SEQ ID NO: 3579616 - RNA, 18 nt, Human
uuaaugagacuuuaaaag

SEQ ID NO: 3579617 - RNA, 23 nt, Human
uuaaugagacuuuaaaagcauuu

SEQ ID NO: 3579618 - RNA, 16 nt, Human
uuaaugcaauauacug

SEQ ID NO: 3579619 - RNA, 22 nt, Human
uuaaugcaguugcuuacuaaag

SEQ ID NO: 3579620 - RNA, 20 nt, Human
uuaaugcauuaaaccugucu

SEQ ID NO: 3579621 - RNA, 19 nt, Human
uuaaugccauuaucccuga

SEQ ID NO: 3579622 - RNA, 13 nt, Human
uuaaugcccagac

SEQ ID NO: 3579623 - RNA, 23 nt, Human
uuaaugccgauauacucuagaug

SEQ ID NO: 3579624 - RNA, 16 nt, Human
uuaaugccugcuuuuu

SEQ ID NO: 3579625 - RNA, 18 nt, Human
uuaaugccugcuuuuugg

SEQ ID NO: 3579626 - RNA, 20 nt, Human
uuaauggacacuuuucaccu

SEQ ID NO: 3579627 - RNA, 18 nt, Human
uuaauggacuuauuucuu

SEQ ID NO: 3579628 - RNA, 20 nt, Human
uuaauggacuuauuucuuca

SEQ ID NO: 3579629 - RNA, 12 nt, Human
uuaauggaugaa

SEQ ID NO: 3579630 - RNA, 16 nt, Human
uuaauggcugauaauu

SEQ ID NO: 3579631 - RNA, 18 nt, Human
uuaauggcugauaauuuu

SEQ ID NO: 3579632 - RNA, 19 nt, Human
uuaauggggguagcagcug

SEQ ID NO: 3579633 - RNA, 21 nt, Human
uuaauggggguagcagcugga

SEQ ID NO: 3579634 - RNA, 19 nt, Human
uuaauggugccuucauuug

SEQ ID NO: 3579635 - RNA, 20 nt, Human
uuaauggugccuucauuugg

SEQ ID NO: 3579636 - RNA, 15 nt, Human
uuaauguagccaugg

SEQ ID NO: 3579637 - RNA, 15 nt, Human
uuaauguauguuacc

SEQ ID NO: 3579638 - RNA, 17 nt, Human
uuaaugucacaggcagg

SEQ ID NO: 3579639 - RNA, 11 nt, Human
uuaaugugagu

SEQ ID NO: 3579640 - RNA, 20 nt, Human
uuaaugugaugauguaauug

SEQ ID NO: 3579641 - RNA, 19 nt, Human
uuaaugugcuguguaaagu

SEQ ID NO: 3579642 - RNA, 21 nt, Human
uuaaugugcuguguaaaguua

SEQ ID NO: 3579643 - RNA, 13 nt, Human
uuaauguguauua

SEQ ID NO: 3579644 - RNA, 22 nt, Human
uuaauguguugggaaaaaggcc

SEQ ID NO: 3579645 - RNA, 22 nt, Human
uuaauguucugaauaauuucuu

SEQ ID NO: 3579646 - RNA, 14 nt, Human
uuaauguucuguga

SEQ ID NO: 3579647 - RNA, 17 nt, Human
uuaauguugaacaaaau

SEQ ID NO: 3579648 - RNA, 17 nt, Human
uuaauguugauuucuag

SEQ ID NO: 3579649 - RNA, 15 nt, Human
uuaauguuuaaaaca

SEQ ID NO: 3579650 - RNA, 15 nt, Human
uuaauguuuauuccu

SEQ ID NO: 3579651 - RNA, 23 nt, Human
uuaauguuuuaaauguacagaca

SEQ ID NO: 3579652 - RNA, 15 nt, Human
uuaauuaaacauugu

SEQ ID NO: 3579653 - RNA, 20 nt, Human
uuaauuaaauagcuuuugug

SEQ ID NO: 3579654 - RNA, 13 nt, Human
uuaauuaauuuga

SEQ ID NO: 3579655 - RNA, 15 nt, Human
uuaauuagcauucug

SEQ ID NO: 3579656 - RNA, 13 nt, Human
uuaauuagguuaa

SEQ ID NO: 3579657 - RNA, 17 nt, Human
uuaauuagguuaacuau

SEQ ID NO: 3579658 - RNA, 16 nt, Human
uuaauuagugcuaagu

SEQ ID NO: 3579659 - RNA, 21 nt, Human
uuaauuagugcuaagugugaa

SEQ ID NO: 3579660 - RNA, 23 nt, Human
uuaauuauaccauggugaauuaa

SEQ ID NO: 3579661 - RNA, 23 nt, Human
uuaauuauaggagccuuaauuuu

SEQ ID NO: 3579662 - RNA, 15 nt, Human
uuaauuaucuuuucu

SEQ ID NO: 3579663 - RNA, 17 nt, Human
uuaauuauuaacuacau

SEQ ID NO: 3579664 - RNA, 19 nt, Human
uuaauuauuauaaaaauau

SEQ ID NO: 3579665 - RNA, 14 nt, Human
uuaauuauuauuug

SEQ ID NO: 3579666 - RNA, 21 nt, Human
uuaauucagaaccccaacuac

SEQ ID NO: 3579667 - RNA, 17 nt, Human
uuaauuccuucagcacu

SEQ ID NO: 3579668 - RNA, 20 nt, Human
uuaauuccuucagcacuuua

SEQ ID NO: 3579669 - RNA, 17 nt, Human
uuaauucucaugugauc

SEQ ID NO: 3579670 - RNA, 21 nt, Human
uuaauugacuuauuuauauaa

SEQ ID NO: 3579671 - RNA, 19 nt, Human
uuaauugccaccucuaaca

SEQ ID NO: 3579672 - RNA, 18 nt, Human
uuaauuggcagcagauuu

SEQ ID NO: 3579673 - RNA, 19 nt, Human
uuaauuggcagcagauuuu

SEQ ID NO: 3579674 - RNA, 13 nt, Human
uuaauugggcacu

SEQ ID NO: 3579675 - RNA, 22 nt, Human
uuaauugggccagcuuuucaaa

SEQ ID NO: 3579676 - RNA, 12 nt, Human
uuaauuguaaac

SEQ ID NO: 3579677 - RNA, 18 nt, Human
uuaauuguaaacuguacu

SEQ ID NO: 3579678 - RNA, 16 nt, Human
uuaauugugugaacuu

SEQ ID NO: 3579679 - RNA, 19 nt, Human
uuaauuguuguuucuuucu

SEQ ID NO: 3579680 - RNA, 22 nt, Human
uuaauuguuguuucuuucuagu

SEQ ID NO: 3579681 - RNA, 13 nt, Human
uuaauuguuuaaa

SEQ ID NO: 3579682 - RNA, 19 nt, Human
uuaauuguuuugcacuuuu

SEQ ID NO: 3579683 - RNA, 16 nt, Human
uuaauuuaaagcuuac

SEQ ID NO: 3579684 - RNA, 21 nt, Human
uuaauuuaaagcuuacucugu

SEQ ID NO: 3579685 - RNA, 17 nt, Human
uuaauuuaauauuuacu

SEQ ID NO: 3579686 - RNA, 16 nt, Human
uuaauuuaaucuuuuu

SEQ ID NO: 3579687 - RNA, 22 nt, Human
uuaauuuacaaaaauauaaaau

SEQ ID NO: 3579688 - RNA, 15 nt, Human
uuaauuuagaaaacu

SEQ ID NO: 3579689 - RNA, 16 nt, Human
uuaauuuagaaaacuu

SEQ ID NO: 3579690 - RNA, 18 nt, Human
uuaauuuaguaaauguua

SEQ ID NO: 3579691 - RNA, 19 nt, Human
uuaauuuaguaaauguuau

SEQ ID NO: 3579692 - RNA, 16 nt, Human
uuaauuuauccucugu

SEQ ID NO: 3579693 - RNA, 14 nt, Human
uuaauuuaugcaga

SEQ ID NO: 3579694 - RNA, 20 nt, Human
uuaauuucaguccuguaguu

SEQ ID NO: 3579695 - RNA, 23 nt, Human
uuaauuucaguccuguaguuuua

SEQ ID NO: 3579696 - RNA, 11 nt, Human
uuaauuuccuu

SEQ ID NO: 3579697 - RNA, 13 nt, Human
uuaauuuccuuuu

SEQ ID NO: 3579698 - RNA, 19 nt, Human
uuaauuuccuuuuugacac

SEQ ID NO: 3579699 - RNA, 22 nt, Human
uuaauuuccuuuuugacacuga

SEQ ID NO: 3579700 - RNA, 23 nt, Human
uuaauuuccuuuuugacacugaa

SEQ ID NO: 3579701 - RNA, 21 nt, Human
uuaauuucugccauuucaugu

SEQ ID NO: 3579702 - RNA, 18 nt, Human
uuaauuucuucaaaaugu

SEQ ID NO: 3579703 - RNA, 16 nt, Human
uuaauuuggaaacuaa

SEQ ID NO: 3579704 - RNA, 22 nt, Human
uuaauuuggagcacaaaauuca

SEQ ID NO: 3579705 - RNA, 16 nt, Human
uuaauuugguuuucac

SEQ ID NO: 3579706 - RNA, 13 nt, Human
uuaauuuuaaagu

SEQ ID NO: 3579707 - RNA, 18 nt, Human
uuaauuuuaaagugcaaa

SEQ ID NO: 3579708 - RNA, 21 nt, Human
uuaauuuuaguuuuucauuaa

SEQ ID NO: 3579709 - RNA, 20 nt, Human
uuaauuuugacacugaaaua

SEQ ID NO: 3579710 - RNA, 16 nt, Human
uuacuggccuuuuuca

SEQ ID NO: 3579711 - RNA, 14 nt, Human
uuacugggcccuga

SEQ ID NO: 3579712 - RNA, 23 nt, Human
uuacugggccuuagugggccagg

SEQ ID NO: 3579713 - RNA, 23 nt, Human
uuacuggggcuggggaaggaagc

SEQ ID NO: 3579714 - RNA, 20 nt, Human
uuacugguaggaacuugaga

SEQ ID NO: 3579715 - RNA, 17 nt, Human
uuacugguccaaaagau

SEQ ID NO: 3579716 - RNA, 15 nt, Human
uuacuguaaaaugca

SEQ ID NO: 3579717 - RNA, 17 nt, Human
uuacuguaagacauuag

SEQ ID NO: 3579718 - RNA, 14 nt, Human
uuacuguacaugaa

SEQ ID NO: 3579719 - RNA, 17 nt, Human
uuacugucaauaaacag

SEQ ID NO: 3579720 - RNA, 20 nt, Human
uuacuguccuguugauuaau

SEQ ID NO: 3579721 - RNA, 15 nt, Human
uuacugucuuaauua

SEQ ID NO: 3579722 - RNA, 18 nt, Human
uuacugucuuaauuaagu

SEQ ID NO: 3579723 - RNA, 14 nt, Human
uuacugugaaacug

SEQ ID NO: 3579724 - RNA, 17 nt, Human
uuacuguggaggaagga

SEQ ID NO: 3579725 - RNA, 14 nt, Human
uuacuguguuuuau

SEQ ID NO: 3579726 - RNA, 11 nt, Human
uuacuguucuu

SEQ ID NO: 3579727 - RNA, 15 nt, Human
uuacuguucuugcug

SEQ ID NO: 3579728 - RNA, 18 nt, Human
uuacuguucuugcugcua

SEQ ID NO: 3579729 - RNA, 20 nt, Human
uuacuguucuugcugcuaga

SEQ ID NO: 3579730 - RNA, 21 nt, Human
uuacuguucuugcugcuagaa

SEQ ID NO: 3579731 - RNA, 15 nt, Human
uuacuguugugaccu

SEQ ID NO: 3579732 - RNA, 18 nt, Human
uuacuguuuauuucuguu

SEQ ID NO: 3579733 - RNA, 22 nt, Human
uuacuguuugucuucuccccag

SEQ ID NO: 3579734 - RNA, 13 nt, Human
uuacuuaaagauu

SEQ ID NO: 3579735 - RNA, 20 nt, Human
uuacuuaaagauuuaucaaa

SEQ ID NO: 3579736 - RNA, 13 nt, Human
uuacuuagcaugc

SEQ ID NO: 3579737 - RNA, 21 nt, Human
uuacuuagcuuaucaauuugu

SEQ ID NO: 3579738 - RNA, 15 nt, Human
uuacuuccuaucaag

SEQ ID NO: 3579739 - RNA, 18 nt, Human
uuacuucucuauaaaaaa

SEQ ID NO: 3579740 - RNA, 24 nt, Human
uuacuucucuauaaaaaauaugua

SEQ ID NO: 3579741 - RNA, 14 nt, Human
uuacuucuugcccu

SEQ ID NO: 3579742 - RNA, 15 nt, Human
uuacuugauaaggga

SEQ ID NO: 3579743 - RNA, 13 nt, Human
uuacuugcuucuc

SEQ ID NO: 3579744 - RNA, 18 nt, Human
uuacuugcuuuaccuuuu

SEQ ID NO: 3579745 - RNA, 17 nt, Human
uuacuuguaaauauaaa

SEQ ID NO: 3579746 - RNA, 19 nt, Human
uuacuuguaaauauaaaga

SEQ ID NO: 3579747 - RNA, 22 nt, Human
uuacuuguaaauauaaagacgu

SEQ ID NO: 3579748 - RNA, 21 nt, Human
uuacuugucuuucugggguuu

SEQ ID NO: 3579749 - RNA, 23 nt, Human
uuacuuguugccuauaagccaaa

SEQ ID NO: 3579750 - RNA, 22 nt, Human
uuacuuuaacuuaguuuugcau

SEQ ID NO: 3579751 - RNA, 20 nt, Human
uuacuuuaccacccccacac

SEQ ID NO: 3579752 - RNA, 23 nt, Human
uuacuuucccuugcuuuucccuc

SEQ ID NO: 3579753 - RNA, 21 nt, Human
uuacuuuccuuuccccagccc

SEQ ID NO: 3579754 - RNA, 13 nt, Human
uuacuuuguaaau

SEQ ID NO: 3579755 - RNA, 17 nt, Human
uuacuuuguaaauucug

SEQ ID NO: 3579756 - RNA, 19 nt, Human
uuacuuuguaaauucugau

SEQ ID NO: 3579757 - RNA, 20 nt, Human
uuacuuuguaaauucugauu

SEQ ID NO: 3579758 - RNA, 15 nt, Human
uuacuuuguaugaua

SEQ ID NO: 3579759 - RNA, 15 nt, Human
uuacuuuuaaacugu

SEQ ID NO: 3579760 - RNA, 15 nt, Human
uuacuuuuaaauguc

SEQ ID NO: 3579761 - RNA, 19 nt, Human
uuacuuuuccuugcauaca

SEQ ID NO: 3579762 - RNA, 20 nt, Human
uuacuuuuccuugcauacaa

SEQ ID NO: 3579763 - RNA, 16 nt, Human
uuagaaaaaaauuacu

SEQ ID NO: 3579764 - RNA, 20 nt, Human
uuagaaaaagaacaugcagu

SEQ ID NO: 3579765 - RNA, 22 nt, Human
uuagaaaaagaacaugcaguuu

SEQ ID NO: 3579766 - RNA, 13 nt, Human
uuagaaaacuuug

SEQ ID NO: 3579767 - RNA, 16 nt, Human
uuagaaaacuuuguua

SEQ ID NO: 3579768 - RNA, 23 nt, Human
uuagaaaagggaguuuaaaaaug

SEQ ID NO: 3579769 - RNA, 21 nt, Human
uuagaaaaggugauaaaauca

SEQ ID NO: 3579770 - RNA, 12 nt, Human
uuagaaaaugug

SEQ ID NO: 3579771 - RNA, 19 nt, Human
uuagaaacacaacuauauu

SEQ ID NO: 3579772 - RNA, 22 nt, Human
uuagaaacacauaauuaacacu

SEQ ID NO: 3579773 - RNA, 16 nt, Human
uuagaaacauaaauaa

SEQ ID NO: 3579774 - RNA, 17 nt, Human
uuagaaacaugguuuug

SEQ ID NO: 3579775 - RNA, 23 nt, Human
uuagaaacuggaaauacuagauu

SEQ ID NO: 3579776 - RNA, 17 nt, Human
uuagaaagcaacuuauc

SEQ ID NO: 3579777 - RNA, 14 nt, Human
uuagaaagcauuug

SEQ ID NO: 3579778 - RNA, 15 nt, Human
uuagaaagcauuuga

SEQ ID NO: 3579779 - RNA, 11 nt, Human
uuagaaauauu

SEQ ID NO: 3579780 - RNA, 19 nt, Human
uuagaaauauucacaucuu

SEQ ID NO: 3579781 - RNA, 16 nt, Human
uuagaaaugcagaauc

SEQ ID NO: 3579782 - RNA, 17 nt, Human
uuagaaauguaaacugc

SEQ ID NO: 3579783 - RNA, 21 nt, Human
uuagaaauguaaacugccaua

SEQ ID NO: 3579784 - RNA, 16 nt, Human
uuagaacaauuuucuu

SEQ ID NO: 3579785 - RNA, 20 nt, Human
uuagaacacuauuuucagaa

SEQ ID NO: 3579786 - RNA, 15 nt, Human
uuagaacagaaaaca

SEQ ID NO: 3579787 - RNA, 18 nt, Human
uuagaacaggcaagugaa

SEQ ID NO: 3579788 - RNA, 20 nt, Human
uuagaacaggcaagugaaga

SEQ ID NO: 3579789 - RNA, 14 nt, Human
uuagaacagguuuu

SEQ ID NO: 3579790 - RNA, 12 nt, Human
uuagaagaaaga

SEQ ID NO: 3579791 - RNA, 15 nt, Human
uuagaagaagugugu

SEQ ID NO: 3579792 - RNA, 19 nt, Human
uuagaagugcauuucugaa

SEQ ID NO: 3579793 - RNA, 12 nt, Human
uuagaaguguca

SEQ ID NO: 3579794 - RNA, 17 nt, Human
uuagaaucccuguguua

SEQ ID NO: 3579795 - RNA, 20 nt, Human
uuagaaucccuguguuaauu

SEQ ID NO: 3579796 - RNA, 16 nt, Human
uuagaaucuauuuucu

SEQ ID NO: 3579797 - RNA, 17 nt, Human
uuagaaucuauuuucua

SEQ ID NO: 3579798 - RNA, 13 nt, Human
uuagaauuauuua

SEQ ID NO: 3579799 - RNA, 19 nt, Human
uuagacaaauacucaugug

SEQ ID NO: 3579800 - RNA, 11 nt, Human
uuagacagagu

SEQ ID NO: 3579801 - RNA, 15 nt, Human
uuagacagucccugc

SEQ ID NO: 3579802 - RNA, 17 nt, Human
uuagacauguaauuugu

SEQ ID NO: 3579803 - RNA, 12 nt, Human
uuagaccaagga

SEQ ID NO: 3579804 - RNA, 17 nt, Human
uuagaccaccaagccuu

SEQ ID NO: 3579805 - RNA, 19 nt, Human
uuagaccaccaagccuuga

SEQ ID NO: 3579806 - RNA, 17 nt, Human
uuagaccccauacaagu

SEQ ID NO: 3579807 - RNA, 13 nt, Human
uuagacccugggu

SEQ ID NO: 3579808 - RNA, 23 nt, Human
uuagaccuacagggggucuggcu

SEQ ID NO: 3579809 - RNA, 12 nt, Human
uuagaccucagc

SEQ ID NO: 3579810 - RNA, 16 nt, Human
uuagaccucagccugu

SEQ ID NO: 3579811 - RNA, 17 nt, Human
uuagacugccagcucuu

SEQ ID NO: 3579812 - RNA, 12 nt, Human
uuagacugcuuu

SEQ ID NO: 3579813 - RNA, 15 nt, Human
uuagacuggaacuug

SEQ ID NO: 3579814 - RNA, 21 nt, Human
uuagacuggaacuugaacuga

SEQ ID NO: 3579815 - RNA, 17 nt, Human
uuagacuucuguuuuca

SEQ ID NO: 3579816 - RNA, 19 nt, Human
uuagacuugaaaagagaca

SEQ ID NO: 3579817 - RNA, 18 nt, Human
uuagacuuuagaaauaaa

SEQ ID NO: 3579818 - RNA, 22 nt, Human
uuagacuuuuccaauaugugau

SEQ ID NO: 3579819 - RNA, 14 nt, Human
uuagagaacugaaa

SEQ ID NO: 3579820 - RNA, 19 nt, Human
uuagagaacugaaaagaga

SEQ ID NO: 3579821 - RNA, 23 nt, Human
uuagagacaguugggugagaaca

SEQ ID NO: 3579822 - RNA, 19 nt, Human
uuagagagggaccaugugu

SEQ ID NO: 3579823 - RNA, 20 nt, Human
uuagagcaguuucuguccug

SEQ ID NO: 3579824 - RNA, 21 nt, Human
uuagagccaggcacacacugu

SEQ ID NO: 3579825 - RNA, 21 nt, Human
uuagagcugacacaaaccugc

SEQ ID NO: 3579826 - RNA, 22 nt, Human
uuagagcuuuuuuuuuuuaauu

SEQ ID NO: 3579827 - RNA, 12 nt, Human
uuagaggccagc

SEQ ID NO: 3579828 - RNA, 13 nt, Human
uuagagguuuuaa

SEQ ID NO: 3579829 - RNA, 21 nt, Human
uuagagguuuuaaagugauua

SEQ ID NO: 3579830 - RNA, 16 nt, Human
uuagaguuaacaauga

SEQ ID NO: 3579831 - RNA, 14 nt, Human
uuagaguuagacug

SEQ ID NO: 3579832 - RNA, 18 nt, Human
uuagaguuagacuguugg

SEQ ID NO: 3579833 - RNA, 16 nt, Human
uuagaguuucuguuug

SEQ ID NO: 3579834 - RNA, 18 nt, Human
uuagaguuucuguuugau

SEQ ID NO: 3579835 - RNA, 20 nt, Human
uuagauagcccuguccuggu

SEQ ID NO: 3579836 - RNA, 14 nt, Human
uuagauauaacacu

SEQ ID NO: 3579837 - RNA, 17 nt, Human
uuagauauaacacuaug

SEQ ID NO: 3579838 - RNA, 23 nt, Human
uuagauaucuuuuuauugaugug

SEQ ID NO: 3579839 - RNA, 20 nt, Human
uuagauccauuaauuuaaau

SEQ ID NO: 3579840 - RNA, 13 nt, Human
uuagaucuaguuc

SEQ ID NO: 3579841 - RNA, 21 nt, Human
uuagaugcaguucugaagaag

SEQ ID NO: 3579842 - RNA, 16 nt, Human
uuagaugcauauuacu

SEQ ID NO: 3579843 - RNA, 23 nt, Human
uuagauggauucuccacucaguu

SEQ ID NO: 3579844 - RNA, 17 nt, Human
uuagaugguuacacugu

SEQ ID NO: 3579845 - RNA, 20 nt, Human
uuagaugugcugcuuugaua

SEQ ID NO: 3579846 - RNA, 22 nt, Human
uuagauguuccaguaaucuaau

SEQ ID NO: 3579847 - RNA, 22 nt, Human
uuagauguucuaagucuuucca

SEQ ID NO: 3579848 - RNA, 21 nt, Human
uuagauguucucuaucauuua

SEQ ID NO: 3579849 - RNA, 19 nt, Human
uuagauuaagaaauagaca

SEQ ID NO: 3579850 - RNA, 15 nt, Human
uuagauucacuuuga

SEQ ID NO: 3579851 - RNA, 13 nt, Human
uuagauugagaaa

SEQ ID NO: 3579852 - RNA, 19 nt, Human
uuagauuucaagaaaaaau

SEQ ID NO: 3579853 - RNA, 21 nt, Human
uuagauuugccauagaguaca

SEQ ID NO: 3579854 - RNA, 19 nt, Human
uucauucaauauugacauu

SEQ ID NO: 3579855 - RNA, 15 nt, Human
uucauucacuucucu

SEQ ID NO: 3579856 - RNA, 12 nt, Human
uucauucauauu

SEQ ID NO: 3579857 - RNA, 16 nt, Human
uucauuccuaaagaaa

SEQ ID NO: 3579858 - RNA, 13 nt, Human
uucauuccuccag

SEQ ID NO: 3579859 - RNA, 22 nt, Human
uucauuccuucagauuuggcuu

SEQ ID NO: 3579860 - RNA, 23 nt, Human
uucauucucauaauuccuacagc

SEQ ID NO: 3579861 - RNA, 21 nt, Human
uucauucucauugcagaauaa

SEQ ID NO: 3579862 - RNA, 18 nt, Human
uucauucucccuuucacu

SEQ ID NO: 3579863 - RNA, 12 nt, Human
uucauucugcau

SEQ ID NO: 3579864 - RNA, 17 nt, Human
uucauucugugaucauu

SEQ ID NO: 3579865 - RNA, 19 nt, Human
uucauucuugaaagcugug

SEQ ID NO: 3579866 - RNA, 22 nt, Human
uucauugaguugguuacuucau

SEQ ID NO: 3579867 - RNA, 18 nt, Human
uucauugauuuccugugu

SEQ ID NO: 3579868 - RNA, 22 nt, Human
uucauugguacugccuuaaaga

SEQ ID NO: 3579869 - RNA, 14 nt, Human
uucauugucuguga

SEQ ID NO: 3579870 - RNA, 13 nt, Human
uucauuuaaaaug

SEQ ID NO: 3579871 - RNA, 14 nt, Human
uucauuuaaaauga

SEQ ID NO: 3579872 - RNA, 16 nt, Human
uucauuuaaaaugauu

SEQ ID NO: 3579873 - RNA, 20 nt, Human
uucauuuaagggaaagaaaa

SEQ ID NO: 3579874 - RNA, 19 nt, Human
uucauuuaggugaggaagc

SEQ ID NO: 3579875 - RNA, 18 nt, Human
uucauuuaucuauaauuu

SEQ ID NO: 3579876 - RNA, 12 nt, Human
uucauuucacug

SEQ ID NO: 3579877 - RNA, 14 nt, Human
uucauuucauccuu

SEQ ID NO: 3579878 - RNA, 14 nt, Human
uucauuucauguau

SEQ ID NO: 3579879 - RNA, 12 nt, Human
uucauuucauug

SEQ ID NO: 3579880 - RNA, 12 nt, Human
uucauuuccugc

SEQ ID NO: 3579881 - RNA, 13 nt, Human
uucauuuccugcc

SEQ ID NO: 3579882 - RNA, 18 nt, Human
uucauuugagaaguaaac

SEQ ID NO: 3579883 - RNA, 16 nt, Human
uucauuugcuuuggaa

SEQ ID NO: 3579884 - RNA, 19 nt, Human
uucauuuggaaauaagcug

SEQ ID NO: 3579885 - RNA, 18 nt, Human
uucauuuguuauucuuaa

SEQ ID NO: 3579886 - RNA, 22 nt, Human
uucauuuguuuguuuguuuguc

SEQ ID NO: 3579887 - RNA, 16 nt, Human
uucauuuuaaaaaguc

SEQ ID NO: 3579888 - RNA, 13 nt, Human
uucauuuuccaau

SEQ ID NO: 3579889 - RNA, 14 nt, Human
uucauuuucuagau

SEQ ID NO: 3579890 - RNA, 20 nt, Human
uucauuuucuagauacaaua

SEQ ID NO: 3579891 - RNA, 22 nt, Human
uucauuuucuagauacaauaaa

SEQ ID NO: 3579892 - RNA, 20 nt, Human
uucauuuugagcugaaaugc

SEQ ID NO: 3579893 - RNA, 15 nt, Human
uucauuuuuccuaac

SEQ ID NO: 3579894 - RNA, 18 nt, Human
uucauuuuuuuccaggcu

SEQ ID NO: 3579895 - RNA, 13 nt, Human
uuccaaaaaaaua

SEQ ID NO: 3579896 - RNA, 18 nt, Human
uuccaaaaagguugcugu

SEQ ID NO: 3579897 - RNA, 22 nt, Human
uuccaaaaauuacuuaguauug

SEQ ID NO: 3579898 - RNA, 17 nt, Human
uuccaaaaguggccucu

SEQ ID NO: 3579899 - RNA, 16 nt, Human
uuccaaaaucucccau

SEQ ID NO: 3579900 - RNA, 21 nt, Human
uuccaaacaacagaaagucau

SEQ ID NO: 3579901 - RNA, 14 nt, Human
uuccaaacaugguu

SEQ ID NO: 3579902 - RNA, 14 nt, Human
uuccaaacuaauuu

SEQ ID NO: 3579903 - RNA, 15 nt, Human
uuccaaagaauucuu

SEQ ID NO: 3579904 - RNA, 22 nt, Human
uuccaaagcuuuauuaccagug

SEQ ID NO: 3579905 - RNA, 15 nt, Human
uuccaaauaaaauga

SEQ ID NO: 3579906 - RNA, 19 nt, Human
uuccaaauaauaaagucua

SEQ ID NO: 3579907 - RNA, 15 nt, Human
uuccaaauacuaaug

SEQ ID NO: 3579908 - RNA, 14 nt, Human
uuccaaauucaguu

SEQ ID NO: 3579909 - RNA, 15 nt, Human
uuccaaauucaguuu

SEQ ID NO: 3579910 - RNA, 19 nt, Human
uuccaaauucaguuucaua

SEQ ID NO: 3579911 - RNA, 15 nt, Human
uuccaaauucugcuu

SEQ ID NO: 3579912 - RNA, 14 nt, Human
uuccaacaaagggu

SEQ ID NO: 3579913 - RNA, 15 nt, Human
uuccaacaaaggguu

SEQ ID NO: 3579914 - RNA, 22 nt, Human
uuccaacaaaggguuuuaaugu

SEQ ID NO: 3579915 - RNA, 23 nt, Human
uuccaacaaaggguuuuaaugua

SEQ ID NO: 3579916 - RNA, 12 nt, Human
uuccaacaccac

SEQ ID NO: 3579917 - RNA, 19 nt, Human
uuccaacaccacagacaca

SEQ ID NO: 3579918 - RNA, 20 nt, Human
uuccaacaccacagacacac

SEQ ID NO: 3579919 - RNA, 16 nt, Human
uuccaacacugauuuc

SEQ ID NO: 3579920 - RNA, 23 nt, Human
uuccaacagcucaagucuucccu

SEQ ID NO: 3579921 - RNA, 14 nt, Human
uuccaacagugagu

SEQ ID NO: 3579922 - RNA, 22 nt, Human
uuccaacucguauagcaugcau

SEQ ID NO: 3579923 - RNA, 13 nt, Human
uuccaacugcugc

SEQ ID NO: 3579924 - RNA, 23 nt, Human
uuccaagaaagaugaauacauuu

SEQ ID NO: 3579925 - RNA, 22 nt, Human
uuccaagacaguauacaguccu

SEQ ID NO: 3579926 - RNA, 21 nt, Human
uuccaagacaugucuguucua

SEQ ID NO: 3579927 - RNA, 13 nt, Human
uuccaagacauug

SEQ ID NO: 3579928 - RNA, 15 nt, Human
uuccaaggguacuaa

SEQ ID NO: 3579929 - RNA, 16 nt, Human
uuccaagucuuugcua

SEQ ID NO: 3579930 - RNA, 13 nt, Human
uuccaauaaacca

SEQ ID NO: 3579931 - RNA, 15 nt, Human
uuccaauaaacuaug

SEQ ID NO: 3579932 - RNA, 14 nt, Human
uuccaauaugugau

SEQ ID NO: 3579933 - RNA, 23 nt, Human
uuccaauccuggcucuguggcuu

SEQ ID NO: 3579934 - RNA, 21 nt, Human
uuccaauucuaucuuuuguuu

SEQ ID NO: 3579935 - RNA, 21 nt, Human
uuccaauuuucuggaauacau

SEQ ID NO: 3579936 - RNA, 11 nt, Human
uuccacaaaau

SEQ ID NO: 3579937 - RNA, 14 nt, Human
uuccacaaagaaaa

SEQ ID NO: 3579938 - RNA, 21 nt, Human
uuccacaagagcccaggccuc

SEQ ID NO: 3579939 - RNA, 20 nt, Human
uuccacaagauucccagaga

SEQ ID NO: 3579940 - RNA, 21 nt, Human
uuccacaagauucccagagac

SEQ ID NO: 3579941 - RNA, 17 nt, Human
uuccacacagaaugcaa

SEQ ID NO: 3579942 - RNA, 13 nt, Human
uuccacacaugca

SEQ ID NO: 3579943 - RNA, 18 nt, Human
uuccacaccaagcagcaa

SEQ ID NO: 3579944 - RNA, 22 nt, Human
uuccacaccuuuuauugacaca

SEQ ID NO: 3579945 - RNA, 18 nt, Human
uuccacacucaccucuaa

SEQ ID NO: 3579946 - RNA, 13 nt, Human
uuccacagaggac

SEQ ID NO: 3579947 - RNA, 22 nt, Human
uuccacagaggacacagagaag

SEQ ID NO: 3579948 - RNA, 21 nt, Human
uuccacagccugcaagucagu

SEQ ID NO: 3579949 - RNA, 17 nt, Human
uuccacagggucccaca

SEQ ID NO: 3579950 - RNA, 18 nt, Human
uuccacagggucccacag

SEQ ID NO: 3579951 - RNA, 22 nt, Human
uuccacagggucccacagccac

SEQ ID NO: 3579952 - RNA, 16 nt, Human
uuccacaguugccacc

SEQ ID NO: 3579953 - RNA, 21 nt, Human
uuccacaguugccaccaccuc

SEQ ID NO: 3579954 - RNA, 22 nt, Human
uuccacaucuacguuuuuggug

SEQ ID NO: 3579955 - RNA, 15 nt, Human
uuccacaugcucuga

SEQ ID NO: 3579956 - RNA, 16 nt, Human
uuccaccacagccagc

SEQ ID NO: 3579957 - RNA, 18 nt, Human
uuccaccaucaagccacc

SEQ ID NO: 3579958 - RNA, 19 nt, Human
uuccaccaucaagccacca

SEQ ID NO: 3579959 - RNA, 23 nt, Human
uuccacccagugcugaauuuccc

SEQ ID NO: 3579960 - RNA, 14 nt, Human
uuccaccucccucc

SEQ ID NO: 3579961 - RNA, 15 nt, Human
uuccaccugcucugc

SEQ ID NO: 3579962 - RNA, 13 nt, Human
uuccaccuuaaau

SEQ ID NO: 3579963 - RNA, 19 nt, Human
uuccacgcugucuccagac

SEQ ID NO: 3579964 - RNA, 22 nt, Human
uuccacggagccacuccucuga

SEQ ID NO: 3579965 - RNA, 19 nt, Human
uuccacgucccccuggggc

SEQ ID NO: 3579966 - RNA, 14 nt, Human
uuccacuaaaaaua

SEQ ID NO: 3579967 - RNA, 18 nt, Human
uuccacuaaaaauauugu

SEQ ID NO: 3579968 - RNA, 12 nt, Human
uuccacuaaccc

SEQ ID NO: 3579969 - RNA, 17 nt, Human
uuccacuacaccuggcu

SEQ ID NO: 3579970 - RNA, 16 nt, Human
uuccacuccuccuagc

SEQ ID NO: 3579971 - RNA, 19 nt, Human
uuccacucuggauucagcc

SEQ ID NO: 3579972 - RNA, 13 nt, Human
uuccacugagcuc

SEQ ID NO: 3579973 - RNA, 15 nt, Human
uuccacugagcucca

SEQ ID NO: 3579974 - RNA, 16 nt, Human
uuccacugagggcagu

SEQ ID NO: 3579975 - RNA, 15 nt, Human
uuccacugccucugc

SEQ ID NO: 3579976 - RNA, 16 nt, Human
uuccacugccucugcc

SEQ ID NO: 3579977 - RNA, 17 nt, Human
uuccacugccucugccu

SEQ ID NO: 3579978 - RNA, 22 nt, Human
uuccacuggacuugagcuuggc

SEQ ID NO: 3579979 - RNA, 21 nt, Human
uuccacuuagaaauugcauuu

SEQ ID NO: 3579980 - RNA, 17 nt, Human
uuccacuuauagccucu

SEQ ID NO: 3579981 - RNA, 19 nt, Human
uuccacuuauaggaauuga

SEQ ID NO: 3579982 - RNA, 14 nt, Human
uuccacuucuuccu

SEQ ID NO: 3579983 - RNA, 15 nt, Human
uuccacuucuuccuu

SEQ ID NO: 3579984 - RNA, 19 nt, Human
uuccacuucuuccuuucuc

SEQ ID NO: 3579985 - RNA, 17 nt, Human
uuccacuugagugucaa

SEQ ID NO: 3579986 - RNA, 18 nt, Human
uuccacuugauuuugcaa

SEQ ID NO: 3579987 - RNA, 19 nt, Human
uuccacuuggcuacacagg

SEQ ID NO: 3579988 - RNA, 19 nt, Human
uuccagaaugcuguacauc

SEQ ID NO: 3579989 - RNA, 16 nt, Human
uuccagaccugaagaa

SEQ ID NO: 3579990 - RNA, 20 nt, Human
uuccagacuuccuugagaca

SEQ ID NO: 3579991 - RNA, 17 nt, Human
uuccagagaguggcucc

SEQ ID NO: 3579992 - RNA, 18 nt, Human
uuccagagcacugcucca

SEQ ID NO: 3579993 - RNA, 18 nt, Human
uuccagauaaccagcugu

SEQ ID NO: 3579994 - RNA, 18 nt, Human
uuccagaucacugccaca

SEQ ID NO: 3579995 - RNA, 16 nt, Human
uuccagaucuuucaga

SEQ ID NO: 3579996 - RNA, 20 nt, Human
uuccagaucuuucagaaaua

SEQ ID NO: 3579997 - RNA, 20 nt, Human
uuccagaugccuucuccaga

SEQ ID NO: 3579998 - RNA, 14 nt, Human
uuccagauguggau

SEQ ID NO: 3579999 - RNA, 13 nt, Human
uuccugaauccaa

SEQ ID NO: 3580000 - RNA, 22 nt, Human
uuccugaauucuauuugcuggg

SEQ ID NO: 3580001 - RNA, 22 nt, Human
uuccugacacuuuaauuaccaa

SEQ ID NO: 3580002 - RNA, 14 nt, Human
uuccugacccaggc

SEQ ID NO: 3580003 - RNA, 15 nt, Human
uuccugacccaggcc

SEQ ID NO: 3580004 - RNA, 22 nt, Human
uuccugacccaggccgcagcuc

SEQ ID NO: 3580005 - RNA, 11 nt, Human
uuccugagcuu

SEQ ID NO: 3580006 - RNA, 13 nt, Human
uuccugagcuugg

SEQ ID NO: 3580007 - RNA, 21 nt, Human
uuccugaggaagagggacugu

SEQ ID NO: 3580008 - RNA, 21 nt, Human
uuccugaugacccaggcugcc

SEQ ID NO: 3580009 - RNA, 15 nt, Human
uuccugaugcuucuu

SEQ ID NO: 3580010 - RNA, 23 nt, Human
uuccugaugcuucuucagagacu

SEQ ID NO: 3580011 - RNA, 19 nt, Human
uuccugaugguacaggaaa

SEQ ID NO: 3580012 - RNA, 16 nt, Human
uuccugauugguuucu

SEQ ID NO: 3580013 - RNA, 19 nt, Human
uuccugauugguuucucuu

SEQ ID NO: 3580014 - RNA, 20 nt, Human
uuccugcaacucaaggacuu

SEQ ID NO: 3580015 - RNA, 21 nt, Human
uuccugcagcagagccuggaa

SEQ ID NO: 3580016 - RNA, 14 nt, Human
uuccugcagccugg

SEQ ID NO: 3580017 - RNA, 15 nt, Human
uuccugccaccaguc

SEQ ID NO: 3580018 - RNA, 16 nt, Human
uuccugccccaggccu

SEQ ID NO: 3580019 - RNA, 18 nt, Human
uuccugccccucuuucuc

SEQ ID NO: 3580020 - RNA, 19 nt, Human
uuccugcccugcuguuuau

SEQ ID NO: 3580021 - RNA, 13 nt, Human
uuccugcccuggg

SEQ ID NO: 3580022 - RNA, 16 nt, Human
uuccugcccuuccuca

SEQ ID NO: 3580023 - RNA, 18 nt, Human
uuccugcccuuccucagu

SEQ ID NO: 3580024 - RNA, 15 nt, Human
uuccugccuggucuc

SEQ ID NO: 3580025 - RNA, 22 nt, Human
uuccugccuggucuccugcccc

SEQ ID NO: 3580026 - RNA, 20 nt, Human
uuccugcggagugaagaggg

SEQ ID NO: 3580027 - RNA, 16 nt, Human
uuccugcguccuccuc

SEQ ID NO: 3580028 - RNA, 17 nt, Human
uuccugcguccuccuca

SEQ ID NO: 3580029 - RNA, 19 nt, Human
uuccugcguccuccucacc

SEQ ID NO: 3580030 - RNA, 14 nt, Human
uuccugcugcuguc

SEQ ID NO: 3580031 - RNA, 20 nt, Human
uuccugcugcugucugggug

SEQ ID NO: 3580032 - RNA, 15 nt, Human
uuccugcuuuucccc

SEQ ID NO: 3580033 - RNA, 20 nt, Human
uuccuggacagcugugccuc

SEQ ID NO: 3580034 - RNA, 19 nt, Human
uuccuggagagucucacuc

SEQ ID NO: 3580035 - RNA, 14 nt, Human
uuccuggagcccga

SEQ ID NO: 3580036 - RNA, 20 nt, Human
uuccuggagcccgaggcacc

SEQ ID NO: 3580037 - RNA, 20 nt, Human
uuccuggcaauaguguguuc

SEQ ID NO: 3580038 - RNA, 16 nt, Human
uuccugggcacacgcu

SEQ ID NO: 3580039 - RNA, 18 nt, Human
uuccuggggcccaaaugc

SEQ ID NO: 3580040 - RNA, 17 nt, Human
uuccuggguggcuacuc

SEQ ID NO: 3580041 - RNA, 16 nt, Human
uuccugguacccagcc

SEQ ID NO: 3580042 - RNA, 18 nt, Human
uuccugguacccagccau

SEQ ID NO: 3580043 - RNA, 20 nt, Human
uuccuggugccaauuucaag

SEQ ID NO: 3580044 - RNA, 14 nt, Human
uuccuggugcugga

SEQ ID NO: 3580045 - RNA, 15 nt, Human
uuccuguagcaucuu

SEQ ID NO: 3580046 - RNA, 22 nt, Human
uuccuguagccuucuguaggaa

SEQ ID NO: 3580047 - RNA, 16 nt, Human
uuccuguauguugucc

SEQ ID NO: 3580048 - RNA, 21 nt, Human
uuccuguauuuguucccaaga

SEQ ID NO: 3580049 - RNA, 15 nt, Human
uuccuguccagagag

SEQ ID NO: 3580050 - RNA, 15 nt, Human
uuccuguccagcucc

SEQ ID NO: 3580051 - RNA, 22 nt, Human
uuccuguccagcuccaaccugc

SEQ ID NO: 3580052 - RNA, 14 nt, Human
uuccugucccugcg

SEQ ID NO: 3580053 - RNA, 21 nt, Human
uuccuguccucuuucagcucc

SEQ ID NO: 3580054 - RNA, 24 nt, Human
uuccuguccucuuucagcuccuga

SEQ ID NO: 3580055 - RNA, 23 nt, Human
uuccuguccuucucucaccuccu

SEQ ID NO: 3580056 - RNA, 11 nt, Human
uuccugugucc

SEQ ID NO: 3580057 - RNA, 16 nt, Human
uuccuguguccaugug

SEQ ID NO: 3580058 - RNA, 17 nt, Human
uuccuguguguacucug

SEQ ID NO: 3580059 - RNA, 21 nt, Human
uuccuguguguacucugucca

SEQ ID NO: 3580060 - RNA, 21 nt, Human
uuccuguucagcauucuuagc

SEQ ID NO: 3580061 - RNA, 17 nt, Human
uuccuguucccaugaga

SEQ ID NO: 3580062 - RNA, 20 nt, Human
uuccuguucuuaagacguga

SEQ ID NO: 3580063 - RNA, 19 nt, Human
uuccuguuggauuuguuua

SEQ ID NO: 3580064 - RNA, 18 nt, Human
uuccuguuucugaaaaga

SEQ ID NO: 3580065 - RNA, 20 nt, Human
uuccuguuucugaaaagaaa

SEQ ID NO: 3580066 - RNA, 14 nt, Human
uuccuguuuguaca

SEQ ID NO: 3580067 - RNA, 19 nt, Human
uuccuguuuuucacauuuu

SEQ ID NO: 3580068 - RNA, 17 nt, Human
uuccuuaaacugugugg

SEQ ID NO: 3580069 - RNA, 18 nt, Human
uuccuuacagaacuacuu

SEQ ID NO: 3580070 - RNA, 23 nt, Human
uuccuuaccuuuaccccaucccu

SEQ ID NO: 3580071 - RNA, 14 nt, Human
uuccuuagcauugu

SEQ ID NO: 3580072 - RNA, 20 nt, Human
uuccuuagcuuagaccucag

SEQ ID NO: 3580073 - RNA, 22 nt, Human
uuccuuagcuuagaccucagcc

SEQ ID NO: 3580074 - RNA, 22 nt, Human
uuccuuagguuuuuuuccuucu

SEQ ID NO: 3580075 - RNA, 23 nt, Human
uuccuuagguuuuuuuccuucug

SEQ ID NO: 3580076 - RNA, 17 nt, Human
uuccuucacauccugug

SEQ ID NO: 3580077 - RNA, 21 nt, Human
uuccuucagagagcagugcuu

SEQ ID NO: 3580078 - RNA, 19 nt, Human
uuccuucagcacuuuagaa

SEQ ID NO: 3580079 - RNA, 14 nt, Human
uuccuucaggguga

SEQ ID NO: 3580080 - RNA, 23 nt, Human
uuccuucagugccuuauggaaca

SEQ ID NO: 3580081 - RNA, 14 nt, Human
uuccuuccagccca

SEQ ID NO: 3580082 - RNA, 21 nt, Human
uuccuucccacccaucgcugu

SEQ ID NO: 3580083 - RNA, 22 nt, Human
uuccuucccgccagagggcuug

SEQ ID NO: 3580084 - RNA, 13 nt, Human
uuccuucccuggc

SEQ ID NO: 3580085 - RNA, 14 nt, Human
uuccuucccuggcu

SEQ ID NO: 3580086 - RNA, 16 nt, Human
uuccuucccugugccu

SEQ ID NO: 3580087 - RNA, 12 nt, Human
uuccuuccgcuu

SEQ ID NO: 3580088 - RNA, 12 nt, Human
uuccuuccuaaa

SEQ ID NO: 3580089 - RNA, 17 nt, Human
uuccuuccuaaaauaau

SEQ ID NO: 3580090 - RNA, 13 nt, Human
uuccuuccucuga

SEQ ID NO: 3580091 - RNA, 17 nt, Human
uuccuuccucugagccu

SEQ ID NO: 3580092 - RNA, 16 nt, Human
uuccuuccuucccugg

SEQ ID NO: 3580093 - RNA, 16 nt, Human
uuccuucucugaacac

SEQ ID NO: 3580094 - RNA, 13 nt, Human
uuccuucugaagu

SEQ ID NO: 3580095 - RNA, 13 nt, Human
uuccuucuggccu

SEQ ID NO: 3580096 - RNA, 17 nt, Human
uuccuucugugaaagua

SEQ ID NO: 3580097 - RNA, 17 nt, Human
uuccuucuugccuucag

SEQ ID NO: 3580098 - RNA, 13 nt, Human
uuccuucuuugau

SEQ ID NO: 3580099 - RNA, 20 nt, Human
uuccuucuuugcccuuuacu

SEQ ID NO: 3580100 - RNA, 22 nt, Human
uuccuugaccugcauuguaaau

SEQ ID NO: 3580101 - RNA, 19 nt, Human
uuccuugaccuuccucugg

SEQ ID NO: 3580102 - RNA, 20 nt, Human
uuccuugaggggagccagga

SEQ ID NO: 3580103 - RNA, 15 nt, Human
uuccuugauaauguu

SEQ ID NO: 3580104 - RNA, 13 nt, Human
uuccuugaucauu

SEQ ID NO: 3580105 - RNA, 14 nt, Human
uuccuugccagucu

SEQ ID NO: 3580106 - RNA, 15 nt, Human
uuccuugccagucuu

SEQ ID NO: 3580107 - RNA, 13 nt, Human
uuccuugccugca

SEQ ID NO: 3580108 - RNA, 13 nt, Human
uuccuugcucucc

SEQ ID NO: 3580109 - RNA, 18 nt, Human
uuccuugcucugcacccc

SEQ ID NO: 3580110 - RNA, 20 nt, Human
uuccuugcuguccuaggcca

SEQ ID NO: 3580111 - RNA, 15 nt, Human
uuccuuggggcaggc

SEQ ID NO: 3580112 - RNA, 18 nt, Human
uuccuuguagccuuuuga

SEQ ID NO: 3580113 - RNA, 15 nt, Human
uuccuuguauuuaaa

SEQ ID NO: 3580114 - RNA, 18 nt, Human
uuccuuguauuuaaauau

SEQ ID NO: 3580115 - RNA, 16 nt, Human
uuccuugucacuggua

SEQ ID NO: 3580116 - RNA, 13 nt, Human
uuccuuuauaaug

SEQ ID NO: 3580117 - RNA, 19 nt, Human
uuccuuuaugugaauuuuu

SEQ ID NO: 3580118 - RNA, 16 nt, Human
uuccuuucauuuacug

SEQ ID NO: 3580119 - RNA, 14 nt, Human
uuccuuucccaagc

SEQ ID NO: 3580120 - RNA, 18 nt, Human
uuccuuucccuuuagcac

SEQ ID NO: 3580121 - RNA, 23 nt, Human
uuccuuuccuguguguacucugu

SEQ ID NO: 3580122 - RNA, 14 nt, Human
uuccuuuccuuuuc

SEQ ID NO: 3580123 - RNA, 13 nt, Human
uuccuuucucacc

SEQ ID NO: 3580124 - RNA, 12 nt, Human
uuccuuucucag

SEQ ID NO: 3580125 - RNA, 15 nt, Human
uuccuuucucuuucu

SEQ ID NO: 3580126 - RNA, 22 nt, Human
uuccuuucucuuucucucuucc

SEQ ID NO: 3580127 - RNA, 18 nt, Human
uuccuuucuuuucccccu

SEQ ID NO: 3580128 - RNA, 22 nt, Human
uuccuuugaauccucucucugu

SEQ ID NO: 3580129 - RNA, 21 nt, Human
uuccuuuguuuuuuuuuccug

SEQ ID NO: 3580130 - RNA, 12 nt, Human
uuccuuuuaauu

SEQ ID NO: 3580131 - RNA, 18 nt, Human
uuccuuuuacuuuucuuc

SEQ ID NO: 3580132 - RNA, 22 nt, Human
uuccuuuuacuuuucuucuauu

SEQ ID NO: 3580133 - RNA, 16 nt, Human
uuccuuuucacugcug

SEQ ID NO: 3580134 - RNA, 16 nt, Human
uuccuuuucccugcuu

SEQ ID NO: 3580135 - RNA, 17 nt, Human
uuccuuuucccugcuuc

SEQ ID NO: 3580136 - RNA, 21 nt, Human
uuccuuuucuauuccuucugg

SEQ ID NO: 3580137 - RNA, 22 nt, Human
uuccuuuucuuguuuaucagca

SEQ ID NO: 3580138 - RNA, 23 nt, Human
uuccuuuugaaagaaucagucuu

SEQ ID NO: 3580139 - RNA, 23 nt, Human
uuccuuuugaacgccccccccca

SEQ ID NO: 3580140 - RNA, 17 nt, Human
uuccuuuugccgacccc

SEQ ID NO: 3580141 - RNA, 18 nt, Human
uuccuuuuuauuuauaug

SEQ ID NO: 3580142 - RNA, 15 nt, Human
uuccuuuuuuauaca

SEQ ID NO: 3580143 - RNA, 17 nt, Human
uugauguuuguggccuc

SEQ ID NO: 3580144 - RNA, 20 nt, Human
uugauguuuguggccucaga

SEQ ID NO: 3580145 - RNA, 22 nt, Human
uugauguuuguggccucagaau

SEQ ID NO: 3580146 - RNA, 23 nt, Human
uugauguuuuaaggaugcuugua

SEQ ID NO: 3580147 - RNA, 14 nt, Human
uugauuaaagauga

SEQ ID NO: 3580148 - RNA, 15 nt, Human
uugauuaaauucuug

SEQ ID NO: 3580149 - RNA, 20 nt, Human
uugauuaaauucuugcaaag

SEQ ID NO: 3580150 - RNA, 14 nt, Human
uugauuaacaaaua

SEQ ID NO: 3580151 - RNA, 15 nt, Human
uugauuaagauuuua

SEQ ID NO: 3580152 - RNA, 20 nt, Human
uugauuaagauuuuacaaaa

SEQ ID NO: 3580153 - RNA, 11 nt, Human
uugauuaaggc

SEQ ID NO: 3580154 - RNA, 18 nt, Human
uugauuaauccagaauaa

SEQ ID NO: 3580155 - RNA, 14 nt, Human
uugauuacagugca

SEQ ID NO: 3580156 - RNA, 17 nt, Human
uugauuacagugcagug

SEQ ID NO: 3580157 - RNA, 16 nt, Human
uugauuaguuuucuug

SEQ ID NO: 3580158 - RNA, 21 nt, Human
uugauuauccauauugaguca

SEQ ID NO: 3580159 - RNA, 17 nt, Human
uugauuauucaguguca

SEQ ID NO: 3580160 - RNA, 13 nt, Human
uugauuauuugca

SEQ ID NO: 3580161 - RNA, 22 nt, Human
uugauucaaaauauuuaaaaau

SEQ ID NO: 3580162 - RNA, 14 nt, Human
uugauucacauguu

SEQ ID NO: 3580163 - RNA, 18 nt, Human
uugauucacauguuuuca

SEQ ID NO: 3580164 - RNA, 23 nt, Human
uugauucacauguuuucaaaugg

SEQ ID NO: 3580165 - RNA, 13 nt, Human
uugauucacuuca

SEQ ID NO: 3580166 - RNA, 14 nt, Human
uugauucagacagc

SEQ ID NO: 3580167 - RNA, 21 nt, Human
uugauucagacagcugccugg

SEQ ID NO: 3580168 - RNA, 16 nt, Human
uugauucagcucugca

SEQ ID NO: 3580169 - RNA, 20 nt, Human
uugauucuccuuuuaugugu

SEQ ID NO: 3580170 - RNA, 20 nt, Human
uugauucugcaguaaaucuu

SEQ ID NO: 3580171 - RNA, 13 nt, Human
uugauugauuuga

SEQ ID NO: 3580172 - RNA, 15 nt, Human
uugauugcuaaaugu

SEQ ID NO: 3580173 - RNA, 12 nt, Human
uugauugcuuuu

SEQ ID NO: 3580174 - RNA, 19 nt, Human
uugauugggaaaacauuug

SEQ ID NO: 3580175 - RNA, 17 nt, Human
uugauugggcacaucau

SEQ ID NO: 3580176 - RNA, 21 nt, Human
uugauuggugauuagguggug

SEQ ID NO: 3580177 - RNA, 15 nt, Human
uugauugucagcuac

SEQ ID NO: 3580178 - RNA, 18 nt, Human
uugauuuaaacacacaga

SEQ ID NO: 3580179 - RNA, 19 nt, Human
uugauuuaugcauggaaac

SEQ ID NO: 3580180 - RNA, 14 nt, Human
uugauuuauuaacu

SEQ ID NO: 3580181 - RNA, 14 nt, Human
uugauuucaaaguu

SEQ ID NO: 3580182 - RNA, 11 nt, Human
uugauuuccuc

SEQ ID NO: 3580183 - RNA, 17 nt, Human
uugauuucuuuccagag

SEQ ID NO: 3580184 - RNA, 13 nt, Human
uugauuugaagaa

SEQ ID NO: 3580185 - RNA, 18 nt, Human
uugauuugauugggauga

SEQ ID NO: 3580186 - RNA, 13 nt, Human
uugauuugcauug

SEQ ID NO: 3580187 - RNA, 19 nt, Human
uugauuugucacugcuuca

SEQ ID NO: 3580188 - RNA, 20 nt, Human
uugauuuguuuuagaaugau

SEQ ID NO: 3580189 - RNA, 19 nt, Human
uugauuuuaaaauguacau

SEQ ID NO: 3580190 - RNA, 23 nt, Human
uugauuuuacaauugaaaugacu

SEQ ID NO: 3580191 - RNA, 19 nt, Human
uugauuuuccaucuaaaaa

SEQ ID NO: 3580192 - RNA, 14 nt, Human
uugauuuucuggau

SEQ ID NO: 3580193 - RNA, 19 nt, Human
uugcaaaaaauguuuuugg

SEQ ID NO: 3580194 - RNA, 15 nt, Human
uugcaaaaacuacaa

SEQ ID NO: 3580195 - RNA, 13 nt, Human
uugcaaaaaucca

SEQ ID NO: 3580196 - RNA, 17 nt, Human
uugcaaaagacuaauuu

SEQ ID NO: 3580197 - RNA, 11 nt, Human
uugcaaaauuu

SEQ ID NO: 3580198 - RNA, 23 nt, Human
uugcaaaauuuccaguaccuuug

SEQ ID NO: 3580199 - RNA, 15 nt, Human
uugcaaaguacugua

SEQ ID NO: 3580200 - RNA, 13 nt, Human
uugcaaaguguau

SEQ ID NO: 3580201 - RNA, 12 nt, Human
uugcaaauaguc

SEQ ID NO: 3580202 - RNA, 17 nt, Human
uugcaaaucuugaaauu

SEQ ID NO: 3580203 - RNA, 18 nt, Human
uugcaaccaggaacagca

SEQ ID NO: 3580204 - RNA, 12 nt, Human
uugcaacuucau

SEQ ID NO: 3580205 - RNA, 17 nt, Human
uugcaacuuuguauaaa

SEQ ID NO: 3580206 - RNA, 18 nt, Human
uugcaacuuuguauaaaa

SEQ ID NO: 3580207 - RNA, 14 nt, Human
uugcaagaugugaa

SEQ ID NO: 3580208 - RNA, 16 nt, Human
uugcaagaugugaauu

SEQ ID NO: 3580209 - RNA, 20 nt, Human
uugcaagaugugaauuauug

SEQ ID NO: 3580210 - RNA, 22 nt, Human
uugcaagaugugaauuauugac

SEQ ID NO: 3580211 - RNA, 22 nt, Human
uugcaagccagauuuuccugaa

SEQ ID NO: 3580212 - RNA, 14 nt, Human
uugcaagccccucu

SEQ ID NO: 3580213 - RNA, 23 nt, Human
uugcaaggccgcuguucacccac

SEQ ID NO: 3580214 - RNA, 22 nt, Human
uugcaagggaaaagucucuugu

SEQ ID NO: 3580215 - RNA, 22 nt, Human
uugcaagggcggccuuucccac

SEQ ID NO: 3580216 - RNA, 23 nt, Human
uugcaagggcggccuuucccacu

SEQ ID NO: 3580217 - RNA, 18 nt, Human
uugcaagguaaaauuuua

SEQ ID NO: 3580218 - RNA, 15 nt, Human
uugcaagguuccaca

SEQ ID NO: 3580219 - RNA, 16 nt, Human
uugcaagucauggcug

SEQ ID NO: 3580220 - RNA, 16 nt, Human
uugcaauaacagcugc

SEQ ID NO: 3580221 - RNA, 13 nt, Human
uugcaauaauacu

SEQ ID NO: 3580222 - RNA, 14 nt, Human
uugcaauaauacuu

SEQ ID NO: 3580223 - RNA, 20 nt, Human
uugcaauaauacuucucaaa

SEQ ID NO: 3580224 - RNA, 13 nt, Human
uugcaauaaugca

SEQ ID NO: 3580225 - RNA, 17 nt, Human
uugcaauaaugcaguau

SEQ ID NO: 3580226 - RNA, 15 nt, Human
uugcaauaccaagua

SEQ ID NO: 3580227 - RNA, 15 nt, Human
uugcaauaucugaag

SEQ ID NO: 3580228 - RNA, 22 nt, Human
uugcaauaucugaagcccuccc

SEQ ID NO: 3580229 - RNA, 20 nt, Human
uugcaauccacaaucugaca

SEQ ID NO: 3580230 - RNA, 13 nt, Human
uugcaaucuauaa

SEQ ID NO: 3580231 - RNA, 23 nt, Human
uugcacaaaaagauaccuuaaaa

SEQ ID NO: 3580232 - RNA, 14 nt, Human
uugcacaaaauaua

SEQ ID NO: 3580233 - RNA, 15 nt, Human
uugcacaauuauaaa

SEQ ID NO: 3580234 - RNA, 19 nt, Human
uugcacacccacucagcuc

SEQ ID NO: 3580235 - RNA, 20 nt, Human
uugcacacuuugguaccaga

SEQ ID NO: 3580236 - RNA, 17 nt, Human
uugcacagaaguccugu

SEQ ID NO: 3580237 - RNA, 15 nt, Human
uugcacaucuuggcu

SEQ ID NO: 3580238 - RNA, 19 nt, Human
uugcacauggauucaguuu

SEQ ID NO: 3580239 - RNA, 13 nt, Human
uugcacaugucuu

SEQ ID NO: 3580240 - RNA, 16 nt, Human
uugcacauuuugauuu

SEQ ID NO: 3580241 - RNA, 14 nt, Human
uugcaccacugcac

SEQ ID NO: 3580242 - RNA, 12 nt, Human
uugcacccagcc

SEQ ID NO: 3580243 - RNA, 22 nt, Human
uugcaccccucacucuggccuc

SEQ ID NO: 3580244 - RNA, 14 nt, Human
uugcaccccuccca

SEQ ID NO: 3580245 - RNA, 16 nt, Human
uugcacccgccucucc

SEQ ID NO: 3580246 - RNA, 14 nt, Human
uugcaccugcucuc

SEQ ID NO: 3580247 - RNA, 15 nt, Human
uugcaccuuucuagu

SEQ ID NO: 3580248 - RNA, 16 nt, Human
uugcacgacgcccucu

SEQ ID NO: 3580249 - RNA, 18 nt, Human
uugcacgcccauguguga

SEQ ID NO: 3580250 - RNA, 19 nt, Human
uugcacguauuuuaauagc

SEQ ID NO: 3580251 - RNA, 20 nt, Human
uugcacguguguuuuucuau

SEQ ID NO: 3580252 - RNA, 21 nt, Human
uugcacuauugagucuucaug

SEQ ID NO: 3580253 - RNA, 20 nt, Human
uugcacucaaaucuuaagaa

SEQ ID NO: 3580254 - RNA, 16 nt, Human
uugcacuccagccugg

SEQ ID NO: 3580255 - RNA, 17 nt, Human
uugcacucuagccuggg

SEQ ID NO: 3580256 - RNA, 19 nt, Human
uugcacugaaauggaauuc

SEQ ID NO: 3580257 - RNA, 12 nt, Human
uugcacugaggg

SEQ ID NO: 3580258 - RNA, 16 nt, Human
uugcacugagggccac

SEQ ID NO: 3580259 - RNA, 17 nt, Human
uugcacuuuuucuuaau

SEQ ID NO: 3580260 - RNA, 17 nt, Human
uugcagaaaagcaccug

SEQ ID NO: 3580261 - RNA, 18 nt, Human
uugcagaaaagcaccugc

SEQ ID NO: 3580262 - RNA, 19 nt, Human
uugcagaaaauucugugcc

SEQ ID NO: 3580263 - RNA, 15 nt, Human
uugcagaaacauuuu

SEQ ID NO: 3580264 - RNA, 15 nt, Human
uugcagaagagggug

SEQ ID NO: 3580265 - RNA, 16 nt, Human
uugcagaagagggugu

SEQ ID NO: 3580266 - RNA, 21 nt, Human
uugcagaagaggguguguuug

SEQ ID NO: 3580267 - RNA, 20 nt, Human
uugcagaagggggucucuuc

SEQ ID NO: 3580268 - RNA, 19 nt, Human
uugcagaaguucuuagugu

SEQ ID NO: 3580269 - RNA, 11 nt, Human
uugcagacagg

SEQ ID NO: 3580270 - RNA, 15 nt, Human
uugcagacaggaauc

SEQ ID NO: 3580271 - RNA, 18 nt, Human
uugcagacaggaaucuua

SEQ ID NO: 3580272 - RNA, 14 nt, Human
uugcagagacagga

SEQ ID NO: 3580273 - RNA, 14 nt, Human
uugcagaugacaaa

SEQ ID NO: 3580274 - RNA, 18 nt, Human
uugcagauucauuuuucu

SEQ ID NO: 3580275 - RNA, 17 nt, Human
uugcagcacagcugaga

SEQ ID NO: 3580276 - RNA, 18 nt, Human
uugcagcacucacacagg

SEQ ID NO: 3580277 - RNA, 15 nt, Human
uugcagcccuuguga

SEQ ID NO: 3580278 - RNA, 20 nt, Human
uugcagccggcacagggucu

SEQ ID NO: 3580279 - RNA, 22 nt, Human
uugcagccugcucuagugggac

SEQ ID NO: 3580280 - RNA, 18 nt, Human
uugcagcgauuaauaaca

SEQ ID NO: 3580281 - RNA, 18 nt, Human
uugcagcucagaaccaca

SEQ ID NO: 3580282 - RNA, 9 nt, Human
uugcagcug

SEQ ID NO: 3580283 - RNA, 14 nt, Human
uugcagcugggaga

SEQ ID NO: 3580284 - RNA, 12 nt, Human
uugcagcuguuu

SEQ ID NO: 3580285 - RNA, 17 nt, Human
uugcaguagauuuucuu

SEQ ID NO: 3580286 - RNA, 14 nt, Human
uugcagucacucua

SEQ ID NO: 3580287 - RNA, 17 nt, Human
uugcagucaucagaagu

SEQ ID NO: 3580288 - RNA, 17 nt, Human
uugcagucugcuucugc

SEQ ID NO: 3580289 - RNA, 14 nt, Human
uugcuguuuuccuc

SEQ ID NO: 3580290 - RNA, 16 nt, Human
uugcuguuuuccuccc

SEQ ID NO: 3580291 - RNA, 19 nt, Human
uugcuguuuuccucccuuc

SEQ ID NO: 3580292 - RNA, 20 nt, Human
uugcuguuuuccucccuucu

SEQ ID NO: 3580293 - RNA, 18 nt, Human
uugcuuaaaccacuuaaa

SEQ ID NO: 3580294 - RNA, 12 nt, Human
uugcuuaaaugu

SEQ ID NO: 3580295 - RNA, 15 nt, Human
uugcuuaaaugugaa

SEQ ID NO: 3580296 - RNA, 16 nt, Human
uugcuuaaaugugaau

SEQ ID NO: 3580297 - RNA, 17 nt, Human
uugcuuaaaugugaauu

SEQ ID NO: 3580298 - RNA, 23 nt, Human
uugcuuacaauuuuuuuaauuuu

SEQ ID NO: 3580299 - RNA, 20 nt, Human
uugcuuaggaugugugcaug

SEQ ID NO: 3580300 - RNA, 14 nt, Human
uugcuuaguaaaau

SEQ ID NO: 3580301 - RNA, 22 nt, Human
uugcuuagucacuuauuucaua

SEQ ID NO: 3580302 - RNA, 12 nt, Human
uugcuuaugaau

SEQ ID NO: 3580303 - RNA, 18 nt, Human
uugcuuauuguuccaaga

SEQ ID NO: 3580304 - RNA, 22 nt, Human
uugcuucaccauggccuuauga

SEQ ID NO: 3580305 - RNA, 20 nt, Human
uugcuucauaaaugaagcag

SEQ ID NO: 3580306 - RNA, 20 nt, Human
uugcuucaugugucccagaa

SEQ ID NO: 3580307 - RNA, 16 nt, Human
uugcuuccccuuuugc

SEQ ID NO: 3580308 - RNA, 17 nt, Human
uugcuuccccuuuugcc

SEQ ID NO: 3580309 - RNA, 20 nt, Human
uugcuuccccuuuugccaau

SEQ ID NO: 3580310 - RNA, 23 nt, Human
uugcuucccuuuuuuccuuucca

SEQ ID NO: 3580311 - RNA, 17 nt, Human
uugcuuccuccucccca

SEQ ID NO: 3580312 - RNA, 14 nt, Human
uugcuucuguagua

SEQ ID NO: 3580313 - RNA, 21 nt, Human
uugcuucuucccuuaaaauuu

SEQ ID NO: 3580314 - RNA, 23 nt, Human
uugcuucuucccuuaaaauuuau

SEQ ID NO: 3580315 - RNA, 18 nt, Human
uugcuucuugugaaggcc

SEQ ID NO: 3580316 - RNA, 12 nt, Human
uugcuucuuucu

SEQ ID NO: 3580317 - RNA, 15 nt, Human
uugcuugaaagaaaa

SEQ ID NO: 3580318 - RNA, 18 nt, Human
uugcuugaacacaguauu

SEQ ID NO: 3580319 - RNA, 19 nt, Human
uugcuugaacacaguauuu

SEQ ID NO: 3580320 - RNA, 14 nt, Human
uugcuugagcccag

SEQ ID NO: 3580321 - RNA, 16 nt, Human
uugcuugccaaaguac

SEQ ID NO: 3580322 - RNA, 15 nt, Human
uugcuugccucucug

SEQ ID NO: 3580323 - RNA, 18 nt, Human
uugcuuguaccucuggcu

SEQ ID NO: 3580324 - RNA, 19 nt, Human
uugcuuguuauauuaagca

SEQ ID NO: 3580325 - RNA, 21 nt, Human
uugcuuguuauauuaagcaga

SEQ ID NO: 3580326 - RNA, 13 nt, Human
uugcuuguucucu

SEQ ID NO: 3580327 - RNA, 23 nt, Human
uugcuuguugggauuccugaccc

SEQ ID NO: 3580328 - RNA, 24 nt, Human
uugcuuguugggauuccugaccca

SEQ ID NO: 3580329 - RNA, 15 nt, Human
uugcuuuauuccaga

SEQ ID NO: 3580330 - RNA, 13 nt, Human
uugcuuucugaaa

SEQ ID NO: 3580331 - RNA, 14 nt, Human
uugcuuucugaaau

SEQ ID NO: 3580332 - RNA, 20 nt, Human
uugcuuucugcucagcuucu

SEQ ID NO: 3580333 - RNA, 21 nt, Human
uugcuuugaaacuagacuuga

SEQ ID NO: 3580334 - RNA, 15 nt, Human
uugcuuugaagcagu

SEQ ID NO: 3580335 - RNA, 16 nt, Human
uugcuuugaagcaguu

SEQ ID NO: 3580336 - RNA, 21 nt, Human
uugcuuugaaguagcucuuuu

SEQ ID NO: 3580337 - RNA, 19 nt, Human
uugcuuugauuuacagcaa

SEQ ID NO: 3580338 - RNA, 13 nt, Human
uugcuuugcccug

SEQ ID NO: 3580339 - RNA, 22 nt, Human
uugcuuuguaagugaaaaacau

SEQ ID NO: 3580340 - RNA, 15 nt, Human
uugcuuugugauuuu

SEQ ID NO: 3580341 - RNA, 16 nt, Human
uugcuuuguguucuuu

SEQ ID NO: 3580342 - RNA, 23 nt, Human
uugcuuuguuaaaaaaaaaaaga

SEQ ID NO: 3580343 - RNA, 14 nt, Human
uugcuuuuaaaacu

SEQ ID NO: 3580344 - RNA, 13 nt, Human
uugcuuuuaaaau

SEQ ID NO: 3580345 - RNA, 16 nt, Human
uugcuuuucaugcaaa

SEQ ID NO: 3580346 - RNA, 16 nt, Human
uugcuuuucccucuuu

SEQ ID NO: 3580347 - RNA, 18 nt, Human
uugcuuuugaaggaauac

SEQ ID NO: 3580348 - RNA, 21 nt, Human
uugcuuuugaaggaauacaau

SEQ ID NO: 3580349 - RNA, 15 nt, Human
uugcuuuuucaccag

SEQ ID NO: 3580350 - RNA, 13 nt, Human
uugcuuuuucuga

SEQ ID NO: 3580351 - RNA, 15 nt, Human
uugcuuuuugugaua

SEQ ID NO: 3580352 - RNA, 19 nt, Human
uugcuuuuuuguauugguu

SEQ ID NO: 3580353 - RNA, 15 nt, Human
uuggaaaaaauuugu

SEQ ID NO: 3580354 - RNA, 17 nt, Human
uuggaaaaagugaugga

SEQ ID NO: 3580355 - RNA, 21 nt, Human
uuggaaaaauccagaaagaaa

SEQ ID NO: 3580356 - RNA, 14 nt, Human
uuggaaaaauguuu

SEQ ID NO: 3580357 - RNA, 20 nt, Human
uuggaaaacgauuuaauuua

SEQ ID NO: 3580358 - RNA, 19 nt, Human
uuggaaaagaauacagaaa

SEQ ID NO: 3580359 - RNA, 15 nt, Human
uuggaaaauaaauca

SEQ ID NO: 3580360 - RNA, 18 nt, Human
uuggaaacacuaaauguu

SEQ ID NO: 3580361 - RNA, 20 nt, Human
uuggaaacacuaaauguuaa

SEQ ID NO: 3580362 - RNA, 17 nt, Human
uuggaaaccugcccugc

SEQ ID NO: 3580363 - RNA, 20 nt, Human
uuggaaaccugcccugccug

SEQ ID NO: 3580364 - RNA, 15 nt, Human
uuggaaacuaauaaa

SEQ ID NO: 3580365 - RNA, 17 nt, Human
uuggaaacuaauaaaau

SEQ ID NO: 3580366 - RNA, 23 nt, Human
uuggaaagaguaggaagacuuug

SEQ ID NO: 3580367 - RNA, 21 nt, Human
uuggaaagcagguggcaucuc

SEQ ID NO: 3580368 - RNA, 21 nt, Human
uuggaaaggaaugcaaagaug

SEQ ID NO: 3580369 - RNA, 14 nt, Human
uuggaaaggaccag

SEQ ID NO: 3580370 - RNA, 22 nt, Human
uuggaaaguacacucugcuguu

SEQ ID NO: 3580371 - RNA, 13 nt, Human
uuggaaauaaagu

SEQ ID NO: 3580372 - RNA, 21 nt, Human
uuggaaauaaagucagaugga

SEQ ID NO: 3580373 - RNA, 16 nt, Human
uuggaaaucaaaugua

SEQ ID NO: 3580374 - RNA, 19 nt, Human
uuggaaaucaaauguaaag

SEQ ID NO: 3580375 - RNA, 22 nt, Human
uuggaaauccuaguuuccucuc

SEQ ID NO: 3580376 - RNA, 21 nt, Human
uuggaaauggaugcaaaguac

SEQ ID NO: 3580377 - RNA, 22 nt, Human
uuggaaccacggagaucuccuu

SEQ ID NO: 3580378 - RNA, 13 nt, Human
uuggaaccagacu

SEQ ID NO: 3580379 - RNA, 18 nt, Human
uuggaagaaggggcaggu

SEQ ID NO: 3580380 - RNA, 24 nt, Human
uuggaagacuaucuuacuauuuca

SEQ ID NO: 3580381 - RNA, 13 nt, Human
uuggaagagaaag

SEQ ID NO: 3580382 - RNA, 15 nt, Human
uuggaagagaaucac

SEQ ID NO: 3580383 - RNA, 15 nt, Human
uuggaagagcagcac

SEQ ID NO: 3580384 - RNA, 20 nt, Human
uuggaagagcagcaccuccu

SEQ ID NO: 3580385 - RNA, 22 nt, Human
uuggaagagcagcaccuccuca

SEQ ID NO: 3580386 - RNA, 21 nt, Human
uuggaagauccugugaggagc

SEQ ID NO: 3580387 - RNA, 22 nt, Human
uuggaagcacaccaaucuuacu

SEQ ID NO: 3580388 - RNA, 18 nt, Human
uuggaagcuguuuggaaa

SEQ ID NO: 3580389 - RNA, 13 nt, Human
uuggaaggagcag

SEQ ID NO: 3580390 - RNA, 15 nt, Human
uuggaaggagcagaa

SEQ ID NO: 3580391 - RNA, 16 nt, Human
uuggaaguugcauggc

SEQ ID NO: 3580392 - RNA, 18 nt, Human
uuggaaguuuagcucuga

SEQ ID NO: 3580393 - RNA, 21 nt, Human
uuggaaguuuagcucugagaa

SEQ ID NO: 3580394 - RNA, 19 nt, Human
uuggaaguuuguguucugu

SEQ ID NO: 3580395 - RNA, 13 nt, Human
uuggaauacuuuu

SEQ ID NO: 3580396 - RNA, 13 nt, Human
uuggaauauuaaa

SEQ ID NO: 3580397 - RNA, 15 nt, Human
uuggaaucuagaaga

SEQ ID NO: 3580398 - RNA, 17 nt, Human
uuggaaugggcagcuca

SEQ ID NO: 3580399 - RNA, 16 nt, Human
uuggaauuaaaacaau

SEQ ID NO: 3580400 - RNA, 17 nt, Human
uuggaauuaaccuggug

SEQ ID NO: 3580401 - RNA, 23 nt, Human
uuggaauuagaacccuugcacag

SEQ ID NO: 3580402 - RNA, 15 nt, Human
uuggaauugucuuua

SEQ ID NO: 3580403 - RNA, 22 nt, Human
uuggaauuuguaaccucagcuc

SEQ ID NO: 3580404 - RNA, 21 nt, Human
uuggacaaaugugaagaugca

SEQ ID NO: 3580405 - RNA, 22 nt, Human
uuggacaaaugugaagaugcau

SEQ ID NO: 3580406 - RNA, 23 nt, Human
uuggacaaucaugaaauaugcau

SEQ ID NO: 3580407 - RNA, 18 nt, Human
uuggacagcaaaaccauu

SEQ ID NO: 3580408 - RNA, 23 nt, Human
uuggacauguccaugaccagaag

SEQ ID NO: 3580409 - RNA, 15 nt, Human
uuggacauuuuaugu

SEQ ID NO: 3580410 - RNA, 14 nt, Human
uuggaccccagcug

SEQ ID NO: 3580411 - RNA, 18 nt, Human
uuggacccugaggcccag

SEQ ID NO: 3580412 - RNA, 21 nt, Human
uuggacccugaggcccagagg

SEQ ID NO: 3580413 - RNA, 19 nt, Human
uuggaccuaaauggccuca

SEQ ID NO: 3580414 - RNA, 17 nt, Human
uuggaccucugcucuga

SEQ ID NO: 3580415 - RNA, 15 nt, Human
uuggacgcacacagc

SEQ ID NO: 3580416 - RNA, 16 nt, Human
uuggacgcacacagcu

SEQ ID NO: 3580417 - RNA, 23 nt, Human
uuggacuaaaugccuaguuuuua

SEQ ID NO: 3580418 - RNA, 12 nt, Human
uuggacuaugga

SEQ ID NO: 3580419 - RNA, 14 nt, Human
uuggacuccaucuc

SEQ ID NO: 3580420 - RNA, 18 nt, Human
uuggacucuccccucuua

SEQ ID NO: 3580421 - RNA, 17 nt, Human
uuggacucuugcucuuu

SEQ ID NO: 3580422 - RNA, 15 nt, Human
uuggacugacauuua

SEQ ID NO: 3580423 - RNA, 13 nt, Human
uuggacuugagga

SEQ ID NO: 3580424 - RNA, 12 nt, Human
uuggacuuuguu

SEQ ID NO: 3580425 - RNA, 14 nt, Human
uuggacuuuguuac

SEQ ID NO: 3580426 - RNA, 17 nt, Human
uuggagaagaacugaaa

SEQ ID NO: 3580427 - RNA, 22 nt, Human
uuggagaagaacugaaaucaua

SEQ ID NO: 3580428 - RNA, 18 nt, Human
uuggagaagguuaucaaa

SEQ ID NO: 3580429 - RNA, 13 nt, Human
uuggagaauuuag

SEQ ID NO: 3580430 - RNA, 22 nt, Human
uuggagacccgccuggcuaaca

SEQ ID NO: 3580431 - RNA, 13 nt, Human
uuggagacucugu

SEQ ID NO: 3580432 - RNA, 16 nt, Human
uuggagacuuucuuua

SEQ ID NO: 3580433 - RNA, 13 nt, Human
uugguuuuaaaau

SEQ ID NO: 3580434 - RNA, 22 nt, Human
uugguuuuaauugaaggaaaga

SEQ ID NO: 3580435 - RNA, 19 nt, Human
uugguuuuaugaugacgua

SEQ ID NO: 3580436 - RNA, 14 nt, Human
uugguuuucuucuu

SEQ ID NO: 3580437 - RNA, 18 nt, Human
uugguuuuuaaaacccag

SEQ ID NO: 3580438 - RNA, 16 nt, Human
uuguaaaaaaaaaugc

SEQ ID NO: 3580439 - RNA, 20 nt, Human
uuguaaaaacagcauugcuu

SEQ ID NO: 3580440 - RNA, 21 nt, Human
uuguaaaaacagcauugcuuu

SEQ ID NO: 3580441 - RNA, 14 nt, Human
uuguaaaacaggua

SEQ ID NO: 3580442 - RNA, 15 nt, Human
uuguaaaacagguag

SEQ ID NO: 3580443 - RNA, 21 nt, Human
uuguaaaagaacaguaaacau

SEQ ID NO: 3580444 - RNA, 19 nt, Human
uuguaaaagcauuuuguaa

SEQ ID NO: 3580445 - RNA, 20 nt, Human
uuguaaaagcauuuuguaau

SEQ ID NO: 3580446 - RNA, 21 nt, Human
uuguaaaauagcuuguauagu

SEQ ID NO: 3580447 - RNA, 17 nt, Human
uuguaaaaugacaauca

SEQ ID NO: 3580448 - RNA, 20 nt, Human
uuguaaaaugacaaucaugu

SEQ ID NO: 3580449 - RNA, 22 nt, Human
uuguaaaaugacaaucaugugu

SEQ ID NO: 3580450 - RNA, 14 nt, Human
uuguaaacaaacuc

SEQ ID NO: 3580451 - RNA, 18 nt, Human
uuguaaacguuucaguaa

SEQ ID NO: 3580452 - RNA, 14 nt, Human
uuguaaacuguacu

SEQ ID NO: 3580453 - RNA, 15 nt, Human
uuguaaacuuugaaa

SEQ ID NO: 3580454 - RNA, 17 nt, Human
uuguaaagaaaaauauu

SEQ ID NO: 3580455 - RNA, 18 nt, Human
uuguaaagaaauuuacua

SEQ ID NO: 3580456 - RNA, 16 nt, Human
uuguaaaggaauuuaa

SEQ ID NO: 3580457 - RNA, 16 nt, Human
uuguaaagugaagaau

SEQ ID NO: 3580458 - RNA, 22 nt, Human
uuguaaaguguggucccaacag

SEQ ID NO: 3580459 - RNA, 21 nt, Human
uuguaaaguugguuggauaag

SEQ ID NO: 3580460 - RNA, 15 nt, Human
uuguaaauaagagau

SEQ ID NO: 3580461 - RNA, 16 nt, Human
uuguaaauaagagauu

SEQ ID NO: 3580462 - RNA, 14 nt, Human
uuguaaauacacca

SEQ ID NO: 3580463 - RNA, 13 nt, Human
uuguaaauauuua

SEQ ID NO: 3580464 - RNA, 11 nt, Human
uuguaaaugug

SEQ ID NO: 3580465 - RNA, 14 nt, Human
uuguaaaugugcuu

SEQ ID NO: 3580466 - RNA, 12 nt, Human
uuguaaauguua

SEQ ID NO: 3580467 - RNA, 17 nt, Human
uuguaaauguuauuucu

SEQ ID NO: 3580468 - RNA, 15 nt, Human
uuguaaauuaacuuu

SEQ ID NO: 3580469 - RNA, 16 nt, Human
uuguaaauuaacuuuu

SEQ ID NO: 3580470 - RNA, 23 nt, Human
uuguaaauuaacuuuuauaaacu

SEQ ID NO: 3580471 - RNA, 14 nt, Human
uuguaaauuaaucu

SEQ ID NO: 3580472 - RNA, 16 nt, Human
uuguaaauuauauuug

SEQ ID NO: 3580473 - RNA, 20 nt, Human
uuguaaauuauauuugugcu

SEQ ID NO: 3580474 - RNA, 12 nt, Human
uuguaaauuggc

SEQ ID NO: 3580475 - RNA, 13 nt, Human
uuguaaauuggca

SEQ ID NO: 3580476 - RNA, 18 nt, Human
uuguaaauuggcauggaa

SEQ ID NO: 3580477 - RNA, 13 nt, Human
uuguaaauuguca

SEQ ID NO: 3580478 - RNA, 19 nt, Human
uuguaaauuuaugugaugg

SEQ ID NO: 3580479 - RNA, 17 nt, Human
uuguaacaagaaaacau

SEQ ID NO: 3580480 - RNA, 15 nt, Human
uuguaacaagaaaau

SEQ ID NO: 3580481 - RNA, 15 nt, Human
uuguaacagacauug

SEQ ID NO: 3580482 - RNA, 16 nt, Human
uuguaacagacauugu

SEQ ID NO: 3580483 - RNA, 23 nt, Human
uuguaacauccaauaggaaugcu

SEQ ID NO: 3580484 - RNA, 21 nt, Human
uuguaacauucuauuucaacu

SEQ ID NO: 3580485 - RNA, 15 nt, Human
uuguaacguugcugu

SEQ ID NO: 3580486 - RNA, 20 nt, Human
uuguaacguugcugugggaa

SEQ ID NO: 3580487 - RNA, 21 nt, Human
uuguaacguugcugugggaac

SEQ ID NO: 3580488 - RNA, 14 nt, Human
uuguaacuuauauu

SEQ ID NO: 3580489 - RNA, 17 nt, Human
uuguaacuuauauugaa

SEQ ID NO: 3580490 - RNA, 19 nt, Human
uuguaacuuauauugaaga

SEQ ID NO: 3580491 - RNA, 17 nt, Human
uuguaacuuggauguag

SEQ ID NO: 3580492 - RNA, 14 nt, Human
uuguaagaaauacu

SEQ ID NO: 3580493 - RNA, 17 nt, Human
uuguaagaaauacugua

SEQ ID NO: 3580494 - RNA, 21 nt, Human
uuguaagacaaagguuuuccu

SEQ ID NO: 3580495 - RNA, 22 nt, Human
uuguaagacaaagguuuuccuc

SEQ ID NO: 3580496 - RNA, 17 nt, Human
uuguaagagcuauacag

SEQ ID NO: 3580497 - RNA, 21 nt, Human
uuguaagagcuauacaguuuu

SEQ ID NO: 3580498 - RNA, 21 nt, Human
uuguaagaguguagaagcauu

SEQ ID NO: 3580499 - RNA, 13 nt, Human
uuguaagaugcug

SEQ ID NO: 3580500 - RNA, 15 nt, Human
uuguaagauuuugaa

SEQ ID NO: 3580501 - RNA, 16 nt, Human
uuguaagauuuugaaa

SEQ ID NO: 3580502 - RNA, 17 nt, Human
uuguaagauuuugaaaa

SEQ ID NO: 3580503 - RNA, 19 nt, Human
uuguaagauuuugaaaacu

SEQ ID NO: 3580504 - RNA, 16 nt, Human
uuguaagcguauggcu

SEQ ID NO: 3580505 - RNA, 21 nt, Human
uuguaagucaguguugagaug

SEQ ID NO: 3580506 - RNA, 13 nt, Human
uuguaaguuucag

SEQ ID NO: 3580507 - RNA, 18 nt, Human
uuguaaguuucaggugac

SEQ ID NO: 3580508 - RNA, 13 nt, Human
uuguaauaagcaa

SEQ ID NO: 3580509 - RNA, 20 nt, Human
uuguaauaagcaaucaaggu

SEQ ID NO: 3580510 - RNA, 14 nt, Human
uuguaauauguaaa

SEQ ID NO: 3580511 - RNA, 15 nt, Human
uuguaauauguaaau

SEQ ID NO: 3580512 - RNA, 14 nt, Human
uuguaauauuuugu

SEQ ID NO: 3580513 - RNA, 18 nt, Human
uuguaauauuuuguauua

SEQ ID NO: 3580514 - RNA, 14 nt, Human
uuguaauauuuuua

SEQ ID NO: 3580515 - RNA, 20 nt, Human
uuguaaucguuaugugugua

SEQ ID NO: 3580516 - RNA, 22 nt, Human
uuguaaugaauuccuagaauua

SEQ ID NO: 3580517 - RNA, 13 nt, Human
uuguaaugcugca

SEQ ID NO: 3580518 - RNA, 15 nt, Human
uuguaauguaacugc

SEQ ID NO: 3580519 - RNA, 20 nt, Human
uuguaauguaacugcucuug

SEQ ID NO: 3580520 - RNA, 15 nt, Human
uuguaaugucuugag

SEQ ID NO: 3580521 - RNA, 21 nt, Human
uuguaaugugugaaaaagaug

SEQ ID NO: 3580522 - RNA, 21 nt, Human
uuguaauuaauaauagauugu

SEQ ID NO: 3580523 - RNA, 15 nt, Human
uuguaauuaugauuu

SEQ ID NO: 3580524 - RNA, 14 nt, Human
uuguaauuauugug

SEQ ID NO: 3580525 - RNA, 17 nt, Human
uuguaauucuucaguug

SEQ ID NO: 3580526 - RNA, 17 nt, Human
uuguaauugcuuacauu

SEQ ID NO: 3580527 - RNA, 22 nt, Human
uuguaauugcuuuuuuaaauau

SEQ ID NO: 3580528 - RNA, 13 nt, Human
uuguaauuuugaa

SEQ ID NO: 3580529 - RNA, 23 nt, Human
uuguaauuuuuuuaauuuacaaa

SEQ ID NO: 3580530 - RNA, 22 nt, Human
uuguacaaaaaaaaaguuuuau

SEQ ID NO: 3580531 - RNA, 18 nt, Human
uuguacaaaauuaagcaa

SEQ ID NO: 3580532 - RNA, 20 nt, Human
uuguacaaaauuaagcaaau

SEQ ID NO: 3580533 - RNA, 13 nt, Human
uuguacaaaguau

SEQ ID NO: 3580534 - RNA, 14 nt, Human
uuguacaaauaaag

SEQ ID NO: 3580535 - RNA, 23 nt, Human
uuguacaauugaacuuaaauaaa

SEQ ID NO: 3580536 - RNA, 13 nt, Human
uuguacacuuuuu

SEQ ID NO: 3580537 - RNA, 15 nt, Human
uuguacacuuuuuug

SEQ ID NO: 3580538 - RNA, 17 nt, Human
uuguacagaauauuucu

SEQ ID NO: 3580539 - RNA, 16 nt, Human
uuguacagacaacaaa

SEQ ID NO: 3580540 - RNA, 18 nt, Human
uuguacagacaacaaacc

SEQ ID NO: 3580541 - RNA, 13 nt, Human
uuguacagcccag

SEQ ID NO: 3580542 - RNA, 21 nt, Human
uuguacagcguuuuaaaagaa

SEQ ID NO: 3580543 - RNA, 16 nt, Human
uuguacagcuguuuaa

SEQ ID NO: 3580544 - RNA, 16 nt, Human
uuguacaguuugcugu

SEQ ID NO: 3580545 - RNA, 17 nt, Human
uuguacaguuugcugua

SEQ ID NO: 3580546 - RNA, 18 nt, Human
uuguacaguuuguuuaca

SEQ ID NO: 3580547 - RNA, 13 nt, Human
uuguacauaaaca

SEQ ID NO: 3580548 - RNA, 16 nt, Human
uuguacauaguuauuu

SEQ ID NO: 3580549 - RNA, 18 nt, Human
uuguacauauguaaaaua

SEQ ID NO: 3580550 - RNA, 13 nt, Human
uuguacaugaaau

SEQ ID NO: 3580551 - RNA, 20 nt, Human
uuguacauuuaugauuuaau

SEQ ID NO: 3580552 - RNA, 20 nt, Human
uuguacauuugggaguuuuu

SEQ ID NO: 3580553 - RNA, 15 nt, Human
uuguaccaaaauuuu

SEQ ID NO: 3580554 - RNA, 12 nt, Human
uuguaccaguga

SEQ ID NO: 3580555 - RNA, 22 nt, Human
uuguaccagugaauuuuugcaa

SEQ ID NO: 3580556 - RNA, 21 nt, Human
uuguaccccccaaccccugag

SEQ ID NO: 3580557 - RNA, 16 nt, Human
uuguaccgcaauguga

SEQ ID NO: 3580558 - RNA, 13 nt, Human
uuguaccugguga

SEQ ID NO: 3580559 - RNA, 21 nt, Human
uuguacgacgucagauguuua

SEQ ID NO: 3580560 - RNA, 16 nt, Human
uuguacuaaagccaaa

SEQ ID NO: 3580561 - RNA, 19 nt, Human
uuguacuauuuaacugacu

SEQ ID NO: 3580562 - RNA, 14 nt, Human
uuguacugaauuuu

SEQ ID NO: 3580563 - RNA, 12 nt, Human
uuguacuguaaa

SEQ ID NO: 3580564 - RNA, 24 nt, Human
uuguacuguuuaauguucugugau

SEQ ID NO: 3580565 - RNA, 15 nt, Human
uuguacuuuaaaaau

SEQ ID NO: 3580566 - RNA, 19 nt, Human
uuguacuuuaucaugaaug

SEQ ID NO: 3580567 - RNA, 20 nt, Human
uuguacuuucuguuaaaaug

SEQ ID NO: 3580568 - RNA, 22 nt, Human
uuguagaacucacucugggcug

SEQ ID NO: 3580569 - RNA, 22 nt, Human
uuguagaaggguuauauuuuac

SEQ ID NO: 3580570 - RNA, 17 nt, Human
uuguagaagucacauuc

SEQ ID NO: 3580571 - RNA, 22 nt, Human
uuguagaagucacauuccugaa

SEQ ID NO: 3580572 - RNA, 14 nt, Human
uuguagaauuguua

SEQ ID NO: 3580573 - RNA, 16 nt, Human
uuguagaauuguuaua

SEQ ID NO: 3580574 - RNA, 15 nt, Human
uuguagagccagggu

SEQ ID NO: 3580575 - RNA, 20 nt, Human
uuguagauacaaucagcugc

SEQ ID NO: 3580576 - RNA, 12 nt, Human
uuguagauuuga

SEQ ID NO: 3580577 - RNA, 19 nt, Human
uuguagcagauuguuuccu

SEQ ID NO: 3580578 - RNA, 16 nt, Human
uuuccaguauuuuagu

SEQ ID NO: 3580579 - RNA, 17 nt, Human
uuuccaguuccucuuuu

SEQ ID NO: 3580580 - RNA, 21 nt, Human
uuuccauauccauagugacuu

SEQ ID NO: 3580581 - RNA, 18 nt, Human
uuuccauauggauuuucu

SEQ ID NO: 3580582 - RNA, 17 nt, Human
uuuccauauuuuuacaa

SEQ ID NO: 3580583 - RNA, 14 nt, Human
uuuccaucauaauu

SEQ ID NO: 3580584 - RNA, 16 nt, Human
uuuccaucauaauucu

SEQ ID NO: 3580585 - RNA, 23 nt, Human
uuuccaucauuaaauuuuuccuu

SEQ ID NO: 3580586 - RNA, 12 nt, Human
uuuccaucuuua

SEQ ID NO: 3580587 - RNA, 16 nt, Human
uuuccaugaaaacguu

SEQ ID NO: 3580588 - RNA, 18 nt, Human
uuuccaugaguccccugu

SEQ ID NO: 3580589 - RNA, 17 nt, Human
uuuccauguugcugcca

SEQ ID NO: 3580590 - RNA, 13 nt, Human
uuuccauuuuaua

SEQ ID NO: 3580591 - RNA, 10 nt, Human
uuucccaagc

SEQ ID NO: 3580592 - RNA, 12 nt, Human
uuucccaagcug

SEQ ID NO: 3580593 - RNA, 20 nt, Human
uuucccaaugguguuuuucu

SEQ ID NO: 3580594 - RNA, 15 nt, Human
uuucccaauuaggaa

SEQ ID NO: 3580595 - RNA, 21 nt, Human
uuucccaccccaaccugcucu

SEQ ID NO: 3580596 - RNA, 11 nt, Human
uuucccacccu

SEQ ID NO: 3580597 - RNA, 16 nt, Human
uuucccacuccaagcc

SEQ ID NO: 3580598 - RNA, 12 nt, Human
uuucccacugca

SEQ ID NO: 3580599 - RNA, 22 nt, Human
uuucccacugcacccccuccug

SEQ ID NO: 3580600 - RNA, 19 nt, Human
uuucccacuucccacccug

SEQ ID NO: 3580601 - RNA, 23 nt, Human
uuucccacuucccacccugcccc

SEQ ID NO: 3580602 - RNA, 12 nt, Human
uuucccaucugc

SEQ ID NO: 3580603 - RNA, 22 nt, Human
uuucccaucugcaccccuucuc

SEQ ID NO: 3580604 - RNA, 18 nt, Human
uuucccaugauuucaugu

SEQ ID NO: 3580605 - RNA, 21 nt, Human
uuuccccaaagucuuaaaaua

SEQ ID NO: 3580606 - RNA, 15 nt, Human
uuuccccaacagugu

SEQ ID NO: 3580607 - RNA, 18 nt, Human
uuuccccaacagugugaa

SEQ ID NO: 3580608 - RNA, 21 nt, Human
uuuccccaggggaaaaugaag

SEQ ID NO: 3580609 - RNA, 23 nt, Human
uuuccccauuuagguuucugagu

SEQ ID NO: 3580610 - RNA, 18 nt, Human
uuuccccuaucauuuauu

SEQ ID NO: 3580611 - RNA, 13 nt, Human
uuuccccucccug

SEQ ID NO: 3580612 - RNA, 16 nt, Human
uuuccccucccugggu

SEQ ID NO: 3580613 - RNA, 23 nt, Human
uuuccccuguccugauggucagc

SEQ ID NO: 3580614 - RNA, 14 nt, Human
uuuccccuuuugca

SEQ ID NO: 3580615 - RNA, 18 nt, Human
uuucccguggccccagcc

SEQ ID NO: 3580616 - RNA, 19 nt, Human
uuucccguggccccagccu

SEQ ID NO: 3580617 - RNA, 13 nt, Human
uuucccuaaaaua

SEQ ID NO: 3580618 - RNA, 20 nt, Human
uuucccuaagccaagggccu

SEQ ID NO: 3580619 - RNA, 15 nt, Human
uuucccuacucccca

SEQ ID NO: 3580620 - RNA, 15 nt, Human
uuucccucacccccu

SEQ ID NO: 3580621 - RNA, 19 nt, Human
uuucccuccacuccuuccu

SEQ ID NO: 3580622 - RNA, 23 nt, Human
uuucccucccuuccucuuuccau

SEQ ID NO: 3580623 - RNA, 13 nt, Human
uuucccugaaguu

SEQ ID NO: 3580624 - RNA, 21 nt, Human
uuucccugaaguuauguguau

SEQ ID NO: 3580625 - RNA, 14 nt, Human
uuucccugacuccu

SEQ ID NO: 3580626 - RNA, 22 nt, Human
uuucccugcuuaaugaaaagcu

SEQ ID NO: 3580627 - RNA, 14 nt, Human
uuucccuucaucug

SEQ ID NO: 3580628 - RNA, 12 nt, Human
uuucccuuccag

SEQ ID NO: 3580629 - RNA, 16 nt, Human
uuucccuucccuucca

SEQ ID NO: 3580630 - RNA, 15 nt, Human
uuucccuuccucuuc

SEQ ID NO: 3580631 - RNA, 19 nt, Human
uuucccuuccucuucggcc

SEQ ID NO: 3580632 - RNA, 13 nt, Human
uuucccuuugcca

SEQ ID NO: 3580633 - RNA, 15 nt, Human
uuucccuuugccuuc

SEQ ID NO: 3580634 - RNA, 15 nt, Human
uuuccuaaaugcagu

SEQ ID NO: 3580635 - RNA, 13 nt, Human
uuuccuaacaaaa

SEQ ID NO: 3580636 - RNA, 16 nt, Human
uuuccuaacaaaagau

SEQ ID NO: 3580637 - RNA, 17 nt, Human
uuuccuaaggcugcaag

SEQ ID NO: 3580638 - RNA, 21 nt, Human
uuuccuaauaaaguucuguac

SEQ ID NO: 3580639 - RNA, 24 nt, Human
uuuccuaauaaaguucuguacuca

SEQ ID NO: 3580640 - RNA, 20 nt, Human
uuuccuacuuauaaaguaga

SEQ ID NO: 3580641 - RNA, 23 nt, Human
uuuccuagauggcagucacugaa

SEQ ID NO: 3580642 - RNA, 21 nt, Human
uuuccuaguucuguagaaaug

SEQ ID NO: 3580643 - RNA, 17 nt, Human
uuuccuaucauguuaac

SEQ ID NO: 3580644 - RNA, 15 nt, Human
uuuccucaaauguug

SEQ ID NO: 3580645 - RNA, 19 nt, Human
uuuccucagacucuaagaa

SEQ ID NO: 3580646 - RNA, 19 nt, Human
uuuccucagcuuaucucuu

SEQ ID NO: 3580647 - RNA, 12 nt, Human
uuuccucaucug

SEQ ID NO: 3580648 - RNA, 16 nt, Human
uuuccucaucugucca

SEQ ID NO: 3580649 - RNA, 14 nt, Human
uuuccuccccagca

SEQ ID NO: 3580650 - RNA, 13 nt, Human
uuuccucccucag

SEQ ID NO: 3580651 - RNA, 17 nt, Human
uuuccucccuucugcua

SEQ ID NO: 3580652 - RNA, 19 nt, Human
uuuccucccuucugcuacu

SEQ ID NO: 3580653 - RNA, 22 nt, Human
uuuccuccgucaccucagagac

SEQ ID NO: 3580654 - RNA, 14 nt, Human
uuuccuccuuccau

SEQ ID NO: 3580655 - RNA, 15 nt, Human
uuuccuccuuuauca

SEQ ID NO: 3580656 - RNA, 12 nt, Human
uuuccuccuuuc

SEQ ID NO: 3580657 - RNA, 22 nt, Human
uuuccucgcagccucucagugc

SEQ ID NO: 3580658 - RNA, 12 nt, Human
uuuccucuccac

SEQ ID NO: 3580659 - RNA, 17 nt, Human
uuuccucucuauauuuc

SEQ ID NO: 3580660 - RNA, 17 nt, Human
uuuccucugcuuugaaa

SEQ ID NO: 3580661 - RNA, 17 nt, Human
uuuccucuuagaagaau

SEQ ID NO: 3580662 - RNA, 17 nt, Human
uuuccucuuccugccua

SEQ ID NO: 3580663 - RNA, 21 nt, Human
uuuccucuuuggucuacacug

SEQ ID NO: 3580664 - RNA, 15 nt, Human
uuuccugaaaucaag

SEQ ID NO: 3580665 - RNA, 23 nt, Human
uuuccugacagaaggacucaggu

SEQ ID NO: 3580666 - RNA, 13 nt, Human
uuuccugagcuug

SEQ ID NO: 3580667 - RNA, 18 nt, Human
uuuccugagcuuggccag

SEQ ID NO: 3580668 - RNA, 21 nt, Human
uuuccugauaaagcacagcug

SEQ ID NO: 3580669 - RNA, 19 nt, Human
uuuccuggcacugcuucca

SEQ ID NO: 3580670 - RNA, 16 nt, Human
uuuccuggcuacucca

SEQ ID NO: 3580671 - RNA, 16 nt, Human
uuuccuggugccaauu

SEQ ID NO: 3580672 - RNA, 19 nt, Human
uuuccuggugccaauuuca

SEQ ID NO: 3580673 - RNA, 23 nt, Human
uuuccuguaaaaaaaaaaaaguu

SEQ ID NO: 3580674 - RNA, 21 nt, Human
uuuccuguccucuuucagcuc

SEQ ID NO: 3580675 - RNA, 13 nt, Human
uuuccuguucagc

SEQ ID NO: 3580676 - RNA, 16 nt, Human
uuuccuguucagcauu

SEQ ID NO: 3580677 - RNA, 23 nt, Human
uuuccuuaaacuguguggacugu

SEQ ID NO: 3580678 - RNA, 14 nt, Human
uuuccuuauuugcu

SEQ ID NO: 3580679 - RNA, 21 nt, Human
uuuccuucagugccuuaugga

SEQ ID NO: 3580680 - RNA, 21 nt, Human
uuuccuucauucaacccaccu

SEQ ID NO: 3580681 - RNA, 12 nt, Human
uuuccuuccaau

SEQ ID NO: 3580682 - RNA, 21 nt, Human
uuuccuuccaaugucuggaga

SEQ ID NO: 3580683 - RNA, 11 nt, Human
uuuccuucccu

SEQ ID NO: 3580684 - RNA, 15 nt, Human
uuuccuucucaucug

SEQ ID NO: 3580685 - RNA, 14 nt, Human
uuuccuucugaagu

SEQ ID NO: 3580686 - RNA, 16 nt, Human
uuuccuugcauacaaa

SEQ ID NO: 3580687 - RNA, 23 nt, Human
uuuccuuggcucccauucacucu

SEQ ID NO: 3580688 - RNA, 19 nt, Human
uuuccuuggggcaggcagu

SEQ ID NO: 3580689 - RNA, 15 nt, Human
uuuccuugugcaaaa

SEQ ID NO: 3580690 - RNA, 17 nt, Human
uuuccuuuaugugaauu

SEQ ID NO: 3580691 - RNA, 14 nt, Human
uuuccuuucucacc

SEQ ID NO: 3580692 - RNA, 21 nt, Human
uuuccuuugugguuuuaugga

SEQ ID NO: 3580693 - RNA, 19 nt, Human
uuuccuuuuuaauaugcuu

SEQ ID NO: 3580694 - RNA, 17 nt, Human
uuuccuuuuucugauua

SEQ ID NO: 3580695 - RNA, 15 nt, Human
uuuccuuuuuuaaaa

SEQ ID NO: 3580696 - RNA, 22 nt, Human
uuuccuuuuuucccauaagaca

SEQ ID NO: 3580697 - RNA, 19 nt, Human
uuucgagaagcugcucugg

SEQ ID NO: 3580698 - RNA, 22 nt, Human
uuucgauucguuaagagagcaa

SEQ ID NO: 3580699 - RNA, 22 nt, Human
uuucgcaggauucuuccucccu

SEQ ID NO: 3580700 - RNA, 16 nt, Human
uuucgccuuuccucuc

SEQ ID NO: 3580701 - RNA, 23 nt, Human
uuucguccacagcuuccuguccc

SEQ ID NO: 3580702 - RNA, 21 nt, Human
uuucgucuguuuauaaacauu

SEQ ID NO: 3580703 - RNA, 13 nt, Human
uuucguuaacauu

SEQ ID NO: 3580704 - RNA, 15 nt, Human
uuucguuaacauuga

SEQ ID NO: 3580705 - RNA, 14 nt, Human
uuucuaaaaaacag

SEQ ID NO: 3580706 - RNA, 14 nt, Human
uuucuaaaaaguca

SEQ ID NO: 3580707 - RNA, 16 nt, Human
uuucuaaaagcuuuca

SEQ ID NO: 3580708 - RNA, 12 nt, Human
uuucuaaaaucu

SEQ ID NO: 3580709 - RNA, 21 nt, Human
uuucuaaaaucuuauaguucu

SEQ ID NO: 3580710 - RNA, 16 nt, Human
uuucuaaacagagaug

SEQ ID NO: 3580711 - RNA, 14 nt, Human
uuucuaaacuggag

SEQ ID NO: 3580712 - RNA, 17 nt, Human
uuucuaaacuggagacu

SEQ ID NO: 3580713 - RNA, 14 nt, Human
uuucuaaagcugcc

SEQ ID NO: 3580714 - RNA, 14 nt, Human
uuucuaaaggaguu

SEQ ID NO: 3580715 - RNA, 16 nt, Human
uuucuaaaggaguuua

SEQ ID NO: 3580716 - RNA, 18 nt, Human
uuucuaaaggcuaccuuu

SEQ ID NO: 3580717 - RNA, 20 nt, Human
uuucuaaaggcuaccuuugu

SEQ ID NO: 3580718 - RNA, 14 nt, Human
uuucuaaaguaaaa

SEQ ID NO: 3580719 - RNA, 22 nt, Human
uuucuaaccuugaaugcugcca

SEQ ID NO: 3580720 - RNA, 22 nt, Human
uuucuaacuacaaagguuuaaa

SEQ ID NO: 3580721 - RNA, 18 nt, Human
uuucuaacucugauguaa

SEQ ID NO: 3580722 - RNA, 22 nt, Human
uuucuaacucugauguaaauga

SEQ ID NO: 3580723 - RNA, 17 nt, Human
uuugaaagucuguccuu

SEQ ID NO: 3580724 - RNA, 19 nt, Human
uuugaaagugaauaaacuu

SEQ ID NO: 3580725 - RNA, 14 nt, Human
uuugaaauaagcua

SEQ ID NO: 3580726 - RNA, 18 nt, Human
uuugaaauaccucauguu

SEQ ID NO: 3580727 - RNA, 13 nt, Human
uuugaaauauaug

SEQ ID NO: 3580728 - RNA, 21 nt, Human
uuugaaauauauggucuaaug

SEQ ID NO: 3580729 - RNA, 15 nt, Human
uuugaaaucagcaua

SEQ ID NO: 3580730 - RNA, 21 nt, Human
uuugaaaucaguaaacacugu

SEQ ID NO: 3580731 - RNA, 17 nt, Human
uuugaaaugaaauuuaa

SEQ ID NO: 3580732 - RNA, 21 nt, Human
uuugaaaugaggucuguuuaa

SEQ ID NO: 3580733 - RNA, 23 nt, Human
uuugaaaugugguuuuccugaaa

SEQ ID NO: 3580734 - RNA, 16 nt, Human
uuugaaauguguuucu

SEQ ID NO: 3580735 - RNA, 15 nt, Human
uuugaaauuauguga

SEQ ID NO: 3580736 - RNA, 17 nt, Human
uuugaaauuaugugaca

SEQ ID NO: 3580737 - RNA, 13 nt, Human
uuugaaauucuga

SEQ ID NO: 3580738 - RNA, 16 nt, Human
uuugaaauucugaauu

SEQ ID NO: 3580739 - RNA, 18 nt, Human
uuugaaauucugaauuug

SEQ ID NO: 3580740 - RNA, 21 nt, Human
uuugaaauucugaauuugcaa

SEQ ID NO: 3580741 - RNA, 21 nt, Human
uuugaaauugaaccuuugugc

SEQ ID NO: 3580742 - RNA, 21 nt, Human
uuugaaauuguauuacaaauc

SEQ ID NO: 3580743 - RNA, 21 nt, Human
uuugaacaaugaaguugaaaa

SEQ ID NO: 3580744 - RNA, 20 nt, Human
uuugaacacgaaagaaaugu

SEQ ID NO: 3580745 - RNA, 12 nt, Human
uuugaacacugg

SEQ ID NO: 3580746 - RNA, 21 nt, Human
uuugaacuaagaaacuuuugu

SEQ ID NO: 3580747 - RNA, 17 nt, Human
uuugaagaacaugugag

SEQ ID NO: 3580748 - RNA, 17 nt, Human
uuugaagacuucaaaau

SEQ ID NO: 3580749 - RNA, 16 nt, Human
uuugaagcuaauuauu

SEQ ID NO: 3580750 - RNA, 18 nt, Human
uuugaagcuacugugugu

SEQ ID NO: 3580751 - RNA, 11 nt, Human
uuugaagcuga

SEQ ID NO: 3580752 - RNA, 13 nt, Human
uuugaaggaaaca

SEQ ID NO: 3580753 - RNA, 20 nt, Human
uuugaaggaaacaguuaaua

SEQ ID NO: 3580754 - RNA, 12 nt, Human
uuugaaggcaaa

SEQ ID NO: 3580755 - RNA, 13 nt, Human
uuugaaggcaaaa

SEQ ID NO: 3580756 - RNA, 17 nt, Human
uuugaagguuuuaagug

SEQ ID NO: 3580757 - RNA, 16 nt, Human
uuugaaguacaauugu

SEQ ID NO: 3580758 - RNA, 16 nt, Human
uuugaagucuuguaua

SEQ ID NO: 3580759 - RNA, 15 nt, Human
uuugaagugcuguuu

SEQ ID NO: 3580760 - RNA, 16 nt, Human
uuugaaguuagcuuua

SEQ ID NO: 3580761 - RNA, 18 nt, Human
uuugaauaaagaauacuu

SEQ ID NO: 3580762 - RNA, 20 nt, Human
uuugaauaaagaauacuuga

SEQ ID NO: 3580763 - RNA, 22 nt, Human
uuugaauaccauuaaaacugcu

SEQ ID NO: 3580764 - RNA, 14 nt, Human
uuugaauauggaca

SEQ ID NO: 3580765 - RNA, 14 nt, Human
uuugaauauguagu

SEQ ID NO: 3580766 - RNA, 18 nt, Human
uuugaaucacaugaauua

SEQ ID NO: 3580767 - RNA, 17 nt, Human
uuugaauccaugcuugg

SEQ ID NO: 3580768 - RNA, 20 nt, Human
uuugaaucuauuuaucuuca

SEQ ID NO: 3580769 - RNA, 20 nt, Human
uuugaaucucauaauuuaua

SEQ ID NO: 3580770 - RNA, 22 nt, Human
uuugaaucucauaauuuauaca

SEQ ID NO: 3580771 - RNA, 13 nt, Human
uuugaaucuuuaa

SEQ ID NO: 3580772 - RNA, 15 nt, Human
uuugaaucuuuaauu

SEQ ID NO: 3580773 - RNA, 15 nt, Human
uuugaaugaaaaauu

SEQ ID NO: 3580774 - RNA, 22 nt, Human
uuugaaugaaaaauuuaagcau

SEQ ID NO: 3580775 - RNA, 24 nt, Human
uuugaaugaaaaauuuaagcauug

SEQ ID NO: 3580776 - RNA, 17 nt, Human
uuugaaugauuuuucuu

SEQ ID NO: 3580777 - RNA, 22 nt, Human
uuugaaugauuuuucuuuacaa

SEQ ID NO: 3580778 - RNA, 13 nt, Human
uuugaaugcauuu

SEQ ID NO: 3580779 - RNA, 14 nt, Human
uuugaaugcauuuu

SEQ ID NO: 3580780 - RNA, 16 nt, Human
uuugaaugcauuuugu

SEQ ID NO: 3580781 - RNA, 17 nt, Human
uuugaauguaugcuuca

SEQ ID NO: 3580782 - RNA, 16 nt, Human
uuugaauguuaauuuu

SEQ ID NO: 3580783 - RNA, 18 nt, Human
uuugaauuguuuucuuua

SEQ ID NO: 3580784 - RNA, 20 nt, Human
uuugaauuuucauuuuacag

SEQ ID NO: 3580785 - RNA, 12 nt, Human
uuugacacugaa

SEQ ID NO: 3580786 - RNA, 19 nt, Human
uuugacacugaaaguuuug

SEQ ID NO: 3580787 - RNA, 21 nt, Human
uuugacacuuauagauugaaa

SEQ ID NO: 3580788 - RNA, 21 nt, Human
uuugacagaauauguuucaaa

SEQ ID NO: 3580789 - RNA, 22 nt, Human
uuugacagaauauguuucaaac

SEQ ID NO: 3580790 - RNA, 18 nt, Human
uuugacaguguugaaaau

SEQ ID NO: 3580791 - RNA, 19 nt, Human
uuugacaguguugaaaaug

SEQ ID NO: 3580792 - RNA, 13 nt, Human
uuugacaugugga

SEQ ID NO: 3580793 - RNA, 17 nt, Human
uuugaccuccucccugu

SEQ ID NO: 3580794 - RNA, 12 nt, Human
uuugaccucugc

SEQ ID NO: 3580795 - RNA, 13 nt, Human
uuugaccuuuuau

SEQ ID NO: 3580796 - RNA, 13 nt, Human
uuugacgccaucc

SEQ ID NO: 3580797 - RNA, 14 nt, Human
uuugacgccauccc

SEQ ID NO: 3580798 - RNA, 16 nt, Human
uuugacgccaucccag

SEQ ID NO: 3580799 - RNA, 14 nt, Human
uuugacuaauuuua

SEQ ID NO: 3580800 - RNA, 20 nt, Human
uuugacuguuuuuacccaua

SEQ ID NO: 3580801 - RNA, 14 nt, Human
uuugacuuaaugug

SEQ ID NO: 3580802 - RNA, 17 nt, Human
uuugacuugcaugaaga

SEQ ID NO: 3580803 - RNA, 13 nt, Human
uuugacuuuaauu

SEQ ID NO: 3580804 - RNA, 15 nt, Human
uuugacuuucuucug

SEQ ID NO: 3580805 - RNA, 12 nt, Human
uuugacuuuucu

SEQ ID NO: 3580806 - RNA, 15 nt, Human
uuugacuuuucugua

SEQ ID NO: 3580807 - RNA, 16 nt, Human
uuugagaaauuaagua

SEQ ID NO: 3580808 - RNA, 13 nt, Human
uuugagacagagu

SEQ ID NO: 3580809 - RNA, 10 nt, Human
uuugagacgg

SEQ ID NO: 3580810 - RNA, 18 nt, Human
uuugagagagcagccagg

SEQ ID NO: 3580811 - RNA, 22 nt, Human
uuugagauauuaaugcccagac

SEQ ID NO: 3580812 - RNA, 16 nt, Human
uuugagaucagccugg

SEQ ID NO: 3580813 - RNA, 17 nt, Human
uuugagaucagccuggg

SEQ ID NO: 3580814 - RNA, 14 nt, Human
uuugagaucuaaaa

SEQ ID NO: 3580815 - RNA, 18 nt, Human
uuugagauuaagaaugcc

SEQ ID NO: 3580816 - RNA, 15 nt, Human
uuugagcagggcuca

SEQ ID NO: 3580817 - RNA, 16 nt, Human
uuugagcauggguuca

SEQ ID NO: 3580818 - RNA, 15 nt, Human
uuugagcccuuguuu

SEQ ID NO: 3580819 - RNA, 16 nt, Human
uuugagccugggaaau

SEQ ID NO: 3580820 - RNA, 18 nt, Human
uuugagcuacuggauucu

SEQ ID NO: 3580821 - RNA, 14 nt, Human
uuugagcucagccc

SEQ ID NO: 3580822 - RNA, 10 nt, Human
uuugagcucc

SEQ ID NO: 3580823 - RNA, 20 nt, Human
uuugagcucugcagcccagg

SEQ ID NO: 3580824 - RNA, 19 nt, Human
uuugagcugaaaugcugca

SEQ ID NO: 3580825 - RNA, 21 nt, Human
uuugagcugaaaugcugcauu

SEQ ID NO: 3580826 - RNA, 20 nt, Human
uuugaggagcagcuucaguu

SEQ ID NO: 3580827 - RNA, 17 nt, Human
uuugaggagcauguuuu

SEQ ID NO: 3580828 - RNA, 15 nt, Human
uuugaggagugguuu

SEQ ID NO: 3580829 - RNA, 20 nt, Human
uuugaggauauauuuucacu

SEQ ID NO: 3580830 - RNA, 22 nt, Human
uuugaggauauauuuucacuuu

SEQ ID NO: 3580831 - RNA, 14 nt, Human
uuugaggcaaaaga

SEQ ID NO: 3580832 - RNA, 20 nt, Human
uuugaggcucaccagaauua

SEQ ID NO: 3580833 - RNA, 18 nt, Human
uuugagggacugccucug

SEQ ID NO: 3580834 - RNA, 21 nt, Human
uuugagggacugccucugcca

SEQ ID NO: 3580835 - RNA, 16 nt, Human
uuugaggggaaaacac

SEQ ID NO: 3580836 - RNA, 23 nt, Human
uuugaggucaaguaagaagacau

SEQ ID NO: 3580837 - RNA, 22 nt, Human
uuugaggucuguucuuuccaaa

SEQ ID NO: 3580838 - RNA, 22 nt, Human
uuugagucccuuccaggccauc

SEQ ID NO: 3580839 - RNA, 14 nt, Human
uuugagugcucuga

SEQ ID NO: 3580840 - RNA, 21 nt, Human
uuugaguggaugauguuucgu

SEQ ID NO: 3580841 - RNA, 19 nt, Human
uuugaguugauugagaaga

SEQ ID NO: 3580842 - RNA, 19 nt, Human
uuugauaaaguaguaaaaa

SEQ ID NO: 3580843 - RNA, 15 nt, Human
uuugauaaaguuucu

SEQ ID NO: 3580844 - RNA, 12 nt, Human
uuugauaauguu

SEQ ID NO: 3580845 - RNA, 14 nt, Human
uuugauaauguuaa

SEQ ID NO: 3580846 - RNA, 13 nt, Human
uuugauacauaau

SEQ ID NO: 3580847 - RNA, 19 nt, Human
uuugauacauaugugaaua

SEQ ID NO: 3580848 - RNA, 15 nt, Human
uuugauaccccuggg

SEQ ID NO: 3580849 - RNA, 18 nt, Human
uuugauacuaagcauuga

SEQ ID NO: 3580850 - RNA, 15 nt, Human
uuugauacuuauauu

SEQ ID NO: 3580851 - RNA, 19 nt, Human
uuugauagggaacugggga

SEQ ID NO: 3580852 - RNA, 18 nt, Human
uuugauaguauugugcau

SEQ ID NO: 3580853 - RNA, 16 nt, Human
uuugauauaccaaauu

SEQ ID NO: 3580854 - RNA, 22 nt, Human
uuugauauaccaaauuaaaaaa

SEQ ID NO: 3580855 - RNA, 17 nt, Human
uuugauaugugaacagu

SEQ ID NO: 3580856 - RNA, 19 nt, Human
uuugauauuaaaggaguua

SEQ ID NO: 3580857 - RNA, 18 nt, Human
uuugaucagguggggagu

SEQ ID NO: 3580858 - RNA, 18 nt, Human
uuugaucucacauuuuua

SEQ ID NO: 3580859 - RNA, 23 nt, Human
uuugaugacuggcauuuuauaga

SEQ ID NO: 3580860 - RNA, 18 nt, Human
uuugaugaggcccuccac

SEQ ID NO: 3580861 - RNA, 21 nt, Human
uuugaugagguauuuuuuccu

SEQ ID NO: 3580862 - RNA, 20 nt, Human
uuugaugcagcauuugauaa

SEQ ID NO: 3580863 - RNA, 21 nt, Human
uuugaugcagcauuugauaau

SEQ ID NO: 3580864 - RNA, 17 nt, Human
uuugaugcaugucuuuu

SEQ ID NO: 3580865 - RNA, 16 nt, Human
uuugaugccaagaaag

SEQ ID NO: 3580866 - RNA, 23 nt, Human
uuugaugcuacaggauuugaaau

SEQ ID NO: 3580867 - RNA, 19 nt, Human
uuugaugcuggagagguua

SEQ ID NO: 3580868 - RNA, 22 nt, Human
ucagagaugcaccaccaagcca

SEQ ID NO: 3580869 - RNA, 19 nt, Human
ucagagauguccauuuuua

SEQ ID NO: 3580870 - RNA, 17 nt, Human
ucagagaugugcaccca

SEQ ID NO: 3580871 - RNA, 17 nt, Human
ucagagauuuauauaaa

SEQ ID NO: 3580872 - RNA, 18 nt, Human
ucagagauuuauauaaau

SEQ ID NO: 3580873 - RNA, 17 nt, Human
ucagagcagcagugaaa

SEQ ID NO: 3580874 - RNA, 21 nt, Human
ucagagcagcagugaaaacaa

SEQ ID NO: 3580875 - RNA, 13 nt, Human
ucagagcaggacc

SEQ ID NO: 3580876 - RNA, 21 nt, Human
ucagagcaggaccucccuucc

SEQ ID NO: 3580877 - RNA, 16 nt, Human
ucagagcgcacaggga

SEQ ID NO: 3580878 - RNA, 21 nt, Human
ucagagcuaagggugggugcu

SEQ ID NO: 3580879 - RNA, 16 nt, Human
ucagagcuacuugggc

SEQ ID NO: 3580880 - RNA, 12 nt, Human
ucagagcugccc

SEQ ID NO: 3580881 - RNA, 13 nt, Human
ucagagcugcccu

SEQ ID NO: 3580882 - RNA, 16 nt, Human
ucagagcugcccucuc

SEQ ID NO: 3580883 - RNA, 17 nt, Human
ucagagcugcccucucc

SEQ ID NO: 3580884 - RNA, 23 nt, Human
ucagaggacaccuguacuggaga

SEQ ID NO: 3580885 - RNA, 22 nt, Human
ucagaggagagauagccugugg

SEQ ID NO: 3580886 - RNA, 22 nt, Human
ucagaggcccucgcugccagcu

SEQ ID NO: 3580887 - RNA, 14 nt, Human
ucagagguaucuua

SEQ ID NO: 3580888 - RNA, 23 nt, Human
ucagaggugaaagcuauaucaau

SEQ ID NO: 3580889 - RNA, 17 nt, Human
ucagagguggcucugga

SEQ ID NO: 3580890 - RNA, 19 nt, Human
ucagaguaagcugcuuuug

SEQ ID NO: 3580891 - RNA, 13 nt, Human
ucagaguagaaau

SEQ ID NO: 3580892 - RNA, 15 nt, Human
ucagaguauggagcu

SEQ ID NO: 3580893 - RNA, 16 nt, Human
ucagagucagccagga

SEQ ID NO: 3580894 - RNA, 16 nt, Human
ucagaguccaggcccc

SEQ ID NO: 3580895 - RNA, 19 nt, Human
ucagagugacauccaggag

SEQ ID NO: 3580896 - RNA, 21 nt, Human
ucagagugacauccaggagga

SEQ ID NO: 3580897 - RNA, 17 nt, Human
ucagaguggaaugcuuc

SEQ ID NO: 3580898 - RNA, 22 nt, Human
ucagaguucuauacuguaaagc

SEQ ID NO: 3580899 - RNA, 14 nt, Human
ucagaguuuucugg

SEQ ID NO: 3580900 - RNA, 15 nt, Human
ucagaguuuucuggg

SEQ ID NO: 3580901 - RNA, 15 nt, Human
ucagauaacuguuau

SEQ ID NO: 3580902 - RNA, 22 nt, Human
ucagauaagguaaaaugccaug

SEQ ID NO: 3580903 - RNA, 15 nt, Human
ucagauacaucacug

SEQ ID NO: 3580904 - RNA, 20 nt, Human
ucagauacuggauuguacuu

SEQ ID NO: 3580905 - RNA, 17 nt, Human
ucagauauaaaagacug

SEQ ID NO: 3580906 - RNA, 18 nt, Human
ucagauauauuuuucaca

SEQ ID NO: 3580907 - RNA, 23 nt, Human
ucagauauauuuuucacaguuuu

SEQ ID NO: 3580908 - RNA, 22 nt, Human
ucagauaucuuggacaaaucac

SEQ ID NO: 3580909 - RNA, 15 nt, Human
ucagauaugauucaa

SEQ ID NO: 3580910 - RNA, 18 nt, Human
ucagauaugauucaaaug

SEQ ID NO: 3580911 - RNA, 18 nt, Human
ucagauauucugcucuau

SEQ ID NO: 3580912 - RNA, 14 nt, Human
ucagauauuugcac

SEQ ID NO: 3580913 - RNA, 15 nt, Human
ucagauauuugcacc

SEQ ID NO: 3580914 - RNA, 16 nt, Human
ucagaucacuacugca

SEQ ID NO: 3580915 - RNA, 17 nt, Human
ucagaucacuacugcag

SEQ ID NO: 3580916 - RNA, 18 nt, Human
ucagaucacuacugcagu

SEQ ID NO: 3580917 - RNA, 23 nt, Human
ucagaucaguguaccauuugccu

SEQ ID NO: 3580918 - RNA, 13 nt, Human
ucagaucauggca

SEQ ID NO: 3580919 - RNA, 14 nt, Human
ucagauccagggac

SEQ ID NO: 3580920 - RNA, 18 nt, Human
ucagauccuuguuucaaa

SEQ ID NO: 3580921 - RNA, 23 nt, Human
ucagaucugacaugauuccuucc

SEQ ID NO: 3580922 - RNA, 15 nt, Human
ucagaucugccuaag

SEQ ID NO: 3580923 - RNA, 18 nt, Human
ucagaucugccuaaggac

SEQ ID NO: 3580924 - RNA, 14 nt, Human
ucagaucugucuga

SEQ ID NO: 3580925 - RNA, 19 nt, Human
ucagaucuuaauauaaauu

SEQ ID NO: 3580926 - RNA, 21 nt, Human
ucagaucuuaauauaaauuca

SEQ ID NO: 3580927 - RNA, 24 nt, Human
ucagaucuuaauauaaauucacuu

SEQ ID NO: 3580928 - RNA, 16 nt, Human
ucagaucuuucuccuu

SEQ ID NO: 3580929 - RNA, 14 nt, Human
ucagaugagaacaa

SEQ ID NO: 3580930 - RNA, 18 nt, Human
ucagaugauuuccccccu

SEQ ID NO: 3580931 - RNA, 21 nt, Human
ucagaugauuuccccccuccg

SEQ ID NO: 3580932 - RNA, 14 nt, Human
ucagaugcccagag

SEQ ID NO: 3580933 - RNA, 21 nt, Human
ucagaugcccagagggcccag

SEQ ID NO: 3580934 - RNA, 22 nt, Human
ucagaugcccagagggcccagg

SEQ ID NO: 3580935 - RNA, 14 nt, Human
ucagaugcuccaag

SEQ ID NO: 3580936 - RNA, 16 nt, Human
ucagaugcuccaagau

SEQ ID NO: 3580937 - RNA, 18 nt, Human
ucagaugcuccaagauuc

SEQ ID NO: 3580938 - RNA, 19 nt, Human
ucagaugcuccaagauucu

SEQ ID NO: 3580939 - RNA, 20 nt, Human
ucagaugcuccaagauucua

SEQ ID NO: 3580940 - RNA, 21 nt, Human
ucagaugcugugcaaauguua

SEQ ID NO: 3580941 - RNA, 22 nt, Human
ucagaugcuugcggcaaaagga

SEQ ID NO: 3580942 - RNA, 12 nt, Human
ucagauggaaaa

SEQ ID NO: 3580943 - RNA, 20 nt, Human
ucagauggaaaauucauuuu

SEQ ID NO: 3580944 - RNA, 16 nt, Human
ucagauggagcaugaa

SEQ ID NO: 3580945 - RNA, 18 nt, Human
ucagauggcagcuuuuaa

SEQ ID NO: 3580946 - RNA, 20 nt, Human
ucagaugggaggaaagagag

SEQ ID NO: 3580947 - RNA, 16 nt, Human
ucagaugucuucugcc

SEQ ID NO: 3580948 - RNA, 16 nt, Human
ucagauguggagccag

SEQ ID NO: 3580949 - RNA, 18 nt, Human
ucagauguggagccaggc

SEQ ID NO: 3580950 - RNA, 16 nt, Human
ucagauguuaaaauaa

SEQ ID NO: 3580951 - RNA, 17 nt, Human
ucagauguuuaaaacac

SEQ ID NO: 3580952 - RNA, 17 nt, Human
ucagauguuuuggucaa

SEQ ID NO: 3580953 - RNA, 14 nt, Human
ucagauuccuuccc

SEQ ID NO: 3580954 - RNA, 15 nt, Human
ucagauuccuuccca

SEQ ID NO: 3580955 - RNA, 16 nt, Human
ucagauuccuucccau

SEQ ID NO: 3580956 - RNA, 18 nt, Human
ucagauugcaugugacuc

SEQ ID NO: 3580957 - RNA, 19 nt, Human
ucagauugcaugugacucu

SEQ ID NO: 3580958 - RNA, 21 nt, Human
ucagauugcaugugacucuga

SEQ ID NO: 3580959 - RNA, 14 nt, Human
ucagauugcuuuug

SEQ ID NO: 3580960 - RNA, 18 nt, Human
ucagauuucucuuugaaa

SEQ ID NO: 3580961 - RNA, 16 nt, Human
ucagauuucugaggaa

SEQ ID NO: 3580962 - RNA, 16 nt, Human
ucagauuugcacaaaa

SEQ ID NO: 3580963 - RNA, 17 nt, Human
ucagauuugccuuauug

SEQ ID NO: 3580964 - RNA, 19 nt, Human
ucagauuuuauuauguaaa

SEQ ID NO: 3580965 - RNA, 20 nt, Human
ucagauuuuauuauguaaau

SEQ ID NO: 3580966 - RNA, 15 nt, Human
ucagauuuuccugug

SEQ ID NO: 3580967 - RNA, 16 nt, Human
ucagcaaaaagcaaaa

SEQ ID NO: 3580968 - RNA, 19 nt, Human
ucagcaaaaauauuuuaug

SEQ ID NO: 3580969 - RNA, 13 nt, Human
ucagcaaagaaaa

SEQ ID NO: 3580970 - RNA, 21 nt, Human
ucagcaaccuuucaccuuugu

SEQ ID NO: 3580971 - RNA, 16 nt, Human
ucagcaacucgcuuua

SEQ ID NO: 3580972 - RNA, 14 nt, Human
ucagcaagagagaa

SEQ ID NO: 3580973 - RNA, 21 nt, Human
ucagcaagcccuacagagcug

SEQ ID NO: 3580974 - RNA, 12 nt, Human
ucagcaaggcca

SEQ ID NO: 3580975 - RNA, 14 nt, Human
ucagcaaggccacc

SEQ ID NO: 3580976 - RNA, 20 nt, Human
ucagcaaggcgcuaacuugc

SEQ ID NO: 3580977 - RNA, 24 nt, Human
ucagcaaggcgcuaacuugcuuaa

SEQ ID NO: 3580978 - RNA, 19 nt, Human
ucagcaauauuuaaggaga

SEQ ID NO: 3580979 - RNA, 18 nt, Human
ucagcacagauaaaaagu

SEQ ID NO: 3580980 - RNA, 22 nt, Human
ucagcacagauaaaaaguggaa

SEQ ID NO: 3580981 - RNA, 21 nt, Human
ucagcacauaggguucccacg

SEQ ID NO: 3580982 - RNA, 12 nt, Human
ucagcaccaccc

SEQ ID NO: 3580983 - RNA, 13 nt, Human
ucagcaccacccu

SEQ ID NO: 3580984 - RNA, 15 nt, Human
ucagcaccacccuag

SEQ ID NO: 3580985 - RNA, 17 nt, Human
ucagcacccccuucucu

SEQ ID NO: 3580986 - RNA, 14 nt, Human
ucagcaccccuucc

SEQ ID NO: 3580987 - RNA, 17 nt, Human
ucagcaccccuuccaug

SEQ ID NO: 3580988 - RNA, 22 nt, Human
ucagcaccuacaguguacaguc

SEQ ID NO: 3580989 - RNA, 16 nt, Human
ucagcacgauuucugu

SEQ ID NO: 3580990 - RNA, 17 nt, Human
ucagcacgauuucuguu

SEQ ID NO: 3580991 - RNA, 13 nt, Human
ucagcacugaaaa

SEQ ID NO: 3580992 - RNA, 15 nt, Human
ucagcacugaaaaua

SEQ ID NO: 3580993 - RNA, 22 nt, Human
ucagcacugccugcucccaucc

SEQ ID NO: 3580994 - RNA, 12 nt, Human
ucagcacugucc

SEQ ID NO: 3580995 - RNA, 16 nt, Human
ucagcacuuggcccuu

SEQ ID NO: 3580996 - RNA, 15 nt, Human
ucagcacuugucuca

SEQ ID NO: 3580997 - RNA, 18 nt, Human
ucagcacuugucucauuu

SEQ ID NO: 3580998 - RNA, 23 nt, Human
ucagcacuugucucauuuuaaug

SEQ ID NO: 3580999 - RNA, 12 nt, Human
ucagcagagugc

SEQ ID NO: 3581000 - RNA, 12 nt, Human
ucagcagcccuc

SEQ ID NO: 3581001 - RNA, 14 nt, Human
ucagcagcccuccu

SEQ ID NO: 3581002 - RNA, 15 nt, Human
ucagcagcccuccuc

SEQ ID NO: 3581003 - RNA, 16 nt, Human
ucagcagcccuccuca

SEQ ID NO: 3581004 - RNA, 23 nt, Human
ucagcagccgccuuaagcugauc

SEQ ID NO: 3581005 - RNA, 20 nt, Human
ucagcagcgaccaccccugc

SEQ ID NO: 3581006 - RNA, 22 nt, Human
ucagcagcgaccaccccugccu

SEQ ID NO: 3581007 - RNA, 17 nt, Human
ucagcaggaagcaacga

SEQ ID NO: 3581008 - RNA, 13 nt, Human
ucagcaggcagcc

SEQ ID NO: 3581009 - RNA, 17 nt, Human
ucagcagggacuguaaa

SEQ ID NO: 3581010 - RNA, 22 nt, Human
ucagcagggacuguaaacacag

SEQ ID NO: 3581011 - RNA, 20 nt, Human
ucagcaguaccuauaaagua

SEQ ID NO: 3581012 - RNA, 22 nt, Human
ucagcuucugcugggcuggggc

SEQ ID NO: 3581013 - RNA, 23 nt, Human
ucagcuucugcugggcuggggcc

SEQ ID NO: 3581014 - RNA, 22 nt, Human
ucagcuuguaaauagcucaggu

SEQ ID NO: 3581015 - RNA, 15 nt, Human
ucagcuuucagggcc

SEQ ID NO: 3581016 - RNA, 22 nt, Human
ucagcuuugccuuccacgcugu

SEQ ID NO: 3581017 - RNA, 16 nt, Human
ucaggaaaagccucug

SEQ ID NO: 3581018 - RNA, 18 nt, Human
ucaggaaauauauaugug

SEQ ID NO: 3581019 - RNA, 13 nt, Human
ucaggaacacucu

SEQ ID NO: 3581020 - RNA, 20 nt, Human
ucaggaaccucgaguacugu

SEQ ID NO: 3581021 - RNA, 21 nt, Human
ucaggaaccucgaguacugug

SEQ ID NO: 3581022 - RNA, 22 nt, Human
ucaggaaccucgaguacugugg

SEQ ID NO: 3581023 - RNA, 13 nt, Human
ucaggaaccugga

SEQ ID NO: 3581024 - RNA, 16 nt, Human
ucaggaaccuggacca

SEQ ID NO: 3581025 - RNA, 14 nt, Human
ucaggaagcucagg

SEQ ID NO: 3581026 - RNA, 17 nt, Human
ucaggaagcucagggcc

SEQ ID NO: 3581027 - RNA, 16 nt, Human
ucaggaaggaugagca

SEQ ID NO: 3581028 - RNA, 17 nt, Human
ucaggaaggaugagcau

SEQ ID NO: 3581029 - RNA, 20 nt, Human
ucaggaaggaugagcauuua

SEQ ID NO: 3581030 - RNA, 19 nt, Human
ucaggaaucggaauccugu

SEQ ID NO: 3581031 - RNA, 17 nt, Human
ucaggacacaggccugu

SEQ ID NO: 3581032 - RNA, 12 nt, Human
ucaggacacuaa

SEQ ID NO: 3581033 - RNA, 13 nt, Human
ucaggaccaggca

SEQ ID NO: 3581034 - RNA, 19 nt, Human
ucaggacccagaggaaggg

SEQ ID NO: 3581035 - RNA, 22 nt, Human
ucaggacccucgcuggccccca

SEQ ID NO: 3581036 - RNA, 19 nt, Human
ucaggacgagaaugagggu

SEQ ID NO: 3581037 - RNA, 14 nt, Human
ucaggacucagaag

SEQ ID NO: 3581038 - RNA, 13 nt, Human
ucaggacuccagc

SEQ ID NO: 3581039 - RNA, 14 nt, Human
ucaggacuccagcc

SEQ ID NO: 3581040 - RNA, 15 nt, Human
ucaggacugggagcc

SEQ ID NO: 3581041 - RNA, 22 nt, Human
ucaggacugggagcccccagcc

SEQ ID NO: 3581042 - RNA, 16 nt, Human
ucaggacuugaaagaa

SEQ ID NO: 3581043 - RNA, 17 nt, Human
ucaggacuugaaagaaa

SEQ ID NO: 3581044 - RNA, 15 nt, Human
ucaggagaggggcag

SEQ ID NO: 3581045 - RNA, 17 nt, Human
ucaggagaggggcagaa

SEQ ID NO: 3581046 - RNA, 20 nt, Human
ucaggagaggggcagaacag

SEQ ID NO: 3581047 - RNA, 21 nt, Human
ucaggagcagccucagaacaa

SEQ ID NO: 3581048 - RNA, 22 nt, Human
ucaggagcagccucagaacaaa

SEQ ID NO: 3581049 - RNA, 14 nt, Human
ucaggagcccuggg

SEQ ID NO: 3581050 - RNA, 19 nt, Human
ucaggagcccugggaggcu

SEQ ID NO: 3581051 - RNA, 23 nt, Human
ucaggagccgaagcccaggggcc

SEQ ID NO: 3581052 - RNA, 18 nt, Human
ucaggagcuccauacaca

SEQ ID NO: 3581053 - RNA, 13 nt, Human
ucaggaggcaggg

SEQ ID NO: 3581054 - RNA, 12 nt, Human
ucaggaggcuga

SEQ ID NO: 3581055 - RNA, 22 nt, Human
ucaggaggcugaggcagaagaa

SEQ ID NO: 3581056 - RNA, 15 nt, Human
ucaggaggcugaggg

SEQ ID NO: 3581057 - RNA, 20 nt, Human
ucaggagucccaaggaaagc

SEQ ID NO: 3581058 - RNA, 22 nt, Human
ucaggagucucugguagccugc

SEQ ID NO: 3581059 - RNA, 20 nt, Human
ucaggaguuagaggccagcc

SEQ ID NO: 3581060 - RNA, 22 nt, Human
ucaggauauccuuaucagagcu

SEQ ID NO: 3581061 - RNA, 22 nt, Human
ucaggauccaagcuaagcacug

SEQ ID NO: 3581062 - RNA, 15 nt, Human
ucaggauugcgagag

SEQ ID NO: 3581063 - RNA, 20 nt, Human
ucaggauugcgagagaugug

SEQ ID NO: 3581064 - RNA, 21 nt, Human
ucaggauugcgagagaugugu

SEQ ID NO: 3581065 - RNA, 22 nt, Human
ucaggauugcgagagaugugug

SEQ ID NO: 3581066 - RNA, 18 nt, Human
ucaggauuuccucuugaa

SEQ ID NO: 3581067 - RNA, 16 nt, Human
ucaggcaaagaaaaug

SEQ ID NO: 3581068 - RNA, 19 nt, Human
ucaggcaauucuccugccu

SEQ ID NO: 3581069 - RNA, 21 nt, Human
ucaggcacacaaggggcccuu

SEQ ID NO: 3581070 - RNA, 13 nt, Human
ucaggcacacagc

SEQ ID NO: 3581071 - RNA, 14 nt, Human
ucaggcacacagcu

SEQ ID NO: 3581072 - RNA, 15 nt, Human
ucaggcacaggucag

SEQ ID NO: 3581073 - RNA, 18 nt, Human
ucaggcaccagucccugu

SEQ ID NO: 3581074 - RNA, 22 nt, Human
ucaggcacuagccuuuggcucu

SEQ ID NO: 3581075 - RNA, 19 nt, Human
ucaggcacugggcaugagg

SEQ ID NO: 3581076 - RNA, 13 nt, Human
ucaggcagcucaa

SEQ ID NO: 3581077 - RNA, 13 nt, Human
ucaggcaggaagg

SEQ ID NO: 3581078 - RNA, 21 nt, Human
ucaggcaggaagggcaggaag

SEQ ID NO: 3581079 - RNA, 19 nt, Human
ucaggcauaggccugggug

SEQ ID NO: 3581080 - RNA, 17 nt, Human
ucaggcaugaacaugua

SEQ ID NO: 3581081 - RNA, 19 nt, Human
ucaggcaugaacauguacu

SEQ ID NO: 3581082 - RNA, 14 nt, Human
ucaggcaugccugu

SEQ ID NO: 3581083 - RNA, 17 nt, Human
ucaggcaugccugugug

SEQ ID NO: 3581084 - RNA, 20 nt, Human
ucaggccaaacucaccugcc

SEQ ID NO: 3581085 - RNA, 23 nt, Human
ucaggccacauggcuaaagaagg

SEQ ID NO: 3581086 - RNA, 16 nt, Human
ucaggccacggcagcc

SEQ ID NO: 3581087 - RNA, 14 nt, Human
ucaggccagcugcu

SEQ ID NO: 3581088 - RNA, 17 nt, Human
ucaggccaggcccucug

SEQ ID NO: 3581089 - RNA, 21 nt, Human
ucaggccaggcccucugccca

SEQ ID NO: 3581090 - RNA, 17 nt, Human
ucaggccaggugcagug

SEQ ID NO: 3581091 - RNA, 21 nt, Human
ucaggccaucaucaguggagc

SEQ ID NO: 3581092 - RNA, 14 nt, Human
ucaggcccaaagcc

SEQ ID NO: 3581093 - RNA, 21 nt, Human
ucaggcccccaccuggcucac

SEQ ID NO: 3581094 - RNA, 22 nt, Human
ucaggcccccgccuuggccugu

SEQ ID NO: 3581095 - RNA, 11 nt, Human
ucaggcccugg

SEQ ID NO: 3581096 - RNA, 19 nt, Human
ucaggcccuuauuuucaag

SEQ ID NO: 3581097 - RNA, 23 nt, Human
ucaggccggcagccccagccugc

SEQ ID NO: 3581098 - RNA, 18 nt, Human
ucaggccgggcagagcac

SEQ ID NO: 3581099 - RNA, 20 nt, Human
ucaggccgggcagagcacag

SEQ ID NO: 3581100 - RNA, 13 nt, Human
ucaggccugugug

SEQ ID NO: 3581101 - RNA, 21 nt, Human
ucaggcgauccaccugucuca

SEQ ID NO: 3581102 - RNA, 11 nt, Human
ucaggcuccau

SEQ ID NO: 3581103 - RNA, 20 nt, Human
ucaggcuccauuaggauuug

SEQ ID NO: 3581104 - RNA, 13 nt, Human
ucaggcucccagg

SEQ ID NO: 3581105 - RNA, 13 nt, Human
ucaggcuccccag

SEQ ID NO: 3581106 - RNA, 13 nt, Human
ucaggcucugccc

SEQ ID NO: 3581107 - RNA, 21 nt, Human
ucaggcucuucuccuuucaca

SEQ ID NO: 3581108 - RNA, 19 nt, Human
ucaggcugcagcuggacag

SEQ ID NO: 3581109 - RNA, 22 nt, Human
ucaggcugcagcuggacagagg

SEQ ID NO: 3581110 - RNA, 20 nt, Human
ucaggcugccuaagacaugu

SEQ ID NO: 3581111 - RNA, 12 nt, Human
ucaggcugcugg

SEQ ID NO: 3581112 - RNA, 15 nt, Human
ucaggcugcuggagg

SEQ ID NO: 3581113 - RNA, 17 nt, Human
ucaggcugcuggaggaa

SEQ ID NO: 3581114 - RNA, 17 nt, Human
ucaggcugcuggcgccu

SEQ ID NO: 3581115 - RNA, 23 nt, Human
ucaggcuuccuuggcaucacagg

SEQ ID NO: 3581116 - RNA, 13 nt, Human
ucagggaaagcau

SEQ ID NO: 3581117 - RNA, 14 nt, Human
ucagggaagcccag

SEQ ID NO: 3581118 - RNA, 16 nt, Human
ucagggaagcccagcu

SEQ ID NO: 3581119 - RNA, 17 nt, Human
ucagggaagcccagcuc

SEQ ID NO: 3581120 - RNA, 19 nt, Human
ucagggaagcccagcucca

SEQ ID NO: 3581121 - RNA, 20 nt, Human
ucagggaaggaggagccugu

SEQ ID NO: 3581122 - RNA, 23 nt, Human
ucagggaaggaggagccuguccu

SEQ ID NO: 3581123 - RNA, 18 nt, Human
ucagggacagagacaccu

SEQ ID NO: 3581124 - RNA, 14 nt, Human
ucagggacagagcc

SEQ ID NO: 3581125 - RNA, 15 nt, Human
ucagggacagagcca

SEQ ID NO: 3581126 - RNA, 15 nt, Human
ucagggacaggauga

SEQ ID NO: 3581127 - RNA, 14 nt, Human
ucagggaccaagga

SEQ ID NO: 3581128 - RNA, 20 nt, Human
ucagggaccaaggaccccuc

SEQ ID NO: 3581129 - RNA, 23 nt, Human
ucagggacucaucuuucccuccu

SEQ ID NO: 3581130 - RNA, 23 nt, Human
ucagggagcagggaaggccugac

SEQ ID NO: 3581131 - RNA, 17 nt, Human
ucagggagugcuggcuc

SEQ ID NO: 3581132 - RNA, 21 nt, Human
ucagggagugggcuaagcacg

SEQ ID NO: 3581133 - RNA, 19 nt, Human
ucagggaguguucccuauc

SEQ ID NO: 3581134 - RNA, 16 nt, Human
ucagggcaaagccagg

SEQ ID NO: 3581135 - RNA, 18 nt, Human
ucagggcagccugccugg

SEQ ID NO: 3581136 - RNA, 16 nt, Human
ucagggcagggcucug

SEQ ID NO: 3581137 - RNA, 13 nt, Human
ucagggccaggcc

SEQ ID NO: 3581138 - RNA, 18 nt, Human
ucagggccaugcugaggc

SEQ ID NO: 3581139 - RNA, 23 nt, Human
ucagggccaugcugaggccuggg

SEQ ID NO: 3581140 - RNA, 14 nt, Human
ucagggcccagagg

SEQ ID NO: 3581141 - RNA, 17 nt, Human
ucagggcccagaggcug

SEQ ID NO: 3581142 - RNA, 20 nt, Human
ucagggccuggggccugaga

SEQ ID NO: 3581143 - RNA, 23 nt, Human
ucagggccuggggccugagagaa

SEQ ID NO: 3581144 - RNA, 23 nt, Human
ucagggcuaaacgggcauugccu

SEQ ID NO: 3581145 - RNA, 16 nt, Human
ucagggcucccagggg

SEQ ID NO: 3581146 - RNA, 21 nt, Human
ucagggcuccugccuucuguc

SEQ ID NO: 3581147 - RNA, 14 nt, Human
ucagggcuccuggg

SEQ ID NO: 3581148 - RNA, 18 nt, Human
ucagggcuggcuccugau

SEQ ID NO: 3581149 - RNA, 19 nt, Human
ucagggcuggcuccugauc

SEQ ID NO: 3581150 - RNA, 16 nt, Human
ucaggggacucagccc

SEQ ID NO: 3581151 - RNA, 15 nt, Human
ucaggggccagagga

SEQ ID NO: 3581152 - RNA, 16 nt, Human
ucaggggcccuggagc

SEQ ID NO: 3581153 - RNA, 17 nt, Human
ucaggggcugacacuuc

SEQ ID NO: 3581154 - RNA, 13 nt, Human
ucaggggcugccc

SEQ ID NO: 3581155 - RNA, 22 nt, Human
ucaggggcugcccgcucccagu

SEQ ID NO: 3581156 - RNA, 16 nt, Human
ucagugggagaaaaca

SEQ ID NO: 3581157 - RNA, 14 nt, Human
ucaguggggcaguc

SEQ ID NO: 3581158 - RNA, 20 nt, Human
ucaguggggcccauggaugu

SEQ ID NO: 3581159 - RNA, 16 nt, Human
ucaguggggcucucug

SEQ ID NO: 3581160 - RNA, 18 nt, Human
ucaguggggcucucugag

SEQ ID NO: 3581161 - RNA, 23 nt, Human
ucaguggguuaacaucaguuuug

SEQ ID NO: 3581162 - RNA, 18 nt, Human
ucaguguaauuucuuugc

SEQ ID NO: 3581163 - RNA, 19 nt, Human
ucaguguaauuucuuugcc

SEQ ID NO: 3581164 - RNA, 20 nt, Human
ucaguguacauggaauaaca

SEQ ID NO: 3581165 - RNA, 22 nt, Human
ucaguguaccgcgucuacccug

SEQ ID NO: 3581166 - RNA, 17 nt, Human
ucaguguaguuaauuua

SEQ ID NO: 3581167 - RNA, 18 nt, Human
ucaguguaguuaauuuau

SEQ ID NO: 3581168 - RNA, 16 nt, Human
ucaguguauuucaguu

SEQ ID NO: 3581169 - RNA, 15 nt, Human
ucaguguauuuguau

SEQ ID NO: 3581170 - RNA, 22 nt, Human
ucagugucaaauaaacacugug

SEQ ID NO: 3581171 - RNA, 20 nt, Human
ucagugucaaugcagccccc

SEQ ID NO: 3581172 - RNA, 20 nt, Human
ucagugucauuuaugaaaag

SEQ ID NO: 3581173 - RNA, 16 nt, Human
ucaguguccaaagcag

SEQ ID NO: 3581174 - RNA, 13 nt, Human
ucagugucccggg

SEQ ID NO: 3581175 - RNA, 13 nt, Human
ucagugugacuga

SEQ ID NO: 3581176 - RNA, 18 nt, Human
ucagugugacugaucucu

SEQ ID NO: 3581177 - RNA, 14 nt, Human
ucagugugcccccc

SEQ ID NO: 3581178 - RNA, 23 nt, Human
ucaguguuaaaaaauuuuugaaa

SEQ ID NO: 3581179 - RNA, 17 nt, Human
ucaguguuaaaugugau

SEQ ID NO: 3581180 - RNA, 16 nt, Human
ucaguguuaccugugu

SEQ ID NO: 3581181 - RNA, 15 nt, Human
ucaguguugguauau

SEQ ID NO: 3581182 - RNA, 14 nt, Human
ucaguguuuaugug

SEQ ID NO: 3581183 - RNA, 18 nt, Human
ucaguguuuuaaauucug

SEQ ID NO: 3581184 - RNA, 17 nt, Human
ucaguuaagccuuugga

SEQ ID NO: 3581185 - RNA, 17 nt, Human
ucaguuaaguuuuuccc

SEQ ID NO: 3581186 - RNA, 18 nt, Human
ucaguuaaguuuuucccu

SEQ ID NO: 3581187 - RNA, 16 nt, Human
ucaguuacucugaagg

SEQ ID NO: 3581188 - RNA, 21 nt, Human
ucaguuauacaguuauaaaau

SEQ ID NO: 3581189 - RNA, 16 nt, Human
ucaguuauucauucug

SEQ ID NO: 3581190 - RNA, 15 nt, Human
ucaguuauuggugga

SEQ ID NO: 3581191 - RNA, 12 nt, Human
ucaguucaaagu

SEQ ID NO: 3581192 - RNA, 13 nt, Human
ucaguucaaaguc

SEQ ID NO: 3581193 - RNA, 16 nt, Human
ucaguucaaagucaug

SEQ ID NO: 3581194 - RNA, 16 nt, Human
ucaguucccagaauca

SEQ ID NO: 3581195 - RNA, 18 nt, Human
ucaguucccuuggccuca

SEQ ID NO: 3581196 - RNA, 20 nt, Human
ucaguuccgauuucccaggc

SEQ ID NO: 3581197 - RNA, 16 nt, Human
ucaguuccucuuugca

SEQ ID NO: 3581198 - RNA, 18 nt, Human
ucaguuccucuuugcaug

SEQ ID NO: 3581199 - RNA, 20 nt, Human
ucaguuccugcccuuggccu

SEQ ID NO: 3581200 - RNA, 20 nt, Human
ucaguucuagucucucuggg

SEQ ID NO: 3581201 - RNA, 14 nt, Human
ucaguucucuucac

SEQ ID NO: 3581202 - RNA, 19 nt, Human
ucaguucucuugauuuuca

SEQ ID NO: 3581203 - RNA, 13 nt, Human
ucaguucugauau

SEQ ID NO: 3581204 - RNA, 20 nt, Human
ucaguucuugccacuuuuuu

SEQ ID NO: 3581205 - RNA, 17 nt, Human
ucaguugauuuucugga

SEQ ID NO: 3581206 - RNA, 12 nt, Human
ucaguugcagcc

SEQ ID NO: 3581207 - RNA, 20 nt, Human
ucaguugcucaaaaagaaau

SEQ ID NO: 3581208 - RNA, 13 nt, Human
ucaguugcuuguc

SEQ ID NO: 3581209 - RNA, 15 nt, Human
ucaguugguaagcuu

SEQ ID NO: 3581210 - RNA, 16 nt, Human
ucaguugguugugucu

SEQ ID NO: 3581211 - RNA, 18 nt, Human
ucaguugguugugucuuu

SEQ ID NO: 3581212 - RNA, 15 nt, Human
ucaguugugacuaac

SEQ ID NO: 3581213 - RNA, 20 nt, Human
ucaguuguuauuuauugaaa

SEQ ID NO: 3581214 - RNA, 15 nt, Human
ucaguuuaauccuuc

SEQ ID NO: 3581215 - RNA, 20 nt, Human
ucaguuuaauccuucuaguu

SEQ ID NO: 3581216 - RNA, 16 nt, Human
ucaguuuauguuguac

SEQ ID NO: 3581217 - RNA, 19 nt, Human
ucaguuucaauucagugcu

SEQ ID NO: 3581218 - RNA, 19 nt, Human
ucaguuucacagaaaauaa

SEQ ID NO: 3581219 - RNA, 14 nt, Human
ucaguuucauaaaa

SEQ ID NO: 3581220 - RNA, 12 nt, Human
ucaguuugauca

SEQ ID NO: 3581221 - RNA, 19 nt, Human
ucaguuugcuagcagaaau

SEQ ID NO: 3581222 - RNA, 14 nt, Human
ucaguuuguauaga

SEQ ID NO: 3581223 - RNA, 16 nt, Human
ucaguuugugugucuu

SEQ ID NO: 3581224 - RNA, 17 nt, Human
ucaguuugugugucuua

SEQ ID NO: 3581225 - RNA, 15 nt, Human
ucaguuuguuggaaa

SEQ ID NO: 3581226 - RNA, 16 nt, Human
ucaguuuuaucauuuu

SEQ ID NO: 3581227 - RNA, 17 nt, Human
ucaguuuuaucauuuuc

SEQ ID NO: 3581228 - RNA, 12 nt, Human
ucaguuuucauu

SEQ ID NO: 3581229 - RNA, 15 nt, Human
ucaguuuuucuuaau

SEQ ID NO: 3581230 - RNA, 17 nt, Human
ucaguuuuuuguuuuac

SEQ ID NO: 3581231 - RNA, 15 nt, Human
ucaguuuuuuuuuau

SEQ ID NO: 3581232 - RNA, 22 nt, Human
ucauaaaaagccugcaauuuca

SEQ ID NO: 3581233 - RNA, 23 nt, Human
ucauaaaaucaaaacaagugaaa

SEQ ID NO: 3581234 - RNA, 13 nt, Human
ucauaaagugaga

SEQ ID NO: 3581235 - RNA, 23 nt, Human
ucauaaaguuagaaucuauuuuc

SEQ ID NO: 3581236 - RNA, 12 nt, Human
ucauaaaugaag

SEQ ID NO: 3581237 - RNA, 11 nt, Human
ucauaaauuau

SEQ ID NO: 3581238 - RNA, 13 nt, Human
ucauaaauuauuu

SEQ ID NO: 3581239 - RNA, 16 nt, Human
ucauaacugugucauu

SEQ ID NO: 3581240 - RNA, 20 nt, Human
ucauaagccaauuuuucugc

SEQ ID NO: 3581241 - RNA, 16 nt, Human
ucauaagcgaucacuu

SEQ ID NO: 3581242 - RNA, 12 nt, Human
ucauaauggccu

SEQ ID NO: 3581243 - RNA, 12 nt, Human
ucauaaugugaa

SEQ ID NO: 3581244 - RNA, 17 nt, Human
ucauaaugugaaguguu

SEQ ID NO: 3581245 - RNA, 15 nt, Human
ucauaauuauuauuu

SEQ ID NO: 3581246 - RNA, 23 nt, Human
ucauaauuccuacagcacuacug

SEQ ID NO: 3581247 - RNA, 22 nt, Human
ucauacaaggcccaggaggcuu

SEQ ID NO: 3581248 - RNA, 19 nt, Human
ucauacacuaaccaaaucu

SEQ ID NO: 3581249 - RNA, 14 nt, Human
ucauacagagaagu

SEQ ID NO: 3581250 - RNA, 13 nt, Human
ucauacauuguac

SEQ ID NO: 3581251 - RNA, 20 nt, Human
ucauaccaacuuuagcagaa

SEQ ID NO: 3581252 - RNA, 13 nt, Human
ucauacccacccc

SEQ ID NO: 3581253 - RNA, 16 nt, Human
ucauaccuaaguacug

SEQ ID NO: 3581254 - RNA, 17 nt, Human
ucauaccuaaguacugu

SEQ ID NO: 3581255 - RNA, 18 nt, Human
ucauaccuaucaucuuaa

SEQ ID NO: 3581256 - RNA, 14 nt, Human
ucauaccucugacc

SEQ ID NO: 3581257 - RNA, 15 nt, Human
ucauacguccaccau

SEQ ID NO: 3581258 - RNA, 20 nt, Human
ucauacuacugaaacagauu

SEQ ID NO: 3581259 - RNA, 20 nt, Human
ucauacuccuaugcuuuagc

SEQ ID NO: 3581260 - RNA, 17 nt, Human
ucauacucgagucugag

SEQ ID NO: 3581261 - RNA, 15 nt, Human
ucauacuuaaaaauu

SEQ ID NO: 3581262 - RNA, 22 nt, Human
ucauacuugaacguuuucuaau

SEQ ID NO: 3581263 - RNA, 13 nt, Human
ucauagaaaugua

SEQ ID NO: 3581264 - RNA, 22 nt, Human
ucauagaauagcauguuguaga

SEQ ID NO: 3581265 - RNA, 20 nt, Human
ucauagagauuugucuaauu

SEQ ID NO: 3581266 - RNA, 14 nt, Human
ucauagauuucuga

SEQ ID NO: 3581267 - RNA, 14 nt, Human
ucauagcacuuccc

SEQ ID NO: 3581268 - RNA, 21 nt, Human
ucauagcauuaacuaaucuau

SEQ ID NO: 3581269 - RNA, 17 nt, Human
ucauagccauaaaugau

SEQ ID NO: 3581270 - RNA, 20 nt, Human
ucauaggaaaaguacauuua

SEQ ID NO: 3581271 - RNA, 22 nt, Human
ucauaggcaccuuuuacuguga

SEQ ID NO: 3581272 - RNA, 16 nt, Human
ucauagguauuucaaa

SEQ ID NO: 3581273 - RNA, 18 nt, Human
ucauaggucacuggcucu

SEQ ID NO: 3581274 - RNA, 14 nt, Human
ucauaggucugaaa

SEQ ID NO: 3581275 - RNA, 22 nt, Human
ucauaggucugaaauuuuucuu

SEQ ID NO: 3581276 - RNA, 21 nt, Human
ucauagguuaaaaaaaaaagu

SEQ ID NO: 3581277 - RNA, 17 nt, Human
ucauagguugagcaauu

SEQ ID NO: 3581278 - RNA, 14 nt, Human
ucauaguaacuucu

SEQ ID NO: 3581279 - RNA, 20 nt, Human
ucauaguagaacuuuauaaa

SEQ ID NO: 3581280 - RNA, 16 nt, Human
ucauaguaguuuuuac

SEQ ID NO: 3581281 - RNA, 16 nt, Human
ucauaguucagaauuu

SEQ ID NO: 3581282 - RNA, 21 nt, Human
ucauaguucugagcugccagu

SEQ ID NO: 3581283 - RNA, 15 nt, Human
ucauaguuuuauuua

SEQ ID NO: 3581284 - RNA, 18 nt, Human
ucauauaaaguaucauca

SEQ ID NO: 3581285 - RNA, 18 nt, Human
ucauauaagauucauauu

SEQ ID NO: 3581286 - RNA, 17 nt, Human
ucauauaccagcaauau

SEQ ID NO: 3581287 - RNA, 17 nt, Human
ucauauauaauaaauua

SEQ ID NO: 3581288 - RNA, 22 nt, Human
ucauauauaucacccagacaua

SEQ ID NO: 3581289 - RNA, 21 nt, Human
ucauauauuaaacauccacaa

SEQ ID NO: 3581290 - RNA, 21 nt, Human
ucauaucaacuuagucaauaa

SEQ ID NO: 3581291 - RNA, 21 nt, Human
ucauaugaaaggugccaugga

SEQ ID NO: 3581292 - RNA, 15 nt, Human
ucauauggauaaaua

SEQ ID NO: 3581293 - RNA, 21 nt, Human
ucauauguaccauguacauga

SEQ ID NO: 3581294 - RNA, 20 nt, Human
ucauauguagccuucacaca

SEQ ID NO: 3581295 - RNA, 22 nt, Human
ucauauguagccuucacacaga

SEQ ID NO: 3581296 - RNA, 21 nt, Human
ucauaugugaucugucuugua

SEQ ID NO: 3581297 - RNA, 22 nt, Human
ucauaugugaucugucuuguaa

SEQ ID NO: 3581298 - RNA, 13 nt, Human
ucauauguugcuc

SEQ ID NO: 3581299 - RNA, 15 nt, Human
ucauauuaagaauga

SEQ ID NO: 3581300 - RNA, 22 nt, Human
ucauauuaagaaugaucugauu

SEQ ID NO: 3581301 - RNA, 19 nt, Human
ucaucuucaccagaggaau

SEQ ID NO: 3581302 - RNA, 13 nt, Human
ucaucuuccugug

SEQ ID NO: 3581303 - RNA, 15 nt, Human
ucaucuuccuguguc

SEQ ID NO: 3581304 - RNA, 16 nt, Human
ucaucuuccugugucc

SEQ ID NO: 3581305 - RNA, 19 nt, Human
ucaucuuccuguguccuga

SEQ ID NO: 3581306 - RNA, 14 nt, Human
ucaucuucucagcu

SEQ ID NO: 3581307 - RNA, 19 nt, Human
ucaucuugaauuguaagga

SEQ ID NO: 3581308 - RNA, 16 nt, Human
ucaucuugaccaagca

SEQ ID NO: 3581309 - RNA, 21 nt, Human
ucaucuugaccaagcaggaag

SEQ ID NO: 3581310 - RNA, 11 nt, Human
ucaucuugcua

SEQ ID NO: 3581311 - RNA, 22 nt, Human
ucaucuugugaaauggccagga

SEQ ID NO: 3581312 - RNA, 16 nt, Human
ucaucuuucccuccuu

SEQ ID NO: 3581313 - RNA, 17 nt, Human
ucaucuuucccuccuug

SEQ ID NO: 3581314 - RNA, 14 nt, Human
ucaucuuucuucca

SEQ ID NO: 3581315 - RNA, 12 nt, Human
ucaugaaaauac

SEQ ID NO: 3581316 - RNA, 14 nt, Human
ucaugaaaauacca

SEQ ID NO: 3581317 - RNA, 13 nt, Human
ucaugaaagauuc

SEQ ID NO: 3581318 - RNA, 15 nt, Human
ucaugaaagauucaa

SEQ ID NO: 3581319 - RNA, 17 nt, Human
ucaugaaagauucaaug

SEQ ID NO: 3581320 - RNA, 14 nt, Human
ucaugaaauaugca

SEQ ID NO: 3581321 - RNA, 15 nt, Human
ucaugaagccugugg

SEQ ID NO: 3581322 - RNA, 13 nt, Human
ucaugaaugcuuu

SEQ ID NO: 3581323 - RNA, 13 nt, Human
ucaugaauguaaa

SEQ ID NO: 3581324 - RNA, 19 nt, Human
ucaugaauguaaauuugua

SEQ ID NO: 3581325 - RNA, 22 nt, Human
ucaugaauuaguuuuauaugcu

SEQ ID NO: 3581326 - RNA, 20 nt, Human
ucaugaauucuuaugcuuau

SEQ ID NO: 3581327 - RNA, 18 nt, Human
ucaugaauuuuaaaguau

SEQ ID NO: 3581328 - RNA, 14 nt, Human
ucaugaauuuuaca

SEQ ID NO: 3581329 - RNA, 16 nt, Human
ucaugaauuuuacaug

SEQ ID NO: 3581330 - RNA, 19 nt, Human
ucaugacaaagacugagua

SEQ ID NO: 3581331 - RNA, 19 nt, Human
ucaugacauguuauauauu

SEQ ID NO: 3581332 - RNA, 22 nt, Human
ucaugacauuccuaaacuaucu

SEQ ID NO: 3581333 - RNA, 16 nt, Human
ucaugaccagcaaaua

SEQ ID NO: 3581334 - RNA, 16 nt, Human
ucaugagccugcugga

SEQ ID NO: 3581335 - RNA, 19 nt, Human
ucaugagccugcuggaagc

SEQ ID NO: 3581336 - RNA, 16 nt, Human
ucaugagcugagcagg

SEQ ID NO: 3581337 - RNA, 22 nt, Human
ucaugaggagauucugccuuug

SEQ ID NO: 3581338 - RNA, 20 nt, Human
ucaugaggaggggccccccu

SEQ ID NO: 3581339 - RNA, 21 nt, Human
ucaugauaaugaacagaacau

SEQ ID NO: 3581340 - RNA, 13 nt, Human
ucaugauccaacu

SEQ ID NO: 3581341 - RNA, 14 nt, Human
ucaugaucucccug

SEQ ID NO: 3581342 - RNA, 15 nt, Human
ucaugaucucccugc

SEQ ID NO: 3581343 - RNA, 16 nt, Human
ucaugaucucccugcc

SEQ ID NO: 3581344 - RNA, 18 nt, Human
ucaugaucucccugccgc

SEQ ID NO: 3581345 - RNA, 22 nt, Human
ucaugaucucccugccgccuca

SEQ ID NO: 3581346 - RNA, 16 nt, Human
ucaugaugcagucucc

SEQ ID NO: 3581347 - RNA, 19 nt, Human
ucaugaugcagucuccucu

SEQ ID NO: 3581348 - RNA, 23 nt, Human
ucaugaugcagucuccucuuuaa

SEQ ID NO: 3581349 - RNA, 23 nt, Human
ucaugauuagaaauuaccugugg

SEQ ID NO: 3581350 - RNA, 16 nt, Human
ucaugauuuauaaaug

SEQ ID NO: 3581351 - RNA, 22 nt, Human
ucaugauuuuaaguuucucugc

SEQ ID NO: 3581352 - RNA, 11 nt, Human
ucaugcaaaau

SEQ ID NO: 3581353 - RNA, 13 nt, Human
ucaugcaaugaca

SEQ ID NO: 3581354 - RNA, 16 nt, Human
ucaugcacacaauuag

SEQ ID NO: 3581355 - RNA, 21 nt, Human
ucaugcacuuaaagaaguauu

SEQ ID NO: 3581356 - RNA, 23 nt, Human
ucaugcagccgugaucaagggaa

SEQ ID NO: 3581357 - RNA, 15 nt, Human
ucaugcauaaauaug

SEQ ID NO: 3581358 - RNA, 20 nt, Human
ucaugcauaaauaugcagug

SEQ ID NO: 3581359 - RNA, 18 nt, Human
ucaugcauagucccagcu

SEQ ID NO: 3581360 - RNA, 15 nt, Human
ucaugcauggaaauu

SEQ ID NO: 3581361 - RNA, 17 nt, Human
ucaugcaugucaaacau

SEQ ID NO: 3581362 - RNA, 21 nt, Human
ucaugccagcuacuuccuccu

SEQ ID NO: 3581363 - RNA, 18 nt, Human
ucaugcccacccccugcc

SEQ ID NO: 3581364 - RNA, 20 nt, Human
ucaugcccacccccugcccu

SEQ ID NO: 3581365 - RNA, 22 nt, Human
ucaugcccacccccugcccugc

SEQ ID NO: 3581366 - RNA, 15 nt, Human
ucaugcccccuuuca

SEQ ID NO: 3581367 - RNA, 17 nt, Human
ucaugcccggucccacc

SEQ ID NO: 3581368 - RNA, 13 nt, Human
ucaugcccuccuc

SEQ ID NO: 3581369 - RNA, 14 nt, Human
ucaugcccuccucu

SEQ ID NO: 3581370 - RNA, 13 nt, Human
ucaugccucugag

SEQ ID NO: 3581371 - RNA, 15 nt, Human
ucaugccucugaggc

SEQ ID NO: 3581372 - RNA, 15 nt, Human
ucaugccuggcuucg

SEQ ID NO: 3581373 - RNA, 15 nt, Human
ucaugccuguaaucc

SEQ ID NO: 3581374 - RNA, 13 nt, Human
ucaugccuuugua

SEQ ID NO: 3581375 - RNA, 14 nt, Human
ucaugccuuuguaa

SEQ ID NO: 3581376 - RNA, 17 nt, Human
ucaugccuuuguaaguu

SEQ ID NO: 3581377 - RNA, 22 nt, Human
ucaugcuaauuauauaauauuu

SEQ ID NO: 3581378 - RNA, 23 nt, Human
ucaugcuccccugugccagccca

SEQ ID NO: 3581379 - RNA, 11 nt, Human
ucaugcugaaa

SEQ ID NO: 3581380 - RNA, 14 nt, Human
ucaugcugggauuu

SEQ ID NO: 3581381 - RNA, 18 nt, Human
ucaugcuuguguuauaac

SEQ ID NO: 3581382 - RNA, 23 nt, Human
ucaugcuuuaaaguguaauaaua

SEQ ID NO: 3581383 - RNA, 15 nt, Human
ucauggaaauauuau

SEQ ID NO: 3581384 - RNA, 19 nt, Human
ucauggaaauauuaugcaa

SEQ ID NO: 3581385 - RNA, 17 nt, Human
ucauggaacacaaacac

SEQ ID NO: 3581386 - RNA, 18 nt, Human
ucauggaacacaaacaca

SEQ ID NO: 3581387 - RNA, 20 nt, Human
ucauggaacgcguugaaauu

SEQ ID NO: 3581388 - RNA, 17 nt, Human
ucauggacacuuugaaa

SEQ ID NO: 3581389 - RNA, 19 nt, Human
ucauggaccacuguuucuu

SEQ ID NO: 3581390 - RNA, 20 nt, Human
ucauggauuuuccaggacug

SEQ ID NO: 3581391 - RNA, 12 nt, Human
ucauggccacac

SEQ ID NO: 3581392 - RNA, 15 nt, Human
ucauggccacacugu

SEQ ID NO: 3581393 - RNA, 18 nt, Human
ucauggccacacugugac

SEQ ID NO: 3581394 - RNA, 15 nt, Human
ucauggcucacugca

SEQ ID NO: 3581395 - RNA, 18 nt, Human
ucauggcucacugcagcc

SEQ ID NO: 3581396 - RNA, 22 nt, Human
ucauggcugugcccucuugaug

SEQ ID NO: 3581397 - RNA, 20 nt, Human
ucauggggggagcacccuga

SEQ ID NO: 3581398 - RNA, 17 nt, Human
ucauggguuauguguau

SEQ ID NO: 3581399 - RNA, 22 nt, Human
ucaugguagagaccgagccucu

SEQ ID NO: 3581400 - RNA, 18 nt, Human
ucaugguccccauggcau

SEQ ID NO: 3581401 - RNA, 16 nt, Human
ucauggucucagucau

SEQ ID NO: 3581402 - RNA, 19 nt, Human
ucauggugaaaauguacug

SEQ ID NO: 3581403 - RNA, 15 nt, Human
ucauggugaggcuua

SEQ ID NO: 3581404 - RNA, 14 nt, Human
ucaugguguaauaa

SEQ ID NO: 3581405 - RNA, 16 nt, Human
ucaugguguaauaaga

SEQ ID NO: 3581406 - RNA, 19 nt, Human
ucaugguguaauaagacau

SEQ ID NO: 3581407 - RNA, 21 nt, Human
ucaugguguaauaagacauaa

SEQ ID NO: 3581408 - RNA, 17 nt, Human
ucauguaaacugugcac

SEQ ID NO: 3581409 - RNA, 19 nt, Human
ucauguaaagaaaugucuu

SEQ ID NO: 3581410 - RNA, 15 nt, Human
ucauguaaauaaaua

SEQ ID NO: 3581411 - RNA, 17 nt, Human
ucauguaaauuuuguau

SEQ ID NO: 3581412 - RNA, 12 nt, Human
ucauguacauuu

SEQ ID NO: 3581413 - RNA, 19 nt, Human
ucauguacauuuggaacua

SEQ ID NO: 3581414 - RNA, 16 nt, Human
ucauguacugcauuau

SEQ ID NO: 3581415 - RNA, 15 nt, Human
ucauguacuuuuuag

SEQ ID NO: 3581416 - RNA, 22 nt, Human
ucauguacuuuuuaguaauuuc

SEQ ID NO: 3581417 - RNA, 17 nt, Human
ucauguagagaaaagca

SEQ ID NO: 3581418 - RNA, 19 nt, Human
ucauguagagaaaagcaca

SEQ ID NO: 3581419 - RNA, 17 nt, Human
ucauguaguaucaaaua

SEQ ID NO: 3581420 - RNA, 15 nt, Human
ucauguaucaucugg

SEQ ID NO: 3581421 - RNA, 18 nt, Human
ucauguaucaucuggaua

SEQ ID NO: 3581422 - RNA, 19 nt, Human
ucauguaucaucuggauag

SEQ ID NO: 3581423 - RNA, 20 nt, Human
ucauguaucaucuggauagg

SEQ ID NO: 3581424 - RNA, 21 nt, Human
ucauguauguucagaagaaau

SEQ ID NO: 3581425 - RNA, 22 nt, Human
ucauguauguucagaagaaauu

SEQ ID NO: 3581426 - RNA, 13 nt, Human
ucauguauguuuc

SEQ ID NO: 3581427 - RNA, 16 nt, Human
ucauguauguuucucu

SEQ ID NO: 3581428 - RNA, 15 nt, Human
ucauguauuugagca

SEQ ID NO: 3581429 - RNA, 23 nt, Human
ucaugucaaauauuuagauguaa

SEQ ID NO: 3581430 - RNA, 16 nt, Human
ucaugucaacuucugg

SEQ ID NO: 3581431 - RNA, 16 nt, Human
ucauguccugugucag

SEQ ID NO: 3581432 - RNA, 18 nt, Human
ucauguccugugucaguu

SEQ ID NO: 3581433 - RNA, 20 nt, Human
ucauguccugugucaguuua

SEQ ID NO: 3581434 - RNA, 13 nt, Human
ucaugucuggcua

SEQ ID NO: 3581435 - RNA, 16 nt, Human
ucaugucuucucacaa

SEQ ID NO: 3581436 - RNA, 17 nt, Human
ucaugugaccacucugu

SEQ ID NO: 3581437 - RNA, 14 nt, Human
ucaugugacucuuu

SEQ ID NO: 3581438 - RNA, 18 nt, Human
ucaugugacucuuuccaa

SEQ ID NO: 3581439 - RNA, 21 nt, Human
ucaugugcauuauuuuccaga

SEQ ID NO: 3581440 - RNA, 21 nt, Human
ucauguggcuggaagauccug

SEQ ID NO: 3581441 - RNA, 18 nt, Human
ucauguguaaucaauaaa

SEQ ID NO: 3581442 - RNA, 10 nt, Human
ucauguguau

SEQ ID NO: 3581443 - RNA, 15 nt, Human
ucauguguauaaaaa

SEQ ID NO: 3581444 - RNA, 12 nt, Human
ucaugugugucc

SEQ ID NO: 3581445 - RNA, 14 nt, Human
ucauguguucccuu

SEQ ID NO: 3581446 - RNA, 13 nt, Human
uccccucccuggc

SEQ ID NO: 3581447 - RNA, 19 nt, Human
uccccucccuggcucccau

SEQ ID NO: 3581448 - RNA, 18 nt, Human
uccccuccggacuggugc

SEQ ID NO: 3581449 - RNA, 14 nt, Human
uccccuccuccacu

SEQ ID NO: 3581450 - RNA, 16 nt, Human
uccccuccuccacucu

SEQ ID NO: 3581451 - RNA, 14 nt, Human
uccccuccucugcu

SEQ ID NO: 3581452 - RNA, 18 nt, Human
uccccuccuucucccuuu

SEQ ID NO: 3581453 - RNA, 18 nt, Human
uccccuccuugggcacuu

SEQ ID NO: 3581454 - RNA, 16 nt, Human
uccccucggagaagag

SEQ ID NO: 3581455 - RNA, 21 nt, Human
uccccucucuugucagaugcc

SEQ ID NO: 3581456 - RNA, 21 nt, Human
uccccucugaaaguuguacau

SEQ ID NO: 3581457 - RNA, 21 nt, Human
uccccucuuauguaccucuuu

SEQ ID NO: 3581458 - RNA, 17 nt, Human
uccccucuucccuucaa

SEQ ID NO: 3581459 - RNA, 12 nt, Human
uccccugagccc

SEQ ID NO: 3581460 - RNA, 19 nt, Human
uccccugcacuguaaaaug

SEQ ID NO: 3581461 - RNA, 17 nt, Human
uccccugcagcccuggc

SEQ ID NO: 3581462 - RNA, 18 nt, Human
uccccugcaggcugagug

SEQ ID NO: 3581463 - RNA, 13 nt, Human
uccccugccacca

SEQ ID NO: 3581464 - RNA, 17 nt, Human
uccccugccaccaggcc

SEQ ID NO: 3581465 - RNA, 12 nt, Human
uccccugccagg

SEQ ID NO: 3581466 - RNA, 15 nt, Human
uccccugccagggca

SEQ ID NO: 3581467 - RNA, 21 nt, Human
uccccugcccaugcugggagc

SEQ ID NO: 3581468 - RNA, 14 nt, Human
uccccugcccccag

SEQ ID NO: 3581469 - RNA, 17 nt, Human
uccccugcccccaggac

SEQ ID NO: 3581470 - RNA, 18 nt, Human
uccccugcccccaggacu

SEQ ID NO: 3581471 - RNA, 19 nt, Human
uccccugcccccaggacug

SEQ ID NO: 3581472 - RNA, 17 nt, Human
uccccugcccccugcag

SEQ ID NO: 3581473 - RNA, 19 nt, Human
uccccugcccccugcagga

SEQ ID NO: 3581474 - RNA, 21 nt, Human
uccccugcccccugcaggaag

SEQ ID NO: 3581475 - RNA, 15 nt, Human
uccccugccuccauc

SEQ ID NO: 3581476 - RNA, 15 nt, Human
uccccugccuugcug

SEQ ID NO: 3581477 - RNA, 19 nt, Human
uccccuggaagcagugccc

SEQ ID NO: 3581478 - RNA, 23 nt, Human
uccccuggaagcagugcccaggu

SEQ ID NO: 3581479 - RNA, 16 nt, Human
uccccuggacugggag

SEQ ID NO: 3581480 - RNA, 19 nt, Human
uccccuggagggggaaugg

SEQ ID NO: 3581481 - RNA, 14 nt, Human
uccccuggggaccc

SEQ ID NO: 3581482 - RNA, 15 nt, Human
uccccuggggaccca

SEQ ID NO: 3581483 - RNA, 16 nt, Human
uccccuggggugcagg

SEQ ID NO: 3581484 - RNA, 20 nt, Human
uccccugugccagcccagag

SEQ ID NO: 3581485 - RNA, 12 nt, Human
uccccugugggg

SEQ ID NO: 3581486 - RNA, 16 nt, Human
uccccuguuccccucu

SEQ ID NO: 3581487 - RNA, 19 nt, Human
uccccuguuccccucuccc

SEQ ID NO: 3581488 - RNA, 20 nt, Human
uccccuguuuguuucugaaa

SEQ ID NO: 3581489 - RNA, 19 nt, Human
uccccuuaauuaggaugca

SEQ ID NO: 3581490 - RNA, 17 nt, Human
uccccuuacccuuagaa

SEQ ID NO: 3581491 - RNA, 19 nt, Human
uccccuuauccucccugua

SEQ ID NO: 3581492 - RNA, 13 nt, Human
uccccuucacucc

SEQ ID NO: 3581493 - RNA, 13 nt, Human
uccccuuccacug

SEQ ID NO: 3581494 - RNA, 17 nt, Human
uccccuuccacugaggg

SEQ ID NO: 3581495 - RNA, 15 nt, Human
uccccuuccauuucu

SEQ ID NO: 3581496 - RNA, 15 nt, Human
uccccuucccugcaa

SEQ ID NO: 3581497 - RNA, 21 nt, Human
uccccuuccuaauuccacagc

SEQ ID NO: 3581498 - RNA, 19 nt, Human
uccccuucucaucacuccc

SEQ ID NO: 3581499 - RNA, 20 nt, Human
uccccuucuccccugcacug

SEQ ID NO: 3581500 - RNA, 16 nt, Human
uccccuucucucaucu

SEQ ID NO: 3581501 - RNA, 18 nt, Human
uccccuugaacucuucac

SEQ ID NO: 3581502 - RNA, 14 nt, Human
uccccuugagcuga

SEQ ID NO: 3581503 - RNA, 14 nt, Human
uccccuugccagcu

SEQ ID NO: 3581504 - RNA, 20 nt, Human
uccccuugcccagggcucag

SEQ ID NO: 3581505 - RNA, 20 nt, Human
uccccuugcccuugcccuga

SEQ ID NO: 3581506 - RNA, 23 nt, Human
uccccuugccugugccaggugag

SEQ ID NO: 3581507 - RNA, 19 nt, Human
uccccuugggcccacaccu

SEQ ID NO: 3581508 - RNA, 22 nt, Human
uccccuugggcccacaccuccu

SEQ ID NO: 3581509 - RNA, 20 nt, Human
uccccuuuauguacaggaug

SEQ ID NO: 3581510 - RNA, 13 nt, Human
uccccuuuccugu

SEQ ID NO: 3581511 - RNA, 20 nt, Human
uccccuuuucuuuucuaccc

SEQ ID NO: 3581512 - RNA, 18 nt, Human
uccccuuuugcauucucc

SEQ ID NO: 3581513 - RNA, 20 nt, Human
ucccgagcaaagucuaaagu

SEQ ID NO: 3581514 - RNA, 22 nt, Human
ucccgagcaccuccacauccuc

SEQ ID NO: 3581515 - RNA, 16 nt, Human
ucccgaguagcuggga

SEQ ID NO: 3581516 - RNA, 12 nt, Human
ucccgagucugg

SEQ ID NO: 3581517 - RNA, 14 nt, Human
ucccgagucuggga

SEQ ID NO: 3581518 - RNA, 19 nt, Human
ucccgauucacccugucca

SEQ ID NO: 3581519 - RNA, 18 nt, Human
ucccgcccaaaccuuucc

SEQ ID NO: 3581520 - RNA, 15 nt, Human
ucccgccccuucccc

SEQ ID NO: 3581521 - RNA, 15 nt, Human
ucccgccuccaaccc

SEQ ID NO: 3581522 - RNA, 19 nt, Human
ucccgccucuucuucuuca

SEQ ID NO: 3581523 - RNA, 12 nt, Human
ucccgcggugcc

SEQ ID NO: 3581524 - RNA, 14 nt, Human
ucccgcucagcccu

SEQ ID NO: 3581525 - RNA, 15 nt, Human
ucccgcucagcccuc

SEQ ID NO: 3581526 - RNA, 21 nt, Human
ucccggacugcaagcagggcu

SEQ ID NO: 3581527 - RNA, 15 nt, Human
ucccggaggaaaucu

SEQ ID NO: 3581528 - RNA, 21 nt, Human
ucccggagggcccugagcuga

SEQ ID NO: 3581529 - RNA, 17 nt, Human
ucccgggccccacagac

SEQ ID NO: 3581530 - RNA, 21 nt, Human
ucccgggcccguugaggauga

SEQ ID NO: 3581531 - RNA, 14 nt, Human
ucccgggcccuccc

SEQ ID NO: 3581532 - RNA, 21 nt, Human
ucccggggccagcacuuccau

SEQ ID NO: 3581533 - RNA, 17 nt, Human
ucccggguccuuggccc

SEQ ID NO: 3581534 - RNA, 16 nt, Human
ucccgucagggcccaa

SEQ ID NO: 3581535 - RNA, 20 nt, Human
ucccgucagggcccaagucc

SEQ ID NO: 3581536 - RNA, 23 nt, Human
ucccgucagggcccaagucccug

SEQ ID NO: 3581537 - RNA, 22 nt, Human
ucccgugcaaaacaugcuaccu

SEQ ID NO: 3581538 - RNA, 22 nt, Human
ucccguggaacguuuuuccugu

SEQ ID NO: 3581539 - RNA, 12 nt, Human
ucccguggcccc

SEQ ID NO: 3581540 - RNA, 14 nt, Human
ucccguggccccag

SEQ ID NO: 3581541 - RNA, 15 nt, Human
ucccguggccccagc

SEQ ID NO: 3581542 - RNA, 15 nt, Human
ucccguguucuccuu

SEQ ID NO: 3581543 - RNA, 19 nt, Human
ucccguuuuccccaugaca

SEQ ID NO: 3581544 - RNA, 19 nt, Human
ucccuaaaauacauuuaaa

SEQ ID NO: 3581545 - RNA, 20 nt, Human
ucccuaagccaagggccucu

SEQ ID NO: 3581546 - RNA, 16 nt, Human
ucccuaagccagccug

SEQ ID NO: 3581547 - RNA, 14 nt, Human
ucccuaauaaagcu

SEQ ID NO: 3581548 - RNA, 16 nt, Human
ucccuaauaaagcugu

SEQ ID NO: 3581549 - RNA, 13 nt, Human
ucccuacauguau

SEQ ID NO: 3581550 - RNA, 16 nt, Human
ucccuacauuaaacau

SEQ ID NO: 3581551 - RNA, 19 nt, Human
ucccuacccccuaagagcc

SEQ ID NO: 3581552 - RNA, 16 nt, Human
ucccuacccucuagag

SEQ ID NO: 3581553 - RNA, 18 nt, Human
ucccuaccgacccagggu

SEQ ID NO: 3581554 - RNA, 21 nt, Human
ucccuaccgagucucuucucc

SEQ ID NO: 3581555 - RNA, 23 nt, Human
ucccuaccgagucucuucuccac

SEQ ID NO: 3581556 - RNA, 15 nt, Human
ucccuaccucaaccu

SEQ ID NO: 3581557 - RNA, 21 nt, Human
ucccuaccucaaccuguaaau

SEQ ID NO: 3581558 - RNA, 21 nt, Human
ucccuacugaagcccuuguga

SEQ ID NO: 3581559 - RNA, 15 nt, Human
ucccuacuguaauuu

SEQ ID NO: 3581560 - RNA, 15 nt, Human
ucccuacuuccugug

SEQ ID NO: 3581561 - RNA, 18 nt, Human
ucccuagaaacuuccaaa

SEQ ID NO: 3581562 - RNA, 16 nt, Human
ucccuagaucuuucua

SEQ ID NO: 3581563 - RNA, 17 nt, Human
ucccuagcagcccaccc

SEQ ID NO: 3581564 - RNA, 13 nt, Human
ucccuagcaguga

SEQ ID NO: 3581565 - RNA, 20 nt, Human
ucccuagcuuuagacccugg

SEQ ID NO: 3581566 - RNA, 14 nt, Human
ucccuagggcuggg

SEQ ID NO: 3581567 - RNA, 14 nt, Human
ucccuauacugcuu

SEQ ID NO: 3581568 - RNA, 19 nt, Human
ucccuaucuuugccacccu

SEQ ID NO: 3581569 - RNA, 21 nt, Human
ucccuauuuuucucuccuguc

SEQ ID NO: 3581570 - RNA, 20 nt, Human
ucccucaaagcacacgucau

SEQ ID NO: 3581571 - RNA, 18 nt, Human
ucccucaaagcuuccauu

SEQ ID NO: 3581572 - RNA, 18 nt, Human
ucccucaaccucauccuc

SEQ ID NO: 3581573 - RNA, 19 nt, Human
ucccucaaccucauccucu

SEQ ID NO: 3581574 - RNA, 15 nt, Human
ucccucaccuucuga

SEQ ID NO: 3581575 - RNA, 19 nt, Human
ucccucacucgucuccccc

SEQ ID NO: 3581576 - RNA, 21 nt, Human
ucccucacucgucucccccaa

SEQ ID NO: 3581577 - RNA, 14 nt, Human
ucccucagccccuc

SEQ ID NO: 3581578 - RNA, 15 nt, Human
ucccucagccccucu

SEQ ID NO: 3581579 - RNA, 16 nt, Human
ucccucagccccucuu

SEQ ID NO: 3581580 - RNA, 20 nt, Human
ucccucagucuggcccuucc

SEQ ID NO: 3581581 - RNA, 21 nt, Human
ucccucagucuggcccuuccu

SEQ ID NO: 3581582 - RNA, 16 nt, Human
ucccucagugcccuca

SEQ ID NO: 3581583 - RNA, 23 nt, Human
ucccucauuccaccuucccaugc

SEQ ID NO: 3581584 - RNA, 19 nt, Human
ucccucauuucaggagcag

SEQ ID NO: 3581585 - RNA, 23 nt, Human
ucccucauuucaggagcagccuc

SEQ ID NO: 3581586 - RNA, 16 nt, Human
ucccuccaccccagga

SEQ ID NO: 3581587 - RNA, 14 nt, Human
ucccuccaccuacc

SEQ ID NO: 3581588 - RNA, 23 nt, Human
ucccuccaccucccugcaauaaa

SEQ ID NO: 3581589 - RNA, 18 nt, Human
ucccuccacguucacccc

SEQ ID NO: 3581590 - RNA, 12 nt, Human
uccgcuggaggu

SEQ ID NO: 3581591 - RNA, 16 nt, Human
uccgcuucccugguuc

SEQ ID NO: 3581592 - RNA, 16 nt, Human
uccgcuuucuacccag

SEQ ID NO: 3581593 - RNA, 21 nt, Human
uccggaacguagucggcacag

SEQ ID NO: 3581594 - RNA, 18 nt, Human
uccggaaugccacccaca

SEQ ID NO: 3581595 - RNA, 12 nt, Human
uccggacuggug

SEQ ID NO: 3581596 - RNA, 15 nt, Human
uccggagauguagca

SEQ ID NO: 3581597 - RNA, 15 nt, Human
uccggaguagcuggg

SEQ ID NO: 3581598 - RNA, 23 nt, Human
uccggauuggcuuguguguuuca

SEQ ID NO: 3581599 - RNA, 19 nt, Human
uccggcagcuucugccccc

SEQ ID NO: 3581600 - RNA, 19 nt, Human
uccggcauggacaauggac

SEQ ID NO: 3581601 - RNA, 18 nt, Human
uccggcccuccagagccc

SEQ ID NO: 3581602 - RNA, 18 nt, Human
uccggcuaagcaggcgca

SEQ ID NO: 3581603 - RNA, 12 nt, Human
uccggcucccag

SEQ ID NO: 3581604 - RNA, 13 nt, Human
uccggcugugcug

SEQ ID NO: 3581605 - RNA, 19 nt, Human
uccggcugugcugggagaa

SEQ ID NO: 3581606 - RNA, 21 nt, Human
uccgggacguggcaccuccuc

SEQ ID NO: 3581607 - RNA, 22 nt, Human
uccgggggcagcucuggagggg

SEQ ID NO: 3581608 - RNA, 20 nt, Human
uccggguuugagauggacac

SEQ ID NO: 3581609 - RNA, 17 nt, Human
uccggucccugucccag

SEQ ID NO: 3581610 - RNA, 20 nt, Human
uccggucggaucucucuccu

SEQ ID NO: 3581611 - RNA, 15 nt, Human
uccgguguucuaaga

SEQ ID NO: 3581612 - RNA, 19 nt, Human
uccgguugcauacuggacu

SEQ ID NO: 3581613 - RNA, 16 nt, Human
uccgguuuacuuuaac

SEQ ID NO: 3581614 - RNA, 13 nt, Human
uccguaaaaauga

SEQ ID NO: 3581615 - RNA, 15 nt, Human
uccguaaaaaugauu

SEQ ID NO: 3581616 - RNA, 14 nt, Human
uccguaguucccug

SEQ ID NO: 3581617 - RNA, 15 nt, Human
uccguaguucccuga

SEQ ID NO: 3581618 - RNA, 13 nt, Human
uccguauuucaga

SEQ ID NO: 3581619 - RNA, 23 nt, Human
uccgucaaaacagauuguuugca

SEQ ID NO: 3581620 - RNA, 14 nt, Human
uccgucacuaccug

SEQ ID NO: 3581621 - RNA, 14 nt, Human
uccgugcuaaggac

SEQ ID NO: 3581622 - RNA, 15 nt, Human
uccgugcuaaggacu

SEQ ID NO: 3581623 - RNA, 14 nt, Human
uccgugcuuaacca

SEQ ID NO: 3581624 - RNA, 21 nt, Human
uccgugcuuaaccaaagaagc

SEQ ID NO: 3581625 - RNA, 24 nt, Human
uccgugcuuguuugcucaccuggg

SEQ ID NO: 3581626 - RNA, 15 nt, Human
uccguggguugcuaa

SEQ ID NO: 3581627 - RNA, 16 nt, Human
uccgugugggagaccg

SEQ ID NO: 3581628 - RNA, 13 nt, Human
uccguuaaaauac

SEQ ID NO: 3581629 - RNA, 15 nt, Human
uccguuaaaauacca

SEQ ID NO: 3581630 - RNA, 16 nt, Human
uccguucacaugugug

SEQ ID NO: 3581631 - RNA, 22 nt, Human
uccuaaaacaaaagcucaucca

SEQ ID NO: 3581632 - RNA, 16 nt, Human
uccuaaaacaacagau

SEQ ID NO: 3581633 - RNA, 17 nt, Human
uccuaaaacaccuggua

SEQ ID NO: 3581634 - RNA, 13 nt, Human
uccuaaaaggccc

SEQ ID NO: 3581635 - RNA, 16 nt, Human
uccuaaaaggcccaga

SEQ ID NO: 3581636 - RNA, 22 nt, Human
uccuaaaauuauggaaacagau

SEQ ID NO: 3581637 - RNA, 23 nt, Human
uccuaaacugagacaaugccuug

SEQ ID NO: 3581638 - RNA, 17 nt, Human
uccuaaagaacaaagua

SEQ ID NO: 3581639 - RNA, 11 nt, Human
uccuaaauagc

SEQ ID NO: 3581640 - RNA, 19 nt, Human
uccuaaauauauuuuaaga

SEQ ID NO: 3581641 - RNA, 21 nt, Human
uccuaaauauuaugagaugcu

SEQ ID NO: 3581642 - RNA, 19 nt, Human
uccuaaaugcagugaauug

SEQ ID NO: 3581643 - RNA, 17 nt, Human
uccuaacugaagagaca

SEQ ID NO: 3581644 - RNA, 13 nt, Human
uccuaagaaagag

SEQ ID NO: 3581645 - RNA, 20 nt, Human
uccuaagaaagaggagugcu

SEQ ID NO: 3581646 - RNA, 20 nt, Human
uccuaagaaauaugugagau

SEQ ID NO: 3581647 - RNA, 16 nt, Human
uccuaagaagcuucua

SEQ ID NO: 3581648 - RNA, 19 nt, Human
uccuaagaagcuucuaaua

SEQ ID NO: 3581649 - RNA, 19 nt, Human
uccuaagacacaaaugcau

SEQ ID NO: 3581650 - RNA, 16 nt, Human
uccuaagagugcuggg

SEQ ID NO: 3581651 - RNA, 17 nt, Human
uccuaagagugcugggc

SEQ ID NO: 3581652 - RNA, 15 nt, Human
uccuaagcaucuaag

SEQ ID NO: 3581653 - RNA, 16 nt, Human
uccuaagccuguggcu

SEQ ID NO: 3581654 - RNA, 20 nt, Human
uccuaagccuguggcugugg

SEQ ID NO: 3581655 - RNA, 16 nt, Human
uccuaagcuauucagu

SEQ ID NO: 3581656 - RNA, 18 nt, Human
uccuaagcuauucaguaa

SEQ ID NO: 3581657 - RNA, 20 nt, Human
uccuaagggucgaaagcucu

SEQ ID NO: 3581658 - RNA, 21 nt, Human
uccuaaguaucaaguauagaa

SEQ ID NO: 3581659 - RNA, 22 nt, Human
uccuaaguucuuagauaucuuu

SEQ ID NO: 3581660 - RNA, 16 nt, Human
uccuaauaaaaaggug

SEQ ID NO: 3581661 - RNA, 18 nt, Human
uccuaaucacucagagca

SEQ ID NO: 3581662 - RNA, 14 nt, Human
uccuaauggugaug

SEQ ID NO: 3581663 - RNA, 18 nt, Human
uccuaauuaccagucuuu

SEQ ID NO: 3581664 - RNA, 16 nt, Human
uccuaauuccacagcu

SEQ ID NO: 3581665 - RNA, 17 nt, Human
uccuaauuccacagcug

SEQ ID NO: 3581666 - RNA, 18 nt, Human
uccuaauuccacagcugc

SEQ ID NO: 3581667 - RNA, 14 nt, Human
uccuaauuucccuu

SEQ ID NO: 3581668 - RNA, 19 nt, Human
uccuaauuucccuucuugc

SEQ ID NO: 3581669 - RNA, 16 nt, Human
uccuaauuucuccucc

SEQ ID NO: 3581670 - RNA, 22 nt, Human
uccuacaagagcagccuguggc

SEQ ID NO: 3581671 - RNA, 17 nt, Human
uccuacaagauuuagaa

SEQ ID NO: 3581672 - RNA, 18 nt, Human
uccuacaagauuuagaaa

SEQ ID NO: 3581673 - RNA, 18 nt, Human
uccuacacccuuggacuu

SEQ ID NO: 3581674 - RNA, 20 nt, Human
uccuacacccuuggacuuga

SEQ ID NO: 3581675 - RNA, 13 nt, Human
uccuacagaaaaa

SEQ ID NO: 3581676 - RNA, 14 nt, Human
uccuacagaaaaac

SEQ ID NO: 3581677 - RNA, 17 nt, Human
uccuacagaaaaaccuu

SEQ ID NO: 3581678 - RNA, 20 nt, Human
uccuacagaaaaaccuuggg

SEQ ID NO: 3581679 - RNA, 16 nt, Human
uccuacagauagucaa

SEQ ID NO: 3581680 - RNA, 21 nt, Human
uccuacagcacuacugggugu

SEQ ID NO: 3581681 - RNA, 16 nt, Human
uccuacaggcagucuc

SEQ ID NO: 3581682 - RNA, 17 nt, Human
uccuacaggcagucucu

SEQ ID NO: 3581683 - RNA, 20 nt, Human
uccuacauuaauuaucuagu

SEQ ID NO: 3581684 - RNA, 20 nt, Human
uccuaccaauagauucccca

SEQ ID NO: 3581685 - RNA, 14 nt, Human
uccuaccaaugcau

SEQ ID NO: 3581686 - RNA, 16 nt, Human
uccuaccaaugcaugc

SEQ ID NO: 3581687 - RNA, 17 nt, Human
uccuaccaaugcaugca

SEQ ID NO: 3581688 - RNA, 15 nt, Human
uccuacccacaccuc

SEQ ID NO: 3581689 - RNA, 20 nt, Human
uccuacccacaccucugcca

SEQ ID NO: 3581690 - RNA, 21 nt, Human
uccuacccacaccucugccag

SEQ ID NO: 3581691 - RNA, 18 nt, Human
uccuacccacccuccuuu

SEQ ID NO: 3581692 - RNA, 18 nt, Human
uccuaccccaauuccuug

SEQ ID NO: 3581693 - RNA, 13 nt, Human
uccuacccccugu

SEQ ID NO: 3581694 - RNA, 12 nt, Human
uccuaccccucc

SEQ ID NO: 3581695 - RNA, 14 nt, Human
uccuaccccuccca

SEQ ID NO: 3581696 - RNA, 16 nt, Human
uccuaccccucccagc

SEQ ID NO: 3581697 - RNA, 18 nt, Human
uccuaccccucccagcug

SEQ ID NO: 3581698 - RNA, 17 nt, Human
uccuacccucgggccca

SEQ ID NO: 3581699 - RNA, 14 nt, Human
uccuacccuuuucu

SEQ ID NO: 3581700 - RNA, 12 nt, Human
uccuaccucagc

SEQ ID NO: 3581701 - RNA, 20 nt, Human
uccuacgucaaacaugaagu

SEQ ID NO: 3581702 - RNA, 16 nt, Human
uccuacuaggcaaaau

SEQ ID NO: 3581703 - RNA, 12 nt, Human
uccuacuccuga

SEQ ID NO: 3581704 - RNA, 14 nt, Human
uccuacuccugacu

SEQ ID NO: 3581705 - RNA, 13 nt, Human
uccuacucugugu

SEQ ID NO: 3581706 - RNA, 17 nt, Human
uccuacucuucucucug

SEQ ID NO: 3581707 - RNA, 19 nt, Human
uccuacuggucucucuaug

SEQ ID NO: 3581708 - RNA, 18 nt, Human
uccuacuuuuaaagaauu

SEQ ID NO: 3581709 - RNA, 19 nt, Human
uccuagagaacgcagcccu

SEQ ID NO: 3581710 - RNA, 18 nt, Human
uccuagagacagaagcag

SEQ ID NO: 3581711 - RNA, 20 nt, Human
uccuagaggcccuuugcugu

SEQ ID NO: 3581712 - RNA, 17 nt, Human
uccuagagggaggggcc

SEQ ID NO: 3581713 - RNA, 16 nt, Human
uccuagauaaaaagau

SEQ ID NO: 3581714 - RNA, 13 nt, Human
uccuagauccuaa

SEQ ID NO: 3581715 - RNA, 17 nt, Human
uccuagcacacacuuuu

SEQ ID NO: 3581716 - RNA, 18 nt, Human
uccuagcacacacuuuug

SEQ ID NO: 3581717 - RNA, 20 nt, Human
uccuagcacagauggccagc

SEQ ID NO: 3581718 - RNA, 21 nt, Human
uccuagccugugccucuggga

SEQ ID NO: 3581719 - RNA, 16 nt, Human
uccuagccuguuucuu

SEQ ID NO: 3581720 - RNA, 19 nt, Human
uccuagccuguuucuuccu

SEQ ID NO: 3581721 - RNA, 17 nt, Human
uccuagcugcacagggc

SEQ ID NO: 3581722 - RNA, 23 nt, Human
uccuagcuggagaggagcccugc

SEQ ID NO: 3581723 - RNA, 12 nt, Human
uccuagcugugu

SEQ ID NO: 3581724 - RNA, 17 nt, Human
uccuagcugugugaaua

SEQ ID NO: 3581725 - RNA, 20 nt, Human
uccuaggagguaaugaccau

SEQ ID NO: 3581726 - RNA, 19 nt, Human
uccuaggcaggacaugcug

SEQ ID NO: 3581727 - RNA, 23 nt, Human
uccuaggcauucuggaccucugg

SEQ ID NO: 3581728 - RNA, 19 nt, Human
uccuaggcauuugcugaau

SEQ ID NO: 3581729 - RNA, 20 nt, Human
uccuaggcuccaccccaucc

SEQ ID NO: 3581730 - RNA, 23 nt, Human
uccuagggcauuguaucugucuu

SEQ ID NO: 3581731 - RNA, 18 nt, Human
uccuaggggaaugagggg

SEQ ID NO: 3581732 - RNA, 14 nt, Human
uccuaguaagaaga

SEQ ID NO: 3581733 - RNA, 18 nt, Human
uccuagucucccucacag

SEQ ID NO: 3581734 - RNA, 21 nt, Human
uccuaguuaaucaucauuuuu

SEQ ID NO: 3581735 - RNA, 19 nt, Human
ucuaggggucaggcuccau

SEQ ID NO: 3581736 - RNA, 18 nt, Human
ucuaggguuauugcauuu

SEQ ID NO: 3581737 - RNA, 21 nt, Human
ucuaggguugcuggagccuga

SEQ ID NO: 3581738 - RNA, 22 nt, Human
ucuaggguugcuggagccugag

SEQ ID NO: 3581739 - RNA, 21 nt, Human
ucuagguacgaugacaguguu

SEQ ID NO: 3581740 - RNA, 17 nt, Human
ucuagguccccauacuc

SEQ ID NO: 3581741 - RNA, 18 nt, Human
ucuagguggcaaggcugu

SEQ ID NO: 3581742 - RNA, 14 nt, Human
ucuagguucuaaaa

SEQ ID NO: 3581743 - RNA, 17 nt, Human
ucuagguuuaacucaga

SEQ ID NO: 3581744 - RNA, 19 nt, Human
ucuagguuuaacucagauc

SEQ ID NO: 3581745 - RNA, 14 nt, Human
ucuaguacuagaaa

SEQ ID NO: 3581746 - RNA, 15 nt, Human
ucuaguaugaaauua

SEQ ID NO: 3581747 - RNA, 24 nt, Human
ucuaguauuccagaccugaagaau

SEQ ID NO: 3581748 - RNA, 20 nt, Human
ucuagucuccuuugcacuga

SEQ ID NO: 3581749 - RNA, 14 nt, Human
ucuagucucucugg

SEQ ID NO: 3581750 - RNA, 12 nt, Human
ucuagugaugau

SEQ ID NO: 3581751 - RNA, 19 nt, Human
ucuagugcagcugaaauug

SEQ ID NO: 3581752 - RNA, 22 nt, Human
ucuagugcagcugauuuuaaca

SEQ ID NO: 3581753 - RNA, 17 nt, Human
ucuagugcugcugaaga

SEQ ID NO: 3581754 - RNA, 15 nt, Human
ucuagugcugugaaa

SEQ ID NO: 3581755 - RNA, 23 nt, Human
ucuagugcugugaaaaaaaaaau

SEQ ID NO: 3581756 - RNA, 16 nt, Human
ucuaguggucuuugua

SEQ ID NO: 3581757 - RNA, 19 nt, Human
ucuaguggucuuuguaaga

SEQ ID NO: 3581758 - RNA, 12 nt, Human
ucuaguguauca

SEQ ID NO: 3581759 - RNA, 19 nt, Human
ucuaguguaucaaaaugcu

SEQ ID NO: 3581760 - RNA, 16 nt, Human
ucuaguucacucucca

SEQ ID NO: 3581761 - RNA, 16 nt, Human
ucuaguucugccagga

SEQ ID NO: 3581762 - RNA, 13 nt, Human
ucuaguucuuugu

SEQ ID NO: 3581763 - RNA, 19 nt, Human
ucuaguugaggaguuuccu

SEQ ID NO: 3581764 - RNA, 21 nt, Human
ucuaguugccaaaucuggcuc

SEQ ID NO: 3581765 - RNA, 22 nt, Human
ucuaguuguuugauucagacag

SEQ ID NO: 3581766 - RNA, 22 nt, Human
ucuaguuuaauuaaucuguaau

SEQ ID NO: 3581767 - RNA, 13 nt, Human
ucuaguuucucuu

SEQ ID NO: 3581768 - RNA, 21 nt, Human
ucuaguuugauuaaauucuug

SEQ ID NO: 3581769 - RNA, 11 nt, Human
ucuaguuuuca

SEQ ID NO: 3581770 - RNA, 20 nt, Human
ucuaguuuucaguuuguaua

SEQ ID NO: 3581771 - RNA, 22 nt, Human
ucuaguuuuuuacuuuuguuua

SEQ ID NO: 3581772 - RNA, 16 nt, Human
ucuauaaaagaaacac

SEQ ID NO: 3581773 - RNA, 14 nt, Human
ucuauaaaauagau

SEQ ID NO: 3581774 - RNA, 13 nt, Human
ucuauaaacacug

SEQ ID NO: 3581775 - RNA, 14 nt, Human
ucuauaaacacugu

SEQ ID NO: 3581776 - RNA, 17 nt, Human
ucuauaaacacuguuug

SEQ ID NO: 3581777 - RNA, 21 nt, Human
ucuauaaacuauaaccucucc

SEQ ID NO: 3581778 - RNA, 12 nt, Human
ucuauaaagcau

SEQ ID NO: 3581779 - RNA, 14 nt, Human
ucuauaaagcauuu

SEQ ID NO: 3581780 - RNA, 17 nt, Human
ucuauaaagcauuuaac

SEQ ID NO: 3581781 - RNA, 19 nt, Human
ucuauaaagcauuuaaccc

SEQ ID NO: 3581782 - RNA, 13 nt, Human
ucuauaacagaua

SEQ ID NO: 3581783 - RNA, 19 nt, Human
ucuauaaucccagcacuuu

SEQ ID NO: 3581784 - RNA, 21 nt, Human
ucuauaaucccagcacuuugg

SEQ ID NO: 3581785 - RNA, 15 nt, Human
ucuauaauuuuacaa

SEQ ID NO: 3581786 - RNA, 22 nt, Human
ucuauacaaauauaaaucuuaa

SEQ ID NO: 3581787 - RNA, 15 nt, Human
ucuauacaucucucc

SEQ ID NO: 3581788 - RNA, 15 nt, Human
ucuauaccaauaaag

SEQ ID NO: 3581789 - RNA, 18 nt, Human
ucuauaccaauaaaguga

SEQ ID NO: 3581790 - RNA, 16 nt, Human
ucuauacccacccaga

SEQ ID NO: 3581791 - RNA, 14 nt, Human
ucuauagaaagugu

SEQ ID NO: 3581792 - RNA, 21 nt, Human
ucuauagaaaguguucuguua

SEQ ID NO: 3581793 - RNA, 24 nt, Human
ucuauagaaaguguucuguuacaa

SEQ ID NO: 3581794 - RNA, 16 nt, Human
ucuauagacucuagga

SEQ ID NO: 3581795 - RNA, 15 nt, Human
ucuauagcaucacuu

SEQ ID NO: 3581796 - RNA, 20 nt, Human
ucuauagcaucacuuaaaac

SEQ ID NO: 3581797 - RNA, 17 nt, Human
ucuauagccaaaaauag

SEQ ID NO: 3581798 - RNA, 19 nt, Human
ucuauagccaaaaauagcu

SEQ ID NO: 3581799 - RNA, 20 nt, Human
ucuauagccaaaaauagcua

SEQ ID NO: 3581800 - RNA, 12 nt, Human
ucuauaguucua

SEQ ID NO: 3581801 - RNA, 21 nt, Human
ucuauaguugauauguuuuau

SEQ ID NO: 3581802 - RNA, 16 nt, Human
ucuauaguugucagua

SEQ ID NO: 3581803 - RNA, 23 nt, Human
ucuauauaaaauaacuaaaaugu

SEQ ID NO: 3581804 - RNA, 19 nt, Human
ucuauauauaauucuguac

SEQ ID NO: 3581805 - RNA, 20 nt, Human
ucuauauauaauucuguaca

SEQ ID NO: 3581806 - RNA, 14 nt, Human
ucuauauaugugua

SEQ ID NO: 3581807 - RNA, 15 nt, Human
ucuauauauguguau

SEQ ID NO: 3581808 - RNA, 19 nt, Human
ucuauauauguguauguac

SEQ ID NO: 3581809 - RNA, 14 nt, Human
ucuauaugaauuua

SEQ ID NO: 3581810 - RNA, 21 nt, Human
ucuauaugaauuuaaauauaa

SEQ ID NO: 3581811 - RNA, 21 nt, Human
ucuauauguacuugucaaaga

SEQ ID NO: 3581812 - RNA, 14 nt, Human
ucuauauuuucauu

SEQ ID NO: 3581813 - RNA, 22 nt, Human
ucuaucaaccccagacacuggu

SEQ ID NO: 3581814 - RNA, 20 nt, Human
ucuaucaacuuuaaucaagu

SEQ ID NO: 3581815 - RNA, 17 nt, Human
ucuaucaagucaaucau

SEQ ID NO: 3581816 - RNA, 15 nt, Human
ucuaucaauagucaa

SEQ ID NO: 3581817 - RNA, 14 nt, Human
ucuaucauuaaagu

SEQ ID NO: 3581818 - RNA, 14 nt, Human
ucuaucauuuaaua

SEQ ID NO: 3581819 - RNA, 18 nt, Human
ucuaucauuuaauaauau

SEQ ID NO: 3581820 - RNA, 17 nt, Human
ucuaucauuuuuguaca

SEQ ID NO: 3581821 - RNA, 14 nt, Human
ucuaucuaaaugau

SEQ ID NO: 3581822 - RNA, 12 nt, Human
ucuaucuaauga

SEQ ID NO: 3581823 - RNA, 16 nt, Human
ucuaucuaaugacaug

SEQ ID NO: 3581824 - RNA, 14 nt, Human
ucuaucuauuugag

SEQ ID NO: 3581825 - RNA, 16 nt, Human
ucuaucugggccuggg

SEQ ID NO: 3581826 - RNA, 17 nt, Human
ucuaucuuccaaaugca

SEQ ID NO: 3581827 - RNA, 14 nt, Human
ucuaucuuguucca

SEQ ID NO: 3581828 - RNA, 17 nt, Human
ucuaugaaauauuaugu

SEQ ID NO: 3581829 - RNA, 18 nt, Human
ucuaugaaguauauaaug

SEQ ID NO: 3581830 - RNA, 12 nt, Human
ucuaugagaaaa

SEQ ID NO: 3581831 - RNA, 17 nt, Human
ucuaugagaaaagaggc

SEQ ID NO: 3581832 - RNA, 15 nt, Human
ucuaugcauuuucug

SEQ ID NO: 3581833 - RNA, 15 nt, Human
ucuaugccaaagauc

SEQ ID NO: 3581834 - RNA, 18 nt, Human
ucuaugcucauaacugug

SEQ ID NO: 3581835 - RNA, 22 nt, Human
ucuaugcugcuuuuauaucugu

SEQ ID NO: 3581836 - RNA, 21 nt, Human
ucuaugcuguuuguagugaaa

SEQ ID NO: 3581837 - RNA, 18 nt, Human
ucuaugcuuuccaaaccu

SEQ ID NO: 3581838 - RNA, 23 nt, Human
ucuaugcuuuccaaaccuuaucu

SEQ ID NO: 3581839 - RNA, 21 nt, Human
ucuauggacagggcugucucu

SEQ ID NO: 3581840 - RNA, 22 nt, Human
ucuaugguuaugaaagaauaua

SEQ ID NO: 3581841 - RNA, 21 nt, Human
ucuauguacuaguacugugua

SEQ ID NO: 3581842 - RNA, 15 nt, Human
ucuauguaggaaaaa

SEQ ID NO: 3581843 - RNA, 13 nt, Human
ucuauguaucaaa

SEQ ID NO: 3581844 - RNA, 17 nt, Human
ucuaugugcuuguaaaa

SEQ ID NO: 3581845 - RNA, 14 nt, Human
ucuauguuaauauu

SEQ ID NO: 3581846 - RNA, 12 nt, Human
ucuauguuuacu

SEQ ID NO: 3581847 - RNA, 13 nt, Human
ucuauuaaaagac

SEQ ID NO: 3581848 - RNA, 23 nt, Human
ucuauuaaagugcuaagguucua

SEQ ID NO: 3581849 - RNA, 13 nt, Human
ucuauuaauauau

SEQ ID NO: 3581850 - RNA, 20 nt, Human
ucuauuagcuuacugauuaa

SEQ ID NO: 3581851 - RNA, 14 nt, Human
ucuauuauacugua

SEQ ID NO: 3581852 - RNA, 19 nt, Human
ucuauuauacuguauuaag

SEQ ID NO: 3581853 - RNA, 22 nt, Human
ucuauuaugaaugugaagccuu

SEQ ID NO: 3581854 - RNA, 20 nt, Human
ucuauuauggaaaacugugu

SEQ ID NO: 3581855 - RNA, 12 nt, Human
ucuauucagcuu

SEQ ID NO: 3581856 - RNA, 13 nt, Human
ucuauuccagcuc

SEQ ID NO: 3581857 - RNA, 19 nt, Human
ucuauuccagcucauucau

SEQ ID NO: 3581858 - RNA, 20 nt, Human
ucuauuccagcucauucauu

SEQ ID NO: 3581859 - RNA, 17 nt, Human
ucuauucucaaaguuuc

SEQ ID NO: 3581860 - RNA, 13 nt, Human
ucuauucucucca

SEQ ID NO: 3581861 - RNA, 19 nt, Human
ucuauucucuccucagacu

SEQ ID NO: 3581862 - RNA, 12 nt, Human
ucuauucugugu

SEQ ID NO: 3581863 - RNA, 16 nt, Human
ucuauucuuuaacucc

SEQ ID NO: 3581864 - RNA, 13 nt, Human
ucuauugccuucu

SEQ ID NO: 3581865 - RNA, 17 nt, Human
ucuauugcuggcaaaga

SEQ ID NO: 3581866 - RNA, 22 nt, Human
ucuauugcuggcaaagacagaa

SEQ ID NO: 3581867 - RNA, 12 nt, Human
ucuauuggucuc

SEQ ID NO: 3581868 - RNA, 23 nt, Human
ucuauuguuguacacagaaauac

SEQ ID NO: 3581869 - RNA, 16 nt, Human
ucuauuguuuauucuu

SEQ ID NO: 3581870 - RNA, 13 nt, Human
ucuauuuaaauuc

SEQ ID NO: 3581871 - RNA, 14 nt, Human
ucuauuuaaauucu

SEQ ID NO: 3581872 - RNA, 15 nt, Human
ucuauuuaaauucuu

SEQ ID NO: 3581873 - RNA, 18 nt, Human
ucuauuuaaauucuuuuu

SEQ ID NO: 3581874 - RNA, 15 nt, Human
ucuauuuaaguaaaa

SEQ ID NO: 3581875 - RNA, 12 nt, Human
ucuauuuaauau

SEQ ID NO: 3581876 - RNA, 18 nt, Human
ucuauuuaauuaggaaaa

SEQ ID NO: 3581877 - RNA, 20 nt, Human
ucuauuuaauuaggaaaaaa

SEQ ID NO: 3581878 - RNA, 23 nt, Human
ucuauuuaauuuugacacugaaa

SEQ ID NO: 3581879 - RNA, 15 nt, Human
ucuauuuaucuucau

SEQ ID NO: 3581880 - RNA, 22 nt, Human
ucuccauccuuucugccucuca

SEQ ID NO: 3581881 - RNA, 11 nt, Human
ucuccaucucu

SEQ ID NO: 3581882 - RNA, 14 nt, Human
ucuccaucucucug

SEQ ID NO: 3581883 - RNA, 13 nt, Human
ucuccaucuguca

SEQ ID NO: 3581884 - RNA, 17 nt, Human
ucuccauggcaucuucg

SEQ ID NO: 3581885 - RNA, 16 nt, Human
ucuccauggcccugcc

SEQ ID NO: 3581886 - RNA, 17 nt, Human
ucuccauggcccugcca

SEQ ID NO: 3581887 - RNA, 20 nt, Human
ucuccauggcccugccaugc

SEQ ID NO: 3581888 - RNA, 16 nt, Human
ucuccauguuugaugu

SEQ ID NO: 3581889 - RNA, 15 nt, Human
ucuccauucugcucc

SEQ ID NO: 3581890 - RNA, 21 nt, Human
ucuccauucugcuccuucccc

SEQ ID NO: 3581891 - RNA, 19 nt, Human
ucuccauugugccuaaguc

SEQ ID NO: 3581892 - RNA, 19 nt, Human
ucuccauuuaauaauuaua

SEQ ID NO: 3581893 - RNA, 19 nt, Human
ucuccauuuuggugucuuu

SEQ ID NO: 3581894 - RNA, 18 nt, Human
ucucccaaaaaacuacuu

SEQ ID NO: 3581895 - RNA, 18 nt, Human
ucucccaaagugcuggga

SEQ ID NO: 3581896 - RNA, 12 nt, Human
ucucccacacug

SEQ ID NO: 3581897 - RNA, 12 nt, Human
ucucccacccuc

SEQ ID NO: 3581898 - RNA, 14 nt, Human
ucucccacccucuu

SEQ ID NO: 3581899 - RNA, 16 nt, Human
ucucccacgugggaga

SEQ ID NO: 3581900 - RNA, 18 nt, Human
ucucccagaaucccagcc

SEQ ID NO: 3581901 - RNA, 21 nt, Human
ucucccagauaaugugaaaau

SEQ ID NO: 3581902 - RNA, 23 nt, Human
ucucccagauaaugugaaaaugg

SEQ ID NO: 3581903 - RNA, 13 nt, Human
ucucccaggccag

SEQ ID NO: 3581904 - RNA, 14 nt, Human
ucucccaggccagg

SEQ ID NO: 3581905 - RNA, 18 nt, Human
ucucccaggccaggcucc

SEQ ID NO: 3581906 - RNA, 23 nt, Human
ucucccaggccaggcuccuuccu

SEQ ID NO: 3581907 - RNA, 14 nt, Human
ucucccaggcccca

SEQ ID NO: 3581908 - RNA, 17 nt, Human
ucucccaggccccauga

SEQ ID NO: 3581909 - RNA, 18 nt, Human
ucucccaggggcuggcuu

SEQ ID NO: 3581910 - RNA, 23 nt, Human
ucucccaggggcuggcuucagga

SEQ ID NO: 3581911 - RNA, 17 nt, Human
ucucccagguaccagcu

SEQ ID NO: 3581912 - RNA, 15 nt, Human
ucucccagucauuua

SEQ ID NO: 3581913 - RNA, 18 nt, Human
ucucccagucuacccaga

SEQ ID NO: 3581914 - RNA, 20 nt, Human
ucucccagucuacccagaga

SEQ ID NO: 3581915 - RNA, 19 nt, Human
ucucccaucucuuccuuga

SEQ ID NO: 3581916 - RNA, 15 nt, Human
ucucccaucuuaacu

SEQ ID NO: 3581917 - RNA, 18 nt, Human
ucucccauggagccccag

SEQ ID NO: 3581918 - RNA, 17 nt, Human
ucucccauugucccucu

SEQ ID NO: 3581919 - RNA, 19 nt, Human
ucuccccaaugagacuugc

SEQ ID NO: 3581920 - RNA, 23 nt, Human
ucuccccaaugagacuugccuuc

SEQ ID NO: 3581921 - RNA, 10 nt, Human
ucuccccaca

SEQ ID NO: 3581922 - RNA, 14 nt, Human
ucuccccaccccua

SEQ ID NO: 3581923 - RNA, 17 nt, Human
ucuccccaccccuaccc

SEQ ID NO: 3581924 - RNA, 19 nt, Human
ucuccccacgagggcuggc

SEQ ID NO: 3581925 - RNA, 12 nt, Human
ucuccccagaau

SEQ ID NO: 3581926 - RNA, 15 nt, Human
ucuccccagcccaga

SEQ ID NO: 3581927 - RNA, 18 nt, Human
ucuccccagcccagagac

SEQ ID NO: 3581928 - RNA, 15 nt, Human
ucuccccagcuccca

SEQ ID NO: 3581929 - RNA, 12 nt, Human
ucuccccagugu

SEQ ID NO: 3581930 - RNA, 21 nt, Human
ucucccccaacagcuggaccc

SEQ ID NO: 3581931 - RNA, 13 nt, Human
ucucccccacccu

SEQ ID NO: 3581932 - RNA, 20 nt, Human
ucucccccacccuuguucca

SEQ ID NO: 3581933 - RNA, 21 nt, Human
ucucccccacccuuguuccag

SEQ ID NO: 3581934 - RNA, 12 nt, Human
ucucccccagcc

SEQ ID NO: 3581935 - RNA, 15 nt, Human
ucucccccagcccca

SEQ ID NO: 3581936 - RNA, 15 nt, Human
ucuccccccgccugc

SEQ ID NO: 3581937 - RNA, 16 nt, Human
ucuccccgcaguguuu

SEQ ID NO: 3581938 - RNA, 12 nt, Human
ucuccccugccc

SEQ ID NO: 3581939 - RNA, 15 nt, Human
ucuccccugccccca

SEQ ID NO: 3581940 - RNA, 16 nt, Human
ucuccccugcccccag

SEQ ID NO: 3581941 - RNA, 22 nt, Human
ucuccccugcccccaggacugg

SEQ ID NO: 3581942 - RNA, 23 nt, Human
ucuccccugcccccaggacuggg

SEQ ID NO: 3581943 - RNA, 18 nt, Human
ucuccccugcccccugca

SEQ ID NO: 3581944 - RNA, 21 nt, Human
ucuccccugcccccugcagga

SEQ ID NO: 3581945 - RNA, 21 nt, Human
ucuccccuuccauuucugccu

SEQ ID NO: 3581946 - RNA, 15 nt, Human
ucucccgcugcugcu

SEQ ID NO: 3581947 - RNA, 16 nt, Human
ucucccgguucuucca

SEQ ID NO: 3581948 - RNA, 13 nt, Human
ucucccgucaggg

SEQ ID NO: 3581949 - RNA, 20 nt, Human
ucucccuagcuccuccccuu

SEQ ID NO: 3581950 - RNA, 23 nt, Human
ucucccucaacaagggagagacc

SEQ ID NO: 3581951 - RNA, 18 nt, Human
ucucccucagucuggccc

SEQ ID NO: 3581952 - RNA, 12 nt, Human
ucucccuccccu

SEQ ID NO: 3581953 - RNA, 14 nt, Human
ucucccucccuugg

SEQ ID NO: 3581954 - RNA, 21 nt, Human
ucucccuccuccaggaagccu

SEQ ID NO: 3581955 - RNA, 18 nt, Human
ucucccuccucugcccgg

SEQ ID NO: 3581956 - RNA, 19 nt, Human
ucucccucgaacccacacu

SEQ ID NO: 3581957 - RNA, 21 nt, Human
ucucccucuaggcucugccuu

SEQ ID NO: 3581958 - RNA, 23 nt, Human
ucucccucucacugucugagagu

SEQ ID NO: 3581959 - RNA, 15 nt, Human
ucucccucuccugcc

SEQ ID NO: 3581960 - RNA, 21 nt, Human
ucucccucuccugccuacuca

SEQ ID NO: 3581961 - RNA, 12 nt, Human
ucucccucuggc

SEQ ID NO: 3581962 - RNA, 13 nt, Human
ucucccucugguc

SEQ ID NO: 3581963 - RNA, 15 nt, Human
ucucccugacccugu

SEQ ID NO: 3581964 - RNA, 15 nt, Human
ucucccugcauggca

SEQ ID NO: 3581965 - RNA, 14 nt, Human
ucucccugccagag

SEQ ID NO: 3581966 - RNA, 12 nt, Human
ucucccugccgc

SEQ ID NO: 3581967 - RNA, 13 nt, Human
ucucccugccugg

SEQ ID NO: 3581968 - RNA, 14 nt, Human
ucucccugccuggc

SEQ ID NO: 3581969 - RNA, 15 nt, Human
ucucccugccuggcc

SEQ ID NO: 3581970 - RNA, 13 nt, Human
ucucccuggcucc

SEQ ID NO: 3581971 - RNA, 15 nt, Human
ucucccuggcucccu

SEQ ID NO: 3581972 - RNA, 16 nt, Human
ucucccuggugcuuau

SEQ ID NO: 3581973 - RNA, 12 nt, Human
ucucccuuaccc

SEQ ID NO: 3581974 - RNA, 23 nt, Human
ucuccgaccagacaccuugacag

SEQ ID NO: 3581975 - RNA, 17 nt, Human
ucuccgacugcuaggga

SEQ ID NO: 3581976 - RNA, 15 nt, Human
ucuccgccccugagc

SEQ ID NO: 3581977 - RNA, 17 nt, Human
ucuccgccccugagccc

SEQ ID NO: 3581978 - RNA, 14 nt, Human
ucuccggccucucc

SEQ ID NO: 3581979 - RNA, 17 nt, Human
ucuccggccucuccagc

SEQ ID NO: 3581980 - RNA, 21 nt, Human
ucuccggccucuccagccuca

SEQ ID NO: 3581981 - RNA, 15 nt, Human
ucuccggcucccagc

SEQ ID NO: 3581982 - RNA, 16 nt, Human
ucuccggcucccagcc

SEQ ID NO: 3581983 - RNA, 18 nt, Human
ucuccggcucccagccuc

SEQ ID NO: 3581984 - RNA, 19 nt, Human
ucuccggggccauuugcaa

SEQ ID NO: 3581985 - RNA, 22 nt, Human
ucuccguuagcuccuguggccc

SEQ ID NO: 3581986 - RNA, 23 nt, Human
ucuccguuagcuccuguggcccc

SEQ ID NO: 3581987 - RNA, 15 nt, Human
ucuccuacugaggau

SEQ ID NO: 3581988 - RNA, 17 nt, Human
ucuccuagacugacccu

SEQ ID NO: 3581989 - RNA, 15 nt, Human
ucuccuaggcauucu

SEQ ID NO: 3581990 - RNA, 16 nt, Human
ucuccuagggcuaugg

SEQ ID NO: 3581991 - RNA, 16 nt, Human
ucuccuauaaucuguc

SEQ ID NO: 3581992 - RNA, 17 nt, Human
ucuccuauaaucuguca

SEQ ID NO: 3581993 - RNA, 18 nt, Human
ucuccuauaaucugucaa

SEQ ID NO: 3581994 - RNA, 23 nt, Human
ucuccuauauauuucuauuauua

SEQ ID NO: 3581995 - RNA, 15 nt, Human
ucuccuauguguaag

SEQ ID NO: 3581996 - RNA, 19 nt, Human
ucuccuauguguaagguga

SEQ ID NO: 3581997 - RNA, 12 nt, Human
ucuccucacuga

SEQ ID NO: 3581998 - RNA, 18 nt, Human
ucuccucaucucuaacag

SEQ ID NO: 3581999 - RNA, 14 nt, Human
ucuccuccaccgcc

SEQ ID NO: 3582000 - RNA, 15 nt, Human
ucuccuccagaguca

SEQ ID NO: 3582001 - RNA, 15 nt, Human
ucuccuccccacccg

SEQ ID NO: 3582002 - RNA, 23 nt, Human
ucuccucccuuccuuuucccugc

SEQ ID NO: 3582003 - RNA, 16 nt, Human
ucuccucgcaagcugg

SEQ ID NO: 3582004 - RNA, 14 nt, Human
ucuccucggccccc

SEQ ID NO: 3582005 - RNA, 15 nt, Human
ucuccucucucugua

SEQ ID NO: 3582006 - RNA, 12 nt, Human
ucuccucugcug

SEQ ID NO: 3582007 - RNA, 14 nt, Human
ucuccucugcugcu

SEQ ID NO: 3582008 - RNA, 15 nt, Human
ucuccucugcugcug

SEQ ID NO: 3582009 - RNA, 17 nt, Human
ucuccucugcugcuggc

SEQ ID NO: 3582010 - RNA, 18 nt, Human
ucuccucugcugcuggcu

SEQ ID NO: 3582011 - RNA, 22 nt, Human
ucuccucuuaaaaaauaaaaac

SEQ ID NO: 3582012 - RNA, 23 nt, Human
ucuccucuuaaaaaauaaaaacu

SEQ ID NO: 3582013 - RNA, 13 nt, Human
ucuccucuuguaa

SEQ ID NO: 3582014 - RNA, 14 nt, Human
ucuccucuuguaaa

SEQ ID NO: 3582015 - RNA, 13 nt, Human
ucuccucuuuaaa

SEQ ID NO: 3582016 - RNA, 14 nt, Human
ucuccucuuuaaaa

SEQ ID NO: 3582017 - RNA, 19 nt, Human
ucuccucuuuaaaacaaaa

SEQ ID NO: 3582018 - RNA, 17 nt, Human
ucuccucuuuguuuugu

SEQ ID NO: 3582019 - RNA, 22 nt, Human
ucuccugaaaaaagcaguucuu

SEQ ID NO: 3582020 - RNA, 17 nt, Human
ucuccugaaguucagcc

SEQ ID NO: 3582021 - RNA, 16 nt, Human
ucuccugacccagucc

SEQ ID NO: 3582022 - RNA, 13 nt, Human
ucuccugacuggu

SEQ ID NO: 3582023 - RNA, 14 nt, Human
ucuccugagcuagg

SEQ ID NO: 3582024 - RNA, 20 nt, Human
ucuccugaggaucagaaagu

SEQ ID NO: 3582025 - RNA, 12 nt, Human
ucuccugccaca

SEQ ID NO: 3582026 - RNA, 15 nt, Human
ucucuuuaacucagg

SEQ ID NO: 3582027 - RNA, 21 nt, Human
ucucuuuaagggcaugccuug

SEQ ID NO: 3582028 - RNA, 17 nt, Human
ucucuuuaaucuucagu

SEQ ID NO: 3582029 - RNA, 15 nt, Human
ucucuuuacauuuug

SEQ ID NO: 3582030 - RNA, 15 nt, Human
ucucuuucaugaguu

SEQ ID NO: 3582031 - RNA, 17 nt, Human
ucucuuucccugguccc

SEQ ID NO: 3582032 - RNA, 16 nt, Human
ucucuuuccuucuugc

SEQ ID NO: 3582033 - RNA, 19 nt, Human
ucucuuuccuucuugccuu

SEQ ID NO: 3582034 - RNA, 23 nt, Human
ucucuuucuccuuagucuucuca

SEQ ID NO: 3582035 - RNA, 11 nt, Human
ucucuuugccc

SEQ ID NO: 3582036 - RNA, 14 nt, Human
ucucuuugccucaa

SEQ ID NO: 3582037 - RNA, 15 nt, Human
ucucuuuggacucuc

SEQ ID NO: 3582038 - RNA, 21 nt, Human
ucucuuuggacucuccccucu

SEQ ID NO: 3582039 - RNA, 16 nt, Human
ucucuuuguggggcuu

SEQ ID NO: 3582040 - RNA, 20 nt, Human
ucucuuuguggggcuuggcg

SEQ ID NO: 3582041 - RNA, 19 nt, Human
ucucuuuuaucuguuuaaa

SEQ ID NO: 3582042 - RNA, 22 nt, Human
ucucuuuuccccuuuccugucc

SEQ ID NO: 3582043 - RNA, 13 nt, Human
ucucuuuucucuu

SEQ ID NO: 3582044 - RNA, 16 nt, Human
ucucuuuucucuuucu

SEQ ID NO: 3582045 - RNA, 18 nt, Human
ucucuuuucuuuagagca

SEQ ID NO: 3582046 - RNA, 17 nt, Human
ucucuuuugaaacaaua

SEQ ID NO: 3582047 - RNA, 23 nt, Human
ucucuuuugaauccaugcuuggg

SEQ ID NO: 3582048 - RNA, 14 nt, Human
ucucuuuuugacuc

SEQ ID NO: 3582049 - RNA, 13 nt, Human
ucucuuuuuggag

SEQ ID NO: 3582050 - RNA, 20 nt, Human
ucugaaaagugaagacagaa

SEQ ID NO: 3582051 - RNA, 13 nt, Human
ucugaaaauguau

SEQ ID NO: 3582052 - RNA, 13 nt, Human
ucugaaaauguga

SEQ ID NO: 3582053 - RNA, 23 nt, Human
ucugaaaauuccagaaaggauau

SEQ ID NO: 3582054 - RNA, 14 nt, Human
ucugaaaauugaug

SEQ ID NO: 3582055 - RNA, 22 nt, Human
ucugaaaauugaugggauuugg

SEQ ID NO: 3582056 - RNA, 20 nt, Human
ucugaaacacacugaaagcu

SEQ ID NO: 3582057 - RNA, 12 nt, Human
ucugaaacagcu

SEQ ID NO: 3582058 - RNA, 14 nt, Human
ucugaaacagcugc

SEQ ID NO: 3582059 - RNA, 15 nt, Human
ucugaaacagcugcc

SEQ ID NO: 3582060 - RNA, 22 nt, Human
ucugaaacagcugccuuagcuu

SEQ ID NO: 3582061 - RNA, 15 nt, Human
ucugaaaccaguguu

SEQ ID NO: 3582062 - RNA, 20 nt, Human
ucugaaaccaguguuaggga

SEQ ID NO: 3582063 - RNA, 13 nt, Human
ucugaaacuaaug

SEQ ID NO: 3582064 - RNA, 17 nt, Human
ucugaaacuaaugaaag

SEQ ID NO: 3582065 - RNA, 18 nt, Human
ucugaaagagucuuucuu

SEQ ID NO: 3582066 - RNA, 22 nt, Human
ucugaaagagucuuucuucuuc

SEQ ID NO: 3582067 - RNA, 21 nt, Human
ucugaaaguuguacaugaaau

SEQ ID NO: 3582068 - RNA, 18 nt, Human
ucugaaauaggaaacaag

SEQ ID NO: 3582069 - RNA, 14 nt, Human
ucugaaaugugaua

SEQ ID NO: 3582070 - RNA, 14 nt, Human
ucugaaauuuccug

SEQ ID NO: 3582071 - RNA, 15 nt, Human
ucugaaauuuuucuu

SEQ ID NO: 3582072 - RNA, 20 nt, Human
ucugaaauuuuucuucuuga

SEQ ID NO: 3582073 - RNA, 15 nt, Human
ucugaacaauucucu

SEQ ID NO: 3582074 - RNA, 12 nt, Human
ucugaacacauu

SEQ ID NO: 3582075 - RNA, 15 nt, Human
ucugaacagcuggug

SEQ ID NO: 3582076 - RNA, 13 nt, Human
ucugaacuaaagu

SEQ ID NO: 3582077 - RNA, 17 nt, Human
ucugaacucgcuucucu

SEQ ID NO: 3582078 - RNA, 14 nt, Human
ucugaacuucagcu

SEQ ID NO: 3582079 - RNA, 15 nt, Human
ucugaacuucagcua

SEQ ID NO: 3582080 - RNA, 13 nt, Human
ucugaacuuugga

SEQ ID NO: 3582081 - RNA, 15 nt, Human
ucugaacuuugggaa

SEQ ID NO: 3582082 - RNA, 16 nt, Human
ucugaacuuugggaag

SEQ ID NO: 3582083 - RNA, 20 nt, Human
ucugaagcauguuucauguu

SEQ ID NO: 3582084 - RNA, 21 nt, Human
ucugaagcauguuucauguuu

SEQ ID NO: 3582085 - RNA, 16 nt, Human
ucugaagcccucccag

SEQ ID NO: 3582086 - RNA, 18 nt, Human
ucugaagcccucccaggu

SEQ ID NO: 3582087 - RNA, 16 nt, Human
ucugaagccucuggga

SEQ ID NO: 3582088 - RNA, 17 nt, Human
ucugaagcucaacucuc

SEQ ID NO: 3582089 - RNA, 20 nt, Human
ucugaagcuucacucacugu

SEQ ID NO: 3582090 - RNA, 16 nt, Human
ucugaaggacacuucc

SEQ ID NO: 3582091 - RNA, 19 nt, Human
ucugaaggagauuuuccuu

SEQ ID NO: 3582092 - RNA, 18 nt, Human
ucugaaggaggccaccuc

SEQ ID NO: 3582093 - RNA, 23 nt, Human
ucugaaggcgucaacgugcauuu

SEQ ID NO: 3582094 - RNA, 20 nt, Human
ucugaaggguaauuauauag

SEQ ID NO: 3582095 - RNA, 23 nt, Human
ucugaagucacaucacaggacac

SEQ ID NO: 3582096 - RNA, 14 nt, Human
ucugaaguuggaca

SEQ ID NO: 3582097 - RNA, 17 nt, Human
ucugaaguuucauuuau

SEQ ID NO: 3582098 - RNA, 17 nt, Human
ucugaauaaagcaauua

SEQ ID NO: 3582099 - RNA, 17 nt, Human
ucugaauaaaguguaac

SEQ ID NO: 3582100 - RNA, 18 nt, Human
ucugaauaaaguguaaca

SEQ ID NO: 3582101 - RNA, 16 nt, Human
ucugaauaacauuugu

SEQ ID NO: 3582102 - RNA, 15 nt, Human
ucugaauaagcacuu

SEQ ID NO: 3582103 - RNA, 18 nt, Human
ucugaauaagcacuuuuu

SEQ ID NO: 3582104 - RNA, 19 nt, Human
ucugaauaagcacuuuuua

SEQ ID NO: 3582105 - RNA, 17 nt, Human
ucugaaugcuucuaagu

SEQ ID NO: 3582106 - RNA, 19 nt, Human
ucugaaugcuucuaaguaa

SEQ ID NO: 3582107 - RNA, 12 nt, Human
ucugaauguaau

SEQ ID NO: 3582108 - RNA, 21 nt, Human
ucugaauguaauuuguguaau

SEQ ID NO: 3582109 - RNA, 14 nt, Human
ucugaauguucuga

SEQ ID NO: 3582110 - RNA, 21 nt, Human
ucugaauuaauuaauuuggag

SEQ ID NO: 3582111 - RNA, 20 nt, Human
ucugaauuggaaugcacuca

SEQ ID NO: 3582112 - RNA, 17 nt, Human
ucugaauuuaucuuuga

SEQ ID NO: 3582113 - RNA, 19 nt, Human
ucugaauuuaucuuugaua

SEQ ID NO: 3582114 - RNA, 21 nt, Human
ucugaauuuaucuuugauaac

SEQ ID NO: 3582115 - RNA, 16 nt, Human
ucugaauuugcaaagu

SEQ ID NO: 3582116 - RNA, 17 nt, Human
ucugaauuugcccuggg

SEQ ID NO: 3582117 - RNA, 17 nt, Human
ucugaauuuuuaaacaa

SEQ ID NO: 3582118 - RNA, 14 nt, Human
ucugacaaacugug

SEQ ID NO: 3582119 - RNA, 12 nt, Human
ucugacaagggc

SEQ ID NO: 3582120 - RNA, 16 nt, Human
ucugacaagggcugac

SEQ ID NO: 3582121 - RNA, 20 nt, Human
ucugacaagggcugaccugc

SEQ ID NO: 3582122 - RNA, 12 nt, Human
ucugacacacag

SEQ ID NO: 3582123 - RNA, 15 nt, Human
ucugacacacagcuc

SEQ ID NO: 3582124 - RNA, 16 nt, Human
ucugacagaaagcaga

SEQ ID NO: 3582125 - RNA, 19 nt, Human
ucugacauaauccaguaaa

SEQ ID NO: 3582126 - RNA, 19 nt, Human
ucugacaugauuccuuccu

SEQ ID NO: 3582127 - RNA, 22 nt, Human
ucugacaugauuccuuccuguu

SEQ ID NO: 3582128 - RNA, 15 nt, Human
ucugacauuaacagu

SEQ ID NO: 3582129 - RNA, 16 nt, Human
ucugacauuaacaguu

SEQ ID NO: 3582130 - RNA, 18 nt, Human
ucugacauuaacaguuuu

SEQ ID NO: 3582131 - RNA, 21 nt, Human
ucugacauuaacaguuuucca

SEQ ID NO: 3582132 - RNA, 13 nt, Human
ucugaccacacuu

SEQ ID NO: 3582133 - RNA, 23 nt, Human
ucugaccaguuuaaccugaugca

SEQ ID NO: 3582134 - RNA, 13 nt, Human
ucugacccacugc

SEQ ID NO: 3582135 - RNA, 14 nt, Human
ucugacccacugcu

SEQ ID NO: 3582136 - RNA, 14 nt, Human
ucugacccagugag

SEQ ID NO: 3582137 - RNA, 21 nt, Human
ucugacccagugagauuacag

SEQ ID NO: 3582138 - RNA, 19 nt, Human
ucugacccagugcccccac

SEQ ID NO: 3582139 - RNA, 23 nt, Human
ucugacccagugcccccacugac

SEQ ID NO: 3582140 - RNA, 17 nt, Human
ucugacccaugcugccc

SEQ ID NO: 3582141 - RNA, 22 nt, Human
ucugacccaugcugcccuguga

SEQ ID NO: 3582142 - RNA, 23 nt, Human
ucugacccaugcugcccugugag

SEQ ID NO: 3582143 - RNA, 15 nt, Human
ucugaccccuccuca

SEQ ID NO: 3582144 - RNA, 17 nt, Human
ucugaccccuccucacu

SEQ ID NO: 3582145 - RNA, 16 nt, Human
ucugacccucucccca

SEQ ID NO: 3582146 - RNA, 19 nt, Human
ucugaccugcaggccaaga

SEQ ID NO: 3582147 - RNA, 13 nt, Human
ucugacggcccug

SEQ ID NO: 3582148 - RNA, 14 nt, Human
ucugacuacuuugc

SEQ ID NO: 3582149 - RNA, 16 nt, Human
ucugacuaugacauaa

SEQ ID NO: 3582150 - RNA, 13 nt, Human
ucugacucagggc

SEQ ID NO: 3582151 - RNA, 14 nt, Human
ucugacucagggcu

SEQ ID NO: 3582152 - RNA, 20 nt, Human
ucugacucagggcuccuggg

SEQ ID NO: 3582153 - RNA, 13 nt, Human
ucugacuccagug

SEQ ID NO: 3582154 - RNA, 14 nt, Human
ucugacuccagugg

SEQ ID NO: 3582155 - RNA, 18 nt, Human
ucugacucgguuucucca

SEQ ID NO: 3582156 - RNA, 20 nt, Human
ucugacucgguuucuccaaa

SEQ ID NO: 3582157 - RNA, 20 nt, Human
ucugacugcacguggcuucu

SEQ ID NO: 3582158 - RNA, 14 nt, Human
ucugacugugugug

SEQ ID NO: 3582159 - RNA, 23 nt, Human
ucugacuuaagcaaaagaaaaag

SEQ ID NO: 3582160 - RNA, 15 nt, Human
ucugacuucugccug

SEQ ID NO: 3582161 - RNA, 16 nt, Human
ucugacuucugccugg

SEQ ID NO: 3582162 - RNA, 20 nt, Human
ucugacuuucuuuuuugaua

SEQ ID NO: 3582163 - RNA, 22 nt, Human
ucugagaaagacuauucaaaca

SEQ ID NO: 3582164 - RNA, 14 nt, Human
ucugagaagaggag

SEQ ID NO: 3582165 - RNA, 15 nt, Human
ucugagaagaggagc

SEQ ID NO: 3582166 - RNA, 23 nt, Human
ucugagaagaggagcccucaucu

SEQ ID NO: 3582167 - RNA, 24 nt, Human
ucugagaagcucugaagaacucuc

SEQ ID NO: 3582168 - RNA, 23 nt, Human
ucugagaaggggaggaccucugg

SEQ ID NO: 3582169 - RNA, 20 nt, Human
ucugagaagguccuuaauga

SEQ ID NO: 3582170 - RNA, 12 nt, Human
ucugagaaugaa

SEQ ID NO: 3582171 - RNA, 16 nt, Human
ucuuucucuuucccug

SEQ ID NO: 3582172 - RNA, 17 nt, Human
ucuuucucuuucccugg

SEQ ID NO: 3582173 - RNA, 17 nt, Human
ucuuucucuuucuuccu

SEQ ID NO: 3582174 - RNA, 18 nt, Human
ucuuucugagcacacuuu

SEQ ID NO: 3582175 - RNA, 19 nt, Human
ucuuucugagcacacuuua

SEQ ID NO: 3582176 - RNA, 22 nt, Human
ucuuucugagugccuucugugg

SEQ ID NO: 3582177 - RNA, 23 nt, Human
ucuuucugauaacuagauggugc

SEQ ID NO: 3582178 - RNA, 20 nt, Human
ucuuucugcacacaaauauu

SEQ ID NO: 3582179 - RNA, 22 nt, Human
ucuuucugcagaaacagaaagg

SEQ ID NO: 3582180 - RNA, 13 nt, Human
ucuuucugcuuug

SEQ ID NO: 3582181 - RNA, 20 nt, Human
ucuuucuggcuaugcauuug

SEQ ID NO: 3582182 - RNA, 21 nt, Human
ucuuucuggcuaugcauuuga

SEQ ID NO: 3582183 - RNA, 14 nt, Human
ucuuucuguauuga

SEQ ID NO: 3582184 - RNA, 13 nt, Human
ucuuucugucccu

SEQ ID NO: 3582185 - RNA, 13 nt, Human
ucuuucuuccaaa

SEQ ID NO: 3582186 - RNA, 13 nt, Human
ucuuucuuccuuu

SEQ ID NO: 3582187 - RNA, 18 nt, Human
ucuuucuucuuccacaca

SEQ ID NO: 3582188 - RNA, 19 nt, Human
ucuuucuugcucccugacu

SEQ ID NO: 3582189 - RNA, 20 nt, Human
ucuuucuugcucccugacug

SEQ ID NO: 3582190 - RNA, 16 nt, Human
ucuuucuuuaaauguu

SEQ ID NO: 3582191 - RNA, 18 nt, Human
ucuuucuuuaaauguuuu

SEQ ID NO: 3582192 - RNA, 21 nt, Human
ucuuucuuuaccugagaccag

SEQ ID NO: 3582193 - RNA, 13 nt, Human
ucuuucuuuauuu

SEQ ID NO: 3582194 - RNA, 15 nt, Human
ucuuucuuucuuaga

SEQ ID NO: 3582195 - RNA, 11 nt, Human
ucuuucuuuuu

SEQ ID NO: 3582196 - RNA, 16 nt, Human
ucuuugaaacaacuuu

SEQ ID NO: 3582197 - RNA, 19 nt, Human
ucuuugaaacaugcuugug

SEQ ID NO: 3582198 - RNA, 21 nt, Human
ucuuugaaagacuuccaaaga

SEQ ID NO: 3582199 - RNA, 22 nt, Human
ucuuugaagaagguggaccuuu

SEQ ID NO: 3582200 - RNA, 16 nt, Human
ucuuugaauauguagu

SEQ ID NO: 3582201 - RNA, 16 nt, Human
ucuuugaauuuucauu

SEQ ID NO: 3582202 - RNA, 17 nt, Human
ucuuugacacucugcag

SEQ ID NO: 3582203 - RNA, 12 nt, Human
ucuuugagaggg

SEQ ID NO: 3582204 - RNA, 19 nt, Human
ucuuugagggacugccucu

SEQ ID NO: 3582205 - RNA, 21 nt, Human
ucuuugagggacugccucugc

SEQ ID NO: 3582206 - RNA, 22 nt, Human
ucuuugagggacugccucugcc

SEQ ID NO: 3582207 - RNA, 23 nt, Human
ucuuugagugaagcugggagaac

SEQ ID NO: 3582208 - RNA, 16 nt, Human
ucuuugauaacaggga

SEQ ID NO: 3582209 - RNA, 14 nt, Human
ucuuugauaauguu

SEQ ID NO: 3582210 - RNA, 16 nt, Human
ucuuugauaauguuaa

SEQ ID NO: 3582211 - RNA, 17 nt, Human
ucuuugauaauguuaaa

SEQ ID NO: 3582212 - RNA, 13 nt, Human
ucuuugauguguu

SEQ ID NO: 3582213 - RNA, 12 nt, Human
ucuuugauguua

SEQ ID NO: 3582214 - RNA, 15 nt, Human
ucuuugauguuaaca

SEQ ID NO: 3582215 - RNA, 17 nt, Human
ucuuugauguuaacaca

SEQ ID NO: 3582216 - RNA, 17 nt, Human
ucuuugauuauuugcau

SEQ ID NO: 3582217 - RNA, 23 nt, Human
ucuuugauucuccuucagcccuc

SEQ ID NO: 3582218 - RNA, 22 nt, Human
ucuuugauucuccuuuuaugug

SEQ ID NO: 3582219 - RNA, 22 nt, Human
ucuuugcaggaggcccaaccuc

SEQ ID NO: 3582220 - RNA, 14 nt, Human
ucuuugcaguuccc

SEQ ID NO: 3582221 - RNA, 18 nt, Human
ucuuugcaguucccaucu

SEQ ID NO: 3582222 - RNA, 20 nt, Human
ucuuugccacccucaugcug

SEQ ID NO: 3582223 - RNA, 18 nt, Human
ucuuugccaucucugcuc

SEQ ID NO: 3582224 - RNA, 20 nt, Human
ucuuugccaucucugcucca

SEQ ID NO: 3582225 - RNA, 21 nt, Human
ucuuugcccccaaacccccau

SEQ ID NO: 3582226 - RNA, 22 nt, Human
ucuuugcccuuuacuugucuuu

SEQ ID NO: 3582227 - RNA, 20 nt, Human
ucuuugccuugggcugcucc

SEQ ID NO: 3582228 - RNA, 12 nt, Human
ucuuugcugcag

SEQ ID NO: 3582229 - RNA, 14 nt, Human
ucuuugcuguaaga

SEQ ID NO: 3582230 - RNA, 17 nt, Human
ucuuugcuugaacacag

SEQ ID NO: 3582231 - RNA, 21 nt, Human
ucuuugcuugaacacaguauu

SEQ ID NO: 3582232 - RNA, 12 nt, Human
ucuuugcuuugc

SEQ ID NO: 3582233 - RNA, 13 nt, Human
ucuuugcuuugcc

SEQ ID NO: 3582234 - RNA, 16 nt, Human
ucuuuggaaaguacac

SEQ ID NO: 3582235 - RNA, 19 nt, Human
ucuuuggacagaagcagcu

SEQ ID NO: 3582236 - RNA, 17 nt, Human
ucuuuggacccugaggc

SEQ ID NO: 3582237 - RNA, 22 nt, Human
ucuuuggacucuccccucuuau

SEQ ID NO: 3582238 - RNA, 14 nt, Human
ucuuuggaguuaaa

SEQ ID NO: 3582239 - RNA, 14 nt, Human
ucuuuggcuccccu

SEQ ID NO: 3582240 - RNA, 22 nt, Human
ucuuuggcuccccuguaccuuu

SEQ ID NO: 3582241 - RNA, 15 nt, Human
ucuuugggaauauuu

SEQ ID NO: 3582242 - RNA, 18 nt, Human
ucuuuggggucagccagg

SEQ ID NO: 3582243 - RNA, 17 nt, Human
ucuuuggggucuacacu

SEQ ID NO: 3582244 - RNA, 16 nt, Human
ucuuuggggugccccu

SEQ ID NO: 3582245 - RNA, 20 nt, Human
ucuuuggguaccuauuuuca

SEQ ID NO: 3582246 - RNA, 18 nt, Human
ucuuugguccucuugcca

SEQ ID NO: 3582247 - RNA, 18 nt, Human
ucuuuggugccuuuccug

SEQ ID NO: 3582248 - RNA, 22 nt, Human
ucuuuguaagaacuaaagaaga

SEQ ID NO: 3582249 - RNA, 24 nt, Human
ucuuuguaagaguguagaagcauu

SEQ ID NO: 3582250 - RNA, 21 nt, Human
ucuuuguaaguaaacugcccu

SEQ ID NO: 3582251 - RNA, 21 nt, Human
ucuuuguaagucaguguugag

SEQ ID NO: 3582252 - RNA, 17 nt, Human
ucuuuguaccaaaauuu

SEQ ID NO: 3582253 - RNA, 19 nt, Human
ucuuuguaccaaaauuuua

SEQ ID NO: 3582254 - RNA, 15 nt, Human
ucuuugucagggagu

SEQ ID NO: 3582255 - RNA, 15 nt, Human
ucuuugucuaaaaca

SEQ ID NO: 3582256 - RNA, 17 nt, Human
ucuuugucuacaccauu

SEQ ID NO: 3582257 - RNA, 11 nt, Human
ucuuugugaag

SEQ ID NO: 3582258 - RNA, 13 nt, Human
ucuuuguggggcu

SEQ ID NO: 3582259 - RNA, 18 nt, Human
ucuuuguggggcuuggcg

SEQ ID NO: 3582260 - RNA, 15 nt, Human
ucuuuguguagcuuu

SEQ ID NO: 3582261 - RNA, 16 nt, Human
ucuuuguucauagccc

SEQ ID NO: 3582262 - RNA, 22 nt, Human
ucuuuguucucagcucccccug

SEQ ID NO: 3582263 - RNA, 16 nt, Human
ucuuuguuuugugucu

SEQ ID NO: 3582264 - RNA, 18 nt, Human
ucuuuguuuugugucucu

SEQ ID NO: 3582265 - RNA, 20 nt, Human
ucuuuguuuugugucucuua

SEQ ID NO: 3582266 - RNA, 13 nt, Human
ucuuuuaaaaagu

SEQ ID NO: 3582267 - RNA, 17 nt, Human
ucuuuuaaaaaguauug

SEQ ID NO: 3582268 - RNA, 13 nt, Human
ucuuuuaaaagac

SEQ ID NO: 3582269 - RNA, 21 nt, Human
ucuuuuaaaagacaagacuuc

SEQ ID NO: 3582270 - RNA, 11 nt, Human
ucuuuuaaacu

SEQ ID NO: 3582271 - RNA, 12 nt, Human
ucuuuuaaacuc

SEQ ID NO: 3582272 - RNA, 18 nt, Human
ucuuuuaaagacccuccu

SEQ ID NO: 3582273 - RNA, 17 nt, Human
ucuuuuaaauuagaaaa

SEQ ID NO: 3582274 - RNA, 21 nt, Human
ucuuuuaaugaggaccaaugu

SEQ ID NO: 3582275 - RNA, 13 nt, Human
ucuuuuacccugg

SEQ ID NO: 3582276 - RNA, 23 nt, Human
ucuuuuacuuuuuuuaguaaguu

SEQ ID NO: 3582277 - RNA, 20 nt, Human
ucuuuuaguuguaucucuuu

SEQ ID NO: 3582278 - RNA, 16 nt, Human
ucuuuuaguuuuaguu

SEQ ID NO: 3582279 - RNA, 18 nt, Human
ucuuuuaguuuuaguugc

SEQ ID NO: 3582280 - RNA, 22 nt, Human
ucuuuuauaaaaaaaaugaaau

SEQ ID NO: 3582281 - RNA, 14 nt, Human
ucuuuuauaggauu

SEQ ID NO: 3582282 - RNA, 21 nt, Human
ucuuuuauaguggaaaaacac

SEQ ID NO: 3582283 - RNA, 13 nt, Human
ucuuuuauauuug

SEQ ID NO: 3582284 - RNA, 12 nt, Human
ucuuuuaucugu

SEQ ID NO: 3582285 - RNA, 14 nt, Human
ucuuuuaucuguuu

SEQ ID NO: 3582286 - RNA, 12 nt, Human
ucuuuuauucuu

SEQ ID NO: 3582287 - RNA, 13 nt, Human
ucuuuucacaaau

SEQ ID NO: 3582288 - RNA, 16 nt, Human
ucuuuucacauucuua

SEQ ID NO: 3582289 - RNA, 17 nt, Human
ucuuuucacauucuuau

SEQ ID NO: 3582290 - RNA, 18 nt, Human
ucuuuucacauucuuaua

SEQ ID NO: 3582291 - RNA, 22 nt, Human
ucuuuucacauucuuauaaaua

SEQ ID NO: 3582292 - RNA, 20 nt, Human
ucuuuucagaucauggcauc

SEQ ID NO: 3582293 - RNA, 18 nt, Human
ucuuuucaucugggaaag

SEQ ID NO: 3582294 - RNA, 19 nt, Human
ucuuuucaucugggaaaga

SEQ ID NO: 3582295 - RNA, 16 nt, Human
ucuuuucccauuuauc

SEQ ID NO: 3582296 - RNA, 19 nt, Human
ucuuuucccauuuaucuaa

SEQ ID NO: 3582297 - RNA, 18 nt, Human
ucuuuuccccuuuccugu

SEQ ID NO: 3582298 - RNA, 19 nt, Human
ucuuuucuacagcaaauuu

SEQ ID NO: 3582299 - RNA, 12 nt, Human
ucuuuucuaccc

SEQ ID NO: 3582300 - RNA, 15 nt, Human
ucuuuucucaugugu

SEQ ID NO: 3582301 - RNA, 16 nt, Human
ucuuuucucuuuuuag

SEQ ID NO: 3582302 - RNA, 12 nt, Human
ucuuuucugaau

SEQ ID NO: 3582303 - RNA, 23 nt, Human
ucuuuucugcaucaucuguagau

SEQ ID NO: 3582304 - RNA, 18 nt, Human
ucuuuucuuacuccuccu

SEQ ID NO: 3582305 - RNA, 20 nt, Human
ucuuuucuugccucuguccc

SEQ ID NO: 3582306 - RNA, 15 nt, Human
ucuuuucuuggcaaa

SEQ ID NO: 3582307 - RNA, 22 nt, Human
ucuuuucuuggcaaaagccuug

SEQ ID NO: 3582308 - RNA, 12 nt, Human
ucuuuucuuuac

SEQ ID NO: 3582309 - RNA, 21 nt, Human
ucuuuucuuuagagaacugaa

SEQ ID NO: 3582310 - RNA, 23 nt, Human
ucuuuucuuuagagcauugccau

SEQ ID NO: 3582311 - RNA, 14 nt, Human
ucuuuucuuuguau

SEQ ID NO: 3582312 - RNA, 17 nt, Human
ucuuuucuuuguaucau

SEQ ID NO: 3582313 - RNA, 20 nt, Human
ucuuuucuuuguaucauuca

SEQ ID NO: 3582314 - RNA, 12 nt, Human
ucuuuugaagca

SEQ ID NO: 3582315 - RNA, 20 nt, Human
ucuuuugaauccaugcuugg

SEQ ID NO: 3582316 - RNA, 22 nt, Human
ugaaaugaggucagagccugca

SEQ ID NO: 3582317 - RNA, 17 nt, Human
ugaaaugaggucuguuu

SEQ ID NO: 3582318 - RNA, 18 nt, Human
ugaaaugaggucuguuua

SEQ ID NO: 3582319 - RNA, 21 nt, Human
ugaaaugauagauuugaccuc

SEQ ID NO: 3582320 - RNA, 13 nt, Human
ugaaaugcauauu

SEQ ID NO: 3582321 - RNA, 20 nt, Human
ugaaaugcaucagguccuuu

SEQ ID NO: 3582322 - RNA, 17 nt, Human
ugaaaugccugcuuuga

SEQ ID NO: 3582323 - RNA, 18 nt, Human
ugaaaugccuuacuuugu

SEQ ID NO: 3582324 - RNA, 19 nt, Human
ugaaaugccuuacuuugua

SEQ ID NO: 3582325 - RNA, 18 nt, Human
ugaaaugcuaugucauuu

SEQ ID NO: 3582326 - RNA, 22 nt, Human
ugaaaugcuaugucauuucaug

SEQ ID NO: 3582327 - RNA, 17 nt, Human
ugaaaugcucuccuuuc

SEQ ID NO: 3582328 - RNA, 13 nt, Human
ugaaaugcugcau

SEQ ID NO: 3582329 - RNA, 17 nt, Human
ugaaaugcugcauuuua

SEQ ID NO: 3582330 - RNA, 19 nt, Human
ugaaauggauacuacaucu

SEQ ID NO: 3582331 - RNA, 13 nt, Human
ugaaaugucaguu

SEQ ID NO: 3582332 - RNA, 20 nt, Human
ugaaaugugaauuuuuauug

SEQ ID NO: 3582333 - RNA, 12 nt, Human
ugaaaugugugu

SEQ ID NO: 3582334 - RNA, 22 nt, Human
ugaaaugugugugaugugacau

SEQ ID NO: 3582335 - RNA, 15 nt, Human
ugaaauguguuucug

SEQ ID NO: 3582336 - RNA, 19 nt, Human
ugaaauguguuucuguaua

SEQ ID NO: 3582337 - RNA, 12 nt, Human
ugaaauuacccu

SEQ ID NO: 3582338 - RNA, 19 nt, Human
ugaaauuacggguaccuga

SEQ ID NO: 3582339 - RNA, 20 nt, Human
ugaaauuacuacaaaauuug

SEQ ID NO: 3582340 - RNA, 19 nt, Human
ugaaauuacuuaucaucca

SEQ ID NO: 3582341 - RNA, 23 nt, Human
ugaaauuagggcccaauuaauaa

SEQ ID NO: 3582342 - RNA, 15 nt, Human
ugaaauuauaucugu

SEQ ID NO: 3582343 - RNA, 17 nt, Human
ugaaauuauguauguuu

SEQ ID NO: 3582344 - RNA, 21 nt, Human
ugaaauuauguauguuuacau

SEQ ID NO: 3582345 - RNA, 20 nt, Human
ugaaauuaugugacauuuua

SEQ ID NO: 3582346 - RNA, 14 nt, Human
ugaaauucacaaag

SEQ ID NO: 3582347 - RNA, 16 nt, Human
ugaaauuccauuugua

SEQ ID NO: 3582348 - RNA, 14 nt, Human
ugaaauucuccugg

SEQ ID NO: 3582349 - RNA, 14 nt, Human
ugaaauucugaauu

SEQ ID NO: 3582350 - RNA, 19 nt, Human
ugaaauucugaauuugcaa

SEQ ID NO: 3582351 - RNA, 21 nt, Human
ugaaauucugaauuugcaaag

SEQ ID NO: 3582352 - RNA, 17 nt, Human
ugaaauugcauacuuug

SEQ ID NO: 3582353 - RNA, 12 nt, Human
ugaaauuguaaa

SEQ ID NO: 3582354 - RNA, 14 nt, Human
ugaaauuguaauua

SEQ ID NO: 3582355 - RNA, 21 nt, Human
ugaaauuguaauuauaucuga

SEQ ID NO: 3582356 - RNA, 18 nt, Human
ugaaauugugaacucauu

SEQ ID NO: 3582357 - RNA, 23 nt, Human
ugaaauuguuuaaguguuguaaa

SEQ ID NO: 3582358 - RNA, 14 nt, Human
ugaaauuuaaacau

SEQ ID NO: 3582359 - RNA, 22 nt, Human
ugaaauuuaaacauuaaaaaug

SEQ ID NO: 3582360 - RNA, 23 nt, Human
ugaaauuuauacaccaauugauu

SEQ ID NO: 3582361 - RNA, 13 nt, Human
ugaaauuuauuga

SEQ ID NO: 3582362 - RNA, 14 nt, Human
ugaaauuuauuuaa

SEQ ID NO: 3582363 - RNA, 12 nt, Human
ugaaauuucaga

SEQ ID NO: 3582364 - RNA, 19 nt, Human
ugaaauuuccuaauuuauu

SEQ ID NO: 3582365 - RNA, 21 nt, Human
ugaaauuuccugggagcuuuu

SEQ ID NO: 3582366 - RNA, 21 nt, Human
ugaaauuucuagccugcacuu

SEQ ID NO: 3582367 - RNA, 16 nt, Human
ugaaauuugaauuuug

SEQ ID NO: 3582368 - RNA, 14 nt, Human
ugaaauuuuaccaa

SEQ ID NO: 3582369 - RNA, 15 nt, Human
ugaaauuuuaccaag

SEQ ID NO: 3582370 - RNA, 16 nt, Human
ugaaauuuuaccaagu

SEQ ID NO: 3582371 - RNA, 17 nt, Human
ugaaauuuuaccaaguu

SEQ ID NO: 3582372 - RNA, 18 nt, Human
ugaaauuuuagaaauauu

SEQ ID NO: 3582373 - RNA, 17 nt, Human
ugaaauuuuccaauguc

SEQ ID NO: 3582374 - RNA, 18 nt, Human
ugaaauuuuccaaugucu

SEQ ID NO: 3582375 - RNA, 17 nt, Human
ugaaauuuucuagacuu

SEQ ID NO: 3582376 - RNA, 13 nt, Human
ugaaauuuuucau

SEQ ID NO: 3582377 - RNA, 14 nt, Human
ugaaauuuuucaua

SEQ ID NO: 3582378 - RNA, 21 nt, Human
ugaaauuuuucauauuuuaau

SEQ ID NO: 3582379 - RNA, 23 nt, Human
ugaaauuuuuuuucaugcuuuau

SEQ ID NO: 3582380 - RNA, 13 nt, Human
ugaacaaaagggu

SEQ ID NO: 3582381 - RNA, 14 nt, Human
ugaacaaaaucugu

SEQ ID NO: 3582382 - RNA, 18 nt, Human
ugaacaaaaucuguugcc

SEQ ID NO: 3582383 - RNA, 13 nt, Human
ugaacaaaauuau

SEQ ID NO: 3582384 - RNA, 15 nt, Human
ugaacaaagaccaau

SEQ ID NO: 3582385 - RNA, 15 nt, Human
ugaacaaauggccuu

SEQ ID NO: 3582386 - RNA, 13 nt, Human
ugaacaaauuuac

SEQ ID NO: 3582387 - RNA, 18 nt, Human
ugaacaacgagccuuuuc

SEQ ID NO: 3582388 - RNA, 14 nt, Human
ugaacaagaauugg

SEQ ID NO: 3582389 - RNA, 16 nt, Human
ugaacaagagaagcau

SEQ ID NO: 3582390 - RNA, 18 nt, Human
ugaacaagagaagcauuc

SEQ ID NO: 3582391 - RNA, 23 nt, Human
ugaacaagagaagcauucucauu

SEQ ID NO: 3582392 - RNA, 15 nt, Human
ugaacaagucccugu

SEQ ID NO: 3582393 - RNA, 23 nt, Human
ugaacaagugggccauuagccag

SEQ ID NO: 3582394 - RNA, 18 nt, Human
ugaacaaugaaguugaaa

SEQ ID NO: 3582395 - RNA, 23 nt, Human
ugaacaaugaaguugaaaaucau

SEQ ID NO: 3582396 - RNA, 13 nt, Human
ugaacaauucucu

SEQ ID NO: 3582397 - RNA, 18 nt, Human
ugaacacaaacuguaaau

SEQ ID NO: 3582398 - RNA, 19 nt, Human
ugaacacaaacuguaaaua

SEQ ID NO: 3582399 - RNA, 14 nt, Human
ugaacacacugugu

SEQ ID NO: 3582400 - RNA, 13 nt, Human
ugaacacaggcag

SEQ ID NO: 3582401 - RNA, 14 nt, Human
ugaacacaucagcu

SEQ ID NO: 3582402 - RNA, 12 nt, Human
ugaacacauuuc

SEQ ID NO: 3582403 - RNA, 22 nt, Human
ugaacacgaaagaaauguaccu

SEQ ID NO: 3582404 - RNA, 16 nt, Human
ugaacacgaagcuuag

SEQ ID NO: 3582405 - RNA, 14 nt, Human
ugaacacucaugcu

SEQ ID NO: 3582406 - RNA, 22 nt, Human
ugaacacuccaauuaaggauuu

SEQ ID NO: 3582407 - RNA, 23 nt, Human
ugaacacuccaauuaaggauuuu

SEQ ID NO: 3582408 - RNA, 16 nt, Human
ugaacacugggggagg

SEQ ID NO: 3582409 - RNA, 17 nt, Human
ugaacacugggggaggg

SEQ ID NO: 3582410 - RNA, 14 nt, Human
ugaacacuuaaauu

SEQ ID NO: 3582411 - RNA, 17 nt, Human
ugaacacuuaaauuaug

SEQ ID NO: 3582412 - RNA, 13 nt, Human
ugaacacuuauaa

SEQ ID NO: 3582413 - RNA, 20 nt, Human
ugaacagaaaacauucugau

SEQ ID NO: 3582414 - RNA, 20 nt, Human
ugaacagcauggcacucccu

SEQ ID NO: 3582415 - RNA, 15 nt, Human
ugaacagcggcugga

SEQ ID NO: 3582416 - RNA, 14 nt, Human
ugaacagcuggugu

SEQ ID NO: 3582417 - RNA, 15 nt, Human
ugaacagcuggugua

SEQ ID NO: 3582418 - RNA, 23 nt, Human
ugaacagcugguguagcuacaga

SEQ ID NO: 3582419 - RNA, 17 nt, Human
ugaacaguaacauagcu

SEQ ID NO: 3582420 - RNA, 12 nt, Human
ugaacaguggag

SEQ ID NO: 3582421 - RNA, 19 nt, Human
ugaacaguuguguuugaag

SEQ ID NO: 3582422 - RNA, 16 nt, Human
ugaacauacaaaugca

SEQ ID NO: 3582423 - RNA, 20 nt, Human
ugaacauagacuagagaaac

SEQ ID NO: 3582424 - RNA, 18 nt, Human
ugaacauccuuccuuccc

SEQ ID NO: 3582425 - RNA, 20 nt, Human
ugaacauccuuccuucccac

SEQ ID NO: 3582426 - RNA, 20 nt, Human
ugaacaucugaguccuggau

SEQ ID NO: 3582427 - RNA, 11 nt, Human
ugaacauucca

SEQ ID NO: 3582428 - RNA, 22 nt, Human
ugaacauugcauauaacuuaua

SEQ ID NO: 3582429 - RNA, 22 nt, Human
ugaacauuuacuacaguuuuua

SEQ ID NO: 3582430 - RNA, 14 nt, Human
ugaacauuuaucaa

SEQ ID NO: 3582431 - RNA, 14 nt, Human
ugaaccaaaacauu

SEQ ID NO: 3582432 - RNA, 21 nt, Human
ugaaccaaaacauuccguuua

SEQ ID NO: 3582433 - RNA, 22 nt, Human
ugaaccaagaacuuuccaggaa

SEQ ID NO: 3582434 - RNA, 14 nt, Human
ugaaccaaugcaag

SEQ ID NO: 3582435 - RNA, 22 nt, Human
ugaaccaccacacccagcccac

SEQ ID NO: 3582436 - RNA, 16 nt, Human
ugaaccacuucccuca

SEQ ID NO: 3582437 - RNA, 15 nt, Human
ugaaccacuuguaga

SEQ ID NO: 3582438 - RNA, 13 nt, Human
ugaaccauaaaau

SEQ ID NO: 3582439 - RNA, 16 nt, Human
ugaaccauaaauucaa

SEQ ID NO: 3582440 - RNA, 21 nt, Human
ugaaccaucauuauaaacgug

SEQ ID NO: 3582441 - RNA, 20 nt, Human
ugaaccauggugaagugcuu

SEQ ID NO: 3582442 - RNA, 22 nt, Human
ugaacccaggacaagcaugguc

SEQ ID NO: 3582443 - RNA, 20 nt, Human
ugaacccaggacgcuucuga

SEQ ID NO: 3582444 - RNA, 13 nt, Human
ugaacccaggagg

SEQ ID NO: 3582445 - RNA, 14 nt, Human
ugaacccccaugau

SEQ ID NO: 3582446 - RNA, 18 nt, Human
ugaacccgggaggcagag

SEQ ID NO: 3582447 - RNA, 13 nt, Human
ugaacccugugcu

SEQ ID NO: 3582448 - RNA, 19 nt, Human
ugaacccugugcugguguc

SEQ ID NO: 3582449 - RNA, 21 nt, Human
ugaacccuuccugagcuuuau

SEQ ID NO: 3582450 - RNA, 13 nt, Human
ugaacccuugcuu

SEQ ID NO: 3582451 - RNA, 13 nt, Human
ugaacccuuuguu

SEQ ID NO: 3582452 - RNA, 15 nt, Human
ugaaccgaugagaaa

SEQ ID NO: 3582453 - RNA, 20 nt, Human
ugaaccucaccccgaggccc

SEQ ID NO: 3582454 - RNA, 22 nt, Human
ugaaccucaccccgaggcccug

SEQ ID NO: 3582455 - RNA, 17 nt, Human
ugaaccugaugcugacu

SEQ ID NO: 3582456 - RNA, 12 nt, Human
ugaaccuggagg

SEQ ID NO: 3582457 - RNA, 20 nt, Human
ugaaccugugaguaaauauu

SEQ ID NO: 3582458 - RNA, 21 nt, Human
ugaacgauauguagcagaaag

SEQ ID NO: 3582459 - RNA, 14 nt, Human
ugaacggccuugcu

SEQ ID NO: 3582460 - RNA, 17 nt, Human
ugaacguuuucuaauug

SEQ ID NO: 3582461 - RNA, 17 nt, Human
ugaauaccacucuguaa

SEQ ID NO: 3582462 - RNA, 23 nt, Human
ugaauaccauuaaaacugcuuuu

SEQ ID NO: 3582463 - RNA, 14 nt, Human
ugaauaccccaaga

SEQ ID NO: 3582464 - RNA, 13 nt, Human
ugaauacuuugaa

SEQ ID NO: 3582465 - RNA, 16 nt, Human
ugaauacuuugaaugu

SEQ ID NO: 3582466 - RNA, 12 nt, Human
ugaauagaaaug

SEQ ID NO: 3582467 - RNA, 18 nt, Human
ugaauagauaugaaagcu

SEQ ID NO: 3582468 - RNA, 14 nt, Human
ugaauauaaacacu

SEQ ID NO: 3582469 - RNA, 15 nt, Human
ugaauauaaacacua

SEQ ID NO: 3582470 - RNA, 21 nt, Human
ugaauauaauauauuugugua

SEQ ID NO: 3582471 - RNA, 22 nt, Human
ugaauauaccccuuaguguuug

SEQ ID NO: 3582472 - RNA, 15 nt, Human
ugaauauauggcauu

SEQ ID NO: 3582473 - RNA, 18 nt, Human
ugaauauauuauaaucuu

SEQ ID NO: 3582474 - RNA, 13 nt, Human
ugaauauccccuc

SEQ ID NO: 3582475 - RNA, 14 nt, Human
ugaauaucuauuaa

SEQ ID NO: 3582476 - RNA, 14 nt, Human
ugaauaucuuucga

SEQ ID NO: 3582477 - RNA, 20 nt, Human
ugaauaugaacggugagcau

SEQ ID NO: 3582478 - RNA, 13 nt, Human
ugaauaugauuaa

SEQ ID NO: 3582479 - RNA, 14 nt, Human
ugaauaugauuaaa

SEQ ID NO: 3582480 - RNA, 21 nt, Human
ugaauaugauuaaaaauauca

SEQ ID NO: 3582481 - RNA, 21 nt, Human
ugaauaugccuguaauucagu

SEQ ID NO: 3582482 - RNA, 19 nt, Human
ugaauauggacaagaggua

SEQ ID NO: 3582483 - RNA, 15 nt, Human
ugaauauuacuccua

SEQ ID NO: 3582484 - RNA, 13 nt, Human
ugaauauuauucc

SEQ ID NO: 3582485 - RNA, 18 nt, Human
ugaauauugccauuaugc

SEQ ID NO: 3582486 - RNA, 18 nt, Human
ugaauauuuaguguucau

SEQ ID NO: 3582487 - RNA, 20 nt, Human
ugaauauuuauauuucacua

SEQ ID NO: 3582488 - RNA, 21 nt, Human
ugaauauuuguuauguagaua

SEQ ID NO: 3582489 - RNA, 19 nt, Human
ugaauauuuucauuaaaag

SEQ ID NO: 3582490 - RNA, 15 nt, Human
ugaauauuuugauaa

SEQ ID NO: 3582491 - RNA, 16 nt, Human
ugaauauuuugauaau

SEQ ID NO: 3582492 - RNA, 15 nt, Human
ugaaucaaaagugcc

SEQ ID NO: 3582493 - RNA, 13 nt, Human
ugaaucaaagaca

SEQ ID NO: 3582494 - RNA, 16 nt, Human
ugaaucaauaauauau

SEQ ID NO: 3582495 - RNA, 17 nt, Human
ugaaucacguaaagcua

SEQ ID NO: 3582496 - RNA, 23 nt, Human
ugaaucacguaaagcuagaaaug

SEQ ID NO: 3582497 - RNA, 16 nt, Human
ugaaucacuguuuuua

SEQ ID NO: 3582498 - RNA, 21 nt, Human
ugaaucagaauaaccuucaaa

SEQ ID NO: 3582499 - RNA, 16 nt, Human
ugaaucagacccuacc

SEQ ID NO: 3582500 - RNA, 18 nt, Human
ugaaucagacccuacccc

SEQ ID NO: 3582501 - RNA, 19 nt, Human
ugaaucaguauaaacaaag

SEQ ID NO: 3582502 - RNA, 22 nt, Human
ugaaucaguauaaacaaaguua

SEQ ID NO: 3582503 - RNA, 23 nt, Human
ugaaucaguuuccaauuauuuga

SEQ ID NO: 3582504 - RNA, 21 nt, Human
ugaaucauuguauguggucau

SEQ ID NO: 3582505 - RNA, 17 nt, Human
ugaauccaaaagaaaaa

SEQ ID NO: 3582506 - RNA, 21 nt, Human
ugaauccaaaagaaaaacagc

SEQ ID NO: 3582507 - RNA, 21 nt, Human
ugaaucccacgcuucucuuug

SEQ ID NO: 3582508 - RNA, 15 nt, Human
ugaauccuaagggcu

SEQ ID NO: 3582509 - RNA, 16 nt, Human
ugaauccuagggccug

SEQ ID NO: 3582510 - RNA, 16 nt, Human
ugaauccucucucugu

SEQ ID NO: 3582511 - RNA, 21 nt, Human
ugaauccucucucuguguuac

SEQ ID NO: 3582512 - RNA, 20 nt, Human
ugaaucgagauguccauagu

SEQ ID NO: 3582513 - RNA, 12 nt, Human
ugaaucuaugcc

SEQ ID NO: 3582514 - RNA, 14 nt, Human
ugaaucuauuuaag

SEQ ID NO: 3582515 - RNA, 18 nt, Human
ugaaucuauuuaucuuca

SEQ ID NO: 3582516 - RNA, 20 nt, Human
ugaaucucauaauuuauaca

SEQ ID NO: 3582517 - RNA, 22 nt, Human
ugaaucugcauuuucuggguuc

SEQ ID NO: 3582518 - RNA, 12 nt, Human
ugaaucuguaca

SEQ ID NO: 3582519 - RNA, 13 nt, Human
ugaaucuuuaauu

SEQ ID NO: 3582520 - RNA, 18 nt, Human
ugaaugaaaaauuuaagc

SEQ ID NO: 3582521 - RNA, 16 nt, Human
ugaaugaaacccccac

SEQ ID NO: 3582522 - RNA, 19 nt, Human
ugaaugaaacccccacaca

SEQ ID NO: 3582523 - RNA, 22 nt, Human
ugaaugaaacccccacacacac

SEQ ID NO: 3582524 - RNA, 14 nt, Human
ugaaugaaagauua

SEQ ID NO: 3582525 - RNA, 16 nt, Human
ugaaugaaagauuaaa

SEQ ID NO: 3582526 - RNA, 21 nt, Human
ugaaugaaagucuugugacua

SEQ ID NO: 3582527 - RNA, 23 nt, Human
ugaaugaaagucuugugacuagu

SEQ ID NO: 3582528 - RNA, 14 nt, Human
ugaaugaacaaccu

SEQ ID NO: 3582529 - RNA, 11 nt, Human
ugaaugaacac

SEQ ID NO: 3582530 - RNA, 16 nt, Human
ugaaugaaccuucugg

SEQ ID NO: 3582531 - RNA, 15 nt, Human
ugaaugacaacagaa

SEQ ID NO: 3582532 - RNA, 22 nt, Human
ugaaugaggucagcaugucuau

SEQ ID NO: 3582533 - RNA, 23 nt, Human
ugaaugagucuguugugugucau

SEQ ID NO: 3582534 - RNA, 15 nt, Human
ugaaugcauaaaaug

SEQ ID NO: 3582535 - RNA, 13 nt, Human
ugaaugcauuuug

SEQ ID NO: 3582536 - RNA, 22 nt, Human
ugaaugccacugccuucgcuuc

SEQ ID NO: 3582537 - RNA, 13 nt, Human
ugaaugcugccag

SEQ ID NO: 3582538 - RNA, 13 nt, Human
ugaaugcugggac

SEQ ID NO: 3582539 - RNA, 17 nt, Human
ugaaugcuucuaaguaa

SEQ ID NO: 3582540 - RNA, 17 nt, Human
ugaauggauuggauuau

SEQ ID NO: 3582541 - RNA, 23 nt, Human
ugaauggccuucauaucauccac

SEQ ID NO: 3582542 - RNA, 12 nt, Human
ugaauggcuuug

SEQ ID NO: 3582543 - RNA, 15 nt, Human
ugaauggcuuuguau

SEQ ID NO: 3582544 - RNA, 19 nt, Human
ugaauggcuuuguauagaa

SEQ ID NO: 3582545 - RNA, 14 nt, Human
ugaaugggaaaaga

SEQ ID NO: 3582546 - RNA, 20 nt, Human
ugaaugggaucaugaaagua

SEQ ID NO: 3582547 - RNA, 14 nt, Human
ugaaugguccaggg

SEQ ID NO: 3582548 - RNA, 15 nt, Human
ugaaugguccagggu

SEQ ID NO: 3582549 - RNA, 20 nt, Human
ugaaugguguuguaugccuu

SEQ ID NO: 3582550 - RNA, 21 nt, Human
ugaaugguuccaugccugagg

SEQ ID NO: 3582551 - RNA, 23 nt, Human
ugaaugguuccaugccugagggu

SEQ ID NO: 3582552 - RNA, 18 nt, Human
ugaauguaaauuuguacu

SEQ ID NO: 3582553 - RNA, 22 nt, Human
ugaauguaaauuuguacuauuu

SEQ ID NO: 3582554 - RNA, 14 nt, Human
ugaauguaauuugu

SEQ ID NO: 3582555 - RNA, 20 nt, Human
ugaauguaauuuguguaaua

SEQ ID NO: 3582556 - RNA, 15 nt, Human
ugaauguaucaggaa

SEQ ID NO: 3582557 - RNA, 23 nt, Human
ugaauguaugcuucauacaggga

SEQ ID NO: 3582558 - RNA, 13 nt, Human
ugaauguauguaa

SEQ ID NO: 3582559 - RNA, 18 nt, Human
ugaauguaugugcacugu

SEQ ID NO: 3582560 - RNA, 23 nt, Human
ugaauguaugugcacugucacuu

SEQ ID NO: 3582561 - RNA, 17 nt, Human
ugaauguauuuauuugg

SEQ ID NO: 3582562 - RNA, 19 nt, Human
ugaauguauuuauuuggga

SEQ ID NO: 3582563 - RNA, 16 nt, Human
ugaaugucacuucugg

SEQ ID NO: 3582564 - RNA, 23 nt, Human
ugaaugucuuuugaauauuccca

SEQ ID NO: 3582565 - RNA, 14 nt, Human
ugaaugugaagccu

SEQ ID NO: 3582566 - RNA, 21 nt, Human
ugaaugugggcacuggcccag

SEQ ID NO: 3582567 - RNA, 16 nt, Human
ugaauguggucucagg

SEQ ID NO: 3582568 - RNA, 14 nt, Human
ugaaugugucacua

SEQ ID NO: 3582569 - RNA, 12 nt, Human
ugaaugugucag

SEQ ID NO: 3582570 - RNA, 21 nt, Human
ugaauguguuucacaguuuga

SEQ ID NO: 3582571 - RNA, 15 nt, Human
ugaauguuaaauaaa

SEQ ID NO: 3582572 - RNA, 14 nt, Human
ugaauguuauuugu

SEQ ID NO: 3582573 - RNA, 12 nt, Human
ugaauguucuga

SEQ ID NO: 3582574 - RNA, 16 nt, Human
ugaauguucugacauu

SEQ ID NO: 3582575 - RNA, 17 nt, Human
ugaauguucugacauua

SEQ ID NO: 3582576 - RNA, 20 nt, Human
ugaauguucugacauuaaca

SEQ ID NO: 3582577 - RNA, 19 nt, Human
ugaauguuuacacucuuug

SEQ ID NO: 3582578 - RNA, 21 nt, Human
ugaauguuuccaaccuggagu

SEQ ID NO: 3582579 - RNA, 15 nt, Human
ugaauguuuuucuaa

SEQ ID NO: 3582580 - RNA, 16 nt, Human
ugaauguuuuucuaaa

SEQ ID NO: 3582581 - RNA, 14 nt, Human
ugaauuaaaacuuc

SEQ ID NO: 3582582 - RNA, 23 nt, Human
ugaauuaaaauugucccauuugc

SEQ ID NO: 3582583 - RNA, 11 nt, Human
ugaauuaaauu

SEQ ID NO: 3582584 - RNA, 15 nt, Human
ugaauuaaauuuaau

SEQ ID NO: 3582585 - RNA, 23 nt, Human
ugaauuaaucaucuauaaagaag

SEQ ID NO: 3582586 - RNA, 21 nt, Human
ugaauuaaugacagagccagu

SEQ ID NO: 3582587 - RNA, 13 nt, Human
ugaauuacauuug

SEQ ID NO: 3582588 - RNA, 14 nt, Human
ugaauuacauuugu

SEQ ID NO: 3582589 - RNA, 15 nt, Human
ugaauuacauuugua

SEQ ID NO: 3582590 - RNA, 16 nt, Human
ugaauuacauuuguau

SEQ ID NO: 3582591 - RNA, 18 nt, Human
ugaauuacauuuguauaa

SEQ ID NO: 3582592 - RNA, 15 nt, Human
ugaauuacuaacuuc

SEQ ID NO: 3582593 - RNA, 19 nt, Human
ugaauuacuaacuucuaaa

SEQ ID NO: 3582594 - RNA, 21 nt, Human
ugaauuacuaacuucuaaaac

SEQ ID NO: 3582595 - RNA, 14 nt, Human
ugaauuagcucacu

SEQ ID NO: 3582596 - RNA, 20 nt, Human
ugaauuaggcuguaacuacu

SEQ ID NO: 3582597 - RNA, 21 nt, Human
ugaauuaggcuguaacuacuu

SEQ ID NO: 3582598 - RNA, 21 nt, Human
ugaauuaggggacacugucuu

SEQ ID NO: 3582599 - RNA, 15 nt, Human
ugaauuauauguuca

SEQ ID NO: 3582600 - RNA, 17 nt, Human
ugaauuaucagcaaaga

SEQ ID NO: 3582601 - RNA, 21 nt, Human
ugaauuauccacaugaaaaua

SEQ ID NO: 3582602 - RNA, 22 nt, Human
ugaauuauccacaugaaaauaa

SEQ ID NO: 3582603 - RNA, 13 nt, Human
ugaauuaugaaac

SEQ ID NO: 3582604 - RNA, 14 nt, Human
ugaauuauuacagu

SEQ ID NO: 3582605 - RNA, 15 nt, Human
ugaauuauucaauuu

SEQ ID NO: 3582606 - RNA, 13 nt, Human
ugaguguaauguu

SEQ ID NO: 3582607 - RNA, 18 nt, Human
ugaguguaugaguagcca

SEQ ID NO: 3582608 - RNA, 12 nt, Human
ugagugugacag

SEQ ID NO: 3582609 - RNA, 16 nt, Human
ugagugugacagggcc

SEQ ID NO: 3582610 - RNA, 19 nt, Human
ugagugugcggcugugugu

SEQ ID NO: 3582611 - RNA, 15 nt, Human
ugagugugcugcugu

SEQ ID NO: 3582612 - RNA, 15 nt, Human
ugaguguggaagccg

SEQ ID NO: 3582613 - RNA, 18 nt, Human
ugaguguggcuccccucu

SEQ ID NO: 3582614 - RNA, 15 nt, Human
ugaguguuucuauga

SEQ ID NO: 3582615 - RNA, 14 nt, Human
ugaguguuuggggg

SEQ ID NO: 3582616 - RNA, 14 nt, Human
ugaguuaagucuau

SEQ ID NO: 3582617 - RNA, 16 nt, Human
ugaguuacugugcauu

SEQ ID NO: 3582618 - RNA, 17 nt, Human
ugaguuaggaaugagaa

SEQ ID NO: 3582619 - RNA, 17 nt, Human
ugaguuaggcuuucucu

SEQ ID NO: 3582620 - RNA, 12 nt, Human
ugaguuaucaug

SEQ ID NO: 3582621 - RNA, 16 nt, Human
ugaguuaucaugaauu

SEQ ID NO: 3582622 - RNA, 20 nt, Human
ugaguuaucaugaauuuuaa

SEQ ID NO: 3582623 - RNA, 17 nt, Human
ugaguucauacccuguu

SEQ ID NO: 3582624 - RNA, 18 nt, Human
ugaguucauacccuguua

SEQ ID NO: 3582625 - RNA, 14 nt, Human
ugaguuccuagcca

SEQ ID NO: 3582626 - RNA, 15 nt, Human
ugaguucuacauaag

SEQ ID NO: 3582627 - RNA, 18 nt, Human
ugaguucucagggcuccu

SEQ ID NO: 3582628 - RNA, 22 nt, Human
ugaguucucagggcuccugccu

SEQ ID NO: 3582629 - RNA, 15 nt, Human
ugaguucuguguauu

SEQ ID NO: 3582630 - RNA, 17 nt, Human
ugaguucuuccuguaau

SEQ ID NO: 3582631 - RNA, 23 nt, Human
ugaguugauagcacagacccugc

SEQ ID NO: 3582632 - RNA, 16 nt, Human
ugaguugauucagcuc

SEQ ID NO: 3582633 - RNA, 19 nt, Human
ugaguugauucagcucugc

SEQ ID NO: 3582634 - RNA, 22 nt, Human
ugaguuggcuuaccuggcccau

SEQ ID NO: 3582635 - RNA, 16 nt, Human
ugaguuguuguggguu

SEQ ID NO: 3582636 - RNA, 23 nt, Human
ugaguuuaccuuguauacuguag

SEQ ID NO: 3582637 - RNA, 19 nt, Human
ugaguuuaguaaggcugug

SEQ ID NO: 3582638 - RNA, 19 nt, Human
ugaguuucauucuccugcc

SEQ ID NO: 3582639 - RNA, 19 nt, Human
ugaguuuccucaggcugcu

SEQ ID NO: 3582640 - RNA, 13 nt, Human
ugaguuucuuaga

SEQ ID NO: 3582641 - RNA, 22 nt, Human
ugaguuugcccugguuucacug

SEQ ID NO: 3582642 - RNA, 22 nt, Human
ugaguuugggccccagaggcug

SEQ ID NO: 3582643 - RNA, 14 nt, Human
ugaguuuguuucuu

SEQ ID NO: 3582644 - RNA, 18 nt, Human
ugaguuuuauugagaauu

SEQ ID NO: 3582645 - RNA, 23 nt, Human
ugaguuuucaccucgaauuuugu

SEQ ID NO: 3582646 - RNA, 19 nt, Human
ugaguuuuccauggcagga

SEQ ID NO: 3582647 - RNA, 17 nt, Human
ugaguuuucuucuguga

SEQ ID NO: 3582648 - RNA, 19 nt, Human
ugaguuuugggaaguuaaa

SEQ ID NO: 3582649 - RNA, 19 nt, Human
ugaguuuuuacaagaugua

SEQ ID NO: 3582650 - RNA, 14 nt, Human
ugauaaaaaauuuu

SEQ ID NO: 3582651 - RNA, 20 nt, Human
ugauaaaaaauuuuguaauu

SEQ ID NO: 3582652 - RNA, 13 nt, Human
ugauaaaaauacu

SEQ ID NO: 3582653 - RNA, 20 nt, Human
ugauaaaagggcaaaucugc

SEQ ID NO: 3582654 - RNA, 13 nt, Human
ugauaaaaucaua

SEQ ID NO: 3582655 - RNA, 15 nt, Human
ugauaaagagacagu

SEQ ID NO: 3582656 - RNA, 18 nt, Human
ugauaaagauuuuuuaau

SEQ ID NO: 3582657 - RNA, 21 nt, Human
ugauaaaguuucucagauccu

SEQ ID NO: 3582658 - RNA, 19 nt, Human
ugauaaauaguguuauuga

SEQ ID NO: 3582659 - RNA, 15 nt, Human
ugauaaaucagucaa

SEQ ID NO: 3582660 - RNA, 15 nt, Human
ugauaaaucauuuua

SEQ ID NO: 3582661 - RNA, 17 nt, Human
ugauaacaauguuuuaa

SEQ ID NO: 3582662 - RNA, 12 nt, Human
ugauaacagcua

SEQ ID NO: 3582663 - RNA, 23 nt, Human
ugauaacagggauugauuuuaaa

SEQ ID NO: 3582664 - RNA, 21 nt, Human
ugauaacuagauggugcugag

SEQ ID NO: 3582665 - RNA, 21 nt, Human
ugauaacuguuuauauguguu

SEQ ID NO: 3582666 - RNA, 12 nt, Human
ugauaagaaaac

SEQ ID NO: 3582667 - RNA, 17 nt, Human
ugauaagagaaucaaca

SEQ ID NO: 3582668 - RNA, 18 nt, Human
ugauaagagaaucaacau

SEQ ID NO: 3582669 - RNA, 21 nt, Human
ugauaagagggcacacacugu

SEQ ID NO: 3582670 - RNA, 12 nt, Human
ugauaagaucuu

SEQ ID NO: 3582671 - RNA, 15 nt, Human
ugauaagaucuuuua

SEQ ID NO: 3582672 - RNA, 19 nt, Human
ugauaaggacaugaugcuu

SEQ ID NO: 3582673 - RNA, 16 nt, Human
ugauaaggaucagaac

SEQ ID NO: 3582674 - RNA, 20 nt, Human
ugauaaggaucagaacagca

SEQ ID NO: 3582675 - RNA, 19 nt, Human
ugauaagggaaaagauaaa

SEQ ID NO: 3582676 - RNA, 20 nt, Human
ugauaagggaaaagauaaag

SEQ ID NO: 3582677 - RNA, 23 nt, Human
ugauaaguuccuuuccuuuucuu

SEQ ID NO: 3582678 - RNA, 13 nt, Human
ugauaauagaaga

SEQ ID NO: 3582679 - RNA, 15 nt, Human
ugauaauagauucuc

SEQ ID NO: 3582680 - RNA, 14 nt, Human
ugauaaucaacugg

SEQ ID NO: 3582681 - RNA, 18 nt, Human
ugauaaucaacugggcug

SEQ ID NO: 3582682 - RNA, 16 nt, Human
ugauaaugaacagaac

SEQ ID NO: 3582683 - RNA, 18 nt, Human
ugauaaugaugaugacga

SEQ ID NO: 3582684 - RNA, 13 nt, Human
ugauaauguuaaa

SEQ ID NO: 3582685 - RNA, 22 nt, Human
ugauaauguuaaauuuguaagu

SEQ ID NO: 3582686 - RNA, 13 nt, Human
ugauaauuuugcu

SEQ ID NO: 3582687 - RNA, 14 nt, Human
ugauacaaugcugu

SEQ ID NO: 3582688 - RNA, 21 nt, Human
ugauacagaaaaguugaauuu

SEQ ID NO: 3582689 - RNA, 20 nt, Human
ugauacagucaacaagccug

SEQ ID NO: 3582690 - RNA, 14 nt, Human
ugauacauaacuaa

SEQ ID NO: 3582691 - RNA, 16 nt, Human
ugauacauaacuaaau

SEQ ID NO: 3582692 - RNA, 13 nt, Human
ugauacauucaaa

SEQ ID NO: 3582693 - RNA, 16 nt, Human
ugauacauucaaauuu

SEQ ID NO: 3582694 - RNA, 17 nt, Human
ugauaccagaagggaaa

SEQ ID NO: 3582695 - RNA, 15 nt, Human
ugauaccccccucug

SEQ ID NO: 3582696 - RNA, 17 nt, Human
ugauaccccccucuguc

SEQ ID NO: 3582697 - RNA, 19 nt, Human
ugauaccccccucugucuu

SEQ ID NO: 3582698 - RNA, 15 nt, Human
ugauaccccugggga

SEQ ID NO: 3582699 - RNA, 13 nt, Human
ugauacuaauaaa

SEQ ID NO: 3582700 - RNA, 14 nt, Human
ugauacuaauaaac

SEQ ID NO: 3582701 - RNA, 22 nt, Human
ugauacuaauaaacuaauaauu

SEQ ID NO: 3582702 - RNA, 14 nt, Human
ugauacuacaguuu

SEQ ID NO: 3582703 - RNA, 21 nt, Human
ugauacuaucauacuacugaa

SEQ ID NO: 3582704 - RNA, 13 nt, Human
ugauacugauggu

SEQ ID NO: 3582705 - RNA, 13 nt, Human
ugauacuguugca

SEQ ID NO: 3582706 - RNA, 14 nt, Human
ugauacuguugcac

SEQ ID NO: 3582707 - RNA, 14 nt, Human
ugauacuuauauuu

SEQ ID NO: 3582708 - RNA, 14 nt, Human
ugauacuucacuac

SEQ ID NO: 3582709 - RNA, 16 nt, Human
ugauacuucauuuaaa

SEQ ID NO: 3582710 - RNA, 22 nt, Human
ugauacuuguuuucaaaccagu

SEQ ID NO: 3582711 - RNA, 15 nt, Human
ugauacuuuuaagag

SEQ ID NO: 3582712 - RNA, 22 nt, Human
ugauagacacauaugaggggga

SEQ ID NO: 3582713 - RNA, 19 nt, Human
ugauagauuugaccuccuc

SEQ ID NO: 3582714 - RNA, 13 nt, Human
ugauagcaaagcg

SEQ ID NO: 3582715 - RNA, 23 nt, Human
ugauagcaagugaauuuuucucu

SEQ ID NO: 3582716 - RNA, 13 nt, Human
ugauagcacagac

SEQ ID NO: 3582717 - RNA, 22 nt, Human
ugauagcacagacccugcccug

SEQ ID NO: 3582718 - RNA, 14 nt, Human
ugauagcacuuucu

SEQ ID NO: 3582719 - RNA, 15 nt, Human
ugauagcguuggaau

SEQ ID NO: 3582720 - RNA, 20 nt, Human
ugauagcguuggaauuaaaa

SEQ ID NO: 3582721 - RNA, 16 nt, Human
ugauagcuaacauuuu

SEQ ID NO: 3582722 - RNA, 18 nt, Human
ugauagguauaaguggug

SEQ ID NO: 3582723 - RNA, 16 nt, Human
ugauagugguggaguu

SEQ ID NO: 3582724 - RNA, 13 nt, Human
ugauaguuacugu

SEQ ID NO: 3582725 - RNA, 14 nt, Human
ugauaguugaaugu

SEQ ID NO: 3582726 - RNA, 24 nt, Human
ugauaguuguaccgcaaugugacu

SEQ ID NO: 3582727 - RNA, 13 nt, Human
ugauauaaacagc

SEQ ID NO: 3582728 - RNA, 18 nt, Human
ugauauaauuuccauagu

SEQ ID NO: 3582729 - RNA, 22 nt, Human
ugauauacuuuuuucuuauuua

SEQ ID NO: 3582730 - RNA, 16 nt, Human
ugauauagaaguauaa

SEQ ID NO: 3582731 - RNA, 11 nt, Human
ugauauagaau

SEQ ID NO: 3582732 - RNA, 17 nt, Human
ugauauagaauuagcuu

SEQ ID NO: 3582733 - RNA, 22 nt, Human
ugauauauaaguguacauaugu

SEQ ID NO: 3582734 - RNA, 20 nt, Human
ugauauaugagacuuuaugu

SEQ ID NO: 3582735 - RNA, 18 nt, Human
ugauauauguauuaauaa

SEQ ID NO: 3582736 - RNA, 14 nt, Human
ugauauauuuuaca

SEQ ID NO: 3582737 - RNA, 15 nt, Human
ugauauauuuuacaa

SEQ ID NO: 3582738 - RNA, 21 nt, Human
ugauaucaugccccuguacuc

SEQ ID NO: 3582739 - RNA, 14 nt, Human
ugauauccuucuag

SEQ ID NO: 3582740 - RNA, 15 nt, Human
ugauaucuauaaaau

SEQ ID NO: 3582741 - RNA, 23 nt, Human
ugauaucuauaaaauagauauaa

SEQ ID NO: 3582742 - RNA, 15 nt, Human
ugauaugaguauaca

SEQ ID NO: 3582743 - RNA, 16 nt, Human
ugauaugaguauacaa

SEQ ID NO: 3582744 - RNA, 17 nt, Human
ugauaugaguauacaau

SEQ ID NO: 3582745 - RNA, 19 nt, Human
ugauaugauuuaaaacaug

SEQ ID NO: 3582746 - RNA, 16 nt, Human
ugauaugcauuuccug

SEQ ID NO: 3582747 - RNA, 20 nt, Human
ugauauggagcccuguaauu

SEQ ID NO: 3582748 - RNA, 15 nt, Human
ugauauggcagaaga

SEQ ID NO: 3582749 - RNA, 12 nt, Human
ugauaugggucu

SEQ ID NO: 3582750 - RNA, 13 nt, Human
ugauauuaaagga

SEQ ID NO: 3582751 - RNA, 22 nt, Human
ugauauuaauuuaucagauugc

SEQ ID NO: 3582752 - RNA, 22 nt, Human
ugauauucagaauuaugaugga

SEQ ID NO: 3582753 - RNA, 19 nt, Human
ugauauuccauaguauauu

SEQ ID NO: 3582754 - RNA, 15 nt, Human
ugauauucuaagacu

SEQ ID NO: 3582755 - RNA, 17 nt, Human
ugauauucuuuguuaau

SEQ ID NO: 3582756 - RNA, 17 nt, Human
ugauauugugaacauuu

SEQ ID NO: 3582757 - RNA, 12 nt, Human
ugauauuucaga

SEQ ID NO: 3582758 - RNA, 17 nt, Human
ugauauuucuagcuuau

SEQ ID NO: 3582759 - RNA, 12 nt, Human
ugauauuucucu

SEQ ID NO: 3582760 - RNA, 17 nt, Human
ugauauuugugcauuuu

SEQ ID NO: 3582761 - RNA, 17 nt, Human
ugauauuuuuuaucaua

SEQ ID NO: 3582762 - RNA, 18 nt, Human
ugaucaaagccacacucu

SEQ ID NO: 3582763 - RNA, 20 nt, Human
ugaucaaaguccgaggggcg

SEQ ID NO: 3582764 - RNA, 16 nt, Human
ugaucaaauguuuaau

SEQ ID NO: 3582765 - RNA, 16 nt, Human
ugaucaaauucauuuu

SEQ ID NO: 3582766 - RNA, 23 nt, Human
ugaucaaauucauuuuuuucacu

SEQ ID NO: 3582767 - RNA, 18 nt, Human
ugaucaacaucuuuucuu

SEQ ID NO: 3582768 - RNA, 23 nt, Human
ugaucaacaucuuuucuugccuc

SEQ ID NO: 3582769 - RNA, 15 nt, Human
ugaucaacucuucga

SEQ ID NO: 3582770 - RNA, 11 nt, Human
ugaucaaggcc

SEQ ID NO: 3582771 - RNA, 13 nt, Human
ugaucaaggccuu

SEQ ID NO: 3582772 - RNA, 22 nt, Human
ugaucaagggaauguaacugcu

SEQ ID NO: 3582773 - RNA, 13 nt, Human
ugaucaauaaaau

SEQ ID NO: 3582774 - RNA, 21 nt, Human
ugaucaauaaaaugugauuuu

SEQ ID NO: 3582775 - RNA, 16 nt, Human
ugaucaauauuuuuau

SEQ ID NO: 3582776 - RNA, 18 nt, Human
ugaucaaugacagagccu

SEQ ID NO: 3582777 - RNA, 14 nt, Human
ugaucaauuaaaug

SEQ ID NO: 3582778 - RNA, 21 nt, Human
ugaucaauuauaguuucugag

SEQ ID NO: 3582779 - RNA, 13 nt, Human
ugaucacggcuca

SEQ ID NO: 3582780 - RNA, 15 nt, Human
ugaucacggcucacu

SEQ ID NO: 3582781 - RNA, 19 nt, Human
ugaucacggcucacugcag

SEQ ID NO: 3582782 - RNA, 15 nt, Human
ugaucacuagccugu

SEQ ID NO: 3582783 - RNA, 16 nt, Human
ugaucacuagccuguc

SEQ ID NO: 3582784 - RNA, 22 nt, Human
ugaucacuccagguaguuuggg

SEQ ID NO: 3582785 - RNA, 18 nt, Human
ugaucacuggcaaugaaa

SEQ ID NO: 3582786 - RNA, 15 nt, Human
ugaucagaucugaca

SEQ ID NO: 3582787 - RNA, 16 nt, Human
ugaucagccccacccu

SEQ ID NO: 3582788 - RNA, 16 nt, Human
ugaucagcuguuuguc

SEQ ID NO: 3582789 - RNA, 20 nt, Human
ugaucagcuuucaaagcauu

SEQ ID NO: 3582790 - RNA, 15 nt, Human
ugaucaguggacagu

SEQ ID NO: 3582791 - RNA, 12 nt, Human
ugaucaguguug

SEQ ID NO: 3582792 - RNA, 20 nt, Human
ugaucauaaacugacuauca

SEQ ID NO: 3582793 - RNA, 21 nt, Human
ugaucauaagucuaaauaaau

SEQ ID NO: 3582794 - RNA, 19 nt, Human
ugaucauagguauuucaaa

SEQ ID NO: 3582795 - RNA, 23 nt, Human
ugaucaucccaucuaagcugcag

SEQ ID NO: 3582796 - RNA, 18 nt, Human
ugaucaucgccagaggug

SEQ ID NO: 3582797 - RNA, 15 nt, Human
ugaucaugcauuguu

SEQ ID NO: 3582798 - RNA, 14 nt, Human
ugaucauguacuuu

SEQ ID NO: 3582799 - RNA, 19 nt, Human
ugaucauguacuuuuuagu

SEQ ID NO: 3582800 - RNA, 16 nt, Human
ugaucauguuguuaaa

SEQ ID NO: 3582801 - RNA, 16 nt, Human
ugaucauuuucccccc

SEQ ID NO: 3582802 - RNA, 18 nt, Human
ugauccaagcaagacuga

SEQ ID NO: 3582803 - RNA, 21 nt, Human
ugauccaagcuggucccacuc

SEQ ID NO: 3582804 - RNA, 17 nt, Human
ugauccacccaccucag

SEQ ID NO: 3582805 - RNA, 23 nt, Human
ugauccagaaagaaaacuuguau

SEQ ID NO: 3582806 - RNA, 20 nt, Human
ugauccagcagauuauucac

SEQ ID NO: 3582807 - RNA, 22 nt, Human
ugauccagcagauuauucacug

SEQ ID NO: 3582808 - RNA, 18 nt, Human
ugauccagcccugaguuc

SEQ ID NO: 3582809 - RNA, 21 nt, Human
ugauccaugaguuugcccugg

SEQ ID NO: 3582810 - RNA, 13 nt, Human
ugauccauguaac

SEQ ID NO: 3582811 - RNA, 14 nt, Human
ugauccauguaacu

SEQ ID NO: 3582812 - RNA, 15 nt, Human
ugauccauguaacug

SEQ ID NO: 3582813 - RNA, 16 nt, Human
ugauccauuucuaauu

SEQ ID NO: 3582814 - RNA, 19 nt, Human
ugaucccagagagcccgag

SEQ ID NO: 3582815 - RNA, 15 nt, Human
ugaucccauuuuccu

SEQ ID NO: 3582816 - RNA, 18 nt, Human
ugauccccacgccacagc

SEQ ID NO: 3582817 - RNA, 20 nt, Human
ugauccccacgccacagccc

SEQ ID NO: 3582818 - RNA, 17 nt, Human
ugaucccguuuucccca

SEQ ID NO: 3582819 - RNA, 21 nt, Human
ugaucccguuuuccccaugac

SEQ ID NO: 3582820 - RNA, 20 nt, Human
ugaucccuguguugucucua

SEQ ID NO: 3582821 - RNA, 19 nt, Human
ugaucccuugagauaugga

SEQ ID NO: 3582822 - RNA, 16 nt, Human
ugauccuaguuccacc

SEQ ID NO: 3582823 - RNA, 18 nt, Human
ugauccucauauggccca

SEQ ID NO: 3582824 - RNA, 16 nt, Human
ugauccucccaccuca

SEQ ID NO: 3582825 - RNA, 21 nt, Human
ugauccucccaccucagccuc

SEQ ID NO: 3582826 - RNA, 14 nt, Human
ugauccuggaggcc

SEQ ID NO: 3582827 - RNA, 15 nt, Human
ugauccuggaggccc

SEQ ID NO: 3582828 - RNA, 14 nt, Human
ugauccugugaagu

SEQ ID NO: 3582829 - RNA, 20 nt, Human
ugauccuuuuauguuauuua

SEQ ID NO: 3582830 - RNA, 15 nt, Human
ugaucgaaaaaauaa

SEQ ID NO: 3582831 - RNA, 16 nt, Human
ugaucgaaaaaauaau

SEQ ID NO: 3582832 - RNA, 15 nt, Human
ugaucgccuucccca

SEQ ID NO: 3582833 - RNA, 16 nt, Human
ugaucgugacgcugaa

SEQ ID NO: 3582834 - RNA, 15 nt, Human
ugaucuacaugagga

SEQ ID NO: 3582835 - RNA, 21 nt, Human
ugaucuaccuugaauugauau

SEQ ID NO: 3582836 - RNA, 20 nt, Human
ugaucuacuucuguaauugu

SEQ ID NO: 3582837 - RNA, 21 nt, Human
ugaucuacuucuguaauugug

SEQ ID NO: 3582838 - RNA, 17 nt, Human
ugaucuagagccaguua

SEQ ID NO: 3582839 - RNA, 17 nt, Human
ugaucuagguuuaacuc

SEQ ID NO: 3582840 - RNA, 18 nt, Human
ugaucuagguuuaacuca

SEQ ID NO: 3582841 - RNA, 19 nt, Human
ugaucucagcucacugcaa

SEQ ID NO: 3582842 - RNA, 16 nt, Human
ugaucucagggaagcc

SEQ ID NO: 3582843 - RNA, 22 nt, Human
ugaucucauuuaauccucucaa

SEQ ID NO: 3582844 - RNA, 21 nt, Human
ugaucuccauauguuacacua

SEQ ID NO: 3582845 - RNA, 20 nt, Human
ugaucuccauggcuuccucc

SEQ ID NO: 3582846 - RNA, 13 nt, Human
ugaucucccugcc

SEQ ID NO: 3582847 - RNA, 15 nt, Human
ugaucuccguggcuu

SEQ ID NO: 3582848 - RNA, 18 nt, Human
ugaucucgaacuccuaac

SEQ ID NO: 3582849 - RNA, 21 nt, Human
ugaucucggcucacugcaacc

SEQ ID NO: 3582850 - RNA, 15 nt, Human
ugaucucucgugauu

SEQ ID NO: 3582851 - RNA, 16 nt, Human
ugaucugcucagcccu

SEQ ID NO: 3582852 - RNA, 17 nt, Human
ugaucugcucagcccug

SEQ ID NO: 3582853 - RNA, 18 nt, Human
ugaucugcucagcccugg

SEQ ID NO: 3582854 - RNA, 20 nt, Human
ugaucugcucagcccuggag

SEQ ID NO: 3582855 - RNA, 15 nt, Human
ugaucuggaacccag

SEQ ID NO: 3582856 - RNA, 17 nt, Human
ugaucuggaacccagac

SEQ ID NO: 3582857 - RNA, 19 nt, Human
ugaucuggaacccagacuc

SEQ ID NO: 3582858 - RNA, 18 nt, Human
ugaucugggaacucccaa

SEQ ID NO: 3582859 - RNA, 17 nt, Human
ugaucugggucucuaau

SEQ ID NO: 3582860 - RNA, 19 nt, Human
ugaucuguauauacaauaa

SEQ ID NO: 3582861 - RNA, 19 nt, Human
ugaucugucuguggcaaaa

SEQ ID NO: 3582862 - RNA, 13 nt, Human
ugaucugucuugu

SEQ ID NO: 3582863 - RNA, 15 nt, Human
ugaucugucuuguaa

SEQ ID NO: 3582864 - RNA, 19 nt, Human
ugaucugugaauugagcug

SEQ ID NO: 3582865 - RNA, 11 nt, Human
ugaucugugcu

SEQ ID NO: 3582866 - RNA, 12 nt, Human
ugaucugugcuu

SEQ ID NO: 3582867 - RNA, 21 nt, Human
ugaucugugcuuuccagcuca

SEQ ID NO: 3582868 - RNA, 16 nt, Human
ugaucuuaagaggcug

SEQ ID NO: 3582869 - RNA, 16 nt, Human
ugaucuuauuuuucua

SEQ ID NO: 3582870 - RNA, 17 nt, Human
ugaucuuauuuuucuaa

SEQ ID NO: 3582871 - RNA, 22 nt, Human
ugaucuucaacaaauugcccuu

SEQ ID NO: 3582872 - RNA, 16 nt, Human
ugaucuuccucugcua

SEQ ID NO: 3582873 - RNA, 21 nt, Human
ugaucuuggcuuacugcagcc

SEQ ID NO: 3582874 - RNA, 15 nt, Human
ugaugaaaagauuua

SEQ ID NO: 3582875 - RNA, 12 nt, Human
ugaugaaaauaa

SEQ ID NO: 3582876 - RNA, 17 nt, Human
ugaugaaaauaaagaau

SEQ ID NO: 3582877 - RNA, 19 nt, Human
ugaugaaagcugauuacug

SEQ ID NO: 3582878 - RNA, 18 nt, Human
ugaugaaauguaaauacu

SEQ ID NO: 3582879 - RNA, 15 nt, Human
ugaugaacuuucucu

SEQ ID NO: 3582880 - RNA, 12 nt, Human
ugaugaagaagu

SEQ ID NO: 3582881 - RNA, 17 nt, Human
ugaugaagaaguugaua

SEQ ID NO: 3582882 - RNA, 14 nt, Human
ugaugaagaggagu

SEQ ID NO: 3582883 - RNA, 21 nt, Human
ugaugaagccgaccuuagauu

SEQ ID NO: 3582884 - RNA, 17 nt, Human
ugaugaagggaggaggu

SEQ ID NO: 3582885 - RNA, 13 nt, Human
ugaugaaucacug

SEQ ID NO: 3582886 - RNA, 18 nt, Human
ugaugacaaaaaauguuu

SEQ ID NO: 3582887 - RNA, 17 nt, Human
ugaugacaauaaagcuu

SEQ ID NO: 3582888 - RNA, 14 nt, Human
ugaugacagacacu

SEQ ID NO: 3582889 - RNA, 15 nt, Human
ugaugacucaagauu

SEQ ID NO: 3582890 - RNA, 22 nt, Human
ugaugacucaagauucccagga

SEQ ID NO: 3582891 - RNA, 16 nt, Human
ugaugagaauuucuaa

SEQ ID NO: 3582892 - RNA, 16 nt, Human
ugaugagaggaaauca

SEQ ID NO: 3582893 - RNA, 16 nt, Human
ugaugaggcccuccac

SEQ ID NO: 3582894 - RNA, 21 nt, Human
ugaugaggcccuccacaccug

SEQ ID NO: 3582895 - RNA, 17 nt, Human
ugaugaggccucuugga

SEQ ID NO: 3582896 - RNA, 15 nt, Human
ugaugaggggagggg

SEQ ID NO: 3582897 - RNA, 17 nt, Human
ugauuaugaauuacauu

SEQ ID NO: 3582898 - RNA, 15 nt, Human
ugauuaugacuguuu

SEQ ID NO: 3582899 - RNA, 16 nt, Human
ugauuauuacuggcaa

SEQ ID NO: 3582900 - RNA, 16 nt, Human
ugauuauucaguguca

SEQ ID NO: 3582901 - RNA, 18 nt, Human
ugauuauuguauuuauuc

SEQ ID NO: 3582902 - RNA, 16 nt, Human
ugauuauuuauuauuu

SEQ ID NO: 3582903 - RNA, 19 nt, Human
ugauuauuugcauguuaug

SEQ ID NO: 3582904 - RNA, 21 nt, Human
ugauuauuuucauuacaaugg

SEQ ID NO: 3582905 - RNA, 13 nt, Human
ugauuauuuucuu

SEQ ID NO: 3582906 - RNA, 20 nt, Human
ugauuauuuuuuucuguaaa

SEQ ID NO: 3582907 - RNA, 18 nt, Human
ugauuauuuuuuuuuucu

SEQ ID NO: 3582908 - RNA, 14 nt, Human
ugauucaaaauauu

SEQ ID NO: 3582909 - RNA, 19 nt, Human
ugauucaaaauauuuaaaa

SEQ ID NO: 3582910 - RNA, 13 nt, Human
ugauucaaauggg

SEQ ID NO: 3582911 - RNA, 14 nt, Human
ugauucaacuaaaa

SEQ ID NO: 3582912 - RNA, 23 nt, Human
ugauucaacuaaaaaaaaaaaag

SEQ ID NO: 3582913 - RNA, 12 nt, Human
ugauucaagcca

SEQ ID NO: 3582914 - RNA, 23 nt, Human
ugauucaaucuguaaacugugua

SEQ ID NO: 3582915 - RNA, 16 nt, Human
ugauucacauguuuuc

SEQ ID NO: 3582916 - RNA, 24 nt, Human
ugauucaccaaaauagucuucuca

SEQ ID NO: 3582917 - RNA, 22 nt, Human
ugauucacccccaaacagugac

SEQ ID NO: 3582918 - RNA, 13 nt, Human
ugauucacugcau

SEQ ID NO: 3582919 - RNA, 19 nt, Human
ugauucagaaaauguucug

SEQ ID NO: 3582920 - RNA, 20 nt, Human
ugauucagaaaauguucugu

SEQ ID NO: 3582921 - RNA, 14 nt, Human
ugauucagaaauug

SEQ ID NO: 3582922 - RNA, 16 nt, Human
ugauucagaaauugga

SEQ ID NO: 3582923 - RNA, 18 nt, Human
ugauucagacagcugccu

SEQ ID NO: 3582924 - RNA, 18 nt, Human
ugauucaggugcagagga

SEQ ID NO: 3582925 - RNA, 21 nt, Human
ugauucaggugcagaggaagu

SEQ ID NO: 3582926 - RNA, 15 nt, Human
ugauucauaaugacu

SEQ ID NO: 3582927 - RNA, 18 nt, Human
ugauucauaguaacuucu

SEQ ID NO: 3582928 - RNA, 17 nt, Human
ugauucauuuuaacauc

SEQ ID NO: 3582929 - RNA, 22 nt, Human
ugauucauuuuaacaucugaga

SEQ ID NO: 3582930 - RNA, 21 nt, Human
ugauuccacuacaccuggcug

SEQ ID NO: 3582931 - RNA, 23 nt, Human
ugauuccacuacaccuggcugag

SEQ ID NO: 3582932 - RNA, 15 nt, Human
ugauuccacuuuuau

SEQ ID NO: 3582933 - RNA, 15 nt, Human
ugauuccagccauca

SEQ ID NO: 3582934 - RNA, 19 nt, Human
ugauuccagccaucaccuu

SEQ ID NO: 3582935 - RNA, 16 nt, Human
ugauuccauccaccuu

SEQ ID NO: 3582936 - RNA, 16 nt, Human
ugauuccaucuccuug

SEQ ID NO: 3582937 - RNA, 15 nt, Human
ugauucccugauuua

SEQ ID NO: 3582938 - RNA, 20 nt, Human
ugauucccuuguuauucaac

SEQ ID NO: 3582939 - RNA, 23 nt, Human
ugauuccuaagccacuugaaaug

SEQ ID NO: 3582940 - RNA, 19 nt, Human
ugauuccuuccuguucuga

SEQ ID NO: 3582941 - RNA, 15 nt, Human
ugauuccuuuaacaa

SEQ ID NO: 3582942 - RNA, 20 nt, Human
ugauuccuuugaagaggaaa

SEQ ID NO: 3582943 - RNA, 19 nt, Human
ugauucuaaugucuucauu

SEQ ID NO: 3582944 - RNA, 19 nt, Human
ugauucucagggucucugc

SEQ ID NO: 3582945 - RNA, 20 nt, Human
ugauucucagggucucugcu

SEQ ID NO: 3582946 - RNA, 23 nt, Human
ugauucucagggucucugcugcc

SEQ ID NO: 3582947 - RNA, 15 nt, Human
ugauucucaugccuc

SEQ ID NO: 3582948 - RNA, 19 nt, Human
ugauucuccugccucagcc

SEQ ID NO: 3582949 - RNA, 22 nt, Human
ugauucugcaguaaaucuuuua

SEQ ID NO: 3582950 - RNA, 19 nt, Human
ugauucugcuuuuaccaug

SEQ ID NO: 3582951 - RNA, 21 nt, Human
ugauucuucagcaaaaauauu

SEQ ID NO: 3582952 - RNA, 20 nt, Human
ugauucuugaguuuagugau

SEQ ID NO: 3582953 - RNA, 18 nt, Human
ugauucuuuuuaaagugu

SEQ ID NO: 3582954 - RNA, 18 nt, Human
ugauugaagaaacagcua

SEQ ID NO: 3582955 - RNA, 13 nt, Human
ugauugacagcuu

SEQ ID NO: 3582956 - RNA, 16 nt, Human
ugauugaccugcuccg

SEQ ID NO: 3582957 - RNA, 13 nt, Human
ugauugagaaguu

SEQ ID NO: 3582958 - RNA, 20 nt, Human
ugauugagaaguucauuguc

SEQ ID NO: 3582959 - RNA, 14 nt, Human
ugauugauuugaag

SEQ ID NO: 3582960 - RNA, 15 nt, Human
ugauugcacauuguu

SEQ ID NO: 3582961 - RNA, 21 nt, Human
ugauugcagaauuguuuagau

SEQ ID NO: 3582962 - RNA, 14 nt, Human
ugauugcagcuuua

SEQ ID NO: 3582963 - RNA, 22 nt, Human
ugauugccuuuuuauaacuuuu

SEQ ID NO: 3582964 - RNA, 13 nt, Human
ugauugcuaaaug

SEQ ID NO: 3582965 - RNA, 17 nt, Human
ugauugcuuuuaaaauu

SEQ ID NO: 3582966 - RNA, 22 nt, Human
ugauuggaagggcuuuucaaaa

SEQ ID NO: 3582967 - RNA, 23 nt, Human
ugauuggaagggcuuuucaaaau

SEQ ID NO: 3582968 - RNA, 13 nt, Human
ugauuggaggggg

SEQ ID NO: 3582969 - RNA, 14 nt, Human
ugauuggauuauuc

SEQ ID NO: 3582970 - RNA, 16 nt, Human
ugauuggauuauucau

SEQ ID NO: 3582971 - RNA, 16 nt, Human
ugauuggcuuguagaa

SEQ ID NO: 3582972 - RNA, 18 nt, Human
ugauugggaauaaauaug

SEQ ID NO: 3582973 - RNA, 15 nt, Human
ugauugggacagagg

SEQ ID NO: 3582974 - RNA, 17 nt, Human
ugauugggacagagguu

SEQ ID NO: 3582975 - RNA, 21 nt, Human
ugauugggcacaucauuucaa

SEQ ID NO: 3582976 - RNA, 21 nt, Human
ugauuggugcaacccuuaccc

SEQ ID NO: 3582977 - RNA, 17 nt, Human
ugauugguuucucuucu

SEQ ID NO: 3582978 - RNA, 16 nt, Human
ugauugguuuuaauug

SEQ ID NO: 3582979 - RNA, 23 nt, Human
ugauuguaaaauagcuuguauag

SEQ ID NO: 3582980 - RNA, 18 nt, Human
ugauuguaacguugcugu

SEQ ID NO: 3582981 - RNA, 19 nt, Human
ugauuguaacguugcugug

SEQ ID NO: 3582982 - RNA, 20 nt, Human
ugauuguaacguugcugugg

SEQ ID NO: 3582983 - RNA, 21 nt, Human
ugauuguaacguugcuguggg

SEQ ID NO: 3582984 - RNA, 20 nt, Human
ugauuguaguaaucugcauu

SEQ ID NO: 3582985 - RNA, 16 nt, Human
ugauuguauuguugaa

SEQ ID NO: 3582986 - RNA, 18 nt, Human
ugauuguggaauggagau

SEQ ID NO: 3582987 - RNA, 21 nt, Human
ugauuguggaauggagauuca

SEQ ID NO: 3582988 - RNA, 15 nt, Human
ugauuuaaaacaugu

SEQ ID NO: 3582989 - RNA, 20 nt, Human
ugauuuaauaaaauaauucu

SEQ ID NO: 3582990 - RNA, 17 nt, Human
ugauuuaauaguguuaa

SEQ ID NO: 3582991 - RNA, 18 nt, Human
ugauuuaauaguguuaau

SEQ ID NO: 3582992 - RNA, 21 nt, Human
ugauuuaauaguguuaaucaa

SEQ ID NO: 3582993 - RNA, 15 nt, Human
ugauuuaauaugcaa

SEQ ID NO: 3582994 - RNA, 17 nt, Human
ugauuuauaaacagaca

SEQ ID NO: 3582995 - RNA, 23 nt, Human
ugauuuauaaacagacaauaugu

SEQ ID NO: 3582996 - RNA, 16 nt, Human
ugauuuaucacacaaa

SEQ ID NO: 3582997 - RNA, 22 nt, Human
ugauuuaugcauggaaaccuga

SEQ ID NO: 3582998 - RNA, 21 nt, Human
ugauuucaaaguuuuguugua

SEQ ID NO: 3582999 - RNA, 16 nt, Human
ugauuucacaaauauu

SEQ ID NO: 3583000 - RNA, 14 nt, Human
ugauuucacagugu

SEQ ID NO: 3583001 - RNA, 21 nt, Human
ugauuucagcaccuacagugu

SEQ ID NO: 3583002 - RNA, 19 nt, Human
ugauuucaggauacucugu

SEQ ID NO: 3583003 - RNA, 23 nt, Human
ugauuucaggauacucugucaga

SEQ ID NO: 3583004 - RNA, 14 nt, Human
ugauuucaguaagu

SEQ ID NO: 3583005 - RNA, 16 nt, Human
ugauuucaguaagucu

SEQ ID NO: 3583006 - RNA, 19 nt, Human
ugauuucaguaagucucau

SEQ ID NO: 3583007 - RNA, 13 nt, Human
ugauuucauguac

SEQ ID NO: 3583008 - RNA, 15 nt, Human
ugauuucauguacug

SEQ ID NO: 3583009 - RNA, 16 nt, Human
ugauuucauguacugc

SEQ ID NO: 3583010 - RNA, 17 nt, Human
ugauuucauguacugca

SEQ ID NO: 3583011 - RNA, 18 nt, Human
ugauuucauguacugcau

SEQ ID NO: 3583012 - RNA, 13 nt, Human
ugauuucauucaa

SEQ ID NO: 3583013 - RNA, 13 nt, Human
ugauuucauuuca

SEQ ID NO: 3583014 - RNA, 18 nt, Human
ugauuucccguggcccca

SEQ ID NO: 3583015 - RNA, 19 nt, Human
ugauuucccguggccccag

SEQ ID NO: 3583016 - RNA, 20 nt, Human
ugauuucccguggccccagc

SEQ ID NO: 3583017 - RNA, 21 nt, Human
ugauuucccguggccccagcc

SEQ ID NO: 3583018 - RNA, 22 nt, Human
ugauuucccguggccccagccu

SEQ ID NO: 3583019 - RNA, 18 nt, Human
ugauuuccguuaaaauac

SEQ ID NO: 3583020 - RNA, 15 nt, Human
ugauuuccuguguca

SEQ ID NO: 3583021 - RNA, 14 nt, Human
ugauuuccuugaau

SEQ ID NO: 3583022 - RNA, 23 nt, Human
ugauuucuaguuauuuauucugg

SEQ ID NO: 3583023 - RNA, 15 nt, Human
ugauuucuaugcuga

SEQ ID NO: 3583024 - RNA, 20 nt, Human
ugauuucuauucaagguggc

SEQ ID NO: 3583025 - RNA, 17 nt, Human
ugauuucuuguaacauc

SEQ ID NO: 3583026 - RNA, 15 nt, Human
ugauuucuuuccaga

SEQ ID NO: 3583027 - RNA, 16 nt, Human
ugauuucuuuccagag

SEQ ID NO: 3583028 - RNA, 23 nt, Human
ugauuugacuguuuuuacccaua

SEQ ID NO: 3583029 - RNA, 14 nt, Human
ugauuugaguugau

SEQ ID NO: 3583030 - RNA, 12 nt, Human
ugauuugcauug

SEQ ID NO: 3583031 - RNA, 18 nt, Human
ugauuugcauugaacaca

SEQ ID NO: 3583032 - RNA, 21 nt, Human
ugauuugccacugauauucag

SEQ ID NO: 3583033 - RNA, 22 nt, Human
ugauuugccacugauauucaga

SEQ ID NO: 3583034 - RNA, 19 nt, Human
ugauuuggugaccaacugu

SEQ ID NO: 3583035 - RNA, 16 nt, Human
ugauuuguuuuagaau

SEQ ID NO: 3583036 - RNA, 20 nt, Human
ugauuuuaaaauguacaugu

SEQ ID NO: 3583037 - RNA, 13 nt, Human
ugauuuuaacaau

SEQ ID NO: 3583038 - RNA, 17 nt, Human
ugauuuuaacaauaacu

SEQ ID NO: 3583039 - RNA, 18 nt, Human
ugauuuuaacaauaacua

SEQ ID NO: 3583040 - RNA, 13 nt, Human
ugcaagugugugc

SEQ ID NO: 3583041 - RNA, 21 nt, Human
ugcaagugugugcacaugugu

SEQ ID NO: 3583042 - RNA, 18 nt, Human
ugcaagugugugcaugug

SEQ ID NO: 3583043 - RNA, 18 nt, Human
ugcaaguugaggacuucu

SEQ ID NO: 3583044 - RNA, 19 nt, Human
ugcaaguugaggacuucuu

SEQ ID NO: 3583045 - RNA, 19 nt, Human
ugcaauaaaucugacccag

SEQ ID NO: 3583046 - RNA, 21 nt, Human
ugcaauaaaucugacccagug

SEQ ID NO: 3583047 - RNA, 23 nt, Human
ugcaauaaaucugacccagugcc

SEQ ID NO: 3583048 - RNA, 17 nt, Human
ugcaauaacagcugcaa

SEQ ID NO: 3583049 - RNA, 18 nt, Human
ugcaauaacagcugcaau

SEQ ID NO: 3583050 - RNA, 15 nt, Human
ugcaauaacuucuga

SEQ ID NO: 3583051 - RNA, 17 nt, Human
ugcaauaacuucugacc

SEQ ID NO: 3583052 - RNA, 18 nt, Human
ugcaauaaugcaguaugg

SEQ ID NO: 3583053 - RNA, 17 nt, Human
ugcaauacaaguuucau

SEQ ID NO: 3583054 - RNA, 19 nt, Human
ugcaauauaucuaaauuga

SEQ ID NO: 3583055 - RNA, 14 nt, Human
ugcaauauauuuug

SEQ ID NO: 3583056 - RNA, 15 nt, Human
ugcaauauauuuugu

SEQ ID NO: 3583057 - RNA, 16 nt, Human
ugcaauauauuuugua

SEQ ID NO: 3583058 - RNA, 15 nt, Human
ugcaauaucugaagc

SEQ ID NO: 3583059 - RNA, 13 nt, Human
ugcaauaucuucg

SEQ ID NO: 3583060 - RNA, 18 nt, Human
ugcaauauuaaugccuuu

SEQ ID NO: 3583061 - RNA, 16 nt, Human
ugcaauauuuccucau

SEQ ID NO: 3583062 - RNA, 14 nt, Human
ugcaauauuuguaa

SEQ ID NO: 3583063 - RNA, 20 nt, Human
ugcaauauuuguaaggcuug

SEQ ID NO: 3583064 - RNA, 20 nt, Human
ugcaaucauaugugaucugu

SEQ ID NO: 3583065 - RNA, 15 nt, Human
ugcaaucccuuaaua

SEQ ID NO: 3583066 - RNA, 19 nt, Human
ugcaauccugucuuucuga

SEQ ID NO: 3583067 - RNA, 15 nt, Human
ugcaauccuuacaaa

SEQ ID NO: 3583068 - RNA, 16 nt, Human
ugcaauccuuacaaau

SEQ ID NO: 3583069 - RNA, 18 nt, Human
ugcaaucuauaauauuug

SEQ ID NO: 3583070 - RNA, 13 nt, Human
ugcaaugaccuuu

SEQ ID NO: 3583071 - RNA, 16 nt, Human
ugcaaugacucaggac

SEQ ID NO: 3583072 - RNA, 18 nt, Human
ugcaauggcuauauggca

SEQ ID NO: 3583073 - RNA, 18 nt, Human
ugcaaugggauguaugaa

SEQ ID NO: 3583074 - RNA, 24 nt, Human
ugcaauguaucccuucucacagca

SEQ ID NO: 3583075 - RNA, 19 nt, Human
ugcaaugucugagugaacc

SEQ ID NO: 3583076 - RNA, 13 nt, Human
ugcaauguguaua

SEQ ID NO: 3583077 - RNA, 15 nt, Human
ugcaauguguauaaa

SEQ ID NO: 3583078 - RNA, 16 nt, Human
ugcaauguguauaaac

SEQ ID NO: 3583079 - RNA, 21 nt, Human
ugcaauguguauaaacaagaa

SEQ ID NO: 3583080 - RNA, 23 nt, Human
ugcaauuaaacuuccaaagaaag

SEQ ID NO: 3583081 - RNA, 15 nt, Human
ugcaauuaaagugau

SEQ ID NO: 3583082 - RNA, 17 nt, Human
ugcaauuaggauuuuga

SEQ ID NO: 3583083 - RNA, 21 nt, Human
ugcaauucaaaaguuccaaga

SEQ ID NO: 3583084 - RNA, 18 nt, Human
ugcaauuccccucugcug

SEQ ID NO: 3583085 - RNA, 18 nt, Human
ugcaauuuauuaaaauga

SEQ ID NO: 3583086 - RNA, 17 nt, Human
ugcaauuucaagguucu

SEQ ID NO: 3583087 - RNA, 18 nt, Human
ugcaauuucaagguucua

SEQ ID NO: 3583088 - RNA, 19 nt, Human
ugcaauuucaagguucuaa

SEQ ID NO: 3583089 - RNA, 14 nt, Human
ugcaauuucauaug

SEQ ID NO: 3583090 - RNA, 23 nt, Human
ugcaauuugauugacugcccauu

SEQ ID NO: 3583091 - RNA, 17 nt, Human
ugcaauuuguuugugcu

SEQ ID NO: 3583092 - RNA, 20 nt, Human
ugcaauuuguuugugcuucu

SEQ ID NO: 3583093 - RNA, 17 nt, Human
ugcaauuuuaacacaca

SEQ ID NO: 3583094 - RNA, 22 nt, Human
ugcaauuuuucuuucuuuuguu

SEQ ID NO: 3583095 - RNA, 16 nt, Human
ugcacaaacagaggcc

SEQ ID NO: 3583096 - RNA, 17 nt, Human
ugcacaaacagaggccg

SEQ ID NO: 3583097 - RNA, 20 nt, Human
ugcacaaacagaggccgcca

SEQ ID NO: 3583098 - RNA, 15 nt, Human
ugcacaaacucacca

SEQ ID NO: 3583099 - RNA, 21 nt, Human
ugcacaaauauuuauuuucuu

SEQ ID NO: 3583100 - RNA, 17 nt, Human
ugcacaaauucaugugc

SEQ ID NO: 3583101 - RNA, 14 nt, Human
ugcacaagaaugga

SEQ ID NO: 3583102 - RNA, 20 nt, Human
ugcacaagaauggaucacaa

SEQ ID NO: 3583103 - RNA, 14 nt, Human
ugcacaagccaggg

SEQ ID NO: 3583104 - RNA, 15 nt, Human
ugcacaagcuccaag

SEQ ID NO: 3583105 - RNA, 22 nt, Human
ugcacaagcuccaagcucccag

SEQ ID NO: 3583106 - RNA, 23 nt, Human
ugcacaagcuccaagcucccagg

SEQ ID NO: 3583107 - RNA, 15 nt, Human
ugcacaagcugcacc

SEQ ID NO: 3583108 - RNA, 16 nt, Human
ugcacaagcugcaccc

SEQ ID NO: 3583109 - RNA, 18 nt, Human
ugcacaaggauugaaaau

SEQ ID NO: 3583110 - RNA, 20 nt, Human
ugcacaauaaaaauguuuaa

SEQ ID NO: 3583111 - RNA, 19 nt, Human
ugcacaauaacuccuccca

SEQ ID NO: 3583112 - RNA, 19 nt, Human
ugcacaauauugaacuuuu

SEQ ID NO: 3583113 - RNA, 14 nt, Human
ugcacacaaauauu

SEQ ID NO: 3583114 - RNA, 20 nt, Human
ugcacacaagcccacagcac

SEQ ID NO: 3583115 - RNA, 15 nt, Human
ugcacacaauuagau

SEQ ID NO: 3583116 - RNA, 18 nt, Human
ugcacacacacacacaug

SEQ ID NO: 3583117 - RNA, 18 nt, Human
ugcacacacauauauuau

SEQ ID NO: 3583118 - RNA, 15 nt, Human
ugcacacaccagagc

SEQ ID NO: 3583119 - RNA, 16 nt, Human
ugcacacagaaauaua

SEQ ID NO: 3583120 - RNA, 17 nt, Human
ugcacacagaaauauau

SEQ ID NO: 3583121 - RNA, 18 nt, Human
ugcacacagaaauauaua

SEQ ID NO: 3583122 - RNA, 10 nt, Human
ugcacacauu

SEQ ID NO: 3583123 - RNA, 19 nt, Human
ugcacacauuaggcauuga

SEQ ID NO: 3583124 - RNA, 11 nt, Human
ugcacacauuu

SEQ ID NO: 3583125 - RNA, 13 nt, Human
ugcacacauuuuu

SEQ ID NO: 3583126 - RNA, 15 nt, Human
ugcacacauuuuuua

SEQ ID NO: 3583127 - RNA, 20 nt, Human
ugcacacauuuuuuaaaugc

SEQ ID NO: 3583128 - RNA, 16 nt, Human
ugcacacccacucagc

SEQ ID NO: 3583129 - RNA, 19 nt, Human
ugcacaccccacucccaca

SEQ ID NO: 3583130 - RNA, 20 nt, Human
ugcacaccuacuagucacca

SEQ ID NO: 3583131 - RNA, 18 nt, Human
ugcacacucacuggcauc

SEQ ID NO: 3583132 - RNA, 22 nt, Human
ugcacacuuugguaccagauaa

SEQ ID NO: 3583133 - RNA, 16 nt, Human
ugcacagaaguccugu

SEQ ID NO: 3583134 - RNA, 21 nt, Human
ugcacagaaguccuguauguc

SEQ ID NO: 3583135 - RNA, 18 nt, Human
ugcacagagaagcugggg

SEQ ID NO: 3583136 - RNA, 20 nt, Human
ugcacagagcucuccagcuc

SEQ ID NO: 3583137 - RNA, 19 nt, Human
ugcacagauggauuugccu

SEQ ID NO: 3583138 - RNA, 16 nt, Human
ugcacagcacaaauua

SEQ ID NO: 3583139 - RNA, 18 nt, Human
ugcacagcaggcugccag

SEQ ID NO: 3583140 - RNA, 15 nt, Human
ugcacagcaucucag

SEQ ID NO: 3583141 - RNA, 24 nt, Human
ugcacagccccuaagucaacuuag

SEQ ID NO: 3583142 - RNA, 17 nt, Human
ugcacagcguccugucc

SEQ ID NO: 3583143 - RNA, 20 nt, Human
ugcacagcuaacauggaagu

SEQ ID NO: 3583144 - RNA, 10 nt, Human
ugcacagcug

SEQ ID NO: 3583145 - RNA, 18 nt, Human
ugcacaggaugcuggccu

SEQ ID NO: 3583146 - RNA, 12 nt, Human
ugcacaggcaga

SEQ ID NO: 3583147 - RNA, 18 nt, Human
ugcacagggauucucaca

SEQ ID NO: 3583148 - RNA, 19 nt, Human
ugcacagggauucucacaa

SEQ ID NO: 3583149 - RNA, 12 nt, Human
ugcacagggcag

SEQ ID NO: 3583150 - RNA, 15 nt, Human
ugcacagggcagcug

SEQ ID NO: 3583151 - RNA, 20 nt, Human
ugcacagggcagcugggccc

SEQ ID NO: 3583152 - RNA, 23 nt, Human
ugcacaguauuuguaauuaaaag

SEQ ID NO: 3583153 - RNA, 20 nt, Human
ugcacagugacuucugagau

SEQ ID NO: 3583154 - RNA, 13 nt, Human
ugcacagugauuu

SEQ ID NO: 3583155 - RNA, 19 nt, Human
ugcacagugauuuuuuucu

SEQ ID NO: 3583156 - RNA, 17 nt, Human
ugcacagugcaucucag

SEQ ID NO: 3583157 - RNA, 19 nt, Human
ugcacagugcaucucagcc

SEQ ID NO: 3583158 - RNA, 23 nt, Human
ugcacaguuuucuggcuggagcc

SEQ ID NO: 3583159 - RNA, 24 nt, Human
ugcacaguuuucuggcuggagccu

SEQ ID NO: 3583160 - RNA, 18 nt, Human
ugcacauauggacucugc

SEQ ID NO: 3583161 - RNA, 19 nt, Human
ugcacauauggacucugca

SEQ ID NO: 3583162 - RNA, 13 nt, Human
ugcacauccauuc

SEQ ID NO: 3583163 - RNA, 15 nt, Human
ugcacaucucugcuu

SEQ ID NO: 3583164 - RNA, 15 nt, Human
ugcacaucugugucu

SEQ ID NO: 3583165 - RNA, 16 nt, Human
ugcacaucugugucuu

SEQ ID NO: 3583166 - RNA, 17 nt, Human
ugcacaucuguuuugua

SEQ ID NO: 3583167 - RNA, 14 nt, Human
ugcacaugaacuua

SEQ ID NO: 3583168 - RNA, 21 nt, Human
ugcacaugaacuuagauuuua

SEQ ID NO: 3583169 - RNA, 14 nt, Human
ugcacaugaagaaa

SEQ ID NO: 3583170 - RNA, 21 nt, Human
ugcacaugaagaaauacugca

SEQ ID NO: 3583171 - RNA, 15 nt, Human
ugcacaugauuucac

SEQ ID NO: 3583172 - RNA, 18 nt, Human
ugcacaugauuucacaaa

SEQ ID NO: 3583173 - RNA, 23 nt, Human
ugcacaugauuucacaaauauua

SEQ ID NO: 3583174 - RNA, 12 nt, Human
ugcacaugucuu

SEQ ID NO: 3583175 - RNA, 14 nt, Human
ugcacaugucuuaa

SEQ ID NO: 3583176 - RNA, 13 nt, Human
ugcacaugugugc

SEQ ID NO: 3583177 - RNA, 16 nt, Human
ugcacauguuuccucu

SEQ ID NO: 3583178 - RNA, 18 nt, Human
ugcacauuaaaugacucu

SEQ ID NO: 3583179 - RNA, 15 nt, Human
ugcacauucacuuag

SEQ ID NO: 3583180 - RNA, 23 nt, Human
ugcacauucacuuagcagaaccu

SEQ ID NO: 3583181 - RNA, 11 nt, Human
ugcacauuguu

SEQ ID NO: 3583182 - RNA, 12 nt, Human
ugcacauuguuc

SEQ ID NO: 3583183 - RNA, 14 nt, Human
ugcacauuuugauu

SEQ ID NO: 3583184 - RNA, 16 nt, Human
ugcaccaaagagaaug

SEQ ID NO: 3583185 - RNA, 17 nt, Human
ugccuccaggugugcac

SEQ ID NO: 3583186 - RNA, 15 nt, Human
ugccuccauccuagu

SEQ ID NO: 3583187 - RNA, 14 nt, Human
ugccuccauggugc

SEQ ID NO: 3583188 - RNA, 22 nt, Human
ugccuccauggugccucuggag

SEQ ID NO: 3583189 - RNA, 16 nt, Human
ugccucccacuucacu

SEQ ID NO: 3583190 - RNA, 17 nt, Human
ugccucccacuucacug

SEQ ID NO: 3583191 - RNA, 17 nt, Human
ugccucccauucugacc

SEQ ID NO: 3583192 - RNA, 16 nt, Human
ugccuccccaacccug

SEQ ID NO: 3583193 - RNA, 22 nt, Human
ugccuccccaacccugccccug

SEQ ID NO: 3583194 - RNA, 17 nt, Human
ugccuccccauuuccca

SEQ ID NO: 3583195 - RNA, 20 nt, Human
ugccuccccauuucccaucu

SEQ ID NO: 3583196 - RNA, 15 nt, Human
ugccuccccuccucu

SEQ ID NO: 3583197 - RNA, 19 nt, Human
ugccuccccuccucugcuu

SEQ ID NO: 3583198 - RNA, 18 nt, Human
ugccuccccucuccuucc

SEQ ID NO: 3583199 - RNA, 22 nt, Human
ugccucccucacccugagcccc

SEQ ID NO: 3583200 - RNA, 19 nt, Human
ugccucccugacccugcag

SEQ ID NO: 3583201 - RNA, 22 nt, Human
ugccucccuggugagagggccg

SEQ ID NO: 3583202 - RNA, 17 nt, Human
ugccucccuguccaccc

SEQ ID NO: 3583203 - RNA, 19 nt, Human
ugccuccgccucaguaaga

SEQ ID NO: 3583204 - RNA, 19 nt, Human
ugccuccguccccugccca

SEQ ID NO: 3583205 - RNA, 12 nt, Human
ugccuccucagg

SEQ ID NO: 3583206 - RNA, 13 nt, Human
ugccuccucagga

SEQ ID NO: 3583207 - RNA, 12 nt, Human
ugccuccuccuu

SEQ ID NO: 3583208 - RNA, 16 nt, Human
ugccuccucguuccuu

SEQ ID NO: 3583209 - RNA, 22 nt, Human
ugccuccugacacaccugcagc

SEQ ID NO: 3583210 - RNA, 18 nt, Human
ugccuccugccugccccu

SEQ ID NO: 3583211 - RNA, 14 nt, Human
ugccuccugugggg

SEQ ID NO: 3583212 - RNA, 18 nt, Human
ugccuccuguggggaaag

SEQ ID NO: 3583213 - RNA, 14 nt, Human
ugccuccuguguac

SEQ ID NO: 3583214 - RNA, 17 nt, Human
ugccuccuuccaccucc

SEQ ID NO: 3583215 - RNA, 19 nt, Human
ugccuccuuccaccucccu

SEQ ID NO: 3583216 - RNA, 21 nt, Human
ugccucgaaacacagaaaccu

SEQ ID NO: 3583217 - RNA, 18 nt, Human
ugccucgaacuggcugca

SEQ ID NO: 3583218 - RNA, 23 nt, Human
ugccucgacacgugggcuccccu

SEQ ID NO: 3583219 - RNA, 21 nt, Human
ugccucgcuccccacucugcu

SEQ ID NO: 3583220 - RNA, 20 nt, Human
ugccucggccucccaaagug

SEQ ID NO: 3583221 - RNA, 13 nt, Human
ugccucggcuccu

SEQ ID NO: 3583222 - RNA, 14 nt, Human
ugccucggcuccug

SEQ ID NO: 3583223 - RNA, 21 nt, Human
ugccucggcuuuucucagcug

SEQ ID NO: 3583224 - RNA, 16 nt, Human
ugccucuacugggaag

SEQ ID NO: 3583225 - RNA, 19 nt, Human
ugccucucacacacauaga

SEQ ID NO: 3583226 - RNA, 21 nt, Human
ugccucucaucaacugaauga

SEQ ID NO: 3583227 - RNA, 15 nt, Human
ugccucucccucugg

SEQ ID NO: 3583228 - RNA, 18 nt, Human
ugccucucccuggcccuc

SEQ ID NO: 3583229 - RNA, 20 nt, Human
ugccucuccuuuguauauua

SEQ ID NO: 3583230 - RNA, 15 nt, Human
ugccucucuaggacc

SEQ ID NO: 3583231 - RNA, 16 nt, Human
ugccucucucaggcca

SEQ ID NO: 3583232 - RNA, 18 nt, Human
ugccucucugcagguccc

SEQ ID NO: 3583233 - RNA, 14 nt, Human
ugccucugacacac

SEQ ID NO: 3583234 - RNA, 12 nt, Human
ugccucugagag

SEQ ID NO: 3583235 - RNA, 22 nt, Human
ugccucugagagcaucaggccu

SEQ ID NO: 3583236 - RNA, 15 nt, Human
ugccucugaggccag

SEQ ID NO: 3583237 - RNA, 22 nt, Human
ugccucugaggccagccuggcc

SEQ ID NO: 3583238 - RNA, 20 nt, Human
ugccucugauaugggacuga

SEQ ID NO: 3583239 - RNA, 16 nt, Human
ugccucugccacacuc

SEQ ID NO: 3583240 - RNA, 13 nt, Human
ugccucugccucu

SEQ ID NO: 3583241 - RNA, 14 nt, Human
ugccucugccucug

SEQ ID NO: 3583242 - RNA, 18 nt, Human
ugccucugccucugacac

SEQ ID NO: 3583243 - RNA, 12 nt, Human
ugccucugccug

SEQ ID NO: 3583244 - RNA, 13 nt, Human
ugccucugccugu

SEQ ID NO: 3583245 - RNA, 14 nt, Human
ugccucugccuguc

SEQ ID NO: 3583246 - RNA, 17 nt, Human
ugccucuggaggccucu

SEQ ID NO: 3583247 - RNA, 20 nt, Human
ugccucuggcucuacacaua

SEQ ID NO: 3583248 - RNA, 13 nt, Human
ugccucugggacu

SEQ ID NO: 3583249 - RNA, 21 nt, Human
ugccucuguccccuucucuca

SEQ ID NO: 3583250 - RNA, 16 nt, Human
ugccucugucuucugg

SEQ ID NO: 3583251 - RNA, 17 nt, Human
ugccucuuacgguaguu

SEQ ID NO: 3583252 - RNA, 14 nt, Human
ugccucuucauucu

SEQ ID NO: 3583253 - RNA, 23 nt, Human
ugccucuuccagucuuccugaca

SEQ ID NO: 3583254 - RNA, 13 nt, Human
ugccucuuccucc

SEQ ID NO: 3583255 - RNA, 20 nt, Human
ugccucuucugggagggcag

SEQ ID NO: 3583256 - RNA, 21 nt, Human
ugccucuucugggagggcagc

SEQ ID NO: 3583257 - RNA, 13 nt, Human
ugccucuugucuu

SEQ ID NO: 3583258 - RNA, 15 nt, Human
ugccucuuucaucca

SEQ ID NO: 3583259 - RNA, 18 nt, Human
ugccucuuuccuguuguu

SEQ ID NO: 3583260 - RNA, 22 nt, Human
ugccucuuuuaccugcugcuuc

SEQ ID NO: 3583261 - RNA, 14 nt, Human
ugccugaacauccu

SEQ ID NO: 3583262 - RNA, 22 nt, Human
ugccugaacauccuuccuuccc

SEQ ID NO: 3583263 - RNA, 17 nt, Human
ugccugaauaaagagcc

SEQ ID NO: 3583264 - RNA, 13 nt, Human
ugccugagaggca

SEQ ID NO: 3583265 - RNA, 14 nt, Human
ugccugagaggcag

SEQ ID NO: 3583266 - RNA, 20 nt, Human
ugccugagcaccucccagcc

SEQ ID NO: 3583267 - RNA, 22 nt, Human
ugccugagcaccucccagcccc

SEQ ID NO: 3583268 - RNA, 21 nt, Human
ugccugagggccccucugccc

SEQ ID NO: 3583269 - RNA, 18 nt, Human
ugccugaggguggagacu

SEQ ID NO: 3583270 - RNA, 18 nt, Human
ugccugaggucuguacgu

SEQ ID NO: 3583271 - RNA, 20 nt, Human
ugccugagucgugaccugcu

SEQ ID NO: 3583272 - RNA, 14 nt, Human
ugccugauauaaau

SEQ ID NO: 3583273 - RNA, 18 nt, Human
ugccugauccuccaacag

SEQ ID NO: 3583274 - RNA, 19 nt, Human
ugccugauucggcugucuc

SEQ ID NO: 3583275 - RNA, 20 nt, Human
ugccugauucggcugucuca

SEQ ID NO: 3583276 - RNA, 20 nt, Human
ugccugauugccaagcucag

SEQ ID NO: 3583277 - RNA, 14 nt, Human
ugccugcaccagga

SEQ ID NO: 3583278 - RNA, 16 nt, Human
ugccugcaccaggaga

SEQ ID NO: 3583279 - RNA, 16 nt, Human
ugccugcagagagaag

SEQ ID NO: 3583280 - RNA, 20 nt, Human
ugccugcagaggucugugcu

SEQ ID NO: 3583281 - RNA, 15 nt, Human
ugccugcagccccgc

SEQ ID NO: 3583282 - RNA, 13 nt, Human
ugccugcagggcc

SEQ ID NO: 3583283 - RNA, 14 nt, Human
ugccugcagggcca

SEQ ID NO: 3583284 - RNA, 16 nt, Human
ugccugcagggccaug

SEQ ID NO: 3583285 - RNA, 17 nt, Human
ugccugcagggccaugg

SEQ ID NO: 3583286 - RNA, 13 nt, Human
ugccugcauucug

SEQ ID NO: 3583287 - RNA, 15 nt, Human
ugccugccagcugca

SEQ ID NO: 3583288 - RNA, 15 nt, Human
ugccugcccacccgu

SEQ ID NO: 3583289 - RNA, 16 nt, Human
ugccugcccacccgug

SEQ ID NO: 3583290 - RNA, 20 nt, Human
ugccugcccaggccccugcc

SEQ ID NO: 3583291 - RNA, 23 nt, Human
ugccugcccaggccccugccacc

SEQ ID NO: 3583292 - RNA, 20 nt, Human
ugccugccccaaacaaauau

SEQ ID NO: 3583293 - RNA, 13 nt, Human
ugccugcccuggu

SEQ ID NO: 3583294 - RNA, 20 nt, Human
ugccugcccugucaggaggc

SEQ ID NO: 3583295 - RNA, 23 nt, Human
ugccugcccugucaggaggcaga

SEQ ID NO: 3583296 - RNA, 19 nt, Human
ugccugccuuaagugagga

SEQ ID NO: 3583297 - RNA, 18 nt, Human
ugccugcggucaaggcca

SEQ ID NO: 3583298 - RNA, 16 nt, Human
ugccugcgucuuccgc

SEQ ID NO: 3583299 - RNA, 19 nt, Human
ugccugcgucuuccgcccc

SEQ ID NO: 3583300 - RNA, 14 nt, Human
ugccugcucccauc

SEQ ID NO: 3583301 - RNA, 15 nt, Human
ugccugcucccaucc

SEQ ID NO: 3583302 - RNA, 18 nt, Human
ugccugcucccauccugu

SEQ ID NO: 3583303 - RNA, 12 nt, Human
ugccugcucuuu

SEQ ID NO: 3583304 - RNA, 10 nt, Human
ugccugcuga

SEQ ID NO: 3583305 - RNA, 12 nt, Human
ugccugcuucag

SEQ ID NO: 3583306 - RNA, 21 nt, Human
ugccugcuucagccucccaca

SEQ ID NO: 3583307 - RNA, 14 nt, Human
ugccugcuuuagaa

SEQ ID NO: 3583308 - RNA, 14 nt, Human
ugccugcuuugaau

SEQ ID NO: 3583309 - RNA, 19 nt, Human
ugccugcuuuucacugcug

SEQ ID NO: 3583310 - RNA, 16 nt, Human
ugccugcuuuuuggaa

SEQ ID NO: 3583311 - RNA, 19 nt, Human
ugccuggaagagcagcccu

SEQ ID NO: 3583312 - RNA, 11 nt, Human
ugccuggaccc

SEQ ID NO: 3583313 - RNA, 11 nt, Human
ugccuggagcu

SEQ ID NO: 3583314 - RNA, 16 nt, Human
ugccuggagcuccugg

SEQ ID NO: 3583315 - RNA, 15 nt, Human
ugccuggaggaccug

SEQ ID NO: 3583316 - RNA, 20 nt, Human
ugccuggaggaccugagccu

SEQ ID NO: 3583317 - RNA, 14 nt, Human
ugccuggaggccag

SEQ ID NO: 3583318 - RNA, 20 nt, Human
ugccuggauggggcugcacc

SEQ ID NO: 3583319 - RNA, 18 nt, Human
ugccuggccacugcuccc

SEQ ID NO: 3583320 - RNA, 12 nt, Human
ugccuggccagg

SEQ ID NO: 3583321 - RNA, 14 nt, Human
ugccuggccaggca

SEQ ID NO: 3583322 - RNA, 16 nt, Human
ugccuggccaggcaga

SEQ ID NO: 3583323 - RNA, 22 nt, Human
ugccuggccuggcacacaucag

SEQ ID NO: 3583324 - RNA, 18 nt, Human
ugccuggccuuccugucu

SEQ ID NO: 3583325 - RNA, 13 nt, Human
ugccuggcucaga

SEQ ID NO: 3583326 - RNA, 14 nt, Human
ugccugggggaguu

SEQ ID NO: 3583327 - RNA, 21 nt, Human
ugccugggggaguuuuccucu

SEQ ID NO: 3583328 - RNA, 22 nt, Human
ugccuggguuuaaggggagagg

SEQ ID NO: 3583329 - RNA, 23 nt, Human
ugccugguauauccaaaagcuuu

SEQ ID NO: 3583330 - RNA, 18 nt, Human
ugcgacuuucugccugga

SEQ ID NO: 3583331 - RNA, 14 nt, Human
ugcgagagaugugu

SEQ ID NO: 3583332 - RNA, 20 nt, Human
ugcgagugcucauuucagga

SEQ ID NO: 3583333 - RNA, 17 nt, Human
ugcgagugugugcaugu

SEQ ID NO: 3583334 - RNA, 21 nt, Human
ugcgagugugugcaugugugu

SEQ ID NO: 3583335 - RNA, 14 nt, Human
ugcgauagagucuc

SEQ ID NO: 3583336 - RNA, 19 nt, Human
ugcgaucucggcucagugc

SEQ ID NO: 3583337 - RNA, 19 nt, Human
ugcgaucuggguucacugc

SEQ ID NO: 3583338 - RNA, 17 nt, Human
ugcgaucuucagagcag

SEQ ID NO: 3583339 - RNA, 18 nt, Human
ugcgaucuucagagcagg

SEQ ID NO: 3583340 - RNA, 13 nt, Human
ugcgauucuggau

SEQ ID NO: 3583341 - RNA, 23 nt, Human
ugcgauucuggauaaagccacug

SEQ ID NO: 3583342 - RNA, 22 nt, Human
ugcgcacaaggcugaccaagag

SEQ ID NO: 3583343 - RNA, 17 nt, Human
ugcgcagccccaucugu

SEQ ID NO: 3583344 - RNA, 21 nt, Human
ugcgcagccccaucugugcau

SEQ ID NO: 3583345 - RNA, 16 nt, Human
ugcgcaggcuggcccu

SEQ ID NO: 3583346 - RNA, 13 nt, Human
ugcgcauucucau

SEQ ID NO: 3583347 - RNA, 20 nt, Human
ugcgccacuacacuccagcc

SEQ ID NO: 3583348 - RNA, 22 nt, Human
ugcgccacugcuccguggagga

SEQ ID NO: 3583349 - RNA, 13 nt, Human
ugcgcccaccccg

SEQ ID NO: 3583350 - RNA, 18 nt, Human
ugcgcccaguccuuccac

SEQ ID NO: 3583351 - RNA, 23 nt, Human
ugcgcccccuccgcccugccacu

SEQ ID NO: 3583352 - RNA, 15 nt, Human
ugcgcccuuaccuuc

SEQ ID NO: 3583353 - RNA, 24 nt, Human
ugcgccgagucugucucugucaug

SEQ ID NO: 3583354 - RNA, 12 nt, Human
ugcgccugcugc

SEQ ID NO: 3583355 - RNA, 14 nt, Human
ugcgccugugacca

SEQ ID NO: 3583356 - RNA, 20 nt, Human
ugcgcucuagccugggcaac

SEQ ID NO: 3583357 - RNA, 17 nt, Human
ugcgcucucuuugcaac

SEQ ID NO: 3583358 - RNA, 17 nt, Human
ugcgcugacaaccaccg

SEQ ID NO: 3583359 - RNA, 16 nt, Human
ugcgcugggcacuucc

SEQ ID NO: 3583360 - RNA, 20 nt, Human
ugcgcugggcacuucccugc

SEQ ID NO: 3583361 - RNA, 22 nt, Human
ugcggaaagguauuugggaaac

SEQ ID NO: 3583362 - RNA, 14 nt, Human
ugcggaaucagcuu

SEQ ID NO: 3583363 - RNA, 18 nt, Human
ugcggacagccacggcca

SEQ ID NO: 3583364 - RNA, 22 nt, Human
ugcggacagccacggccaggcc

SEQ ID NO: 3583365 - RNA, 18 nt, Human
ugcggaccacccucacug

SEQ ID NO: 3583366 - RNA, 13 nt, Human
ugcggaccccagc

SEQ ID NO: 3583367 - RNA, 23 nt, Human
ugcggaccccagcugugagccuu

SEQ ID NO: 3583368 - RNA, 14 nt, Human
ugcggacgggcugu

SEQ ID NO: 3583369 - RNA, 15 nt, Human
ugcggagcacacugg

SEQ ID NO: 3583370 - RNA, 19 nt, Human
ugcggagucauuuuguguu

SEQ ID NO: 3583371 - RNA, 16 nt, Human
ugcggagugaagaggg

SEQ ID NO: 3583372 - RNA, 14 nt, Human
ugcggaucucugga

SEQ ID NO: 3583373 - RNA, 15 nt, Human
ugcggaucucuggag

SEQ ID NO: 3583374 - RNA, 14 nt, Human
ugcggcagggaaga

SEQ ID NO: 3583375 - RNA, 15 nt, Human
ugcggcccagcccgg

SEQ ID NO: 3583376 - RNA, 16 nt, Human
ugcggcccagcccggc

SEQ ID NO: 3583377 - RNA, 15 nt, Human
ugcggccccuccccc

SEQ ID NO: 3583378 - RNA, 18 nt, Human
ugcggcguacaggcuggc

SEQ ID NO: 3583379 - RNA, 13 nt, Human
ugcggcuccucag

SEQ ID NO: 3583380 - RNA, 15 nt, Human
ugcggcuccucaggg

SEQ ID NO: 3583381 - RNA, 15 nt, Human
ugcggcuggccaugg

SEQ ID NO: 3583382 - RNA, 17 nt, Human
ugcgggaugguccuggg

SEQ ID NO: 3583383 - RNA, 18 nt, Human
ugcgggaugguccugggg

SEQ ID NO: 3583384 - RNA, 17 nt, Human
ugcgggcacaauaaauc

SEQ ID NO: 3583385 - RNA, 15 nt, Human
ugcgggcugggcagc

SEQ ID NO: 3583386 - RNA, 16 nt, Human
ugcgggcugggcagcu

SEQ ID NO: 3583387 - RNA, 14 nt, Human
ugcgggucacagga

SEQ ID NO: 3583388 - RNA, 16 nt, Human
ugcgggugagaguaau

SEQ ID NO: 3583389 - RNA, 15 nt, Human
ugcgguagccagcac

SEQ ID NO: 3583390 - RNA, 17 nt, Human
ugcgguauccgccccca

SEQ ID NO: 3583391 - RNA, 15 nt, Human
ugcgguccacccagg

SEQ ID NO: 3583392 - RNA, 17 nt, Human
ugcgguccacccaggag

SEQ ID NO: 3583393 - RNA, 17 nt, Human
ugcggugcuaucucccc

SEQ ID NO: 3583394 - RNA, 21 nt, Human
ugcggugcuaucucccccagc

SEQ ID NO: 3583395 - RNA, 21 nt, Human
ugcgguggcucacgccuguaa

SEQ ID NO: 3583396 - RNA, 20 nt, Human
ugcgguuauaaaaaaugguu

SEQ ID NO: 3583397 - RNA, 22 nt, Human
ugcgguuauaaaaaaugguuca

SEQ ID NO: 3583398 - RNA, 21 nt, Human
ugcgguuuguuggaucuucaa

SEQ ID NO: 3583399 - RNA, 20 nt, Human
ugcguacguuuccugagaag

SEQ ID NO: 3583400 - RNA, 20 nt, Human
ugcguaugccaccaacuuac

SEQ ID NO: 3583401 - RNA, 14 nt, Human
ugcguccuccucac

SEQ ID NO: 3583402 - RNA, 16 nt, Human
ugcguccuccucaccu

SEQ ID NO: 3583403 - RNA, 21 nt, Human
ugcgucuggaggggccccugc

SEQ ID NO: 3583404 - RNA, 22 nt, Human
ugcgucuggaggggccccugcu

SEQ ID NO: 3583405 - RNA, 22 nt, Human
ugcgucuugguguaauuugaag

SEQ ID NO: 3583406 - RNA, 12 nt, Human
ugcgugaaugua

SEQ ID NO: 3583407 - RNA, 17 nt, Human
ugcgugcccggggcagc

SEQ ID NO: 3583408 - RNA, 17 nt, Human
ugcgugccgugugagug

SEQ ID NO: 3583409 - RNA, 19 nt, Human
ugcgugccgugugagugug

SEQ ID NO: 3583410 - RNA, 23 nt, Human
ugcgugccgugugagugugacag

SEQ ID NO: 3583411 - RNA, 22 nt, Human
ugcguggacucugcacaugucu

SEQ ID NO: 3583412 - RNA, 19 nt, Human
ugcgugguggucccugggu

SEQ ID NO: 3583413 - RNA, 23 nt, Human
ugcgugguguggagugugugucu

SEQ ID NO: 3583414 - RNA, 14 nt, Human
ugcguguguagagu

SEQ ID NO: 3583415 - RNA, 22 nt, Human
ugcguguuuggguuuuuuuccu

SEQ ID NO: 3583416 - RNA, 16 nt, Human
ugcguucugcaagcau

SEQ ID NO: 3583417 - RNA, 17 nt, Human
ugcuaaaaaugggacuu

SEQ ID NO: 3583418 - RNA, 17 nt, Human
ugcuaaaaccugaaauu

SEQ ID NO: 3583419 - RNA, 12 nt, Human
ugcuaaacacug

SEQ ID NO: 3583420 - RNA, 13 nt, Human
ugcuaaacacugc

SEQ ID NO: 3583421 - RNA, 19 nt, Human
ugcuaaaccuuaguacuga

SEQ ID NO: 3583422 - RNA, 21 nt, Human
ugcuaaaccuuaguacugagu

SEQ ID NO: 3583423 - RNA, 22 nt, Human
ugcuaaacguguauguuuuuca

SEQ ID NO: 3583424 - RNA, 17 nt, Human
ugcuaaaggagcaucua

SEQ ID NO: 3583425 - RNA, 16 nt, Human
ugcuaaaucuccuauu

SEQ ID NO: 3583426 - RNA, 11 nt, Human
ugcuaaaugua

SEQ ID NO: 3583427 - RNA, 15 nt, Human
ugcuaaauguaacag

SEQ ID NO: 3583428 - RNA, 20 nt, Human
ugcuaaauguaacagucuga

SEQ ID NO: 3583429 - RNA, 18 nt, Human
ugcuaaauguaagaauca

SEQ ID NO: 3583430 - RNA, 15 nt, Human
ugcuaaaugugaaug

SEQ ID NO: 3583431 - RNA, 21 nt, Human
ugcuaaauuuucaguagggcu

SEQ ID NO: 3583432 - RNA, 22 nt, Human
ugcuaacaaagacaaaagucug

SEQ ID NO: 3583433 - RNA, 21 nt, Human
ugcuaacagcaacacaaagcu

SEQ ID NO: 3583434 - RNA, 17 nt, Human
ugcuaacaugaagaccu

SEQ ID NO: 3583435 - RNA, 23 nt, Human
ugcuaaccacgucugucuucaca

SEQ ID NO: 3583436 - RNA, 18 nt, Human
ugcuaacggugcucaggg

SEQ ID NO: 3583437 - RNA, 19 nt, Human
ugcuaacggugcucagggg

SEQ ID NO: 3583438 - RNA, 22 nt, Human
ugcuaacuagcuuggaaacugg

SEQ ID NO: 3583439 - RNA, 17 nt, Human
ugcuaacuuggagcccc

SEQ ID NO: 3583440 - RNA, 19 nt, Human
ugcuaacuuggagccccag

SEQ ID NO: 3583441 - RNA, 19 nt, Human
ugcuaagaauuuuuuauuu

SEQ ID NO: 3583442 - RNA, 13 nt, Human
ugcuaagaugcuc

SEQ ID NO: 3583443 - RNA, 16 nt, Human
ugcuaagaugcucuau

SEQ ID NO: 3583444 - RNA, 18 nt, Human
ugcuaaggacuuguuaga

SEQ ID NO: 3583445 - RNA, 17 nt, Human
ugcuaagguucuaaggc

SEQ ID NO: 3583446 - RNA, 18 nt, Human
ugcuaaguaaaucucuuc

SEQ ID NO: 3583447 - RNA, 13 nt, Human
ugcuaagugugaa

SEQ ID NO: 3583448 - RNA, 15 nt, Human
ugcuaagugugaacu

SEQ ID NO: 3583449 - RNA, 17 nt, Human
ugcuaagugugaacugg

SEQ ID NO: 3583450 - RNA, 13 nt, Human
ugcuaauauuaaa

SEQ ID NO: 3583451 - RNA, 20 nt, Human
ugcuaaucaaagccaggguc

SEQ ID NO: 3583452 - RNA, 22 nt, Human
ugcuaaucagggaggucauuuu

SEQ ID NO: 3583453 - RNA, 13 nt, Human
ugcuaaucagugu

SEQ ID NO: 3583454 - RNA, 20 nt, Human
ugcuaaucuucuuaugcaau

SEQ ID NO: 3583455 - RNA, 19 nt, Human
ugcuaaucuugugaaaaua

SEQ ID NO: 3583456 - RNA, 21 nt, Human
ugcuaaucuugugaaaauaau

SEQ ID NO: 3583457 - RNA, 12 nt, Human
ugcuaauucuuu

SEQ ID NO: 3583458 - RNA, 22 nt, Human
ugcuaauucuuugcaaaaaucc

SEQ ID NO: 3583459 - RNA, 15 nt, Human
ugcuaauugcuguug

SEQ ID NO: 3583460 - RNA, 16 nt, Human
ugcuaauugcuguuga

SEQ ID NO: 3583461 - RNA, 13 nt, Human
ugcuaauuuguuu

SEQ ID NO: 3583462 - RNA, 19 nt, Human
ugcuaauuuugaaaaacug

SEQ ID NO: 3583463 - RNA, 15 nt, Human
ugcuacaaaaacaca

SEQ ID NO: 3583464 - RNA, 19 nt, Human
ugcuacaaaaacacagcaa

SEQ ID NO: 3583465 - RNA, 20 nt, Human
ugcuacaaaaacacagcaag

SEQ ID NO: 3583466 - RNA, 13 nt, Human
ugcuacaacuuca

SEQ ID NO: 3583467 - RNA, 12 nt, Human
ugcuacaauguc

SEQ ID NO: 3583468 - RNA, 18 nt, Human
ugcuacagaaaagaaacu

SEQ ID NO: 3583469 - RNA, 15 nt, Human
ugcuacaggggccag

SEQ ID NO: 3583470 - RNA, 21 nt, Human
ugcuacaggggccagaagaug

SEQ ID NO: 3583471 - RNA, 18 nt, Human
ugcuacaggguccaacau

SEQ ID NO: 3583472 - RNA, 14 nt, Human
ugcuacauaaauug

SEQ ID NO: 3583473 - RNA, 23 nt, Human
ugcuacaugacgacaaagcugcu

SEQ ID NO: 3583474 - RNA, 18 nt, Human
ugcucauuuaaguuucaa

SEQ ID NO: 3583475 - RNA, 15 nt, Human
ugcuccaagauucua

SEQ ID NO: 3583476 - RNA, 19 nt, Human
ugcuccaagauucuagaug

SEQ ID NO: 3583477 - RNA, 15 nt, Human
ugcuccaccccacuc

SEQ ID NO: 3583478 - RNA, 19 nt, Human
ugcuccacccuuggccugu

SEQ ID NO: 3583479 - RNA, 22 nt, Human
ugcuccaccuuucagcccacgu

SEQ ID NO: 3583480 - RNA, 14 nt, Human
ugcuccagaauuug

SEQ ID NO: 3583481 - RNA, 17 nt, Human
ugcuccagacagggaau

SEQ ID NO: 3583482 - RNA, 21 nt, Human
ugcuccagaccugauccugga

SEQ ID NO: 3583483 - RNA, 17 nt, Human
ugcuccagccaaccccu

SEQ ID NO: 3583484 - RNA, 22 nt, Human
ugcuccagccaaccccugugga

SEQ ID NO: 3583485 - RNA, 19 nt, Human
ugcuccagcuguucagcug

SEQ ID NO: 3583486 - RNA, 12 nt, Human
ugcuccaggcag

SEQ ID NO: 3583487 - RNA, 14 nt, Human
ugcuccaggcaggc

SEQ ID NO: 3583488 - RNA, 16 nt, Human
ugcuccagggagauuu

SEQ ID NO: 3583489 - RNA, 19 nt, Human
ugcuccagggaugauucaa

SEQ ID NO: 3583490 - RNA, 12 nt, Human
ugcucccaccuc

SEQ ID NO: 3583491 - RNA, 14 nt, Human
ugcucccaccuccu

SEQ ID NO: 3583492 - RNA, 15 nt, Human
ugcucccaccuccug

SEQ ID NO: 3583493 - RNA, 23 nt, Human
ugcucccaccuccugacacccuu

SEQ ID NO: 3583494 - RNA, 15 nt, Human
ugcucccaccuggcu

SEQ ID NO: 3583495 - RNA, 17 nt, Human
ugcucccaccuggcucu

SEQ ID NO: 3583496 - RNA, 15 nt, Human
ugcucccagcagccc

SEQ ID NO: 3583497 - RNA, 21 nt, Human
ugcucccagcagcccuaagga

SEQ ID NO: 3583498 - RNA, 11 nt, Human
ugcuccccaca

SEQ ID NO: 3583499 - RNA, 20 nt, Human
ugcuccccacagcgucccug

SEQ ID NO: 3583500 - RNA, 23 nt, Human
ugcuccccacagcgucccuggcg

SEQ ID NO: 3583501 - RNA, 16 nt, Human
ugcuccccagcccugg

SEQ ID NO: 3583502 - RNA, 18 nt, Human
ugcucccccauccucccc

SEQ ID NO: 3583503 - RNA, 21 nt, Human
ugcucccccauccuccccuuc

SEQ ID NO: 3583504 - RNA, 23 nt, Human
ugcucccccauccuccccuuccc

SEQ ID NO: 3583505 - RNA, 16 nt, Human
ugcuccccucccuccu

SEQ ID NO: 3583506 - RNA, 20 nt, Human
ugcucccuaagccagccugg

SEQ ID NO: 3583507 - RNA, 15 nt, Human
ugcucccucacaugu

SEQ ID NO: 3583508 - RNA, 13 nt, Human
ugcucccucagac

SEQ ID NO: 3583509 - RNA, 14 nt, Human
ugcucccucagacu

SEQ ID NO: 3583510 - RNA, 14 nt, Human
ugcucccuccccug

SEQ ID NO: 3583511 - RNA, 15 nt, Human
ugcucccuccccugc

SEQ ID NO: 3583512 - RNA, 17 nt, Human
ugcucccuccccugccc

SEQ ID NO: 3583513 - RNA, 14 nt, Human
ugcucccugaagcc

SEQ ID NO: 3583514 - RNA, 19 nt, Human
ugcucccugaagccagccu

SEQ ID NO: 3583515 - RNA, 20 nt, Human
ugcucccugaagccagccuu

SEQ ID NO: 3583516 - RNA, 12 nt, Human
ugcucccugugu

SEQ ID NO: 3583517 - RNA, 17 nt, Human
ugcucccuguguccacc

SEQ ID NO: 3583518 - RNA, 23 nt, Human
ugcucccuguguccaccuguggg

SEQ ID NO: 3583519 - RNA, 18 nt, Human
ugcuccgaggacccagga

SEQ ID NO: 3583520 - RNA, 18 nt, Human
ugcuccgccuggccuggc

SEQ ID NO: 3583521 - RNA, 13 nt, Human
ugcuccgugccuc

SEQ ID NO: 3583522 - RNA, 16 nt, Human
ugcuccgugccuccac

SEQ ID NO: 3583523 - RNA, 13 nt, Human
ugcuccguggagg

SEQ ID NO: 3583524 - RNA, 20 nt, Human
ugcuccuagagggaggggcc

SEQ ID NO: 3583525 - RNA, 18 nt, Human
ugcuccuaguuugaccuc

SEQ ID NO: 3583526 - RNA, 20 nt, Human
ugcuccuaguuugaccucac

SEQ ID NO: 3583527 - RNA, 13 nt, Human
ugcuccuccaggg

SEQ ID NO: 3583528 - RNA, 16 nt, Human
ugcuccuccagggcca

SEQ ID NO: 3583529 - RNA, 15 nt, Human
ugcuccucccuggcu

SEQ ID NO: 3583530 - RNA, 19 nt, Human
ugcuccucccuggcugccc

SEQ ID NO: 3583531 - RNA, 20 nt, Human
ugcuccucccuggcugcccu

SEQ ID NO: 3583532 - RNA, 22 nt, Human
ugcuccucccuggcugcccugg

SEQ ID NO: 3583533 - RNA, 19 nt, Human
ugcuccuccuuggugccug

SEQ ID NO: 3583534 - RNA, 13 nt, Human
ugcuccucuccag

SEQ ID NO: 3583535 - RNA, 14 nt, Human
ugcuccucucccca

SEQ ID NO: 3583536 - RNA, 17 nt, Human
ugcuccucuccccagca

SEQ ID NO: 3583537 - RNA, 18 nt, Human
ugcuccucuccccagcaa

SEQ ID NO: 3583538 - RNA, 19 nt, Human
ugcuccucuccccagcaag

SEQ ID NO: 3583539 - RNA, 13 nt, Human
ugcuccucuuccc

SEQ ID NO: 3583540 - RNA, 16 nt, Human
ugcuccucuuccccag

SEQ ID NO: 3583541 - RNA, 13 nt, Human
ugcuccugagccc

SEQ ID NO: 3583542 - RNA, 14 nt, Human
ugcuccugagcccc

SEQ ID NO: 3583543 - RNA, 15 nt, Human
ugcuccugcagcaug

SEQ ID NO: 3583544 - RNA, 22 nt, Human
ugcuccugccaggccuucagaa

SEQ ID NO: 3583545 - RNA, 21 nt, Human
ugcuccuggaucucccugaga

SEQ ID NO: 3583546 - RNA, 19 nt, Human
ugcuccuggccuugcugac

SEQ ID NO: 3583547 - RNA, 16 nt, Human
ugcuccuucccuugcu

SEQ ID NO: 3583548 - RNA, 22 nt, Human
ugcuccuuggcuuaccugaccu

SEQ ID NO: 3583549 - RNA, 14 nt, Human
ugcuccuuguuccu

SEQ ID NO: 3583550 - RNA, 17 nt, Human
ugcuccuuguuccuaga

SEQ ID NO: 3583551 - RNA, 17 nt, Human
ugcucgagacacaguga

SEQ ID NO: 3583552 - RNA, 16 nt, Human
ugcucgccccagcagg

SEQ ID NO: 3583553 - RNA, 13 nt, Human
ugcucgcuguugc

SEQ ID NO: 3583554 - RNA, 17 nt, Human
ugcucgcuguugcugaa

SEQ ID NO: 3583555 - RNA, 19 nt, Human
ugcucggagaagagcgcag

SEQ ID NO: 3583556 - RNA, 14 nt, Human
ugcucgggcccagg

SEQ ID NO: 3583557 - RNA, 16 nt, Human
ugcucggggugcacag

SEQ ID NO: 3583558 - RNA, 19 nt, Human
ugcucggggugcacaggag

SEQ ID NO: 3583559 - RNA, 22 nt, Human
ugcucggggugcacaggagggg

SEQ ID NO: 3583560 - RNA, 15 nt, Human
ugcucuaacagcccu

SEQ ID NO: 3583561 - RNA, 17 nt, Human
ugcucuaagcacacgga

SEQ ID NO: 3583562 - RNA, 13 nt, Human
ugcucuaggaaga

SEQ ID NO: 3583563 - RNA, 16 nt, Human
ugcucuagugccuucu

SEQ ID NO: 3583564 - RNA, 16 nt, Human
ugcucuagugggacag

SEQ ID NO: 3583565 - RNA, 18 nt, Human
ugcucuagugggacagcc

SEQ ID NO: 3583566 - RNA, 17 nt, Human
ugcucuaucucacagca

SEQ ID NO: 3583567 - RNA, 16 nt, Human
ugcucuaugcuuucca

SEQ ID NO: 3583568 - RNA, 18 nt, Human
ugcucucaaaccccugac

SEQ ID NO: 3583569 - RNA, 22 nt, Human
ugcucucaccagcugcugcucu

SEQ ID NO: 3583570 - RNA, 20 nt, Human
ugcucuccaagucucagugg

SEQ ID NO: 3583571 - RNA, 21 nt, Human
ugcucuccauucugcuccuuc

SEQ ID NO: 3583572 - RNA, 13 nt, Human
ugcucuccuccac

SEQ ID NO: 3583573 - RNA, 12 nt, Human
ugcucuccucuu

SEQ ID NO: 3583574 - RNA, 14 nt, Human
ugcucuccucuugc

SEQ ID NO: 3583575 - RNA, 16 nt, Human
ugcucuccucuugcca

SEQ ID NO: 3583576 - RNA, 12 nt, Human
ugcucuccuucc

SEQ ID NO: 3583577 - RNA, 17 nt, Human
ugcucuccuuccuggag

SEQ ID NO: 3583578 - RNA, 18 nt, Human
ugcucuccuuccuggagc

SEQ ID NO: 3583579 - RNA, 12 nt, Human
ugcucuccuuuc

SEQ ID NO: 3583580 - RNA, 18 nt, Human
ugcucucuacccagccca

SEQ ID NO: 3583581 - RNA, 19 nt, Human
ugcucucuacccagcccau

SEQ ID NO: 3583582 - RNA, 20 nt, Human
ugcucucuacccagcccauc

SEQ ID NO: 3583583 - RNA, 17 nt, Human
ugcucugaaaucuccuu

SEQ ID NO: 3583584 - RNA, 20 nt, Human
ugcucugagaagaggagccc

SEQ ID NO: 3583585 - RNA, 23 nt, Human
ugcucugagaagaggagcccuca

SEQ ID NO: 3583586 - RNA, 19 nt, Human
ugcucugaucccucuacag

SEQ ID NO: 3583587 - RNA, 17 nt, Human
ugcucugaugcaucaga

SEQ ID NO: 3583588 - RNA, 15 nt, Human
ugcucugcaaaagga

SEQ ID NO: 3583589 - RNA, 16 nt, Human
ugcucugcaggcaccu

SEQ ID NO: 3583590 - RNA, 20 nt, Human
ugcucugcaggcaccuuagu

SEQ ID NO: 3583591 - RNA, 15 nt, Human
ugcucugcccagagc

SEQ ID NO: 3583592 - RNA, 17 nt, Human
ugcucugcccagagcug

SEQ ID NO: 3583593 - RNA, 14 nt, Human
ugcucugcucgccu

SEQ ID NO: 3583594 - RNA, 14 nt, Human
ugcucugcugacag

SEQ ID NO: 3583595 - RNA, 16 nt, Human
ugcucugcugacagac

SEQ ID NO: 3583596 - RNA, 22 nt, Human
ugcucugcugacagacacaggc

SEQ ID NO: 3583597 - RNA, 12 nt, Human
ugcucugcuuca

SEQ ID NO: 3583598 - RNA, 21 nt, Human
ugcucugcuugacaacaucug

SEQ ID NO: 3583599 - RNA, 16 nt, Human
ugcucuggacaggcau

SEQ ID NO: 3583600 - RNA, 17 nt, Human
ugcucuggacaggcaug

SEQ ID NO: 3583601 - RNA, 14 nt, Human
ugcucuggaccugc

SEQ ID NO: 3583602 - RNA, 15 nt, Human
ugcucuggaccugcc

SEQ ID NO: 3583603 - RNA, 21 nt, Human
ugcucugguuguuucuguucc

SEQ ID NO: 3583604 - RNA, 22 nt, Human
ugcucuguaaucucguuucaaa

SEQ ID NO: 3583605 - RNA, 22 nt, Human
ugcucugucuucuuugcccaca

SEQ ID NO: 3583606 - RNA, 21 nt, Human
ugcucuguuaauaaucucaca

SEQ ID NO: 3583607 - RNA, 12 nt, Human
ugcucuuagcug

SEQ ID NO: 3583608 - RNA, 13 nt, Human
ugcucuucugugg

SEQ ID NO: 3583609 - RNA, 22 nt, Human
ugcucuugaacuccugaccuca

SEQ ID NO: 3583610 - RNA, 20 nt, Human
ugcucuugaccuuguagaga

SEQ ID NO: 3583611 - RNA, 20 nt, Human
ugcucuuggcuggacccagc

SEQ ID NO: 3583612 - RNA, 21 nt, Human
ugcucuuggcuggacccagcc

SEQ ID NO: 3583613 - RNA, 15 nt, Human
ugcucuugggcaaua

SEQ ID NO: 3583614 - RNA, 18 nt, Human
ugcucuugggcaauauuc

SEQ ID NO: 3583615 - RNA, 24 nt, Human
ugcucuugggcaauauucucugua

SEQ ID NO: 3583616 - RNA, 19 nt, Human
ugcucuuguagcccaggcu

SEQ ID NO: 3583617 - RNA, 16 nt, Human
ugcucuugucccacgu

SEQ ID NO: 3583618 - RNA, 22 nt, Human
ugcucuugucccacgugucuuc

SEQ ID NO: 3583619 - RNA, 19 nt, Human
ugcuggaacucuugacagc

SEQ ID NO: 3583620 - RNA, 19 nt, Human
ugcuggacaggucugggag

SEQ ID NO: 3583621 - RNA, 14 nt, Human
ugcuggacugucau

SEQ ID NO: 3583622 - RNA, 22 nt, Human
ugcuggagaagagaggagagga

SEQ ID NO: 3583623 - RNA, 20 nt, Human
ugcuggagaggccccagccg

SEQ ID NO: 3583624 - RNA, 14 nt, Human
ugcuggagagguua

SEQ ID NO: 3583625 - RNA, 20 nt, Human
ugcuggagcacugggcuccc

SEQ ID NO: 3583626 - RNA, 19 nt, Human
ugcuggagccacuaacuag

SEQ ID NO: 3583627 - RNA, 14 nt, Human
ugcuggagccugug

SEQ ID NO: 3583628 - RNA, 23 nt, Human
ugcuggagccuguguaacagcuc

SEQ ID NO: 3583629 - RNA, 13 nt, Human
ugcuggaggccuc

SEQ ID NO: 3583630 - RNA, 17 nt, Human
ugcuggaggccucaggu

SEQ ID NO: 3583631 - RNA, 14 nt, Human
ugcuggagguggga

SEQ ID NO: 3583632 - RNA, 22 nt, Human
ugcuggaggugggagcaggaga

SEQ ID NO: 3583633 - RNA, 17 nt, Human
ugcuggauauuuucaaa

SEQ ID NO: 3583634 - RNA, 18 nt, Human
ugcuggauggagcccagg

SEQ ID NO: 3583635 - RNA, 20 nt, Human
ugcuggcacauuuccccaga

SEQ ID NO: 3583636 - RNA, 18 nt, Human
ugcuggccaaauagcaaa

SEQ ID NO: 3583637 - RNA, 14 nt, Human
ugcuggcccagggc

SEQ ID NO: 3583638 - RNA, 20 nt, Human
ugcuggcccagggcccagag

SEQ ID NO: 3583639 - RNA, 22 nt, Human
ugcuggcccagggcccagagcc

SEQ ID NO: 3583640 - RNA, 19 nt, Human
ugcuggccccagcccugcu

SEQ ID NO: 3583641 - RNA, 20 nt, Human
ugcuggccccagcccugcug

SEQ ID NO: 3583642 - RNA, 21 nt, Human
ugcuggccccagcccugcugg

SEQ ID NO: 3583643 - RNA, 23 nt, Human
ugcuggccgcccccagcccccuc

SEQ ID NO: 3583644 - RNA, 19 nt, Human
ugcuggccgggcacagcug

SEQ ID NO: 3583645 - RNA, 15 nt, Human
ugcuggcgccucugc

SEQ ID NO: 3583646 - RNA, 13 nt, Human
ugcuggcugccca

SEQ ID NO: 3583647 - RNA, 15 nt, Human
ugcuggcugccuuag

SEQ ID NO: 3583648 - RNA, 21 nt, Human
ugcuggcuggaagggaggagc

SEQ ID NO: 3583649 - RNA, 22 nt, Human
ugcugggacucagccuucagac

SEQ ID NO: 3583650 - RNA, 23 nt, Human
ugcugggacucagccuucagaca

SEQ ID NO: 3583651 - RNA, 16 nt, Human
ugcugggagcuccacu

SEQ ID NO: 3583652 - RNA, 20 nt, Human
ugcugggagcuccacucugc

SEQ ID NO: 3583653 - RNA, 18 nt, Human
ugcugggagcugaaaaau

SEQ ID NO: 3583654 - RNA, 17 nt, Human
ugcugggaggagggaga

SEQ ID NO: 3583655 - RNA, 19 nt, Human
ugcugggauggugggcuuc

SEQ ID NO: 3583656 - RNA, 19 nt, Human
ugcugggauuacaagcgug

SEQ ID NO: 3583657 - RNA, 20 nt, Human
ugcugggauuacagguguga

SEQ ID NO: 3583658 - RNA, 16 nt, Human
ugcugggauuuccaac

SEQ ID NO: 3583659 - RNA, 19 nt, Human
ugcugggcauuuucccaga

SEQ ID NO: 3583660 - RNA, 18 nt, Human
ugcugggccccugccucu

SEQ ID NO: 3583661 - RNA, 22 nt, Human
ugcugggccccugccucucugc

SEQ ID NO: 3583662 - RNA, 23 nt, Human
ugcugggcucuccaccucagccu

SEQ ID NO: 3583663 - RNA, 10 nt, Human
ugcugggcug

SEQ ID NO: 3583664 - RNA, 11 nt, Human
ugcugggcugg

SEQ ID NO: 3583665 - RNA, 14 nt, Human
ugcugggcuggggc

SEQ ID NO: 3583666 - RNA, 16 nt, Human
ugcugggcugggugcg

SEQ ID NO: 3583667 - RNA, 16 nt, Human
ugcuggggaagacagu

SEQ ID NO: 3583668 - RNA, 23 nt, Human
ugcuggggcaagucccugacucu

SEQ ID NO: 3583669 - RNA, 15 nt, Human
ugcuggggccucaga

SEQ ID NO: 3583670 - RNA, 14 nt, Human
ugcuggggccuggg

SEQ ID NO: 3583671 - RNA, 21 nt, Human
ugcugggggaaugagcccaga

SEQ ID NO: 3583672 - RNA, 19 nt, Human
ugcugggggcaacuggcca

SEQ ID NO: 3583673 - RNA, 15 nt, Human
ugcuggguggcccau

SEQ ID NO: 3583674 - RNA, 16 nt, Human
ugcuggguggcccauc

SEQ ID NO: 3583675 - RNA, 20 nt, Human
ugcuggguggcccauccccc

SEQ ID NO: 3583676 - RNA, 22 nt, Human
ugcuggguggcccauccccccu

SEQ ID NO: 3583677 - RNA, 13 nt, Human
ugcuggguguggc

SEQ ID NO: 3583678 - RNA, 14 nt, Human
ugcuggguuggugc

SEQ ID NO: 3583679 - RNA, 16 nt, Human
ugcugguaaaaugaag

SEQ ID NO: 3583680 - RNA, 17 nt, Human
ugcugguaaaaugaaga

SEQ ID NO: 3583681 - RNA, 20 nt, Human
ugcuggucacagccuccucu

SEQ ID NO: 3583682 - RNA, 14 nt, Human
ugcugguguccuga

SEQ ID NO: 3583683 - RNA, 14 nt, Human
ugcugguugcugug

SEQ ID NO: 3583684 - RNA, 15 nt, Human
ugcugguugcugugu

SEQ ID NO: 3583685 - RNA, 17 nt, Human
ugcugguugcugugugg

SEQ ID NO: 3583686 - RNA, 20 nt, Human
ugcugguuuuccuaaaugca

SEQ ID NO: 3583687 - RNA, 22 nt, Human
ugcugguuuuccuaaaugcagu

SEQ ID NO: 3583688 - RNA, 12 nt, Human
ugcugguuuuuc

SEQ ID NO: 3583689 - RNA, 15 nt, Human
ugcugguuuuucagu

SEQ ID NO: 3583690 - RNA, 20 nt, Human
ugcuguaaagaguugcuuuu

SEQ ID NO: 3583691 - RNA, 19 nt, Human
ugcuguaaauuuggcuucu

SEQ ID NO: 3583692 - RNA, 17 nt, Human
ugcuguaacuuaaaaua

SEQ ID NO: 3583693 - RNA, 18 nt, Human
ugcuguaacuuucugaaa

SEQ ID NO: 3583694 - RNA, 17 nt, Human
ugcuguaagaugucugu

SEQ ID NO: 3583695 - RNA, 23 nt, Human
ugcuguacacauauuugaagggu

SEQ ID NO: 3583696 - RNA, 19 nt, Human
ugcuguacuagagaucugg

SEQ ID NO: 3583697 - RNA, 16 nt, Human
ugcuguagacaucugu

SEQ ID NO: 3583698 - RNA, 15 nt, Human
ugcuguagacauuug

SEQ ID NO: 3583699 - RNA, 23 nt, Human
ugcuguaguguugucuuugauaa

SEQ ID NO: 3583700 - RNA, 21 nt, Human
ugcuguauauuugugauagca

SEQ ID NO: 3583701 - RNA, 21 nt, Human
ugcugucaccucucccacggg

SEQ ID NO: 3583702 - RNA, 24 nt, Human
ugcugucauugcuucuucugaggc

SEQ ID NO: 3583703 - RNA, 19 nt, Human
ugcuguccagacagccugu

SEQ ID NO: 3583704 - RNA, 10 nt, Human
ugcugucccc

SEQ ID NO: 3583705 - RNA, 17 nt, Human
ugcuguccccucuugcc

SEQ ID NO: 3583706 - RNA, 12 nt, Human
ugcugucccucc

SEQ ID NO: 3583707 - RNA, 13 nt, Human
ugcugucccuccc

SEQ ID NO: 3583708 - RNA, 16 nt, Human
ugcugucccuuacgug

SEQ ID NO: 3583709 - RNA, 19 nt, Human
ugcugucccuuacgugagu

SEQ ID NO: 3583710 - RNA, 18 nt, Human
ugcuguccgguggagauc

SEQ ID NO: 3583711 - RNA, 19 nt, Human
ugcuguccucagguggcca

SEQ ID NO: 3583712 - RNA, 16 nt, Human
ugcuguccugaucugu

SEQ ID NO: 3583713 - RNA, 14 nt, Human
ugcugucucugcuc

SEQ ID NO: 3583714 - RNA, 15 nt, Human
ugcugucucugcucg

SEQ ID NO: 3583715 - RNA, 14 nt, Human
ugcugucugcagcc

SEQ ID NO: 3583716 - RNA, 15 nt, Human
ugcugucugggugcu

SEQ ID NO: 3583717 - RNA, 19 nt, Human
ugcugucuggguggcucac

SEQ ID NO: 3583718 - RNA, 14 nt, Human
ugcugucuuaaacu

SEQ ID NO: 3583719 - RNA, 21 nt, Human
ugcugucuuucuugcucccug

SEQ ID NO: 3583720 - RNA, 12 nt, Human
ugcugugaaaaa

SEQ ID NO: 3583721 - RNA, 23 nt, Human
ugcugugaacaagugaacacauu

SEQ ID NO: 3583722 - RNA, 22 nt, Human
ugcugugaacccuggggccuga

SEQ ID NO: 3583723 - RNA, 19 nt, Human
ugcugugaccauuuauaau

SEQ ID NO: 3583724 - RNA, 17 nt, Human
ugcugugaggcuguccu

SEQ ID NO: 3583725 - RNA, 15 nt, Human
ugcugugccucccaa

SEQ ID NO: 3583726 - RNA, 15 nt, Human
ugcuguggccugggc

SEQ ID NO: 3583727 - RNA, 10 nt, Human
ugcuguggga

SEQ ID NO: 3583728 - RNA, 12 nt, Human
ugcugugggaac

SEQ ID NO: 3583729 - RNA, 14 nt, Human
ugcuguggucucuu

SEQ ID NO: 3583730 - RNA, 17 nt, Human
ugcuguggucucuuugu

SEQ ID NO: 3583731 - RNA, 16 nt, Human
ugcugugguuccuggg

SEQ ID NO: 3583732 - RNA, 19 nt, Human
ugcuguguaaugguuacac

SEQ ID NO: 3583733 - RNA, 13 nt, Human
ugcuguguauaug

SEQ ID NO: 3583734 - RNA, 23 nt, Human
ugcuguguauaugguauauauac

SEQ ID NO: 3583735 - RNA, 16 nt, Human
ugcuguguaucugaua

SEQ ID NO: 3583736 - RNA, 15 nt, Human
ugcuguguccaacuc

SEQ ID NO: 3583737 - RNA, 19 nt, Human
ugcuguguccaacuccagu

SEQ ID NO: 3583738 - RNA, 20 nt, Human
ugcuguguccaacuccagua

SEQ ID NO: 3583739 - RNA, 11 nt, Human
ugcugugugcc

SEQ ID NO: 3583740 - RNA, 15 nt, Human
ugcuguguuugagcu

SEQ ID NO: 3583741 - RNA, 18 nt, Human
ugcuguuacaguuuucuu

SEQ ID NO: 3583742 - RNA, 13 nt, Human
ugcuguuacaugc

SEQ ID NO: 3583743 - RNA, 16 nt, Human
ugcuguuaucccugcc

SEQ ID NO: 3583744 - RNA, 19 nt, Human
ugcuguuaugucuguuuaa

SEQ ID NO: 3583745 - RNA, 22 nt, Human
ugcuguucuagcacuucaucug

SEQ ID NO: 3583746 - RNA, 21 nt, Human
ugcuguugaaagcaaaaaugc

SEQ ID NO: 3583747 - RNA, 15 nt, Human
ugcuguugacauauu

SEQ ID NO: 3583748 - RNA, 12 nt, Human
ugcuguugauug

SEQ ID NO: 3583749 - RNA, 15 nt, Human
ugcuguugauugcua

SEQ ID NO: 3583750 - RNA, 17 nt, Human
ugcuguugauugcuaaa

SEQ ID NO: 3583751 - RNA, 20 nt, Human
ugcuguugauugcuaaaugu

SEQ ID NO: 3583752 - RNA, 19 nt, Human
ugcuguugauuucuuucca

SEQ ID NO: 3583753 - RNA, 21 nt, Human
ugcuguugauuucuuuccaga

SEQ ID NO: 3583754 - RNA, 15 nt, Human
ugcuguugcuugaau

SEQ ID NO: 3583755 - RNA, 16 nt, Human
ugcuguuggucaugug

SEQ ID NO: 3583756 - RNA, 23 nt, Human
ugcuguuguuaugaugugcuuaa

SEQ ID NO: 3583757 - RNA, 14 nt, Human
ugcuguuguucucg

SEQ ID NO: 3583758 - RNA, 23 nt, Human
ugcuguuuauuaaucuuagugua

SEQ ID NO: 3583759 - RNA, 13 nt, Human
ugcuguuugacaa

SEQ ID NO: 3583760 - RNA, 19 nt, Human
ugcuguuuuccucccuucu

SEQ ID NO: 3583761 - RNA, 13 nt, Human
ugcuguuuuguua

SEQ ID NO: 3583762 - RNA, 15 nt, Human
ugcuguuuuguucug

SEQ ID NO: 3583763 - RNA, 14 nt, Human
ugcuuaaaauaagc

SEQ ID NO: 3583764 - RNA, 18 nt, Human
uggcccucaaggccuccc

SEQ ID NO: 3583765 - RNA, 14 nt, Human
uggcccucuacccc

SEQ ID NO: 3583766 - RNA, 16 nt, Human
uggcccucuccccugc

SEQ ID NO: 3583767 - RNA, 13 nt, Human
uggcccucuucuu

SEQ ID NO: 3583768 - RNA, 19 nt, Human
uggcccugccaucuuccca

SEQ ID NO: 3583769 - RNA, 13 nt, Human
uggcccugcccug

SEQ ID NO: 3583770 - RNA, 14 nt, Human
uggcccugcccugg

SEQ ID NO: 3583771 - RNA, 15 nt, Human
uggcccuggccugcu

SEQ ID NO: 3583772 - RNA, 16 nt, Human
uggcccuggccugcug

SEQ ID NO: 3583773 - RNA, 18 nt, Human
uggcccuggccugcuggg

SEQ ID NO: 3583774 - RNA, 14 nt, Human
uggcccuggcugcc

SEQ ID NO: 3583775 - RNA, 13 nt, Human
uggcccuggggcc

SEQ ID NO: 3583776 - RNA, 12 nt, Human
uggcccuggggu

SEQ ID NO: 3583777 - RNA, 13 nt, Human
uggcccugucccu

SEQ ID NO: 3583778 - RNA, 19 nt, Human
uggcccugucccucccacc

SEQ ID NO: 3583779 - RNA, 23 nt, Human
uggcccuuacuugcuucucuagc

SEQ ID NO: 3583780 - RNA, 13 nt, Human
uggcccuuccugg

SEQ ID NO: 3583781 - RNA, 16 nt, Human
uggcccuuccuggaca

SEQ ID NO: 3583782 - RNA, 13 nt, Human
uggcccuuuccuu

SEQ ID NO: 3583783 - RNA, 15 nt, Human
uggccgaguccaagc

SEQ ID NO: 3583784 - RNA, 17 nt, Human
uggccgcccccugcccc

SEQ ID NO: 3583785 - RNA, 12 nt, Human
uggccgccucac

SEQ ID NO: 3583786 - RNA, 21 nt, Human
uggccgcgccaaauaaugucu

SEQ ID NO: 3583787 - RNA, 22 nt, Human
uggccgcgccaaauaaugucuc

SEQ ID NO: 3583788 - RNA, 18 nt, Human
uggccgcgcuccgggcuu

SEQ ID NO: 3583789 - RNA, 19 nt, Human
uggccgcguuuagaccaag

SEQ ID NO: 3583790 - RNA, 19 nt, Human
uggccgcugaguggcaggg

SEQ ID NO: 3583791 - RNA, 19 nt, Human
uggccggcaaccccaguuc

SEQ ID NO: 3583792 - RNA, 24 nt, Human
uggccggcaaccccaguucugcuc

SEQ ID NO: 3583793 - RNA, 12 nt, Human
uggccggccagc

SEQ ID NO: 3583794 - RNA, 22 nt, Human
uggccggccagccagccacucu

SEQ ID NO: 3583795 - RNA, 23 nt, Human
uggccggccagccagccacucua

SEQ ID NO: 3583796 - RNA, 17 nt, Human
uggccgggaccccgagc

SEQ ID NO: 3583797 - RNA, 15 nt, Human
uggccgggagccuga

SEQ ID NO: 3583798 - RNA, 23 nt, Human
uggccgggcgcgguggcucacgc

SEQ ID NO: 3583799 - RNA, 17 nt, Human
uggccgggugcgguggc

SEQ ID NO: 3583800 - RNA, 18 nt, Human
uggccgggugcgguggcu

SEQ ID NO: 3583801 - RNA, 15 nt, Human
uggccggucugcaag

SEQ ID NO: 3583802 - RNA, 21 nt, Human
uggccggucugcaagucagag

SEQ ID NO: 3583803 - RNA, 17 nt, Human
uggccgugaaugggugc

SEQ ID NO: 3583804 - RNA, 14 nt, Human
uggccguuaucugg

SEQ ID NO: 3583805 - RNA, 21 nt, Human
uggccguugauguuggcuggg

SEQ ID NO: 3583806 - RNA, 14 nt, Human
uggccguuggccac

SEQ ID NO: 3583807 - RNA, 16 nt, Human
uggccuaaaaaugcaa

SEQ ID NO: 3583808 - RNA, 21 nt, Human
uggccuaaaccucaguuauua

SEQ ID NO: 3583809 - RNA, 23 nt, Human
uggccuaaccugccgagagucca

SEQ ID NO: 3583810 - RNA, 21 nt, Human
uggccuaagaggcugcccucc

SEQ ID NO: 3583811 - RNA, 18 nt, Human
uggccuacaaaucaguaa

SEQ ID NO: 3583812 - RNA, 23 nt, Human
uggccuagcauacguacacauuu

SEQ ID NO: 3583813 - RNA, 17 nt, Human
uggccuagcccacccug

SEQ ID NO: 3583814 - RNA, 20 nt, Human
uggccuagcccacccugcug

SEQ ID NO: 3583815 - RNA, 22 nt, Human
uggccuaggagauaucugaggg

SEQ ID NO: 3583816 - RNA, 19 nt, Human
uggccuauccgcugccagc

SEQ ID NO: 3583817 - RNA, 21 nt, Human
uggccuauccgcugccagccu

SEQ ID NO: 3583818 - RNA, 13 nt, Human
uggccuaugcaca

SEQ ID NO: 3583819 - RNA, 14 nt, Human
uggccuaugcacau

SEQ ID NO: 3583820 - RNA, 15 nt, Human
uggccuaugcacaua

SEQ ID NO: 3583821 - RNA, 17 nt, Human
uggccuauuauauuaaa

SEQ ID NO: 3583822 - RNA, 21 nt, Human
uggccuauuauauuaaaauau

SEQ ID NO: 3583823 - RNA, 13 nt, Human
uggccucaacccu

SEQ ID NO: 3583824 - RNA, 18 nt, Human
uggccucaacccucccuc

SEQ ID NO: 3583825 - RNA, 20 nt, Human
uggccucaacccucccucag

SEQ ID NO: 3583826 - RNA, 15 nt, Human
uggccucacccaccc

SEQ ID NO: 3583827 - RNA, 17 nt, Human
uggccucagaauucaca

SEQ ID NO: 3583828 - RNA, 14 nt, Human
uggccucagacugc

SEQ ID NO: 3583829 - RNA, 17 nt, Human
uggccucagacugcacc

SEQ ID NO: 3583830 - RNA, 20 nt, Human
uggccucagacugcacccag

SEQ ID NO: 3583831 - RNA, 21 nt, Human
uggccucagacugcacccagg

SEQ ID NO: 3583832 - RNA, 14 nt, Human
uggccucagcugcc

SEQ ID NO: 3583833 - RNA, 19 nt, Human
uggccucagcugccucacu

SEQ ID NO: 3583834 - RNA, 19 nt, Human
uggccucauguggcuggaa

SEQ ID NO: 3583835 - RNA, 13 nt, Human
uggccuccaaguc

SEQ ID NO: 3583836 - RNA, 15 nt, Human
uggccuccaggcccg

SEQ ID NO: 3583837 - RNA, 22 nt, Human
uggccuccaggcccgucugucc

SEQ ID NO: 3583838 - RNA, 19 nt, Human
uggccucccaacucacccc

SEQ ID NO: 3583839 - RNA, 22 nt, Human
uggccucccaacucaccccagc

SEQ ID NO: 3583840 - RNA, 18 nt, Human
uggccucccacagacuca

SEQ ID NO: 3583841 - RNA, 13 nt, Human
uggccucccaccc

SEQ ID NO: 3583842 - RNA, 21 nt, Human
uggccucccacccgaugcugc

SEQ ID NO: 3583843 - RNA, 22 nt, Human
uggccucccacccgaugcugcu

SEQ ID NO: 3583844 - RNA, 15 nt, Human
uggccuccccugcca

SEQ ID NO: 3583845 - RNA, 19 nt, Human
uggccuccccugccaccag

SEQ ID NO: 3583846 - RNA, 20 nt, Human
uggccuccccugccaccagg

SEQ ID NO: 3583847 - RNA, 15 nt, Human
uggccuccccugcug

SEQ ID NO: 3583848 - RNA, 16 nt, Human
uggccuccccugcuga

SEQ ID NO: 3583849 - RNA, 21 nt, Human
uggccuccggcgucagccucc

SEQ ID NO: 3583850 - RNA, 15 nt, Human
uggccuccugccucu

SEQ ID NO: 3583851 - RNA, 17 nt, Human
uggccucgccuggccug

SEQ ID NO: 3583852 - RNA, 17 nt, Human
uggccucuaccacaagg

SEQ ID NO: 3583853 - RNA, 21 nt, Human
uggccucuccuuguggccugg

SEQ ID NO: 3583854 - RNA, 18 nt, Human
uggccucugcaaaggaaa

SEQ ID NO: 3583855 - RNA, 15 nt, Human
uggccucugcacucc

SEQ ID NO: 3583856 - RNA, 16 nt, Human
uggccucuggcucuca

SEQ ID NO: 3583857 - RNA, 17 nt, Human
uggccucuugagcagug

SEQ ID NO: 3583858 - RNA, 22 nt, Human
uggccucuugagcaguggcugg

SEQ ID NO: 3583859 - RNA, 23 nt, Human
uggccucuuuucagaucauggca

SEQ ID NO: 3583860 - RNA, 16 nt, Human
uggccugacuccccca

SEQ ID NO: 3583861 - RNA, 17 nt, Human
uggccugacucccccag

SEQ ID NO: 3583862 - RNA, 14 nt, Human
uggccugagaagag

SEQ ID NO: 3583863 - RNA, 15 nt, Human
uggccugagagggga

SEQ ID NO: 3583864 - RNA, 15 nt, Human
uggccugaggagcag

SEQ ID NO: 3583865 - RNA, 15 nt, Human
uggccugcaaacugg

SEQ ID NO: 3583866 - RNA, 21 nt, Human
uggccugcacggugggccuug

SEQ ID NO: 3583867 - RNA, 20 nt, Human
uggccugcuaaggucuugga

SEQ ID NO: 3583868 - RNA, 22 nt, Human
uggccugcugggcucuccaccu

SEQ ID NO: 3583869 - RNA, 11 nt, Human
uggccuggaca

SEQ ID NO: 3583870 - RNA, 15 nt, Human
uggccuggacaguau

SEQ ID NO: 3583871 - RNA, 13 nt, Human
uggccuggacugu

SEQ ID NO: 3583872 - RNA, 21 nt, Human
uggccuggaucuccccacucu

SEQ ID NO: 3583873 - RNA, 16 nt, Human
uggccuggccaggagc

SEQ ID NO: 3583874 - RNA, 18 nt, Human
uggccuggccccucaggg

SEQ ID NO: 3583875 - RNA, 21 nt, Human
uggccuggccccucagggucc

SEQ ID NO: 3583876 - RNA, 14 nt, Human
uggccuggcccugc

SEQ ID NO: 3583877 - RNA, 13 nt, Human
uggccuggccugg

SEQ ID NO: 3583878 - RNA, 15 nt, Human
uggccuggccuggcc

SEQ ID NO: 3583879 - RNA, 17 nt, Human
uggccuggccuggcccu

SEQ ID NO: 3583880 - RNA, 18 nt, Human
uggccuggccuggcccug

SEQ ID NO: 3583881 - RNA, 16 nt, Human
uggccuggcuucuccu

SEQ ID NO: 3583882 - RNA, 11 nt, Human
uggccugggca

SEQ ID NO: 3583883 - RNA, 11 nt, Human
uggccugggcc

SEQ ID NO: 3583884 - RNA, 17 nt, Human
uggccugggccuccuca

SEQ ID NO: 3583885 - RNA, 19 nt, Human
uggccuguagaauagccug

SEQ ID NO: 3583886 - RNA, 23 nt, Human
uggccuguagaauagccuguggc

SEQ ID NO: 3583887 - RNA, 14 nt, Human
uggccugucucauc

SEQ ID NO: 3583888 - RNA, 24 nt, Human
uggccugucucauccccagggguc

SEQ ID NO: 3583889 - RNA, 16 nt, Human
uggccuguggcugucg

SEQ ID NO: 3583890 - RNA, 14 nt, Human
uggccuguguccca

SEQ ID NO: 3583891 - RNA, 20 nt, Human
uggccuguguggccacuucu

SEQ ID NO: 3583892 - RNA, 22 nt, Human
uggccuguguggccacuucugu

SEQ ID NO: 3583893 - RNA, 13 nt, Human
uggccuguucugu

SEQ ID NO: 3583894 - RNA, 16 nt, Human
uggccuuaauuuccuu

SEQ ID NO: 3583895 - RNA, 15 nt, Human
uggccuuaccccugc

SEQ ID NO: 3583896 - RNA, 16 nt, Human
uggccuuaccccugcc

SEQ ID NO: 3583897 - RNA, 15 nt, Human
uggccuuccccagca

SEQ ID NO: 3583898 - RNA, 17 nt, Human
uggccuuccccagccuc

SEQ ID NO: 3583899 - RNA, 21 nt, Human
uggccuuggcuuuucuagccu

SEQ ID NO: 3583900 - RNA, 21 nt, Human
uggccuugggauccaggcccc

SEQ ID NO: 3583901 - RNA, 18 nt, Human
uggccuuguaagacccuu

SEQ ID NO: 3583902 - RNA, 21 nt, Human
uggccuugugguccaaauagg

SEQ ID NO: 3583903 - RNA, 12 nt, Human
uggccuuuauua

SEQ ID NO: 3583904 - RNA, 20 nt, Human
uggccuuuguaagugcagga

SEQ ID NO: 3583905 - RNA, 22 nt, Human
uggccuuuuucauuuaucuaua

SEQ ID NO: 3583906 - RNA, 18 nt, Human
uggcgaaucucaaaauua

SEQ ID NO: 3583907 - RNA, 19 nt, Human
uggcgagccauuuguccca

SEQ ID NO: 3583908 - RNA, 22 nt, Human
uggcgagccauuugucccaagu

SEQ ID NO: 3583909 - RNA, 14 nt, Human
uggcugcuguugcu

SEQ ID NO: 3583910 - RNA, 21 nt, Human
uggcugcuucaaggauccuga

SEQ ID NO: 3583911 - RNA, 21 nt, Human
uggcuggaagauccugcgggu

SEQ ID NO: 3583912 - RNA, 17 nt, Human
uggcuggcccgucaugu

SEQ ID NO: 3583913 - RNA, 22 nt, Human
uggcuggcuaacuggaagcaug

SEQ ID NO: 3583914 - RNA, 13 nt, Human
uggcuggcugagg

SEQ ID NO: 3583915 - RNA, 14 nt, Human
uggcuggcugaggg

SEQ ID NO: 3583916 - RNA, 15 nt, Human
uggcugggaacucac

SEQ ID NO: 3583917 - RNA, 17 nt, Human
uggcugggacugggaac

SEQ ID NO: 3583918 - RNA, 10 nt, Human
uggcugggca

SEQ ID NO: 3583919 - RNA, 20 nt, Human
uggcugggcagagcugcauc

SEQ ID NO: 3583920 - RNA, 16 nt, Human
uggcugggcccagaag

SEQ ID NO: 3583921 - RNA, 14 nt, Human
uggcugggcugcuc

SEQ ID NO: 3583922 - RNA, 21 nt, Human
uggcuggggccuaucagugug

SEQ ID NO: 3583923 - RNA, 16 nt, Human
uggcugggggcaggag

SEQ ID NO: 3583924 - RNA, 15 nt, Human
uggcugggggccuca

SEQ ID NO: 3583925 - RNA, 16 nt, Human
uggcugggggccucag

SEQ ID NO: 3583926 - RNA, 22 nt, Human
uggcugguaagggccaaguccc

SEQ ID NO: 3583927 - RNA, 20 nt, Human
uggcuggugagccggucagg

SEQ ID NO: 3583928 - RNA, 17 nt, Human
uggcuggugugguacag

SEQ ID NO: 3583929 - RNA, 21 nt, Human
uggcuggugugguacagagaa

SEQ ID NO: 3583930 - RNA, 15 nt, Human
uggcugguguuaaca

SEQ ID NO: 3583931 - RNA, 21 nt, Human
uggcugguguuaacagaaggg

SEQ ID NO: 3583932 - RNA, 16 nt, Human
uggcuguaaggcucua

SEQ ID NO: 3583933 - RNA, 21 nt, Human
uggcuguaaggcucuagauca

SEQ ID NO: 3583934 - RNA, 16 nt, Human
uggcuguaaucauuug

SEQ ID NO: 3583935 - RNA, 15 nt, Human
uggcuguacccagga

SEQ ID NO: 3583936 - RNA, 20 nt, Human
uggcuguagaaggagacaga

SEQ ID NO: 3583937 - RNA, 18 nt, Human
uggcugucaaugggaccu

SEQ ID NO: 3583938 - RNA, 12 nt, Human
uggcuguccagu

SEQ ID NO: 3583939 - RNA, 17 nt, Human
uggcuguccagugccca

SEQ ID NO: 3583940 - RNA, 15 nt, Human
uggcugugaggcccc

SEQ ID NO: 3583941 - RNA, 17 nt, Human
uggcugugccucugccu

SEQ ID NO: 3583942 - RNA, 19 nt, Human
uggcugugccucugccugu

SEQ ID NO: 3583943 - RNA, 19 nt, Human
uggcugugcucucaccagc

SEQ ID NO: 3583944 - RNA, 21 nt, Human
uggcuguggagacaaugucug

SEQ ID NO: 3583945 - RNA, 14 nt, Human
uggcugugggcucc

SEQ ID NO: 3583946 - RNA, 15 nt, Human
uggcuguuggcuggg

SEQ ID NO: 3583947 - RNA, 19 nt, Human
uggcuuaaauauaguuccu

SEQ ID NO: 3583948 - RNA, 11 nt, Human
uggcuuaauuc

SEQ ID NO: 3583949 - RNA, 21 nt, Human
uggcuuaccugaccucuugcu

SEQ ID NO: 3583950 - RNA, 13 nt, Human
uggcuuaccuggc

SEQ ID NO: 3583951 - RNA, 17 nt, Human
uggcuuaccuggcccau

SEQ ID NO: 3583952 - RNA, 23 nt, Human
uggcuuacuacaugugggagcuu

SEQ ID NO: 3583953 - RNA, 23 nt, Human
uggcuucacggaagagccuugcg

SEQ ID NO: 3583954 - RNA, 14 nt, Human
uggcuucagcucca

SEQ ID NO: 3583955 - RNA, 16 nt, Human
uggcuucagcuccagc

SEQ ID NO: 3583956 - RNA, 18 nt, Human
uggcuucagcuccagccc

SEQ ID NO: 3583957 - RNA, 18 nt, Human
uggcuucauuagagcagg

SEQ ID NO: 3583958 - RNA, 15 nt, Human
uggcuuccagguauc

SEQ ID NO: 3583959 - RNA, 21 nt, Human
uggcuuccagguaucuccagg

SEQ ID NO: 3583960 - RNA, 14 nt, Human
uggcuucccauccc

SEQ ID NO: 3583961 - RNA, 21 nt, Human
uggcuucccauccccagcgau

SEQ ID NO: 3583962 - RNA, 17 nt, Human
uggcuucccgcucagcc

SEQ ID NO: 3583963 - RNA, 19 nt, Human
uggcuucccgcucagcccu

SEQ ID NO: 3583964 - RNA, 11 nt, Human
uggcuuccucc

SEQ ID NO: 3583965 - RNA, 14 nt, Human
uggcuuccuuucuu

SEQ ID NO: 3583966 - RNA, 16 nt, Human
uggcuuccuuucuugg

SEQ ID NO: 3583967 - RNA, 18 nt, Human
uggcuucggacaaaauau

SEQ ID NO: 3583968 - RNA, 15 nt, Human
uggcuucuggccagg

SEQ ID NO: 3583969 - RNA, 16 nt, Human
uggcuucuggccagga

SEQ ID NO: 3583970 - RNA, 18 nt, Human
uggcuucuggccaggaag

SEQ ID NO: 3583971 - RNA, 19 nt, Human
uggcuucuggccaggaagc

SEQ ID NO: 3583972 - RNA, 21 nt, Human
uggcuucuggccaggaagcuu

SEQ ID NO: 3583973 - RNA, 19 nt, Human
uggcuucuguugucaccuu

SEQ ID NO: 3583974 - RNA, 18 nt, Human
uggcuucuucuuuaggau

SEQ ID NO: 3583975 - RNA, 19 nt, Human
uggcuucuuuucuuuguau

SEQ ID NO: 3583976 - RNA, 20 nt, Human
uggcuugaagccaagucagc

SEQ ID NO: 3583977 - RNA, 15 nt, Human
uggcuugagaaauau

SEQ ID NO: 3583978 - RNA, 17 nt, Human
uggcuugccacagcucu

SEQ ID NO: 3583979 - RNA, 17 nt, Human
uggcuuggccacagcca

SEQ ID NO: 3583980 - RNA, 20 nt, Human
uggcuuggccacagccaggg

SEQ ID NO: 3583981 - RNA, 13 nt, Human
uggcuuggcccug

SEQ ID NO: 3583982 - RNA, 19 nt, Human
uggcuuggcccuggcagcc

SEQ ID NO: 3583983 - RNA, 18 nt, Human
uggcuugggacuaaaugc

SEQ ID NO: 3583984 - RNA, 23 nt, Human
uggcuuggggucaagaaacagcc

SEQ ID NO: 3583985 - RNA, 17 nt, Human
uggcuuguagaauuguu

SEQ ID NO: 3583986 - RNA, 13 nt, Human
uggcuugucuaua

SEQ ID NO: 3583987 - RNA, 16 nt, Human
uggcuuguguguuuca

SEQ ID NO: 3583988 - RNA, 20 nt, Human
uggcuuuaggagcaguggga

SEQ ID NO: 3583989 - RNA, 16 nt, Human
uggcuuuauccucuuu

SEQ ID NO: 3583990 - RNA, 20 nt, Human
uggcuuuauccucuuuagag

SEQ ID NO: 3583991 - RNA, 15 nt, Human
uggcuuucagccucu

SEQ ID NO: 3583992 - RNA, 14 nt, Human
uggcuuucagggag

SEQ ID NO: 3583993 - RNA, 17 nt, Human
uggcuuucauuauuagu

SEQ ID NO: 3583994 - RNA, 17 nt, Human
uggcuuuccuuguggca

SEQ ID NO: 3583995 - RNA, 21 nt, Human
uggcuuuccuuguggcagagg

SEQ ID NO: 3583996 - RNA, 17 nt, Human
uggcuuugcccaaccuc

SEQ ID NO: 3583997 - RNA, 20 nt, Human
uggcuuugcccaaccucagc

SEQ ID NO: 3583998 - RNA, 23 nt, Human
uggcuuugcccaaccucagcaac

SEQ ID NO: 3583999 - RNA, 22 nt, Human
uggcuuuguauagaaccucuuu

SEQ ID NO: 3584000 - RNA, 17 nt, Human
uggcuuugucccacagc

SEQ ID NO: 3584001 - RNA, 11 nt, Human
uggcuuuguuu

SEQ ID NO: 3584002 - RNA, 16 nt, Human
uggcuuuuagacagau

SEQ ID NO: 3584003 - RNA, 21 nt, Human
uggcuuuuauuaaugcacuuu

SEQ ID NO: 3584004 - RNA, 14 nt, Human
uggcuuuucacugc

SEQ ID NO: 3584005 - RNA, 18 nt, Human
uggcuuuucacugcuggc

SEQ ID NO: 3584006 - RNA, 19 nt, Human
uggcuuuucugauccaguu

SEQ ID NO: 3584007 - RNA, 14 nt, Human
uggcuuuucuguuu

SEQ ID NO: 3584008 - RNA, 18 nt, Human
uggcuuuucuguuuccug

SEQ ID NO: 3584009 - RNA, 19 nt, Human
uggcuuuucuguuuccugu

SEQ ID NO: 3584010 - RNA, 14 nt, Human
uggcuuuugugcau

SEQ ID NO: 3584011 - RNA, 19 nt, Human
uggcuuuuuuccuccugug

SEQ ID NO: 3584012 - RNA, 19 nt, Human
ugggaaaaaaaugaaugag

SEQ ID NO: 3584013 - RNA, 16 nt, Human
ugggaaaaauguagga

SEQ ID NO: 3584014 - RNA, 17 nt, Human
ugggaaaaauguaggag

SEQ ID NO: 3584015 - RNA, 14 nt, Human
ugggaaaacauuug

SEQ ID NO: 3584016 - RNA, 23 nt, Human
ugggaaaauaccccaucauucau

SEQ ID NO: 3584017 - RNA, 17 nt, Human
ugggaaacacuccuugc

SEQ ID NO: 3584018 - RNA, 18 nt, Human
ugggaaacacuccuugca

SEQ ID NO: 3584019 - RNA, 15 nt, Human
ugggaaacagaggcu

SEQ ID NO: 3584020 - RNA, 21 nt, Human
ugggaaacuugucacuugcau

SEQ ID NO: 3584021 - RNA, 21 nt, Human
ugggaaagaaggcaaaguccc

SEQ ID NO: 3584022 - RNA, 15 nt, Human
ugggaaagcauaaag

SEQ ID NO: 3584023 - RNA, 15 nt, Human
ugggaaagccaccuc

SEQ ID NO: 3584024 - RNA, 20 nt, Human
ugggaaagccccugccccuc

SEQ ID NO: 3584025 - RNA, 23 nt, Human
ugggaaagcgcggacgugcuggg

SEQ ID NO: 3584026 - RNA, 16 nt, Human
ugggaaaggaguagaa

SEQ ID NO: 3584027 - RNA, 16 nt, Human
ugggaaaguauucugu

SEQ ID NO: 3584028 - RNA, 17 nt, Human
ugggaaauaagagagaa

SEQ ID NO: 3584029 - RNA, 23 nt, Human
ugggaaaugcugauuuaaacuuc

SEQ ID NO: 3584030 - RNA, 20 nt, Human
ugggaacaccauaggucacc

SEQ ID NO: 3584031 - RNA, 20 nt, Human
ugggaaccccuucauccucu

SEQ ID NO: 3584032 - RNA, 15 nt, Human
ugggaaccucccaga

SEQ ID NO: 3584033 - RNA, 20 nt, Human
ugggaacgagaggggaagag

SEQ ID NO: 3584034 - RNA, 16 nt, Human
ugggaacugcagaccu

SEQ ID NO: 3584035 - RNA, 12 nt, Human
ugggaagaaaca

SEQ ID NO: 3584036 - RNA, 14 nt, Human
ugggaagaaacaaa

SEQ ID NO: 3584037 - RNA, 14 nt, Human
ugggaagacaugaa

SEQ ID NO: 3584038 - RNA, 18 nt, Human
ugggaagacgaggcccuc

SEQ ID NO: 3584039 - RNA, 17 nt, Human
ugggaagagcuuagaaa

SEQ ID NO: 3584040 - RNA, 17 nt, Human
ugggaagauaggcucug

SEQ ID NO: 3584041 - RNA, 15 nt, Human
ugggaagcugagggc

SEQ ID NO: 3584042 - RNA, 20 nt, Human
ugggaagcugagggcaaauc

SEQ ID NO: 3584043 - RNA, 15 nt, Human
ugggaaggccagcug

SEQ ID NO: 3584044 - RNA, 22 nt, Human
ugggaaggccucuuggagaccu

SEQ ID NO: 3584045 - RNA, 20 nt, Human
ugggaagggucauagaaagg

SEQ ID NO: 3584046 - RNA, 15 nt, Human
ugggaagugaagacu

SEQ ID NO: 3584047 - RNA, 23 nt, Human
ugggaaguugcauuccuuugucu

SEQ ID NO: 3584048 - RNA, 15 nt, Human
ugggaauaaauaugc

SEQ ID NO: 3584049 - RNA, 20 nt, Human
ugggaauauaauauugucuc

SEQ ID NO: 3584050 - RNA, 20 nt, Human
ugggaauauuugaaucuugu

SEQ ID NO: 3584051 - RNA, 22 nt, Human
ugggaauauuugaaucuugucu

SEQ ID NO: 3584052 - RNA, 13 nt, Human
ugggaaugaagcu

SEQ ID NO: 3584053 - RNA, 13 nt, Human
ugggaugaccagg

SEQ ID NO: 3584054 - RNA, 19 nt, Human
ugggaugagaguuuuggau

SEQ ID NO: 3584055 - RNA, 18 nt, Human
ugggaugauuggaggggg

SEQ ID NO: 3584056 - RNA, 14 nt, Human
ugggaugcuugccu

SEQ ID NO: 3584057 - RNA, 20 nt, Human
ugggaugcuugccuagggcc

SEQ ID NO: 3584058 - RNA, 16 nt, Human
ugggauggugggcuuc

SEQ ID NO: 3584059 - RNA, 19 nt, Human
ugggauguccacagaugcc

SEQ ID NO: 3584060 - RNA, 23 nt, Human
ugggauguggcugcagcagcggu

SEQ ID NO: 3584061 - RNA, 21 nt, Human
ugggauguucagcacuguccc

SEQ ID NO: 3584062 - RNA, 17 nt, Human
ugggauuacaggcguga

SEQ ID NO: 3584063 - RNA, 18 nt, Human
ugggauuacaggcuccug

SEQ ID NO: 3584064 - RNA, 21 nt, Human
ugggauuacagggaugagcca

SEQ ID NO: 3584065 - RNA, 19 nt, Human
ugggauuaugggucacagg

SEQ ID NO: 3584066 - RNA, 21 nt, Human
ugggauuaugggucacaggaa

SEQ ID NO: 3584067 - RNA, 14 nt, Human
ugggauucagagaa

SEQ ID NO: 3584068 - RNA, 23 nt, Human
ugggauucaggaaaaggccuggg

SEQ ID NO: 3584069 - RNA, 22 nt, Human
ugggauuccugacccaggccgc

SEQ ID NO: 3584070 - RNA, 17 nt, Human
ugggauucuacuuuaag

SEQ ID NO: 3584071 - RNA, 22 nt, Human
ugggauucuacuuuaagcacua

SEQ ID NO: 3584072 - RNA, 16 nt, Human
ugggauugagucugug

SEQ ID NO: 3584073 - RNA, 19 nt, Human
ugggauugagucugugcca

SEQ ID NO: 3584074 - RNA, 18 nt, Human
ugggauugggggcuggug

SEQ ID NO: 3584075 - RNA, 17 nt, Human
ugggauuuaauuuccag

SEQ ID NO: 3584076 - RNA, 16 nt, Human
ugggcaaaaaacucga

SEQ ID NO: 3584077 - RNA, 15 nt, Human
ugggcaaaagagugu

SEQ ID NO: 3584078 - RNA, 14 nt, Human
ugggcaacagagca

SEQ ID NO: 3584079 - RNA, 15 nt, Human
ugggcaacagagcaa

SEQ ID NO: 3584080 - RNA, 13 nt, Human
ugggcaaggaaaa

SEQ ID NO: 3584081 - RNA, 18 nt, Human
ugggcaauauaaccaaug

SEQ ID NO: 3584082 - RNA, 15 nt, Human
ugggcaauauagcaa

SEQ ID NO: 3584083 - RNA, 21 nt, Human
ugggcaauauucucuguacau

SEQ ID NO: 3584084 - RNA, 13 nt, Human
ugggcaauuuaga

SEQ ID NO: 3584085 - RNA, 16 nt, Human
ugggcacacgccuccc

SEQ ID NO: 3584086 - RNA, 22 nt, Human
ugggcacacgccucccacuggg

SEQ ID NO: 3584087 - RNA, 20 nt, Human
ugggcacacgcugcucugcc

SEQ ID NO: 3584088 - RNA, 22 nt, Human
ugggcacacgcugcucugcccc

SEQ ID NO: 3584089 - RNA, 13 nt, Human
ugggcacagguca

SEQ ID NO: 3584090 - RNA, 14 nt, Human
ugggcacaguuugg

SEQ ID NO: 3584091 - RNA, 20 nt, Human
ugggcacaucauuucaagaa

SEQ ID NO: 3584092 - RNA, 22 nt, Human
ugggcaccaagagccaauggag

SEQ ID NO: 3584093 - RNA, 16 nt, Human
ugggcaccacaaaaua

SEQ ID NO: 3584094 - RNA, 14 nt, Human
ugggcacccacccu

SEQ ID NO: 3584095 - RNA, 16 nt, Human
ugggcacccacccugg

SEQ ID NO: 3584096 - RNA, 20 nt, Human
ugggcacccacccugggacc

SEQ ID NO: 3584097 - RNA, 16 nt, Human
ugggcacccccagccu

SEQ ID NO: 3584098 - RNA, 19 nt, Human
ugggcacccccagccuggg

SEQ ID NO: 3584099 - RNA, 21 nt, Human
ugggcacccccagccugggcc

SEQ ID NO: 3584100 - RNA, 19 nt, Human
ugggcaccuggggaguggg

SEQ ID NO: 3584101 - RNA, 20 nt, Human
ugggcaccuggggaguggga

SEQ ID NO: 3584102 - RNA, 12 nt, Human
ugggcacugaag

SEQ ID NO: 3584103 - RNA, 18 nt, Human
ugggcacugcucucaccu

SEQ ID NO: 3584104 - RNA, 14 nt, Human
ugggcacugcuggg

SEQ ID NO: 3584105 - RNA, 17 nt, Human
ugggcacugcugggugg

SEQ ID NO: 3584106 - RNA, 21 nt, Human
ugggcacugcuggguggccca

SEQ ID NO: 3584107 - RNA, 23 nt, Human
ugggcacugcuggguggcccauc

SEQ ID NO: 3584108 - RNA, 16 nt, Human
ugggcacuggauuagu

SEQ ID NO: 3584109 - RNA, 15 nt, Human
ugggcacuucccugc

SEQ ID NO: 3584110 - RNA, 17 nt, Human
ugggcacuucccugcug

SEQ ID NO: 3584111 - RNA, 12 nt, Human
ugggcagaagga

SEQ ID NO: 3584112 - RNA, 13 nt, Human
ugggcagaaggaa

SEQ ID NO: 3584113 - RNA, 20 nt, Human
ugggcagaaggaagacuuca

SEQ ID NO: 3584114 - RNA, 16 nt, Human
ugggcagaaggccaag

SEQ ID NO: 3584115 - RNA, 17 nt, Human
ugggcagaaggccaaga

SEQ ID NO: 3584116 - RNA, 15 nt, Human
ugggcagaagggaga

SEQ ID NO: 3584117 - RNA, 17 nt, Human
ugggcagagcagagacc

SEQ ID NO: 3584118 - RNA, 14 nt, Human
ugggcagagcccaa

SEQ ID NO: 3584119 - RNA, 14 nt, Human
ugggcagagcuggc

SEQ ID NO: 3584120 - RNA, 21 nt, Human
ugggcagaucuaccccuuacu

SEQ ID NO: 3584121 - RNA, 18 nt, Human
ugggcagcaauuuaaaug

SEQ ID NO: 3584122 - RNA, 16 nt, Human
ugggcagcauagcaag

SEQ ID NO: 3584123 - RNA, 20 nt, Human
ugggcagcgcccuuccucuc

SEQ ID NO: 3584124 - RNA, 22 nt, Human
ugggcagcuaccauuucccuuu

SEQ ID NO: 3584125 - RNA, 10 nt, Human
ugggcagcuc

SEQ ID NO: 3584126 - RNA, 12 nt, Human
ugggcagcugcc

SEQ ID NO: 3584127 - RNA, 13 nt, Human
ugggcagcugccu

SEQ ID NO: 3584128 - RNA, 14 nt, Human
ugggcagcugccuc

SEQ ID NO: 3584129 - RNA, 18 nt, Human
ugggcagcuuagggcccu

SEQ ID NO: 3584130 - RNA, 23 nt, Human
ugggcaggaagugaagagauccu

SEQ ID NO: 3584131 - RNA, 21 nt, Human
ugggcaggacucagcucccca

SEQ ID NO: 3584132 - RNA, 18 nt, Human
ugggcaggagggaggugc

SEQ ID NO: 3584133 - RNA, 16 nt, Human
ugggcaggugguggca

SEQ ID NO: 3584134 - RNA, 21 nt, Human
ugggcaggugguggcacugag

SEQ ID NO: 3584135 - RNA, 17 nt, Human
ugggcaguuacaugcau

SEQ ID NO: 3584136 - RNA, 18 nt, Human
ugggcaguuuuucuguau

SEQ ID NO: 3584137 - RNA, 22 nt, Human
ugggcaguuuuucuguauuuua

SEQ ID NO: 3584138 - RNA, 15 nt, Human
ugggcaguuuuuuga

SEQ ID NO: 3584139 - RNA, 16 nt, Human
ugggcauagaugcagg

SEQ ID NO: 3584140 - RNA, 15 nt, Human
ugggcaucuguucug

SEQ ID NO: 3584141 - RNA, 13 nt, Human
ugggcaucuuuug

SEQ ID NO: 3584142 - RNA, 23 nt, Human
ugggcaugagggguuccuccccu

SEQ ID NO: 3584143 - RNA, 13 nt, Human
ugggcauggggug

SEQ ID NO: 3584144 - RNA, 15 nt, Human
ugggcaugggguggg

SEQ ID NO: 3584145 - RNA, 21 nt, Human
ugggcauggggugggccucug

SEQ ID NO: 3584146 - RNA, 19 nt, Human
ugggcaugguguucuccug

SEQ ID NO: 3584147 - RNA, 17 nt, Human
ugggcaugugggcuuca

SEQ ID NO: 3584148 - RNA, 14 nt, Human
ugggcauucaaaug

SEQ ID NO: 3584149 - RNA, 14 nt, Human
ugggcauucucucu

SEQ ID NO: 3584150 - RNA, 15 nt, Human
ugggcauugccaugu

SEQ ID NO: 3584151 - RNA, 18 nt, Human
ugggcauugccaugugga

SEQ ID NO: 3584152 - RNA, 12 nt, Human
ugggcauugcuu

SEQ ID NO: 3584153 - RNA, 14 nt, Human
ugggcauugcuuuc

SEQ ID NO: 3584154 - RNA, 15 nt, Human
ugggcauuugugagg

SEQ ID NO: 3584155 - RNA, 21 nt, Human
ugggccaaauccgcucucuuc

SEQ ID NO: 3584156 - RNA, 15 nt, Human
ugggccaagccaggg

SEQ ID NO: 3584157 - RNA, 17 nt, Human
ugggccaccgccuugcc

SEQ ID NO: 3584158 - RNA, 23 nt, Human
ugggccaccgccuugcccagccu

SEQ ID NO: 3584159 - RNA, 18 nt, Human
ugggccagaauuucaaac

SEQ ID NO: 3584160 - RNA, 13 nt, Human
ugggccagacaug

SEQ ID NO: 3584161 - RNA, 13 nt, Human
ugggccagccccu

SEQ ID NO: 3584162 - RNA, 18 nt, Human
ugggccagccccucccac

SEQ ID NO: 3584163 - RNA, 20 nt, Human
ugggccagccccucccacca

SEQ ID NO: 3584164 - RNA, 18 nt, Human
ugggccagcuuuucaaac

SEQ ID NO: 3584165 - RNA, 20 nt, Human
ugggccagggcugcccugag

SEQ ID NO: 3584166 - RNA, 21 nt, Human
ugggccagggcugcccugaga

SEQ ID NO: 3584167 - RNA, 19 nt, Human
ugggccagggucuguguga

SEQ ID NO: 3584168 - RNA, 22 nt, Human
ugggccagggucugugugaaug

SEQ ID NO: 3584169 - RNA, 16 nt, Human
ugggccagucugugga

SEQ ID NO: 3584170 - RNA, 15 nt, Human
ugggccauacuggcc

SEQ ID NO: 3584171 - RNA, 20 nt, Human
ugggccauucuccacagcaa

SEQ ID NO: 3584172 - RNA, 20 nt, Human
ugggcccaaugcacuuuguu

SEQ ID NO: 3584173 - RNA, 20 nt, Human
ugggcccacaccuccuuccc

SEQ ID NO: 3584174 - RNA, 22 nt, Human
ugggcccacccaagcaggaggc

SEQ ID NO: 3584175 - RNA, 12 nt, Human
ugggcccagaag

SEQ ID NO: 3584176 - RNA, 19 nt, Human
ugggcccagaggcacagcc

SEQ ID NO: 3584177 - RNA, 12 nt, Human
ugggcccagcug

SEQ ID NO: 3584178 - RNA, 17 nt, Human
ugggcccagcugggcuc

SEQ ID NO: 3584179 - RNA, 19 nt, Human
ugggcccagcugggcucug

SEQ ID NO: 3584180 - RNA, 10 nt, Human
ugggcccagg

SEQ ID NO: 3584181 - RNA, 15 nt, Human
ugggcccaggaccag

SEQ ID NO: 3584182 - RNA, 22 nt, Human
ugggcccaggaccagcuggggc

SEQ ID NO: 3584183 - RNA, 13 nt, Human
ugggcccaucucc

SEQ ID NO: 3584184 - RNA, 16 nt, Human
ugggcccaucucccug

SEQ ID NO: 3584185 - RNA, 19 nt, Human
ugggcccaucucccugcuu

SEQ ID NO: 3584186 - RNA, 14 nt, Human
ugggccccacccuc

SEQ ID NO: 3584187 - RNA, 16 nt, Human
ugggccccacccucgg

SEQ ID NO: 3584188 - RNA, 15 nt, Human
ugggccccagcccac

SEQ ID NO: 3584189 - RNA, 15 nt, Human
ugggccccagccuuc

SEQ ID NO: 3584190 - RNA, 21 nt, Human
ugggccccaggggaacacugg

SEQ ID NO: 3584191 - RNA, 22 nt, Human
ugggccccaguuguauuuauuu

SEQ ID NO: 3584192 - RNA, 18 nt, Human
ugggccccccagcucagg

SEQ ID NO: 3584193 - RNA, 23 nt, Human
ugggccccucaucugcucagcag

SEQ ID NO: 3584194 - RNA, 19 nt, Human
ugggccccucccuaccuca

SEQ ID NO: 3584195 - RNA, 15 nt, Human
ugggccccuggcacu

SEQ ID NO: 3584196 - RNA, 11 nt, Human
ugggcccuccu

SEQ ID NO: 3584197 - RNA, 18 nt, Human
ugggcccucucugcucug

SEQ ID NO: 3584198 - RNA, 23 nt, Human
uggggagguguucacugaagacg

SEQ ID NO: 3584199 - RNA, 16 nt, Human
uggggagugggacaga

SEQ ID NO: 3584200 - RNA, 16 nt, Human
uggggaguuaagaccu

SEQ ID NO: 3584201 - RNA, 18 nt, Human
uggggaguuaagaccugg

SEQ ID NO: 3584202 - RNA, 21 nt, Human
uggggauaaaaugacuacuua

SEQ ID NO: 3584203 - RNA, 17 nt, Human
uggggauaggccagccg

SEQ ID NO: 3584204 - RNA, 18 nt, Human
uggggauaggccagccgc

SEQ ID NO: 3584205 - RNA, 15 nt, Human
uggggauauaauacu

SEQ ID NO: 3584206 - RNA, 13 nt, Human
uggggauaugcuu

SEQ ID NO: 3584207 - RNA, 21 nt, Human
uggggaucacagagacauucc

SEQ ID NO: 3584208 - RNA, 13 nt, Human
uggggauucagau

SEQ ID NO: 3584209 - RNA, 13 nt, Human
uggggauucuuaa

SEQ ID NO: 3584210 - RNA, 16 nt, Human
uggggauucuuaaagu

SEQ ID NO: 3584211 - RNA, 18 nt, Human
uggggauucuuaaaguug

SEQ ID NO: 3584212 - RNA, 20 nt, Human
uggggauugggccccugcca

SEQ ID NO: 3584213 - RNA, 15 nt, Human
uggggauuucuccca

SEQ ID NO: 3584214 - RNA, 17 nt, Human
uggggauuucucccagc

SEQ ID NO: 3584215 - RNA, 17 nt, Human
uggggcacaguccagga

SEQ ID NO: 3584216 - RNA, 18 nt, Human
uggggcacaguccaggaa

SEQ ID NO: 3584217 - RNA, 15 nt, Human
uggggcagagccucc

SEQ ID NO: 3584218 - RNA, 16 nt, Human
uggggcagaggagaac

SEQ ID NO: 3584219 - RNA, 17 nt, Human
uggggcagaggagaacu

SEQ ID NO: 3584220 - RNA, 14 nt, Human
uggggcagcacaga

SEQ ID NO: 3584221 - RNA, 16 nt, Human
uggggcagcuugaggg

SEQ ID NO: 3584222 - RNA, 22 nt, Human
uggggcaggaggggagugaggc

SEQ ID NO: 3584223 - RNA, 22 nt, Human
uggggcaggaguagcugagcuc

SEQ ID NO: 3584224 - RNA, 18 nt, Human
uggggcaggcugggccau

SEQ ID NO: 3584225 - RNA, 20 nt, Human
uggggcaggcugggccaugu

SEQ ID NO: 3584226 - RNA, 12 nt, Human
uggggcagggag

SEQ ID NO: 3584227 - RNA, 14 nt, Human
uggggcagggagcu

SEQ ID NO: 3584228 - RNA, 21 nt, Human
uggggcagggagcugggcccg

SEQ ID NO: 3584229 - RNA, 14 nt, Human
uggggccacacaga

SEQ ID NO: 3584230 - RNA, 12 nt, Human
uggggccacagc

SEQ ID NO: 3584231 - RNA, 15 nt, Human
uggggccacagccag

SEQ ID NO: 3584232 - RNA, 18 nt, Human
uggggccagauccagccu

SEQ ID NO: 3584233 - RNA, 14 nt, Human
uggggccaugccuc

SEQ ID NO: 3584234 - RNA, 20 nt, Human
uggggccauugcuuaccuug

SEQ ID NO: 3584235 - RNA, 14 nt, Human
uggggcccaaaugc

SEQ ID NO: 3584236 - RNA, 12 nt, Human
uggggcccagug

SEQ ID NO: 3584237 - RNA, 14 nt, Human
uggggcccagugca

SEQ ID NO: 3584238 - RNA, 21 nt, Human
uggggccccuuuuuacucccc

SEQ ID NO: 3584239 - RNA, 12 nt, Human
uggggcccugcc

SEQ ID NO: 3584240 - RNA, 15 nt, Human
uggggcccugccucc

SEQ ID NO: 3584241 - RNA, 18 nt, Human
uggggccuacagcuuuga

SEQ ID NO: 3584242 - RNA, 22 nt, Human
uggggccuagcgaucucuccug

SEQ ID NO: 3584243 - RNA, 19 nt, Human
uggggccuaucagugugcc

SEQ ID NO: 3584244 - RNA, 20 nt, Human
uggggccuaucagugugccc

SEQ ID NO: 3584245 - RNA, 13 nt, Human
uggggccugacug

SEQ ID NO: 3584246 - RNA, 12 nt, Human
uggggccugaga

SEQ ID NO: 3584247 - RNA, 13 nt, Human
uggggccugagag

SEQ ID NO: 3584248 - RNA, 19 nt, Human
uggggccugauggggaggg

SEQ ID NO: 3584249 - RNA, 15 nt, Human
uggggccuggaccug

SEQ ID NO: 3584250 - RNA, 17 nt, Human
uggggccuggaccugcc

SEQ ID NO: 3584251 - RNA, 19 nt, Human
uggggccuggaccugccuc

SEQ ID NO: 3584252 - RNA, 12 nt, Human
uggggccuggca

SEQ ID NO: 3584253 - RNA, 12 nt, Human
uggggccuggga

SEQ ID NO: 3584254 - RNA, 14 nt, Human
uggggccugggagg

SEQ ID NO: 3584255 - RNA, 11 nt, Human
uggggccugua

SEQ ID NO: 3584256 - RNA, 18 nt, Human
uggggccuguacugccug

SEQ ID NO: 3584257 - RNA, 19 nt, Human
uggggccuguacugccugc

SEQ ID NO: 3584258 - RNA, 12 nt, Human
uggggccugugg

SEQ ID NO: 3584259 - RNA, 14 nt, Human
uggggccuguggaa

SEQ ID NO: 3584260 - RNA, 21 nt, Human
uggggccuguggaaugagugu

SEQ ID NO: 3584261 - RNA, 16 nt, Human
uggggcgcgugaggcc

SEQ ID NO: 3584262 - RNA, 19 nt, Human
uggggcgggaaagccagug

SEQ ID NO: 3584263 - RNA, 23 nt, Human
uggggcucccagccaggcccuug

SEQ ID NO: 3584264 - RNA, 15 nt, Human
uggggcucccgccuc

SEQ ID NO: 3584265 - RNA, 22 nt, Human
uggggcuccuucuccaccccag

SEQ ID NO: 3584266 - RNA, 17 nt, Human
uggggcucgccaugccg

SEQ ID NO: 3584267 - RNA, 20 nt, Human
uggggcucuaacgccugagc

SEQ ID NO: 3584268 - RNA, 24 nt, Human
uggggcucuaacgccugagcccag

SEQ ID NO: 3584269 - RNA, 17 nt, Human
uggggcucugugcaggg

SEQ ID NO: 3584270 - RNA, 17 nt, Human
uggggcugaucucaggg

SEQ ID NO: 3584271 - RNA, 20 nt, Human
uggggcugaucucagggaag

SEQ ID NO: 3584272 - RNA, 18 nt, Human
uggggcugggggaugggc

SEQ ID NO: 3584273 - RNA, 21 nt, Human
uggggcugggggaugggccug

SEQ ID NO: 3584274 - RNA, 19 nt, Human
uggggcugguagcucaggu

SEQ ID NO: 3584275 - RNA, 18 nt, Human
uggggcuuggcguggagc

SEQ ID NO: 3584276 - RNA, 15 nt, Human
ugggggaaagcaaag

SEQ ID NO: 3584277 - RNA, 17 nt, Human
ugggggaaagcaaagca

SEQ ID NO: 3584278 - RNA, 21 nt, Human
ugggggaaagcaaagcacaga

SEQ ID NO: 3584279 - RNA, 17 nt, Human
ugggggaaauggugccu

SEQ ID NO: 3584280 - RNA, 18 nt, Human
ugggggaacucagaucca

SEQ ID NO: 3584281 - RNA, 20 nt, Human
ugggggaacucagauccagg

SEQ ID NO: 3584282 - RNA, 23 nt, Human
ugggggaaugagcccagagaaca

SEQ ID NO: 3584283 - RNA, 20 nt, Human
ugggggacagaaagagacuc

SEQ ID NO: 3584284 - RNA, 16 nt, Human
ugggggacagggcugg

SEQ ID NO: 3584285 - RNA, 18 nt, Human
ugggggacagggcuggcc

SEQ ID NO: 3584286 - RNA, 22 nt, Human
ugggggacagggcuggcccagc

SEQ ID NO: 3584287 - RNA, 17 nt, Human
ugggggacguuucucau

SEQ ID NO: 3584288 - RNA, 16 nt, Human
ugggggacuguaaguu

SEQ ID NO: 3584289 - RNA, 13 nt, Human
ugggggagagcag

SEQ ID NO: 3584290 - RNA, 19 nt, Human
ugggggagagcaggcuggc

SEQ ID NO: 3584291 - RNA, 16 nt, Human
ugggggagggcugcga

SEQ ID NO: 3584292 - RNA, 16 nt, Human
ugggggaugggccuga

SEQ ID NO: 3584293 - RNA, 11 nt, Human
ugggggaugua

SEQ ID NO: 3584294 - RNA, 16 nt, Human
ugggggcacaggaggc

SEQ ID NO: 3584295 - RNA, 17 nt, Human
ugggggcagagggcaga

SEQ ID NO: 3584296 - RNA, 22 nt, Human
ugggggcaggagggcccuaccu

SEQ ID NO: 3584297 - RNA, 13 nt, Human
ugggggcagggcu

SEQ ID NO: 3584298 - RNA, 19 nt, Human
ugggggccaccugccugcg

SEQ ID NO: 3584299 - RNA, 13 nt, Human
ugggggccaugag

SEQ ID NO: 3584300 - RNA, 11 nt, Human
ugggggccugg

SEQ ID NO: 3584301 - RNA, 12 nt, Human
ugggggccuggc

SEQ ID NO: 3584302 - RNA, 13 nt, Human
ugggggccuggcu

SEQ ID NO: 3584303 - RNA, 17 nt, Human
ugggggcucagcaaggc

SEQ ID NO: 3584304 - RNA, 17 nt, Human
ugggggcugggcagagg

SEQ ID NO: 3584305 - RNA, 15 nt, Human
ugggggcuggugcca

SEQ ID NO: 3584306 - RNA, 16 nt, Human
ugggggcuggugccag

SEQ ID NO: 3584307 - RNA, 21 nt, Human
uggggggaacgcccacuuccc

SEQ ID NO: 3584308 - RNA, 20 nt, Human
uggggggagcacccugaggg

SEQ ID NO: 3584309 - RNA, 21 nt, Human
uggggggagcacccugagggc

SEQ ID NO: 3584310 - RNA, 20 nt, Human
uggggggaugguaagagaaa

SEQ ID NO: 3584311 - RNA, 15 nt, Human
uggggggccaacacc

SEQ ID NO: 3584312 - RNA, 13 nt, Human
ugggggggcagag

SEQ ID NO: 3584313 - RNA, 13 nt, Human
uggggggguggcc

SEQ ID NO: 3584314 - RNA, 19 nt, Human
uggggggguguuaauuuau

SEQ ID NO: 3584315 - RNA, 18 nt, Human
uggggggugaugagggca

SEQ ID NO: 3584316 - RNA, 19 nt, Human
uggggggugaugagggcag

SEQ ID NO: 3584317 - RNA, 15 nt, Human
uggggguagagcuga

SEQ ID NO: 3584318 - RNA, 18 nt, Human
uggggguagagcugaucc

SEQ ID NO: 3584319 - RNA, 18 nt, Human
ugggggucaggcagccag

SEQ ID NO: 3584320 - RNA, 18 nt, Human
ugggggucuguguguuua

SEQ ID NO: 3584321 - RNA, 13 nt, Human
ugggggugggcca

SEQ ID NO: 3584322 - RNA, 16 nt, Human
ugggggugggccaggc

SEQ ID NO: 3584323 - RNA, 13 nt, Human
uggggguggguca

SEQ ID NO: 3584324 - RNA, 22 nt, Human
uggggguguucagccacugagg

SEQ ID NO: 3584325 - RNA, 12 nt, Human
uggggguugcug

SEQ ID NO: 3584326 - RNA, 18 nt, Human
uggggguuguaaauuggc

SEQ ID NO: 3584327 - RNA, 17 nt, Human
ugggguacccacugcuc

SEQ ID NO: 3584328 - RNA, 18 nt, Human
ugggguacccacugcucu

SEQ ID NO: 3584329 - RNA, 15 nt, Human
ugggguagguuggga

SEQ ID NO: 3584330 - RNA, 15 nt, Human
ugggguaugggagag

SEQ ID NO: 3584331 - RNA, 22 nt, Human
ugggguauuggacauagauauu

SEQ ID NO: 3584332 - RNA, 13 nt, Human
uggggucacucug

SEQ ID NO: 3584333 - RNA, 14 nt, Human
uggggucacucugg

SEQ ID NO: 3584334 - RNA, 19 nt, Human
uggggucacucuggcagcu

SEQ ID NO: 3584335 - RNA, 13 nt, Human
uggggucagccag

SEQ ID NO: 3584336 - RNA, 14 nt, Human
uggggucagccagg

SEQ ID NO: 3584337 - RNA, 18 nt, Human
uggggucagccagggcca

SEQ ID NO: 3584338 - RNA, 21 nt, Human
uggggucagccagggccaggg

SEQ ID NO: 3584339 - RNA, 20 nt, Human
uggggucaggccgggcagag

SEQ ID NO: 3584340 - RNA, 22 nt, Human
uggggucagguugacaggaggu

SEQ ID NO: 3584341 - RNA, 14 nt, Human
ugggguccagggag

SEQ ID NO: 3584342 - RNA, 10 nt, Human
uggggucucu

SEQ ID NO: 3584343 - RNA, 11 nt, Human
uggggugacag

SEQ ID NO: 3584344 - RNA, 16 nt, Human
ugucacucauugcuga

SEQ ID NO: 3584345 - RNA, 23 nt, Human
ugucacucauugcugagccucug

SEQ ID NO: 3584346 - RNA, 19 nt, Human
ugucacugacacaaaggaa

SEQ ID NO: 3584347 - RNA, 16 nt, Human
ugucacugcuuuuggc

SEQ ID NO: 3584348 - RNA, 19 nt, Human
ugucacugcuuuuggccug

SEQ ID NO: 3584349 - RNA, 15 nt, Human
ugucacugugguccu

SEQ ID NO: 3584350 - RNA, 14 nt, Human
ugucacuuacuguu

SEQ ID NO: 3584351 - RNA, 21 nt, Human
ugucacuuacuguuucuguca

SEQ ID NO: 3584352 - RNA, 12 nt, Human
ugucacuucugg

SEQ ID NO: 3584353 - RNA, 15 nt, Human
ugucacuugcauguc

SEQ ID NO: 3584354 - RNA, 14 nt, Human
ugucacuugugcuu

SEQ ID NO: 3584355 - RNA, 16 nt, Human
ugucacuuugcucugg

SEQ ID NO: 3584356 - RNA, 16 nt, Human
ugucacuuuuucugau

SEQ ID NO: 3584357 - RNA, 17 nt, Human
ugucacuuuuugaggca

SEQ ID NO: 3584358 - RNA, 19 nt, Human
ugucacuuuuugaggcaaa

SEQ ID NO: 3584359 - RNA, 14 nt, Human
ugucagacauaaag

SEQ ID NO: 3584360 - RNA, 16 nt, Human
ugucagacauaaagcc

SEQ ID NO: 3584361 - RNA, 17 nt, Human
ugucagacauaaagcca

SEQ ID NO: 3584362 - RNA, 20 nt, Human
ugucagacauaaagccaugu

SEQ ID NO: 3584363 - RNA, 13 nt, Human
ugucagacuggcu

SEQ ID NO: 3584364 - RNA, 14 nt, Human
ugucagagcuggga

SEQ ID NO: 3584365 - RNA, 20 nt, Human
ugucagauauuuuuucagaa

SEQ ID NO: 3584366 - RNA, 16 nt, Human
ugucagaugagaacaa

SEQ ID NO: 3584367 - RNA, 21 nt, Human
ugucagaugagaacaaagcug

SEQ ID NO: 3584368 - RNA, 11 nt, Human
ugucagauucc

SEQ ID NO: 3584369 - RNA, 18 nt, Human
ugucagcaaaaagcaaaa

SEQ ID NO: 3584370 - RNA, 15 nt, Human
ugucagcauagaagu

SEQ ID NO: 3584371 - RNA, 18 nt, Human
ugucagcaucuucucacu

SEQ ID NO: 3584372 - RNA, 20 nt, Human
ugucagccgagccgggccug

SEQ ID NO: 3584373 - RNA, 21 nt, Human
ugucagccgagccgggccugg

SEQ ID NO: 3584374 - RNA, 15 nt, Human
ugucagccgggcccu

SEQ ID NO: 3584375 - RNA, 22 nt, Human
ugucagccgggcccugaguaau

SEQ ID NO: 3584376 - RNA, 21 nt, Human
ugucagcgccuggccuaccca

SEQ ID NO: 3584377 - RNA, 20 nt, Human
ugucagcuaaagaaguuuga

SEQ ID NO: 3584378 - RNA, 20 nt, Human
ugucagcucucaucugaggc

SEQ ID NO: 3584379 - RNA, 19 nt, Human
ugucagcugaaccugggua

SEQ ID NO: 3584380 - RNA, 14 nt, Human
ugucagcugaggcu

SEQ ID NO: 3584381 - RNA, 22 nt, Human
ugucagcugcaagguacucugg

SEQ ID NO: 3584382 - RNA, 16 nt, Human
ugucaggaacagaagg

SEQ ID NO: 3584383 - RNA, 16 nt, Human
ugucaggagugugugu

SEQ ID NO: 3584384 - RNA, 21 nt, Human
ugucaggauugcgagagaugu

SEQ ID NO: 3584385 - RNA, 21 nt, Human
ugucaggccugacggggagga

SEQ ID NO: 3584386 - RNA, 11 nt, Human
ugucaggccuu

SEQ ID NO: 3584387 - RNA, 19 nt, Human
ugucagggcaguacaaugu

SEQ ID NO: 3584388 - RNA, 22 nt, Human
ugucaggggcggggagggugac

SEQ ID NO: 3584389 - RNA, 17 nt, Human
ugucaguacuauucagg

SEQ ID NO: 3584390 - RNA, 23 nt, Human
ugucaguauuucaguguaguuaa

SEQ ID NO: 3584391 - RNA, 15 nt, Human
ugucagucacagcca

SEQ ID NO: 3584392 - RNA, 14 nt, Human
ugucagucacuaaa

SEQ ID NO: 3584393 - RNA, 17 nt, Human
ugucagucugcuuagaa

SEQ ID NO: 3584394 - RNA, 19 nt, Human
ugucagucugcuuagaaau

SEQ ID NO: 3584395 - RNA, 20 nt, Human
ugucagucugcuuagaaaua

SEQ ID NO: 3584396 - RNA, 14 nt, Human
ugucagugcagccc

SEQ ID NO: 3584397 - RNA, 13 nt, Human
ugucagugccgcc

SEQ ID NO: 3584398 - RNA, 18 nt, Human
ugucaguggggcucucug

SEQ ID NO: 3584399 - RNA, 19 nt, Human
ugucaguggggcucucuga

SEQ ID NO: 3584400 - RNA, 15 nt, Human
ugucagugugacuga

SEQ ID NO: 3584401 - RNA, 19 nt, Human
ugucagugugacugaucuc

SEQ ID NO: 3584402 - RNA, 14 nt, Human
ugucaguguuuggu

SEQ ID NO: 3584403 - RNA, 18 nt, Human
ugucauaaacagaugaau

SEQ ID NO: 3584404 - RNA, 22 nt, Human
ugucauaaagugagaaaacugu

SEQ ID NO: 3584405 - RNA, 14 nt, Human
ugucauaagaauga

SEQ ID NO: 3584406 - RNA, 17 nt, Human
ugucauaagaaugaaua

SEQ ID NO: 3584407 - RNA, 16 nt, Human
ugucauagaaauuaca

SEQ ID NO: 3584408 - RNA, 13 nt, Human
ugucauagccagu

SEQ ID NO: 3584409 - RNA, 17 nt, Human
ugucauauacugccaug

SEQ ID NO: 3584410 - RNA, 20 nt, Human
ugucauauauggggggccaa

SEQ ID NO: 3584411 - RNA, 21 nt, Human
ugucauauguaggugucugca

SEQ ID NO: 3584412 - RNA, 15 nt, Human
ugucaucaauugaau

SEQ ID NO: 3584413 - RNA, 13 nt, Human
ugucaucagaacu

SEQ ID NO: 3584414 - RNA, 15 nt, Human
ugucaucagaagaua

SEQ ID NO: 3584415 - RNA, 16 nt, Human
ugucaucagaagauaa

SEQ ID NO: 3584416 - RNA, 19 nt, Human
ugucaucagagcuccucug

SEQ ID NO: 3584417 - RNA, 20 nt, Human
ugucaucagagcuccucugu

SEQ ID NO: 3584418 - RNA, 15 nt, Human
ugucaucagccacca

SEQ ID NO: 3584419 - RNA, 18 nt, Human
ugucaucaucauggccag

SEQ ID NO: 3584420 - RNA, 21 nt, Human
ugucaucaucauggccagcug

SEQ ID NO: 3584421 - RNA, 18 nt, Human
ugucaucauuguauauau

SEQ ID NO: 3584422 - RNA, 22 nt, Human
ugucaucauuguauauaugugu

SEQ ID NO: 3584423 - RNA, 20 nt, Human
ugucauccucaaagaaagug

SEQ ID NO: 3584424 - RNA, 14 nt, Human
ugucauccucacag

SEQ ID NO: 3584425 - RNA, 20 nt, Human
ugucauccuuggucuuugua

SEQ ID NO: 3584426 - RNA, 13 nt, Human
ugucaucucagcu

SEQ ID NO: 3584427 - RNA, 20 nt, Human
ugucaucugaauuugcccug

SEQ ID NO: 3584428 - RNA, 14 nt, Human
ugucaucugagaau

SEQ ID NO: 3584429 - RNA, 16 nt, Human
ugucaucugagaauga

SEQ ID NO: 3584430 - RNA, 12 nt, Human
ugucaugaacau

SEQ ID NO: 3584431 - RNA, 21 nt, Human
ugucaugaauucuuaugcuua

SEQ ID NO: 3584432 - RNA, 17 nt, Human
ugucaugccccccucaa

SEQ ID NO: 3584433 - RNA, 23 nt, Human
ugucaugccccccucaaaccucc

SEQ ID NO: 3584434 - RNA, 13 nt, Human
ugucaugcugccu

SEQ ID NO: 3584435 - RNA, 16 nt, Human
ugucaugcugggauuu

SEQ ID NO: 3584436 - RNA, 17 nt, Human
ugucaugcuucaucauu

SEQ ID NO: 3584437 - RNA, 14 nt, Human
ugucauguguauaa

SEQ ID NO: 3584438 - RNA, 13 nt, Human
ugucauuaaaaua

SEQ ID NO: 3584439 - RNA, 18 nt, Human
ugucauuaaaauaaauaa

SEQ ID NO: 3584440 - RNA, 14 nt, Human
ugucauuaaugugu

SEQ ID NO: 3584441 - RNA, 15 nt, Human
ugucauuaauguguu

SEQ ID NO: 3584442 - RNA, 20 nt, Human
ugucauuagccugaguagaa

SEQ ID NO: 3584443 - RNA, 21 nt, Human
ugucauuagccugaguagaaa

SEQ ID NO: 3584444 - RNA, 22 nt, Human
ugucauucagagucagccagga

SEQ ID NO: 3584445 - RNA, 13 nt, Human
ugucauugcuucu

SEQ ID NO: 3584446 - RNA, 18 nt, Human
ugucauugcuucuucuga

SEQ ID NO: 3584447 - RNA, 23 nt, Human
ugucauuguuauauaaucauuau

SEQ ID NO: 3584448 - RNA, 20 nt, Human
ugucauuuaguucagcaucc

SEQ ID NO: 3584449 - RNA, 16 nt, Human
ugucauuuauauagau

SEQ ID NO: 3584450 - RNA, 18 nt, Human
ugucauuucauguccugu

SEQ ID NO: 3584451 - RNA, 16 nt, Human
ugucauuugagcaggg

SEQ ID NO: 3584452 - RNA, 22 nt, Human
ugucauuugagcagggcucagc

SEQ ID NO: 3584453 - RNA, 19 nt, Human
ugucauuuucauuagcaaa

SEQ ID NO: 3584454 - RNA, 17 nt, Human
ugucauuuugaagcuaa

SEQ ID NO: 3584455 - RNA, 18 nt, Human
ugucauuuugaagcuaau

SEQ ID NO: 3584456 - RNA, 22 nt, Human
ugucauuuugaagcuaauuauu

SEQ ID NO: 3584457 - RNA, 18 nt, Human
ugucauuuuugcaguaga

SEQ ID NO: 3584458 - RNA, 16 nt, Human
uguccaaaaccgccag

SEQ ID NO: 3584459 - RNA, 18 nt, Human
uguccaaaaccgccagcu

SEQ ID NO: 3584460 - RNA, 23 nt, Human
uguccaaaaccgccagcucuguu

SEQ ID NO: 3584461 - RNA, 16 nt, Human
uguccaaaacugccuc

SEQ ID NO: 3584462 - RNA, 21 nt, Human
uguccaaacguccucuuuagu

SEQ ID NO: 3584463 - RNA, 22 nt, Human
uguccaaacugccuaagcccuc

SEQ ID NO: 3584464 - RNA, 21 nt, Human
uguccaaagaggcugccccuc

SEQ ID NO: 3584465 - RNA, 12 nt, Human
uguccaaagcag

SEQ ID NO: 3584466 - RNA, 19 nt, Human
uguccaaagcagggucugg

SEQ ID NO: 3584467 - RNA, 14 nt, Human
uguccaagaagccc

SEQ ID NO: 3584468 - RNA, 17 nt, Human
uguccaagugugugugc

SEQ ID NO: 3584469 - RNA, 18 nt, Human
uguccaagugugugugcg

SEQ ID NO: 3584470 - RNA, 14 nt, Human
uguccaauccuaug

SEQ ID NO: 3584471 - RNA, 18 nt, Human
uguccacaggcuucugag

SEQ ID NO: 3584472 - RNA, 17 nt, Human
uguccacccccgccucc

SEQ ID NO: 3584473 - RNA, 12 nt, Human
uguccaccuggc

SEQ ID NO: 3584474 - RNA, 13 nt, Human
uguccaccuggcc

SEQ ID NO: 3584475 - RNA, 15 nt, Human
uguccaccugugggu

SEQ ID NO: 3584476 - RNA, 18 nt, Human
uguccacgacugucucca

SEQ ID NO: 3584477 - RNA, 15 nt, Human
uguccagaagaauau

SEQ ID NO: 3584478 - RNA, 21 nt, Human
uguccagacagagcccuguga

SEQ ID NO: 3584479 - RNA, 13 nt, Human
uguccagagacaa

SEQ ID NO: 3584480 - RNA, 22 nt, Human
uguccagcaccuugugccuggg

SEQ ID NO: 3584481 - RNA, 15 nt, Human
uguccagcagucacu

SEQ ID NO: 3584482 - RNA, 22 nt, Human
uguccagccugggcagccaggc

SEQ ID NO: 3584483 - RNA, 23 nt, Human
uguccagccugggcagccaggcu

SEQ ID NO: 3584484 - RNA, 14 nt, Human
uguccagcgccuag

SEQ ID NO: 3584485 - RNA, 11 nt, Human
uguccagcucc

SEQ ID NO: 3584486 - RNA, 21 nt, Human
uguccaggcacugcugcccag

SEQ ID NO: 3584487 - RNA, 22 nt, Human
uguccaguaagaucacuguuua

SEQ ID NO: 3584488 - RNA, 15 nt, Human
uguccagugcccauu

SEQ ID NO: 3584489 - RNA, 19 nt, Human
ugucuggacauucagaaca

SEQ ID NO: 3584490 - RNA, 11 nt, Human
ugucuggagac

SEQ ID NO: 3584491 - RNA, 20 nt, Human
ugucuggagaccaccagggc

SEQ ID NO: 3584492 - RNA, 17 nt, Human
ugucuggcacagccugg

SEQ ID NO: 3584493 - RNA, 16 nt, Human
ugucuggcugcagagc

SEQ ID NO: 3584494 - RNA, 11 nt, Human
ugucugggcug

SEQ ID NO: 3584495 - RNA, 21 nt, Human
ugucugggugcuacuggggaa

SEQ ID NO: 3584496 - RNA, 16 nt, Human
ugucugguggccccgu

SEQ ID NO: 3584497 - RNA, 23 nt, Human
ugucugguucucaauuccaacag

SEQ ID NO: 3584498 - RNA, 15 nt, Human
ugucugguuuuaaca

SEQ ID NO: 3584499 - RNA, 18 nt, Human
ugucuguaaaagagccua

SEQ ID NO: 3584500 - RNA, 18 nt, Human
ugucuguaaaucuaacau

SEQ ID NO: 3584501 - RNA, 16 nt, Human
ugucuguagagggccc

SEQ ID NO: 3584502 - RNA, 20 nt, Human
ugucuguagagggcccuggu

SEQ ID NO: 3584503 - RNA, 23 nt, Human
ugucuguagcuccucaacucacc

SEQ ID NO: 3584504 - RNA, 16 nt, Human
ugucugucccgggguc

SEQ ID NO: 3584505 - RNA, 16 nt, Human
ugucugucugucuguc

SEQ ID NO: 3584506 - RNA, 12 nt, Human
ugucugucuucc

SEQ ID NO: 3584507 - RNA, 20 nt, Human
ugucugugacuuuugugaaa

SEQ ID NO: 3584508 - RNA, 21 nt, Human
ugucugugcuagggaaacuuc

SEQ ID NO: 3584509 - RNA, 21 nt, Human
ugucuguucuacauagaugcu

SEQ ID NO: 3584510 - RNA, 19 nt, Human
ugucuguuuguuucaagaa

SEQ ID NO: 3584511 - RNA, 21 nt, Human
ugucuuaaaaccugcuuuuca

SEQ ID NO: 3584512 - RNA, 18 nt, Human
ugucuuaauggaugaaau

SEQ ID NO: 3584513 - RNA, 19 nt, Human
ugucuuaauggaugaaauc

SEQ ID NO: 3584514 - RNA, 14 nt, Human
ugucuuaauuaaaa

SEQ ID NO: 3584515 - RNA, 20 nt, Human
ugucuuaauuaaguaaacua

SEQ ID NO: 3584516 - RNA, 14 nt, Human
ugucuuaauuauua

SEQ ID NO: 3584517 - RNA, 22 nt, Human
ugucuuauauauauuucuuugu

SEQ ID NO: 3584518 - RNA, 16 nt, Human
ugucuuaucuggcccu

SEQ ID NO: 3584519 - RNA, 19 nt, Human
ugucuuauugacaguugug

SEQ ID NO: 3584520 - RNA, 14 nt, Human
ugucuuauuuuuag

SEQ ID NO: 3584521 - RNA, 15 nt, Human
ugucuuauuuuuaga

SEQ ID NO: 3584522 - RNA, 16 nt, Human
ugucuuauuuuuagau

SEQ ID NO: 3584523 - RNA, 23 nt, Human
ugucuuauuuuuagaugguuaca

SEQ ID NO: 3584524 - RNA, 17 nt, Human
ugucuucaacagcuccc

SEQ ID NO: 3584525 - RNA, 13 nt, Human
ugucuucaaggcu

SEQ ID NO: 3584526 - RNA, 19 nt, Human
ugucuucacagcucugugu

SEQ ID NO: 3584527 - RNA, 15 nt, Human
ugucuucauagcaga

SEQ ID NO: 3584528 - RNA, 17 nt, Human
ugucuucauuucauugu

SEQ ID NO: 3584529 - RNA, 14 nt, Human
ugucuuccauaaug

SEQ ID NO: 3584530 - RNA, 16 nt, Human
ugucuuccauaaugua

SEQ ID NO: 3584531 - RNA, 14 nt, Human
ugucuucccagggu

SEQ ID NO: 3584532 - RNA, 11 nt, Human
ugucuuccuca

SEQ ID NO: 3584533 - RNA, 13 nt, Human
ugucuuccugcau

SEQ ID NO: 3584534 - RNA, 18 nt, Human
ugucuuccugcauucacc

SEQ ID NO: 3584535 - RNA, 14 nt, Human
ugucuuccuguggg

SEQ ID NO: 3584536 - RNA, 19 nt, Human
ugucuucggaaaccuuggu

SEQ ID NO: 3584537 - RNA, 22 nt, Human
ugucuucucaggcucugcccug

SEQ ID NO: 3584538 - RNA, 17 nt, Human
ugucuucucccugcaca

SEQ ID NO: 3584539 - RNA, 14 nt, Human
ugucuucucugucu

SEQ ID NO: 3584540 - RNA, 16 nt, Human
ugucuucucugucuca

SEQ ID NO: 3584541 - RNA, 22 nt, Human
ugucuucucugucucagacuuu

SEQ ID NO: 3584542 - RNA, 13 nt, Human
ugucuucugcuuu

SEQ ID NO: 3584543 - RNA, 15 nt, Human
ugucuucugcuuugu

SEQ ID NO: 3584544 - RNA, 13 nt, Human
ugucuucuguaua

SEQ ID NO: 3584545 - RNA, 19 nt, Human
ugucuugagcucuauuaug

SEQ ID NO: 3584546 - RNA, 20 nt, Human
ugucuugcaauggcagccuu

SEQ ID NO: 3584547 - RNA, 19 nt, Human
ugucuugcacuggccuucu

SEQ ID NO: 3584548 - RNA, 22 nt, Human
ugucuugcacuggccuucugau

SEQ ID NO: 3584549 - RNA, 15 nt, Human
ugucuuggacacugu

SEQ ID NO: 3584550 - RNA, 19 nt, Human
ugucuuggcuuucauguua

SEQ ID NO: 3584551 - RNA, 17 nt, Human
ugucuugguacuugcug

SEQ ID NO: 3584552 - RNA, 15 nt, Human
ugucuuguaagcaaa

SEQ ID NO: 3584553 - RNA, 18 nt, Human
ugucuuguaauauuuugu

SEQ ID NO: 3584554 - RNA, 13 nt, Human
ugucuuguacaug

SEQ ID NO: 3584555 - RNA, 15 nt, Human
ugucuuguguuucuu

SEQ ID NO: 3584556 - RNA, 19 nt, Human
ugucuuguuaauauucuuu

SEQ ID NO: 3584557 - RNA, 22 nt, Human
ugucuuuaaaaacuguuuuaga

SEQ ID NO: 3584558 - RNA, 22 nt, Human
ugucuuuaaaaguauccagaga

SEQ ID NO: 3584559 - RNA, 14 nt, Human
ugucuuuaaugcaa

SEQ ID NO: 3584560 - RNA, 15 nt, Human
ugucuuuaauucugu

SEQ ID NO: 3584561 - RNA, 17 nt, Human
ugucuuuagauagcccu

SEQ ID NO: 3584562 - RNA, 18 nt, Human
ugucuuuagauagcccug

SEQ ID NO: 3584563 - RNA, 21 nt, Human
ugucuuuaggcagcagcuuuu

SEQ ID NO: 3584564 - RNA, 19 nt, Human
ugucuuucagauacauggu

SEQ ID NO: 3584565 - RNA, 13 nt, Human
ugucuuuccuaga

SEQ ID NO: 3584566 - RNA, 17 nt, Human
ugucuuucuaagaaauc

SEQ ID NO: 3584567 - RNA, 19 nt, Human
ugucuuucuccaaaguuau

SEQ ID NO: 3584568 - RNA, 14 nt, Human
ugucuuucuuuggu

SEQ ID NO: 3584569 - RNA, 20 nt, Human
ugucuuucuuuggugccuuu

SEQ ID NO: 3584570 - RNA, 21 nt, Human
ugucuuuggaaaaauguuugu

SEQ ID NO: 3584571 - RNA, 17 nt, Human
ugucuuuggacccugag

SEQ ID NO: 3584572 - RNA, 22 nt, Human
ugucuuuuauaguggaaaaaca

SEQ ID NO: 3584573 - RNA, 15 nt, Human
ugucuuuuauauuug

SEQ ID NO: 3584574 - RNA, 17 nt, Human
ugucuuuuaugcagaua

SEQ ID NO: 3584575 - RNA, 19 nt, Human
ugucuuuuaugcagauaga

SEQ ID NO: 3584576 - RNA, 20 nt, Human
ugucuuuuaugcagauagaa

SEQ ID NO: 3584577 - RNA, 20 nt, Human
ugucuuuucccauuuaucua

SEQ ID NO: 3584578 - RNA, 23 nt, Human
ugucuuuucuugcaugaggcuag

SEQ ID NO: 3584579 - RNA, 15 nt, Human
ugucuuuucuuggca

SEQ ID NO: 3584580 - RNA, 13 nt, Human
ugucuuuuggagg

SEQ ID NO: 3584581 - RNA, 21 nt, Human
ugucuuuuuauuaaaauauuu

SEQ ID NO: 3584582 - RNA, 17 nt, Human
ugucuuuuucuggacug

SEQ ID NO: 3584583 - RNA, 20 nt, Human
ugucuuuuucuggacugaag

SEQ ID NO: 3584584 - RNA, 22 nt, Human
ugucuuuuuuuguauaguuaac

SEQ ID NO: 3584585 - RNA, 21 nt, Human
ugucuuuuuuuuaaugugcug

SEQ ID NO: 3584586 - RNA, 13 nt, Human
ugugaaaagaaaa

SEQ ID NO: 3584587 - RNA, 17 nt, Human
ugugaaaagaaaaauga

SEQ ID NO: 3584588 - RNA, 21 nt, Human
ugugaaaagaaaaaugagccu

SEQ ID NO: 3584589 - RNA, 22 nt, Human
ugugaaaaugguccaggagaag

SEQ ID NO: 3584590 - RNA, 15 nt, Human
ugugaaacacagcug

SEQ ID NO: 3584591 - RNA, 17 nt, Human
ugugaaacacagcuguu

SEQ ID NO: 3584592 - RNA, 13 nt, Human
ugugaaacauguu

SEQ ID NO: 3584593 - RNA, 14 nt, Human
ugugaaaccuguga

SEQ ID NO: 3584594 - RNA, 15 nt, Human
ugugaaacuuucauu

SEQ ID NO: 3584595 - RNA, 13 nt, Human
ugugaaaggaaag

SEQ ID NO: 3584596 - RNA, 14 nt, Human
ugugaaaggaaaga

SEQ ID NO: 3584597 - RNA, 18 nt, Human
ugugaaaggaaagaggcu

SEQ ID NO: 3584598 - RNA, 21 nt, Human
ugugaaauaaaacuggcuuug

SEQ ID NO: 3584599 - RNA, 14 nt, Human
ugugaaauguaacu

SEQ ID NO: 3584600 - RNA, 17 nt, Human
ugugaaauuuuucauau

SEQ ID NO: 3584601 - RNA, 15 nt, Human
ugugaacagagagac

SEQ ID NO: 3584602 - RNA, 23 nt, Human
ugugaacagagagacccuugugg

SEQ ID NO: 3584603 - RNA, 15 nt, Human
ugugaacagcggcug

SEQ ID NO: 3584604 - RNA, 20 nt, Human
ugugaacaguuguguuugaa

SEQ ID NO: 3584605 - RNA, 16 nt, Human
ugugaaccaccacacc

SEQ ID NO: 3584606 - RNA, 17 nt, Human
ugugaaccaccacaccc

SEQ ID NO: 3584607 - RNA, 19 nt, Human
ugugaaccaccacacccag

SEQ ID NO: 3584608 - RNA, 21 nt, Human
ugugaaccaccacacccagcc

SEQ ID NO: 3584609 - RNA, 22 nt, Human
ugugaaccaccacacccagccc

SEQ ID NO: 3584610 - RNA, 15 nt, Human
ugugaacccaggaca

SEQ ID NO: 3584611 - RNA, 21 nt, Human
ugugaaccccacgaaggagcc

SEQ ID NO: 3584612 - RNA, 17 nt, Human
ugugaaccgaggggcuc

SEQ ID NO: 3584613 - RNA, 20 nt, Human
ugugaacuaaacuuucacac

SEQ ID NO: 3584614 - RNA, 14 nt, Human
ugugaacuauguuu

SEQ ID NO: 3584615 - RNA, 15 nt, Human
ugugaacucagccaa

SEQ ID NO: 3584616 - RNA, 16 nt, Human
ugugaacucagccaag

SEQ ID NO: 3584617 - RNA, 18 nt, Human
ugugaacucagccaagca

SEQ ID NO: 3584618 - RNA, 20 nt, Human
ugugaacucagccaagcaca

SEQ ID NO: 3584619 - RNA, 14 nt, Human
ugugaacugaaauu

SEQ ID NO: 3584620 - RNA, 23 nt, Human
ugugaacugaacucugacaacag

SEQ ID NO: 3584621 - RNA, 21 nt, Human
ugugaacuggacccuguugcu

SEQ ID NO: 3584622 - RNA, 14 nt, Human
ugugaacuugaaau

SEQ ID NO: 3584623 - RNA, 16 nt, Human
ugugaacuugaaauuu

SEQ ID NO: 3584624 - RNA, 15 nt, Human
ugugaacuuggaagc

SEQ ID NO: 3584625 - RNA, 20 nt, Human
ugugaacuuguagcuguaaa

SEQ ID NO: 3584626 - RNA, 22 nt, Human
ugugaagaucacguuccuuccc

SEQ ID NO: 3584627 - RNA, 16 nt, Human
ugugaagauguuugca

SEQ ID NO: 3584628 - RNA, 20 nt, Human
ugugaagccaauucagacag

SEQ ID NO: 3584629 - RNA, 21 nt, Human
ugugaagccaauucagacagg

SEQ ID NO: 3584630 - RNA, 23 nt, Human
ugugaagccaugaguuccagaaa

SEQ ID NO: 3584631 - RNA, 17 nt, Human
ugugaagcccuguugug

SEQ ID NO: 3584632 - RNA, 12 nt, Human
ugugaagccuuc

SEQ ID NO: 3584633 - RNA, 16 nt, Human
uuccgugcguggcacu

SEQ ID NO: 3584634 - RNA, 17 nt, Human
uuccguguccaccccca

SEQ ID NO: 3584635 - RNA, 22 nt, Human
uuccguuugauuugucacugcu

SEQ ID NO: 3584636 - RNA, 21 nt, Human
uuccuaaauauauuuuaagac

SEQ ID NO: 3584637 - RNA, 16 nt, Human
uuccuaaauauuauga

SEQ ID NO: 3584638 - RNA, 16 nt, Human
uuccuaaaugcaguga

SEQ ID NO: 3584639 - RNA, 18 nt, Human
uuccuaacacagcaugug

SEQ ID NO: 3584640 - RNA, 19 nt, Human
uuccuaacacagcaugugu

SEQ ID NO: 3584641 - RNA, 18 nt, Human
uuccuaagaagcuucuaa

SEQ ID NO: 3584642 - RNA, 19 nt, Human
uuccuaagccuguggcugu

SEQ ID NO: 3584643 - RNA, 17 nt, Human
uuccuaaguucuuagau

SEQ ID NO: 3584644 - RNA, 16 nt, Human
uuccuaauaucaaaug

SEQ ID NO: 3584645 - RNA, 20 nt, Human
uuccuaaucacucagagcag

SEQ ID NO: 3584646 - RNA, 20 nt, Human
uuccuaaucagaaauuuuua

SEQ ID NO: 3584647 - RNA, 14 nt, Human
uuccuaauuuuagu

SEQ ID NO: 3584648 - RNA, 23 nt, Human
uuccuaauuuuagugacagcucu

SEQ ID NO: 3584649 - RNA, 17 nt, Human
uuccuacagauagucaa

SEQ ID NO: 3584650 - RNA, 17 nt, Human
uuccuacaggcagucuc

SEQ ID NO: 3584651 - RNA, 20 nt, Human
uuccuacaggcagucucucu

SEQ ID NO: 3584652 - RNA, 21 nt, Human
uuccuaccacccgguccccac

SEQ ID NO: 3584653 - RNA, 23 nt, Human
uuccuacccacuuaggcuuugua

SEQ ID NO: 3584654 - RNA, 15 nt, Human
uuccuacccugccuc

SEQ ID NO: 3584655 - RNA, 23 nt, Human
uuccuacguaggaugaaaagauu

SEQ ID NO: 3584656 - RNA, 17 nt, Human
uuccuacucuucucucu

SEQ ID NO: 3584657 - RNA, 18 nt, Human
uuccuacucuucucucug

SEQ ID NO: 3584658 - RNA, 19 nt, Human
uuccuacucuucucucugc

SEQ ID NO: 3584659 - RNA, 19 nt, Human
uuccuacuuuuccuucccu

SEQ ID NO: 3584660 - RNA, 22 nt, Human
uuccuagaaguuacugaaugca

SEQ ID NO: 3584661 - RNA, 19 nt, Human
uuccuagagaagacaggcu

SEQ ID NO: 3584662 - RNA, 17 nt, Human
uuccuagauaaaaagau

SEQ ID NO: 3584663 - RNA, 21 nt, Human
uuccuagccaccgccuccuac

SEQ ID NO: 3584664 - RNA, 14 nt, Human
uuccuagcccucuc

SEQ ID NO: 3584665 - RNA, 13 nt, Human
uuccuagccuguu

SEQ ID NO: 3584666 - RNA, 22 nt, Human
uuccuagcuggagaggagcccu

SEQ ID NO: 3584667 - RNA, 16 nt, Human
uuccuaguucuguaga

SEQ ID NO: 3584668 - RNA, 17 nt, Human
uuccuaguucuguagaa

SEQ ID NO: 3584669 - RNA, 19 nt, Human
uuccuauaacuugaugcau

SEQ ID NO: 3584670 - RNA, 21 nt, Human
uuccuauaacuugaugcaugu

SEQ ID NO: 3584671 - RNA, 20 nt, Human
uuccuauaauauaauaaaua

SEQ ID NO: 3584672 - RNA, 19 nt, Human
uuccuauacgcagcgugcu

SEQ ID NO: 3584673 - RNA, 16 nt, Human
uuccuaucccauccca

SEQ ID NO: 3584674 - RNA, 17 nt, Human
uuccuaucccaucccau

SEQ ID NO: 3584675 - RNA, 21 nt, Human
uuccuaugauguauacugcca

SEQ ID NO: 3584676 - RNA, 14 nt, Human
uuccuaugcuuuga

SEQ ID NO: 3584677 - RNA, 20 nt, Human
uuccuauugugauuugacug

SEQ ID NO: 3584678 - RNA, 21 nt, Human
uuccuauugugauuugacugu

SEQ ID NO: 3584679 - RNA, 22 nt, Human
uuccuauugugauuugacuguu

SEQ ID NO: 3584680 - RNA, 22 nt, Human
uuccuauuucaguguuaccugu

SEQ ID NO: 3584681 - RNA, 20 nt, Human
uuccuauuugccaugggcuu

SEQ ID NO: 3584682 - RNA, 22 nt, Human
uuccuauuuuuaaauaauuucc

SEQ ID NO: 3584683 - RNA, 18 nt, Human
uuccucaaagcuuggauu

SEQ ID NO: 3584684 - RNA, 15 nt, Human
uuccucaaauguuga

SEQ ID NO: 3584685 - RNA, 20 nt, Human
uuccucaaauuuuuugacuu

SEQ ID NO: 3584686 - RNA, 21 nt, Human
uuccucacaccaggcuugccu

SEQ ID NO: 3584687 - RNA, 14 nt, Human
uuccucagccagcc

SEQ ID NO: 3584688 - RNA, 16 nt, Human
uuccucagccagccuc

SEQ ID NO: 3584689 - RNA, 19 nt, Human
uuccucagcuuaucucuuu

SEQ ID NO: 3584690 - RNA, 23 nt, Human
uuccucauaguaugguggcuggg

SEQ ID NO: 3584691 - RNA, 16 nt, Human
uuccucauccucagau

SEQ ID NO: 3584692 - RNA, 19 nt, Human
uuccucauccucagaugcu

SEQ ID NO: 3584693 - RNA, 15 nt, Human
uuccucaucugucca

SEQ ID NO: 3584694 - RNA, 14 nt, Human
uuccucaugaaugu

SEQ ID NO: 3584695 - RNA, 17 nt, Human
uuccucaugaauguaaa

SEQ ID NO: 3584696 - RNA, 22 nt, Human
uuccucaugaauguaaauuugu

SEQ ID NO: 3584697 - RNA, 15 nt, Human
uuccuccacauccuu

SEQ ID NO: 3584698 - RNA, 17 nt, Human
uuccuccacauccuuuc

SEQ ID NO: 3584699 - RNA, 13 nt, Human
uuccuccauccua

SEQ ID NO: 3584700 - RNA, 14 nt, Human
uuccuccauccucc

SEQ ID NO: 3584701 - RNA, 22 nt, Human
uuccuccauccuccuccuuccu

SEQ ID NO: 3584702 - RNA, 20 nt, Human
uuccucccaaguggugccua

SEQ ID NO: 3584703 - RNA, 14 nt, Human
uuccuccccagcag

SEQ ID NO: 3584704 - RNA, 23 nt, Human
uuccuccccauuagagucagccu

SEQ ID NO: 3584705 - RNA, 14 nt, Human
uuccucccuucugc

SEQ ID NO: 3584706 - RNA, 15 nt, Human
uuccucccuucugcu

SEQ ID NO: 3584707 - RNA, 16 nt, Human
uuccucccuucugcua

SEQ ID NO: 3584708 - RNA, 18 nt, Human
uuccucccuucugcuacu

SEQ ID NO: 3584709 - RNA, 13 nt, Human
uuccuccucaggc

SEQ ID NO: 3584710 - RNA, 20 nt, Human
uuccuccucaggcacacagc

SEQ ID NO: 3584711 - RNA, 15 nt, Human
uuccuccuccaccac

SEQ ID NO: 3584712 - RNA, 19 nt, Human
uuccuccuccaccaccgcc

SEQ ID NO: 3584713 - RNA, 19 nt, Human
uuccuccugacaccccacu

SEQ ID NO: 3584714 - RNA, 11 nt, Human
uuccuccugga

SEQ ID NO: 3584715 - RNA, 13 nt, Human
uuccuccuggaaa

SEQ ID NO: 3584716 - RNA, 14 nt, Human
uuccuccuggcaga

SEQ ID NO: 3584717 - RNA, 15 nt, Human
uuccuccugggcccu

SEQ ID NO: 3584718 - RNA, 23 nt, Human
uuccuccugggcccucucugcuc

SEQ ID NO: 3584719 - RNA, 14 nt, Human
uuccuccuuuauca

SEQ ID NO: 3584720 - RNA, 18 nt, Human
uuccucgcagagaggcca

SEQ ID NO: 3584721 - RNA, 23 nt, Human
uuccucuagugcccuccacagcc

SEQ ID NO: 3584722 - RNA, 17 nt, Human
uuccucucacuaaacuu

SEQ ID NO: 3584723 - RNA, 19 nt, Human
uuccucucacuaaacuuua

SEQ ID NO: 3584724 - RNA, 23 nt, Human
uuccucucauccuuuucuccuau

SEQ ID NO: 3584725 - RNA, 12 nt, Human
uuccucuccacu

SEQ ID NO: 3584726 - RNA, 15 nt, Human
uuccucuccacugcc

SEQ ID NO: 3584727 - RNA, 22 nt, Human
uuccucuccuucguaucccgag

SEQ ID NO: 3584728 - RNA, 16 nt, Human
uuccucucuauauuuc

SEQ ID NO: 3584729 - RNA, 21 nt, Human
uuccucucuuuguucucagcu

SEQ ID NO: 3584730 - RNA, 22 nt, Human
uuccucucuuuguucucagcuc

SEQ ID NO: 3584731 - RNA, 19 nt, Human
uuccucugcagcugaccuc

SEQ ID NO: 3584732 - RNA, 16 nt, Human
uuccucugcuaaauug

SEQ ID NO: 3584733 - RNA, 14 nt, Human
uuccucugcucacc

SEQ ID NO: 3584734 - RNA, 12 nt, Human
uuccucugcucc

SEQ ID NO: 3584735 - RNA, 21 nt, Human
uuccucugcucccccuuuucc

SEQ ID NO: 3584736 - RNA, 18 nt, Human
uuccucugucuccuaagc

SEQ ID NO: 3584737 - RNA, 21 nt, Human
uuccucuuagaagaauauugu

SEQ ID NO: 3584738 - RNA, 13 nt, Human
uuccucuucccca

SEQ ID NO: 3584739 - RNA, 19 nt, Human
uuccucuuccccuugcccu

SEQ ID NO: 3584740 - RNA, 20 nt, Human
uuccucuucuauuuuguaaa

SEQ ID NO: 3584741 - RNA, 17 nt, Human
uuccucuugacccugca

SEQ ID NO: 3584742 - RNA, 22 nt, Human
uuccucuuuccaucuacccucc

SEQ ID NO: 3584743 - RNA, 14 nt, Human
uuccucuuugcuuu

SEQ ID NO: 3584744 - RNA, 16 nt, Human
uuccucuuugcuuugc

SEQ ID NO: 3584745 - RNA, 16 nt, Human
uuccucuuuucucugc

SEQ ID NO: 3584746 - RNA, 21 nt, Human
uuccucuuuugugcugcuucu

SEQ ID NO: 3584747 - RNA, 22 nt, Human
uuccucuuuuuauuuaguuccu

SEQ ID NO: 3584748 - RNA, 18 nt, Human
uuccugaaacaacuugga

SEQ ID NO: 3584749 - RNA, 17 nt, Human
uuccugaaagaaacagu

SEQ ID NO: 3584750 - RNA, 15 nt, Human
uuccugaaaugcagu

SEQ ID NO: 3584751 - RNA, 12 nt, Human
uuccugaacagg

SEQ ID NO: 3584752 - RNA, 14 nt, Human
uuccugaaccaugu

SEQ ID NO: 3584753 - RNA, 15 nt, Human
uuccugaaccugaug

SEQ ID NO: 3584754 - RNA, 16 nt, Human
uuccugaagaaccagu

SEQ ID NO: 3584755 - RNA, 18 nt, Human
uuccugaagaauugaaaa

SEQ ID NO: 3584756 - RNA, 14 nt, Human
uuccugaagcugag

SEQ ID NO: 3584757 - RNA, 20 nt, Human
uuccugaauucuauuugcug

SEQ ID NO: 3584758 - RNA, 23 nt, Human
uuccugacccaggccgcagcucu

SEQ ID NO: 3584759 - RNA, 20 nt, Human
uuccugaccuccgccaucca

SEQ ID NO: 3584760 - RNA, 17 nt, Human
uuccugagacaaauuuu

SEQ ID NO: 3584761 - RNA, 16 nt, Human
uuccugagauuuccuc

SEQ ID NO: 3584762 - RNA, 22 nt, Human
uuccugaguuaggcuuucucuu

SEQ ID NO: 3584763 - RNA, 15 nt, Human
uuccugaugacccag

SEQ ID NO: 3584764 - RNA, 16 nt, Human
uuccugaugacccagg

SEQ ID NO: 3584765 - RNA, 18 nt, Human
uuccugaugacccaggcu

SEQ ID NO: 3584766 - RNA, 19 nt, Human
uuccugcaacucaaggacu

SEQ ID NO: 3584767 - RNA, 13 nt, Human
uuccugcaaugaa

SEQ ID NO: 3584768 - RNA, 21 nt, Human
uuccugcaaugaagucucuga

SEQ ID NO: 3584769 - RNA, 17 nt, Human
uuccugcaauuuucuaa

SEQ ID NO: 3584770 - RNA, 21 nt, Human
uuccugcaggccaggccagcu

SEQ ID NO: 3584771 - RNA, 17 nt, Human
uuccugccaggcauggu

SEQ ID NO: 3584772 - RNA, 23 nt, Human
uuccugccccaacuccuuccagc

SEQ ID NO: 3584773 - RNA, 17 nt, Human
uuccugccccucuuucu

SEQ ID NO: 3584774 - RNA, 20 nt, Human
uuccugccccucuuucucuu

SEQ ID NO: 3584775 - RNA, 21 nt, Human
uuccugccccucuuucucuuu

SEQ ID NO: 3584776 - RNA, 22 nt, Human
uuccugccccucuuucucuuuc

SEQ ID NO: 3584777 - RNA, 11 nt, Human
uuccugcccug

SEQ ID NO: 3584778 - RNA, 22 nt, Human
uuccugcccugggaggcaguga

SEQ ID NO: 3584779 - RNA, 17 nt, Human
uuccugcccuuccucag

SEQ ID NO: 3584780 - RNA, 18 nt, Human
uuccugccugucuccuuu

SEQ ID NO: 3584781 - RNA, 21 nt, Human
uuccugccuuggccucccaag

SEQ ID NO: 3584782 - RNA, 15 nt, Human
uuccugcguccuccu

SEQ ID NO: 3584783 - RNA, 11 nt, Human
uuccugcugcu

SEQ ID NO: 3584784 - RNA, 12 nt, Human
uuccugcugcug

SEQ ID NO: 3584785 - RNA, 17 nt, Human
uuccugcugcugucugg

SEQ ID NO: 3584786 - RNA, 16 nt, Human
uuccugcuuccucaga

SEQ ID NO: 3584787 - RNA, 22 nt, Human
uuccuggaauugccagcugaca

SEQ ID NO: 3584788 - RNA, 15 nt, Human
uuccuggacacucag

SEQ ID NO: 3584789 - RNA, 19 nt, Human
uuccuggacacucagaccu

SEQ ID NO: 3584790 - RNA, 17 nt, Human
uuccuggacagcugugc

SEQ ID NO: 3584791 - RNA, 19 nt, Human
uuccuggacagcugugccu

SEQ ID NO: 3584792 - RNA, 21 nt, Human
uuccuggacagcugugccucg

SEQ ID NO: 3584793 - RNA, 18 nt, Human
uuccuggacaggccaggu

SEQ ID NO: 3584794 - RNA, 24 nt, Human
uuccuggacauccucuucugcuua

SEQ ID NO: 3584795 - RNA, 19 nt, Human
uuccuggaggucagcauuu

SEQ ID NO: 3584796 - RNA, 15 nt, Human
uuccuggcaauagug

SEQ ID NO: 3584797 - RNA, 22 nt, Human
uuccuggcaauaguguguucug

SEQ ID NO: 3584798 - RNA, 19 nt, Human
uuccuggcacugcuuccag

SEQ ID NO: 3584799 - RNA, 21 nt, Human
uuccuggcacuggaccccagc

SEQ ID NO: 3584800 - RNA, 16 nt, Human
uuccugggaacaucac

SEQ ID NO: 3584801 - RNA, 19 nt, Human
uuccugggcacacgcugcu

SEQ ID NO: 3584802 - RNA, 22 nt, Human
uuccugggcacacgcugcucug

SEQ ID NO: 3584803 - RNA, 19 nt, Human
uuccuggggcauccauggg

SEQ ID NO: 3584804 - RNA, 16 nt, Human
uuccuggguggcuacu

SEQ ID NO: 3584805 - RNA, 22 nt, Human
uuccuggguggcuacucugugc

SEQ ID NO: 3584806 - RNA, 15 nt, Human
uuccugguacccagc

SEQ ID NO: 3584807 - RNA, 17 nt, Human
uuccugguacccagcca

SEQ ID NO: 3584808 - RNA, 14 nt, Human
uuccuggucuguag

SEQ ID NO: 3584809 - RNA, 15 nt, Human
uuccuggugcuggag

SEQ ID NO: 3584810 - RNA, 12 nt, Human
uuccuguacugu

SEQ ID NO: 3584811 - RNA, 22 nt, Human
uuccuguauuuguucccaagag

SEQ ID NO: 3584812 - RNA, 15 nt, Human
uuccugucccugcgc

SEQ ID NO: 3584813 - RNA, 21 nt, Human
uuccugucccugcgccuuucc

SEQ ID NO: 3584814 - RNA, 22 nt, Human
uuccugucccugcgccuuuccu

SEQ ID NO: 3584815 - RNA, 14 nt, Human
uuccuguccuccca

SEQ ID NO: 3584816 - RNA, 20 nt, Human
uuccuguccucuuucagcuc

SEQ ID NO: 3584817 - RNA, 24 nt, Human
uuccuguccuucucucaccuccua

SEQ ID NO: 3584818 - RNA, 14 nt, Human
uuccugucuuccug

SEQ ID NO: 3584819 - RNA, 17 nt, Human
uuccugugauccaccca

SEQ ID NO: 3584820 - RNA, 22 nt, Human
uuccugugauccacccaacccu

SEQ ID NO: 3584821 - RNA, 14 nt, Human
uuccugugcacagc

SEQ ID NO: 3584822 - RNA, 13 nt, Human
uuccuguggcucc

SEQ ID NO: 3584823 - RNA, 13 nt, Human
uuccugugucaau

SEQ ID NO: 3584824 - RNA, 21 nt, Human
uuccuguguguccaaaacugc

SEQ ID NO: 3584825 - RNA, 14 nt, Human
uuccuguucagcau

SEQ ID NO: 3584826 - RNA, 15 nt, Human
uuccuguucagcauu

SEQ ID NO: 3584827 - RNA, 13 nt, Human
uuccuguucugaa

SEQ ID NO: 3584828 - RNA, 22 nt, Human
uuccuguuguuauggaaacugu

SEQ ID NO: 3584829 - RNA, 15 nt, Human
uuccuguuucugaaa

SEQ ID NO: 3584830 - RNA, 22 nt, Human
uuccuguuuuguacauagauuu

SEQ ID NO: 3584831 - RNA, 23 nt, Human
uuccuguuuuucacauuuuccuu

SEQ ID NO: 3584832 - RNA, 15 nt, Human
uuccuuacccaaacu

SEQ ID NO: 3584833 - RNA, 21 nt, Human
uuccuuauuuuaagcauugug

SEQ ID NO: 3584834 - RNA, 20 nt, Human
uuccuucaaagcaaaugucu

SEQ ID NO: 3584835 - RNA, 15 nt, Human
uuccuucagauauuu

SEQ ID NO: 3584836 - RNA, 15 nt, Human
uuccuucagcuucca

SEQ ID NO: 3584837 - RNA, 15 nt, Human
uuccuucagggugau

SEQ ID NO: 3584838 - RNA, 11 nt, Human
uuccuucagug

SEQ ID NO: 3584839 - RNA, 15 nt, Human
uuccuucagugccuu

SEQ ID NO: 3584840 - RNA, 16 nt, Human
uuccuucagugccuua

SEQ ID NO: 3584841 - RNA, 14 nt, Human
uuccuucccaugga

SEQ ID NO: 3584842 - RNA, 21 nt, Human
uuccuucccugggcugugcua

SEQ ID NO: 3584843 - RNA, 15 nt, Human
uuccuuccuguucug

SEQ ID NO: 3584844 - RNA, 14 nt, Human
uuccuucucaucug

SEQ ID NO: 3584845 - RNA, 17 nt, Human
uuccuucucugaacaca

SEQ ID NO: 3584846 - RNA, 22 nt, Human
uuccuucucugaacacaggcag

SEQ ID NO: 3584847 - RNA, 14 nt, Human
uuccuucuggccuu

SEQ ID NO: 3584848 - RNA, 14 nt, Human
uuccuucuuugaua

SEQ ID NO: 3584849 - RNA, 15 nt, Human
uuccuucuuugcccu

SEQ ID NO: 3584850 - RNA, 13 nt, Human
uuccuugaagccg

SEQ ID NO: 3584851 - RNA, 14 nt, Human
uuccuugaagccga

SEQ ID NO: 3584852 - RNA, 15 nt, Human
uuccuugaccagcag

SEQ ID NO: 3584853 - RNA, 18 nt, Human
uuccuugaccuuccucug

SEQ ID NO: 3584854 - RNA, 22 nt, Human
uuccuugagacacggagcccag

SEQ ID NO: 3584855 - RNA, 22 nt, Human
uuccuugaggggagccaggagg

SEQ ID NO: 3584856 - RNA, 23 nt, Human
uuccuugaggggagccaggaggg

SEQ ID NO: 3584857 - RNA, 19 nt, Human
uuccuugccugcacaaacu

SEQ ID NO: 3584858 - RNA, 13 nt, Human
uuccuugcuaaug

SEQ ID NO: 3584859 - RNA, 13 nt, Human
uuccuugcucaac

SEQ ID NO: 3584860 - RNA, 15 nt, Human
uuccuugcucaacca

SEQ ID NO: 3584861 - RNA, 14 nt, Human
uuccuugcucuccc

SEQ ID NO: 3584862 - RNA, 23 nt, Human
uuccuuggauaggcuuuuuagua

SEQ ID NO: 3584863 - RNA, 15 nt, Human
uuccuuggcucccau

SEQ ID NO: 3584864 - RNA, 23 nt, Human
uuccuuggcucccauucacucuu

SEQ ID NO: 3584865 - RNA, 15 nt, Human
uuccuuggcuuuaug

SEQ ID NO: 3584866 - RNA, 17 nt, Human
uuccuuggggcaggcag

SEQ ID NO: 3584867 - RNA, 18 nt, Human
uuccuuggggcaggcagu

SEQ ID NO: 3584868 - RNA, 23 nt, Human
uuccuugguccuaguaagaagac

SEQ ID NO: 3584869 - RNA, 16 nt, Human
uuccuuguagccuuuu

SEQ ID NO: 3584870 - RNA, 17 nt, Human
uuccuuguccccacacu

SEQ ID NO: 3584871 - RNA, 21 nt, Human
uuccuuguuacccaugaaaaa

SEQ ID NO: 3584872 - RNA, 13 nt, Human
uuccuuuaaaaaa

SEQ ID NO: 3584873 - RNA, 17 nt, Human
uuccuuuaaaaaaauuu

SEQ ID NO: 3584874 - RNA, 23 nt, Human
uuccuuuaaaaaaauuuaagugc

SEQ ID NO: 3584875 - RNA, 18 nt, Human
uuccuuuaacaacauguu

SEQ ID NO: 3584876 - RNA, 21 nt, Human
uuccuuuaacaacauguuucc

SEQ ID NO: 3584877 - RNA, 22 nt, Human
uuccuuuaacaacauguuucca

SEQ ID NO: 3584878 - RNA, 13 nt, Human
uuccuuuacuuuc

SEQ ID NO: 3584879 - RNA, 15 nt, Human
uuccuuuacuuuccc

SEQ ID NO: 3584880 - RNA, 20 nt, Human
uuccuuuacuuucccuugcu

SEQ ID NO: 3584881 - RNA, 14 nt, Human
uuccuuuaugugaa

SEQ ID NO: 3584882 - RNA, 21 nt, Human
uuccuuucauuuacuguggcu

SEQ ID NO: 3584883 - RNA, 14 nt, Human
uuccuuuccccagc

SEQ ID NO: 3584884 - RNA, 17 nt, Human
uuccuuuccccagccca

SEQ ID NO: 3584885 - RNA, 16 nt, Human
uuccuuucccuuuagc

SEQ ID NO: 3584886 - RNA, 10 nt, Human
uuccuuucuc

SEQ ID NO: 3584887 - RNA, 12 nt, Human
uuccuuucucac

SEQ ID NO: 3584888 - RNA, 14 nt, Human
uuccuuugaagagg

SEQ ID NO: 3584889 - RNA, 15 nt, Human
uuccuuugaagagga

SEQ ID NO: 3584890 - RNA, 13 nt, Human
uuccuuugugcuu

SEQ ID NO: 3584891 - RNA, 20 nt, Human
uuccuuugugguuuuaugga

SEQ ID NO: 3584892 - RNA, 12 nt, Human
uuccuuuucacu

SEQ ID NO: 3584893 - RNA, 13 nt, Human
uuccuuuucacug

SEQ ID NO: 3584894 - RNA, 14 nt, Human
uuccuuuucccugc

SEQ ID NO: 3584895 - RNA, 15 nt, Human
uuccuuuucccugcu

SEQ ID NO: 3584896 - RNA, 18 nt, Human
uuccuuuucuaacucucc

SEQ ID NO: 3584897 - RNA, 20 nt, Human
uuccuuuugaacgccccccc

SEQ ID NO: 3584898 - RNA, 18 nt, Human
uuccuuuuuaugaggcaa

SEQ ID NO: 3584899 - RNA, 21 nt, Human
uuccuuuuucugauuagcuuu

SEQ ID NO: 3584900 - RNA, 22 nt, Human
uuccuuuuucugauuagcuuug

SEQ ID NO: 3584901 - RNA, 15 nt, Human
uuccuuuuugacacu

SEQ ID NO: 3584902 - RNA, 16 nt, Human
uuccuuuuugacacug

SEQ ID NO: 3584903 - RNA, 16 nt, Human
uuccuuuuuucaaaau

SEQ ID NO: 3584904 - RNA, 14 nt, Human
uuccuuuuuuugau

SEQ ID NO: 3584905 - RNA, 16 nt, Human
uuccuuuuuuuguacc

SEQ ID NO: 3584906 - RNA, 13 nt, Human
uucgaaaaucaaa

SEQ ID NO: 3584907 - RNA, 22 nt, Human
uucgaaaccugggauucaggaa

SEQ ID NO: 3584908 - RNA, 22 nt, Human
uucgaagccuugccuaaauuua

SEQ ID NO: 3584909 - RNA, 18 nt, Human
uucgaagucauuaaacug

SEQ ID NO: 3584910 - RNA, 14 nt, Human
uucgacacuguucu

SEQ ID NO: 3584911 - RNA, 23 nt, Human
uucgacagcauuuuccucugcuu

SEQ ID NO: 3584912 - RNA, 18 nt, Human
uucgaccugauuuacagu

SEQ ID NO: 3584913 - RNA, 17 nt, Human
uucgacucagccucagg

SEQ ID NO: 3584914 - RNA, 19 nt, Human
uucgacugugaccuguggg

SEQ ID NO: 3584915 - RNA, 16 nt, Human
uucgacuguuguuauc

SEQ ID NO: 3584916 - RNA, 22 nt, Human
uucgagcuauauuuaaguauuc

SEQ ID NO: 3584917 - RNA, 13 nt, Human
uucgaggccugaa

SEQ ID NO: 3584918 - RNA, 20 nt, Human
uucgaggccugaagccagcu

SEQ ID NO: 3584919 - RNA, 20 nt, Human
uucgaugggcccaauucuua

SEQ ID NO: 3584920 - RNA, 15 nt, Human
uucgcagccacccug

SEQ ID NO: 3584921 - RNA, 22 nt, Human
uucgcaguccacuucugacagc

SEQ ID NO: 3584922 - RNA, 14 nt, Human
uucgcaucaaaaga

SEQ ID NO: 3584923 - RNA, 18 nt, Human
uucgcaucaaaagacaau

SEQ ID NO: 3584924 - RNA, 21 nt, Human
uucgcaucaaaagacaauucu

SEQ ID NO: 3584925 - RNA, 22 nt, Human
uucgcaucaaaagacaauucuu

SEQ ID NO: 3584926 - RNA, 20 nt, Human
uucgcauggucacacacuga

SEQ ID NO: 3584927 - RNA, 21 nt, Human
uucgcauggucacacacugau

SEQ ID NO: 3584928 - RNA, 19 nt, Human
uucgcccaaagccagacag

SEQ ID NO: 3584929 - RNA, 21 nt, Human
uucgccguggcugcggcaccc

SEQ ID NO: 3584930 - RNA, 19 nt, Human
uucgcgugcccucgcugcu

SEQ ID NO: 3584931 - RNA, 19 nt, Human
uucucccagguaccagcug

SEQ ID NO: 3584932 - RNA, 20 nt, Human
uucuccccaaugagacuugc

SEQ ID NO: 3584933 - RNA, 22 nt, Human
uucuccccaaugagacuugccu

SEQ ID NO: 3584934 - RNA, 17 nt, Human
uucucccccugggcucu

SEQ ID NO: 3584935 - RNA, 21 nt, Human
uucuccccugcccccaggacu

SEQ ID NO: 3584936 - RNA, 18 nt, Human
uucuccccuuccauuucu

SEQ ID NO: 3584937 - RNA, 17 nt, Human
uucucccgggacucugc

SEQ ID NO: 3584938 - RNA, 20 nt, Human
uucucccucauuucaggagc

SEQ ID NO: 3584939 - RNA, 18 nt, Human
uucucccucccaccuuaa

SEQ ID NO: 3584940 - RNA, 17 nt, Human
uucucccucucacuguc

SEQ ID NO: 3584941 - RNA, 11 nt, Human
uucucccugga

SEQ ID NO: 3584942 - RNA, 19 nt, Human
uucucccuggauuuuuacc

SEQ ID NO: 3584943 - RNA, 20 nt, Human
uucucccuggauuuuuacca

SEQ ID NO: 3584944 - RNA, 10 nt, Human
uucucccugu

SEQ ID NO: 3584945 - RNA, 13 nt, Human
uucuccgccagcc

SEQ ID NO: 3584946 - RNA, 19 nt, Human
uucuccgccagccuccucu

SEQ ID NO: 3584947 - RNA, 19 nt, Human
uucuccguccucgauggga

SEQ ID NO: 3584948 - RNA, 22 nt, Human
uucuccguuagcuccuguggcc

SEQ ID NO: 3584949 - RNA, 13 nt, Human
uucuccucccagg

SEQ ID NO: 3584950 - RNA, 20 nt, Human
uucuccucccuuccuuuucc

SEQ ID NO: 3584951 - RNA, 10 nt, Human
uucuccugga

SEQ ID NO: 3584952 - RNA, 20 nt, Human
uucuccuguuuauucccauc

SEQ ID NO: 3584953 - RNA, 22 nt, Human
uucuccuuccaacugcugcccc

SEQ ID NO: 3584954 - RNA, 21 nt, Human
uucuccuugaauaucuuucga

SEQ ID NO: 3584955 - RNA, 21 nt, Human
uucuccuuguuguugguuguu

SEQ ID NO: 3584956 - RNA, 17 nt, Human
uucuccuuuguacuuug

SEQ ID NO: 3584957 - RNA, 16 nt, Human
uucuccuuuuuacccc

SEQ ID NO: 3584958 - RNA, 19 nt, Human
uucucgcuguccuuucuag

SEQ ID NO: 3584959 - RNA, 12 nt, Human
uucucgggcuga

SEQ ID NO: 3584960 - RNA, 20 nt, Human
uucucuaaaauagccacuua

SEQ ID NO: 3584961 - RNA, 13 nt, Human
uucucuaauaaua

SEQ ID NO: 3584962 - RNA, 21 nt, Human
uucucuaauucuuccuuugua

SEQ ID NO: 3584963 - RNA, 23 nt, Human
uucucuacccaucuuaaaaacaa

SEQ ID NO: 3584964 - RNA, 17 nt, Human
uucucuacucuagggaa

SEQ ID NO: 3584965 - RNA, 17 nt, Human
uucucuagcucucuagg

SEQ ID NO: 3584966 - RNA, 19 nt, Human
uucucuagcuggugguuuc

SEQ ID NO: 3584967 - RNA, 12 nt, Human
uucucuaggaaa

SEQ ID NO: 3584968 - RNA, 17 nt, Human
uucucuaguuugauuaa

SEQ ID NO: 3584969 - RNA, 16 nt, Human
uucucuauaaaaaaua

SEQ ID NO: 3584970 - RNA, 13 nt, Human
uucucuaucauuu

SEQ ID NO: 3584971 - RNA, 16 nt, Human
uucucuaucauuuaau

SEQ ID NO: 3584972 - RNA, 20 nt, Human
uucucucaacaccaugauuc

SEQ ID NO: 3584973 - RNA, 13 nt, Human
uucucucaccucc

SEQ ID NO: 3584974 - RNA, 13 nt, Human
uucucucaucucu

SEQ ID NO: 3584975 - RNA, 14 nt, Human
uucucucaucuguu

SEQ ID NO: 3584976 - RNA, 14 nt, Human
uucucuccagcccc

SEQ ID NO: 3584977 - RNA, 18 nt, Human
uucucuccagccccugga

SEQ ID NO: 3584978 - RNA, 19 nt, Human
uucucuccagcugacuaaa

SEQ ID NO: 3584979 - RNA, 12 nt, Human
uucucuccauuu

SEQ ID NO: 3584980 - RNA, 23 nt, Human
uucucucccaggggcuggcuuca

SEQ ID NO: 3584981 - RNA, 15 nt, Human
uucucuccccaaccc

SEQ ID NO: 3584982 - RNA, 12 nt, Human
uucucuccuccc

SEQ ID NO: 3584983 - RNA, 15 nt, Human
uucucuccuccccaa

SEQ ID NO: 3584984 - RNA, 17 nt, Human
uucucuccuccccaaau

SEQ ID NO: 3584985 - RNA, 23 nt, Human
uucucuccucuccccaugauguu

SEQ ID NO: 3584986 - RNA, 14 nt, Human
uucucuccuguacc

SEQ ID NO: 3584987 - RNA, 18 nt, Human
uucucuccuguaccucuu

SEQ ID NO: 3584988 - RNA, 17 nt, Human
uucucuccuguccuccc

SEQ ID NO: 3584989 - RNA, 21 nt, Human
uucucuccuguccucccucac

SEQ ID NO: 3584990 - RNA, 18 nt, Human
uucucucuaugguaaaga

SEQ ID NO: 3584991 - RNA, 20 nt, Human
uucucucuaugguaaagaua

SEQ ID NO: 3584992 - RNA, 12 nt, Human
uucucucugcuc

SEQ ID NO: 3584993 - RNA, 16 nt, Human
uucucucuucccucag

SEQ ID NO: 3584994 - RNA, 17 nt, Human
uucucucuuuauacagc

SEQ ID NO: 3584995 - RNA, 18 nt, Human
uucucucuuuauacagcu

SEQ ID NO: 3584996 - RNA, 18 nt, Human
uucucugaacacaggcag

SEQ ID NO: 3584997 - RNA, 23 nt, Human
uucucugaagaguggguuucaca

SEQ ID NO: 3584998 - RNA, 11 nt, Human
uucucugacuu

SEQ ID NO: 3584999 - RNA, 16 nt, Human
uucucugagcugugca

SEQ ID NO: 3585000 - RNA, 18 nt, Human
uucucugagcugugcagg

SEQ ID NO: 3585001 - RNA, 14 nt, Human
uucucugauacaga

SEQ ID NO: 3585002 - RNA, 10 nt, Human
uucucugcca

SEQ ID NO: 3585003 - RNA, 11 nt, Human
uucucugcccu

SEQ ID NO: 3585004 - RNA, 16 nt, Human
uucucugcccuccaag

SEQ ID NO: 3585005 - RNA, 23 nt, Human
uucucugccgcuaccucccuccc

SEQ ID NO: 3585006 - RNA, 21 nt, Human
uucucugccuuugacauuuaa

SEQ ID NO: 3585007 - RNA, 21 nt, Human
uucucugcuauauauaaaacg

SEQ ID NO: 3585008 - RNA, 13 nt, Human
uucucugcuccac

SEQ ID NO: 3585009 - RNA, 15 nt, Human
uucucugcuccacca

SEQ ID NO: 3585010 - RNA, 12 nt, Human
uucucugcuuca

SEQ ID NO: 3585011 - RNA, 15 nt, Human
uucucuggagccaag

SEQ ID NO: 3585012 - RNA, 12 nt, Human
uucucugggaga

SEQ ID NO: 3585013 - RNA, 15 nt, Human
uucucugggagaaaa

SEQ ID NO: 3585014 - RNA, 20 nt, Human
uucucugggagaaaaucauc

SEQ ID NO: 3585015 - RNA, 19 nt, Human
uucucugguaauauugacu

SEQ ID NO: 3585016 - RNA, 22 nt, Human
uucucugguacaauuucuuuug

SEQ ID NO: 3585017 - RNA, 12 nt, Human
uucucuguacau

SEQ ID NO: 3585018 - RNA, 14 nt, Human
uucucuguacuuuu

SEQ ID NO: 3585019 - RNA, 18 nt, Human
uucucuguacuuuucauu

SEQ ID NO: 3585020 - RNA, 21 nt, Human
uucucuguacuuuucauucuc

SEQ ID NO: 3585021 - RNA, 17 nt, Human
uucucugucucaugugu

SEQ ID NO: 3585022 - RNA, 12 nt, Human
uucucugugaac

SEQ ID NO: 3585023 - RNA, 20 nt, Human
uucucugugucuaagauucu

SEQ ID NO: 3585024 - RNA, 21 nt, Human
uucucugugucuaagauucua

SEQ ID NO: 3585025 - RNA, 22 nt, Human
uucucugugucuaagauucuag

SEQ ID NO: 3585026 - RNA, 19 nt, Human
uucucuguguuuguuccua

SEQ ID NO: 3585027 - RNA, 24 nt, Human
uucucuguguuuguuccuacagcc

SEQ ID NO: 3585028 - RNA, 18 nt, Human
uucucuuaaacuugugaa

SEQ ID NO: 3585029 - RNA, 16 nt, Human
uucucuuacugcaaau

SEQ ID NO: 3585030 - RNA, 22 nt, Human
uucucuuccaaccauuuaucuu

SEQ ID NO: 3585031 - RNA, 20 nt, Human
uucucuucuccccuuccauu

SEQ ID NO: 3585032 - RNA, 21 nt, Human
uucucuucuccccuuccauuu

SEQ ID NO: 3585033 - RNA, 14 nt, Human
uucucuucuugaac

SEQ ID NO: 3585034 - RNA, 16 nt, Human
uucucuugagcuggcc

SEQ ID NO: 3585035 - RNA, 22 nt, Human
uucucuugagcuggccucucua

SEQ ID NO: 3585036 - RNA, 18 nt, Human
uucucuugagucacacug

SEQ ID NO: 3585037 - RNA, 17 nt, Human
uucucuugggaacugaa

SEQ ID NO: 3585038 - RNA, 22 nt, Human
uucucuuuccuuggcucccauu

SEQ ID NO: 3585039 - RNA, 11 nt, Human
uucucuuucuu

SEQ ID NO: 3585040 - RNA, 19 nt, Human
uucucuuugauuauuugca

SEQ ID NO: 3585041 - RNA, 20 nt, Human
uucucuuugauuauuugcau

SEQ ID NO: 3585042 - RNA, 20 nt, Human
uucucuuuuccccuuuccug

SEQ ID NO: 3585043 - RNA, 22 nt, Human
uucucuuuuccccuuuccuguc

SEQ ID NO: 3585044 - RNA, 17 nt, Human
uucugaaacuaaugaaa

SEQ ID NO: 3585045 - RNA, 19 nt, Human
uucugaaagagucuuucuu

SEQ ID NO: 3585046 - RNA, 13 nt, Human
uucugaacuaaag

SEQ ID NO: 3585047 - RNA, 17 nt, Human
uucugaacucaaacuga

SEQ ID NO: 3585048 - RNA, 18 nt, Human
uucugaacucaaacugag

SEQ ID NO: 3585049 - RNA, 12 nt, Human
uucugaacucgc

SEQ ID NO: 3585050 - RNA, 14 nt, Human
uucugaagaagaug

SEQ ID NO: 3585051 - RNA, 18 nt, Human
uucugaagucuacuuugu

SEQ ID NO: 3585052 - RNA, 17 nt, Human
uucugaaguuauauuuc

SEQ ID NO: 3585053 - RNA, 19 nt, Human
uucugaaguuauauuuccu

SEQ ID NO: 3585054 - RNA, 14 nt, Human
uucugaauaaagca

SEQ ID NO: 3585055 - RNA, 15 nt, Human
uucugaauaaagcaa

SEQ ID NO: 3585056 - RNA, 19 nt, Human
uucugaauacaaagugaug

SEQ ID NO: 3585057 - RNA, 18 nt, Human
uucugaaugcuucuaagu

SEQ ID NO: 3585058 - RNA, 11 nt, Human
uucugaaugua

SEQ ID NO: 3585059 - RNA, 14 nt, Human
uucugaauuugcaa

SEQ ID NO: 3585060 - RNA, 17 nt, Human
uucugaauuugcaaagu

SEQ ID NO: 3585061 - RNA, 22 nt, Human
uucugacaaaaaguuuccauau

SEQ ID NO: 3585062 - RNA, 21 nt, Human
uucugacaguuuuucuguuuu

SEQ ID NO: 3585063 - RNA, 23 nt, Human
uucugacaucuuaguauuugcau

SEQ ID NO: 3585064 - RNA, 14 nt, Human
uucugacauuaaca

SEQ ID NO: 3585065 - RNA, 15 nt, Human
uucugacauuaacag

SEQ ID NO: 3585066 - RNA, 20 nt, Human
uucugacauuaacaguuuuc

SEQ ID NO: 3585067 - RNA, 22 nt, Human
uucugacauuaacaguuuucca

SEQ ID NO: 3585068 - RNA, 13 nt, Human
uucugaccacacu

SEQ ID NO: 3585069 - RNA, 22 nt, Human
uucugaccacacuuccugucca

SEQ ID NO: 3585070 - RNA, 18 nt, Human
uucugacccaugcugccc

SEQ ID NO: 3585071 - RNA, 21 nt, Human
uucugacccugcuucaaauau

SEQ ID NO: 3585072 - RNA, 14 nt, Human
uucugacggcccug

SEQ ID NO: 3585073 - RNA, 18 nt, Human
uucugacucgguuucucc

SEQ ID NO: 3585074 - RNA, 16 nt, Human
uucugacucugagcua

SEQ ID NO: 3585075 - RNA, 13 nt, Human
uucugacugcuga

SEQ ID NO: 3585076 - RNA, 12 nt, Human
uucugacuugac

SEQ ID NO: 3585077 - RNA, 14 nt, Human
uucugagaaaacaa

SEQ ID NO: 3585078 - RNA, 12 nt, Human
uucugagaaaag

SEQ ID NO: 3585079 - RNA, 22 nt, Human
uucugagcagcgagccugcuag

SEQ ID NO: 3585080 - RNA, 14 nt, Human
uucugagcauuuaa

SEQ ID NO: 3585081 - RNA, 20 nt, Human
uucugagcccgggcugccug

SEQ ID NO: 3585082 - RNA, 14 nt, Human
uucugagccugccu

SEQ ID NO: 3585083 - RNA, 23 nt, Human
uucugagcuauuucaucuauuuu

SEQ ID NO: 3585084 - RNA, 13 nt, Human
uucugagcuccug

SEQ ID NO: 3585085 - RNA, 15 nt, Human
uucugagcuccuguc

SEQ ID NO: 3585086 - RNA, 15 nt, Human
uucugagcugccagu

SEQ ID NO: 3585087 - RNA, 20 nt, Human
uucugagcuuacguaguucu

SEQ ID NO: 3585088 - RNA, 16 nt, Human
uucugagugccuucug

SEQ ID NO: 3585089 - RNA, 15 nt, Human
uucugaguuccugca

SEQ ID NO: 3585090 - RNA, 14 nt, Human
uucugaguuuugug

SEQ ID NO: 3585091 - RNA, 15 nt, Human
uucugaguuuugugu

SEQ ID NO: 3585092 - RNA, 23 nt, Human
uucugaguuuuguguuuguugua

SEQ ID NO: 3585093 - RNA, 13 nt, Human
uucugauagagga

SEQ ID NO: 3585094 - RNA, 21 nt, Human
uucugauagaggaagccugau

SEQ ID NO: 3585095 - RNA, 22 nt, Human
uucugauaugcaguuuuccuua

SEQ ID NO: 3585096 - RNA, 13 nt, Human
uucugauauuaau

SEQ ID NO: 3585097 - RNA, 14 nt, Human
uucugauauuaauu

SEQ ID NO: 3585098 - RNA, 19 nt, Human
uucugaucacugaaauaaa

SEQ ID NO: 3585099 - RNA, 19 nt, Human
uucugauccuaguuccacc

SEQ ID NO: 3585100 - RNA, 14 nt, Human
uucugaugaaaugu

SEQ ID NO: 3585101 - RNA, 18 nt, Human
uucugaugaaauguuaac

SEQ ID NO: 3585102 - RNA, 17 nt, Human
uucugauuacacaaaac

SEQ ID NO: 3585103 - RNA, 17 nt, Human
uucugauuagaaaugac

SEQ ID NO: 3585104 - RNA, 18 nt, Human
uucugauuagcuuugugu

SEQ ID NO: 3585105 - RNA, 22 nt, Human
uucugauuguaacguugcugug

SEQ ID NO: 3585106 - RNA, 23 nt, Human
uucugauuugccacugauauuca

SEQ ID NO: 3585107 - RNA, 14 nt, Human
uucugcaaacaaac

SEQ ID NO: 3585108 - RNA, 15 nt, Human
uucugcaaauagaaa

SEQ ID NO: 3585109 - RNA, 17 nt, Human
uucugcaaauagaaaac

SEQ ID NO: 3585110 - RNA, 19 nt, Human
uucugcaaauagaaaacag

SEQ ID NO: 3585111 - RNA, 15 nt, Human
uucugcaagccugcg

SEQ ID NO: 3585112 - RNA, 13 nt, Human
uucugcacccucc

SEQ ID NO: 3585113 - RNA, 23 nt, Human
uucugcacccuccacccuguccc

SEQ ID NO: 3585114 - RNA, 14 nt, Human
uucugcacugaaaa

SEQ ID NO: 3585115 - RNA, 15 nt, Human
uucugcagaagagga

SEQ ID NO: 3585116 - RNA, 20 nt, Human
uucugcagacacgccuuccc

SEQ ID NO: 3585117 - RNA, 20 nt, Human
uucugcagcaugaccuguga

SEQ ID NO: 3585118 - RNA, 22 nt, Human
uucugcagcaugaccugugacc

SEQ ID NO: 3585119 - RNA, 23 nt, Human
uucugcagcaugaccugugacca

SEQ ID NO: 3585120 - RNA, 15 nt, Human
uucugcagcuguuuu

SEQ ID NO: 3585121 - RNA, 19 nt, Human
uucugcaguagucucugug

SEQ ID NO: 3585122 - RNA, 22 nt, Human
uucugcauauguugaauacuuu

SEQ ID NO: 3585123 - RNA, 23 nt, Human
uucugcauauguugaauacuuuu

SEQ ID NO: 3585124 - RNA, 16 nt, Human
uucugcauugcuagau

SEQ ID NO: 3585125 - RNA, 20 nt, Human
uucugcauugcuagauaaaa

SEQ ID NO: 3585126 - RNA, 21 nt, Human
uucugccacccugcugagucu

SEQ ID NO: 3585127 - RNA, 14 nt, Human
uucugccacuuccc

SEQ ID NO: 3585128 - RNA, 17 nt, Human
uucugccacuucccagg

SEQ ID NO: 3585129 - RNA, 12 nt, Human
uucugccaggag

SEQ ID NO: 3585130 - RNA, 16 nt, Human
uucugccagggagcuu

SEQ ID NO: 3585131 - RNA, 19 nt, Human
uucugccaucuagccagcc

SEQ ID NO: 3585132 - RNA, 15 nt, Human
uucugcccccagccc

SEQ ID NO: 3585133 - RNA, 16 nt, Human
uucugcccccugcaga

SEQ ID NO: 3585134 - RNA, 19 nt, Human
uucugcccccugcagaacc

SEQ ID NO: 3585135 - RNA, 13 nt, Human
uucugcccuggcu

SEQ ID NO: 3585136 - RNA, 14 nt, Human
uucugcccuggcug

SEQ ID NO: 3585137 - RNA, 19 nt, Human
uucugcccuggcugcugcc

SEQ ID NO: 3585138 - RNA, 22 nt, Human
uucugccgcccccuccugaacc

SEQ ID NO: 3585139 - RNA, 18 nt, Human
uucugccggcccuggggc

SEQ ID NO: 3585140 - RNA, 14 nt, Human
uucugccuccuuua

SEQ ID NO: 3585141 - RNA, 17 nt, Human
uucugccuccuuuagua

SEQ ID NO: 3585142 - RNA, 12 nt, Human
uucugccucucc

SEQ ID NO: 3585143 - RNA, 14 nt, Human
uucugccucugagg

SEQ ID NO: 3585144 - RNA, 22 nt, Human
uucugccucugauguauuuugu

SEQ ID NO: 3585145 - RNA, 21 nt, Human
uucugccugaggggcagccug

SEQ ID NO: 3585146 - RNA, 18 nt, Human
uucugccugccagcugca

SEQ ID NO: 3585147 - RNA, 15 nt, Human
uucugccugcccagg

SEQ ID NO: 3585148 - RNA, 16 nt, Human
uucugccugcccaggc

SEQ ID NO: 3585149 - RNA, 21 nt, Human
uucugccugcccaggccccug

SEQ ID NO: 3585150 - RNA, 14 nt, Human
uucugccuggagac

SEQ ID NO: 3585151 - RNA, 19 nt, Human
uucugccuuugcagaaaca

SEQ ID NO: 3585152 - RNA, 14 nt, Human
uucugccuuugcca

SEQ ID NO: 3585153 - RNA, 15 nt, Human
uucugccuuuuuuau

SEQ ID NO: 3585154 - RNA, 15 nt, Human
uucugcuaccucacu

SEQ ID NO: 3585155 - RNA, 21 nt, Human
uucugcuaccucacugggguc

SEQ ID NO: 3585156 - RNA, 19 nt, Human
uucugcucacauaucuguc

SEQ ID NO: 3585157 - RNA, 20 nt, Human
uucugcucagcucugggcca

SEQ ID NO: 3585158 - RNA, 13 nt, Human
uucugcucaucau

SEQ ID NO: 3585159 - RNA, 14 nt, Human
uucugcucaucauu

SEQ ID NO: 3585160 - RNA, 21 nt, Human
uucugcucaucauucucuguc

SEQ ID NO: 3585161 - RNA, 17 nt, Human
uucugcuccacccuugg

SEQ ID NO: 3585162 - RNA, 11 nt, Human
uucugcuccuc

SEQ ID NO: 3585163 - RNA, 13 nt, Human
uucugcuccucuc

SEQ ID NO: 3585164 - RNA, 17 nt, Human
uucugcuccucuccagg

SEQ ID NO: 3585165 - RNA, 22 nt, Human
uucugcucugguuguuucuguu

SEQ ID NO: 3585166 - RNA, 20 nt, Human
uucugcuggccucugcgagu

SEQ ID NO: 3585167 - RNA, 15 nt, Human
uucugcugggcuggg

SEQ ID NO: 3585168 - RNA, 20 nt, Human
uucugcuggggccugggaca

SEQ ID NO: 3585169 - RNA, 14 nt, Human
uucugcuucacauu

SEQ ID NO: 3585170 - RNA, 14 nt, Human
uucugcuucagccu

SEQ ID NO: 3585171 - RNA, 19 nt, Human
uucugcuucagccucccga

SEQ ID NO: 3585172 - RNA, 18 nt, Human
uucugcuuguguuaagua

SEQ ID NO: 3585173 - RNA, 17 nt, Human
uucugcuuuagacuuga

SEQ ID NO: 3585174 - RNA, 19 nt, Human
uucugcuuuagacuugaaa

SEQ ID NO: 3585175 - RNA, 22 nt, Human
uucugcuuucuccccaaugaga

SEQ ID NO: 3585176 - RNA, 14 nt, Human
uucugcuuugcucu

SEQ ID NO: 3585177 - RNA, 12 nt, Human
uucugcuuuguu

SEQ ID NO: 3585178 - RNA, 17 nt, Human
uucugcuuuucugcccu

SEQ ID NO: 3585179 - RNA, 18 nt, Human
uucugcuuuucugcccug

SEQ ID NO: 3585180 - RNA, 21 nt, Human
uucuggaauuuguucaaguuu

SEQ ID NO: 3585181 - RNA, 22 nt, Human
uucuggacagucagcucuucau

SEQ ID NO: 3585182 - RNA, 19 nt, Human
uucuggacccguucaacuu

SEQ ID NO: 3585183 - RNA, 20 nt, Human
uucuggacuauagcuguucu

SEQ ID NO: 3585184 - RNA, 15 nt, Human
uucuggacucuggac

SEQ ID NO: 3585185 - RNA, 17 nt, Human
uucuggagucuccagug

SEQ ID NO: 3585186 - RNA, 10 nt, Human
uucuggaguu

SEQ ID NO: 3585187 - RNA, 15 nt, Human
uucuggaugcauuuc

SEQ ID NO: 3585188 - RNA, 15 nt, Human
uucuggauucuuggc

SEQ ID NO: 3585189 - RNA, 23 nt, Human
uucuggcaguuuugacaucagcc

SEQ ID NO: 3585190 - RNA, 14 nt, Human
uucuggccaggaag

SEQ ID NO: 3585191 - RNA, 16 nt, Human
uucuggccaguguuua

SEQ ID NO: 3585192 - RNA, 21 nt, Human
uucuggccaguguuuaaaacu

SEQ ID NO: 3585193 - RNA, 15 nt, Human
uucuggccucccaca

SEQ ID NO: 3585194 - RNA, 17 nt, Human
uucuggccuuguaagac

SEQ ID NO: 3585195 - RNA, 17 nt, Human
uucuggccuuuccucuc

SEQ ID NO: 3585196 - RNA, 18 nt, Human
uucuggcuaugcauuuga

SEQ ID NO: 3585197 - RNA, 17 nt, Human
uucuggcucagggaggu

SEQ ID NO: 3585198 - RNA, 17 nt, Human
uucuggcucuuccaggc

SEQ ID NO: 3585199 - RNA, 15 nt, Human
uucuggcugaaaaag

SEQ ID NO: 3585200 - RNA, 22 nt, Human
uucugggacacaguucaauucu

SEQ ID NO: 3585201 - RNA, 22 nt, Human
uucugggagacacccaaagggu

SEQ ID NO: 3585202 - RNA, 23 nt, Human
uucugggcaccacaaaauauaca

SEQ ID NO: 3585203 - RNA, 19 nt, Human
uucugggcacccucccacc

SEQ ID NO: 3585204 - RNA, 21 nt, Human
uucuggggaaagacacugccu

SEQ ID NO: 3585205 - RNA, 23 nt, Human
uucuggggaaagacacugccugg

SEQ ID NO: 3585206 - RNA, 17 nt, Human
uucuggggcaggcuggg

SEQ ID NO: 3585207 - RNA, 23 nt, Human
uucuggggccccuuuuuacuccc

SEQ ID NO: 3585208 - RNA, 21 nt, Human
uucuggggccuaauaaaacug

SEQ ID NO: 3585209 - RNA, 22 nt, Human
uucuggggggacccagugcaga

SEQ ID NO: 3585210 - RNA, 18 nt, Human
uucugggugguugcccuu

SEQ ID NO: 3585211 - RNA, 17 nt, Human
uucuggguucugggugg

SEQ ID NO: 3585212 - RNA, 20 nt, Human
uucugguaggaauagcaugu

SEQ ID NO: 3585213 - RNA, 21 nt, Human
uucugguaugaacuugaggac

SEQ ID NO: 3585214 - RNA, 22 nt, Human
uucuggucaagggcugucauug

SEQ ID NO: 3585215 - RNA, 19 nt, Human
uucuggucucgucuuccgu

SEQ ID NO: 3585216 - RNA, 22 nt, Human
uucuggucucgucuuccgucuc

SEQ ID NO: 3585217 - RNA, 21 nt, Human
uucuggucucuaggcugggga

SEQ ID NO: 3585218 - RNA, 13 nt, Human
uucuuugaauuua

SEQ ID NO: 3585219 - RNA, 16 nt, Human
uucuuugaauuuucau

SEQ ID NO: 3585220 - RNA, 21 nt, Human
uucuuugagggacugccucug

SEQ ID NO: 3585221 - RNA, 22 nt, Human
uucuuugauaauguuaaauuug

SEQ ID NO: 3585222 - RNA, 20 nt, Human
uucuuugauguuaacacauu

SEQ ID NO: 3585223 - RNA, 21 nt, Human
uucuuugauguuaacacauuu

SEQ ID NO: 3585224 - RNA, 12 nt, Human
uucuuugauuau

SEQ ID NO: 3585225 - RNA, 23 nt, Human
uucuuugauucuccuuuuaugug

SEQ ID NO: 3585226 - RNA, 12 nt, Human
uucuuugcaaag

SEQ ID NO: 3585227 - RNA, 19 nt, Human
uucuuugcacuuuuucuua

SEQ ID NO: 3585228 - RNA, 14 nt, Human
uucuuugcccuuua

SEQ ID NO: 3585229 - RNA, 17 nt, Human
uucuuugccuguucagu

SEQ ID NO: 3585230 - RNA, 15 nt, Human
uucuuugcuguaaga

SEQ ID NO: 3585231 - RNA, 16 nt, Human
uucuuugcuguaagau

SEQ ID NO: 3585232 - RNA, 16 nt, Human
uucuuuggaaaguaca

SEQ ID NO: 3585233 - RNA, 20 nt, Human
uucuuuggaguuaaaaugca

SEQ ID NO: 3585234 - RNA, 18 nt, Human
uucuuuggugccuuuccu

SEQ ID NO: 3585235 - RNA, 22 nt, Human
uucuuugguuucccaagagcua

SEQ ID NO: 3585236 - RNA, 15 nt, Human
uucuuuguagcauuu

SEQ ID NO: 3585237 - RNA, 17 nt, Human
uucuuuguuucuuucuu

SEQ ID NO: 3585238 - RNA, 18 nt, Human
uucuuuguuuuuagagac

SEQ ID NO: 3585239 - RNA, 21 nt, Human
uucuuuuaaaggggcagaaaa

SEQ ID NO: 3585240 - RNA, 17 nt, Human
uucuuuuaagaaucaau

SEQ ID NO: 3585241 - RNA, 15 nt, Human
uucuuuuauuuguua

SEQ ID NO: 3585242 - RNA, 19 nt, Human
uucuuuucacauucuuaua

SEQ ID NO: 3585243 - RNA, 12 nt, Human
uucuuuucucau

SEQ ID NO: 3585244 - RNA, 14 nt, Human
uucuuuucuuugua

SEQ ID NO: 3585245 - RNA, 20 nt, Human
uucuuuugccguuauuaaaa

SEQ ID NO: 3585246 - RNA, 22 nt, Human
uucuuuugguaaagacuggcuu

SEQ ID NO: 3585247 - RNA, 23 nt, Human
uucuuuugguaaagacuggcuuu

SEQ ID NO: 3585248 - RNA, 12 nt, Human
uucuuuuguaag

SEQ ID NO: 3585249 - RNA, 14 nt, Human
uucuuuuguaugua

SEQ ID NO: 3585250 - RNA, 12 nt, Human
uucuuuuguuac

SEQ ID NO: 3585251 - RNA, 14 nt, Human
uucuuuuguuacug

SEQ ID NO: 3585252 - RNA, 16 nt, Human
uucuuuuguuacuguu

SEQ ID NO: 3585253 - RNA, 21 nt, Human
uucuuuuguuacuguucuugc

SEQ ID NO: 3585254 - RNA, 14 nt, Human
uucuuuuuacauaa

SEQ ID NO: 3585255 - RNA, 16 nt, Human
uucuuuuuacauaacu

SEQ ID NO: 3585256 - RNA, 15 nt, Human
uucuuuuuauugaau

SEQ ID NO: 3585257 - RNA, 15 nt, Human
uucuuuuuauuuucu

SEQ ID NO: 3585258 - RNA, 16 nt, Human
uucuuuuucuggacuc

SEQ ID NO: 3585259 - RNA, 12 nt, Human
uucuuuuugaau

SEQ ID NO: 3585260 - RNA, 14 nt, Human
uucuuuuugcucua

SEQ ID NO: 3585261 - RNA, 13 nt, Human
uucuuuuugcugu

SEQ ID NO: 3585262 - RNA, 23 nt, Human
uucuuuuugcuguuguuucuaaa

SEQ ID NO: 3585263 - RNA, 17 nt, Human
uucuuuuuuaaaaucaa

SEQ ID NO: 3585264 - RNA, 15 nt, Human
uucuuuuuuauuaau

SEQ ID NO: 3585265 - RNA, 22 nt, Human
uucuuuuuuauuaaucacugug

SEQ ID NO: 3585266 - RNA, 23 nt, Human
uucuuuuuugauauagaaguaua

SEQ ID NO: 3585267 - RNA, 16 nt, Human
uucuuuuuuuagagaa

SEQ ID NO: 3585268 - RNA, 18 nt, Human
uucuuuuuuuccuuuuua

SEQ ID NO: 3585269 - RNA, 19 nt, Human
uucuuuuuuuccuuuuuaa

SEQ ID NO: 3585270 - RNA, 18 nt, Human
uucuuuuuuuucauuaua

SEQ ID NO: 3585271 - RNA, 17 nt, Human
uucuuuuuuuuuaaguu

SEQ ID NO: 3585272 - RNA, 21 nt, Human
uucuuuuuuuuuaaguucuua

SEQ ID NO: 3585273 - RNA, 15 nt, Human
uugaaaaaaacuuca

SEQ ID NO: 3585274 - RNA, 12 nt, Human
uugaaaaaaaua

SEQ ID NO: 3585275 - RNA, 14 nt, Human
uugaaaaaaauugg

SEQ ID NO: 3585276 - RNA, 18 nt, Human
uugaaaaaagcucauuuc

SEQ ID NO: 3585277 - RNA, 20 nt, Human
uugaaaaaccauuuugcugu

SEQ ID NO: 3585278 - RNA, 14 nt, Human
uugaaaaacucuuu

SEQ ID NO: 3585279 - RNA, 13 nt, Human
uugaaaaagcgaa

SEQ ID NO: 3585280 - RNA, 14 nt, Human
uugaaaaaucacuu

SEQ ID NO: 3585281 - RNA, 13 nt, Human
uugaaaaauuccu

SEQ ID NO: 3585282 - RNA, 18 nt, Human
uugaaaaccaaaaugaca

SEQ ID NO: 3585283 - RNA, 21 nt, Human
uugaaaaccaaaaugacaucu

SEQ ID NO: 3585284 - RNA, 13 nt, Human
uugaaaagagcug

SEQ ID NO: 3585285 - RNA, 17 nt, Human
uugaaaagcagacauuu

SEQ ID NO: 3585286 - RNA, 20 nt, Human
uugaaaagccauguuuaaga

SEQ ID NO: 3585287 - RNA, 22 nt, Human
uugaaaagccauguuuaagauu

SEQ ID NO: 3585288 - RNA, 22 nt, Human
uugaaaagcuauuagccaggau

SEQ ID NO: 3585289 - RNA, 17 nt, Human
uugaaaagcuucuuaau

SEQ ID NO: 3585290 - RNA, 16 nt, Human
uugaaaaggugaccuu

SEQ ID NO: 3585291 - RNA, 14 nt, Human
uugaaaauaguuua

SEQ ID NO: 3585292 - RNA, 21 nt, Human
uugaaaaucuuauaauuuaaa

SEQ ID NO: 3585293 - RNA, 15 nt, Human
uugaaaaucuugugu

SEQ ID NO: 3585294 - RNA, 18 nt, Human
uugaaaauuaacaugaau

SEQ ID NO: 3585295 - RNA, 20 nt, Human
uugaaaauuauuuuaaacaa

SEQ ID NO: 3585296 - RNA, 21 nt, Human
uugaaaauucaaaaaguguuu

SEQ ID NO: 3585297 - RNA, 16 nt, Human
uugaaaauugaaaagu

SEQ ID NO: 3585298 - RNA, 15 nt, Human
uugaaacagaaaaau

SEQ ID NO: 3585299 - RNA, 19 nt, Human
uugaaaccaccuuuuauua

SEQ ID NO: 3585300 - RNA, 16 nt, Human
uugaaaccugcucugu

SEQ ID NO: 3585301 - RNA, 16 nt, Human
uugaaacggaugauuu

SEQ ID NO: 3585302 - RNA, 23 nt, Human
uugaaacugagaugugaacacau

SEQ ID NO: 3585303 - RNA, 17 nt, Human
uugaaacugcauuugug

SEQ ID NO: 3585304 - RNA, 18 nt, Human
uugaaacugcauuugugc

SEQ ID NO: 3585305 - RNA, 14 nt, Human
uugaaacuuugaga

SEQ ID NO: 3585306 - RNA, 17 nt, Human
uugaaagaaaggacucu

SEQ ID NO: 3585307 - RNA, 14 nt, Human
uugaaagaauagaa

SEQ ID NO: 3585308 - RNA, 17 nt, Human
uugaaagaauguaaagc

SEQ ID NO: 3585309 - RNA, 14 nt, Human
uugaaagagauggc

SEQ ID NO: 3585310 - RNA, 14 nt, Human
uugaaagaguuaag

SEQ ID NO: 3585311 - RNA, 19 nt, Human
uugaaagaguuaagaaugu

SEQ ID NO: 3585312 - RNA, 20 nt, Human
uugaaagcaaaaaugcuaau

SEQ ID NO: 3585313 - RNA, 21 nt, Human
uugaaaggcauucucugaaga

SEQ ID NO: 3585314 - RNA, 17 nt, Human
uugaaagggaucaucau

SEQ ID NO: 3585315 - RNA, 21 nt, Human
uugaaagguuuuuuuucaguu

SEQ ID NO: 3585316 - RNA, 21 nt, Human
uugaaagugaauaaacuucag

SEQ ID NO: 3585317 - RNA, 17 nt, Human
uugaaaguuuucagaac

SEQ ID NO: 3585318 - RNA, 17 nt, Human
uugaaauaaaaagagua

SEQ ID NO: 3585319 - RNA, 21 nt, Human
uugaaauaagaauucagacau

SEQ ID NO: 3585320 - RNA, 13 nt, Human
uugaaauaccuca

SEQ ID NO: 3585321 - RNA, 19 nt, Human
uugaaauauaaugcaaacc

SEQ ID NO: 3585322 - RNA, 21 nt, Human
uugaaauauggucuuuugguu

SEQ ID NO: 3585323 - RNA, 11 nt, Human
uugaaaucuuu

SEQ ID NO: 3585324 - RNA, 13 nt, Human
uugaaaucuuuua

SEQ ID NO: 3585325 - RNA, 19 nt, Human
uugaaaugaggucuguuua

SEQ ID NO: 3585326 - RNA, 18 nt, Human
uugaaaugcauugcucug

SEQ ID NO: 3585327 - RNA, 21 nt, Human
uugaaauguaaggcuguguaa

SEQ ID NO: 3585328 - RNA, 18 nt, Human
uugaaauguguuucugua

SEQ ID NO: 3585329 - RNA, 20 nt, Human
uugaaauuaagaaggcaaaa

SEQ ID NO: 3585330 - RNA, 17 nt, Human
uugaaauuaugugacau

SEQ ID NO: 3585331 - RNA, 13 nt, Human
uugaaauucuauu

SEQ ID NO: 3585332 - RNA, 13 nt, Human
uugaaauucugaa

SEQ ID NO: 3585333 - RNA, 16 nt, Human
uugaaauucugaauuu

SEQ ID NO: 3585334 - RNA, 13 nt, Human
uugaaauuguaau

SEQ ID NO: 3585335 - RNA, 14 nt, Human
uugaaauuguaauu

SEQ ID NO: 3585336 - RNA, 20 nt, Human
uugaacacaaacuguaaaua

SEQ ID NO: 3585337 - RNA, 18 nt, Human
uugaacacaguauuuucc

SEQ ID NO: 3585338 - RNA, 20 nt, Human
uugaacacucaugcugaaag

SEQ ID NO: 3585339 - RNA, 20 nt, Human
uugaacacuggcuaaagaua

SEQ ID NO: 3585340 - RNA, 14 nt, Human
uugaaccaaaacau

SEQ ID NO: 3585341 - RNA, 15 nt, Human
uugaaccaaaccucc

SEQ ID NO: 3585342 - RNA, 16 nt, Human
uugaaccauaaaaugu

SEQ ID NO: 3585343 - RNA, 15 nt, Human
uugaaccauccacuu

SEQ ID NO: 3585344 - RNA, 16 nt, Human
uugaaccauccacuua

SEQ ID NO: 3585345 - RNA, 12 nt, Human
uugaacccagga

SEQ ID NO: 3585346 - RNA, 16 nt, Human
uugaaccuauuucucu

SEQ ID NO: 3585347 - RNA, 23 nt, Human
uugaaccugugaguaaauauuga

SEQ ID NO: 3585348 - RNA, 17 nt, Human
uugaaccuuugugcccu

SEQ ID NO: 3585349 - RNA, 19 nt, Human
uugaaccuuugugcccuau

SEQ ID NO: 3585350 - RNA, 22 nt, Human
uugaacuaagaaacuuuuguaa

SEQ ID NO: 3585351 - RNA, 17 nt, Human
uugaacuccugaccuca

SEQ ID NO: 3585352 - RNA, 15 nt, Human
uugaacuccuggccu

SEQ ID NO: 3585353 - RNA, 15 nt, Human
uugaacucugagaga

SEQ ID NO: 3585354 - RNA, 14 nt, Human
uugaacucugggcu

SEQ ID NO: 3585355 - RNA, 15 nt, Human
uugaacucugguggc

SEQ ID NO: 3585356 - RNA, 21 nt, Human
uugaacucuucucauuacuug

SEQ ID NO: 3585357 - RNA, 16 nt, Human
uugaacugagcuugga

SEQ ID NO: 3585358 - RNA, 16 nt, Human
uugaacugauaaagau

SEQ ID NO: 3585359 - RNA, 13 nt, Human
uugaacugauuca

SEQ ID NO: 3585360 - RNA, 18 nt, Human
uugaacuggguacuugug

SEQ ID NO: 3585361 - RNA, 22 nt, Human
uugaacuuaaauaaaugucauu

SEQ ID NO: 3585362 - RNA, 16 nt, Human
uugaacuucaccugca

SEQ ID NO: 3585363 - RNA, 17 nt, Human
uugaacuuugaccucug

SEQ ID NO: 3585364 - RNA, 20 nt, Human
uugaacuuugaccucugcag

SEQ ID NO: 3585365 - RNA, 13 nt, Human
uugaacuuuugua

SEQ ID NO: 3585366 - RNA, 14 nt, Human
uugaacuuuuguac

SEQ ID NO: 3585367 - RNA, 19 nt, Human
uugaacuuuuguacugaau

SEQ ID NO: 3585368 - RNA, 16 nt, Human
uugaacuuuuuuccac

SEQ ID NO: 3585369 - RNA, 21 nt, Human
uugaagaauguuaagacuuga

SEQ ID NO: 3585370 - RNA, 12 nt, Human
uugaagacaauu

SEQ ID NO: 3585371 - RNA, 15 nt, Human
uugaagacaauuuga

SEQ ID NO: 3585372 - RNA, 20 nt, Human
uugaagagagauauaucuga

SEQ ID NO: 3585373 - RNA, 18 nt, Human
uugaagagcagcuccuuc

SEQ ID NO: 3585374 - RNA, 22 nt, Human
uugaagauucuauguuaauauu

SEQ ID NO: 3585375 - RNA, 23 nt, Human
uugaagauucuauguuaauauuu

SEQ ID NO: 3585376 - RNA, 20 nt, Human
uugaagcaaaucgaaugaaa

SEQ ID NO: 3585377 - RNA, 20 nt, Human
uugaagcacagugaucaagu

SEQ ID NO: 3585378 - RNA, 15 nt, Human
uugaagcaguugugu

SEQ ID NO: 3585379 - RNA, 23 nt, Human
uugaagcauagauaauauuguuu

SEQ ID NO: 3585380 - RNA, 14 nt, Human
uugaagcauuuuau

SEQ ID NO: 3585381 - RNA, 15 nt, Human
uugaagcauuuuaua

SEQ ID NO: 3585382 - RNA, 20 nt, Human
uugaagccaaguggggugcu

SEQ ID NO: 3585383 - RNA, 15 nt, Human
uugaagccacugccu

SEQ ID NO: 3585384 - RNA, 14 nt, Human
uugaagccaugucu

SEQ ID NO: 3585385 - RNA, 17 nt, Human
uugaagccgacucuggc

SEQ ID NO: 3585386 - RNA, 19 nt, Human
uugaagccgacucuggccc

SEQ ID NO: 3585387 - RNA, 13 nt, Human
uugaagccugccc

SEQ ID NO: 3585388 - RNA, 13 nt, Human
uugaagccugcuc

SEQ ID NO: 3585389 - RNA, 16 nt, Human
uugaagccugcuccuu

SEQ ID NO: 3585390 - RNA, 13 nt, Human
uugaagccuuugu

SEQ ID NO: 3585391 - RNA, 17 nt, Human
uugaagcuaauuauuuu

SEQ ID NO: 3585392 - RNA, 14 nt, Human
uugaagcugaaaau

SEQ ID NO: 3585393 - RNA, 13 nt, Human
uugaaggaaacag

SEQ ID NO: 3585394 - RNA, 14 nt, Human
uugaaggaaacagu

SEQ ID NO: 3585395 - RNA, 17 nt, Human
uugaaggaaagauuugu

SEQ ID NO: 3585396 - RNA, 20 nt, Human
uugaaggaagccaaauuuau

SEQ ID NO: 3585397 - RNA, 21 nt, Human
uugaaggacuaauagaaaagu

SEQ ID NO: 3585398 - RNA, 15 nt, Human
uugaaggaucuguuu

SEQ ID NO: 3585399 - RNA, 14 nt, Human
uugaaggaugcugu

SEQ ID NO: 3585400 - RNA, 18 nt, Human
uugcccuaagcagaaagu

SEQ ID NO: 3585401 - RNA, 12 nt, Human
uugcccucccau

SEQ ID NO: 3585402 - RNA, 13 nt, Human
uugcccugaccuc

SEQ ID NO: 3585403 - RNA, 16 nt, Human
uugcccugcugcccuc

SEQ ID NO: 3585404 - RNA, 18 nt, Human
uugcccugcugcccuccc

SEQ ID NO: 3585405 - RNA, 16 nt, Human
uugcccuggggaucaa

SEQ ID NO: 3585406 - RNA, 10 nt, Human
uugcccuggu

SEQ ID NO: 3585407 - RNA, 14 nt, Human
uugcccuucacagu

SEQ ID NO: 3585408 - RNA, 17 nt, Human
uugcccuucccuguccc

SEQ ID NO: 3585409 - RNA, 19 nt, Human
uugcccuucccugucccuc

SEQ ID NO: 3585410 - RNA, 16 nt, Human
uugcccuugcccugac

SEQ ID NO: 3585411 - RNA, 18 nt, Human
uugcccuuucuguaccau

SEQ ID NO: 3585412 - RNA, 16 nt, Human
uugccgaaacuggaag

SEQ ID NO: 3585413 - RNA, 17 nt, Human
uugccgaaacuggaagu

SEQ ID NO: 3585414 - RNA, 15 nt, Human
uugccgucuaccuga

SEQ ID NO: 3585415 - RNA, 14 nt, Human
uugccguuauuaaa

SEQ ID NO: 3585416 - RNA, 15 nt, Human
uugccuaaauccauu

SEQ ID NO: 3585417 - RNA, 19 nt, Human
uugccuaagcauugccugg

SEQ ID NO: 3585418 - RNA, 23 nt, Human
uugccuaaguauuaaaacauugg

SEQ ID NO: 3585419 - RNA, 19 nt, Human
uugccuaauaaacauccuu

SEQ ID NO: 3585420 - RNA, 18 nt, Human
uugccuaauacauuaaag

SEQ ID NO: 3585421 - RNA, 19 nt, Human
uugccuaauacauuaaagc

SEQ ID NO: 3585422 - RNA, 21 nt, Human
uugccuaauacauuaaagcag

SEQ ID NO: 3585423 - RNA, 17 nt, Human
uugccuacuaugccaga

SEQ ID NO: 3585424 - RNA, 15 nt, Human
uugccuauccugcug

SEQ ID NO: 3585425 - RNA, 16 nt, Human
uugccuauccugcugu

SEQ ID NO: 3585426 - RNA, 20 nt, Human
uugccuauccugcuguucua

SEQ ID NO: 3585427 - RNA, 23 nt, Human
uugccucaaauaaaaagugcuuu

SEQ ID NO: 3585428 - RNA, 22 nt, Human
uugccuccccauuucccaucug

SEQ ID NO: 3585429 - RNA, 14 nt, Human
uugccuccguguca

SEQ ID NO: 3585430 - RNA, 18 nt, Human
uugccucugagagcauca

SEQ ID NO: 3585431 - RNA, 14 nt, Human
uugccucugccucu

SEQ ID NO: 3585432 - RNA, 20 nt, Human
uugccucuguccccuucucu

SEQ ID NO: 3585433 - RNA, 20 nt, Human
uugccugcagagagaagccu

SEQ ID NO: 3585434 - RNA, 13 nt, Human
uugccugcagggc

SEQ ID NO: 3585435 - RNA, 12 nt, Human
uugccugccuuu

SEQ ID NO: 3585436 - RNA, 15 nt, Human
uugccugccuuucca

SEQ ID NO: 3585437 - RNA, 12 nt, Human
uugccuggccuu

SEQ ID NO: 3585438 - RNA, 14 nt, Human
uugccuguaacaag

SEQ ID NO: 3585439 - RNA, 21 nt, Human
uugccuguguauggaaaaacc

SEQ ID NO: 3585440 - RNA, 13 nt, Human
uugccuguucagu

SEQ ID NO: 3585441 - RNA, 20 nt, Human
uugccuguucaguuacagaa

SEQ ID NO: 3585442 - RNA, 16 nt, Human
uugccuuaacuggagc

SEQ ID NO: 3585443 - RNA, 22 nt, Human
uugccuuccagaaaacaaaacu

SEQ ID NO: 3585444 - RNA, 22 nt, Human
uugccuuccuuucuccaggacc

SEQ ID NO: 3585445 - RNA, 23 nt, Human
uugccuuccuuucuccaggacca

SEQ ID NO: 3585446 - RNA, 14 nt, Human
uugccuucucacca

SEQ ID NO: 3585447 - RNA, 23 nt, Human
uugccuucucaccagcugcaaag

SEQ ID NO: 3585448 - RNA, 16 nt, Human
uugccuugacaaacuu

SEQ ID NO: 3585449 - RNA, 20 nt, Human
uugccuugcagaacugccau

SEQ ID NO: 3585450 - RNA, 20 nt, Human
uugccuugggcugcuccuca

SEQ ID NO: 3585451 - RNA, 22 nt, Human
uugccuuuagugaucacagcag

SEQ ID NO: 3585452 - RNA, 11 nt, Human
uugccuuucuc

SEQ ID NO: 3585453 - RNA, 14 nt, Human
uugccuuucugugu

SEQ ID NO: 3585454 - RNA, 17 nt, Human
uugaaggcagaaagcaa

SEQ ID NO: 3585455 - RNA, 15 nt, Human
uugaagggccagagc

SEQ ID NO: 3585456 - RNA, 19 nt, Human
uugaagggccagagccagg

SEQ ID NO: 3585457 - RNA, 19 nt, Human
uugaaggguaaagaaguuu

SEQ ID NO: 3585458 - RNA, 15 nt, Human
uugaagguagaaugu

SEQ ID NO: 3585459 - RNA, 19 nt, Human
uugaagguagaauguuuuc

SEQ ID NO: 3585460 - RNA, 22 nt, Human
uugaaggugauaagggaaaaga

SEQ ID NO: 3585461 - RNA, 15 nt, Human
uugaaguaaacuuuu

SEQ ID NO: 3585462 - RNA, 16 nt, Human
uugaaguaaacuuuuu

SEQ ID NO: 3585463 - RNA, 18 nt, Human
uugaaguaaucccgccac

SEQ ID NO: 3585464 - RNA, 12 nt, Human
uugaaguaauga

SEQ ID NO: 3585465 - RNA, 15 nt, Human
uugaaguacuugcca

SEQ ID NO: 3585466 - RNA, 21 nt, Human
uugaaguacuugccagaaguu

SEQ ID NO: 3585467 - RNA, 19 nt, Human
uugaagucaccuugugugu

SEQ ID NO: 3585468 - RNA, 16 nt, Human
uugaagucuuguauaa

SEQ ID NO: 3585469 - RNA, 20 nt, Human
uugaagucuuuaauaaauaa

SEQ ID NO: 3585470 - RNA, 17 nt, Human
uugaaguguaggcagac

SEQ ID NO: 3585471 - RNA, 18 nt, Human
uugaaguguaggcagaca

SEQ ID NO: 3585472 - RNA, 22 nt, Human
uugaaguguaggcagacacagg

SEQ ID NO: 3585473 - RNA, 23 nt, Human
uugaaguuagcuuuaacuuaaau

SEQ ID NO: 3585474 - RNA, 23 nt, Human
uugaaguugacucugcucuugca

SEQ ID NO: 3585475 - RNA, 19 nt, Human
uugaaguuuacauuuuuau

SEQ ID NO: 3585476 - RNA, 21 nt, Human
uugaauaaaaacuuugcuaaa

SEQ ID NO: 3585477 - RNA, 20 nt, Human
uugaauaaaaauauguacaa

SEQ ID NO: 3585478 - RNA, 21 nt, Human
uugaauaaacaccacuggauu

SEQ ID NO: 3585479 - RNA, 22 nt, Human
uugaauaaacaccacuggauua

SEQ ID NO: 3585480 - RNA, 12 nt, Human
uugaauaaacua

SEQ ID NO: 3585481 - RNA, 14 nt, Human
uugaauaaauguca

SEQ ID NO: 3585482 - RNA, 17 nt, Human
uugaauaaaugucacuu

SEQ ID NO: 3585483 - RNA, 15 nt, Human
uugaauaaggaaaug

SEQ ID NO: 3585484 - RNA, 12 nt, Human
uugaauaauggu

SEQ ID NO: 3585485 - RNA, 22 nt, Human
uugaauaaugguaccagauaaa

SEQ ID NO: 3585486 - RNA, 19 nt, Human
uugaauaccauuaaaacug

SEQ ID NO: 3585487 - RNA, 17 nt, Human
uugaauacuuugaaugu

SEQ ID NO: 3585488 - RNA, 18 nt, Human
uugaauacuuugaaugug

SEQ ID NO: 3585489 - RNA, 15 nt, Human
uugaauaguauugug

SEQ ID NO: 3585490 - RNA, 16 nt, Human
uugaauaguauugugu

SEQ ID NO: 3585491 - RNA, 17 nt, Human
uugaauauccccuccca

SEQ ID NO: 3585492 - RNA, 22 nt, Human
uugaauaucuuucgauaaacaa

SEQ ID NO: 3585493 - RNA, 23 nt, Human
uugaauaugauuaaaaauaucaa

SEQ ID NO: 3585494 - RNA, 22 nt, Human
uugaauauuugucgauauuucc

SEQ ID NO: 3585495 - RNA, 22 nt, Human
uugaaucaauaauauauuuucu

SEQ ID NO: 3585496 - RNA, 23 nt, Human
uugaaucaauaauauauuuucug

SEQ ID NO: 3585497 - RNA, 15 nt, Human
uugaaucacaugaau

SEQ ID NO: 3585498 - RNA, 23 nt, Human
uugaaucauguaguaucaaauau

SEQ ID NO: 3585499 - RNA, 14 nt, Human
uugaauccuuugcc

SEQ ID NO: 3585500 - RNA, 18 nt, Human
uugaaucuauuucacuua

SEQ ID NO: 3585501 - RNA, 21 nt, Human
uugaaucucauaauuuauaca

SEQ ID NO: 3585502 - RNA, 20 nt, Human
uugaaucuugucucaaugcu

SEQ ID NO: 3585503 - RNA, 14 nt, Human
uugaaucuuuaauu

SEQ ID NO: 3585504 - RNA, 15 nt, Human
uugaaucuuuccaau

SEQ ID NO: 3585505 - RNA, 20 nt, Human
uugaaugagaugauucagaa

SEQ ID NO: 3585506 - RNA, 23 nt, Human
uugaaugagaugauucagaaggg

SEQ ID NO: 3585507 - RNA, 16 nt, Human
uugaaugaugccauga

SEQ ID NO: 3585508 - RNA, 15 nt, Human
uugaaugcaaaccau

SEQ ID NO: 3585509 - RNA, 16 nt, Human
uugaaugcauuuuguu

SEQ ID NO: 3585510 - RNA, 14 nt, Human
uugaaugcugccag

SEQ ID NO: 3585511 - RNA, 15 nt, Human
uugaaugcuuuuuga

SEQ ID NO: 3585512 - RNA, 17 nt, Human
uugaaugcuuuuugaau

SEQ ID NO: 3585513 - RNA, 16 nt, Human
uugaauggcuauguuu

SEQ ID NO: 3585514 - RNA, 16 nt, Human
uugaaugguguuguau

SEQ ID NO: 3585515 - RNA, 20 nt, Human
uugaaugguguuguaugccu

SEQ ID NO: 3585516 - RNA, 18 nt, Human
uugaauguaugcuucaua

SEQ ID NO: 3585517 - RNA, 16 nt, Human
uugaaugucuuuugaa

SEQ ID NO: 3585518 - RNA, 21 nt, Human
uugaauguggcuugagaaaua

SEQ ID NO: 3585519 - RNA, 16 nt, Human
uugaauguuaagaauu

SEQ ID NO: 3585520 - RNA, 17 nt, Human
uugaauguuaagaauug

SEQ ID NO: 3585521 - RNA, 23 nt, Human
uugaauguuauuuguuauuuuca

SEQ ID NO: 3585522 - RNA, 14 nt, Human
uugaauuaaaacuu

SEQ ID NO: 3585523 - RNA, 16 nt, Human
uugaauuaaaacuucu

SEQ ID NO: 3585524 - RNA, 19 nt, Human
uugaauuaaauguucaucu

SEQ ID NO: 3585525 - RNA, 22 nt, Human
uugaauuaaauuaggaauaaau

SEQ ID NO: 3585526 - RNA, 23 nt, Human
uugaauuaauaucccuacaugua

SEQ ID NO: 3585527 - RNA, 14 nt, Human
uugaauuagaaaca

SEQ ID NO: 3585528 - RNA, 22 nt, Human
uugaauuaucuugguugaaaau

SEQ ID NO: 3585529 - RNA, 21 nt, Human
uugaauucuugguugaggaaa

SEQ ID NO: 3585530 - RNA, 14 nt, Human
uugaauuguuacau

SEQ ID NO: 3585531 - RNA, 14 nt, Human
uugaauuuaacaau

SEQ ID NO: 3585532 - RNA, 15 nt, Human
uugaauuuauuggcu

SEQ ID NO: 3585533 - RNA, 23 nt, Human
uugaauuuauuuuuaagaaagaa

SEQ ID NO: 3585534 - RNA, 16 nt, Human
uugaauuuuaaaucua

SEQ ID NO: 3585535 - RNA, 23 nt, Human
uugaauuuucaagcaucuccuga

SEQ ID NO: 3585536 - RNA, 18 nt, Human
uugaauuuucccacugca

SEQ ID NO: 3585537 - RNA, 21 nt, Human
uugaauuuuguguuagagauu

SEQ ID NO: 3585538 - RNA, 20 nt, Human
uugaauuuuguucucuggga

SEQ ID NO: 3585539 - RNA, 17 nt, Human
uugaauuuuuccuaugc

SEQ ID NO: 3585540 - RNA, 19 nt, Human
uugacaaaauguuauuucc

SEQ ID NO: 3585541 - RNA, 12 nt, Human
uugacaaaauuu

SEQ ID NO: 3585542 - RNA, 17 nt, Human
uugacaaaauuuucuca

SEQ ID NO: 3585543 - RNA, 18 nt, Human
uugacaaaauuuucucau

SEQ ID NO: 3585544 - RNA, 17 nt, Human
uugacaaaucuguguau

SEQ ID NO: 3585545 - RNA, 22 nt, Human
uugacaaaucuguguauauuau

SEQ ID NO: 3585546 - RNA, 14 nt, Human
uugacaacaaauua

SEQ ID NO: 3585547 - RNA, 12 nt, Human
uugacaacaucu

SEQ ID NO: 3585548 - RNA, 21 nt, Human
uugauucaccuccuaaaacaa

SEQ ID NO: 3585549 - RNA, 17 nt, Human
uugauucagacagcugc

SEQ ID NO: 3585550 - RNA, 14 nt, Human
uugauuccaucucc

SEQ ID NO: 3585551 - RNA, 13 nt, Human
uugauucuccuuc

SEQ ID NO: 3585552 - RNA, 17 nt, Human
uugauucuccuucagcc

SEQ ID NO: 3585553 - RNA, 23 nt, Human
uugauucuccuuuuauguguagu

SEQ ID NO: 3585554 - RNA, 13 nt, Human
uugauucucucca

SEQ ID NO: 3585555 - RNA, 14 nt, Human
uugauucucuccau

SEQ ID NO: 3585556 - RNA, 21 nt, Human
uugauugagaguaacuuaagu

SEQ ID NO: 3585557 - RNA, 23 nt, Human
uugauugcuaaauguaacagucu

SEQ ID NO: 3585558 - RNA, 15 nt, Human
uugauugcugugucc

SEQ ID NO: 3585559 - RNA, 22 nt, Human
uugauugggaaaacauuugcug

SEQ ID NO: 3585560 - RNA, 21 nt, Human
uugauugucagcuacuaauga

SEQ ID NO: 3585561 - RNA, 11 nt, Human
uugauuuacag

SEQ ID NO: 3585562 - RNA, 15 nt, Human
uugauuuauuaacuu

SEQ ID NO: 3585563 - RNA, 17 nt, Human
uugauuuauuaacuuaa

SEQ ID NO: 3585564 - RNA, 18 nt, Human
uugauuucccuucuucug

SEQ ID NO: 3585565 - RNA, 22 nt, Human
uugauuucuaguuauuuauucu

SEQ ID NO: 3585566 - RNA, 15 nt, Human
uugauuugcauugaa

SEQ ID NO: 3585567 - RNA, 13 nt, Human
uugauuuuacaau

SEQ ID NO: 3585568 - RNA, 20 nt, Human
uugauuuuuacguuugaaga

SEQ ID NO: 3585569 - RNA, 20 nt, Human
uugauuuuugccucuuccag

SEQ ID NO: 3585570 - RNA, 19 nt, Human
uugcaaaaacuacaaccaa

SEQ ID NO: 3585571 - RNA, 19 nt, Human
uugcaaaauagcauuuguu

SEQ ID NO: 3585572 - RNA, 16 nt, Human
uugcaaaauuuccagu

SEQ ID NO: 3585573 - RNA, 22 nt, Human
uugcaaaauuuccaguaccuuu

SEQ ID NO: 3585574 - RNA, 13 nt, Human
uugcaaagaaaga

SEQ ID NO: 3585575 - RNA, 19 nt, Human
uugcaaagaaagaaaaaaa

SEQ ID NO: 3585576 - RNA, 11 nt, Human
uugcaaagcaa

SEQ ID NO: 3585577 - RNA, 13 nt, Human
uugcaaaguacug

SEQ ID NO: 3585578 - RNA, 17 nt, Human
uugcaaaguauuguaaa

SEQ ID NO: 3585579 - RNA, 16 nt, Human
uugcaaauauaaacau

SEQ ID NO: 3585580 - RNA, 12 nt, Human
uugcaaaucuug

SEQ ID NO: 3585581 - RNA, 15 nt, Human
uugcaaaucuugaaa

SEQ ID NO: 3585582 - RNA, 22 nt, Human
uugcaaauguaguauggccugu

SEQ ID NO: 3585583 - RNA, 13 nt, Human
uugcaacacacag

SEQ ID NO: 3585584 - RNA, 14 nt, Human
uugcaacaggcugg

SEQ ID NO: 3585585 - RNA, 17 nt, Human
uugcaacaggcugggcu

SEQ ID NO: 3585586 - RNA, 12 nt, Human
uugcaaccacug

SEQ ID NO: 3585587 - RNA, 13 nt, Human
uugcaaccaggaa

SEQ ID NO: 3585588 - RNA, 19 nt, Human
uugcaagaugugaauuauu

SEQ ID NO: 3585589 - RNA, 16 nt, Human
uugcaagccuccugau

SEQ ID NO: 3585590 - RNA, 13 nt, Human
uugcaaggaagcc

SEQ ID NO: 3585591 - RNA, 19 nt, Human
uugcaagggaaaagucucu

SEQ ID NO: 3585592 - RNA, 21 nt, Human
uugcaaguauguuuuagcaug

SEQ ID NO: 3585593 - RNA, 15 nt, Human
uugcaagucauggcu

SEQ ID NO: 3585594 - RNA, 15 nt, Human
uugcaagugaagguu

SEQ ID NO: 3585595 - RNA, 18 nt, Human
uugcaagugaagguuuac

SEQ ID NO: 3585596 - RNA, 14 nt, Human
uugcaagugcugga

SEQ ID NO: 3585597 - RNA, 16 nt, Human
uugcaagugcuggagu

SEQ ID NO: 3585598 - RNA, 14 nt, Human
uugcaauaacagcu

SEQ ID NO: 3585599 - RNA, 17 nt, Human
uugcaauaacagcugca

SEQ ID NO: 3585600 - RNA, 20 nt, Human
uugcaauaacagcugcaauu

SEQ ID NO: 3585601 - RNA, 16 nt, Human
uugcaauggcagccuu

SEQ ID NO: 3585602 - RNA, 19 nt, Human
uugcaauggcagccuuggc

SEQ ID NO: 3585603 - RNA, 20 nt, Human
uugcaaugguguugcccuga

SEQ ID NO: 3585604 - RNA, 15 nt, Human
uugcaauuccugcuc

SEQ ID NO: 3585605 - RNA, 20 nt, Human
uugcaauuuuaacacacaua

SEQ ID NO: 3585606 - RNA, 15 nt, Human
uugcacaaaaagaua

SEQ ID NO: 3585607 - RNA, 22 nt, Human
uugcacaaaaagauaccuuaaa

SEQ ID NO: 3585608 - RNA, 19 nt, Human
uugcacaaaccaauuaaac

SEQ ID NO: 3585609 - RNA, 21 nt, Human
uugcacaauauugaacuuuuu

SEQ ID NO: 3585610 - RNA, 17 nt, Human
uugcacacaucaucugu

SEQ ID NO: 3585611 - RNA, 20 nt, Human
uugcacacaucaucuguaag

SEQ ID NO: 3585612 - RNA, 21 nt, Human
uugcacacccacucagcuccg

SEQ ID NO: 3585613 - RNA, 22 nt, Human
uugcacacuccccugcacugga

SEQ ID NO: 3585614 - RNA, 13 nt, Human
uugcacacuugug

SEQ ID NO: 3585615 - RNA, 23 nt, Human
uugcacagaaguccuguaugucu

SEQ ID NO: 3585616 - RNA, 15 nt, Human
uugcacagcaucuca

SEQ ID NO: 3585617 - RNA, 19 nt, Human
uugcacagccaaauuuaaa

SEQ ID NO: 3585618 - RNA, 16 nt, Human
uugcacagcuaugaag

SEQ ID NO: 3585619 - RNA, 21 nt, Human
uugcacagucacugcucuuca

SEQ ID NO: 3585620 - RNA, 11 nt, Human
uugcacauuaa

SEQ ID NO: 3585621 - RNA, 15 nt, Human
uugcacccagcccug

SEQ ID NO: 3585622 - RNA, 21 nt, Human
uugcaccccaaagcuuuccug

SEQ ID NO: 3585623 - RNA, 19 nt, Human
uugcaccccaugcuguuga

SEQ ID NO: 3585624 - RNA, 24 nt, Human
uugcaccccucacucuggccucag

SEQ ID NO: 3585625 - RNA, 15 nt, Human
uugcaccccucccau

SEQ ID NO: 3585626 - RNA, 13 nt, Human
uugcaccuguccc

SEQ ID NO: 3585627 - RNA, 19 nt, Human
uugcacgacgcccucuccc

SEQ ID NO: 3585628 - RNA, 20 nt, Human
uugcacgcgcccuuucuacc

SEQ ID NO: 3585629 - RNA, 14 nt, Human
uugcacguguguuu

SEQ ID NO: 3585630 - RNA, 23 nt, Human
uugcacguguguuuuucuauuaa

SEQ ID NO: 3585631 - RNA, 16 nt, Human
uugcacuaagauauuu

SEQ ID NO: 3585632 - RNA, 16 nt, Human
uugcacucaaaucuua

SEQ ID NO: 3585633 - RNA, 15 nt, Human
uugcacuccagccug

SEQ ID NO: 3585634 - RNA, 19 nt, Human
uugcacucuaaaagguuca

SEQ ID NO: 3585635 - RNA, 22 nt, Human
uugcacucuaaaagguucaggg

SEQ ID NO: 3585636 - RNA, 12 nt, Human
uugcacugaagu

SEQ ID NO: 3585637 - RNA, 17 nt, Human
uugcacuggaguucuau

SEQ ID NO: 3585638 - RNA, 20 nt, Human
uugcacuugugauuauuuau

SEQ ID NO: 3585639 - RNA, 12 nt, Human
uugcacuuugua

SEQ ID NO: 3585640 - RNA, 14 nt, Human
uugcacuuuguagu

SEQ ID NO: 3585641 - RNA, 20 nt, Human
uugcagaaaagcaccugccg

SEQ ID NO: 3585642 - RNA, 17 nt, Human
uugcagaaaauucugug

SEQ ID NO: 3585643 - RNA, 11 nt, Human
uugcagaacug

SEQ ID NO: 3585644 - RNA, 16 nt, Human
uugcagaacugccauu

SEQ ID NO: 3585645 - RNA, 21 nt, Human
uugcagaacuugaagccugcu

SEQ ID NO: 3585646 - RNA, 20 nt, Human
uugcagaagaggguguguuu

SEQ ID NO: 3585647 - RNA, 16 nt, Human
uugcagacaggcaagc

SEQ ID NO: 3585648 - RNA, 13 nt, Human
uugcagacuagaa

SEQ ID NO: 3585649 - RNA, 19 nt, Human
uugcagacucaguuuguca

SEQ ID NO: 3585650 - RNA, 19 nt, Human
uugcagagacaggaccuga

SEQ ID NO: 3585651 - RNA, 12 nt, Human
uugcagcaguga

SEQ ID NO: 3585652 - RNA, 22 nt, Human
uugcagcccugcugcugccugc

SEQ ID NO: 3585653 - RNA, 23 nt, Human
uugcagccugcucuagugggaca

SEQ ID NO: 3585654 - RNA, 19 nt, Human
uugcagcgauuaauaacag

SEQ ID NO: 3585655 - RNA, 17 nt, Human
uugcagcucccauucua

SEQ ID NO: 3585656 - RNA, 18 nt, Human
uugcagcugggagaaggg

SEQ ID NO: 3585657 - RNA, 20 nt, Human
uugcagcuguuuuguugaca

SEQ ID NO: 3585658 - RNA, 21 nt, Human
uugcagcuguuuuguugacau

SEQ ID NO: 3585659 - RNA, 12 nt, Human
uugcagggcagc

SEQ ID NO: 3585660 - RNA, 14 nt, Human
uugcagggcagccc

SEQ ID NO: 3585661 - RNA, 23 nt, Human
uugcaggguccucuucugggccu

SEQ ID NO: 3585662 - RNA, 19 nt, Human
uugcagguggaacucaguc

SEQ ID NO: 3585663 - RNA, 20 nt, Human
uugcagguggaacucaguca

SEQ ID NO: 3585664 - RNA, 14 nt, Human
uugcagguggccaa

SEQ ID NO: 3585665 - RNA, 23 nt, Human
uugcaguaucggcacuguacaaa

SEQ ID NO: 3585666 - RNA, 22 nt, Human
uugcagucacucuagucaauga

SEQ ID NO: 3585667 - RNA, 13 nt, Human
uugcagucccaag

SEQ ID NO: 3585668 - RNA, 23 nt, Human
uugcaguccuuuuacuacagcua

SEQ ID NO: 3585669 - RNA, 13 nt, Human
uugcagugagcca

SEQ ID NO: 3585670 - RNA, 15 nt, Human
uugcagugagcugag

SEQ ID NO: 3585671 - RNA, 21 nt, Human
uugcaguucccacauuaaaga

SEQ ID NO: 3585672 - RNA, 18 nt, Human
uugcaguuuaucauucaa

SEQ ID NO: 3585673 - RNA, 20 nt, Human
uugcaguuuaucauucaagu

SEQ ID NO: 3585674 - RNA, 14 nt, Human
uugcauaaagcaua

SEQ ID NO: 3585675 - RNA, 19 nt, Human
uugcauaacaauuccucua

SEQ ID NO: 3585676 - RNA, 21 nt, Human
uugcauaauaagcuaaagagg

SEQ ID NO: 3585677 - RNA, 16 nt, Human
uugcauacuauuaaac

SEQ ID NO: 3585678 - RNA, 19 nt, Human
uugcauacuauuaaacaug

SEQ ID NO: 3585679 - RNA, 17 nt, Human
uugcauacuuuguauuu

SEQ ID NO: 3585680 - RNA, 17 nt, Human
uugcauauaacuuauau

SEQ ID NO: 3585681 - RNA, 14 nt, Human
uugcauauauacau

SEQ ID NO: 3585682 - RNA, 14 nt, Human
uugcauauguauga

SEQ ID NO: 3585683 - RNA, 19 nt, Human
uugcauauuauaaaggaua

SEQ ID NO: 3585684 - RNA, 17 nt, Human
uugcauauugcauacua

SEQ ID NO: 3585685 - RNA, 18 nt, Human
uugcauauuuuguaacuu

SEQ ID NO: 3585686 - RNA, 20 nt, Human
uugcaucaccucuguaauuu

SEQ ID NO: 3585687 - RNA, 23 nt, Human
uugcaucaguauuaauacuaaaa

SEQ ID NO: 3585688 - RNA, 18 nt, Human
uugcauccaacuccagga

SEQ ID NO: 3585689 - RNA, 23 nt, Human
uugcaucccaaaccacgccucuu

SEQ ID NO: 3585690 - RNA, 15 nt, Human
uugcauccuuccuau

SEQ ID NO: 3585691 - RNA, 14 nt, Human
uugcaucugaaaua

SEQ ID NO: 3585692 - RNA, 20 nt, Human
uugcaucuggguagcuguaa

SEQ ID NO: 3585693 - RNA, 13 nt, Human
uugcaucuguaua

SEQ ID NO: 3585694 - RNA, 22 nt, Human
uugcaugcugcuuuaauuguga

SEQ ID NO: 3585695 - RNA, 19 nt, Human
uugcauggcacuugcaucu

SEQ ID NO: 3585696 - RNA, 19 nt, Human
uugcauggcaucaccucca

SEQ ID NO: 3585697 - RNA, 18 nt, Human
uugcaugggcuaaugaag

SEQ ID NO: 3585698 - RNA, 13 nt, Human
uugcauguaguaa

SEQ ID NO: 3585699 - RNA, 17 nt, Human
uugcauguaguaacacu

SEQ ID NO: 3585700 - RNA, 19 nt, Human
uugcauguaguaacacuaa

SEQ ID NO: 3585701 - RNA, 14 nt, Human
uugcaugugaaaau

SEQ ID NO: 3585702 - RNA, 17 nt, Human
uugcauguuauguuuaa

SEQ ID NO: 3585703 - RNA, 19 nt, Human
uugcauguuccacuaaccc

SEQ ID NO: 3585704 - RNA, 16 nt, Human
uugcauucuuauucau

SEQ ID NO: 3585705 - RNA, 19 nt, Human
uugcauugacuuuccccac

SEQ ID NO: 3585706 - RNA, 15 nt, Human
uugcauugucugucu

SEQ ID NO: 3585707 - RNA, 18 nt, Human
uugccaaaaagugaaaua

SEQ ID NO: 3585708 - RNA, 19 nt, Human
uugccaaaaagugaaauaa

SEQ ID NO: 3585709 - RNA, 23 nt, Human
uugccaaaacccagcugcacccc

SEQ ID NO: 3585710 - RNA, 15 nt, Human
uugccaaaauaaugu

SEQ ID NO: 3585711 - RNA, 22 nt, Human
uugccaaaauaaugucuuguua

SEQ ID NO: 3585712 - RNA, 14 nt, Human
uugccaaacauuaa

SEQ ID NO: 3585713 - RNA, 21 nt, Human
uugccaaacauuaauguugau

SEQ ID NO: 3585714 - RNA, 16 nt, Human
uugccaaauauguccu

SEQ ID NO: 3585715 - RNA, 22 nt, Human
uugccaagacaaaucaacagaa

SEQ ID NO: 3585716 - RNA, 17 nt, Human
uugccaagaccuuucaa

SEQ ID NO: 3585717 - RNA, 23 nt, Human
uugccaagggcccaaagaaagag

SEQ ID NO: 3585718 - RNA, 19 nt, Human
uugccaauuugcacauuaa

SEQ ID NO: 3585719 - RNA, 22 nt, Human
uugccaauuugcacauuaaaug

SEQ ID NO: 3585720 - RNA, 13 nt, Human
uugccacagcucu

SEQ ID NO: 3585721 - RNA, 22 nt, Human
uugccacagcuggagcucucaa

SEQ ID NO: 3585722 - RNA, 13 nt, Human
uugccacagcuuu

SEQ ID NO: 3585723 - RNA, 19 nt, Human
uugccacaggccucccugu

SEQ ID NO: 3585724 - RNA, 19 nt, Human
uugccaccaacuggcccuc

SEQ ID NO: 3585725 - RNA, 13 nt, Human
uugccacccucau

SEQ ID NO: 3585726 - RNA, 16 nt, Human
uugccacuaauuuuag

SEQ ID NO: 3585727 - RNA, 21 nt, Human
uugccacuaauuuuaguauuc

SEQ ID NO: 3585728 - RNA, 20 nt, Human
uugccacugauauucagaau

SEQ ID NO: 3585729 - RNA, 15 nt, Human
uugccacuuugcacg

SEQ ID NO: 3585730 - RNA, 17 nt, Human
uugccagcugcugagcc

SEQ ID NO: 3585731 - RNA, 20 nt, Human
uugccagcugcugagccgca

SEQ ID NO: 3585732 - RNA, 15 nt, Human
uugccagcugcugcu

SEQ ID NO: 3585733 - RNA, 19 nt, Human
uugccagcugcugcuggau

SEQ ID NO: 3585734 - RNA, 16 nt, Human
uugccaggacaugcaa

SEQ ID NO: 3585735 - RNA, 19 nt, Human
uugccaggcuggagugcag

SEQ ID NO: 3585736 - RNA, 14 nt, Human
uugccagugucuuu

SEQ ID NO: 3585737 - RNA, 17 nt, Human
uugccagugucuuucuu

SEQ ID NO: 3585738 - RNA, 20 nt, Human
uugccaguuguccuccuucc

SEQ ID NO: 3585739 - RNA, 13 nt, Human
uugccauauugca

SEQ ID NO: 3585740 - RNA, 22 nt, Human
uugccauauugcacaugucuua

SEQ ID NO: 3585741 - RNA, 13 nt, Human
uugccaucccucc

SEQ ID NO: 3585742 - RNA, 17 nt, Human
uugccaucccucccucc

SEQ ID NO: 3585743 - RNA, 18 nt, Human
uugccaucccucccucca

SEQ ID NO: 3585744 - RNA, 20 nt, Human
uugccaugacaacuucuaau

SEQ ID NO: 3585745 - RNA, 13 nt, Human
uugccaugugcuu

SEQ ID NO: 3585746 - RNA, 20 nt, Human
uugccaugugcuucugccac

SEQ ID NO: 3585747 - RNA, 14 nt, Human
uugccauguugcca

SEQ ID NO: 3585748 - RNA, 21 nt, Human
uugcccaacaccagccccugc

SEQ ID NO: 3585749 - RNA, 15 nt, Human
uugcccaaccucagc

SEQ ID NO: 3585750 - RNA, 23 nt, Human
uugcccacgcuggagugcaguga

SEQ ID NO: 3585751 - RNA, 22 nt, Human
uugcccacuccugcucugcucg

SEQ ID NO: 3585752 - RNA, 17 nt, Human
uugcccagagaugccuc

SEQ ID NO: 3585753 - RNA, 18 nt, Human
uugcccagagaugccucc

SEQ ID NO: 3585754 - RNA, 19 nt, Human
uugcccagagaugccucca

SEQ ID NO: 3585755 - RNA, 16 nt, Human
uugcccagccucuuuc

SEQ ID NO: 3585756 - RNA, 19 nt, Human
uugcccagccucuuucccu

SEQ ID NO: 3585757 - RNA, 17 nt, Human
uugcccaggcuggagug

SEQ ID NO: 3585758 - RNA, 14 nt, Human
uugcccaggcuggc

SEQ ID NO: 3585759 - RNA, 17 nt, Human
uugcccagggcucagcc

SEQ ID NO: 3585760 - RNA, 19 nt, Human
uugcccagggcucagccug

SEQ ID NO: 3585761 - RNA, 20 nt, Human
uugcccagggcucagccugg

SEQ ID NO: 3585762 - RNA, 13 nt, Human
uugcccauccuga

SEQ ID NO: 3585763 - RNA, 16 nt, Human
uugcccauuuacacuu

SEQ ID NO: 3585764 - RNA, 14 nt, Human
uugccccaaccccc

SEQ ID NO: 3585765 - RNA, 18 nt, Human
uugccccaacccuucuuc

SEQ ID NO: 3585766 - RNA, 21 nt, Human
uugcccccaaacccccauucu

SEQ ID NO: 3585767 - RNA, 13 nt, Human
uugccccccaccc

SEQ ID NO: 3585768 - RNA, 16 nt, Human
uugccccccaccccag

SEQ ID NO: 3585769 - RNA, 16 nt, Human
uugccccccuggccuc

SEQ ID NO: 3585770 - RNA, 17 nt, Human
uugccccgucucuguuc

SEQ ID NO: 3585771 - RNA, 13 nt, Human
uugccccugagac

SEQ ID NO: 3585772 - RNA, 19 nt, Human
uugcccggauucugggagg

SEQ ID NO: 3585773 - RNA, 16 nt, Human
uuggagggugucccaa

SEQ ID NO: 3585774 - RNA, 23 nt, Human
uuggaguccccucaccuccucua

SEQ ID NO: 3585775 - RNA, 15 nt, Human
uuggagucuuccaaa

SEQ ID NO: 3585776 - RNA, 15 nt, Human
uuggagugcaguggc

SEQ ID NO: 3585777 - RNA, 22 nt, Human
uuggaguucauucauauuacaa

SEQ ID NO: 3585778 - RNA, 17 nt, Human
uuggaguuggaguagaa

SEQ ID NO: 3585779 - RNA, 19 nt, Human
uuggaguuugcauucuuau

SEQ ID NO: 3585780 - RNA, 22 nt, Human
uuggauaacaccaccauucaca

SEQ ID NO: 3585781 - RNA, 13 nt, Human
uuggauccugugu

SEQ ID NO: 3585782 - RNA, 18 nt, Human
uuggauccuguguggaga

SEQ ID NO: 3585783 - RNA, 23 nt, Human
uuggaucucuucuuaauguacau

SEQ ID NO: 3585784 - RNA, 12 nt, Human
uuggaugaguuu

SEQ ID NO: 3585785 - RNA, 24 nt, Human
uuggaugcagugcucgcuguugcu

SEQ ID NO: 3585786 - RNA, 21 nt, Human
uuggauggaguccagggaaga

SEQ ID NO: 3585787 - RNA, 22 nt, Human
uuggaugguguuacauauuaua

SEQ ID NO: 3585788 - RNA, 15 nt, Human
uuggauguaauuuag

SEQ ID NO: 3585789 - RNA, 21 nt, Human
uuggauuaaauacauauggau

SEQ ID NO: 3585790 - RNA, 17 nt, Human
uuggauuauucauuuaa

SEQ ID NO: 3585791 - RNA, 14 nt, Human
uuggauuauuuaau

SEQ ID NO: 3585792 - RNA, 17 nt, Human
uuggauuauuuaauaac

SEQ ID NO: 3585793 - RNA, 23 nt, Human
uuggauuccaugcuaagcaagcu

SEQ ID NO: 3585794 - RNA, 17 nt, Human
uuggauucuaaauacau

SEQ ID NO: 3585795 - RNA, 15 nt, Human
uuggauucuuaugua

SEQ ID NO: 3585796 - RNA, 17 nt, Human
uuggauugacaguaacu

SEQ ID NO: 3585797 - RNA, 17 nt, Human
uuggauuggacaaaaug

SEQ ID NO: 3585798 - RNA, 21 nt, Human
uuggauuggacaaaaugacuu

SEQ ID NO: 3585799 - RNA, 19 nt, Human
uuggauuuaaaagccugcu

SEQ ID NO: 3585800 - RNA, 16 nt, Human
uuggauuuaguuucag

SEQ ID NO: 3585801 - RNA, 12 nt, Human
uuggauuuccua

SEQ ID NO: 3585802 - RNA, 16 nt, Human
uuggauuuuugacucu

SEQ ID NO: 3585803 - RNA, 17 nt, Human
uuggcaaaaaggcagga

SEQ ID NO: 3585804 - RNA, 20 nt, Human
uuggcaaacucuccaccaca

SEQ ID NO: 3585805 - RNA, 20 nt, Human
uuggcaauaguuugcauaga

SEQ ID NO: 3585806 - RNA, 21 nt, Human
uuggcaaugacucaaagucug

SEQ ID NO: 3585807 - RNA, 13 nt, Human
uuggcaauuuugu

SEQ ID NO: 3585808 - RNA, 16 nt, Human
uuggcacagaaacaca

SEQ ID NO: 3585809 - RNA, 17 nt, Human
uuggcaccagacaccca

SEQ ID NO: 3585810 - RNA, 20 nt, Human
uuggcaccagacacccagga

SEQ ID NO: 3585811 - RNA, 19 nt, Human
uuggcaccuaauccaggca

SEQ ID NO: 3585812 - RNA, 23 nt, Human
uuggcaccuucccccucccccag

SEQ ID NO: 3585813 - RNA, 14 nt, Human
uuggcacucacaga

SEQ ID NO: 3585814 - RNA, 15 nt, Human
uuggcagcaccuguc

SEQ ID NO: 3585815 - RNA, 14 nt, Human
uuggcagcagauuu

SEQ ID NO: 3585816 - RNA, 21 nt, Human
uuggcagcccgggucaucugu

SEQ ID NO: 3585817 - RNA, 20 nt, Human
uuggcagccuacuagggacc

SEQ ID NO: 3585818 - RNA, 12 nt, Human
uuggcagccuug

SEQ ID NO: 3585819 - RNA, 16 nt, Human
uuggcagccuugugau

SEQ ID NO: 3585820 - RNA, 20 nt, Human
uuggcagguccuggccagau

SEQ ID NO: 3585821 - RNA, 23 nt, Human
uuggcagugagugagccuggcuc

SEQ ID NO: 3585822 - RNA, 19 nt, Human
uuggcaguguuuugagaac

SEQ ID NO: 3585823 - RNA, 20 nt, Human
uuggcauggaaauuuaaagc

SEQ ID NO: 3585824 - RNA, 14 nt, Human
uuggcauggcuuua

SEQ ID NO: 3585825 - RNA, 20 nt, Human
uuggcauguaaauguaaacu

SEQ ID NO: 3585826 - RNA, 14 nt, Human
uuggcauuaaaacu

SEQ ID NO: 3585827 - RNA, 19 nt, Human
uuggcauuccccacuugag

SEQ ID NO: 3585828 - RNA, 15 nt, Human
uuggccaaacaagug

SEQ ID NO: 3585829 - RNA, 15 nt, Human
uuggccaaaguguua

SEQ ID NO: 3585830 - RNA, 21 nt, Human
uuggccacuccgagagguggg

SEQ ID NO: 3585831 - RNA, 22 nt, Human
uuggccagaaaccuuccugcug

SEQ ID NO: 3585832 - RNA, 14 nt, Human
uuggccaggcuggu

SEQ ID NO: 3585833 - RNA, 19 nt, Human
uuggccauauuuaccucag

SEQ ID NO: 3585834 - RNA, 22 nt, Human
uuggccauauuuaccucagccu

SEQ ID NO: 3585835 - RNA, 12 nt, Human
uuggccaucugc

SEQ ID NO: 3585836 - RNA, 19 nt, Human
uuggccaugcagaaagcau

SEQ ID NO: 3585837 - RNA, 22 nt, Human
uuggcccaggaguuuggccaga

SEQ ID NO: 3585838 - RNA, 20 nt, Human
uuggcccaggauuauuguca

SEQ ID NO: 3585839 - RNA, 18 nt, Human
uuggccccugcccggcug

SEQ ID NO: 3585840 - RNA, 19 nt, Human
uuggccggcugugcucaga

SEQ ID NO: 3585841 - RNA, 23 nt, Human
uuggccuagcccacccugcugcc

SEQ ID NO: 3585842 - RNA, 20 nt, Human
uuggccuaucuccuagggcu

SEQ ID NO: 3585843 - RNA, 12 nt, Human
uuggccucagaa

SEQ ID NO: 3585844 - RNA, 23 nt, Human
uuggccugagaugccuggugagc

SEQ ID NO: 3585845 - RNA, 16 nt, Human
uuggccuggagguggg

SEQ ID NO: 3585846 - RNA, 12 nt, Human
uuggccugggcc

SEQ ID NO: 3585847 - RNA, 19 nt, Human
uuggcgcacccuccccucc

SEQ ID NO: 3585848 - RNA, 15 nt, Human
uuggcgcuauuacaa

SEQ ID NO: 3585849 - RNA, 22 nt, Human
uuggcgcugccccuggcagccc

SEQ ID NO: 3585850 - RNA, 23 nt, Human
uuggcgcugccccuggcagcccc

SEQ ID NO: 3585851 - RNA, 22 nt, Human
uuggcggggaggaggaaauccc

SEQ ID NO: 3585852 - RNA, 22 nt, Human
uuggcguagcagaguuaaaucu

SEQ ID NO: 3585853 - RNA, 18 nt, Human
uuggcguaggcuacagag

SEQ ID NO: 3585854 - RNA, 13 nt, Human
uuggcgugacccg

SEQ ID NO: 3585855 - RNA, 21 nt, Human
uuggcuagagguucaaagaua

SEQ ID NO: 3585856 - RNA, 22 nt, Human
uuggcuaggaccccuccaugug

SEQ ID NO: 3585857 - RNA, 16 nt, Human
uuggcuauuuaaaacu

SEQ ID NO: 3585858 - RNA, 17 nt, Human
uuggcuauuuaaaacuu

SEQ ID NO: 3585859 - RNA, 22 nt, Human
uuggcucccaucuuuuguuacu

SEQ ID NO: 3585860 - RNA, 22 nt, Human
uuggcuccugcccacugauagc

SEQ ID NO: 3585861 - RNA, 12 nt, Human
uuggcucugagg

SEQ ID NO: 3585862 - RNA, 14 nt, Human
uuggcucugccagu

SEQ ID NO: 3585863 - RNA, 13 nt, Human
uuggcucuggaga

SEQ ID NO: 3585864 - RNA, 19 nt, Human
uuggcucuggagacagccc

SEQ ID NO: 3585865 - RNA, 19 nt, Human
uuggcugaaauucuccugg

SEQ ID NO: 3585866 - RNA, 20 nt, Human
uuggcugaaauucuccugga

SEQ ID NO: 3585867 - RNA, 11 nt, Human
uuggcugcuga

SEQ ID NO: 3585868 - RNA, 17 nt, Human
uuggcuggacccagcca

SEQ ID NO: 3585869 - RNA, 23 nt, Human
uuggcuggaugaaauuuucuaga

SEQ ID NO: 3585870 - RNA, 16 nt, Human
uuggcugggcccagaa

SEQ ID NO: 3585871 - RNA, 17 nt, Human
uuggcugggcccagaag

SEQ ID NO: 3585872 - RNA, 22 nt, Human
uuggcugggggccucagugcca

SEQ ID NO: 3585873 - RNA, 11 nt, Human
uuggcugggua

SEQ ID NO: 3585874 - RNA, 14 nt, Human
uuggcuuaaauaua

SEQ ID NO: 3585875 - RNA, 15 nt, Human
uuggcuuaaauauag

SEQ ID NO: 3585876 - RNA, 17 nt, Human
uuggcuuacugcagccu

SEQ ID NO: 3585877 - RNA, 19 nt, Human
uuggcuuauaauucuuuca

SEQ ID NO: 3585878 - RNA, 23 nt, Human
uuggcuucacggaagagccuugc

SEQ ID NO: 3585879 - RNA, 11 nt, Human
uuggcuucugu

SEQ ID NO: 3585880 - RNA, 14 nt, Human
uuggcuuuauccuc

SEQ ID NO: 3585881 - RNA, 17 nt, Human
uuggcuuuaugcacauu

SEQ ID NO: 3585882 - RNA, 16 nt, Human
uuggcuuuccagucau

SEQ ID NO: 3585883 - RNA, 22 nt, Human
uuggcuuuggguugcaggaccu

SEQ ID NO: 3585884 - RNA, 19 nt, Human
uuggcuuuucugauccagu

SEQ ID NO: 3585885 - RNA, 13 nt, Human
uugggaaaacaug

SEQ ID NO: 3585886 - RNA, 16 nt, Human
uugggaaaacauuugc

SEQ ID NO: 3585887 - RNA, 22 nt, Human
uugggaaccaagcuauuccuuu

SEQ ID NO: 3585888 - RNA, 19 nt, Human
uugggaauauccauguacu

SEQ ID NO: 3585889 - RNA, 17 nt, Human
uugggaauauuugaauc

SEQ ID NO: 3585890 - RNA, 18 nt, Human
uugggaauggauccugga

SEQ ID NO: 3585891 - RNA, 14 nt, Human
uugggaauguuugu

SEQ ID NO: 3585892 - RNA, 20 nt, Human
uuuaauaaaaaggcaccuau

SEQ ID NO: 3585893 - RNA, 16 nt, Human
uuuaauaaaauaauuc

SEQ ID NO: 3585894 - RNA, 17 nt, Human
uuuaauaaaauaauucu

SEQ ID NO: 3585895 - RNA, 21 nt, Human
uuuaauaaagcgaaaaacuca

SEQ ID NO: 3585896 - RNA, 14 nt, Human
uuuaauaaauuuau

SEQ ID NO: 3585897 - RNA, 23 nt, Human
uuuaauaacauuaccuuacugug

SEQ ID NO: 3585898 - RNA, 14 nt, Human
uuuaauaauuauau

SEQ ID NO: 3585899 - RNA, 14 nt, Human
uuuaauacagcagu

SEQ ID NO: 3585900 - RNA, 17 nt, Human
uuuaauagaauauaauu

SEQ ID NO: 3585901 - RNA, 17 nt, Human
uuuaauaguguuaauca

SEQ ID NO: 3585902 - RNA, 23 nt, Human
uuuaauauaaaguuuuauauauu

SEQ ID NO: 3585903 - RNA, 18 nt, Human
uuuaauauaaaugcaaau

SEQ ID NO: 3585904 - RNA, 14 nt, Human
uuuaauauagcuau

SEQ ID NO: 3585905 - RNA, 16 nt, Human
uuuaauauagcuauuu

SEQ ID NO: 3585906 - RNA, 13 nt, Human
uuuaauaucuuca

SEQ ID NO: 3585907 - RNA, 15 nt, Human
uuuaauaugaaauuu

SEQ ID NO: 3585908 - RNA, 16 nt, Human
uuuaauaugaaauuuu

SEQ ID NO: 3585909 - RNA, 18 nt, Human
uuuaauauggguucuuuu

SEQ ID NO: 3585910 - RNA, 13 nt, Human
uuuaauauguauu

SEQ ID NO: 3585911 - RNA, 15 nt, Human
uuuaauauuaaagcc

SEQ ID NO: 3585912 - RNA, 15 nt, Human
uuuaauauuaccuaa

SEQ ID NO: 3585913 - RNA, 15 nt, Human
uuuaauauugagaaa

SEQ ID NO: 3585914 - RNA, 12 nt, Human
uuuaauauuuaa

SEQ ID NO: 3585915 - RNA, 13 nt, Human
uuuaauauuuaaa

SEQ ID NO: 3585916 - RNA, 17 nt, Human
uuuaaucaaauuuguag

SEQ ID NO: 3585917 - RNA, 12 nt, Human
uuuaaucacuua

SEQ ID NO: 3585918 - RNA, 12 nt, Human
uuuaaucauaua

SEQ ID NO: 3585919 - RNA, 14 nt, Human
uuuaaucaugaaau

SEQ ID NO: 3585920 - RNA, 12 nt, Human
uuuaauccaguu

SEQ ID NO: 3585921 - RNA, 22 nt, Human
uuuaauccccaguaaaauugcc

SEQ ID NO: 3585922 - RNA, 16 nt, Human
uuuaaucuacugcauu

SEQ ID NO: 3585923 - RNA, 17 nt, Human
uuuaaucuacugcauuu

SEQ ID NO: 3585924 - RNA, 21 nt, Human
uuuaaucuccaccagucauuu

SEQ ID NO: 3585925 - RNA, 18 nt, Human
uuuaaucuguuauguacu

SEQ ID NO: 3585926 - RNA, 13 nt, Human
uuuaaucuucagu

SEQ ID NO: 3585927 - RNA, 15 nt, Human
uuuaaucuuuuauga

SEQ ID NO: 3585928 - RNA, 18 nt, Human
uuuaaucuuuuaugauug

SEQ ID NO: 3585929 - RNA, 16 nt, Human
uuuaaugaagaucuaa

SEQ ID NO: 3585930 - RNA, 19 nt, Human
uuuaaugaagaucuaaaua

SEQ ID NO: 3585931 - RNA, 14 nt, Human
uuuaaugagauaau

SEQ ID NO: 3585932 - RNA, 23 nt, Human
uuuaaugcauguuaggaaaauuu

SEQ ID NO: 3585933 - RNA, 18 nt, Human
uuuaaugcauuaaaccug

SEQ ID NO: 3585934 - RNA, 21 nt, Human
uuuaaugcauuaaaccugucu

SEQ ID NO: 3585935 - RNA, 19 nt, Human
uuuaaugcuaaucuuguga

SEQ ID NO: 3585936 - RNA, 15 nt, Human
uuuaaugcuauuuga

SEQ ID NO: 3585937 - RNA, 19 nt, Human
uuuaaugcuucauucaaua

SEQ ID NO: 3585938 - RNA, 21 nt, Human
uuuaauggacaugagauaaug

SEQ ID NO: 3585939 - RNA, 19 nt, Human
uuuaauggcagcagaaaac

SEQ ID NO: 3585940 - RNA, 20 nt, Human
uuuaauggccggcuggaaau

SEQ ID NO: 3585941 - RNA, 19 nt, Human
uuuaauggggugcaccugu

SEQ ID NO: 3585942 - RNA, 16 nt, Human
uuuaauguaaagauuu

SEQ ID NO: 3585943 - RNA, 14 nt, Human
uuuaauguagccau

SEQ ID NO: 3585944 - RNA, 18 nt, Human
uuuaauguauaguaaauc

SEQ ID NO: 3585945 - RNA, 20 nt, Human
uuuaauguauaguaaaucac

SEQ ID NO: 3585946 - RNA, 13 nt, Human
uuuaaugugaacu

SEQ ID NO: 3585947 - RNA, 14 nt, Human
uuuaucagauacau

SEQ ID NO: 3585948 - RNA, 16 nt, Human
uuuaucagauacauca

SEQ ID NO: 3585949 - RNA, 20 nt, Human
uuuaucagauacaucacugc

SEQ ID NO: 3585950 - RNA, 23 nt, Human
uuuaucagauugcuuuugugcau

SEQ ID NO: 3585951 - RNA, 12 nt, Human
uuuaucagcagu

SEQ ID NO: 3585952 - RNA, 22 nt, Human
uuuaucagcaguuguuauuaca

SEQ ID NO: 3585953 - RNA, 19 nt, Human
uuuaucagggaaacuaaga

SEQ ID NO: 3585954 - RNA, 16 nt, Human
uuuaucaugaagccug

SEQ ID NO: 3585955 - RNA, 17 nt, Human
uuuaucaugaaugcuuu

SEQ ID NO: 3585956 - RNA, 17 nt, Human
uuuaucauucaagugua

SEQ ID NO: 3585957 - RNA, 17 nt, Human
uuuauccaaaaugugua

SEQ ID NO: 3585958 - RNA, 20 nt, Human
uuuauccaaaauguguauuu

SEQ ID NO: 3585959 - RNA, 22 nt, Human
uuuauccaaaauguguauuucu

SEQ ID NO: 3585960 - RNA, 20 nt, Human
uuuauccacaggaaaguguu

SEQ ID NO: 3585961 - RNA, 16 nt, Human
uuuauccauuuguaau

SEQ ID NO: 3585962 - RNA, 21 nt, Human
uuuaucccaaaguuguuguaa

SEQ ID NO: 3585963 - RNA, 22 nt, Human
uuuauccuagucauucuucccu

SEQ ID NO: 3585964 - RNA, 23 nt, Human
uuuauccuagucauucuucccua

SEQ ID NO: 3585965 - RNA, 20 nt, Human
uuuaucgcugggaaaugaga

SEQ ID NO: 3585966 - RNA, 14 nt, Human
uuuaucguuuuugu

SEQ ID NO: 3585967 - RNA, 12 nt, Human
uuuaucuaaauu

SEQ ID NO: 3585968 - RNA, 15 nt, Human
uuuaucuaaauuaaa

SEQ ID NO: 3585969 - RNA, 15 nt, Human
uuuaucuagauguaa

SEQ ID NO: 3585970 - RNA, 17 nt, Human
uuuaucuagauguaaau

SEQ ID NO: 3585971 - RNA, 20 nt, Human
uuuaucuauauaaaauaacu

SEQ ID NO: 3585972 - RNA, 21 nt, Human
uuuaucuauuguaagauaaaa

SEQ ID NO: 3585973 - RNA, 18 nt, Human
uuuaucucagauguuaaa

SEQ ID NO: 3585974 - RNA, 19 nt, Human
uuuaucucagauguuaaaa

SEQ ID NO: 3585975 - RNA, 13 nt, Human
uuuaucucuauuu

SEQ ID NO: 3585976 - RNA, 14 nt, Human
uuuaucugccucuc

SEQ ID NO: 3585977 - RNA, 20 nt, Human
uuuaucugccucucuuguaa

SEQ ID NO: 3585978 - RNA, 21 nt, Human
uuuaucugccucucuuguaau

SEQ ID NO: 3585979 - RNA, 17 nt, Human
uuuaucuggccccaggu

SEQ ID NO: 3585980 - RNA, 17 nt, Human
uuuaucugggauuaugg

SEQ ID NO: 3585981 - RNA, 16 nt, Human
uuuaucuguucauaug

SEQ ID NO: 3585982 - RNA, 13 nt, Human
uuuaucuguucuu

SEQ ID NO: 3585983 - RNA, 21 nt, Human
uuuaucuuggacugacauuua

SEQ ID NO: 3585984 - RNA, 18 nt, Human
uuuaucuuuauaugaaga

SEQ ID NO: 3585985 - RNA, 18 nt, Human
uuuaucuuugauucuccu

SEQ ID NO: 3585986 - RNA, 12 nt, Human
uuuaucuuuucu

SEQ ID NO: 3585987 - RNA, 16 nt, Human
uuuaucuuuucuacag

SEQ ID NO: 3585988 - RNA, 16 nt, Human
uuuaucuuuuuaccuu

SEQ ID NO: 3585989 - RNA, 13 nt, Human
uuuaugaaaagag

SEQ ID NO: 3585990 - RNA, 11 nt, Human
uuuaugaaaau

SEQ ID NO: 3585991 - RNA, 16 nt, Human
uuuaugaaaauaaaua

SEQ ID NO: 3585992 - RNA, 19 nt, Human
uuuaugaaagguuuacauu

SEQ ID NO: 3585993 - RNA, 12 nt, Human
uuuaugaaauga

SEQ ID NO: 3585994 - RNA, 16 nt, Human
uuuaugacaguaauug

SEQ ID NO: 3585995 - RNA, 19 nt, Human
uuuaugacaguaauugugu

SEQ ID NO: 3585996 - RNA, 13 nt, Human
uuuaugagaaaug

SEQ ID NO: 3585997 - RNA, 19 nt, Human
uuuaugagccagacaaaug

SEQ ID NO: 3585998 - RNA, 18 nt, Human
uuuaugaguaacuauuau

SEQ ID NO: 3585999 - RNA, 21 nt, Human
uuuaugaguaacuauuauuau

SEQ ID NO: 3586000 - RNA, 22 nt, Human
uuuaugaguaacuauuauuaua

SEQ ID NO: 3586001 - RNA, 17 nt, Human
uuuaugauaauagauuc

SEQ ID NO: 3586002 - RNA, 18 nt, Human
uuuaugauaauagauucu

SEQ ID NO: 3586003 - RNA, 19 nt, Human
uuuaugauaauagauucuc

SEQ ID NO: 3586004 - RNA, 14 nt, Human
uuuaugauauuuuu

SEQ ID NO: 3586005 - RNA, 15 nt, Human
uuuaugaucaguguu

SEQ ID NO: 3586006 - RNA, 14 nt, Human
uuuaugaugaugaa

SEQ ID NO: 3586007 - RNA, 12 nt, Human
uuuaugauuuaa

SEQ ID NO: 3586008 - RNA, 17 nt, Human
uuuaugauuuucauaac

SEQ ID NO: 3586009 - RNA, 19 nt, Human
uuuaugcacuuauaaggug

SEQ ID NO: 3586010 - RNA, 14 nt, Human
uuuaugcagauaga

SEQ ID NO: 3586011 - RNA, 16 nt, Human
uuuaugcagugcugcu

SEQ ID NO: 3586012 - RNA, 14 nt, Human
uuuaugccaccuga

SEQ ID NO: 3586013 - RNA, 13 nt, Human
uuuaugcuugcaa

SEQ ID NO: 3586014 - RNA, 13 nt, Human
uuuauggccucag

SEQ ID NO: 3586015 - RNA, 18 nt, Human
uuuaugggccccuggcac

SEQ ID NO: 3586016 - RNA, 22 nt, Human
uuuauggggcugaacggggaga

SEQ ID NO: 3586017 - RNA, 23 nt, Human
uuuaugguccuaaaagcaaaaua

SEQ ID NO: 3586018 - RNA, 16 nt, Human
uuuaugguuucuccag

SEQ ID NO: 3586019 - RNA, 14 nt, Human
uuuauguaaaauuu

SEQ ID NO: 3586020 - RNA, 22 nt, Human
uuuauguaaacugcauuagaaa

SEQ ID NO: 3586021 - RNA, 14 nt, Human
uuuauguaauuuca

SEQ ID NO: 3586022 - RNA, 14 nt, Human
uuuauguacaggau

SEQ ID NO: 3586023 - RNA, 19 nt, Human
uuuauguauugugcaaugu

SEQ ID NO: 3586024 - RNA, 14 nt, Human
uuuaugucuaaaga

SEQ ID NO: 3586025 - RNA, 18 nt, Human
uuuaugucuauuuaagcc

SEQ ID NO: 3586026 - RNA, 11 nt, Human
uuuaugucugg

SEQ ID NO: 3586027 - RNA, 19 nt, Human
uuuaugucuguggauuuuu

SEQ ID NO: 3586028 - RNA, 17 nt, Human
uuuauguguaguugucu

SEQ ID NO: 3586029 - RNA, 16 nt, Human
uuuaugugugauucaa

SEQ ID NO: 3586030 - RNA, 11 nt, Human
uuuaugugugu

SEQ ID NO: 3586031 - RNA, 13 nt, Human
uuuaugugugugu

SEQ ID NO: 3586032 - RNA, 15 nt, Human
uuuauguuaaaagau

SEQ ID NO: 3586033 - RNA, 20 nt, Human
uuuauguuauauauaaauau

SEQ ID NO: 3586034 - RNA, 22 nt, Human
uuuauguuauauauaaauauau

SEQ ID NO: 3586035 - RNA, 14 nt, Human
uuuauguuugaaua

SEQ ID NO: 3586036 - RNA, 23 nt, Human
uuuauguuugcacuugugauuau

SEQ ID NO: 3586037 - RNA, 14 nt, Human
uuuauguuuugguc

SEQ ID NO: 3586038 - RNA, 20 nt, Human
uuuauguuuugguccacuuu

SEQ ID NO: 3586039 - RNA, 20 nt, Human
uuuauguuuuguuucugaaa

SEQ ID NO: 3586040 - RNA, 14 nt, Human
uuuauuaaaaugau

SEQ ID NO: 3586041 - RNA, 14 nt, Human
uuuauuaaagaaaa

SEQ ID NO: 3586042 - RNA, 12 nt, Human
uuuauuaaauaa

SEQ ID NO: 3586043 - RNA, 21 nt, Human
uuuauuaaauacaaaacuucc

SEQ ID NO: 3586044 - RNA, 19 nt, Human
uuuauuaaaugcccagccc

SEQ ID NO: 3586045 - RNA, 23 nt, Human
uuuauuaaauuuuuuuguaugaa

SEQ ID NO: 3586046 - RNA, 12 nt, Human
uuuauuaagaug

SEQ ID NO: 3586047 - RNA, 15 nt, Human
uuuauuaagauggau

SEQ ID NO: 3586048 - RNA, 20 nt, Human
uuuauuaagcacguauuuau

SEQ ID NO: 3586049 - RNA, 17 nt, Human
uuuauuaauauauauua

SEQ ID NO: 3586050 - RNA, 19 nt, Human
uuuauuaauauauauuauc

SEQ ID NO: 3586051 - RNA, 13 nt, Human
uuuauuaaucacu

SEQ ID NO: 3586052 - RNA, 13 nt, Human
uuuauuaaucuua

SEQ ID NO: 3586053 - RNA, 12 nt, Human
uuuauuaaugca

SEQ ID NO: 3586054 - RNA, 17 nt, Human
uuuauuaaugcacuuuc

SEQ ID NO: 3586055 - RNA, 14 nt, Human
uuuauuacaguaua

SEQ ID NO: 3586056 - RNA, 22 nt, Human
uuuauuacaguauaauuaacau

SEQ ID NO: 3586057 - RNA, 14 nt, Human
uuuauuacauaauu

SEQ ID NO: 3586058 - RNA, 14 nt, Human
uuuauuaccagugg

SEQ ID NO: 3586059 - RNA, 17 nt, Human
uuuauuacccccuccuu

SEQ ID NO: 3586060 - RNA, 13 nt, Human
uuuauuaccucug

SEQ ID NO: 3586061 - RNA, 19 nt, Human
uuuauuacuguaagaaaau

SEQ ID NO: 3586062 - RNA, 13 nt, Human
uuuauuagaugaa

SEQ ID NO: 3586063 - RNA, 14 nt, Human
uuuauuagaugaau

SEQ ID NO: 3586064 - RNA, 14 nt, Human
uuuauuauaaacug

SEQ ID NO: 3586065 - RNA, 15 nt, Human
uuuauuaugaagaag

SEQ ID NO: 3586066 - RNA, 17 nt, Human
uuuauuaugcauaacug

SEQ ID NO: 3586067 - RNA, 20 nt, Human
uuuauuaugcauaacugaca

SEQ ID NO: 3586068 - RNA, 16 nt, Human
uuuauuaugcauuaua

SEQ ID NO: 3586069 - RNA, 16 nt, Human
uuuauuauguaaaucc

SEQ ID NO: 3586070 - RNA, 18 nt, Human
uuuauucaagguaaaauu

SEQ ID NO: 3586071 - RNA, 19 nt, Human
uuuauucaagguaaaauuc

SEQ ID NO: 3586072 - RNA, 19 nt, Human
uuuauucagcuucauuugu

SEQ ID NO: 3586073 - RNA, 22 nt, Human
uuuauucauuggucuaauuuau

SEQ ID NO: 3586074 - RNA, 19 nt, Human
uuuauuccauauucaugua

SEQ ID NO: 3586075 - RNA, 22 nt, Human
uuuauuccuauauaguuuauug

SEQ ID NO: 3586076 - RNA, 15 nt, Human
uuuauucuucuagag

SEQ ID NO: 3586077 - RNA, 18 nt, Human
uuuauucuucuagaguuc

SEQ ID NO: 3586078 - RNA, 13 nt, Human
uuuauugacacag

SEQ ID NO: 3586079 - RNA, 15 nt, Human
uuuauugacacagaa

SEQ ID NO: 3586080 - RNA, 15 nt, Human
uuuauugaugugcaa

SEQ ID NO: 3586081 - RNA, 16 nt, Human
uuuauugaugugcaaa

SEQ ID NO: 3586082 - RNA, 19 nt, Human
uuuauugaugugcaaaaau

SEQ ID NO: 3586083 - RNA, 21 nt, Human
uuuauugaugugcaaaaauuu

SEQ ID NO: 3586084 - RNA, 23 nt, Human
uuuauugcaucuggguagcugua

SEQ ID NO: 3586085 - RNA, 22 nt, Human
uuuauugccuucucaccagcug

SEQ ID NO: 3586086 - RNA, 14 nt, Human
uuuauugcuacuuc

SEQ ID NO: 3586087 - RNA, 20 nt, Human
uuuauugcuaguauuugaau

SEQ ID NO: 3586088 - RNA, 19 nt, Human
uuuauugcuguguaacacu

SEQ ID NO: 3586089 - RNA, 17 nt, Human
uuuauuggcuuuucuga

SEQ ID NO: 3586090 - RNA, 17 nt, Human
uuuauugguuuugcaga

SEQ ID NO: 3586091 - RNA, 16 nt, Human
uuuauuguguuuguca

SEQ ID NO: 3586092 - RNA, 20 nt, Human
uuuauuguuaacucuugucu

SEQ ID NO: 3586093 - RNA, 17 nt, Human
uuuauuguuaauacaag

SEQ ID NO: 3586094 - RNA, 22 nt, Human
uuuauuguuuaaaaucauuucu

SEQ ID NO: 3586095 - RNA, 23 nt, Human
uuuauuguuuaaagcaacugucu

SEQ ID NO: 3586096 - RNA, 22 nt, Human
uuuauuuaaaaaacuaaaaacu

SEQ ID NO: 3586097 - RNA, 12 nt, Human
uuuauuuaaaag

SEQ ID NO: 3586098 - RNA, 17 nt, Human
uuuauuuaaaagauuca

SEQ ID NO: 3586099 - RNA, 14 nt, Human
uuuauuuaaagcau

SEQ ID NO: 3586100 - RNA, 21 nt, Human
uuuauuuaaaugucuaaugua

SEQ ID NO: 3586101 - RNA, 12 nt, Human
uuuauuuacuuc

SEQ ID NO: 3586102 - RNA, 15 nt, Human
uuuauuuagggaaca

SEQ ID NO: 3586103 - RNA, 15 nt, Human
uuuauuuauauguau

SEQ ID NO: 3586104 - RNA, 15 nt, Human
uuuauuuauauuuau

SEQ ID NO: 3586105 - RNA, 15 nt, Human
uuuauuuaucaguga

SEQ ID NO: 3586106 - RNA, 16 nt, Human
uuuauuucaaaauaua

SEQ ID NO: 3586107 - RNA, 15 nt, Human
uuuauuucagauuuu

SEQ ID NO: 3586108 - RNA, 20 nt, Human
uuuauuucauuuuucaauag

SEQ ID NO: 3586109 - RNA, 20 nt, Human
uuuauuuccacuaaaaauau

SEQ ID NO: 3586110 - RNA, 13 nt, Human
uuuauuuccuccc

SEQ ID NO: 3586111 - RNA, 13 nt, Human
uuuauuucuccuu

SEQ ID NO: 3586112 - RNA, 15 nt, Human
uuuauuucuccuuuu

SEQ ID NO: 3586113 - RNA, 17 nt, Human
uuuauuucuccuuuugu

SEQ ID NO: 3586114 - RNA, 21 nt, Human
uuuauuucuccuuuuguguuc

SEQ ID NO: 3586115 - RNA, 13 nt, Human
uuuauuucuuaaa

SEQ ID NO: 3586116 - RNA, 23 nt, Human
uuuauuugaacaaugaaguugaa

SEQ ID NO: 3586117 - RNA, 14 nt, Human
uuuauuugcuucuu

SEQ ID NO: 3586118 - RNA, 22 nt, Human
uuuauuuggaaaggaaugcaaa

SEQ ID NO: 3586119 - RNA, 13 nt, Human
uuuauuuguugag

SEQ ID NO: 3586120 - RNA, 14 nt, Human
uuuauuuguugaga

SEQ ID NO: 3586121 - RNA, 18 nt, Human
uuuauuuguugagagugu

SEQ ID NO: 3586122 - RNA, 20 nt, Human
uuuauuuguuugugcauuug

SEQ ID NO: 3586123 - RNA, 13 nt, Human
uuuauuuuaaaac

SEQ ID NO: 3586124 - RNA, 19 nt, Human
uuuauuuuagcaguucugc

SEQ ID NO: 3586125 - RNA, 23 nt, Human
uuuauuuuagcaguucugcaaau

SEQ ID NO: 3586126 - RNA, 15 nt, Human
uuuauuuuaugagaa

SEQ ID NO: 3586127 - RNA, 20 nt, Human
uuuauuuuaugagaaaugua

SEQ ID NO: 3586128 - RNA, 12 nt, Human
uuuauuuuccua

SEQ ID NO: 3586129 - RNA, 16 nt, Human
uuuauuuuccucccca

SEQ ID NO: 3586130 - RNA, 10 nt, Human
uuuauuuucu

SEQ ID NO: 3586131 - RNA, 22 nt, Human
uuuauuuucugguagauagaaa

SEQ ID NO: 3586132 - RNA, 22 nt, Human
uuuauuuugugcucauuuaagu

SEQ ID NO: 3586133 - RNA, 16 nt, Human
uuuauuuuuaagaaag

SEQ ID NO: 3586134 - RNA, 14 nt, Human
uuuauuuuuuaagu

SEQ ID NO: 3586135 - RNA, 15 nt, Human
uuuauuuuuuauaca

SEQ ID NO: 3586136 - RNA, 23 nt, Human
uuucaaaaacaccccccccccac

SEQ ID NO: 3586137 - RNA, 23 nt, Human
uuucaaaaaucugaagauuguuu

SEQ ID NO: 3586138 - RNA, 23 nt, Human
uuucaaaacacaucuuuccuguc

SEQ ID NO: 3586139 - RNA, 13 nt, Human
uuucaaaagaaag

SEQ ID NO: 3586140 - RNA, 18 nt, Human
uuucaaaagacauguugu

SEQ ID NO: 3586141 - RNA, 20 nt, Human
uuucaaaauaaaaaccaaga

SEQ ID NO: 3586142 - RNA, 18 nt, Human
uuucaaaauaaaauauca

SEQ ID NO: 3586143 - RNA, 18 nt, Human
uuucaaaauccaaaaaga

SEQ ID NO: 3586144 - RNA, 12 nt, Human
uuucaaaaugcu

SEQ ID NO: 3586145 - RNA, 13 nt, Human
uuucaaaaugcuu

SEQ ID NO: 3586146 - RNA, 15 nt, Human
uuucaaaaugcuuuu

SEQ ID NO: 3586147 - RNA, 19 nt, Human
uuucaaacaaucaaguuga

SEQ ID NO: 3586148 - RNA, 17 nt, Human
uuucaaacauauauaac

SEQ ID NO: 3586149 - RNA, 19 nt, Human
uuucaaacauauauaacaa

SEQ ID NO: 3586150 - RNA, 22 nt, Human
uuucaaaccaguauacaagaua

SEQ ID NO: 3586151 - RNA, 22 nt, Human
uuucaaacuccaagguucccuu

SEQ ID NO: 3586152 - RNA, 16 nt, Human
uuucaaacuuacuauu

SEQ ID NO: 3586153 - RNA, 22 nt, Human
uuucaaacuuuacuauggcccu

SEQ ID NO: 3586154 - RNA, 12 nt, Human
uuucaaagcaau

SEQ ID NO: 3586155 - RNA, 14 nt, Human
uuucaaagcaauug

SEQ ID NO: 3586156 - RNA, 21 nt, Human
uuucaaagcaauugaaaugca

SEQ ID NO: 3586157 - RNA, 18 nt, Human
uuucaaaggaacauugug

SEQ ID NO: 3586158 - RNA, 15 nt, Human
uuucaaaguacauaa

SEQ ID NO: 3586159 - RNA, 20 nt, Human
uuucaaaguuuuguuguacu

SEQ ID NO: 3586160 - RNA, 19 nt, Human
uuucaaauagggucuaacu

SEQ ID NO: 3586161 - RNA, 20 nt, Human
uuucaaauagggucuaacuc

SEQ ID NO: 3586162 - RNA, 19 nt, Human
uuucaaauuggacuuucaa

SEQ ID NO: 3586163 - RNA, 21 nt, Human
uuucaaauuggagcuucaugg

SEQ ID NO: 3586164 - RNA, 14 nt, Human
uuucaaauuuagaa

SEQ ID NO: 3586165 - RNA, 21 nt, Human
uuucaaauuuagaaacuaauu

SEQ ID NO: 3586166 - RNA, 23 nt, Human
uuucaacaaauaucuuguguugu

SEQ ID NO: 3586167 - RNA, 20 nt, Human
uuucaaccagauaacauacc

SEQ ID NO: 3586168 - RNA, 14 nt, Human
uuucaaccccaccc

SEQ ID NO: 3586169 - RNA, 19 nt, Human
uuucaaccccacccuguuu

SEQ ID NO: 3586170 - RNA, 21 nt, Human
uuucaaccccacccuguuugg

SEQ ID NO: 3586171 - RNA, 15 nt, Human
uuucaaccucuagaa

SEQ ID NO: 3586172 - RNA, 22 nt, Human
uuucaaccucuagaauuuuaag

SEQ ID NO: 3586173 - RNA, 15 nt, Human
uuucaacgcagcccu

SEQ ID NO: 3586174 - RNA, 20 nt, Human
uuucaacgcagcccugcuuu

SEQ ID NO: 3586175 - RNA, 13 nt, Human
uuucaacuuugaa

SEQ ID NO: 3586176 - RNA, 18 nt, Human
uuucaagaaaaaauaaau

SEQ ID NO: 3586177 - RNA, 23 nt, Human
uuucaagaauaaucacgcuuucc

SEQ ID NO: 3586178 - RNA, 22 nt, Human
uuucaagaucuaaaucauauau

SEQ ID NO: 3586179 - RNA, 20 nt, Human
uuucaagcagcaucuucugg

SEQ ID NO: 3586180 - RNA, 20 nt, Human
uuucaagcaucuccugagga

SEQ ID NO: 3586181 - RNA, 14 nt, Human
uuucaagcuuauuu

SEQ ID NO: 3586182 - RNA, 11 nt, Human
uuucaaggaag

SEQ ID NO: 3586183 - RNA, 17 nt, Human
uuucaaggaagguucau

SEQ ID NO: 3586184 - RNA, 21 nt, Human
uuucaaggcacucuagauucc

SEQ ID NO: 3586185 - RNA, 13 nt, Human
uuuuuuuuuuggu

SEQ ID NO: 3586186 - RNA, 19 nt, Human
uuuugugauggagugcugu

SEQ ID NO: 3586187 - RNA, 16 nt, Human
uuuugugauuuagaac

SEQ ID NO: 3586188 - RNA, 23 nt, Human
uuuugugcauuaucuagauacug

SEQ ID NO: 3586189 - RNA, 12 nt, Human
uuuugugcauuu

SEQ ID NO: 3586190 - RNA, 20 nt, Human
uuuuguguccuccaggagcu

SEQ ID NO: 3586191 - RNA, 21 nt, Human
uuuugugucucuuauggaugu

SEQ ID NO: 3586192 - RNA, 20 nt, Human
uuuugugugaccaacugugu

SEQ ID NO: 3586193 - RNA, 17 nt, Human
uuuuguguguauuugcu

SEQ ID NO: 3586194 - RNA, 23 nt, Human
uuuuguguuuauucuugaugaaa

SEQ ID NO: 3586195 - RNA, 16 nt, Human
uuuuguguuuguugua

SEQ ID NO: 3586196 - RNA, 16 nt, Human
uuuuguuaccuuuaug

SEQ ID NO: 3586197 - RNA, 16 nt, Human
uuuuguuacucuuggg

SEQ ID NO: 3586198 - RNA, 15 nt, Human
uuuuguuacuguucu

SEQ ID NO: 3586199 - RNA, 20 nt, Human
uuuuguuacuguucuugcug

SEQ ID NO: 3586200 - RNA, 18 nt, Human
uuuuguuaucagucaaua

SEQ ID NO: 3586201 - RNA, 15 nt, Human
uuuuguuauuaaaca

SEQ ID NO: 3586202 - RNA, 19 nt, Human
uuuuguucuuaauugcacu

SEQ ID NO: 3586203 - RNA, 19 nt, Human
uuuuguucuucagagauca

SEQ ID NO: 3586204 - RNA, 12 nt, Human
uuuuguugacau

SEQ ID NO: 3586205 - RNA, 15 nt, Human
uuuuguugcacugaa

SEQ ID NO: 3586206 - RNA, 13 nt, Human
uuuuguuggcaua

SEQ ID NO: 3586207 - RNA, 16 nt, Human
uuuuguuguuucagug

SEQ ID NO: 3586208 - RNA, 18 nt, Human
uuuuguuucaaugaggug

SEQ ID NO: 3586209 - RNA, 19 nt, Human
uuuuguuucauauugaugu

SEQ ID NO: 3586210 - RNA, 12 nt, Human
uuuuguuucugu

SEQ ID NO: 3586211 - RNA, 18 nt, Human
uuuuguuuggagacguuu

SEQ ID NO: 3586212 - RNA, 18 nt, Human
uuuuguuuggcaaggaaa

SEQ ID NO: 3586213 - RNA, 22 nt, Human
uuuuguuugguauuguauuuau

SEQ ID NO: 3586214 - RNA, 21 nt, Human
uuuuguuugguuauaucgaaa

SEQ ID NO: 3586215 - RNA, 16 nt, Human
uuuuguuuuacaaugu

SEQ ID NO: 3586216 - RNA, 13 nt, Human
uuuuguuuugcuu

SEQ ID NO: 3586217 - RNA, 18 nt, Human
uuuuguuuuucugcuuua

SEQ ID NO: 3586218 - RNA, 14 nt, Human
uuuuuaaaaaaaga

SEQ ID NO: 3586219 - RNA, 13 nt, Human
uuuuuaaaaaacu

SEQ ID NO: 3586220 - RNA, 14 nt, Human
uuuuuaaaaaacuu

SEQ ID NO: 3586221 - RNA, 18 nt, Human
uuuuuaaaaaagaaacau

SEQ ID NO: 3586222 - RNA, 15 nt, Human
uuuuuaaaaaagcuu

SEQ ID NO: 3586223 - RNA, 14 nt, Human
uuuuuaaaacacau

SEQ ID NO: 3586224 - RNA, 18 nt, Human
uuuuuaaaacacauguuu

SEQ ID NO: 3586225 - RNA, 15 nt, Human
uuuuuaaaagagaca

SEQ ID NO: 3586226 - RNA, 23 nt, Human
uuuuuaaaauagaaauuuuguaa

SEQ ID NO: 3586227 - RNA, 13 nt, Human
uuuuuaaaaucuu

SEQ ID NO: 3586228 - RNA, 16 nt, Human
uuuuuaaacaaguauu

SEQ ID NO: 3586229 - RNA, 16 nt, Human
uuuuuaaacaauaaag

SEQ ID NO: 3586230 - RNA, 13 nt, Human
uuuuuaaacauca

SEQ ID NO: 3586231 - RNA, 13 nt, Human
uuuuuaaacugua

SEQ ID NO: 3586232 - RNA, 19 nt, Human
uuuuuaaacuguacagugu

SEQ ID NO: 3586233 - RNA, 18 nt, Human
uuuuuaaagacuuuuaug

SEQ ID NO: 3586234 - RNA, 12 nt, Human
uuuuuaaagauc

SEQ ID NO: 3586235 - RNA, 11 nt, Human
uuuuuaaauaa

SEQ ID NO: 3586236 - RNA, 14 nt, Human
uuuuuaaauaaacu

SEQ ID NO: 3586237 - RNA, 14 nt, Human
uuuuuaaauauauu

SEQ ID NO: 3586238 - RNA, 11 nt, Human
uuuuuaaaugc

SEQ ID NO: 3586239 - RNA, 23 nt, Human
uuuuuaaauguauacuauaguac

SEQ ID NO: 3586240 - RNA, 19 nt, Human
uuuuuaaccccgucaacaa

SEQ ID NO: 3586241 - RNA, 22 nt, Human
uuuuuaacucaauauuuuccau

SEQ ID NO: 3586242 - RNA, 21 nt, Human
uuuuuaacuuuaccaugcuca

SEQ ID NO: 3586243 - RNA, 16 nt, Human
uuuuuaagaauaucug

SEQ ID NO: 3586244 - RNA, 13 nt, Human
uuuuuaagaauug

SEQ ID NO: 3586245 - RNA, 16 nt, Human
uuuuuaagauagugua

SEQ ID NO: 3586246 - RNA, 16 nt, Human
uuuuuaagauuuuucu

SEQ ID NO: 3586247 - RNA, 23 nt, Human
uuuuuaagcuguaaaaagagaga

SEQ ID NO: 3586248 - RNA, 18 nt, Human
uuuuuaagcuguuuccau

SEQ ID NO: 3586249 - RNA, 16 nt, Human
uuuuuaagcuucaguu

SEQ ID NO: 3586250 - RNA, 21 nt, Human
uuuuuaaguaauguggaagaa

SEQ ID NO: 3586251 - RNA, 16 nt, Human
uuuuuaaguauuuaua

SEQ ID NO: 3586252 - RNA, 14 nt, Human
uuuuuaagugaaau

SEQ ID NO: 3586253 - RNA, 18 nt, Human
uuuuuaagugcugcauuu

SEQ ID NO: 3586254 - RNA, 17 nt, Human
uuuuuaauaaagacagg

SEQ ID NO: 3586255 - RNA, 15 nt, Human
uuuuuaaucaugaaa

SEQ ID NO: 3586256 - RNA, 17 nt, Human
uuuuuaaucaugaauau

SEQ ID NO: 3586257 - RNA, 13 nt, Human
uuuuuaaugauau

SEQ ID NO: 3586258 - RNA, 20 nt, Human
uuuuuaaugcuaaucuugug

SEQ ID NO: 3586259 - RNA, 21 nt, Human
uuuuuaaugcuaaucuuguga

SEQ ID NO: 3586260 - RNA, 18 nt, Human
uuuuuaauguauaguaaa

SEQ ID NO: 3586261 - RNA, 17 nt, Human
uuuuuaaugugcugugu

SEQ ID NO: 3586262 - RNA, 20 nt, Human
uuuuuaaugugcuguguaaa

SEQ ID NO: 3586263 - RNA, 20 nt, Human
uuuuuaauuaaaaacuagua

SEQ ID NO: 3586264 - RNA, 12 nt, Human
uuuuuaauuauu

SEQ ID NO: 3586265 - RNA, 13 nt, Human
uuuuuaauuguau

SEQ ID NO: 3586266 - RNA, 18 nt, Human
uuuuuaauuguuguuucu

SEQ ID NO: 3586267 - RNA, 11 nt, Human
uuuuuaauuua

SEQ ID NO: 3586268 - RNA, 12 nt, Human
uuuuuaauuuug

SEQ ID NO: 3586269 - RNA, 17 nt, Human
uuuuuacaauguaauua

SEQ ID NO: 3586270 - RNA, 16 nt, Human
uuuuuacauggagaaa

SEQ ID NO: 3586271 - RNA, 11 nt, Human
uuuuuacauuu

SEQ ID NO: 3586272 - RNA, 18 nt, Human
uuuuuacccauauccccu

SEQ ID NO: 3586273 - RNA, 19 nt, Human
uuuuuaccguuucuucccu

SEQ ID NO: 3586274 - RNA, 17 nt, Human
uuuuuaccugucacauu

SEQ ID NO: 3586275 - RNA, 13 nt, Human
uuuuuacuguguu

SEQ ID NO: 3586276 - RNA, 20 nt, Human
uuuuuagaaagcauuugaau

SEQ ID NO: 3586277 - RNA, 12 nt, Human
uuuuuagaauuu

SEQ ID NO: 3586278 - RNA, 20 nt, Human
uuuuuaggaagcaagcuuaa

SEQ ID NO: 3586279 - RNA, 20 nt, Human
uuuuuaguaaucuguacauu

SEQ ID NO: 3586280 - RNA, 18 nt, Human
uuuuuauaaaauggcugu

SEQ ID NO: 3586281 - RNA, 23 nt, Human
uuuuuauaacaucuuuauugaaa

SEQ ID NO: 3586282 - RNA, 13 nt, Human
uuuuuauaauugu

SEQ ID NO: 3586283 - RNA, 18 nt, Human
uuuuuauaauuguacaaa

SEQ ID NO: 3586284 - RNA, 23 nt, Human
uuuuuauaauuguacaaaauuaa

SEQ ID NO: 3586285 - RNA, 13 nt, Human
uuuuuauacacau

SEQ ID NO: 3586286 - RNA, 18 nt, Human
uuuuuauagcaacaacaa

SEQ ID NO: 3586287 - RNA, 14 nt, Human
uuuuuauauauaca

SEQ ID NO: 3586288 - RNA, 17 nt, Human
uuuuuauauauaugcau

SEQ ID NO: 3586289 - RNA, 23 nt, Human
uuuuuauaucuggaaugagccug

SEQ ID NO: 3586290 - RNA, 14 nt, Human
uuuuuauaucuugg

SEQ ID NO: 3586291 - RNA, 17 nt, Human
uuuuuauauuaguugcu

SEQ ID NO: 3586292 - RNA, 18 nt, Human
uuuuuauauuaguugcuu

SEQ ID NO: 3586293 - RNA, 22 nt, Human
uuuuuauauuucaaguacacug

SEQ ID NO: 3586294 - RNA, 15 nt, Human
uuuuuauauuuccuu

SEQ ID NO: 3586295 - RNA, 17 nt, Human
uuuuuauauuugaaaua

SEQ ID NO: 3586296 - RNA, 17 nt, Human
uuuuuaucaugcauguc

SEQ ID NO: 3586297 - RNA, 22 nt, Human
uuuuuaucuauauaaaauaacu

SEQ ID NO: 3586298 - RNA, 14 nt, Human
uuuuuaucuuuuua

SEQ ID NO: 3586299 - RNA, 13 nt, Human
uuuuuaugaggca

SEQ ID NO: 3586300 - RNA, 16 nt, Human
uuuuuaugcuauuucu

SEQ ID NO: 3586301 - RNA, 21 nt, Human
uuuuuauggcuuuugugcauu

SEQ ID NO: 3586302 - RNA, 15 nt, Human
uuuuuauuaaucacu

SEQ ID NO: 3586303 - RNA, 17 nt, Human
uuuuuauuaguauuguu

SEQ ID NO: 3586304 - RNA, 14 nt, Human
uuuuuauuaugcau

SEQ ID NO: 3586305 - RNA, 15 nt, Human
uuuuuauuaugcauu

SEQ ID NO: 3586306 - RNA, 12 nt, Human
uuuuuauugaug

SEQ ID NO: 3586307 - RNA, 13 nt, Human
uuuuuauugaugu

SEQ ID NO: 3586308 - RNA, 22 nt, Human
uuuuuauugcuaguauuugaau

SEQ ID NO: 3586309 - RNA, 13 nt, Human
uuuuuauuuaaau

SEQ ID NO: 3586310 - RNA, 13 nt, Human
uuuuuauuuauau

SEQ ID NO: 3586311 - RNA, 14 nt, Human
uuuuuauuuauaug

SEQ ID NO: 3586312 - RNA, 18 nt, Human
uuuuuauuuauauguacu

SEQ ID NO: 3586313 - RNA, 22 nt, Human
uuuuuauuucugucaguuauga

SEQ ID NO: 3586314 - RNA, 19 nt, Human
uuuuucaaagauguguugc

SEQ ID NO: 3586315 - RNA, 18 nt, Human
uuuuucaacaaauaucuu

SEQ ID NO: 3586316 - RNA, 22 nt, Human
uuuuucaaccccacccuguuug

SEQ ID NO: 3586317 - RNA, 23 nt, Human
uuuuucaaccccacccuguuugg

SEQ ID NO: 3586318 - RNA, 13 nt, Human
uuuuucaaggaag

SEQ ID NO: 3586319 - RNA, 19 nt, Human
uuuuucaaguuguaaauaa

SEQ ID NO: 3586320 - RNA, 12 nt, Human
uuuuucaauaua

SEQ ID NO: 3586321 - RNA, 19 nt, Human
uuuuucaauauauugaacu

SEQ ID NO: 3586322 - RNA, 13 nt, Human
uuuuucaauuaaa

SEQ ID NO: 3586323 - RNA, 17 nt, Human
uuuuucaauuaaacgga

SEQ ID NO: 3586324 - RNA, 18 nt, Human
uuuuucaauuaaacggau

SEQ ID NO: 3586325 - RNA, 12 nt, Human
uuuuucagaccg

SEQ ID NO: 3586326 - RNA, 14 nt, Human
uuuuucagaccgaa

SEQ ID NO: 3586327 - RNA, 16 nt, Human
uuuuucaguucaaagu

SEQ ID NO: 3586328 - RNA, 12 nt, Human
uuuuucauauuu

SEQ ID NO: 3586329 - RNA, 19 nt, Human
uuuuucauauuuucuaaag

SEQ ID NO: 3586330 - RNA, 23 nt, Human
uuuuucaucuucaguugucucug

SEQ ID NO: 3586331 - RNA, 18 nt, Human
uuuuucauguuuuaacaa

SEQ ID NO: 3586332 - RNA, 20 nt, Human
uuuuucauuaaauaaauuug

SEQ ID NO: 3586333 - RNA, 21 nt, Human
uuuuucauugauaugaaaaau

SEQ ID NO: 3586334 - RNA, 22 nt, Human
uuuuucauuuauuguuuaugua

SEQ ID NO: 3586335 - RNA, 17 nt, Human
uuuuucauuuuccaaua

SEQ ID NO: 3586336 - RNA, 21 nt, Human
uuuuuccaacuacuaauagaa

SEQ ID NO: 3586337 - RNA, 23 nt, Human
uuuuuccaacuacuaauagaaua

SEQ ID NO: 3586338 - RNA, 21 nt, Human
uuuuuccacauaaggaaacug

SEQ ID NO: 3586339 - RNA, 18 nt, Human
uuuuucccauaagacaau

SEQ ID NO: 3586340 - RNA, 16 nt, Human
uuuuucccauuuagaa

SEQ ID NO: 3586341 - RNA, 23 nt, Human
uuuuucccuucaucugggcacug

SEQ ID NO: 3586342 - RNA, 11 nt, Human
uuuuuccuguc

SEQ ID NO: 3586343 - RNA, 19 nt, Human
uuuuuccuuacauaaacau

SEQ ID NO: 3586344 - RNA, 11 nt, Human
uuuuuccuuca

SEQ ID NO: 3586345 - RNA, 16 nt, Human
uuuuuccuucccuucu

SEQ ID NO: 3586346 - RNA, 16 nt, Human
uuuuuccuuuuucuga

SEQ ID NO: 3586347 - RNA, 22 nt, Human
uuuuucuaaaacuaaauagcau

SEQ ID NO: 3586348 - RNA, 13 nt, Human
uuuuucuaaagga

SEQ ID NO: 3586349 - RNA, 15 nt, Human
uuuuucuaacuacaa

SEQ ID NO: 3586350 - RNA, 16 nt, Human
uuuuucucaaaguuuu

SEQ ID NO: 3586351 - RNA, 14 nt, Human
uuuuucucccucug

SEQ ID NO: 3586352 - RNA, 19 nt, Human
uuuuucucuaggaaauauu

SEQ ID NO: 3586353 - RNA, 12 nt, Human
uuuuucucuccu

SEQ ID NO: 3586354 - RNA, 17 nt, Human
uuuuucugauaaaagau

SEQ ID NO: 3586355 - RNA, 13 nt, Human
uuuuucugauugu

SEQ ID NO: 3586356 - RNA, 22 nt, Human
uuuuucugcacugagcagaguc

SEQ ID NO: 3586357 - RNA, 23 nt, Human
uuuuucugcacugagcagagucu

SEQ ID NO: 3586358 - RNA, 14 nt, Human
uuuuucugccuccu

SEQ ID NO: 3586359 - RNA, 13 nt, Human
uuuuucugcuuua

SEQ ID NO: 3586360 - RNA, 14 nt, Human
uuuuucugcuuuug

SEQ ID NO: 3586361 - RNA, 17 nt, Human
uuuuucugcuuuugaaa

SEQ ID NO: 3586362 - RNA, 21 nt, Human
uuuuucuggagguugauaacu

SEQ ID NO: 3586363 - RNA, 13 nt, Human
uuuuucuguauaa

SEQ ID NO: 3586364 - RNA, 16 nt, Human
uuuuucuucacugcaa

SEQ ID NO: 3586365 - RNA, 12 nt, Human
uuuuucuugucu

SEQ ID NO: 3586366 - RNA, 17 nt, Human
uuuuucuugucuauaaa

SEQ ID NO: 3586367 - RNA, 12 nt, Human
uuuuucuuuaca

SEQ ID NO: 3586368 - RNA, 17 nt, Human
uuuuucuuuauaaacuu

SEQ ID NO: 3586369 - RNA, 23 nt, Human
uuuuugaaaucaguaaacacugu

SEQ ID NO: 3586370 - RNA, 12 nt, Human
uuuuugaaauga

SEQ ID NO: 3586371 - RNA, 15 nt, Human
uuuuugaaaugaaau

SEQ ID NO: 3586372 - RNA, 17 nt, Human
uuuuugaaaugaaauuu

SEQ ID NO: 3586373 - RNA, 21 nt, Human
uuuuugaaccauccacuuaca

SEQ ID NO: 3586374 - RNA, 19 nt, Human
uuuuugaacucuucucauu

SEQ ID NO: 3586375 - RNA, 15 nt, Human
uuuuugaagucuugu

SEQ ID NO: 3586376 - RNA, 13 nt, Human
uuuuugacagaau

SEQ ID NO: 3586377 - RNA, 13 nt, Human
uuuuugaggcaaa

SEQ ID NO: 3586378 - RNA, 15 nt, Human
uuuuugauaaagccu

SEQ ID NO: 3586379 - RNA, 21 nt, Human
uuuuugauaaaguuucucaga

SEQ ID NO: 3586380 - RNA, 14 nt, Human
uuuuugauagcuuu

SEQ ID NO: 3586381 - RNA, 11 nt, Human
uuuuugcaaua

SEQ ID NO: 3586382 - RNA, 20 nt, Human
uuuuugcacauguuuccucu

SEQ ID NO: 3586383 - RNA, 23 nt, Human
uuuuugcaccccaugcuguugau

SEQ ID NO: 3586384 - RNA, 19 nt, Human
uuuuugcaugcaugcaaau

SEQ ID NO: 3586385 - RNA, 17 nt, Human
uuuuugcauuuaaaaca

SEQ ID NO: 3586386 - RNA, 16 nt, Human
uuuuugccacagcuuu

SEQ ID NO: 3586387 - RNA, 23 nt, Human
uuuuugcugcugccucuuucccu

SEQ ID NO: 3586388 - RNA, 15 nt, Human
uuuuuggaaagucag

SEQ ID NO: 3586389 - RNA, 17 nt, Human
uuuuuggaaagucagaa

SEQ ID NO: 3586390 - RNA, 13 nt, Human
uuuuuggacauuu

SEQ ID NO: 3586391 - RNA, 21 nt, Human
uuuuuggagaagguuaucaaa

SEQ ID NO: 3586392 - RNA, 15 nt, Human
uuuuuggaggugcuu

SEQ ID NO: 3586393 - RNA, 14 nt, Human
uuuuuggaguguua

SEQ ID NO: 3586394 - RNA, 20 nt, Human
uuuuuggcguggcugacuua

SEQ ID NO: 3586395 - RNA, 20 nt, Human
uuuuugggcagcaauuuaaa

SEQ ID NO: 3586396 - RNA, 23 nt, Human
uuuuugggcagcaauuuaaaugu

SEQ ID NO: 3586397 - RNA, 13 nt, Human
uuuuugguacaaa

SEQ ID NO: 3586398 - RNA, 14 nt, Human
uuuuugguacaaaa

SEQ ID NO: 3586399 - RNA, 15 nt, Human
uuuuugguggaugua

SEQ ID NO: 3586400 - RNA, 18 nt, Human
uuuuugguggauguaaau

SEQ ID NO: 3586401 - RNA, 15 nt, Human
uuuuuguaaacugga

SEQ ID NO: 3586402 - RNA, 19 nt, Human
uuuuuguaaagauuucugu

SEQ ID NO: 3586403 - RNA, 16 nt, Human
uuuuuguaaaugugua

SEQ ID NO: 3586404 - RNA, 12 nt, Human
uuuuuguaccaa

SEQ ID NO: 3586405 - RNA, 19 nt, Human
uuuuuguagagccaggguc

SEQ ID NO: 3586406 - RNA, 11 nt, Human
uuuuuguagua

SEQ ID NO: 3586407 - RNA, 18 nt, Human
uuuuuguauaaaauagac

SEQ ID NO: 3586408 - RNA, 18 nt, Human
uuuuuguauaguuaacac

SEQ ID NO: 3586409 - RNA, 21 nt, Human
uuuuuguauaguuaacacacu

SEQ ID NO: 3586410 - RNA, 12 nt, Human
uuuuuguaugug

SEQ ID NO: 3586411 - RNA, 16 nt, Human
uuuuugucaacauugu

SEQ ID NO: 3586412 - RNA, 17 nt, Human
uuuuugucaacauugug

SEQ ID NO: 3586413 - RNA, 21 nt, Human
uuuuugucccccaacuugaga

SEQ ID NO: 3586414 - RNA, 20 nt, Human
uuuuugugaaaaugucaaag

SEQ ID NO: 3586415 - RNA, 15 nt, Human
uuuuuguguauuugu

SEQ ID NO: 3586416 - RNA, 17 nt, Human
uuuuuguguguauuugc

SEQ ID NO: 3586417 - RNA, 14 nt, Human
uuuuuguuaacuuu

SEQ ID NO: 3586418 - RNA, 13 nt, Human
uuuuuguugacau

SEQ ID NO: 3586419 - RNA, 19 nt, Human
uuuuuguuggaguguuucu

SEQ ID NO: 3586420 - RNA, 17 nt, Human
uuuuuguuguguucugu

SEQ ID NO: 3586421 - RNA, 12 nt, Human
uuuuuguuugcc

SEQ ID NO: 3586422 - RNA, 14 nt, Human
uuuuuguuuggaga

SEQ ID NO: 3586423 - RNA, 18 nt, Human
uuuuuguuuuguugcacu

SEQ ID NO: 3586424 - RNA, 18 nt, Human
uuuuuuaaaauaagucug

SEQ ID NO: 3586425 - RNA, 14 nt, Human
uuuuuuaaaauaga

SEQ ID NO: 3586426 - RNA, 15 nt, Human
uuuuuuaaauaaacu

SEQ ID NO: 3586427 - RNA, 16 nt, Human
uuuuuuaaauaaacuu

SEQ ID NO: 3586428 - RNA, 12 nt, Human
uuuuuuaacauu

SEQ ID NO: 3586429 - RNA, 19 nt, Human
uuuuuuaaccaaaggugaa

SEQ ID NO: 3586430 - RNA, 20 nt, Human
uuuuuuaaccccgucaacaa

SEQ ID NO: 3586431 - RNA, 17 nt, Human
uuuuuuaaguauuuaua

SEQ ID NO: 3586432 - RNA, 13 nt, Human
uuuuuuacaaagg

SEQ ID NO: 3586433 - RNA, 23 nt, Human
uuuuuuacaaauuggagcaggga

SEQ ID NO: 3586434 - RNA, 13 nt, Human
uuuuuuacagauu

SEQ ID NO: 3586435 - RNA, 11 nt, Human
uuuuuuacauu

SEQ ID NO: 3586436 - RNA, 14 nt, Human
uuuuuuacuuuugu

SEQ ID NO: 3586437 - RNA, 13 nt, Human
uuuuuuagaacag

SEQ ID NO: 3586438 - RNA, 15 nt, Human
uuuuuuagaucaaau

SEQ ID NO: 3586439 - RNA, 12 nt, Human
uuuuuuaggaaa

SEQ ID NO: 3586440 - RNA, 18 nt, Human
uuuuuuaggguuucugau

SEQ ID NO: 3586441 - RNA, 20 nt, Human
uuuuuuauacacuguaauga

SEQ ID NO: 3586442 - RNA, 15 nt, Human
uuuuuuauauaugug

SEQ ID NO: 3586443 - RNA, 11 nt, Human
uuuuuuauuau

SEQ ID NO: 3586444 - RNA, 16 nt, Human
uuuuuuauuguuuaaa

SEQ ID NO: 3586445 - RNA, 12 nt, Human
uuuuuuauuucu

SEQ ID NO: 3586446 - RNA, 17 nt, Human
uuuuuuauuucuacugu

SEQ ID NO: 3586447 - RNA, 14 nt, Human
uuuuuucagaccga

SEQ ID NO: 3586448 - RNA, 12 nt, Human
uuuuuucaguug

SEQ ID NO: 3586449 - RNA, 12 nt, Human
uuuuuuccaaaa

SEQ ID NO: 3586450 - RNA, 14 nt, Human
uuuuuuccaaaauc

SEQ ID NO: 3586451 - RNA, 13 nt, Human
uuuuuuccacuua

SEQ ID NO: 3586452 - RNA, 19 nt, Human
uuuuuuccuguuucugaaa

SEQ ID NO: 3586453 - RNA, 17 nt, Human
uuuuuuccuucagugcc

SEQ ID NO: 3586454 - RNA, 13 nt, Human
uuuuuucguuugu

SEQ ID NO: 3586455 - RNA, 15 nt, Human
uuuuuucuaagagaa

SEQ ID NO: 3586456 - RNA, 12 nt, Human
uuuuuucugaaa

SEQ ID NO: 3586457 - RNA, 12 nt, Human
uuuuuucuuuca

SEQ ID NO: 3586458 - RNA, 12 nt, Human
uuuuuugaaaac

SEQ ID NO: 3586459 - RNA, 13 nt, Human
uuuuuugaaauca

SEQ ID NO: 3586460 - RNA, 12 nt, Human
uuuuuugaaaug

SEQ ID NO: 3586461 - RNA, 10 nt, Human
uuuuuugaag

SEQ ID NO: 3586462 - RNA, 12 nt, Human
uuuuuuguauag

SEQ ID NO: 3586463 - RNA, 15 nt, Human
uuuuuuguauaguua

SEQ ID NO: 3586464 - RNA, 13 nt, Human
uuuuuuguaugug

SEQ ID NO: 3586465 - RNA, 18 nt, Human
uuuuuuguuuuacaaugu

SEQ ID NO: 3586466 - RNA, 11 nt, Human
uuuuuuuacua

SEQ ID NO: 3586467 - RNA, 12 nt, Human
uuuuuuucaaug

SEQ ID NO: 3586468 - RNA, 12 nt, Human
uuuuuuucaguu

SEQ ID NO: 3586469 - RNA, 13 nt, Human
uuuuuuuccagca

SEQ ID NO: 3586470 - RNA, 12 nt, Human
uuuuuuuccuua

SEQ ID NO: 3586471 - RNA, 12 nt, Human
uuuuuuucuacc

SEQ ID NO: 3586472 - RNA, 14 nt, Human
uuuuuuugaaacuu

SEQ ID NO: 3586473 - RNA, 12 nt, Human
uuuuuuuuaaga

SEQ ID NO: 3586474 - RNA, 13 nt, Human
uuuuuuuuaaugu

SEQ ID NO: 3586475 - RNA, 13 nt, Human
uuuuuuuuccugu

SEQ ID NO: 3586476 - RNA, 18 nt, Human
uuucuauauuuucauucu

SEQ ID NO: 3586477 - RNA, 15 nt, Human
uuucuauccucugua

SEQ ID NO: 3586478 - RNA, 14 nt, Human
uuucuaugaaauau

SEQ ID NO: 3586479 - RNA, 21 nt, Human
uuucuaugcugaguuugugcu

SEQ ID NO: 3586480 - RNA, 23 nt, Human
uuucuauggguguuaucaccuag

SEQ ID NO: 3586481 - RNA, 15 nt, Human
uuucuauuaaaagac

SEQ ID NO: 3586482 - RNA, 16 nt, Human
uuucuauuaaaagacu

SEQ ID NO: 3586483 - RNA, 13 nt, Human
uuucuauuccaaa

SEQ ID NO: 3586484 - RNA, 18 nt, Human
uuucuauuccuucuggcc

SEQ ID NO: 3586485 - RNA, 19 nt, Human
uuucuauuccuucuggccu

SEQ ID NO: 3586486 - RNA, 17 nt, Human
uuucuauuuaugccuug

SEQ ID NO: 3586487 - RNA, 17 nt, Human
uuucuauuucacuggag

SEQ ID NO: 3586488 - RNA, 16 nt, Human
uuucuauuugacuugu

SEQ ID NO: 3586489 - RNA, 16 nt, Human
uuucuauuuucucuga

SEQ ID NO: 3586490 - RNA, 14 nt, Human
uuucucaaaagcau

SEQ ID NO: 3586491 - RNA, 19 nt, Human
uuucucaaaagcauuuauc

SEQ ID NO: 3586492 - RNA, 15 nt, Human
uuucucaaaguuuug

SEQ ID NO: 3586493 - RNA, 18 nt, Human
uuucucaaaguuuugaaa

SEQ ID NO: 3586494 - RNA, 22 nt, Human
uuucucaaaguuuugaaaagcu

SEQ ID NO: 3586495 - RNA, 18 nt, Human
uuucucacagaagaugaa

SEQ ID NO: 3586496 - RNA, 16 nt, Human
uuucucacuaaaucuu

SEQ ID NO: 3586497 - RNA, 19 nt, Human
uuucucagacuuuggaaaa

SEQ ID NO: 3586498 - RNA, 17 nt, Human
uuucucagauccuuguu

SEQ ID NO: 3586499 - RNA, 23 nt, Human
uuucucagccgcuucugacugcu

SEQ ID NO: 3586500 - RNA, 20 nt, Human
uuucucagcucccauuucua

SEQ ID NO: 3586501 - RNA, 15 nt, Human
uuucucauauuugag

SEQ ID NO: 3586502 - RNA, 19 nt, Human
uuucucauguguuugcaua

SEQ ID NO: 3586503 - RNA, 15 nt, Human
uuucucauguugaaa

SEQ ID NO: 3586504 - RNA, 16 nt, Human
uuucucauucuuguuu

SEQ ID NO: 3586505 - RNA, 19 nt, Human
uuucucauugcucugaaua

SEQ ID NO: 3586506 - RNA, 20 nt, Human
uuucuccaauaucagugcuc

SEQ ID NO: 3586507 - RNA, 13 nt, Human
uuucuccagaacc

SEQ ID NO: 3586508 - RNA, 21 nt, Human
uuucuccagcucagaacccag

SEQ ID NO: 3586509 - RNA, 15 nt, Human
uuucuccagugcugu

SEQ ID NO: 3586510 - RNA, 14 nt, Human
uuucucccccuggg

SEQ ID NO: 3586511 - RNA, 13 nt, Human
uuucucccucuca

SEQ ID NO: 3586512 - RNA, 22 nt, Human
uuucucccucucacugucugag

SEQ ID NO: 3586513 - RNA, 16 nt, Human
uuucuccucccuuccu

SEQ ID NO: 3586514 - RNA, 16 nt, Human
uuucuccuuugauaaa

SEQ ID NO: 3586515 - RNA, 19 nt, Human
uuucuccuuuuguguucca

SEQ ID NO: 3586516 - RNA, 16 nt, Human
uuucucuauuaaaaug

SEQ ID NO: 3586517 - RNA, 16 nt, Human
uuucucucaacaccau

SEQ ID NO: 3586518 - RNA, 19 nt, Human
uuucucucagccuuacauu

SEQ ID NO: 3586519 - RNA, 16 nt, Human
uuucucucuacagugc

SEQ ID NO: 3586520 - RNA, 16 nt, Human
uuucucugauacagaa

SEQ ID NO: 3586521 - RNA, 17 nt, Human
uuucucugauacagaaa

SEQ ID NO: 3586522 - RNA, 18 nt, Human
uuucucugauacagaaaa

SEQ ID NO: 3586523 - RNA, 13 nt, Human
uuucucugcagaa

SEQ ID NO: 3586524 - RNA, 23 nt, Human
uuucucugccgcuaccucccucc

SEQ ID NO: 3586525 - RNA, 21 nt, Human
uuucucugcuucagcuugcuu

SEQ ID NO: 3586526 - RNA, 12 nt, Human
uuucucuuagaa

SEQ ID NO: 3586527 - RNA, 21 nt, Human
uuucucuuagaacauuguauu

SEQ ID NO: 3586528 - RNA, 13 nt, Human
uuucucuucuccc

SEQ ID NO: 3586529 - RNA, 14 nt, Human
uuucucuuucuccu

SEQ ID NO: 3586530 - RNA, 15 nt, Human
uuucucuuucuuccu

SEQ ID NO: 3586531 - RNA, 12 nt, Human
uuucucuuugaa

SEQ ID NO: 3586532 - RNA, 20 nt, Human
uuucucuuuuccccuuuccu

SEQ ID NO: 3586533 - RNA, 15 nt, Human
uuucucuuuucuagu

SEQ ID NO: 3586534 - RNA, 16 nt, Human
uuucugaaaagaaaua

SEQ ID NO: 3586535 - RNA, 16 nt, Human
uuucugaaaauauaac

SEQ ID NO: 3586536 - RNA, 18 nt, Human
uuucugaaaauuccagaa

SEQ ID NO: 3586537 - RNA, 21 nt, Human
uuucugaaaauuccagaaagg

SEQ ID NO: 3586538 - RNA, 17 nt, Human
uuucugaaacuaaugaa

SEQ ID NO: 3586539 - RNA, 20 nt, Human
uuucugaaaguuacccacug

SEQ ID NO: 3586540 - RNA, 21 nt, Human
uuucugaaauuuccugggagc

SEQ ID NO: 3586541 - RNA, 17 nt, Human
uuucugaacagcuggug

SEQ ID NO: 3586542 - RNA, 22 nt, Human
uuucugaacagcugguguagcu

SEQ ID NO: 3586543 - RNA, 19 nt, Human
uuucugaagguagcauucu

SEQ ID NO: 3586544 - RNA, 13 nt, Human
uuucugacaguuu

SEQ ID NO: 3586545 - RNA, 13 nt, Human
uuucugagaaaga

SEQ ID NO: 3586546 - RNA, 12 nt, Human
uuucugagcccg

SEQ ID NO: 3586547 - RNA, 15 nt, Human
uuucugagcccgggc

SEQ ID NO: 3586548 - RNA, 18 nt, Human
uuucugaggagaaacaaa

SEQ ID NO: 3586549 - RNA, 17 nt, Human
uuucugaguuuuaccaa

SEQ ID NO: 3586550 - RNA, 16 nt, Human
uuucugauccaguuuu

SEQ ID NO: 3586551 - RNA, 20 nt, Human
uuucugauccaguuuuguuu

SEQ ID NO: 3586552 - RNA, 15 nt, Human
uuucugauguugccu

SEQ ID NO: 3586553 - RNA, 18 nt, Human
uuucugauuagcuuugug

SEQ ID NO: 3586554 - RNA, 14 nt, Human
uuucugcaucagcu

SEQ ID NO: 3586555 - RNA, 13 nt, Human
uuucugcaucucc

SEQ ID NO: 3586556 - RNA, 15 nt, Human
uuucugcaucuccac

SEQ ID NO: 3586557 - RNA, 13 nt, Human
uuucugcauuuug

SEQ ID NO: 3586558 - RNA, 16 nt, Human
uuucugccagggagcu

SEQ ID NO: 3586559 - RNA, 13 nt, Human
uuucugcccugcc

SEQ ID NO: 3586560 - RNA, 13 nt, Human
uuucugcccuggc

SEQ ID NO: 3586561 - RNA, 14 nt, Human
uuucugcccuggcu

SEQ ID NO: 3586562 - RNA, 14 nt, Human
uuucugccgcagcc

SEQ ID NO: 3586563 - RNA, 16 nt, Human
uuucugccgcagcccu

SEQ ID NO: 3586564 - RNA, 22 nt, Human
uuucugccuggaguguaugacu

SEQ ID NO: 3586565 - RNA, 19 nt, Human
uuucugcucagcuucuccu

SEQ ID NO: 3586566 - RNA, 20 nt, Human
uuucugcugaauuuucacau

SEQ ID NO: 3586567 - RNA, 23 nt, Human
uuucugcugaauuuucacaugaa

SEQ ID NO: 3586568 - RNA, 19 nt, Human
uuucugcuggaaacagacu

SEQ ID NO: 3586569 - RNA, 19 nt, Human
uuucugcuuuagacuugaa

SEQ ID NO: 3586570 - RNA, 18 nt, Human
uuucuggaauguaaucaa

SEQ ID NO: 3586571 - RNA, 17 nt, Human
uuucuggacucuggacu

SEQ ID NO: 3586572 - RNA, 18 nt, Human
uuucuggacucuggacuu

SEQ ID NO: 3586573 - RNA, 23 nt, Human
uuucuggacugaagccugcagga

SEQ ID NO: 3586574 - RNA, 16 nt, Human
uuucuggagguugaua

SEQ ID NO: 3586575 - RNA, 17 nt, Human
uuucuggagguugauaa

SEQ ID NO: 3586576 - RNA, 11 nt, Human
uuucuggaguc

SEQ ID NO: 3586577 - RNA, 15 nt, Human
uuucuggauuucaua

SEQ ID NO: 3586578 - RNA, 19 nt, Human
uuucuggccaguguuuaaa

SEQ ID NO: 3586579 - RNA, 23 nt, Human
uuucugggagacagaaaacaugu

SEQ ID NO: 3586580 - RNA, 21 nt, Human
uuucugggcugucuauucuag

SEQ ID NO: 3586581 - RNA, 15 nt, Human
uuucuggggaaagac

SEQ ID NO: 3586582 - RNA, 21 nt, Human
uuucuggggaaagacacugcc

SEQ ID NO: 3586583 - RNA, 17 nt, Human
uuucugguggucuguug

SEQ ID NO: 3586584 - RNA, 15 nt, Human
uuucuguaaauacca

SEQ ID NO: 3586585 - RNA, 11 nt, Human
uuucuguacuu

SEQ ID NO: 3586586 - RNA, 19 nt, Human
uuucuguacuuuuuggcau

SEQ ID NO: 3586587 - RNA, 12 nt, Human
uuucuguauaga

SEQ ID NO: 3586588 - RNA, 14 nt, Human
uuucugucagaaug

SEQ ID NO: 3586589 - RNA, 20 nt, Human
uuucugucagaugagaacaa

SEQ ID NO: 3586590 - RNA, 22 nt, Human
uuucugucagaugagaacaaag

SEQ ID NO: 3586591 - RNA, 15 nt, Human
uuucugucccuucug

SEQ ID NO: 3586592 - RNA, 18 nt, Human
uuucuguccuguaacugu

SEQ ID NO: 3586593 - RNA, 15 nt, Human
uuucugucucugccu

SEQ ID NO: 3586594 - RNA, 13 nt, Human
uuucugugcccua

SEQ ID NO: 3586595 - RNA, 17 nt, Human
uuucugugcccuccuga

SEQ ID NO: 3586596 - RNA, 11 nt, Human
uuucugugugc

SEQ ID NO: 3586597 - RNA, 17 nt, Human
uuucuguguguuccugg

SEQ ID NO: 3586598 - RNA, 13 nt, Human
uuucuguguuuau

SEQ ID NO: 3586599 - RNA, 17 nt, Human
uuucuguuaaaaugcau

SEQ ID NO: 3586600 - RNA, 20 nt, Human
uuucuguucagcguuuugca

SEQ ID NO: 3586601 - RNA, 16 nt, Human
uuucuguuccaaauuc

SEQ ID NO: 3586602 - RNA, 14 nt, Human
uuucuguucuaguu

SEQ ID NO: 3586603 - RNA, 15 nt, Human
uuucuguugaaguuu

SEQ ID NO: 3586604 - RNA, 13 nt, Human
uuucuguugucau

SEQ ID NO: 3586605 - RNA, 16 nt, Human
uuucuguuugauucuu

SEQ ID NO: 3586606 - RNA, 17 nt, Human
uuucuuaaaaaguuaua

SEQ ID NO: 3586607 - RNA, 17 nt, Human
uuucuuaaacaaaugua

SEQ ID NO: 3586608 - RNA, 17 nt, Human
uuucuuaaagugccagu

SEQ ID NO: 3586609 - RNA, 19 nt, Human
uuucuuaaauaagaaacuu

SEQ ID NO: 3586610 - RNA, 20 nt, Human
uuucuuaaauaagaaacuuu

SEQ ID NO: 3586611 - RNA, 13 nt, Human
uuucuuaaauaau

SEQ ID NO: 3586612 - RNA, 23 nt, Human
uuucuuaaauaaugcuucagaua

SEQ ID NO: 3586613 - RNA, 18 nt, Human
uuucuuaaccagaucauu

SEQ ID NO: 3586614 - RNA, 15 nt, Human
uuucuuaaccaucuu

SEQ ID NO: 3586615 - RNA, 20 nt, Human
uuuggcugaaauucuccugg

SEQ ID NO: 3586616 - RNA, 15 nt, Human
uuuggcugugucuaa

SEQ ID NO: 3586617 - RNA, 17 nt, Human
uuuggcugugucuaaac

SEQ ID NO: 3586618 - RNA, 16 nt, Human
uuuggcuuaaauauag

SEQ ID NO: 3586619 - RNA, 16 nt, Human
uuugggaaacuuguca

SEQ ID NO: 3586620 - RNA, 17 nt, Human
uuugggaaccaagcuau

SEQ ID NO: 3586621 - RNA, 21 nt, Human
uuugggaaguuaaagggaaga

SEQ ID NO: 3586622 - RNA, 17 nt, Human
uuugggaauguuugucu

SEQ ID NO: 3586623 - RNA, 18 nt, Human
uuugggagacaugugaca

SEQ ID NO: 3586624 - RNA, 23 nt, Human
uuugggagagacuuguuuuggau

SEQ ID NO: 3586625 - RNA, 22 nt, Human
uuugggaggccaaggugggagg

SEQ ID NO: 3586626 - RNA, 15 nt, Human
uuugggaugucuuau

SEQ ID NO: 3586627 - RNA, 14 nt, Human
uuugggccucugcu

SEQ ID NO: 3586628 - RNA, 15 nt, Human
uuugggcuucagccu

SEQ ID NO: 3586629 - RNA, 16 nt, Human
uuugggcuucagcugc

SEQ ID NO: 3586630 - RNA, 18 nt, Human
uuuggggaaaccuagaga

SEQ ID NO: 3586631 - RNA, 23 nt, Human
uuuggggacagauucagucuugc

SEQ ID NO: 3586632 - RNA, 20 nt, Human
uuuggggagcagagacacua

SEQ ID NO: 3586633 - RNA, 20 nt, Human
uuuggggauuuucaaaagau

SEQ ID NO: 3586634 - RNA, 19 nt, Human
uuuggggcgaggcagagga

SEQ ID NO: 3586635 - RNA, 14 nt, Human
uuugggggaaacuu

SEQ ID NO: 3586636 - RNA, 20 nt, Human
uuugggggugggucuggccg

SEQ ID NO: 3586637 - RNA, 16 nt, Human
uuugggguaugggaga

SEQ ID NO: 3586638 - RNA, 10 nt, Human
uuuggggucu

SEQ ID NO: 3586639 - RNA, 18 nt, Human
uuuggggugccccucucc

SEQ ID NO: 3586640 - RNA, 11 nt, Human
uuuggguuucu

SEQ ID NO: 3586641 - RNA, 13 nt, Human
uuugguaaauguu

SEQ ID NO: 3586642 - RNA, 23 nt, Human
uuugguacuuuugagugugugug

SEQ ID NO: 3586643 - RNA, 14 nt, Human
uuugguagauuaaa

SEQ ID NO: 3586644 - RNA, 13 nt, Human
uuugguauuguau

SEQ ID NO: 3586645 - RNA, 17 nt, Human
uuugguccgucauaacc

SEQ ID NO: 3586646 - RNA, 16 nt, Human
uuuggucgaggaguaa

SEQ ID NO: 3586647 - RNA, 16 nt, Human
uuuggucuggacugac

SEQ ID NO: 3586648 - RNA, 21 nt, Human
uuuggucuuuuuuuguauuau

SEQ ID NO: 3586649 - RNA, 23 nt, Human
uuuggugaacauugcaauagaaa

SEQ ID NO: 3586650 - RNA, 18 nt, Human
uuuggugccuuuccuguu

SEQ ID NO: 3586651 - RNA, 21 nt, Human
uuuggugcuucucagauuucu

SEQ ID NO: 3586652 - RNA, 20 nt, Human
uuuggugcuuuuuauaaaaa

SEQ ID NO: 3586653 - RNA, 17 nt, Human
uuugguggauguaaaua

SEQ ID NO: 3586654 - RNA, 15 nt, Human
uuugguguacagacu

SEQ ID NO: 3586655 - RNA, 12 nt, Human
uuugguguaugg

SEQ ID NO: 3586656 - RNA, 13 nt, Human
uuugguguauggu

SEQ ID NO: 3586657 - RNA, 21 nt, Human
uuuggugucaacaugaaacac

SEQ ID NO: 3586658 - RNA, 16 nt, Human
uuuguauucucugagc

SEQ ID NO: 3586659 - RNA, 14 nt, Human
uuuguauuuucaug

SEQ ID NO: 3586660 - RNA, 15 nt, Human
uuuguauuuuccaag

SEQ ID NO: 3586661 - RNA, 17 nt, Human
uuuguauuuuuuugcaa

SEQ ID NO: 3586662 - RNA, 16 nt, Human
uuugucaaacuguaga

SEQ ID NO: 3586663 - RNA, 20 nt, Human
uuugucagaacuagaauuug

SEQ ID NO: 3586664 - RNA, 22 nt, Human
uuugucagaacuagaauuugau

SEQ ID NO: 3586665 - RNA, 14 nt, Human
uuugucagacuuua

SEQ ID NO: 3586666 - RNA, 17 nt, Human
uuugucaucagccacca

SEQ ID NO: 3586667 - RNA, 21 nt, Human
uuugucauuuucauuagcaaa

SEQ ID NO: 3586668 - RNA, 14 nt, Human
uuugucauuuugaa

SEQ ID NO: 3586669 - RNA, 17 nt, Human
uuugucauuuugaagcu

SEQ ID NO: 3586670 - RNA, 20 nt, Human
uuugucauuuugaagcuaau

SEQ ID NO: 3586671 - RNA, 13 nt, Human
uuuguccccaccg

SEQ ID NO: 3586672 - RNA, 15 nt, Human
uuugucccccaacuu

SEQ ID NO: 3586673 - RNA, 14 nt, Human
uuuguccccugcuu

SEQ ID NO: 3586674 - RNA, 17 nt, Human
uuuguccuaaaacaccu

SEQ ID NO: 3586675 - RNA, 22 nt, Human
uuuguccuuggggacaucucau

SEQ ID NO: 3586676 - RNA, 20 nt, Human
uuugucgaauuuuuauuauu

SEQ ID NO: 3586677 - RNA, 19 nt, Human
uuugucuaaaacaauaaaa

SEQ ID NO: 3586678 - RNA, 15 nt, Human
uuugucuacaccauu

SEQ ID NO: 3586679 - RNA, 18 nt, Human
uuugucucaguuggaaau

SEQ ID NO: 3586680 - RNA, 19 nt, Human
uuugucucaucccauucug

SEQ ID NO: 3586681 - RNA, 23 nt, Human
uuugucucugcaaacugccuucu

SEQ ID NO: 3586682 - RNA, 21 nt, Human
uuugucuguuuguuucaagaa

SEQ ID NO: 3586683 - RNA, 13 nt, Human
uuugucuuaaaaa

SEQ ID NO: 3586684 - RNA, 16 nt, Human
uuugucuugaaugucu

SEQ ID NO: 3586685 - RNA, 17 nt, Human
uuugucuuuaacuguca

SEQ ID NO: 3586686 - RNA, 19 nt, Human
uuugucuuuggugaacauu

SEQ ID NO: 3586687 - RNA, 20 nt, Human
uuugugaaacagacuuguau

SEQ ID NO: 3586688 - RNA, 17 nt, Human
uuugugaagcaaaauuu

SEQ ID NO: 3586689 - RNA, 20 nt, Human
uuugugaagguggaaauaaa

SEQ ID NO: 3586690 - RNA, 18 nt, Human
uuugugaauagaacucug

SEQ ID NO: 3586691 - RNA, 22 nt, Human
uuugugaauuaggcuguaacua

SEQ ID NO: 3586692 - RNA, 15 nt, Human
uuugugacauuccuu

SEQ ID NO: 3586693 - RNA, 14 nt, Human
uuugugacuauaua

SEQ ID NO: 3586694 - RNA, 22 nt, Human
uuugugacuauauagagauguu

SEQ ID NO: 3586695 - RNA, 23 nt, Human
uuugugacuauauagagauguuu

SEQ ID NO: 3586696 - RNA, 16 nt, Human
uuugugaguuuguuuc

SEQ ID NO: 3586697 - RNA, 14 nt, Human
uuugugauaauuua

SEQ ID NO: 3586698 - RNA, 22 nt, Human
uuugugauaugcacaauguaga

SEQ ID NO: 3586699 - RNA, 20 nt, Human
uuugugauauggagcccugu

SEQ ID NO: 3586700 - RNA, 21 nt, Human
uuugugcaaaagcuucaaauu

SEQ ID NO: 3586701 - RNA, 15 nt, Human
uuugugcaaagccaa

SEQ ID NO: 3586702 - RNA, 19 nt, Human
uuugugcauuaucuagaua

SEQ ID NO: 3586703 - RNA, 13 nt, Human
uuugugcauuuuc

SEQ ID NO: 3586704 - RNA, 15 nt, Human
uuugugcauuuucua

SEQ ID NO: 3586705 - RNA, 20 nt, Human
uuugugcuagaaauuuucaa

SEQ ID NO: 3586706 - RNA, 21 nt, Human
uuugugcuagaaauuuucaag

SEQ ID NO: 3586707 - RNA, 19 nt, Human
uuugugcugguguaugugu

SEQ ID NO: 3586708 - RNA, 13 nt, Human
uuugugcuguggg

SEQ ID NO: 3586709 - RNA, 17 nt, Human
uuuguggaaaauaacuc

SEQ ID NO: 3586710 - RNA, 19 nt, Human
uuuuauaaaccucuaauuu

SEQ ID NO: 3586711 - RNA, 13 nt, Human
uuuuauaaacuuu

SEQ ID NO: 3586712 - RNA, 22 nt, Human
uuuuauaaauacugcaaaucag

SEQ ID NO: 3586713 - RNA, 15 nt, Human
uuuuauaaauuaaau

SEQ ID NO: 3586714 - RNA, 20 nt, Human
uuuuauaacuaguccuuuac

SEQ ID NO: 3586715 - RNA, 15 nt, Human
uuuuauaagaaaacc

SEQ ID NO: 3586716 - RNA, 14 nt, Human
uuuuauaagcaaau

SEQ ID NO: 3586717 - RNA, 19 nt, Human
uuuuauaaggacuuccuga

SEQ ID NO: 3586718 - RNA, 15 nt, Human
uuuuauacacauaau

SEQ ID NO: 3586719 - RNA, 14 nt, Human
uuuuauacaguagu

SEQ ID NO: 3586720 - RNA, 21 nt, Human
uuuuauacauaaacaagacca

SEQ ID NO: 3586721 - RNA, 18 nt, Human
uuuuauacucuuucugua

SEQ ID NO: 3586722 - RNA, 17 nt, Human
uuuuauagccuggacug

SEQ ID NO: 3586723 - RNA, 20 nt, Human
uuuuauagccuggacugcua

SEQ ID NO: 3586724 - RNA, 22 nt, Human
uuuuauauaauaucuaaaguua

SEQ ID NO: 3586725 - RNA, 22 nt, Human
uuuuauauacagaggaaaucug

SEQ ID NO: 3586726 - RNA, 19 nt, Human
uuuuauauagcuugaaaca

SEQ ID NO: 3586727 - RNA, 12 nt, Human
uuuuauauauua

SEQ ID NO: 3586728 - RNA, 15 nt, Human
uuuuauauauuauau

SEQ ID NO: 3586729 - RNA, 20 nt, Human
uuuuauaugcuucuguuuua

SEQ ID NO: 3586730 - RNA, 16 nt, Human
uuuuauauguugcuau

SEQ ID NO: 3586731 - RNA, 11 nt, Human
uuuuauauuuc

SEQ ID NO: 3586732 - RNA, 18 nt, Human
uuuuauauuucaaguaca

SEQ ID NO: 3586733 - RNA, 22 nt, Human
uuuuauauuuccuuuaugugaa

SEQ ID NO: 3586734 - RNA, 13 nt, Human
uuuuauauuugua

SEQ ID NO: 3586735 - RNA, 15 nt, Human
uuuuaucaugacaug

SEQ ID NO: 3586736 - RNA, 17 nt, Human
uuuuaucaugacauguu

SEQ ID NO: 3586737 - RNA, 21 nt, Human
uuuuaugaagugcgugaaugu

SEQ ID NO: 3586738 - RNA, 21 nt, Human
uuuuaugacuucauuaauaau

SEQ ID NO: 3586739 - RNA, 16 nt, Human
uuuuaugagcuuccaa

SEQ ID NO: 3586740 - RNA, 16 nt, Human
uuuuaugauacuugaa

SEQ ID NO: 3586741 - RNA, 11 nt, Human
uuuuaugauau

SEQ ID NO: 3586742 - RNA, 13 nt, Human
uuuuaugauccag

SEQ ID NO: 3586743 - RNA, 16 nt, Human
uuuuaugaugaugaaa

SEQ ID NO: 3586744 - RNA, 15 nt, Human
uuuuaugcaaauauu

SEQ ID NO: 3586745 - RNA, 13 nt, Human
uuuuaugcagaua

SEQ ID NO: 3586746 - RNA, 18 nt, Human
uuuuaugcuuuaaacauu

SEQ ID NO: 3586747 - RNA, 19 nt, Human
uuuuauggcacuaguauuu

SEQ ID NO: 3586748 - RNA, 18 nt, Human
uuuuaugugaaacauguu

SEQ ID NO: 3586749 - RNA, 12 nt, Human
uuuuauguugac

SEQ ID NO: 3586750 - RNA, 18 nt, Human
uuuuauguugacauuugu

SEQ ID NO: 3586751 - RNA, 22 nt, Human
uuuuauguugcauagaauaaaa

SEQ ID NO: 3586752 - RNA, 15 nt, Human
uuuuauguuuagaua

SEQ ID NO: 3586753 - RNA, 12 nt, Human
uuuuauguuuga

SEQ ID NO: 3586754 - RNA, 16 nt, Human
uuuuauguuugaauau

SEQ ID NO: 3586755 - RNA, 22 nt, Human
uuuuauuaagcuuuuuggaauc

SEQ ID NO: 3586756 - RNA, 12 nt, Human
uuuuauuaauca

SEQ ID NO: 3586757 - RNA, 20 nt, Human
uuuuauuaaucacuguguau

SEQ ID NO: 3586758 - RNA, 11 nt, Human
uuuuauuaaug

SEQ ID NO: 3586759 - RNA, 13 nt, Human
uuuuauuaaugca

SEQ ID NO: 3586760 - RNA, 15 nt, Human
uuuuauuaguauugu

SEQ ID NO: 3586761 - RNA, 13 nt, Human
uuuuauuaugcau

SEQ ID NO: 3586762 - RNA, 12 nt, Human
uuuuauuaugcu

SEQ ID NO: 3586763 - RNA, 16 nt, Human
uuuuauuauuacuguu

SEQ ID NO: 3586764 - RNA, 15 nt, Human
uuuuauuauuguggu

SEQ ID NO: 3586765 - RNA, 22 nt, Human
uuuuauuauugugguaggccuu

SEQ ID NO: 3586766 - RNA, 14 nt, Human
uuuuauucaaggua

SEQ ID NO: 3586767 - RNA, 23 nt, Human
uuuuauucaagguaaaauucuaa

SEQ ID NO: 3586768 - RNA, 20 nt, Human
uuuuauucauaagccaauuu

SEQ ID NO: 3586769 - RNA, 15 nt, Human
uuuuauuccuguaug

SEQ ID NO: 3586770 - RNA, 13 nt, Human
uuuuauucuugau

SEQ ID NO: 3586771 - RNA, 14 nt, Human
aaggucuguuuuga

SEQ ID NO: 3586772 - RNA, 18 nt, Human
aaggucuuucaguacuuu

SEQ ID NO: 3586773 - RNA, 19 nt, Human
aaggucuuucaguacuuuu

SEQ ID NO: 3586774 - RNA, 13 nt, Human
aaggucuuugguu

SEQ ID NO: 3586775 - RNA, 16 nt, Human
aaggugaaggaauaua

SEQ ID NO: 3586776 - RNA, 17 nt, Human
aaggugaggccugucug

SEQ ID NO: 3586777 - RNA, 21 nt, Human
aaggugaggccugucugugac

SEQ ID NO: 3586778 - RNA, 20 nt, Human
aaggugaguuugagcugccu

SEQ ID NO: 3586779 - RNA, 15 nt, Human
aaggugauaaaauca

SEQ ID NO: 3586780 - RNA, 13 nt, Human
aaggugccacuuu

SEQ ID NO: 3586781 - RNA, 17 nt, Human
aaggugccauggaagag

SEQ ID NO: 3586782 - RNA, 19 nt, Human
aagguggaccuuuuaaagu

SEQ ID NO: 3586783 - RNA, 20 nt, Human
aagguggacuggaaggggcc

SEQ ID NO: 3586784 - RNA, 14 nt, Human
aagguggaguggau

SEQ ID NO: 3586785 - RNA, 11 nt, Human
aaggugggagg

SEQ ID NO: 3586786 - RNA, 20 nt, Human
aaggugggaggaugugaauu

SEQ ID NO: 3586787 - RNA, 22 nt, Human
aaggugggaggaugugaauugu

SEQ ID NO: 3586788 - RNA, 18 nt, Human
aaggugggcugagcccug

SEQ ID NO: 3586789 - RNA, 19 nt, Human
aaggugggcugagcccugg

SEQ ID NO: 3586790 - RNA, 16 nt, Human
aagguggggacaggga

SEQ ID NO: 3586791 - RNA, 13 nt, Human
aagguggggugga

SEQ ID NO: 3586792 - RNA, 22 nt, Human
aagguggucugcucgggcccag

SEQ ID NO: 3586793 - RNA, 12 nt, Human
aagguguauuua

SEQ ID NO: 3586794 - RNA, 18 nt, Human
aaggugucagaauaauaa

SEQ ID NO: 3586795 - RNA, 15 nt, Human
aagguguccuacaga

SEQ ID NO: 3586796 - RNA, 20 nt, Human
aagguguccuacagaaaaac

SEQ ID NO: 3586797 - RNA, 20 nt, Human
aaggugucuggacauucaga

SEQ ID NO: 3586798 - RNA, 20 nt, Human
aaggugucuuccucccaagu

SEQ ID NO: 3586799 - RNA, 21 nt, Human
aagguguuugaaaauaguuua

SEQ ID NO: 3586800 - RNA, 16 nt, Human
aagguguuuucugugu

SEQ ID NO: 3586801 - RNA, 19 nt, Human
aagguguuuucuguguaac

SEQ ID NO: 3586802 - RNA, 16 nt, Human
aagguuaagcccugag

SEQ ID NO: 3586803 - RNA, 15 nt, Human
aagguuaauaaagua

SEQ ID NO: 3586804 - RNA, 22 nt, Human
aagguuauaguaacaucaaaga

SEQ ID NO: 3586805 - RNA, 18 nt, Human
aagguuaucagugcuucc

SEQ ID NO: 3586806 - RNA, 17 nt, Human
aagguuauuuauuuaaa

SEQ ID NO: 3586807 - RNA, 17 nt, Human
aagguucacuaaagcag

SEQ ID NO: 3586808 - RNA, 22 nt, Human
aagguuccaaucagaucuuuau

SEQ ID NO: 3586809 - RNA, 17 nt, Human
aagguucccguugcauu

SEQ ID NO: 3586810 - RNA, 23 nt, Human
aagguuccgcuuggagcagaggg

SEQ ID NO: 3586811 - RNA, 13 nt, Human
aagguucuaaggc

SEQ ID NO: 3586812 - RNA, 21 nt, Human
aagguucucagguguugccaa

SEQ ID NO: 3586813 - RNA, 21 nt, Human
aagguucucuccuccccaagg

SEQ ID NO: 3586814 - RNA, 20 nt, Human
aagguucuucaucccuuucc

SEQ ID NO: 3586815 - RNA, 21 nt, Human
aagguucuucccuuuuacaua

SEQ ID NO: 3586816 - RNA, 17 nt, Human
aagguugaauaauauau

SEQ ID NO: 3586817 - RNA, 17 nt, Human
aagguuguauugcauau

SEQ ID NO: 3586818 - RNA, 22 nt, Human
aagguuuaaacuucucugaagg

SEQ ID NO: 3586819 - RNA, 23 nt, Human
aagguuuaaacuucucugaaggg

SEQ ID NO: 3586820 - RNA, 21 nt, Human
aagguuuaaaugaacaagaga

SEQ ID NO: 3586821 - RNA, 15 nt, Human
aagguuuaggcuggu

SEQ ID NO: 3586822 - RNA, 21 nt, Human
aagguuucguuucuguauaca

SEQ ID NO: 3586823 - RNA, 17 nt, Human
aagguuuguauauuguc

SEQ ID NO: 3586824 - RNA, 20 nt, Human
aagguuuuaauuuaguaaac

SEQ ID NO: 3586825 - RNA, 16 nt, Human
aagguuuuagguucua

SEQ ID NO: 3586826 - RNA, 15 nt, Human
aagguuuuauuuugu

SEQ ID NO: 3586827 - RNA, 13 nt, Human
aagguuuucucca

SEQ ID NO: 3586828 - RNA, 14 nt, Human
aagguuuucuccac

SEQ ID NO: 3586829 - RNA, 23 nt, Human
aagguuuuggaucuugaaugugg

SEQ ID NO: 3586830 - RNA, 14 nt, Human
aagguuuuugauag

SEQ ID NO: 3586831 - RNA, 17 nt, Human
aagguuuuuguaaagau

SEQ ID NO: 3586832 - RNA, 18 nt, Human
aagguuuuuguaaagauu

SEQ ID NO: 3586833 - RNA, 17 nt, Human
aaguaaaacaaacaaua

SEQ ID NO: 3586834 - RNA, 20 nt, Human
aaguaaaacaaacaauaccu

SEQ ID NO: 3586835 - RNA, 18 nt, Human
aaguaaaagcaaaaaaga

SEQ ID NO: 3586836 - RNA, 13 nt, Human
aaguaaacugccc

SEQ ID NO: 3586837 - RNA, 15 nt, Human
aaguaaaucucuucu

SEQ ID NO: 3586838 - RNA, 16 nt, Human
aaguaaaucucuucug

SEQ ID NO: 3586839 - RNA, 12 nt, Human
aaguaaaugcua

SEQ ID NO: 3586840 - RNA, 18 nt, Human
aaguaacuggugauauau

SEQ ID NO: 3586841 - RNA, 15 nt, Human
aaguaacuugucuua

SEQ ID NO: 3586842 - RNA, 18 nt, Human
aaguaacuugucuuaaau

SEQ ID NO: 3586843 - RNA, 13 nt, Human
aaguaacuuuaaa

SEQ ID NO: 3586844 - RNA, 21 nt, Human
aaguaacuuuauucuugaaag

SEQ ID NO: 3586845 - RNA, 13 nt, Human
aaguaagaaaaua

SEQ ID NO: 3586846 - RNA, 18 nt, Human
aaguaagaaagugaagca

SEQ ID NO: 3586847 - RNA, 21 nt, Human
aaguaagaaagugaagcaaau

SEQ ID NO: 3586848 - RNA, 14 nt, Human
aaguaagaagacau

SEQ ID NO: 3586849 - RNA, 15 nt, Human
aaguaagagacucag

SEQ ID NO: 3586850 - RNA, 20 nt, Human
aaguaaggugcuuggaguuu

SEQ ID NO: 3586851 - RNA, 16 nt, Human
aaguaauacaaacuaa

SEQ ID NO: 3586852 - RNA, 18 nt, Human
aaguaauaugcacacauu

SEQ ID NO: 3586853 - RNA, 14 nt, Human
aaguaauauuuauu

SEQ ID NO: 3586854 - RNA, 17 nt, Human
aaguaaucaucuaaguc

SEQ ID NO: 3586855 - RNA, 19 nt, Human
aaguaaugaauuuuuauga

SEQ ID NO: 3586856 - RNA, 21 nt, Human
aaguaaugaauuuuuaugaua

SEQ ID NO: 3586857 - RNA, 18 nt, Human
aaguaaugacagaacaug

SEQ ID NO: 3586858 - RNA, 14 nt, Human
aaguaaugccucug

SEQ ID NO: 3586859 - RNA, 15 nt, Human
aaguaaugccucugu

SEQ ID NO: 3586860 - RNA, 13 nt, Human
aaguaauguggaa

SEQ ID NO: 3586861 - RNA, 11 nt, Human
aaguaauuauc

SEQ ID NO: 3586862 - RNA, 15 nt, Human
aaguaauuaucggga

SEQ ID NO: 3586863 - RNA, 13 nt, Human
aaguaauuaugca

SEQ ID NO: 3586864 - RNA, 16 nt, Human
aaguaauuaugcacua

SEQ ID NO: 3586865 - RNA, 19 nt, Human
aaguaauuaugcacuaaau

SEQ ID NO: 3586866 - RNA, 23 nt, Human
aaguaauuucaguguaaagugug

SEQ ID NO: 3586867 - RNA, 16 nt, Human
aaguacacaauaagca

SEQ ID NO: 3586868 - RNA, 18 nt, Human
aaguacacuguuucaaac

SEQ ID NO: 3586869 - RNA, 19 nt, Human
aaguacagaauuugaauua

SEQ ID NO: 3586870 - RNA, 14 nt, Human
aaguacagagaagc

SEQ ID NO: 3586871 - RNA, 21 nt, Human
aaguacauauuaggaaaauau

SEQ ID NO: 3586872 - RNA, 21 nt, Human
aaguacauauuuauuuucuuu

SEQ ID NO: 3586873 - RNA, 12 nt, Human
aaguaccagacu

SEQ ID NO: 3586874 - RNA, 15 nt, Human
aaguacguuauuguu

SEQ ID NO: 3586875 - RNA, 14 nt, Human
aaguacuauaauuu

SEQ ID NO: 3586876 - RNA, 16 nt, Human
aaguacuauguaucaa

SEQ ID NO: 3586877 - RNA, 11 nt, Human
aaguacuguaa

SEQ ID NO: 3586878 - RNA, 15 nt, Human
aaguacuguaagaau

SEQ ID NO: 3586879 - RNA, 19 nt, Human
aaguacuguaagaauaauu

SEQ ID NO: 3586880 - RNA, 21 nt, Human
aaguacuguaauaauaccuca

SEQ ID NO: 3586881 - RNA, 20 nt, Human
aaguacuguuuaccauuuuu

SEQ ID NO: 3586882 - RNA, 19 nt, Human
aaguacuucuccacccugc

SEQ ID NO: 3586883 - RNA, 21 nt, Human
aaguacuugaguguaauguuu

SEQ ID NO: 3586884 - RNA, 22 nt, Human
aaguacuugaguguaauguuug

SEQ ID NO: 3586885 - RNA, 18 nt, Human
aaguagaaacaaaauaca

SEQ ID NO: 3586886 - RNA, 17 nt, Human
aaguagaacuuuguaua

SEQ ID NO: 3586887 - RNA, 21 nt, Human
aaguagaagucuuagauguau

SEQ ID NO: 3586888 - RNA, 19 nt, Human
aaguagacuacuguucagc

SEQ ID NO: 3586889 - RNA, 20 nt, Human
aaguagagguuguauacacc

SEQ ID NO: 3586890 - RNA, 14 nt, Human
aaguagcacaggcu

SEQ ID NO: 3586891 - RNA, 11 nt, Human
aaguagcauuu

SEQ ID NO: 3586892 - RNA, 15 nt, Human
aaguagcugggauuu

SEQ ID NO: 3586893 - RNA, 22 nt, Human
aaguaggacuuuccuaaauguu

SEQ ID NO: 3586894 - RNA, 23 nt, Human
aaguaggacuuuccuaaauguuu

SEQ ID NO: 3586895 - RNA, 13 nt, Human
aaguaguaaaaau

SEQ ID NO: 3586896 - RNA, 15 nt, Human
aaguaguaaaaauua

SEQ ID NO: 3586897 - RNA, 15 nt, Human
aaguagucugcucac

SEQ ID NO: 3586898 - RNA, 17 nt, Human
aaguaguguaucacagu

SEQ ID NO: 3586899 - RNA, 15 nt, Human
aaguaguuaucaugu

SEQ ID NO: 3586900 - RNA, 22 nt, Human
aaguaguucuguauuugaaagu

SEQ ID NO: 3586901 - RNA, 23 nt, Human
aaguaguucuguauuugaaagug

SEQ ID NO: 3586902 - RNA, 23 nt, Human
aaguaguucuguuuggugugucc

SEQ ID NO: 3586903 - RNA, 20 nt, Human
aaguauaaaauaguaugaaa

SEQ ID NO: 3586904 - RNA, 15 nt, Human
aaguauaaauuugug

SEQ ID NO: 3586905 - RNA, 20 nt, Human
aaguauaaauuuguguaaua

SEQ ID NO: 3586906 - RNA, 12 nt, Human
aaguauacaguu

SEQ ID NO: 3586907 - RNA, 12 nt, Human
aaguauacugua

SEQ ID NO: 3586908 - RNA, 16 nt, Human
aaguauagaaaaucuu

SEQ ID NO: 3586909 - RNA, 12 nt, Human
aaguauagagag

SEQ ID NO: 3586910 - RNA, 12 nt, Human
aaguauauaaug

SEQ ID NO: 3586911 - RNA, 13 nt, Human
aaguauauauuua

SEQ ID NO: 3586912 - RNA, 12 nt, Human
aaguauauuaaa

SEQ ID NO: 3586913 - RNA, 14 nt, Human
aaguauauuaaaca

SEQ ID NO: 3586914 - RNA, 12 nt, Human
aaguaucaugca

SEQ ID NO: 3586915 - RNA, 16 nt, Human
cuguucuaacauguaa

SEQ ID NO: 3586916 - RNA, 12 nt, Human
cuguucuaaggg

SEQ ID NO: 3586917 - RNA, 13 nt, Human
cuguucucugccc

SEQ ID NO: 3586918 - RNA, 15 nt, Human
cuguucucugcccuc

SEQ ID NO: 3586919 - RNA, 16 nt, Human
cuguucucugcccucc

SEQ ID NO: 3586920 - RNA, 20 nt, Human
cuguucugauauuaauuuau

SEQ ID NO: 3586921 - RNA, 13 nt, Human
cuguucugcacug

SEQ ID NO: 3586922 - RNA, 14 nt, Human
cuguucugcacuga

SEQ ID NO: 3586923 - RNA, 14 nt, Human
cuguucuggaggaa

SEQ ID NO: 3586924 - RNA, 22 nt, Human
cuguucuggaggaaagggagga

SEQ ID NO: 3586925 - RNA, 22 nt, Human
cuguucugguuuuuaaccauug

SEQ ID NO: 3586926 - RNA, 20 nt, Human
cuguucugugguuccucugc

SEQ ID NO: 3586927 - RNA, 21 nt, Human
cuguucuuagcucaaugagca

SEQ ID NO: 3586928 - RNA, 16 nt, Human
cuguucuuccucagcc

SEQ ID NO: 3586929 - RNA, 18 nt, Human
cuguucuuccucagccag

SEQ ID NO: 3586930 - RNA, 21 nt, Human
cuguucuuccuccagcugcac

SEQ ID NO: 3586931 - RNA, 13 nt, Human
cuguucuugcugc

SEQ ID NO: 3586932 - RNA, 15 nt, Human
cuguucuuggggccc

SEQ ID NO: 3586933 - RNA, 21 nt, Human
cuguucuuucuggcuaugcau

SEQ ID NO: 3586934 - RNA, 22 nt, Human
cuguugaaaauuauuuuaaaca

SEQ ID NO: 3586935 - RNA, 14 nt, Human
cuguugaaagcaaa

SEQ ID NO: 3586936 - RNA, 16 nt, Human
cuguugaaagcaaaaa

SEQ ID NO: 3586937 - RNA, 21 nt, Human
cuguugacacaggucuuuccu

SEQ ID NO: 3586938 - RNA, 17 nt, Human
cuguugacauauuuaau

SEQ ID NO: 3586939 - RNA, 18 nt, Human
cuguugacauauuuaaug

SEQ ID NO: 3586940 - RNA, 19 nt, Human
cuguugacauauuuaaugu

SEQ ID NO: 3586941 - RNA, 15 nt, Human
cuguugaccaggcac

SEQ ID NO: 3586942 - RNA, 17 nt, Human
cuguugagcaucacaga

SEQ ID NO: 3586943 - RNA, 21 nt, Human
cuguugauaauucuuauuuug

SEQ ID NO: 3586944 - RNA, 17 nt, Human
cuguugaugaggccucu

SEQ ID NO: 3586945 - RNA, 23 nt, Human
cuguugaugggaugauugaagaa

SEQ ID NO: 3586946 - RNA, 22 nt, Human
cuguugauguaucugaguugcc

SEQ ID NO: 3586947 - RNA, 21 nt, Human
cuguugauuaauuucugccau

SEQ ID NO: 3586948 - RNA, 14 nt, Human
cuguugauugcuaa

SEQ ID NO: 3586949 - RNA, 18 nt, Human
cuguugauugcuaaaugu

SEQ ID NO: 3586950 - RNA, 20 nt, Human
cuguugauugcuaaauguaa

SEQ ID NO: 3586951 - RNA, 22 nt, Human
cuguugauugcuaaauguaaca

SEQ ID NO: 3586952 - RNA, 21 nt, Human
cuguugcaauuaggauuuuga

SEQ ID NO: 3586953 - RNA, 22 nt, Human
cuguugcaauuaggauuuugau

SEQ ID NO: 3586954 - RNA, 14 nt, Human
cuguugcacccagc

SEQ ID NO: 3586955 - RNA, 19 nt, Human
cuguugcacccagcccugg

SEQ ID NO: 3586956 - RNA, 17 nt, Human
cuguugcacguguguuu

SEQ ID NO: 3586957 - RNA, 18 nt, Human
cuguugcacguguguuuu

SEQ ID NO: 3586958 - RNA, 23 nt, Human
ugcucaucucaguccucaaagcu

SEQ ID NO: 3586959 - RNA, 15 nt, Human
ugcucaucugcuggu

SEQ ID NO: 3586960 - RNA, 14 nt, Human
ugcucauggaauug

SEQ ID NO: 3586961 - RNA, 22 nt, Human
ugcucaugguccccauggcaug

SEQ ID NO: 3586962 - RNA, 12 nt, Human
ugcucauuuaag

SEQ ID NO: 3586963 - RNA, 14 nt, Human
ugcucauuucagga

SEQ ID NO: 3586964 - RNA, 14 nt, Human
ugcucauuucaugg

SEQ ID NO: 3586965 - RNA, 17 nt, Human
ugcuccaagauucuaga

SEQ ID NO: 3586966 - RNA, 13 nt, Human
ugcuccacagugu

SEQ ID NO: 3586967 - RNA, 14 nt, Human
ugcuccaccacauc

SEQ ID NO: 3586968 - RNA, 15 nt, Human
ugcuccaccacaucc

SEQ ID NO: 3586969 - RNA, 16 nt, Human
ugcuccaccccacuca

SEQ ID NO: 3586970 - RNA, 17 nt, Human
ugcuccaccccacucac

SEQ ID NO: 3586971 - RNA, 23 nt, Human
ugcuccacccuuggccugucuca

SEQ ID NO: 3586972 - RNA, 21 nt, Human
ugcuccaccuuucagcccacg

SEQ ID NO: 3586973 - RNA, 18 nt, Human
ugcuccacgcgcuucgac

SEQ ID NO: 3586974 - RNA, 22 nt, Human
ugcuccagaauuuggaaauccu

SEQ ID NO: 3586975 - RNA, 13 nt, Human
ugcuccagacagg

SEQ ID NO: 3586976 - RNA, 19 nt, Human
ugcuccagcaacacagccu

SEQ ID NO: 3586977 - RNA, 18 nt, Human
ugcuccagccaaccccug

SEQ ID NO: 3586978 - RNA, 20 nt, Human
ugcuccagccaaccccugug

SEQ ID NO: 3586979 - RNA, 23 nt, Human
ugcuccagccaaccccuguggag

SEQ ID NO: 3586980 - RNA, 14 nt, Human
ugcuccagccuggc

SEQ ID NO: 3586981 - RNA, 16 nt, Human
ugcuccagccuggcuc

SEQ ID NO: 3586982 - RNA, 18 nt, Human
ugcuccaggccugcagca

SEQ ID NO: 3586983 - RNA, 23 nt, Human
ugcuccauaguuuggcauuugca

SEQ ID NO: 3586984 - RNA, 22 nt, Human
ugcucccaaggggccugagcag

SEQ ID NO: 3586985 - RNA, 16 nt, Human
ugcucccaccuggcuc

SEQ ID NO: 3586986 - RNA, 18 nt, Human
ugcucccaccuggcucug

SEQ ID NO: 3586987 - RNA, 13 nt, Human
ugcucccagcagc

SEQ ID NO: 3586988 - RNA, 20 nt, Human
ugcucccagcagcccuaagg

SEQ ID NO: 3586989 - RNA, 22 nt, Human
ugcuccccacagcgucccuggc

SEQ ID NO: 3586990 - RNA, 22 nt, Human
ugcuccccagcccuggcucugc

SEQ ID NO: 3586991 - RNA, 14 nt, Human
ugcucccccacccc

SEQ ID NO: 3586992 - RNA, 16 nt, Human
ugcucccccacccccu

SEQ ID NO: 3586993 - RNA, 23 nt, Human
ugcucccccacccccuccccagg

SEQ ID NO: 3586994 - RNA, 15 nt, Human
ugcucccccuuuucc

SEQ ID NO: 3586995 - RNA, 15 nt, Human
ugcuccccucugaaa

SEQ ID NO: 3586996 - RNA, 18 nt, Human
ugcuccccugugccagcc

SEQ ID NO: 3586997 - RNA, 18 nt, Human
ugcucccuaagccagccu

SEQ ID NO: 3586998 - RNA, 19 nt, Human
ugcucccucagacuggggc

SEQ ID NO: 3586999 - RNA, 20 nt, Human
ugcucccuccccugcccugg

SEQ ID NO: 3587000 - RNA, 15 nt, Human
ugcucccucuccccc

SEQ ID NO: 3587001 - RNA, 13 nt, Human
ugcucccugaagc

SEQ ID NO: 3587002 - RNA, 18 nt, Human
ugcucccugaagccagcc

SEQ ID NO: 3587003 - RNA, 22 nt, Human
ugcucccugaagccagccuucu

SEQ ID NO: 3587004 - RNA, 13 nt, Human
ugcucccugacug

SEQ ID NO: 3587005 - RNA, 15 nt, Human
ugcucccuucagccc

SEQ ID NO: 3587006 - RNA, 16 nt, Human
ugcucccuucagcccc

SEQ ID NO: 3587007 - RNA, 20 nt, Human
ugcuccgaggacccaggaaa

SEQ ID NO: 3587008 - RNA, 18 nt, Human
ugcuccgccucugcuggc

SEQ ID NO: 3587009 - RNA, 14 nt, Human
ugcuccgccuggcc

SEQ ID NO: 3587010 - RNA, 16 nt, Human
ugcuccgccuggccug

SEQ ID NO: 3587011 - RNA, 15 nt, Human
ugcuccgcugcuccu

SEQ ID NO: 3587012 - RNA, 23 nt, Human
ugcuccgcugcuccuuggcuuac

SEQ ID NO: 3587013 - RNA, 17 nt, Human
ugcuccgugccuccacc

SEQ ID NO: 3587014 - RNA, 13 nt, Human
ugcuccgugcuug

SEQ ID NO: 3587015 - RNA, 14 nt, Human
ugcuccuagaggga

SEQ ID NO: 3587016 - RNA, 22 nt, Human
ugcuccuaggacccgucuccag

SEQ ID NO: 3587017 - RNA, 19 nt, Human
ugcuccucacugcccgcac

SEQ ID NO: 3587018 - RNA, 12 nt, Human
ugcuccuccagg

SEQ ID NO: 3587019 - RNA, 17 nt, Human
ugcuccucccuggcugc

SEQ ID NO: 3587020 - RNA, 14 nt, Human
ugcuccucuccagg

SEQ ID NO: 3587021 - RNA, 12 nt, Human
ugcuccugagcc

SEQ ID NO: 3587022 - RNA, 16 nt, Human
ugcuccugagccccca

SEQ ID NO: 3587023 - RNA, 21 nt, Human
ugcuccugagcccccagcuuc

SEQ ID NO: 3587024 - RNA, 21 nt, Human
ugcuccuggagccuuugaaua

SEQ ID NO: 3587025 - RNA, 20 nt, Human
ugcuccugggcuacaaggac

SEQ ID NO: 3587026 - RNA, 16 nt, Human
ugcuccuuagcugcca

SEQ ID NO: 3587027 - RNA, 19 nt, Human
ugcuccuuccaacaggagc

SEQ ID NO: 3587028 - RNA, 21 nt, Human
ugcuccuuccaacaggagcug

SEQ ID NO: 3587029 - RNA, 15 nt, Human
ugcuccuuccccauc

SEQ ID NO: 3587030 - RNA, 17 nt, Human
ugcuccuuggcuuaccu

SEQ ID NO: 3587031 - RNA, 19 nt, Human
ugcuccuuggcuuaccuga

SEQ ID NO: 3587032 - RNA, 18 nt, Human
ugcuccuugggcccuuug

SEQ ID NO: 3587033 - RNA, 16 nt, Human
ugcuccuuguuccuag

SEQ ID NO: 3587034 - RNA, 23 nt, Human
ugcucgauuauucccuguacaau

SEQ ID NO: 3587035 - RNA, 18 nt, Human
ugcucgcuguugcugaau

SEQ ID NO: 3587036 - RNA, 23 nt, Human
ugcucgggcccaggccaucuucc

SEQ ID NO: 3587037 - RNA, 14 nt, Human
ugcucuaaaauauu

SEQ ID NO: 3587038 - RNA, 23 nt, Human
ugcucuaaaauauuuaugaagaa

SEQ ID NO: 3587039 - RNA, 20 nt, Human
ugcucuacaaugacacacaa

SEQ ID NO: 3587040 - RNA, 16 nt, Human
ugcucuagaugagcug

SEQ ID NO: 3587041 - RNA, 20 nt, Human
ugcucuagaugagcugggcc

SEQ ID NO: 3587042 - RNA, 15 nt, Human
ugcucuaggaagaca

SEQ ID NO: 3587043 - RNA, 13 nt, Human
ugcucuagugccu

SEQ ID NO: 3587044 - RNA, 20 nt, Human
ugcucuaucucacagcacac

SEQ ID NO: 3587045 - RNA, 17 nt, Human
ugcucuaucucucaaaa

SEQ ID NO: 3587046 - RNA, 20 nt, Human
ugcucuaucuugcucuguaa

SEQ ID NO: 3587047 - RNA, 12 nt, Human
ugcucuauugua

SEQ ID NO: 3587048 - RNA, 21 nt, Human
ugcucuauuguagcauuucuu

SEQ ID NO: 3587049 - RNA, 19 nt, Human
ugcucucaaaccccugacc

SEQ ID NO: 3587050 - RNA, 20 nt, Human
ugcucucaccuugguuccug

SEQ ID NO: 3587051 - RNA, 19 nt, Human
ugcucuccaagucucagug

SEQ ID NO: 3587052 - RNA, 19 nt, Human
ugcucuccauucugcuccu

SEQ ID NO: 3587053 - RNA, 20 nt, Human
ugcucuccauucugcuccuu

SEQ ID NO: 3587054 - RNA, 13 nt, Human
ugcucuccccugc

SEQ ID NO: 3587055 - RNA, 13 nt, Human
ugcucuccucuuc

SEQ ID NO: 3587056 - RNA, 14 nt, Human
ugcucuccucuucu

SEQ ID NO: 3587057 - RNA, 18 nt, Human
ugcucuccucuugccacu

SEQ ID NO: 3587058 - RNA, 21 nt, Human
ugcucuccucuugccacugcc

SEQ ID NO: 3587059 - RNA, 22 nt, Human
ugcucucgcaccuuuccaaagu

SEQ ID NO: 3587060 - RNA, 14 nt, Human
ugcucucugcagcc

SEQ ID NO: 3587061 - RNA, 20 nt, Human
ugcucucugcagccagccca

SEQ ID NO: 3587062 - RNA, 13 nt, Human
ugcucucugccac

SEQ ID NO: 3587063 - RNA, 15 nt, Human
ugcucucuuucuguc

SEQ ID NO: 3587064 - RNA, 18 nt, Human
ugcucugaacacgaagcu

SEQ ID NO: 3587065 - RNA, 18 nt, Human
ugcucugagaagaggagc

SEQ ID NO: 3587066 - RNA, 22 nt, Human
ugcucugagaagaggagcccuc

SEQ ID NO: 3587067 - RNA, 12 nt, Human
ugcucugagagc

SEQ ID NO: 3587068 - RNA, 23 nt, Human
ugcucugagagcaaacuggcuug

SEQ ID NO: 3587069 - RNA, 16 nt, Human
ugcucugagccacagu

SEQ ID NO: 3587070 - RNA, 16 nt, Human
ugcucugaggcuucca

SEQ ID NO: 3587071 - RNA, 19 nt, Human
ugcucugaucauccacugu

SEQ ID NO: 3587072 - RNA, 14 nt, Human
ugcucugaucccuc

SEQ ID NO: 3587073 - RNA, 16 nt, Human
ugcucugaucccucua

SEQ ID NO: 3587074 - RNA, 18 nt, Human
ugcucugaugaagaggag

SEQ ID NO: 3587075 - RNA, 18 nt, Human
ugcucugaugcaucagaa

SEQ ID NO: 3587076 - RNA, 14 nt, Human
ugcucugauuuauc

SEQ ID NO: 3587077 - RNA, 18 nt, Human
ugcucugcauguuacaua

SEQ ID NO: 3587078 - RNA, 13 nt, Human
ugcucugcccaga

SEQ ID NO: 3587079 - RNA, 20 nt, Human
ugcucugcccagagcugggu

SEQ ID NO: 3587080 - RNA, 23 nt, Human
ugcucugccccagcuugggcaga

SEQ ID NO: 3587081 - RNA, 11 nt, Human
ugcucugcccu

SEQ ID NO: 3587082 - RNA, 12 nt, Human
ugcucugcccuu

SEQ ID NO: 3587083 - RNA, 15 nt, Human
ugcucugcugacaga

SEQ ID NO: 3587084 - RNA, 21 nt, Human
ugcucugcugacagacacagg

SEQ ID NO: 3587085 - RNA, 15 nt, Human
ugcucugcugaugac

SEQ ID NO: 3587086 - RNA, 19 nt, Human
ugcucuggaaaaugugacc

SEQ ID NO: 3587087 - RNA, 16 nt, Human
ugcucuggaagagagg

SEQ ID NO: 3587088 - RNA, 14 nt, Human
ugcucuggaauuug

SEQ ID NO: 3587089 - RNA, 14 nt, Human
ugcucuggacaggc

SEQ ID NO: 3587090 - RNA, 15 nt, Human
ugcucuggacaggca

SEQ ID NO: 3587091 - RNA, 16 nt, Human
ugcucuggaccugccc

SEQ ID NO: 3587092 - RNA, 20 nt, Human
ugcucuggaccugcccccgc

SEQ ID NO: 3587093 - RNA, 18 nt, Human
ugcucugguuguuucugu

SEQ ID NO: 3587094 - RNA, 19 nt, Human
ugcucugguuguuucuguu

SEQ ID NO: 3587095 - RNA, 14 nt, Human
ugcucuguagccua

SEQ ID NO: 3587096 - RNA, 20 nt, Human
ugcucuguaggagcuacccu

SEQ ID NO: 3587097 - RNA, 16 nt, Human
ugcucuuaauugccac

SEQ ID NO: 3587098 - RNA, 20 nt, Human
ugcucuuacuacacugagga

SEQ ID NO: 3587099 - RNA, 15 nt, Human
ugcucuuagcugucu

SEQ ID NO: 3587100 - RNA, 13 nt, Human
ugcucuuauuuca

SEQ ID NO: 3587101 - RNA, 17 nt, Human
ugcucuucagaugccac

SEQ ID NO: 3587102 - RNA, 18 nt, Human
ugcucuucagaugccacu

SEQ ID NO: 3587103 - RNA, 14 nt, Human
ugcucuucuuuaga

SEQ ID NO: 3587104 - RNA, 17 nt, Human
ugcucuugaugccuggc

SEQ ID NO: 3587105 - RNA, 14 nt, Human
ugcucuugucccac

SEQ ID NO: 3587106 - RNA, 19 nt, Human
ugcucuuucccacccagcc

SEQ ID NO: 3587107 - RNA, 21 nt, Human
ugcucuuucccacccagccug

SEQ ID NO: 3587108 - RNA, 13 nt, Human
ugcucuuuucucc

SEQ ID NO: 3587109 - RNA, 21 nt, Human
ugcucuuuucuccucacugua

SEQ ID NO: 3587110 - RNA, 23 nt, Human
ugcucuuuucuccucacuguauc

SEQ ID NO: 3587111 - RNA, 17 nt, Human
ugcucuuuuuuacucau

SEQ ID NO: 3587112 - RNA, 18 nt, Human
ugcucuuuuuuacucauu

SEQ ID NO: 3587113 - RNA, 19 nt, Human
ugcugaaaacuagcucgug

SEQ ID NO: 3587114 - RNA, 21 nt, Human
ugcugaaaauguccuugugau

SEQ ID NO: 3587115 - RNA, 17 nt, Human
ugcugaaacaacaaaua

SEQ ID NO: 3587116 - RNA, 17 nt, Human
ugcugaaauuuuauaug

SEQ ID NO: 3587117 - RNA, 15 nt, Human
ugcugaacaaaaaau

SEQ ID NO: 3587118 - RNA, 20 nt, Human
ugcugaacaaaaaauaaaaa

SEQ ID NO: 3587119 - RNA, 16 nt, Human
ugcugaacaccuugug

SEQ ID NO: 3587120 - RNA, 16 nt, Human
ugcugaagaaucuacu

SEQ ID NO: 3587121 - RNA, 14 nt, Human
ugcugaagcugccu

SEQ ID NO: 3587122 - RNA, 18 nt, Human
ugcugaagggcauucuuu

SEQ ID NO: 3587123 - RNA, 21 nt, Human
ugcugaagggcauucuuuccc

SEQ ID NO: 3587124 - RNA, 22 nt, Human
ugcugaagguggggauugccca

SEQ ID NO: 3587125 - RNA, 18 nt, Human
ugcugaauacagaggcaa

SEQ ID NO: 3587126 - RNA, 21 nt, Human
ugcugaauaggcgaucacaac

SEQ ID NO: 3587127 - RNA, 19 nt, Human
ugcugaaucggaaucucug

SEQ ID NO: 3587128 - RNA, 23 nt, Human
ugcugaaugccgcgaugggucag

SEQ ID NO: 3587129 - RNA, 17 nt, Human
ugcugaaugguuuucaa

SEQ ID NO: 3587130 - RNA, 18 nt, Human
ugcugaaugguuuucaaa

SEQ ID NO: 3587131 - RNA, 15 nt, Human
ugcugacagcugacc

SEQ ID NO: 3587132 - RNA, 14 nt, Human
ugcugacagcugcu

SEQ ID NO: 3587133 - RNA, 16 nt, Human
ugcugacagcugcucc

SEQ ID NO: 3587134 - RNA, 23 nt, Human
ugcugaccaauugugcugccauu

SEQ ID NO: 3587135 - RNA, 18 nt, Human
ugcugacccaugggcagg

SEQ ID NO: 3587136 - RNA, 21 nt, Human
ugcugacccaugggcaggaga

SEQ ID NO: 3587137 - RNA, 21 nt, Human
ugcugaccucagcgguugcca

SEQ ID NO: 3587138 - RNA, 13 nt, Human
ugcugaccugcug

SEQ ID NO: 3587139 - RNA, 16 nt, Human
ugcugacuguacuccu

SEQ ID NO: 3587140 - RNA, 21 nt, Human
ugcugacuguacuccucccag

SEQ ID NO: 3587141 - RNA, 17 nt, Human
ugcugacuguagcuuug

SEQ ID NO: 3587142 - RNA, 15 nt, Human
ugcugagaaaacaug

SEQ ID NO: 3587143 - RNA, 19 nt, Human
ugcugagaaccuggccuuc

SEQ ID NO: 3587144 - RNA, 14 nt, Human
ugcugagaagcuuu

SEQ ID NO: 3587145 - RNA, 14 nt, Human
ugcugagagaaaua

SEQ ID NO: 3587146 - RNA, 23 nt, Human
ugcugagagaaauauggaacuua

SEQ ID NO: 3587147 - RNA, 18 nt, Human
ugcugagagacccaagga

SEQ ID NO: 3587148 - RNA, 22 nt, Human
ugcugagagacccaaggaggaa

SEQ ID NO: 3587149 - RNA, 18 nt, Human
ugcugagauacauacaga

SEQ ID NO: 3587150 - RNA, 20 nt, Human
ugcugagauuacagguguga

SEQ ID NO: 3587151 - RNA, 16 nt, Human
ugcugagauucuucag

SEQ ID NO: 3587152 - RNA, 23 nt, Human
ugcugagccuguaaaauaaaagg

SEQ ID NO: 3587153 - RNA, 13 nt, Human
ugcugagcucuga

SEQ ID NO: 3587154 - RNA, 23 nt, Human
ugcugagcucugagaggcccugg

SEQ ID NO: 3587155 - RNA, 15 nt, Human
ugcugagcuguuuau

SEQ ID NO: 3587156 - RNA, 13 nt, Human
ugcugaggccugg

SEQ ID NO: 3587157 - RNA, 14 nt, Human
ugcugaggccuggg

SEQ ID NO: 3587158 - RNA, 15 nt, Human
ugcugaggccugggc

SEQ ID NO: 3587159 - RNA, 24 nt, Human
ugcugaguagaugcgcagccccau

SEQ ID NO: 3587160 - RNA, 17 nt, Human
ugcugagucaucuguua

SEQ ID NO: 3587161 - RNA, 19 nt, Human
ugcugagucaucuguuagg

SEQ ID NO: 3587162 - RNA, 15 nt, Human
ugcugagucccaggc

SEQ ID NO: 3587163 - RNA, 21 nt, Human
ugcugagucugaaggcugggu

SEQ ID NO: 3587164 - RNA, 23 nt, Human
ugcugagucugaaggcuggguuc

SEQ ID NO: 3587165 - RNA, 23 nt, Human
ugcugaguguacagaguggaaua

SEQ ID NO: 3587166 - RNA, 17 nt, Human
ugcugaguuugugcugg

SEQ ID NO: 3587167 - RNA, 18 nt, Human
ugcugauauuuucucuag

SEQ ID NO: 3587168 - RNA, 21 nt, Human
ugcugaucaucgccagaggug

SEQ ID NO: 3587169 - RNA, 19 nt, Human
ugcugaugaaucacuguuu

SEQ ID NO: 3587170 - RNA, 23 nt, Human
ugcugaugacccccccagcuuca

SEQ ID NO: 3587171 - RNA, 20 nt, Human
ugcugauguucaguguaauu

SEQ ID NO: 3587172 - RNA, 23 nt, Human
ugcugauguucaguguaauuucu

SEQ ID NO: 3587173 - RNA, 16 nt, Human
ugcugauuuccccucu

SEQ ID NO: 3587174 - RNA, 13 nt, Human
ugcugauuuuaau

SEQ ID NO: 3587175 - RNA, 16 nt, Human
ugcugcaaacuuaaug

SEQ ID NO: 3587176 - RNA, 17 nt, Human
ugcugcaacaaaaugua

SEQ ID NO: 3587177 - RNA, 14 nt, Human
ugcugcaccaaccc

SEQ ID NO: 3587178 - RNA, 17 nt, Human
ugcugcaccaacccagc

SEQ ID NO: 3587179 - RNA, 19 nt, Human
ugcugcaccaacccagccg

SEQ ID NO: 3587180 - RNA, 15 nt, Human
ugcugcacuuccugu

SEQ ID NO: 3587181 - RNA, 17 nt, Human
ugcugcacuuccuguuu

SEQ ID NO: 3587182 - RNA, 14 nt, Human
ugcugcagcucccu

SEQ ID NO: 3587183 - RNA, 16 nt, Human
ugcugcagggcuuuaa

SEQ ID NO: 3587184 - RNA, 16 nt, Human
ugcugcaguugccagu

SEQ ID NO: 3587185 - RNA, 23 nt, Human
ugcugcaguugccagucaccccg

SEQ ID NO: 3587186 - RNA, 23 nt, Human
ugcugcaucuuauagcacuuuga

SEQ ID NO: 3587187 - RNA, 15 nt, Human
ugcuucuuucauuuu

SEQ ID NO: 3587188 - RNA, 16 nt, Human
ugcuugaaggcccugc

SEQ ID NO: 3587189 - RNA, 12 nt, Human
ugcuugaauagc

SEQ ID NO: 3587190 - RNA, 15 nt, Human
ugcuugacaacaucu

SEQ ID NO: 3587191 - RNA, 20 nt, Human
ugcuugacauaauuucacug

SEQ ID NO: 3587192 - RNA, 21 nt, Human
ugcuugagccaggaggccugc

SEQ ID NO: 3587193 - RNA, 16 nt, Human
ugcuugagcccaggag

SEQ ID NO: 3587194 - RNA, 20 nt, Human
ugcuugagucagguuugagu

SEQ ID NO: 3587195 - RNA, 13 nt, Human
ugcuugauagaaa

SEQ ID NO: 3587196 - RNA, 18 nt, Human
ugcuugaugguuuauguu

SEQ ID NO: 3587197 - RNA, 12 nt, Human
ugcuugauuuuu

SEQ ID NO: 3587198 - RNA, 22 nt, Human
ugcuugcacuuuguaacauguu

SEQ ID NO: 3587199 - RNA, 16 nt, Human
ugcuugcaguagauuu

SEQ ID NO: 3587200 - RNA, 19 nt, Human
ugcuugcaguagauuuucu

SEQ ID NO: 3587201 - RNA, 21 nt, Human
ugcuugccaaggcagaggccu

SEQ ID NO: 3587202 - RNA, 18 nt, Human
ugcuugcccccaugcugg

SEQ ID NO: 3587203 - RNA, 14 nt, Human
ugcuugccuagggc

SEQ ID NO: 3587204 - RNA, 22 nt, Human
ugcuugccuagggccuggucca

SEQ ID NO: 3587205 - RNA, 20 nt, Human
ugcuugccugcagggccaug

SEQ ID NO: 3587206 - RNA, 19 nt, Human
ugcuugccugcguuuugga

SEQ ID NO: 3587207 - RNA, 19 nt, Human
ugcuugcggcaaaaggaaa

SEQ ID NO: 3587208 - RNA, 17 nt, Human
ugcuuggaacauacugu

SEQ ID NO: 3587209 - RNA, 21 nt, Human
ugcuuggaauaucugcuguau

SEQ ID NO: 3587210 - RNA, 20 nt, Human
ugcuuggaccucgugcuuua

SEQ ID NO: 3587211 - RNA, 15 nt, Human
ugcuuggcccaggag

SEQ ID NO: 3587212 - RNA, 19 nt, Human
ugcuuggcugcuuggccuu

SEQ ID NO: 3587213 - RNA, 15 nt, Human
ugcuugggaaggggc

SEQ ID NO: 3587214 - RNA, 12 nt, Human
ugcuugggcuuc

SEQ ID NO: 3587215 - RNA, 20 nt, Human
ugcuuggggggugaugaggg

SEQ ID NO: 3587216 - RNA, 16 nt, Human
ugcuuggucuguuuga

SEQ ID NO: 3587217 - RNA, 18 nt, Human
ugcuuguaacaagaaaac

SEQ ID NO: 3587218 - RNA, 14 nt, Human
ugcuuguacauaau

SEQ ID NO: 3587219 - RNA, 14 nt, Human
ugcuuguaccucug

SEQ ID NO: 3587220 - RNA, 19 nt, Human
ugcuuguauuuuuuaaugc

SEQ ID NO: 3587221 - RNA, 20 nt, Human
ugcuugugaaaauguguucu

SEQ ID NO: 3587222 - RNA, 12 nt, Human
ugcuuguguuaa

SEQ ID NO: 3587223 - RNA, 15 nt, Human
ugcuuguguuaagua

SEQ ID NO: 3587224 - RNA, 20 nt, Human
ugcuuguuaaugcuuucuga

SEQ ID NO: 3587225 - RNA, 14 nt, Human
ugcuuguugacaga

SEQ ID NO: 3587226 - RNA, 15 nt, Human
ugcuuguuucuuggu

SEQ ID NO: 3587227 - RNA, 16 nt, Human
ugcuuuaaaaacuauu

SEQ ID NO: 3587228 - RNA, 13 nt, Human
ugcuuuaaagaua

SEQ ID NO: 3587229 - RNA, 23 nt, Human
ugcuuuaaaguguaauaauauga

SEQ ID NO: 3587230 - RNA, 15 nt, Human
ugcuuuaauaucauc

SEQ ID NO: 3587231 - RNA, 19 nt, Human
ugcuuuaauuguuaagaua

SEQ ID NO: 3587232 - RNA, 19 nt, Human
ugcuuuaccaaacagcaaa

SEQ ID NO: 3587233 - RNA, 21 nt, Human
ugcuuuaccaauugaaguaaa

SEQ ID NO: 3587234 - RNA, 14 nt, Human
ugcuuuacugucaa

SEQ ID NO: 3587235 - RNA, 16 nt, Human
ugcuuuagacuugaaa

SEQ ID NO: 3587236 - RNA, 22 nt, Human
ugcuuuagcuugaaaaggugac

SEQ ID NO: 3587237 - RNA, 12 nt, Human
ugcuuuauaaau

SEQ ID NO: 3587238 - RNA, 14 nt, Human
ugcuuuauuccaga

SEQ ID NO: 3587239 - RNA, 17 nt, Human
ugcuuuauuccagaaug

SEQ ID NO: 3587240 - RNA, 13 nt, Human
ugcuuuauuugua

SEQ ID NO: 3587241 - RNA, 15 nt, Human
ugcuuuauuuguaaa

SEQ ID NO: 3587242 - RNA, 16 nt, Human
ugcuuuauuuguaaau

SEQ ID NO: 3587243 - RNA, 23 nt, Human
ugcuuuauuuguaaauuuagugu

SEQ ID NO: 3587244 - RNA, 12 nt, Human
ugcuuucacucu

SEQ ID NO: 3587245 - RNA, 16 nt, Human
ugcuuucagaagugcc

SEQ ID NO: 3587246 - RNA, 20 nt, Human
ugcuuuccaaaccuuaucuc

SEQ ID NO: 3587247 - RNA, 12 nt, Human
ugcuuuccagcu

SEQ ID NO: 3587248 - RNA, 21 nt, Human
ugcuuuccauucgugaaaaca

SEQ ID NO: 3587249 - RNA, 13 nt, Human
ugcuuuccccugu

SEQ ID NO: 3587250 - RNA, 17 nt, Human
ugcuuucgguuccaguu

SEQ ID NO: 3587251 - RNA, 21 nt, Human
ugcuuucuaugcuguuuguag

SEQ ID NO: 3587252 - RNA, 15 nt, Human
ugcuuucugaagcuu

SEQ ID NO: 3587253 - RNA, 20 nt, Human
ugcuuucugcucagcuucuc

SEQ ID NO: 3587254 - RNA, 16 nt, Human
ugcuuugaaguagcuc

SEQ ID NO: 3587255 - RNA, 20 nt, Human
ugcuuugaaguagcucuuuu

SEQ ID NO: 3587256 - RNA, 15 nt, Human
ugcuuugagagagaa

SEQ ID NO: 3587257 - RNA, 17 nt, Human
ugcuuugauauuucaau

SEQ ID NO: 3587258 - RNA, 17 nt, Human
ugcuuugcccacaugcc

SEQ ID NO: 3587259 - RNA, 12 nt, Human
ugcuuugcucuu

SEQ ID NO: 3587260 - RNA, 14 nt, Human
ugcuuugcucuugu

SEQ ID NO: 3587261 - RNA, 17 nt, Human
ugcuuuggaaaacccag

SEQ ID NO: 3587262 - RNA, 18 nt, Human
ugcuuuggaccuaaaugg

SEQ ID NO: 3587263 - RNA, 22 nt, Human
ugcuuuggaccuaaauggccuc

SEQ ID NO: 3587264 - RNA, 15 nt, Human
ugcuuugggaagccg

SEQ ID NO: 3587265 - RNA, 21 nt, Human
ugcuuuggucacuuuuagaug

SEQ ID NO: 3587266 - RNA, 17 nt, Human
ugcuuuggucuugcccc

SEQ ID NO: 3587267 - RNA, 23 nt, Human
ugcuuuguaagugaaaaacauga

SEQ ID NO: 3587268 - RNA, 22 nt, Human
ugcuuuguagaguuuugucauu

SEQ ID NO: 3587269 - RNA, 12 nt, Human
ugcuuugucucc

SEQ ID NO: 3587270 - RNA, 14 nt, Human
ugcuuugucuccuc

SEQ ID NO: 3587271 - RNA, 12 nt, Human
ugcuuugugauu

SEQ ID NO: 3587272 - RNA, 16 nt, Human
ugcuuugugauuuuug

SEQ ID NO: 3587273 - RNA, 17 nt, Human
ugcuuugugauuuuugu

SEQ ID NO: 3587274 - RNA, 14 nt, Human
ugcuuuguguucuu

SEQ ID NO: 3587275 - RNA, 21 nt, Human
ugcuuuguuaccuuaaaacua

SEQ ID NO: 3587276 - RNA, 13 nt, Human
ugcuuuguugcac

SEQ ID NO: 3587277 - RNA, 15 nt, Human
ugcuuuguugugugc

SEQ ID NO: 3587278 - RNA, 16 nt, Human
ugcuuuguugugugcc

SEQ ID NO: 3587279 - RNA, 24 nt, Human
ugcuuuguugugugccucuagcug

SEQ ID NO: 3587280 - RNA, 10 nt, Human
ugcuuuuaaa

SEQ ID NO: 3587281 - RNA, 17 nt, Human
ugcuuuuaaaaaaaaau

SEQ ID NO: 3587282 - RNA, 17 nt, Human
ugcuuuuaaaacuacuu

SEQ ID NO: 3587283 - RNA, 19 nt, Human
ugcuuuuaaaauuuuaagc

SEQ ID NO: 3587284 - RNA, 19 nt, Human
ugcuuuuaaggaaaggcaa

SEQ ID NO: 3587285 - RNA, 12 nt, Human
ugcuuuuaauua

SEQ ID NO: 3587286 - RNA, 17 nt, Human
ugcuuuuaccaugcccc

SEQ ID NO: 3587287 - RNA, 22 nt, Human
ugcuuuucacugcugcaaggcc

SEQ ID NO: 3587288 - RNA, 14 nt, Human
ugcuuuucauccuu

SEQ ID NO: 3587289 - RNA, 13 nt, Human
ugcuuuucccucu

SEQ ID NO: 3587290 - RNA, 14 nt, Human
ugcuuuucccucuu

SEQ ID NO: 3587291 - RNA, 22 nt, Human
ugcuuuuccuuggggcaggcag

SEQ ID NO: 3587292 - RNA, 15 nt, Human
ugcuuuucugcccug

SEQ ID NO: 3587293 - RNA, 18 nt, Human
ugcuuuucugcccuggcu

SEQ ID NO: 3587294 - RNA, 17 nt, Human
ugcuuuucuguauuuua

SEQ ID NO: 3587295 - RNA, 17 nt, Human
ugcuuuucuuuucuaac

SEQ ID NO: 3587296 - RNA, 14 nt, Human
ugcuuuugcuucua

SEQ ID NO: 3587297 - RNA, 21 nt, Human
ugcuuuuggcaaaacucuacu

SEQ ID NO: 3587298 - RNA, 18 nt, Human
ugcuuuuggucuguguga

SEQ ID NO: 3587299 - RNA, 17 nt, Human
ugcuuuuuaaguguuaa

SEQ ID NO: 3587300 - RNA, 16 nt, Human
ugcuuuuuauaaaaag

SEQ ID NO: 3587301 - RNA, 16 nt, Human
ugcuuuuuauggccug

SEQ ID NO: 3587302 - RNA, 14 nt, Human
ugcuuuuucuaaug

SEQ ID NO: 3587303 - RNA, 17 nt, Human
ugcuuuuucucaaaaug

SEQ ID NO: 3587304 - RNA, 17 nt, Human
ugcuuuuuuaaauauua

SEQ ID NO: 3587305 - RNA, 20 nt, Human
ugcuuuuuuccaaaacaaaa

SEQ ID NO: 3587306 - RNA, 17 nt, Human
ugcuuuuuuguuuuggc

SEQ ID NO: 3587307 - RNA, 20 nt, Human
ugcuuuuuuugaaacuuuga

SEQ ID NO: 3587308 - RNA, 23 nt, Human
ugcuuuuuuuguguguauuugcu

SEQ ID NO: 3587309 - RNA, 17 nt, Human
ugcuuuuuuuuuuccag

SEQ ID NO: 3587310 - RNA, 19 nt, Human
ugcuuuuuuuuuuccagca

SEQ ID NO: 3587311 - RNA, 23 nt, Human
uggaaaaaaaaaaaagaggaaaa

SEQ ID NO: 3587312 - RNA, 14 nt, Human
uggaaaaaaacauc

SEQ ID NO: 3587313 - RNA, 16 nt, Human
uggaaaaacagcaugu

SEQ ID NO: 3587314 - RNA, 20 nt, Human
uggaaaaauagccugccucu

SEQ ID NO: 3587315 - RNA, 13 nt, Human
uggaaaaauccag

SEQ ID NO: 3587316 - RNA, 14 nt, Human
uggaaaaauguuug

SEQ ID NO: 3587317 - RNA, 16 nt, Human
uggaaaaauuccagaa

SEQ ID NO: 3587318 - RNA, 18 nt, Human
uggaaaacagaacacuua

SEQ ID NO: 3587319 - RNA, 15 nt, Human
uggaaaacuguguug

SEQ ID NO: 3587320 - RNA, 20 nt, Human
uggaaaacuguguugccaca

SEQ ID NO: 3587321 - RNA, 15 nt, Human
uggaaaagaacuguu

SEQ ID NO: 3587322 - RNA, 16 nt, Human
uggaaaagaggaguuu

SEQ ID NO: 3587323 - RNA, 15 nt, Human
uggaaaaggaagacu

SEQ ID NO: 3587324 - RNA, 19 nt, Human
uggaaaagggucuugggaa

SEQ ID NO: 3587325 - RNA, 21 nt, Human
uggaaaagggucuugggaaau

SEQ ID NO: 3587326 - RNA, 17 nt, Human
uggaaaauaaaaggucu

SEQ ID NO: 3587327 - RNA, 15 nt, Human
uggaaaauaaauuau

SEQ ID NO: 3587328 - RNA, 16 nt, Human
uggaaaauaaauuauu

SEQ ID NO: 3587329 - RNA, 15 nt, Human
uggaaaauucauuuu

SEQ ID NO: 3587330 - RNA, 13 nt, Human
uggaaacaagaug

SEQ ID NO: 3587331 - RNA, 23 nt, Human
uggaaacacuaaauguuaaagau

SEQ ID NO: 3587332 - RNA, 22 nt, Human
uggaaacagcucgacuuuaaaa

SEQ ID NO: 3587333 - RNA, 21 nt, Human
uggaaacccuuaggacagggu

SEQ ID NO: 3587334 - RNA, 19 nt, Human
uggaaaccucuacauauuu

SEQ ID NO: 3587335 - RNA, 14 nt, Human
uggaaaccugcccu

SEQ ID NO: 3587336 - RNA, 15 nt, Human
uggaaaccugcccug

SEQ ID NO: 3587337 - RNA, 16 nt, Human
uggaaaccugcccugc

SEQ ID NO: 3587338 - RNA, 17 nt, Human
uggaaaccugcccugcc

SEQ ID NO: 3587339 - RNA, 19 nt, Human
uggaaaccugucugagguu

SEQ ID NO: 3587340 - RNA, 19 nt, Human
uggaaaccuuccacccagu

SEQ ID NO: 3587341 - RNA, 14 nt, Human
uggaaacuaauaaa

SEQ ID NO: 3587342 - RNA, 19 nt, Human
uggaaacuaauaaaauauu

SEQ ID NO: 3587343 - RNA, 22 nt, Human
uggaaacuaauaaaauauuuuc

SEQ ID NO: 3587344 - RNA, 23 nt, Human
uggaaacuaauaaaauauuuucu

SEQ ID NO: 3587345 - RNA, 21 nt, Human
uggaaacuauguguuuuucuc

SEQ ID NO: 3587346 - RNA, 18 nt, Human
uggaaacucuuuaacuuc

SEQ ID NO: 3587347 - RNA, 21 nt, Human
uggaaacuguugccagagaug

SEQ ID NO: 3587348 - RNA, 16 nt, Human
uggaaagaaucuaaua

SEQ ID NO: 3587349 - RNA, 21 nt, Human
uggaaagacuuuuccaacccu

SEQ ID NO: 3587350 - RNA, 12 nt, Human
uggaaagcaaag

SEQ ID NO: 3587351 - RNA, 12 nt, Human
uggaaagcaggu

SEQ ID NO: 3587352 - RNA, 16 nt, Human
uggaaagcaucaccuc

SEQ ID NO: 3587353 - RNA, 14 nt, Human
uggaaagccucugc

SEQ ID NO: 3587354 - RNA, 21 nt, Human
uggaaaggaaugcaaagauga

SEQ ID NO: 3587355 - RNA, 14 nt, Human
uggaaaggagagga

SEQ ID NO: 3587356 - RNA, 16 nt, Human
uggaaaggagaggaaa

SEQ ID NO: 3587357 - RNA, 17 nt, Human
uggaaaggagaggaaag

SEQ ID NO: 3587358 - RNA, 23 nt, Human
uggaaaggagaggaaagaacuca

SEQ ID NO: 3587359 - RNA, 13 nt, Human
uggaaaggcucag

SEQ ID NO: 3587360 - RNA, 23 nt, Human
uggaaaggcucagucucaggagc

SEQ ID NO: 3587361 - RNA, 22 nt, Human
uggaaaggugugagacugggaa

SEQ ID NO: 3587362 - RNA, 19 nt, Human
uggaaaguaacucauuugu

SEQ ID NO: 3587363 - RNA, 15 nt, Human
uggaaaguaacugug

SEQ ID NO: 3587364 - RNA, 20 nt, Human
uggaaaguacacucugcugu

SEQ ID NO: 3587365 - RNA, 15 nt, Human
uggaaagugaauuug

SEQ ID NO: 3587366 - RNA, 17 nt, Human
uggaaagugaauuugaa

SEQ ID NO: 3587367 - RNA, 15 nt, Human
uggaaaguguaaagc

SEQ ID NO: 3587368 - RNA, 16 nt, Human
uggaaaguguaaagca

SEQ ID NO: 3587369 - RNA, 17 nt, Human
uggaaaguguaaagcau

SEQ ID NO: 3587370 - RNA, 18 nt, Human
uggaaaguguaaagcauu

SEQ ID NO: 3587371 - RNA, 15 nt, Human
uggaaaguuuuugua

SEQ ID NO: 3587372 - RNA, 14 nt, Human
uggaaauaaaguca

SEQ ID NO: 3587373 - RNA, 17 nt, Human
uggaaauaauaaaagau

SEQ ID NO: 3587374 - RNA, 15 nt, Human
uggaaauacacagug

SEQ ID NO: 3587375 - RNA, 19 nt, Human
uggaaauauauauuauacu

SEQ ID NO: 3587376 - RNA, 15 nt, Human
uggaaauauuaagaa

SEQ ID NO: 3587377 - RNA, 20 nt, Human
uggaaauauuaagaaagacu

SEQ ID NO: 3587378 - RNA, 16 nt, Human
uggaaauauuaugcaa

SEQ ID NO: 3587379 - RNA, 19 nt, Human
uggaaauauuaugcaaauu

SEQ ID NO: 3587380 - RNA, 21 nt, Human
uggaaauauuuugauaauaaa

SEQ ID NO: 3587381 - RNA, 16 nt, Human
uggaaaucagccaagu

SEQ ID NO: 3587382 - RNA, 18 nt, Human
uggaaaucaucgaaaauu

SEQ ID NO: 3587383 - RNA, 22 nt, Human
uggaaauccuaguuuccucucc

SEQ ID NO: 3587384 - RNA, 14 nt, Human
uggaaaucuuuaaa

SEQ ID NO: 3587385 - RNA, 15 nt, Human
uggaaaugcugggcu

SEQ ID NO: 3587386 - RNA, 16 nt, Human
uggaaaugcugggcug

SEQ ID NO: 3587387 - RNA, 17 nt, Human
uggaaauggaugcaaag

SEQ ID NO: 3587388 - RNA, 17 nt, Human
uggaaaugggcagagca

SEQ ID NO: 3587389 - RNA, 20 nt, Human
uggaaauuagguugaaacau

SEQ ID NO: 3587390 - RNA, 14 nt, Human
uggaaauuccugua

SEQ ID NO: 3587391 - RNA, 22 nt, Human
uggaaauuccuguacugugucu

SEQ ID NO: 3587392 - RNA, 16 nt, Human
uggaaauugacgaggg

SEQ ID NO: 3587393 - RNA, 16 nt, Human
uggaaauuggaagagc

SEQ ID NO: 3587394 - RNA, 12 nt, Human
uggaaauuuaaa

SEQ ID NO: 3587395 - RNA, 13 nt, Human
uggaaauuuaaag

SEQ ID NO: 3587396 - RNA, 21 nt, Human
uggaaauuuguuauaaugaau

SEQ ID NO: 3587397 - RNA, 21 nt, Human
uggaacaagaugguucuagca

SEQ ID NO: 3587398 - RNA, 22 nt, Human
uggaacaccuaccaaaaaauaa

SEQ ID NO: 3587399 - RNA, 15 nt, Human
uggaacacggccaca

SEQ ID NO: 3587400 - RNA, 17 nt, Human
uggaacacggccacauc

SEQ ID NO: 3587401 - RNA, 19 nt, Human
uggaacacuaaugaggaaa

SEQ ID NO: 3587402 - RNA, 21 nt, Human
uggaacacuagacaagccaga

SEQ ID NO: 3587403 - RNA, 22 nt, Human
uggaacacuagacaagccagaa

SEQ ID NO: 3587404 - RNA, 19 nt, Human
uggaacacucuauaacaaa

SEQ ID NO: 3587405 - RNA, 14 nt, Human
uggaacacucugag

SEQ ID NO: 3587406 - RNA, 15 nt, Human
uggaacacucugaga

SEQ ID NO: 3587407 - RNA, 17 nt, Human
uggaacacucugagacu

SEQ ID NO: 3587408 - RNA, 19 nt, Human
uggaacagauucacacugu

SEQ ID NO: 3587409 - RNA, 20 nt, Human
uggaacagauucacacuguc

SEQ ID NO: 3587410 - RNA, 20 nt, Human
uggaacauaaaauacaaugu

SEQ ID NO: 3587411 - RNA, 22 nt, Human
uggaacauccuuugcagggcag

SEQ ID NO: 3587412 - RNA, 13 nt, Human
uggaacauuggaa

SEQ ID NO: 3587413 - RNA, 19 nt, Human
uggaaccacauugaagaau

SEQ ID NO: 3587414 - RNA, 21 nt, Human
uggaaccacggagaucuccuu

SEQ ID NO: 3587415 - RNA, 12 nt, Human
uggaacccagac

SEQ ID NO: 3587416 - RNA, 15 nt, Human
uggaacccagacuca

SEQ ID NO: 3587417 - RNA, 21 nt, Human
uggaacccagcaguucuguua

SEQ ID NO: 3587418 - RNA, 19 nt, Human
uggaacccuuuuggccccc

SEQ ID NO: 3587419 - RNA, 21 nt, Human
uggaacccuuuuggcccccga

SEQ ID NO: 3587420 - RNA, 19 nt, Human
uggaaccgcaggaagcugc

SEQ ID NO: 3587421 - RNA, 20 nt, Human
uggaaccgcaggaagcugcu

SEQ ID NO: 3587422 - RNA, 23 nt, Human
uggaaccgcaggaagcugcuccg

SEQ ID NO: 3587423 - RNA, 18 nt, Human
uggaaccucagccuggcc

SEQ ID NO: 3587424 - RNA, 19 nt, Human
uggaaccucagccuggcca

SEQ ID NO: 3587425 - RNA, 12 nt, Human
uggaaccuccuu

SEQ ID NO: 3587426 - RNA, 20 nt, Human
uggaaccucugucucauccu

SEQ ID NO: 3587427 - RNA, 14 nt, Human
uggaaccuugcugu

SEQ ID NO: 3587428 - RNA, 18 nt, Human
uggaacgcguugaaauug

SEQ ID NO: 3587429 - RNA, 23 nt, Human
uggaacucagcugucuguggcuu

SEQ ID NO: 3587430 - RNA, 19 nt, Human
uggaacucauuccugccug

SEQ ID NO: 3587431 - RNA, 18 nt, Human
uggaacucgugucuggca

SEQ ID NO: 3587432 - RNA, 20 nt, Human
uggaacucuaucugggccug

SEQ ID NO: 3587433 - RNA, 13 nt, Human
uggaacucugcuu

SEQ ID NO: 3587434 - RNA, 13 nt, Human
uggaacugaaggg

SEQ ID NO: 3587435 - RNA, 13 nt, Human
uggaacugcugcc

SEQ ID NO: 3587436 - RNA, 19 nt, Human
uggaacugcugccacugag

SEQ ID NO: 3587437 - RNA, 13 nt, Human
uggaacuggaggc

SEQ ID NO: 3587438 - RNA, 16 nt, Human
uggaacuuacauuguu

SEQ ID NO: 3587439 - RNA, 16 nt, Human
uggaacuuagccauuu

SEQ ID NO: 3587440 - RNA, 21 nt, Human
uggaacuuagccauuuuucaa

SEQ ID NO: 3587441 - RNA, 14 nt, Human
uggaacuucuaaua

SEQ ID NO: 3587442 - RNA, 18 nt, Human
uggaacuugccugccuuu

SEQ ID NO: 3587443 - RNA, 16 nt, Human
uggaacuuuuauuaga

SEQ ID NO: 3587444 - RNA, 21 nt, Human
uggaagaaaaaaaccacacaa

SEQ ID NO: 3587445 - RNA, 18 nt, Human
uggaagaaaaaaaucuuc

SEQ ID NO: 3587446 - RNA, 13 nt, Human
uggaagaaaguaa

SEQ ID NO: 3587447 - RNA, 18 nt, Human
uggaagaacaggccucuc

SEQ ID NO: 3587448 - RNA, 12 nt, Human
uggaagaaggga

SEQ ID NO: 3587449 - RNA, 15 nt, Human
uggaagacacauuga

SEQ ID NO: 3587450 - RNA, 12 nt, Human
uggaagacagcu

SEQ ID NO: 3587451 - RNA, 15 nt, Human
uggaagacagcucuu

SEQ ID NO: 3587452 - RNA, 14 nt, Human
uggaagagaaaucu

SEQ ID NO: 3587453 - RNA, 14 nt, Human
uggaagagaaucac

SEQ ID NO: 3587454 - RNA, 15 nt, Human
uggaagaggaaaagg

SEQ ID NO: 3587455 - RNA, 15 nt, Human
uggaagagggcugca

SEQ ID NO: 3587456 - RNA, 16 nt, Human
uggaagaggggacagg

SEQ ID NO: 3587457 - RNA, 21 nt, Human
uggaagaggggacaggucccu

SEQ ID NO: 3587458 - RNA, 18 nt, Human
uggaagauagcugugacu

SEQ ID NO: 3587459 - RNA, 13 nt, Human
uggaagauccugc

SEQ ID NO: 3587460 - RNA, 18 nt, Human
uggaagauuauugagagc

SEQ ID NO: 3587461 - RNA, 21 nt, Human
uggaagcacaccaaucuuacu

SEQ ID NO: 3587462 - RNA, 11 nt, Human
uggaagcacag

SEQ ID NO: 3587463 - RNA, 19 nt, Human
uggaagcagguuaaauguu

SEQ ID NO: 3587464 - RNA, 21 nt, Human
uggaagcagguuaaauguuuu

SEQ ID NO: 3587465 - RNA, 16 nt, Human
uggaagcagugcccag

SEQ ID NO: 3587466 - RNA, 20 nt, Human
uggaagcagugcccaggugg

SEQ ID NO: 3587467 - RNA, 19 nt, Human
uggaagcauauuguuauua

SEQ ID NO: 3587468 - RNA, 19 nt, Human
uggaagcauguaggagaau

SEQ ID NO: 3587469 - RNA, 15 nt, Human
uggaagccagcuuuc

SEQ ID NO: 3587470 - RNA, 16 nt, Human
uggaagccagcuuucc

SEQ ID NO: 3587471 - RNA, 12 nt, Human
uggaagcccucc

SEQ ID NO: 3587472 - RNA, 16 nt, Human
uggaagcccuccuucc

SEQ ID NO: 3587473 - RNA, 19 nt, Human
uggaagcccuccuuccacg

SEQ ID NO: 3587474 - RNA, 16 nt, Human
uggaagcuaauuugca

SEQ ID NO: 3587475 - RNA, 20 nt, Human
uggaagcuagacacaugaag

SEQ ID NO: 3587476 - RNA, 22 nt, Human
uggaagcuagcuccccuccucu

SEQ ID NO: 3587477 - RNA, 13 nt, Human
uggaagcuccgcu

SEQ ID NO: 3587478 - RNA, 18 nt, Human
uggaagcuguuuggaaaa

SEQ ID NO: 3587479 - RNA, 14 nt, Human
uggaagcuuccagu

SEQ ID NO: 3587480 - RNA, 20 nt, Human
uggaagcuucuggugaccuu

SEQ ID NO: 3587481 - RNA, 16 nt, Human
uggaagcuuggggaag

SEQ ID NO: 3587482 - RNA, 18 nt, Human
uggaagcuuguuuuccag

SEQ ID NO: 3587483 - RNA, 14 nt, Human
uggaaggaaagaug

SEQ ID NO: 3587484 - RNA, 15 nt, Human
uggaaggaaagaugc

SEQ ID NO: 3587485 - RNA, 15 nt, Human
uggaaggagacacag

SEQ ID NO: 3587486 - RNA, 19 nt, Human
uggaaggagacacagaugu

SEQ ID NO: 3587487 - RNA, 14 nt, Human
uggaaggagcagaa

SEQ ID NO: 3587488 - RNA, 11 nt, Human
uggagaggaac

SEQ ID NO: 3587489 - RNA, 15 nt, Human
uggagaggagcccug

SEQ ID NO: 3587490 - RNA, 16 nt, Human
uggagaggagcccugc

SEQ ID NO: 3587491 - RNA, 17 nt, Human
uggagaggagcccugcc

SEQ ID NO: 3587492 - RNA, 18 nt, Human
uggagaggagcccugccu

SEQ ID NO: 3587493 - RNA, 20 nt, Human
uggagaggcccggccucuca

SEQ ID NO: 3587494 - RNA, 18 nt, Human
uggagaggcccucuggag

SEQ ID NO: 3587495 - RNA, 15 nt, Human
uggagagggaaugug

SEQ ID NO: 3587496 - RNA, 18 nt, Human
uggagagggaaugugaaa

SEQ ID NO: 3587497 - RNA, 13 nt, Human
uggagagggauga

SEQ ID NO: 3587498 - RNA, 19 nt, Human
uggagagggcucugugcug

SEQ ID NO: 3587499 - RNA, 16 nt, Human
uggagagggggccugg

SEQ ID NO: 3587500 - RNA, 22 nt, Human
uggagagguuauaggucacucc

SEQ ID NO: 3587501 - RNA, 21 nt, Human
uggagaguucaauggcugcug

SEQ ID NO: 3587502 - RNA, 15 nt, Human
uggagaguuuccuga

SEQ ID NO: 3587503 - RNA, 17 nt, Human
uggagaguuuccugaaa

SEQ ID NO: 3587504 - RNA, 20 nt, Human
uggagauaaagauuucuuga

SEQ ID NO: 3587505 - RNA, 19 nt, Human
uggagaugaggccagacca

SEQ ID NO: 3587506 - RNA, 22 nt, Human
uggagaugaggccagaccaugg

SEQ ID NO: 3587507 - RNA, 13 nt, Human
uggagaugcagag

SEQ ID NO: 3587508 - RNA, 13 nt, Human
uggagauggggag

SEQ ID NO: 3587509 - RNA, 13 nt, Human
uggagaugucuuc

SEQ ID NO: 3587510 - RNA, 23 nt, Human
uggagaugucuucguacaguucu

SEQ ID NO: 3587511 - RNA, 16 nt, Human
uggagauuauaauaaa

SEQ ID NO: 3587512 - RNA, 16 nt, Human
uggagauugaccugga

SEQ ID NO: 3587513 - RNA, 21 nt, Human
uggagcaaagugagggccgag

SEQ ID NO: 3587514 - RNA, 22 nt, Human
uggagcacucugaguuuaccau

SEQ ID NO: 3587515 - RNA, 15 nt, Human
uggagcacugggcuc

SEQ ID NO: 3587516 - RNA, 19 nt, Human
uggagcacugggcucccgg

SEQ ID NO: 3587517 - RNA, 14 nt, Human
uggagcagaaucag

SEQ ID NO: 3587518 - RNA, 15 nt, Human
uggagcagaaucagu

SEQ ID NO: 3587519 - RNA, 13 nt, Human
uggagcagaccac

SEQ ID NO: 3587520 - RNA, 13 nt, Human
uggagcagccacc

SEQ ID NO: 3587521 - RNA, 16 nt, Human
uggagcagccacccca

SEQ ID NO: 3587522 - RNA, 17 nt, Human
uggagcaucaagccacu

SEQ ID NO: 3587523 - RNA, 15 nt, Human
uggagcaucugacuc

SEQ ID NO: 3587524 - RNA, 16 nt, Human
uggagcaucugacuca

SEQ ID NO: 3587525 - RNA, 21 nt, Human
uggagccagccgagcaggagg

SEQ ID NO: 3587526 - RNA, 22 nt, Human
uggagccagccgagcaggaggc

SEQ ID NO: 3587527 - RNA, 13 nt, Human
uggagccagcucc

SEQ ID NO: 3587528 - RNA, 13 nt, Human
uggagccaggcgu

SEQ ID NO: 3587529 - RNA, 15 nt, Human
uggagcccagaggag

SEQ ID NO: 3587530 - RNA, 20 nt, Human
uggagcccagaggagggcag

SEQ ID NO: 3587531 - RNA, 14 nt, Human
uggagcccaggagu

SEQ ID NO: 3587532 - RNA, 16 nt, Human
uggagccccacugccc

SEQ ID NO: 3587533 - RNA, 22 nt, Human
uggagccccacugcccuucuca

SEQ ID NO: 3587534 - RNA, 14 nt, Human
uggagccccagccc

SEQ ID NO: 3587535 - RNA, 14 nt, Human
uggagccccaucag

SEQ ID NO: 3587536 - RNA, 12 nt, Human
uggagccccugg

SEQ ID NO: 3587537 - RNA, 14 nt, Human
uggagccccugggu

SEQ ID NO: 3587538 - RNA, 23 nt, Human
uggagccccuggguggguggugg

SEQ ID NO: 3587539 - RNA, 18 nt, Human
uggagcccgaggcaccag

SEQ ID NO: 3587540 - RNA, 19 nt, Human
uggagcccgcacccccacc

SEQ ID NO: 3587541 - RNA, 22 nt, Human
uggagcccgcacccccacccuu

SEQ ID NO: 3587542 - RNA, 12 nt, Human
uggagccgaggc

SEQ ID NO: 3587543 - RNA, 23 nt, Human
uggagccggacuuucggaguugg

SEQ ID NO: 3587544 - RNA, 13 nt, Human
uggagccugacag

SEQ ID NO: 3587545 - RNA, 21 nt, Human
uggagccugagucagggccca

SEQ ID NO: 3587546 - RNA, 11 nt, Human
uggagccugca

SEQ ID NO: 3587547 - RNA, 13 nt, Human
uggagccuggugc

SEQ ID NO: 3587548 - RNA, 18 nt, Human
uggagccuguguaacagc

SEQ ID NO: 3587549 - RNA, 21 nt, Human
uggagccuguguaacagcucc

SEQ ID NO: 3587550 - RNA, 21 nt, Human
uggagcgcaccugcccccugg

SEQ ID NO: 3587551 - RNA, 18 nt, Human
uggagcggggcccacccg

SEQ ID NO: 3587552 - RNA, 18 nt, Human
uggagcgggguaugaaga

SEQ ID NO: 3587553 - RNA, 15 nt, Human
uggagcuauuuuaaa

SEQ ID NO: 3587554 - RNA, 16 nt, Human
uggagcuccagccuga

SEQ ID NO: 3587555 - RNA, 18 nt, Human
uggagcuccugggaaggc

SEQ ID NO: 3587556 - RNA, 12 nt, Human
uggagcugagca

SEQ ID NO: 3587557 - RNA, 15 nt, Human
uggagcugagccucu

SEQ ID NO: 3587558 - RNA, 18 nt, Human
uggagcuggcgucugucu

SEQ ID NO: 3587559 - RNA, 16 nt, Human
uggagcuuaagccacu

SEQ ID NO: 3587560 - RNA, 21 nt, Human
uggagcuuuuuucuuuaagau

SEQ ID NO: 3587561 - RNA, 21 nt, Human
uggaggaaaaccaagccgugg

SEQ ID NO: 3587562 - RNA, 21 nt, Human
uggaggaacaaucggcugcau

SEQ ID NO: 3587563 - RNA, 20 nt, Human
uggaggaaggaaacccagcu

SEQ ID NO: 3587564 - RNA, 21 nt, Human
uggaggaaggaaacccagcuc

SEQ ID NO: 3587565 - RNA, 13 nt, Human
uggaggaaggauu

SEQ ID NO: 3587566 - RNA, 18 nt, Human
uggaggaaggauuguaaa

SEQ ID NO: 3587567 - RNA, 21 nt, Human
uggaggaagggggguugcagu

SEQ ID NO: 3587568 - RNA, 15 nt, Human
uggaggaaugcuccc

SEQ ID NO: 3587569 - RNA, 17 nt, Human
uggaggaaugcuccccc

SEQ ID NO: 3587570 - RNA, 13 nt, Human
uggaggaccugag

SEQ ID NO: 3587571 - RNA, 19 nt, Human
uggaggaccugagccugcc

SEQ ID NO: 3587572 - RNA, 15 nt, Human
uggaggaccugcccg

SEQ ID NO: 3587573 - RNA, 14 nt, Human
uggaggagaagaau

SEQ ID NO: 3587574 - RNA, 21 nt, Human
uggaggagaagaauuuucaga

SEQ ID NO: 3587575 - RNA, 14 nt, Human
uggaggagaaggac

SEQ ID NO: 3587576 - RNA, 15 nt, Human
uggaggagagaagaa

SEQ ID NO: 3587577 - RNA, 11 nt, Human
uggaggagcaa

SEQ ID NO: 3587578 - RNA, 21 nt, Human
uggaggagcaaaggcugagaa

SEQ ID NO: 3587579 - RNA, 12 nt, Human
uggaggagccca

SEQ ID NO: 3587580 - RNA, 14 nt, Human
uggaggagcccagg

SEQ ID NO: 3587581 - RNA, 22 nt, Human
uggaggagcuugggggaugacu

SEQ ID NO: 3587582 - RNA, 17 nt, Human
uggaggaggaaggcaag

SEQ ID NO: 3587583 - RNA, 18 nt, Human
uggaggaggccugggggc

SEQ ID NO: 3587584 - RNA, 17 nt, Human
uggaggaucaguuuuuu

SEQ ID NO: 3587585 - RNA, 20 nt, Human
uggaggauggagagagggga

SEQ ID NO: 3587586 - RNA, 16 nt, Human
uggaggaugugggcag

SEQ ID NO: 3587587 - RNA, 13 nt, Human
uggaggauugcua

SEQ ID NO: 3587588 - RNA, 14 nt, Human
uggaggcaauccua

SEQ ID NO: 3587589 - RNA, 14 nt, Human
uggaggcagggccu

SEQ ID NO: 3587590 - RNA, 15 nt, Human
uggaggcagugucau

SEQ ID NO: 3587591 - RNA, 16 nt, Human
uggaggcagugucauu

SEQ ID NO: 3587592 - RNA, 12 nt, Human
uggaggcccagu

SEQ ID NO: 3587593 - RNA, 15 nt, Human
uggaggccucugggc

SEQ ID NO: 3587594 - RNA, 16 nt, Human
uggaggccucugggcc

SEQ ID NO: 3587595 - RNA, 18 nt, Human
uggaggccuuccagcugc

SEQ ID NO: 3587596 - RNA, 16 nt, Human
uggaggcugccuccca

SEQ ID NO: 3587597 - RNA, 13 nt, Human
uggaggcugucuu

SEQ ID NO: 3587598 - RNA, 22 nt, Human
uggaggcugucuucucaggcuc

SEQ ID NO: 3587599 - RNA, 23 nt, Human
uggaggcugucuucucaggcucu

SEQ ID NO: 3587600 - RNA, 17 nt, Human
uggaggcuuccugcguc

SEQ ID NO: 3587601 - RNA, 21 nt, Human
uggagggaaugaaccuggagg

SEQ ID NO: 3587602 - RNA, 22 nt, Human
uggagggacaaguggacucagg

SEQ ID NO: 3587603 - RNA, 18 nt, Human
uggagggaggccccaggg

SEQ ID NO: 3587604 - RNA, 19 nt, Human
uggagggaggccccagggg

SEQ ID NO: 3587605 - RNA, 21 nt, Human
uggagggcgugggagcguggg

SEQ ID NO: 3587606 - RNA, 21 nt, Human
uggagggcuagaaccuggaga

SEQ ID NO: 3587607 - RNA, 15 nt, Human
uggaggggagcucug

SEQ ID NO: 3587608 - RNA, 16 nt, Human
uggaggggcagagcca

SEQ ID NO: 3587609 - RNA, 14 nt, Human
uggaggggccccug

SEQ ID NO: 3587610 - RNA, 20 nt, Human
uggagggguaggggcuggga

SEQ ID NO: 3587611 - RNA, 19 nt, Human
uggaggggugguccugacu

SEQ ID NO: 3587612 - RNA, 20 nt, Human
uggaggggugguccugacuc

SEQ ID NO: 3587613 - RNA, 11 nt, Human
uggaggggugu

SEQ ID NO: 3587614 - RNA, 19 nt, Human
uggagggucccaagcuggg

SEQ ID NO: 3587615 - RNA, 21 nt, Human
uggagggucccaagcugggcc

SEQ ID NO: 3587616 - RNA, 14 nt, Human
uggagguacacucu

SEQ ID NO: 3587617 - RNA, 22 nt, Human
uggaggucacauucaggaagau

SEQ ID NO: 3587618 - RNA, 19 nt, Human
uggaggugccagcaaagcc

SEQ ID NO: 3587619 - RNA, 12 nt, Human
uggaggugggag

SEQ ID NO: 3587620 - RNA, 13 nt, Human
uggaggugggagc

SEQ ID NO: 3587621 - RNA, 16 nt, Human
uggagguggggcaugg

SEQ ID NO: 3587622 - RNA, 14 nt, Human
uggagguggggccu

SEQ ID NO: 3587623 - RNA, 21 nt, Human
uggagguggggcgaggcaggc

SEQ ID NO: 3587624 - RNA, 16 nt, Human
uggaggugucaggcug

SEQ ID NO: 3587625 - RNA, 20 nt, Human
uggaggugucaggcugcugg

SEQ ID NO: 3587626 - RNA, 17 nt, Human
uggagguugauaacuuu

SEQ ID NO: 3587627 - RNA, 18 nt, Human
uggaguaugucugaugga

SEQ ID NO: 3587628 - RNA, 21 nt, Human
uggaguaugucugauggaucc

SEQ ID NO: 3587629 - RNA, 19 nt, Human
uggagucagacagaugugg

SEQ ID NO: 3587630 - RNA, 14 nt, Human
uggagucagccucg

SEQ ID NO: 3587631 - RNA, 15 nt, Human
uggagucaugccaag

SEQ ID NO: 3587632 - RNA, 14 nt, Human
uggagucauucuca

SEQ ID NO: 3587633 - RNA, 22 nt, Human
uggaguccaggacaggagaugc

SEQ ID NO: 3587634 - RNA, 19 nt, Human
uggaguccccucaccuccu

SEQ ID NO: 3587635 - RNA, 17 nt, Human
uggagucuccagugguu

SEQ ID NO: 3587636 - RNA, 14 nt, Human
uggagucuccugag

SEQ ID NO: 3587637 - RNA, 17 nt, Human
uggagucuggagugggc

SEQ ID NO: 3587638 - RNA, 16 nt, Human
uggagugcaccaaaga

SEQ ID NO: 3587639 - RNA, 17 nt, Human
uggagugcagggaggag

SEQ ID NO: 3587640 - RNA, 19 nt, Human
uggagugcagggaggagag

SEQ ID NO: 3587641 - RNA, 13 nt, Human
uggagugcagugg

SEQ ID NO: 3587642 - RNA, 17 nt, Human
uggaguggcagcccagc

SEQ ID NO: 3587643 - RNA, 18 nt, Human
uggaguggcagcccagcc

SEQ ID NO: 3587644 - RNA, 19 nt, Human
uggaguggcucgccaggcc

SEQ ID NO: 3587645 - RNA, 17 nt, Human
uggaguguaugacugca

SEQ ID NO: 3587646 - RNA, 19 nt, Human
uggaguguaugacugcaca

SEQ ID NO: 3587647 - RNA, 17 nt, Human
uggaguguggcugagga

SEQ ID NO: 3587648 - RNA, 15 nt, Human
uggaguuaaaaugca

SEQ ID NO: 3587649 - RNA, 18 nt, Human
uggaguuacauuaauguu

SEQ ID NO: 3587650 - RNA, 20 nt, Human
uggaguucaucuugaauugu

SEQ ID NO: 3587651 - RNA, 17 nt, Human
uggaguucauucauauu

SEQ ID NO: 3587652 - RNA, 20 nt, Human
uggaguucauucauauuaca

SEQ ID NO: 3587653 - RNA, 14 nt, Human
uggaguuucuaagg

SEQ ID NO: 3587654 - RNA, 21 nt, Human
uggaguuuuuguuuggagagc

SEQ ID NO: 3587655 - RNA, 22 nt, Human
uggaguuuuuguuuggagagca

SEQ ID NO: 3587656 - RNA, 15 nt, Human
uggauaaauuguuua

SEQ ID NO: 3587657 - RNA, 17 nt, Human
uggauaaauuguuuagu

SEQ ID NO: 3587658 - RNA, 18 nt, Human
uggauaacaaagauaucu

SEQ ID NO: 3587659 - RNA, 20 nt, Human
uggauaacaaagauaucuuu

SEQ ID NO: 3587660 - RNA, 23 nt, Human
uggauaagcuauccguguugcag

SEQ ID NO: 3587661 - RNA, 15 nt, Human
uggauacagcaguag

SEQ ID NO: 3587662 - RNA, 15 nt, Human
uggauaccauuauau

SEQ ID NO: 3587663 - RNA, 19 nt, Human
uggauacgacaacuugcac

SEQ ID NO: 3587664 - RNA, 17 nt, Human
uggauacgugucaaugu

SEQ ID NO: 3587665 - RNA, 21 nt, Human
uggauacgugucaaugugugc

SEQ ID NO: 3587666 - RNA, 14 nt, Human
uggauacuacaucu

SEQ ID NO: 3587667 - RNA, 15 nt, Human
uggauacuacaucuu

SEQ ID NO: 3587668 - RNA, 22 nt, Human
uggauacugcccggggcagcug

SEQ ID NO: 3587669 - RNA, 22 nt, Human
uggauacuuggauuuaguuuca

SEQ ID NO: 3587670 - RNA, 13 nt, Human
uggauagaugccc

SEQ ID NO: 3587671 - RNA, 15 nt, Human
uggauauaaaaugug

SEQ ID NO: 3587672 - RNA, 17 nt, Human
uggauauaaauauauau

SEQ ID NO: 3587673 - RNA, 18 nt, Human
uggauauauguuuuugaa

SEQ ID NO: 3587674 - RNA, 16 nt, Human
uggauauguaaaacau

SEQ ID NO: 3587675 - RNA, 16 nt, Human
uggauauuauuagaaa

SEQ ID NO: 3587676 - RNA, 14 nt, Human
uggauauuguuacg

SEQ ID NO: 3587677 - RNA, 11 nt, Human
uggauauuugu

SEQ ID NO: 3587678 - RNA, 21 nt, Human
uggauauuuguacuguuuaau

SEQ ID NO: 3587679 - RNA, 13 nt, Human
uggauauuuucaa

SEQ ID NO: 3587680 - RNA, 23 nt, Human
uggaucaaaaucuguagagcagg

SEQ ID NO: 3587681 - RNA, 14 nt, Human
uggaucaaguauua

SEQ ID NO: 3587682 - RNA, 20 nt, Human
uggaucacagcugcuuucug

SEQ ID NO: 3587683 - RNA, 14 nt, Human
uggauccaauguua

SEQ ID NO: 3587684 - RNA, 18 nt, Human
uggaucccgaagaaugga

SEQ ID NO: 3587685 - RNA, 16 nt, Human
uggauccuguguggag

SEQ ID NO: 3587686 - RNA, 17 nt, Human
uggauccuguguggaga

SEQ ID NO: 3587687 - RNA, 15 nt, Human
uggaucuaccuggag

SEQ ID NO: 3587688 - RNA, 17 nt, Human
uggaucuaccuggaggg

SEQ ID NO: 3587689 - RNA, 18 nt, Human
uggaucuauuucauguuu

SEQ ID NO: 3587690 - RNA, 18 nt, Human
uggaucucauuggacccu

SEQ ID NO: 3587691 - RNA, 21 nt, Human
uggaucuccaaggaccagguu

SEQ ID NO: 3587692 - RNA, 19 nt, Human
uggaucuccccacucuagg

SEQ ID NO: 3587693 - RNA, 19 nt, Human
uggaucucuucuuaaugua

SEQ ID NO: 3587694 - RNA, 20 nt, Human
uggaucucuucuuaauguac

SEQ ID NO: 3587695 - RNA, 21 nt, Human
uggaucucuucuuaauguaca

SEQ ID NO: 3587696 - RNA, 16 nt, Human
uggaucuguccaagga

SEQ ID NO: 3587697 - RNA, 14 nt, Human
uggaugaaauuuuc

SEQ ID NO: 3587698 - RNA, 18 nt, Human
uggaugaaauuuucuaga

SEQ ID NO: 3587699 - RNA, 20 nt, Human
uggaugaccagaacaagguu

SEQ ID NO: 3587700 - RNA, 20 nt, Human
uggaugagacuuccaaaccu

SEQ ID NO: 3587701 - RNA, 13 nt, Human
uggaugagcuccc

SEQ ID NO: 3587702 - RNA, 15 nt, Human
uggaugaucaauccu

SEQ ID NO: 3587703 - RNA, 20 nt, Human
uggaugauggucuucagccu

SEQ ID NO: 3587704 - RNA, 14 nt, Human
uggaugauguuucg

SEQ ID NO: 3587705 - RNA, 17 nt, Human
uggaugauguuucguga

SEQ ID NO: 3587706 - RNA, 20 nt, Human
uggaugccaauauuaaaucu

SEQ ID NO: 3587707 - RNA, 20 nt, Human
uggaugccacagcccagcuu

SEQ ID NO: 3587708 - RNA, 15 nt, Human
uggaugcccagagga

SEQ ID NO: 3587709 - RNA, 13 nt, Human
uggaugccugauu

SEQ ID NO: 3587710 - RNA, 15 nt, Human
uggaugccugguggc

SEQ ID NO: 3587711 - RNA, 20 nt, Human
uggaugccugguggcagcug

SEQ ID NO: 3587712 - RNA, 17 nt, Human
uggaugcgcagugccuu

SEQ ID NO: 3587713 - RNA, 21 nt, Human
uggaugcuuagagggauuucu

SEQ ID NO: 3587714 - RNA, 16 nt, Human
uggauggccccagcac

SEQ ID NO: 3587715 - RNA, 21 nt, Human
uggauggccccagcacagcuu

SEQ ID NO: 3587716 - RNA, 13 nt, Human
uggauggcuucua

SEQ ID NO: 3587717 - RNA, 16 nt, Human
uggaugggcagucauu

SEQ ID NO: 3587718 - RNA, 18 nt, Human
uggaugggggaacucaga

SEQ ID NO: 3587719 - RNA, 17 nt, Human
uggauggguggauggcc

SEQ ID NO: 3587720 - RNA, 15 nt, Human
uggaugucugaacuu

SEQ ID NO: 3587721 - RNA, 16 nt, Human
uggaugucugaacuuu

SEQ ID NO: 3587722 - RNA, 15 nt, Human
uggauguugugugua

SEQ ID NO: 3587723 - RNA, 13 nt, Human
uggauguuuuaau

SEQ ID NO: 3587724 - RNA, 18 nt, Human
uggauguuuuaauuccau

SEQ ID NO: 3587725 - RNA, 20 nt, Human
uggauguuuuaauuccauga

SEQ ID NO: 3587726 - RNA, 22 nt, Human
uggauuaaacuuaaucuaaaug

SEQ ID NO: 3587727 - RNA, 14 nt, Human
uggauuaaacuuau

SEQ ID NO: 3587728 - RNA, 13 nt, Human
uggauuaaauuua

SEQ ID NO: 3587729 - RNA, 15 nt, Human
uggauuaaauuuaau

SEQ ID NO: 3587730 - RNA, 17 nt, Human
uggauuaauuaaaugca

SEQ ID NO: 3587731 - RNA, 13 nt, Human
uggauuaggucuc

SEQ ID NO: 3587732 - RNA, 16 nt, Human
uggauuauaaucagaa

SEQ ID NO: 3587733 - RNA, 16 nt, Human
uggauuauucaggcuu

SEQ ID NO: 3587734 - RNA, 14 nt, Human
uggauuauucauuu

SEQ ID NO: 3587735 - RNA, 22 nt, Human
uggauuauucuuucuccuuuuu

SEQ ID NO: 3587736 - RNA, 17 nt, Human
uggauuauuuaauaaca

SEQ ID NO: 3587737 - RNA, 14 nt, Human
uggauucauauuua

SEQ ID NO: 3587738 - RNA, 14 nt, Human
uggauucauugucu

SEQ ID NO: 3587739 - RNA, 13 nt, Human
uggauucauuucc

SEQ ID NO: 3587740 - RNA, 18 nt, Human
uggauuccccaucucagg

SEQ ID NO: 3587741 - RNA, 19 nt, Human
uggauuccccaucucaggc

SEQ ID NO: 3587742 - RNA, 12 nt, Human
uggauucucaga

SEQ ID NO: 3587743 - RNA, 14 nt, Human
uggauucucagaua

SEQ ID NO: 3587744 - RNA, 16 nt, Human
uggauucugagagcug

SEQ ID NO: 3587745 - RNA, 14 nt, Human
uggauucuuuccau

SEQ ID NO: 3587746 - RNA, 13 nt, Human
uggauugagggua

SEQ ID NO: 3587747 - RNA, 13 nt, Human
uggauuggacaaa

SEQ ID NO: 3587748 - RNA, 19 nt, Human
uggauuggacaaaaugacu

SEQ ID NO: 3587749 - RNA, 20 nt, Human
uggauuggagauagggaaag

SEQ ID NO: 3587750 - RNA, 21 nt, Human
uggauuggauuauuuaauaac

SEQ ID NO: 3587751 - RNA, 23 nt, Human
uggauuggauuauuuaauaacau

SEQ ID NO: 3587752 - RNA, 21 nt, Human
uggauugggggggccaaaagg

SEQ ID NO: 3587753 - RNA, 14 nt, Human
uggauugggguccc

SEQ ID NO: 3587754 - RNA, 18 nt, Human
uggauuggguuaugaaua

SEQ ID NO: 3587755 - RNA, 13 nt, Human
uggauuguccccg

SEQ ID NO: 3587756 - RNA, 19 nt, Human
uggauugugccuaaugugu

SEQ ID NO: 3587757 - RNA, 23 nt, Human
uggauugugccuaauguguuuga

SEQ ID NO: 3587758 - RNA, 14 nt, Human
uggauuuauaaaug

SEQ ID NO: 3587759 - RNA, 20 nt, Human
uggauuuauaaaugcuauuu

SEQ ID NO: 3587760 - RNA, 23 nt, Human
uggauuucccauccccuguggga

SEQ ID NO: 3587761 - RNA, 17 nt, Human
uggauuugccugugcca

SEQ ID NO: 3587762 - RNA, 18 nt, Human
uggauuugccugugccac

SEQ ID NO: 3587763 - RNA, 15 nt, Human
uggauuuguuuaaaa

SEQ ID NO: 3587764 - RNA, 16 nt, Human
uggauuuuauguugac

SEQ ID NO: 3587765 - RNA, 22 nt, Human
uggauuuugguuuuguuccccu

SEQ ID NO: 3587766 - RNA, 15 nt, Human
uggauuuuuaauuaa

SEQ ID NO: 3587767 - RNA, 12 nt, Human
uggcaaaaaggc

SEQ ID NO: 3587768 - RNA, 17 nt, Human
uggcaaaagccuugugu

SEQ ID NO: 3587769 - RNA, 15 nt, Human
uggcaaacagggccu

SEQ ID NO: 3587770 - RNA, 18 nt, Human
uggcaaacagggccucug

SEQ ID NO: 3587771 - RNA, 20 nt, Human
uggcaaacagggccucugcg

SEQ ID NO: 3587772 - RNA, 17 nt, Human
uggcaaacucuccacca

SEQ ID NO: 3587773 - RNA, 17 nt, Human
uggcaaacuucagacug

SEQ ID NO: 3587774 - RNA, 13 nt, Human
uggcaaagacaga

SEQ ID NO: 3587775 - RNA, 17 nt, Human
uggcaaagacagaagcc

SEQ ID NO: 3587776 - RNA, 23 nt, Human
uggcaaagcagcaacacacaugc

SEQ ID NO: 3587777 - RNA, 23 nt, Human
uggcaaagcagcaacuauucaca

SEQ ID NO: 3587778 - RNA, 21 nt, Human
uggcaaagccuucauugccuu

SEQ ID NO: 3587779 - RNA, 17 nt, Human
uggcaaagcuguucuuc

SEQ ID NO: 3587780 - RNA, 19 nt, Human
uggcaaagcuguucuuccu

SEQ ID NO: 3587781 - RNA, 20 nt, Human
uggcaaagcuguucuuccug

SEQ ID NO: 3587782 - RNA, 17 nt, Human
uggcaaagcuuuuagaa

SEQ ID NO: 3587783 - RNA, 18 nt, Human
uggcaaagcuuuuagaaa

SEQ ID NO: 3587784 - RNA, 12 nt, Human
uggcaaauauaa

SEQ ID NO: 3587785 - RNA, 13 nt, Human
uggcaacaaacug

SEQ ID NO: 3587786 - RNA, 14 nt, Human
uggcaacaaacugc

SEQ ID NO: 3587787 - RNA, 17 nt, Human
uggcaacaaacugcaca

SEQ ID NO: 3587788 - RNA, 12 nt, Human
uggcaacagaag

SEQ ID NO: 3587789 - RNA, 20 nt, Human
uggcccccacuggcuguggg

SEQ ID NO: 3587790 - RNA, 11 nt, Human
uggcccccucc

SEQ ID NO: 3587791 - RNA, 14 nt, Human
uggcccccuguccu

SEQ ID NO: 3587792 - RNA, 23 nt, Human
uggcccccuuucccgggcugucc

SEQ ID NO: 3587793 - RNA, 15 nt, Human
uggccccgccgccug

SEQ ID NO: 3587794 - RNA, 21 nt, Human
uggccccgccgccugguacuc

SEQ ID NO: 3587795 - RNA, 15 nt, Human
uggccccguuucugg

SEQ ID NO: 3587796 - RNA, 19 nt, Human
uggccccuagaaucagccu

SEQ ID NO: 3587797 - RNA, 13 nt, Human
uggccccucgccu

SEQ ID NO: 3587798 - RNA, 12 nt, Human
uggccccucuga

SEQ ID NO: 3587799 - RNA, 14 nt, Human
uggccccugagauc

SEQ ID NO: 3587800 - RNA, 15 nt, Human
uggccccugcccggc

SEQ ID NO: 3587801 - RNA, 20 nt, Human
uggccccugcccggcugcgg

SEQ ID NO: 3587802 - RNA, 21 nt, Human
uggccccugcccggcugcgga

SEQ ID NO: 3587803 - RNA, 13 nt, Human
uggccccuucacu

SEQ ID NO: 3587804 - RNA, 21 nt, Human
uggccccuucacuucugacca

SEQ ID NO: 3587805 - RNA, 16 nt, Human
uggccccuuugggccc

SEQ ID NO: 3587806 - RNA, 20 nt, Human
uggccccuuugggcccugca

SEQ ID NO: 3587807 - RNA, 19 nt, Human
uggcccgacagccuggcac

SEQ ID NO: 3587808 - RNA, 18 nt, Human
uggcccgugacagacucc

SEQ ID NO: 3587809 - RNA, 20 nt, Human
uggcccgugacagacuccug

SEQ ID NO: 3587810 - RNA, 19 nt, Human
uggcccucaaggccuccca

SEQ ID NO: 3587811 - RNA, 20 nt, Human
uggcccucaaggccucccac

SEQ ID NO: 3587812 - RNA, 23 nt, Human
uggcccucaaggccucccacagu

SEQ ID NO: 3587813 - RNA, 16 nt, Human
uggcccucaccccugc

SEQ ID NO: 3587814 - RNA, 21 nt, Human
uggcccucccaguaccuccug

SEQ ID NO: 3587815 - RNA, 16 nt, Human
uggcccucuucuuacu

SEQ ID NO: 3587816 - RNA, 23 nt, Human
uggcccugaggugugggggcugc

SEQ ID NO: 3587817 - RNA, 15 nt, Human
uggcccugcaaaagg

SEQ ID NO: 3587818 - RNA, 21 nt, Human
uggcccugccaucuucccagc

SEQ ID NO: 3587819 - RNA, 21 nt, Human
uggcccugcccucuccuuccu

SEQ ID NO: 3587820 - RNA, 15 nt, Human
uggcccugcccugag

SEQ ID NO: 3587821 - RNA, 12 nt, Human
uggcccugccuu

SEQ ID NO: 3587822 - RNA, 14 nt, Human
uggcccuggcagcc

SEQ ID NO: 3587823 - RNA, 14 nt, Human
uggcccuggcucug

SEQ ID NO: 3587824 - RNA, 15 nt, Human
uggcccugucccucc

SEQ ID NO: 3587825 - RNA, 20 nt, Human
uggcccugucccucccaccu

SEQ ID NO: 3587826 - RNA, 21 nt, Human
uggcccugucccucccaccuc

SEQ ID NO: 3587827 - RNA, 23 nt, Human
uggcccugucccucccaccucug

SEQ ID NO: 3587828 - RNA, 13 nt, Human
uggcccugugcua

SEQ ID NO: 3587829 - RNA, 19 nt, Human
uggcccuucccacuggagg

SEQ ID NO: 3587830 - RNA, 21 nt, Human
uggcccuuccuccuccaccac

SEQ ID NO: 3587831 - RNA, 15 nt, Human
uggcccuuccuggac

SEQ ID NO: 3587832 - RNA, 18 nt, Human
uggcccuuccuggacagc

SEQ ID NO: 3587833 - RNA, 20 nt, Human
uggcccuuccuggacagcug

SEQ ID NO: 3587834 - RNA, 21 nt, Human
uggcccuuccuggacagcugu

SEQ ID NO: 3587835 - RNA, 22 nt, Human
uggcccuugcaguucagcacca

SEQ ID NO: 3587836 - RNA, 17 nt, Human
uggccgaguccaagcug

SEQ ID NO: 3587837 - RNA, 13 nt, Human
uggccgcccccug

SEQ ID NO: 3587838 - RNA, 23 nt, Human
uggccgcccccugccccccagcc

SEQ ID NO: 3587839 - RNA, 16 nt, Human
uggccgccucaccccc

SEQ ID NO: 3587840 - RNA, 17 nt, Human
uggccgcugaguggcag

SEQ ID NO: 3587841 - RNA, 13 nt, Human
uggccggccagcc

SEQ ID NO: 3587842 - RNA, 19 nt, Human
uggccggccagccagccac

SEQ ID NO: 3587843 - RNA, 19 nt, Human
uggccgggaccccgagccu

SEQ ID NO: 3587844 - RNA, 14 nt, Human
uggccgggcacagc

SEQ ID NO: 3587845 - RNA, 13 nt, Human
uggccgggcaggg

SEQ ID NO: 3587846 - RNA, 21 nt, Human
uggccgugaaugggugcccac

SEQ ID NO: 3587847 - RNA, 17 nt, Human
uggccguggaugcgcag

SEQ ID NO: 3587848 - RNA, 14 nt, Human
uggccguggauggc

SEQ ID NO: 3587849 - RNA, 18 nt, Human
uggccuaaaacuggccug

SEQ ID NO: 3587850 - RNA, 22 nt, Human
uggccuagcccacccugcugcc

SEQ ID NO: 3587851 - RNA, 15 nt, Human
uggccuauccgcugc

SEQ ID NO: 3587852 - RNA, 13 nt, Human
uggccuaucuccu

SEQ ID NO: 3587853 - RNA, 19 nt, Human
uggccuauguggucuaagg

SEQ ID NO: 3587854 - RNA, 15 nt, Human
uggccucaacccucc

SEQ ID NO: 3587855 - RNA, 17 nt, Human
uggccucaacccucccu

SEQ ID NO: 3587856 - RNA, 19 nt, Human
uggccucaacccucccuca

SEQ ID NO: 3587857 - RNA, 21 nt, Human
uggccucaagaucaaugaaau

SEQ ID NO: 3587858 - RNA, 18 nt, Human
uggccucaagugauucuc

SEQ ID NO: 3587859 - RNA, 22 nt, Human
uggccucacccaccccugcaca

SEQ ID NO: 3587860 - RNA, 22 nt, Human
uggccucagacugcacccagga

SEQ ID NO: 3587861 - RNA, 23 nt, Human
uggccucagacugcacccaggag

SEQ ID NO: 3587862 - RNA, 22 nt, Human
uggccucagaggacccuuucca

SEQ ID NO: 3587863 - RNA, 22 nt, Human
uggccucagcugaaugccuccu

SEQ ID NO: 3587864 - RNA, 16 nt, Human
uggccucagcugccuc

SEQ ID NO: 3587865 - RNA, 17 nt, Human
uggccucagcugccuca

SEQ ID NO: 3587866 - RNA, 17 nt, Human
uggccucauguggcugg

SEQ ID NO: 3587867 - RNA, 21 nt, Human
uggccucauguggcuggaaga

SEQ ID NO: 3587868 - RNA, 22 nt, Human
uggccucauuacuuuaccaccc

SEQ ID NO: 3587869 - RNA, 14 nt, Human
uggccuccaggccc

SEQ ID NO: 3587870 - RNA, 11 nt, Human
uggccucccaa

SEQ ID NO: 3587871 - RNA, 20 nt, Human
uggccucccaaaugagccau

SEQ ID NO: 3587872 - RNA, 20 nt, Human
uggccucccaacucacccca

SEQ ID NO: 3587873 - RNA, 11 nt, Human
uggccucccac

SEQ ID NO: 3587874 - RNA, 15 nt, Human
uggccucccacccga

SEQ ID NO: 3587875 - RNA, 21 nt, Human
uggccuccccugccaccaggc

SEQ ID NO: 3587876 - RNA, 16 nt, Human
uggccucccugcucua

SEQ ID NO: 3587877 - RNA, 12 nt, Human
uggccuccggcc

SEQ ID NO: 3587878 - RNA, 15 nt, Human
uggccuccggccucc

SEQ ID NO: 3587879 - RNA, 18 nt, Human
uggccuccggccuccccu

SEQ ID NO: 3587880 - RNA, 13 nt, Human
uggccuccugccu

SEQ ID NO: 3587881 - RNA, 14 nt, Human
uggccuccugccuc

SEQ ID NO: 3587882 - RNA, 14 nt, Human
uggccucgccuggc

SEQ ID NO: 3587883 - RNA, 20 nt, Human
uggccucucacugccucccc

SEQ ID NO: 3587884 - RNA, 23 nt, Human
uggccucucuauccucucuuccu

SEQ ID NO: 3587885 - RNA, 15 nt, Human
uggccucucucuagg

SEQ ID NO: 3587886 - RNA, 17 nt, Human
uggccucugcacucccc

SEQ ID NO: 3587887 - RNA, 18 nt, Human
uggccucugcacuccccu

SEQ ID NO: 3587888 - RNA, 19 nt, Human
uggccucugcacuccccug

SEQ ID NO: 3587889 - RNA, 21 nt, Human
uggccucugcugauccuccca

SEQ ID NO: 3587890 - RNA, 13 nt, Human
uggccucuucaga

SEQ ID NO: 3587891 - RNA, 20 nt, Human
uggccucuugagcaguggcu

SEQ ID NO: 3587892 - RNA, 21 nt, Human
uggccugaagaguccucugaa

SEQ ID NO: 3587893 - RNA, 14 nt, Human
uggccugacucccc

SEQ ID NO: 3587894 - RNA, 12 nt, Human
uggccugaggag

SEQ ID NO: 3587895 - RNA, 16 nt, Human
uggccugcaaacuggg

SEQ ID NO: 3587896 - RNA, 20 nt, Human
uggccugcaaacugggaacc

SEQ ID NO: 3587897 - RNA, 20 nt, Human
uggccugcugggcucuccac

SEQ ID NO: 3587898 - RNA, 11 nt, Human
uggccugcugu

SEQ ID NO: 3587899 - RNA, 16 nt, Human
uggccuggcacacauc

SEQ ID NO: 3587900 - RNA, 12 nt, Human
uggccuggccag

SEQ ID NO: 3587901 - RNA, 15 nt, Human
uggccuggccaggag

SEQ ID NO: 3587902 - RNA, 12 nt, Human
uggccuggcccc

SEQ ID NO: 3587903 - RNA, 16 nt, Human
uggccuggcccugccc

SEQ ID NO: 3587904 - RNA, 14 nt, Human
uggccuggccuggc

SEQ ID NO: 3587905 - RNA, 19 nt, Human
uggccuggccuggcccugc

SEQ ID NO: 3587906 - RNA, 14 nt, Human
uggccuggcuccgc

SEQ ID NO: 3587907 - RNA, 18 nt, Human
uggccuggcuccgcugug

SEQ ID NO: 3587908 - RNA, 21 nt, Human
uggccugguauggcugcaguc

SEQ ID NO: 3587909 - RNA, 16 nt, Human
uggccugucucauccc

SEQ ID NO: 3587910 - RNA, 16 nt, Human
uggccugugucccaug

SEQ ID NO: 3587911 - RNA, 21 nt, Human
uggccugugucccaugaccca

SEQ ID NO: 3587912 - RNA, 12 nt, Human
uggccugugugg

SEQ ID NO: 3587913 - RNA, 21 nt, Human
uggccuguucuucuauggguu

SEQ ID NO: 3587914 - RNA, 18 nt, Human
uggccuguuucaacacag

SEQ ID NO: 3587915 - RNA, 15 nt, Human
uggccuuaauuuccu

SEQ ID NO: 3587916 - RNA, 18 nt, Human
uggccuuccauuuauaug

SEQ ID NO: 3587917 - RNA, 16 nt, Human
uggccuuccugcccua

SEQ ID NO: 3587918 - RNA, 17 nt, Human
uggccuucggccuccau

SEQ ID NO: 3587919 - RNA, 18 nt, Human
uggccuugaaaccaccuu

SEQ ID NO: 3587920 - RNA, 23 nt, Human
uggccuugcagcacucacacagg

SEQ ID NO: 3587921 - RNA, 12 nt, Human
uggccuugcuga

SEQ ID NO: 3587922 - RNA, 15 nt, Human
uggccuuguggucca

SEQ ID NO: 3587923 - RNA, 19 nt, Human
uggccuugugguccaaaua

SEQ ID NO: 3587924 - RNA, 14 nt, Human
uggccuuguucugu

SEQ ID NO: 3587925 - RNA, 14 nt, Human
uggccuuuccucuc

SEQ ID NO: 3587926 - RNA, 24 nt, Human
uggccuuugcgcuccuggcccagc

SEQ ID NO: 3587927 - RNA, 18 nt, Human
uggccuuugcuuaugaau

SEQ ID NO: 3587928 - RNA, 21 nt, Human
uggccuuugcuuaugaauauu

SEQ ID NO: 3587929 - RNA, 19 nt, Human
uggccuuuguaagugcagg

SEQ ID NO: 3587930 - RNA, 16 nt, Human
uggccuuuuucauuua

SEQ ID NO: 3587931 - RNA, 17 nt, Human
uggcgagaggaggggcc

SEQ ID NO: 3587932 - RNA, 19 nt, Human
uggcgaugccagccaagcu

SEQ ID NO: 3587933 - RNA, 15 nt, Human
uggcgcacccucccc

SEQ ID NO: 3587934 - RNA, 22 nt, Human
uggcgcagcauauucaggaagc

SEQ ID NO: 3587935 - RNA, 16 nt, Human
uggcgcaggugggcug

SEQ ID NO: 3587936 - RNA, 18 nt, Human
uggcgcagugccucuggu

SEQ ID NO: 3587937 - RNA, 17 nt, Human
uggcgccgucuccaggg

SEQ ID NO: 3587938 - RNA, 18 nt, Human
uggcgccgucuccagggg

SEQ ID NO: 3587939 - RNA, 16 nt, Human
uggcugcuucaaggau

SEQ ID NO: 3587940 - RNA, 16 nt, Human
uggcuggaagggagga

SEQ ID NO: 3587941 - RNA, 16 nt, Human
uggcuggacccagcca

SEQ ID NO: 3587942 - RNA, 23 nt, Human
uggcuggagacgggugggcggcu

SEQ ID NO: 3587943 - RNA, 19 nt, Human
uggcuggccucacccaccc

SEQ ID NO: 3587944 - RNA, 14 nt, Human
uggcuggcugcagu

SEQ ID NO: 3587945 - RNA, 23 nt, Human
uggcugggaacucaccuggggcu

SEQ ID NO: 3587946 - RNA, 15 nt, Human
uggcugggacguggc

SEQ ID NO: 3587947 - RNA, 15 nt, Human
uggcugggcccagaa

SEQ ID NO: 3587948 - RNA, 20 nt, Human
uggcuggggcauggaaggca

SEQ ID NO: 3587949 - RNA, 20 nt, Human
uggcuggggccuaucagugu

SEQ ID NO: 3587950 - RNA, 14 nt, Human
uggcugggggccuc

SEQ ID NO: 3587951 - RNA, 20 nt, Human
uggcugggggccucagugcc

SEQ ID NO: 3587952 - RNA, 19 nt, Human
uggcugggguggccugugu

SEQ ID NO: 3587953 - RNA, 21 nt, Human
uggcugggguggccugugugg

SEQ ID NO: 3587954 - RNA, 15 nt, Human
uggcugguccagggc

SEQ ID NO: 3587955 - RNA, 16 nt, Human
uggcugguccagggcu

SEQ ID NO: 3587956 - RNA, 16 nt, Human
uggcuggugagccggu

SEQ ID NO: 3587957 - RNA, 19 nt, Human
uggcuggugugguacagag

SEQ ID NO: 3587958 - RNA, 22 nt, Human
uggcugguuagagguucccuuu

SEQ ID NO: 3587959 - RNA, 15 nt, Human
uggcuguaaggcucu

SEQ ID NO: 3587960 - RNA, 13 nt, Human
uggcuguaaucau

SEQ ID NO: 3587961 - RNA, 17 nt, Human
uggcuguagaucccaag

SEQ ID NO: 3587962 - RNA, 22 nt, Human
uggcugucaaugggaccugugg

SEQ ID NO: 3587963 - RNA, 12 nt, Human
uggcugugagga

SEQ ID NO: 3587964 - RNA, 22 nt, Human
uggcugugccucugccugucuc

SEQ ID NO: 3587965 - RNA, 14 nt, Human
uggcuguggcaggc

SEQ ID NO: 3587966 - RNA, 20 nt, Human
uggcuguggccuaaccugcc

SEQ ID NO: 3587967 - RNA, 13 nt, Human
uggcugugggcuc

SEQ ID NO: 3587968 - RNA, 14 nt, Human
uggcugugucuaaa

SEQ ID NO: 3587969 - RNA, 19 nt, Human
uggcugugucuaaacugca

SEQ ID NO: 3587970 - RNA, 18 nt, Human
uggcuguuggcagugagu

SEQ ID NO: 3587971 - RNA, 18 nt, Human
uggcuguuggcugggggc

SEQ ID NO: 3587972 - RNA, 14 nt, Human
uggcuguuugagau

SEQ ID NO: 3587973 - RNA, 18 nt, Human
uggcuuaaaaaaaacucu

SEQ ID NO: 3587974 - RNA, 22 nt, Human
uggcuuaaauauaguuccuaag

SEQ ID NO: 3587975 - RNA, 22 nt, Human
uggcuuaccugaccucuugcug

SEQ ID NO: 3587976 - RNA, 15 nt, Human
uggcuuaccuggccc

SEQ ID NO: 3587977 - RNA, 20 nt, Human
uggcuuacuacaugugggag

SEQ ID NO: 3587978 - RNA, 16 nt, Human
uggcuuauagguguug

SEQ ID NO: 3587979 - RNA, 15 nt, Human
uggcuuauccagcug

SEQ ID NO: 3587980 - RNA, 14 nt, Human
uggcuuauuuuaau

SEQ ID NO: 3587981 - RNA, 17 nt, Human
uggcuucaaaauagaga

SEQ ID NO: 3587982 - RNA, 22 nt, Human
uggcuucaaauauuaugcaggg

SEQ ID NO: 3587983 - RNA, 17 nt, Human
uggcuucacggaagagc

SEQ ID NO: 3587984 - RNA, 20 nt, Human
uggcuucacggaagagccuu

SEQ ID NO: 3587985 - RNA, 14 nt, Human
uggcuucacuccug

SEQ ID NO: 3587986 - RNA, 16 nt, Human
uggcuucacuccugcu

SEQ ID NO: 3587987 - RNA, 18 nt, Human
uggcuucacuccugcugu

SEQ ID NO: 3587988 - RNA, 19 nt, Human
uggcuucacuccugcugua

SEQ ID NO: 3587989 - RNA, 12 nt, Human
uggcuucagcuc

SEQ ID NO: 3587990 - RNA, 21 nt, Human
uggcuucagcuccagccccuu

SEQ ID NO: 3587991 - RNA, 12 nt, Human
uggcuucaggag

SEQ ID NO: 3587992 - RNA, 13 nt, Human
uggcuucaggagg

SEQ ID NO: 3587993 - RNA, 20 nt, Human
uggcuucauuagagcaggcg

SEQ ID NO: 3587994 - RNA, 22 nt, Human
uggcuuccagaaaaccccagca

SEQ ID NO: 3587995 - RNA, 23 nt, Human
uggcuuccagaaaaccccagcau

SEQ ID NO: 3587996 - RNA, 16 nt, Human
uggcuuccaugauggu

SEQ ID NO: 3587997 - RNA, 15 nt, Human
uggcuucccaucccc

SEQ ID NO: 3587998 - RNA, 19 nt, Human
uggcuucccauccccagcg

SEQ ID NO: 3587999 - RNA, 15 nt, Human
uggcuucccaugucu

SEQ ID NO: 3588000 - RNA, 17 nt, Human
uggcuucccaugucuuu

SEQ ID NO: 3588001 - RNA, 16 nt, Human
uggcuucccgcucagc

SEQ ID NO: 3588002 - RNA, 21 nt, Human
uggcuuccuccucccuccugc

SEQ ID NO: 3588003 - RNA, 21 nt, Human
uggcuucucauacguccacca

SEQ ID NO: 3588004 - RNA, 22 nt, Human
uggcuucucauacguccaccau

SEQ ID NO: 3588005 - RNA, 15 nt, Human
uggcuucucugagga

SEQ ID NO: 3588006 - RNA, 16 nt, Human
uggcuucucugaggaa

SEQ ID NO: 3588007 - RNA, 22 nt, Human
uggcuucugugaugagcugauc

SEQ ID NO: 3588008 - RNA, 20 nt, Human
uggcuucuguggggccccuc

SEQ ID NO: 3588009 - RNA, 16 nt, Human
uggcuucuguuucuag

SEQ ID NO: 3588010 - RNA, 19 nt, Human
uggcuugacucaggauuua

SEQ ID NO: 3588011 - RNA, 21 nt, Human
uggcuugaguuuaaauuguaa

SEQ ID NO: 3588012 - RNA, 23 nt, Human
uggcuugggacuaaaugcccugc

SEQ ID NO: 3588013 - RNA, 16 nt, Human
uggcuugggcagcauc

SEQ ID NO: 3588014 - RNA, 17 nt, Human
uggcuuguaacuccacc

SEQ ID NO: 3588015 - RNA, 14 nt, Human
uggcuuguagaauu

SEQ ID NO: 3588016 - RNA, 16 nt, Human
uggcuuguagaauugu

SEQ ID NO: 3588017 - RNA, 24 nt, Human
uggcuuguaucaacacuguuacuu

SEQ ID NO: 3588018 - RNA, 14 nt, Human
uggcuuguccucac

SEQ ID NO: 3588019 - RNA, 16 nt, Human
uggcuuguuguaaagc

SEQ ID NO: 3588020 - RNA, 18 nt, Human
uggcuuguuguaaagcaa

SEQ ID NO: 3588021 - RNA, 21 nt, Human
uggcuuuauccucuuuagagu

SEQ ID NO: 3588022 - RNA, 15 nt, Human
uggcuuucagaaaac

SEQ ID NO: 3588023 - RNA, 11 nt, Human
uggcuuucagg

SEQ ID NO: 3588024 - RNA, 21 nt, Human
uggcuuucauuuucucucagg

SEQ ID NO: 3588025 - RNA, 19 nt, Human
uggcuuuccuuguggcaga

SEQ ID NO: 3588026 - RNA, 16 nt, Human
uggcuuugaugauaaa

SEQ ID NO: 3588027 - RNA, 13 nt, Human
uggcuuuggaagc

SEQ ID NO: 3588028 - RNA, 17 nt, Human
uggcuuuggcuucuugg

SEQ ID NO: 3588029 - RNA, 14 nt, Human
uggcuuuguauaga

SEQ ID NO: 3588030 - RNA, 20 nt, Human
uggcuuugugauucaaucug

SEQ ID NO: 3588031 - RNA, 22 nt, Human
uggcuuuuauuaaugcacuuuc

SEQ ID NO: 3588032 - RNA, 15 nt, Human
uggcuuuucacugcu

SEQ ID NO: 3588033 - RNA, 21 nt, Human
uggcuuuucacugcuggcugc

SEQ ID NO: 3588034 - RNA, 22 nt, Human
uggcuuuucacugcuggcugcc

SEQ ID NO: 3588035 - RNA, 21 nt, Human
uggcuuuucaugcgugugugu

SEQ ID NO: 3588036 - RNA, 18 nt, Human
uggcuuuucugauccagu

SEQ ID NO: 3588037 - RNA, 16 nt, Human
uggcuuuugugcauua

SEQ ID NO: 3588038 - RNA, 21 nt, Human
uggcuuuugugcauuaucuag

SEQ ID NO: 3588039 - RNA, 21 nt, Human
ugggaaaacauguuaaugaca

SEQ ID NO: 3588040 - RNA, 17 nt, Human
ugggaaaauauguccau

SEQ ID NO: 3588041 - RNA, 19 nt, Human
ugggaaacacuccuugcau

SEQ ID NO: 3588042 - RNA, 15 nt, Human
ugggaaacuugucac

SEQ ID NO: 3588043 - RNA, 17 nt, Human
ugggaaagagauuuaaa

SEQ ID NO: 3588044 - RNA, 17 nt, Human
ugggaaagcauuguaaa

SEQ ID NO: 3588045 - RNA, 18 nt, Human
ugggaaagcauuguaaau

SEQ ID NO: 3588046 - RNA, 21 nt, Human
ugggaaagccaccucucccuc

SEQ ID NO: 3588047 - RNA, 17 nt, Human
ugggaaaggaguagaaa

SEQ ID NO: 3588048 - RNA, 20 nt, Human
ugggaaagggauuuucagcc

SEQ ID NO: 3588049 - RNA, 19 nt, Human
ugggaaauauuuagcaaau

SEQ ID NO: 3588050 - RNA, 19 nt, Human
ugggaaaugagaaggcagc

SEQ ID NO: 3588051 - RNA, 15 nt, Human
ugggaaauggcuuga

SEQ ID NO: 3588052 - RNA, 22 nt, Human
ugggaaaugguaugagcugagg

SEQ ID NO: 3588053 - RNA, 23 nt, Human
ugggaaaugguaugagcugaggg

SEQ ID NO: 3588054 - RNA, 21 nt, Human
ugggaacauuuauuuuaugag

SEQ ID NO: 3588055 - RNA, 20 nt, Human
ugggaacccaaguccaagca

SEQ ID NO: 3588056 - RNA, 18 nt, Human
ugggaaccccuuucccac

SEQ ID NO: 3588057 - RNA, 17 nt, Human
ugggaaccucccagagg

SEQ ID NO: 3588058 - RNA, 19 nt, Human
ugggaaccucccagagguc

SEQ ID NO: 3588059 - RNA, 15 nt, Human
ugggaacgagagggg

SEQ ID NO: 3588060 - RNA, 16 nt, Human
ugggaacgugacugcc

SEQ ID NO: 3588061 - RNA, 15 nt, Human
ugggaacucaccugg

SEQ ID NO: 3588062 - RNA, 17 nt, Human
ugggaacucaccugggg

SEQ ID NO: 3588063 - RNA, 22 nt, Human
ugggaacucugacaagggcuga

SEQ ID NO: 3588064 - RNA, 17 nt, Human
ugggaacugcagaccug

SEQ ID NO: 3588065 - RNA, 13 nt, Human
ugggaagacauga

SEQ ID NO: 3588066 - RNA, 21 nt, Human
ugggaagacauggggaggaag

SEQ ID NO: 3588067 - RNA, 23 nt, Human
ugggaagaccagcuuugcaguga

SEQ ID NO: 3588068 - RNA, 17 nt, Human
ugggaagacgaggcccu

SEQ ID NO: 3588069 - RNA, 19 nt, Human
ugggaagacgccugagcuc

SEQ ID NO: 3588070 - RNA, 20 nt, Human
ugggaagagcuuagaaacug

SEQ ID NO: 3588071 - RNA, 20 nt, Human
ugggaagauaggcucugcac

SEQ ID NO: 3588072 - RNA, 12 nt, Human
ugggaaggaggg

SEQ ID NO: 3588073 - RNA, 23 nt, Human
ugggaaggcuacuucggggcugg

SEQ ID NO: 3588074 - RNA, 18 nt, Human
ugggaaggcuugggauuu

SEQ ID NO: 3588075 - RNA, 13 nt, Human
ugggaagggagag

SEQ ID NO: 3588076 - RNA, 15 nt, Human
ugggaagggguuucu

SEQ ID NO: 3588077 - RNA, 14 nt, Human
ugggaagugacuua

SEQ ID NO: 3588078 - RNA, 20 nt, Human
ugggaagugacuuagcagau

SEQ ID NO: 3588079 - RNA, 14 nt, Human
ugggaauaaauaug

SEQ ID NO: 3588080 - RNA, 15 nt, Human
ugggaauaccugugg

SEQ ID NO: 3588081 - RNA, 14 nt, Human
ugggaauauuugaa

SEQ ID NO: 3588082 - RNA, 18 nt, Human
ugggaauauuugaaucuu

SEQ ID NO: 3588083 - RNA, 15 nt, Human
ugggaaugagacaua

SEQ ID NO: 3588084 - RNA, 22 nt, Human
ugggaaugaggcuugcugagag

SEQ ID NO: 3588085 - RNA, 17 nt, Human
ugggaauggaggggcag

SEQ ID NO: 3588086 - RNA, 23 nt, Human
ugggaauggaggggcagagccag

SEQ ID NO: 3588087 - RNA, 13 nt, Human
aagccaaagccaa

SEQ ID NO: 3588088 - RNA, 20 nt, Human
aagccaaagcuaggccuggc

SEQ ID NO: 3588089 - RNA, 22 nt, Human
aagccaaaguggcauguuuugu

SEQ ID NO: 3588090 - RNA, 17 nt, Human
aagccaacagucaaaac

SEQ ID NO: 3588091 - RNA, 22 nt, Human
aagccaacuuggcuuucccgga

SEQ ID NO: 3588092 - RNA, 15 nt, Human
aagccaagaccucac

SEQ ID NO: 3588093 - RNA, 14 nt, Human
aagccaagggaaag

SEQ ID NO: 3588094 - RNA, 16 nt, Human
aagccaagggaaaggg

SEQ ID NO: 3588095 - RNA, 23 nt, Human
aagccaagggaaaggggugcuuu

SEQ ID NO: 3588096 - RNA, 18 nt, Human
aagccaagggaaccugug

SEQ ID NO: 3588097 - RNA, 16 nt, Human
aagccaagggccucuu

SEQ ID NO: 3588098 - RNA, 21 nt, Human
aagccaaggugucauuuaugu

SEQ ID NO: 3588099 - RNA, 22 nt, Human
aagccaagucagcuuugccuuc

SEQ ID NO: 3588100 - RNA, 20 nt, Human
aagccaauccccuccuuggg

SEQ ID NO: 3588101 - RNA, 19 nt, Human
aagccaaucuacaaucucu

SEQ ID NO: 3588102 - RNA, 17 nt, Human
aagccaauucagacagg

SEQ ID NO: 3588103 - RNA, 15 nt, Human
aagccacaagaaauu

SEQ ID NO: 3588104 - RNA, 16 nt, Human
aagccacaagaaauuu

SEQ ID NO: 3588105 - RNA, 18 nt, Human
aagccacaagaaauuuga

SEQ ID NO: 3588106 - RNA, 18 nt, Human
aagccacagcccaggccu

SEQ ID NO: 3588107 - RNA, 24 nt, Human
aagccacagcccaggccuccagcu

SEQ ID NO: 3588108 - RNA, 23 nt, Human
aagccacaggccugagauuucau

SEQ ID NO: 3588109 - RNA, 19 nt, Human
aagccaccaacauacuccc

SEQ ID NO: 3588110 - RNA, 16 nt, Human
aagccacccucccagc

SEQ ID NO: 3588111 - RNA, 18 nt, Human
aagccacccucccagcuc

SEQ ID NO: 3588112 - RNA, 21 nt, Human
aagccacccucccagcucuga

SEQ ID NO: 3588113 - RNA, 17 nt, Human
aagccaccucucccuca

SEQ ID NO: 3588114 - RNA, 13 nt, Human
aagccacugaagc

SEQ ID NO: 3588115 - RNA, 18 nt, Human
aagccacugccucucccu

SEQ ID NO: 3588116 - RNA, 19 nt, Human
aagccacugccucucccuc

SEQ ID NO: 3588117 - RNA, 12 nt, Human
aagccagaagcu

SEQ ID NO: 3588118 - RNA, 17 nt, Human
aagccagaagcugagca

SEQ ID NO: 3588119 - RNA, 11 nt, Human
aagccagacag

SEQ ID NO: 3588120 - RNA, 14 nt, Human
aagccagaggcugg

SEQ ID NO: 3588121 - RNA, 22 nt, Human
aagccagcaccggaccagccug

SEQ ID NO: 3588122 - RNA, 19 nt, Human
aagccagcaggcucucagg

SEQ ID NO: 3588123 - RNA, 16 nt, Human
aagccagcccggccgc

SEQ ID NO: 3588124 - RNA, 21 nt, Human
aagccagccugguccaugcag

SEQ ID NO: 3588125 - RNA, 20 nt, Human
aagccagcugcccccagagc

SEQ ID NO: 3588126 - RNA, 23 nt, Human
aagccagcugccgaccagagccc

SEQ ID NO: 3588127 - RNA, 11 nt, Human
aagccagcuug

SEQ ID NO: 3588128 - RNA, 23 nt, Human
aagccagcuuucccugccucuca

SEQ ID NO: 3588129 - RNA, 22 nt, Human
aagccaggaauuucccaggacc

SEQ ID NO: 3588130 - RNA, 23 nt, Human
aagccaggaauuucccaggaccc

SEQ ID NO: 3588131 - RNA, 23 nt, Human
aagccagggauggggccacagcc

SEQ ID NO: 3588132 - RNA, 17 nt, Human
aagccagggcuggagaa

SEQ ID NO: 3588133 - RNA, 16 nt, Human
aagccaggucccucuc

SEQ ID NO: 3588134 - RNA, 18 nt, Human
aagccagugacuccagga

SEQ ID NO: 3588135 - RNA, 18 nt, Human
aagccaguguugccuaag

SEQ ID NO: 3588136 - RNA, 17 nt, Human
aagccauaugaacagcu

SEQ ID NO: 3588137 - RNA, 16 nt, Human
aagccaucuugguaaa

SEQ ID NO: 3588138 - RNA, 13 nt, Human
aagccaugcugga

SEQ ID NO: 3588139 - RNA, 21 nt, Human
aagccaugcuggaaaauaaua

SEQ ID NO: 3588140 - RNA, 18 nt, Human
aagccauggguagccugg

SEQ ID NO: 3588141 - RNA, 22 nt, Human
aagccauggguagccugggugu

SEQ ID NO: 3588142 - RNA, 16 nt, Human
aagccauguauaaaug

SEQ ID NO: 3588143 - RNA, 12 nt, Human
aagccauguuua

SEQ ID NO: 3588144 - RNA, 15 nt, Human
aagccauguuuaaga

SEQ ID NO: 3588145 - RNA, 16 nt, Human
aagccauguuuaagau

SEQ ID NO: 3588146 - RNA, 13 nt, Human
aagccauguuuau

SEQ ID NO: 3588147 - RNA, 17 nt, Human
aagccauguuuauuaca

SEQ ID NO: 3588148 - RNA, 20 nt, Human
aagccauguuuauuacagua

SEQ ID NO: 3588149 - RNA, 22 nt, Human
aagccauguuuauuacaguaua

SEQ ID NO: 3588150 - RNA, 14 nt, Human
aagccauuccaaag

SEQ ID NO: 3588151 - RNA, 22 nt, Human
aagccauucuccugccucagcc

SEQ ID NO: 3588152 - RNA, 12 nt, Human
aagccauugucu

SEQ ID NO: 3588153 - RNA, 16 nt, Human
aagcccaaccuccuga

SEQ ID NO: 3588154 - RNA, 22 nt, Human
aagcccaaccuccugaccuguc

SEQ ID NO: 3588155 - RNA, 17 nt, Human
aagcccagagggucugg

SEQ ID NO: 3588156 - RNA, 14 nt, Human
aagcccagcuccag

SEQ ID NO: 3588157 - RNA, 15 nt, Human
aagcccagcuccagg

SEQ ID NO: 3588158 - RNA, 14 nt, Human
aagcccaggccccu

SEQ ID NO: 3588159 - RNA, 19 nt, Human
aagcccaguucagcuuggg

SEQ ID NO: 3588160 - RNA, 14 nt, Human
aagcccauccugac

SEQ ID NO: 3588161 - RNA, 20 nt, Human
aagcccaugaguccuugaaa

SEQ ID NO: 3588162 - RNA, 16 nt, Human
aagccccacaugucca

SEQ ID NO: 3588163 - RNA, 17 nt, Human
aagccccacccaggcca

SEQ ID NO: 3588164 - RNA, 18 nt, Human
aagccccacccaggccag

SEQ ID NO: 3588165 - RNA, 22 nt, Human
aagccccacccaggccaggcau

SEQ ID NO: 3588166 - RNA, 22 nt, Human
aagccccaugcuggagccugug

SEQ ID NO: 3588167 - RNA, 14 nt, Human
aagcccccaccgug

SEQ ID NO: 3588168 - RNA, 14 nt, Human
aagcccccagagcc

SEQ ID NO: 3588169 - RNA, 16 nt, Human
aagcccccccuuccac

SEQ ID NO: 3588170 - RNA, 14 nt, Human
aagccccugggccc

SEQ ID NO: 3588171 - RNA, 17 nt, Human
aagcccgacuugcuguu

SEQ ID NO: 3588172 - RNA, 19 nt, Human
aagcccuacagagcugugg

SEQ ID NO: 3588173 - RNA, 13 nt, Human
aagcccucccagg

SEQ ID NO: 3588174 - RNA, 14 nt, Human
aagcccuccuucca

SEQ ID NO: 3588175 - RNA, 21 nt, Human
aagcccucuuccaucaugucc

SEQ ID NO: 3588176 - RNA, 23 nt, Human
aagcccugauuguguauauucau

SEQ ID NO: 3588177 - RNA, 13 nt, Human
aagcccuggagac

SEQ ID NO: 3588178 - RNA, 23 nt, Human
aagcccuggagccaacugcugcu

SEQ ID NO: 3588179 - RNA, 19 nt, Human
aagcccugggaucacugug

SEQ ID NO: 3588180 - RNA, 18 nt, Human
aagcccugucgagacacu

SEQ ID NO: 3588181 - RNA, 18 nt, Human
aagcccuguugugccaca

SEQ ID NO: 3588182 - RNA, 15 nt, Human
aagccgaccuuagau

SEQ ID NO: 3588183 - RNA, 17 nt, Human
aagccgacucuggcccu

SEQ ID NO: 3588184 - RNA, 18 nt, Human
aagccgacucuggcccug

SEQ ID NO: 3588185 - RNA, 12 nt, Human
aagccggcggcc

SEQ ID NO: 3588186 - RNA, 14 nt, Human
aagccguggcuucc

SEQ ID NO: 3588187 - RNA, 13 nt, Human
aagccuaaagauu

SEQ ID NO: 3588188 - RNA, 23 nt, Human
aagccuaaaugccuuagaaaugu

SEQ ID NO: 3588189 - RNA, 14 nt, Human
aagccuaagaaucu

SEQ ID NO: 3588190 - RNA, 22 nt, Human
aagccuaaucacaguuuuuccu

SEQ ID NO: 3588191 - RNA, 21 nt, Human
aagccuaucaaagaccuugug

SEQ ID NO: 3588192 - RNA, 16 nt, Human
aagccucaaaacaaag

SEQ ID NO: 3588193 - RNA, 22 nt, Human
aagccucaacuagucauuuuuu

SEQ ID NO: 3588194 - RNA, 13 nt, Human
aagccucagagaa

SEQ ID NO: 3588195 - RNA, 20 nt, Human
aagccucagauuccuuccca

SEQ ID NO: 3588196 - RNA, 14 nt, Human
aagccucauauuua

SEQ ID NO: 3588197 - RNA, 15 nt, Human
aagccuccuccagcc

SEQ ID NO: 3588198 - RNA, 19 nt, Human
aagccuccuuagaaaaaaa

SEQ ID NO: 3588199 - RNA, 11 nt, Human
aagccucugcu

SEQ ID NO: 3588200 - RNA, 14 nt, Human
aagccucugcugcc

SEQ ID NO: 3588201 - RNA, 12 nt, Human
aagccucuggga

SEQ ID NO: 3588202 - RNA, 22 nt, Human
aagccucugugucacuggcugc

SEQ ID NO: 3588203 - RNA, 21 nt, Human
aagccugaaggggcgucuguu

SEQ ID NO: 3588204 - RNA, 24 nt, Human
aagccugaaggggcgucuguuccc

SEQ ID NO: 3588205 - RNA, 21 nt, Human
aagccugagggaaaggccagc

SEQ ID NO: 3588206 - RNA, 22 nt, Human
aagccugagggaaaggccagca

SEQ ID NO: 3588207 - RNA, 22 nt, Human
aagccugcacaauaaaaauguu

SEQ ID NO: 3588208 - RNA, 11 nt, Human
aagccugcccu

SEQ ID NO: 3588209 - RNA, 18 nt, Human
aagccugcccuugucuga

SEQ ID NO: 3588210 - RNA, 16 nt, Human
aagccugggggccugg

SEQ ID NO: 3588211 - RNA, 13 nt, Human
aagccugugcaaa

SEQ ID NO: 3588212 - RNA, 17 nt, Human
aagccugugcaaaaaaa

SEQ ID NO: 3588213 - RNA, 22 nt, Human
aagccuguggaugaucaauccu

SEQ ID NO: 3588214 - RNA, 13 nt, Human
aagccuguggcug

SEQ ID NO: 3588215 - RNA, 18 nt, Human
aagccuguucauggcaga

SEQ ID NO: 3588216 - RNA, 20 nt, Human
aagccuguuccccucacugg

SEQ ID NO: 3588217 - RNA, 14 nt, Human
aagccuuagggaag

SEQ ID NO: 3588218 - RNA, 23 nt, Human
aagccuuaucaagugucuuccau

SEQ ID NO: 3588219 - RNA, 13 nt, Human
aagccuucaagcu

SEQ ID NO: 3588220 - RNA, 16 nt, Human
aagccuucaagcucug

SEQ ID NO: 3588221 - RNA, 18 nt, Human
aagccuucaagcucugag

SEQ ID NO: 3588222 - RNA, 12 nt, Human
aagccuuccccu

SEQ ID NO: 3588223 - RNA, 11 nt, Human
aagccuuccua

SEQ ID NO: 3588224 - RNA, 22 nt, Human
aagccuucgggcgucugugugc

SEQ ID NO: 3588225 - RNA, 21 nt, Human
aagccuuggggcugaugcagu

SEQ ID NO: 3588226 - RNA, 22 nt, Human
aagccuuguguauauuuguaua

SEQ ID NO: 3588227 - RNA, 20 nt, Human
aagccuuuaguaucaguguu

SEQ ID NO: 3588228 - RNA, 18 nt, Human
aagccuuuguugaacugu

SEQ ID NO: 3588229 - RNA, 14 nt, Human
aagcgaaaaacuca

SEQ ID NO: 3588230 - RNA, 22 nt, Human
aagcgauauacagaugaaaauu

SEQ ID NO: 3588231 - RNA, 21 nt, Human
aagcgaugaauuuggagacuc

SEQ ID NO: 3588232 - RNA, 15 nt, Human
aagcgauucuccugc

SEQ ID NO: 3588233 - RNA, 16 nt, Human
aagcgauucuucugcu

SEQ ID NO: 3588234 - RNA, 17 nt, Human
aagcgauucuucugcuu

SEQ ID NO: 3588235 - RNA, 13 nt, Human
aagcgcccuggcc

SEQ ID NO: 3588236 - RNA, 23 nt, Human
ugggauucccaccaaggucuuca

SEQ ID NO: 3588237 - RNA, 15 nt, Human
ugggauuccugaccc

SEQ ID NO: 3588238 - RNA, 21 nt, Human
ugggauuccugacccaggccg

SEQ ID NO: 3588239 - RNA, 19 nt, Human
ugggauugugguacaaucu

SEQ ID NO: 3588240 - RNA, 16 nt, Human
ugggauuuaauuucca

SEQ ID NO: 3588241 - RNA, 15 nt, Human
ugggcaaaaaacucg

SEQ ID NO: 3588242 - RNA, 18 nt, Human
ugggcaaaacccacagaa

SEQ ID NO: 3588243 - RNA, 15 nt, Human
ugggcaaagagugua

SEQ ID NO: 3588244 - RNA, 15 nt, Human
ugggcaacaaaguga

SEQ ID NO: 3588245 - RNA, 17 nt, Human
ugggcaacccccagccu

SEQ ID NO: 3588246 - RNA, 22 nt, Human
ugggcaagcuggcggcuggggu

SEQ ID NO: 3588247 - RNA, 19 nt, Human
ugggcaaggaaaaagaaaa

SEQ ID NO: 3588248 - RNA, 15 nt, Human
ugggcaagugauuga

SEQ ID NO: 3588249 - RNA, 18 nt, Human
ugggcaauauucucugua

SEQ ID NO: 3588250 - RNA, 19 nt, Human
ugggcaauauucucuguac

SEQ ID NO: 3588251 - RNA, 20 nt, Human
ugggcaauauucucuguaca

SEQ ID NO: 3588252 - RNA, 15 nt, Human
ugggcaauuuagaaa

SEQ ID NO: 3588253 - RNA, 19 nt, Human
ugggcacaaagggcccaga

SEQ ID NO: 3588254 - RNA, 22 nt, Human
ugggcacaacugcaauaacuuc

SEQ ID NO: 3588255 - RNA, 18 nt, Human
ugggcaccacaaaauaua

SEQ ID NO: 3588256 - RNA, 21 nt, Human
ugggcacccagccucuaggga

SEQ ID NO: 3588257 - RNA, 18 nt, Human
ugggcacccccagccugg

SEQ ID NO: 3588258 - RNA, 15 nt, Human
ugggcaccuggggag

SEQ ID NO: 3588259 - RNA, 19 nt, Human
ugggcacgcugugggcagg

SEQ ID NO: 3588260 - RNA, 20 nt, Human
ugggcacuauuuauuuacaa

SEQ ID NO: 3588261 - RNA, 16 nt, Human
ugggcacugcugggug

SEQ ID NO: 3588262 - RNA, 15 nt, Human
ugggcacugggauga

SEQ ID NO: 3588263 - RNA, 16 nt, Human
ugggcacuucccugcu

SEQ ID NO: 3588264 - RNA, 16 nt, Human
ugggcagaaggaagac

SEQ ID NO: 3588265 - RNA, 18 nt, Human
ugggcagaaggccaagag

SEQ ID NO: 3588266 - RNA, 12 nt, Human
ugggcagagcag

SEQ ID NO: 3588267 - RNA, 13 nt, Human
ugggcagagcaga

SEQ ID NO: 3588268 - RNA, 22 nt, Human
ugggcagagcagagaccauccc

SEQ ID NO: 3588269 - RNA, 12 nt, Human
ugggcagagcug

SEQ ID NO: 3588270 - RNA, 16 nt, Human
ugggcagagcuggcuc

SEQ ID NO: 3588271 - RNA, 20 nt, Human
ugggcagagcuggcucugag

SEQ ID NO: 3588272 - RNA, 16 nt, Human
ugggcagaucuacccc

SEQ ID NO: 3588273 - RNA, 22 nt, Human
ugggcagaucuaccccuuacuu

SEQ ID NO: 3588274 - RNA, 19 nt, Human
ugggcagcaauuuaaaugu

SEQ ID NO: 3588275 - RNA, 18 nt, Human
ugggcagcauagcaagac

SEQ ID NO: 3588276 - RNA, 19 nt, Human
ugggcagcgcccuuccucu

SEQ ID NO: 3588277 - RNA, 21 nt, Human
ugggcagcgcccuuccucucc

SEQ ID NO: 3588278 - RNA, 17 nt, Human
ugggcagcugaacagug

SEQ ID NO: 3588279 - RNA, 19 nt, Human
ugggcagcugccuccccuc

SEQ ID NO: 3588280 - RNA, 20 nt, Human
ugggcagcugccuccccucc

SEQ ID NO: 3588281 - RNA, 22 nt, Human
ugggcagcugccuccccuccuc

SEQ ID NO: 3588282 - RNA, 19 nt, Human
ugggcagcugucccuugcu

SEQ ID NO: 3588283 - RNA, 23 nt, Human
ugggcagcuuagggcccuggagg

SEQ ID NO: 3588284 - RNA, 18 nt, Human
ugggcaggacucagcucc

SEQ ID NO: 3588285 - RNA, 23 nt, Human
ugggcaggacucagcuccccaga

SEQ ID NO: 3588286 - RNA, 15 nt, Human
ugggcaggagggagg

SEQ ID NO: 3588287 - RNA, 21 nt, Human
ugggcagggucuguuuggacu

SEQ ID NO: 3588288 - RNA, 14 nt, Human
ugggcagguggugg

SEQ ID NO: 3588289 - RNA, 15 nt, Human
ugggcaguuacaugc

SEQ ID NO: 3588290 - RNA, 21 nt, Human
ugggcauacuaauaaaguaug

SEQ ID NO: 3588291 - RNA, 16 nt, Human
ugggcaucuguucugg

SEQ ID NO: 3588292 - RNA, 17 nt, Human
ugggcaucuguucuggu

SEQ ID NO: 3588293 - RNA, 19 nt, Human
ugggcaucuuuuguauuaa

SEQ ID NO: 3588294 - RNA, 22 nt, Human
ugggcaugguaccagcccuggg

SEQ ID NO: 3588295 - RNA, 14 nt, Human
ugggcaugugggcu

SEQ ID NO: 3588296 - RNA, 15 nt, Human
ugggcaugugggcuu

SEQ ID NO: 3588297 - RNA, 23 nt, Human
ugggcauuacuguuuaagacacu

SEQ ID NO: 3588298 - RNA, 23 nt, Human
ugggcauugacaaaucuguguau

SEQ ID NO: 3588299 - RNA, 15 nt, Human
ugggcauugcuuucc

SEQ ID NO: 3588300 - RNA, 23 nt, Human
ugggccaaauccgcucucuuccu

SEQ ID NO: 3588301 - RNA, 19 nt, Human
ugggccaagccagggaugg

SEQ ID NO: 3588302 - RNA, 20 nt, Human
ugggccaagucaaagacauu

SEQ ID NO: 3588303 - RNA, 20 nt, Human
ugggccaccaggaucagcca

SEQ ID NO: 3588304 - RNA, 15 nt, Human
ugggccacuguggug

SEQ ID NO: 3588305 - RNA, 17 nt, Human
ugggccagaauuucaaa

SEQ ID NO: 3588306 - RNA, 14 nt, Human
ugggccagccccuc

SEQ ID NO: 3588307 - RNA, 22 nt, Human
ugggccagccccuccaucugua

SEQ ID NO: 3588308 - RNA, 23 nt, Human
ugggccagccccucccaccacag

SEQ ID NO: 3588309 - RNA, 18 nt, Human
ugggccaggacaggcccg

SEQ ID NO: 3588310 - RNA, 12 nt, Human
ugggccagggcu

SEQ ID NO: 3588311 - RNA, 14 nt, Human
ugggccagggucug

SEQ ID NO: 3588312 - RNA, 14 nt, Human
ugggccaguguggg

SEQ ID NO: 3588313 - RNA, 16 nt, Human
ugggccauacuggccu

SEQ ID NO: 3588314 - RNA, 18 nt, Human
ugggccauacuggccucg

SEQ ID NO: 3588315 - RNA, 20 nt, Human
ugggccauacuggccucgcc

SEQ ID NO: 3588316 - RNA, 18 nt, Human
ugggccauguccaaagag

SEQ ID NO: 3588317 - RNA, 18 nt, Human
ugggccauguugugccuc

SEQ ID NO: 3588318 - RNA, 15 nt, Human
ugggcccacaccucc

SEQ ID NO: 3588319 - RNA, 17 nt, Human
ugggcccagaggcacag

SEQ ID NO: 3588320 - RNA, 13 nt, Human
ugggcccagaucu

SEQ ID NO: 3588321 - RNA, 16 nt, Human
ugggcccagcugggcu

SEQ ID NO: 3588322 - RNA, 14 nt, Human
ugggcccaggacca

SEQ ID NO: 3588323 - RNA, 18 nt, Human
ugggcccaggaccagcug

SEQ ID NO: 3588324 - RNA, 19 nt, Human
ugggcccaggaccagcugg

SEQ ID NO: 3588325 - RNA, 21 nt, Human
ugggcccaggaccagcugggg

SEQ ID NO: 3588326 - RNA, 15 nt, Human
ugggcccaggccuca

SEQ ID NO: 3588327 - RNA, 12 nt, Human
ugggcccaggga

SEQ ID NO: 3588328 - RNA, 22 nt, Human
ugggcccagggacaccagccag

SEQ ID NO: 3588329 - RNA, 16 nt, Human
ugggcccccaaaugga

SEQ ID NO: 3588330 - RNA, 19 nt, Human
ugggccccccagcucaggg

SEQ ID NO: 3588331 - RNA, 19 nt, Human
ugggccccucaucugcuca

SEQ ID NO: 3588332 - RNA, 14 nt, Human
ugggccccucccua

SEQ ID NO: 3588333 - RNA, 13 nt, Human
ugggcccucucug

SEQ ID NO: 3588334 - RNA, 16 nt, Human
ugggcccucucugcuc

SEQ ID NO: 3588335 - RNA, 17 nt, Human
ugggcccugggcuggaa

SEQ ID NO: 3588336 - RNA, 13 nt, Human
ugggcccuggggc

SEQ ID NO: 3588337 - RNA, 16 nt, Human
ugggcccuggggccug

SEQ ID NO: 3588338 - RNA, 13 nt, Human
ugggcccuuugag

SEQ ID NO: 3588339 - RNA, 21 nt, Human
ugggccggcuucaugccagcu

SEQ ID NO: 3588340 - RNA, 21 nt, Human
ugggccguaucuccggcuccc

SEQ ID NO: 3588341 - RNA, 15 nt, Human
ugggccuaggcugca

SEQ ID NO: 3588342 - RNA, 19 nt, Human
ugggccuauggagagcccu

SEQ ID NO: 3588343 - RNA, 23 nt, Human
ugggccucaaggacuugaaagca

SEQ ID NO: 3588344 - RNA, 13 nt, Human
ugggccuccucac

SEQ ID NO: 3588345 - RNA, 16 nt, Human
ugggccuccugugugu

SEQ ID NO: 3588346 - RNA, 20 nt, Human
ugggccucugcuucucucac

SEQ ID NO: 3588347 - RNA, 13 nt, Human
ugggccugaguga

SEQ ID NO: 3588348 - RNA, 19 nt, Human
ugggccugccgggcugagg

SEQ ID NO: 3588349 - RNA, 15 nt, Human
ugggccugcuccaga

SEQ ID NO: 3588350 - RNA, 16 nt, Human
ugggccugcuccagac

SEQ ID NO: 3588351 - RNA, 18 nt, Human
ugggccugcugcugagaa

SEQ ID NO: 3588352 - RNA, 15 nt, Human
ugggccugcuuccug

SEQ ID NO: 3588353 - RNA, 13 nt, Human
ugggccugggcuc

SEQ ID NO: 3588354 - RNA, 12 nt, Human
ugggccuucagg

SEQ ID NO: 3588355 - RNA, 15 nt, Human
ugggccuucagggag

SEQ ID NO: 3588356 - RNA, 15 nt, Human
ugggccuuggccugg

SEQ ID NO: 3588357 - RNA, 16 nt, Human
ugggccuuggccugga

SEQ ID NO: 3588358 - RNA, 18 nt, Human
ugggccuuggccuggagc

SEQ ID NO: 3588359 - RNA, 19 nt, Human
ugggccuuggccuggagca

SEQ ID NO: 3588360 - RNA, 15 nt, Human
ugggccuugggcucc

SEQ ID NO: 3588361 - RNA, 20 nt, Human
ugggcgccccccccucccca

SEQ ID NO: 3588362 - RNA, 20 nt, Human
ugggcgccgugcugggcagc

SEQ ID NO: 3588363 - RNA, 19 nt, Human
ugggcggcagagaggacug

SEQ ID NO: 3588364 - RNA, 12 nt, Human
ugggcggcugag

SEQ ID NO: 3588365 - RNA, 14 nt, Human
ugggcggcugagag

SEQ ID NO: 3588366 - RNA, 15 nt, Human
ugggcggcugagagc

SEQ ID NO: 3588367 - RNA, 18 nt, Human
ugggcggcugagagcccc

SEQ ID NO: 3588368 - RNA, 19 nt, Human
ugggcgggcagcacagcaa

SEQ ID NO: 3588369 - RNA, 22 nt, Human
ugggcgggcaggggagggucag

SEQ ID NO: 3588370 - RNA, 18 nt, Human
ugggcgugagaccugccc

SEQ ID NO: 3588371 - RNA, 20 nt, Human
ugggcgugagaccugccccu

SEQ ID NO: 3588372 - RNA, 20 nt, Human
ugggcguuaggggcaggcag

SEQ ID NO: 3588373 - RNA, 14 nt, Human
ugggcuauggacac

SEQ ID NO: 3588374 - RNA, 15 nt, Human
ugggcuauggacaca

SEQ ID NO: 3588375 - RNA, 19 nt, Human
ugggcuauggacacagggu

SEQ ID NO: 3588376 - RNA, 20 nt, Human
ugggcucaagcaauccucuc

SEQ ID NO: 3588377 - RNA, 14 nt, Human
ugggcucagcacau

SEQ ID NO: 3588378 - RNA, 14 nt, Human
ugggcucagugaag

SEQ ID NO: 3588379 - RNA, 19 nt, Human
ugggcucagugaaguugcu

SEQ ID NO: 3588380 - RNA, 14 nt, Human
ugggcuccccucuu

SEQ ID NO: 3588381 - RNA, 15 nt, Human
ugggcucccugacug

SEQ ID NO: 3588382 - RNA, 20 nt, Human
ugggcucccuucccaccucu

SEQ ID NO: 3588383 - RNA, 21 nt, Human
ugggcucccuucccaccucuc

SEQ ID NO: 3588384 - RNA, 21 nt, Human
ugggcuccggaggacucacca

SEQ ID NO: 3588385 - RNA, 22 nt, Human
ugggaauguauaguauuugaaa

SEQ ID NO: 3588386 - RNA, 21 nt, Human
ugggaauguauuauucugcag

SEQ ID NO: 3588387 - RNA, 22 nt, Human
ugggaauguauuauucugcagc

SEQ ID NO: 3588388 - RNA, 10 nt, Human
ugggaauguu

SEQ ID NO: 3588389 - RNA, 16 nt, Human
ugggaauguuugucuc

SEQ ID NO: 3588390 - RNA, 22 nt, Human
ugggacaacuguagaggcaguu

SEQ ID NO: 3588391 - RNA, 14 nt, Human
ugggacaccaggga

SEQ ID NO: 3588392 - RNA, 18 nt, Human
ugggacaccagggaagaa

SEQ ID NO: 3588393 - RNA, 14 nt, Human
ugggacacccugug

SEQ ID NO: 3588394 - RNA, 22 nt, Human
ugggacacuaauggggcgguga

SEQ ID NO: 3588395 - RNA, 16 nt, Human
ugggacagcaaccugu

SEQ ID NO: 3588396 - RNA, 18 nt, Human
ugggacagcccagagccu

SEQ ID NO: 3588397 - RNA, 20 nt, Human
ugggacaguuuaucaugaag

SEQ ID NO: 3588398 - RNA, 14 nt, Human
ugggacccaguggc

SEQ ID NO: 3588399 - RNA, 16 nt, Human
ugggaccccaggccca

SEQ ID NO: 3588400 - RNA, 14 nt, Human
ugggacccccgugg

SEQ ID NO: 3588401 - RNA, 22 nt, Human
ugggacccccguggggcaggga

SEQ ID NO: 3588402 - RNA, 23 nt, Human
ugggacccugcuuuagagcuagg

SEQ ID NO: 3588403 - RNA, 13 nt, Human
ugggacccuuucc

SEQ ID NO: 3588404 - RNA, 21 nt, Human
ugggaccgcuacaccacucug

SEQ ID NO: 3588405 - RNA, 22 nt, Human
ugggaccgcuacaccacucugg

SEQ ID NO: 3588406 - RNA, 19 nt, Human
ugggaccuaggggcgccgc

SEQ ID NO: 3588407 - RNA, 23 nt, Human
ugggaccucaguuuuaucauuuu

SEQ ID NO: 3588408 - RNA, 18 nt, Human
ugggaccugccaggcagg

SEQ ID NO: 3588409 - RNA, 20 nt, Human
ugggaccugccaggcagggg

SEQ ID NO: 3588410 - RNA, 23 nt, Human
ugggacgggaugguucuggcugu

SEQ ID NO: 3588411 - RNA, 21 nt, Human
ugggacguggcucagccagca

SEQ ID NO: 3588412 - RNA, 16 nt, Human
ugggacuacaggcacc

SEQ ID NO: 3588413 - RNA, 20 nt, Human
ugggacucaaugcacugaca

SEQ ID NO: 3588414 - RNA, 17 nt, Human
ugggacucagccuucag

SEQ ID NO: 3588415 - RNA, 14 nt, Human
ugggacuggacaau

SEQ ID NO: 3588416 - RNA, 12 nt, Human
ugggacuggagu

SEQ ID NO: 3588417 - RNA, 14 nt, Human
ugggacuggccucu

SEQ ID NO: 3588418 - RNA, 13 nt, Human
ugggacugggagg

SEQ ID NO: 3588419 - RNA, 19 nt, Human
ugggacuggguuuggaccc

SEQ ID NO: 3588420 - RNA, 22 nt, Human
ugggacuguacacacuuuauuu

SEQ ID NO: 3588421 - RNA, 15 nt, Human
ugggacuuauuacaa

SEQ ID NO: 3588422 - RNA, 15 nt, Human
ugggagaaaaucauc

SEQ ID NO: 3588423 - RNA, 19 nt, Human
ugggagaaaucuggcuucu

SEQ ID NO: 3588424 - RNA, 15 nt, Human
ugggagaaaugaaaa

SEQ ID NO: 3588425 - RNA, 16 nt, Human
ugggagaaaugaaaaa

SEQ ID NO: 3588426 - RNA, 19 nt, Human
ugggagaaauugacagauc

SEQ ID NO: 3588427 - RNA, 21 nt, Human
ugggagaaccaaaaagaggcu

SEQ ID NO: 3588428 - RNA, 22 nt, Human
ugggagaaccaaaaagaggcua

SEQ ID NO: 3588429 - RNA, 14 nt, Human
ugggagaaccucag

SEQ ID NO: 3588430 - RNA, 22 nt, Human
ugggagaaccucaggcuuccuu

SEQ ID NO: 3588431 - RNA, 16 nt, Human
ugggagaagggcagag

SEQ ID NO: 3588432 - RNA, 22 nt, Human
ugggagaaugucaguaugugga

SEQ ID NO: 3588433 - RNA, 18 nt, Human
ugggagaaugucaguuca

SEQ ID NO: 3588434 - RNA, 15 nt, Human
ugggagacaugugac

SEQ ID NO: 3588435 - RNA, 20 nt, Human
ugggagaccggccugccagg

SEQ ID NO: 3588436 - RNA, 23 nt, Human
ugggagaccggccugccaggagg

SEQ ID NO: 3588437 - RNA, 18 nt, Human
ugggagaccuguaaucau

SEQ ID NO: 3588438 - RNA, 19 nt, Human
ugggagagaagagaaugca

SEQ ID NO: 3588439 - RNA, 12 nt, Human
ugggagagacuu

SEQ ID NO: 3588440 - RNA, 23 nt, Human
ugggugccccccuugccagacau

SEQ ID NO: 3588441 - RNA, 16 nt, Human
ugggugccuaggccug

SEQ ID NO: 3588442 - RNA, 20 nt, Human
ugggugcgaccccaucugcc

SEQ ID NO: 3588443 - RNA, 13 nt, Human
ugggugcucagaa

SEQ ID NO: 3588444 - RNA, 14 nt, Human
ugggugcucagaau

SEQ ID NO: 3588445 - RNA, 15 nt, Human
ugggugcucagaaua

SEQ ID NO: 3588446 - RNA, 13 nt, Human
ugggugcucccua

SEQ ID NO: 3588447 - RNA, 17 nt, Human
uggguggaaacuaagac

SEQ ID NO: 3588448 - RNA, 15 nt, Human
uggguggagaagcca

SEQ ID NO: 3588449 - RNA, 17 nt, Human
uggguggagaagccauu

SEQ ID NO: 3588450 - RNA, 21 nt, Human
uggguggagaagccauugucu

SEQ ID NO: 3588451 - RNA, 20 nt, Human
uggguggauauaaauauaua

SEQ ID NO: 3588452 - RNA, 14 nt, Human
uggguggaugccug

SEQ ID NO: 3588453 - RNA, 23 nt, Human
uggguggaugccugguggcagcu

SEQ ID NO: 3588454 - RNA, 20 nt, Human
uggguggcaccagcagccug

SEQ ID NO: 3588455 - RNA, 21 nt, Human
uggguggcaccagcagccugg

SEQ ID NO: 3588456 - RNA, 22 nt, Human
uggguggcaccagcagccugga

SEQ ID NO: 3588457 - RNA, 15 nt, Human
uggguggcacugcca

SEQ ID NO: 3588458 - RNA, 14 nt, Human
uggguggcccaucc

SEQ ID NO: 3588459 - RNA, 14 nt, Human
uggguggcuacucu

SEQ ID NO: 3588460 - RNA, 19 nt, Human
uggguggcuacucugugcc

SEQ ID NO: 3588461 - RNA, 20 nt, Human
uggguggcuacucugugcca

SEQ ID NO: 3588462 - RNA, 19 nt, Human
ugggugggcucugugcagu

SEQ ID NO: 3588463 - RNA, 14 nt, Human
uggguggggaggga

SEQ ID NO: 3588464 - RNA, 20 nt, Human
uggguggggggcauugagua

SEQ ID NO: 3588465 - RNA, 18 nt, Human
uggguggggggcuucaua

SEQ ID NO: 3588466 - RNA, 20 nt, Human
uggguggggggcuucauaca

SEQ ID NO: 3588467 - RNA, 14 nt, Human
ugggugguggggag

SEQ ID NO: 3588468 - RNA, 23 nt, Human
uggguguaacaggucuccucuua

SEQ ID NO: 3588469 - RNA, 20 nt, Human
uggguguauuaggacuggcu

SEQ ID NO: 3588470 - RNA, 23 nt, Human
ugggugucaagagggucugagga

SEQ ID NO: 3588471 - RNA, 14 nt, Human
ugggugucauuuca

SEQ ID NO: 3588472 - RNA, 19 nt, Human
ugggugucauuucauucca

SEQ ID NO: 3588473 - RNA, 20 nt, Human
ugggugucauuucauuccau

SEQ ID NO: 3588474 - RNA, 18 nt, Human
uggguguccaaaggaaga

SEQ ID NO: 3588475 - RNA, 15 nt, Human
uggguguccugccug

SEQ ID NO: 3588476 - RNA, 19 nt, Human
uggguguuccuggcaguuu

SEQ ID NO: 3588477 - RNA, 14 nt, Human
uggguuaaguauua

SEQ ID NO: 3588478 - RNA, 23 nt, Human
uggguuacaguaugcuugcucua

SEQ ID NO: 3588479 - RNA, 22 nt, Human
uggguuaggcauuaauguuucu

SEQ ID NO: 3588480 - RNA, 21 nt, Human
uggguuagggaaaacauucca

SEQ ID NO: 3588481 - RNA, 21 nt, Human
uggguucagaaaugcugccug

SEQ ID NO: 3588482 - RNA, 21 nt, Human
uggguucauccuauucuuucg

SEQ ID NO: 3588483 - RNA, 16 nt, Human
uggguucauuauugga

SEQ ID NO: 3588484 - RNA, 21 nt, Human
uggguuccagcaauucuccug

SEQ ID NO: 3588485 - RNA, 14 nt, Human
uggguuccuccucu

SEQ ID NO: 3588486 - RNA, 15 nt, Human
uggguucuacccagg

SEQ ID NO: 3588487 - RNA, 17 nt, Human
uggguucuauguuuacu

SEQ ID NO: 3588488 - RNA, 14 nt, Human
uggguucugccugc

SEQ ID NO: 3588489 - RNA, 16 nt, Human
uggguucugccugcca

SEQ ID NO: 3588490 - RNA, 17 nt, Human
uggguugcuaacugaac

SEQ ID NO: 3588491 - RNA, 23 nt, Human
uggguuggcgcacccuccccucc

SEQ ID NO: 3588492 - RNA, 20 nt, Human
uggguuggugcacagugauu

SEQ ID NO: 3588493 - RNA, 15 nt, Human
uggguugucaccaag

SEQ ID NO: 3588494 - RNA, 21 nt, Human
uggguuucuaaagcugccagc

SEQ ID NO: 3588495 - RNA, 14 nt, Human
uggguuuggacccc

SEQ ID NO: 3588496 - RNA, 19 nt, Human
uggguuuggaccccagcug

SEQ ID NO: 3588497 - RNA, 17 nt, Human
uggguuugguguauggu

SEQ ID NO: 3588498 - RNA, 14 nt, Human
uggguuuucuuccc

SEQ ID NO: 3588499 - RNA, 18 nt, Human
uggguuuuguagguacuu

SEQ ID NO: 3588500 - RNA, 19 nt, Human
uggguuuuguauucucuga

SEQ ID NO: 3588501 - RNA, 14 nt, Human
uggguuuuucccug

SEQ ID NO: 3588502 - RNA, 15 nt, Human
uggguuuuuguuacc

SEQ ID NO: 3588503 - RNA, 17 nt, Human
uggguuuuuuuccuuua

SEQ ID NO: 3588504 - RNA, 14 nt, Human
ugguaaaaagaaaa

SEQ ID NO: 3588505 - RNA, 15 nt, Human
ugguaaaaugaagaa

SEQ ID NO: 3588506 - RNA, 18 nt, Human
ugguaaaaugaagaauuu

SEQ ID NO: 3588507 - RNA, 16 nt, Human
ugguaaaauugcaugg

SEQ ID NO: 3588508 - RNA, 19 nt, Human
ugguaaacgcugucccuag

SEQ ID NO: 3588509 - RNA, 21 nt, Human
ugguaaacuauuugucuuuca

SEQ ID NO: 3588510 - RNA, 18 nt, Human
ugguaaagauauuauuca

SEQ ID NO: 3588511 - RNA, 13 nt, Human
ugguaaauguuuc

SEQ ID NO: 3588512 - RNA, 14 nt, Human
ugguaaauguuucu

SEQ ID NO: 3588513 - RNA, 16 nt, Human
ugguaaauuuccccaa

SEQ ID NO: 3588514 - RNA, 23 nt, Human
ugguaaauuuccccaacagugug

SEQ ID NO: 3588515 - RNA, 21 nt, Human
ugguaacaguucauguuugcu

SEQ ID NO: 3588516 - RNA, 14 nt, Human
ugguaacugcuuuc

SEQ ID NO: 3588517 - RNA, 14 nt, Human
ugguaacuuuugug

SEQ ID NO: 3588518 - RNA, 22 nt, Human
ugguaagaagccgggaacagac

SEQ ID NO: 3588519 - RNA, 13 nt, Human
ugguaagagaaaa

SEQ ID NO: 3588520 - RNA, 12 nt, Human
ugguaagauugu

SEQ ID NO: 3588521 - RNA, 14 nt, Human
ugguaagauuguua

SEQ ID NO: 3588522 - RNA, 19 nt, Human
ugguaagauuguuauuaaa

SEQ ID NO: 3588523 - RNA, 20 nt, Human
ugguaagauuguuauuaaau

SEQ ID NO: 3588524 - RNA, 14 nt, Human
ugguaagcucuggc

SEQ ID NO: 3588525 - RNA, 20 nt, Human
ugguaagcuuccaggaaaaa

SEQ ID NO: 3588526 - RNA, 20 nt, Human
ugguaaggggaauugaggac

SEQ ID NO: 3588527 - RNA, 16 nt, Human
ugguaauaagcacugu

SEQ ID NO: 3588528 - RNA, 23 nt, Human
ugguaauccccuaaaauaacagu

SEQ ID NO: 3588529 - RNA, 14 nt, Human
ugguaauuguacua

SEQ ID NO: 3588530 - RNA, 18 nt, Human
ugguacaaaaauaaauuu

SEQ ID NO: 3588531 - RNA, 21 nt, Human
ugguacaaaaauaaauuuaua

SEQ ID NO: 3588532 - RNA, 20 nt, Human
ugguacaacggaggccugcg

SEQ ID NO: 3588533 - RNA, 12 nt, Human
ugguacagagaa

SEQ ID NO: 3588534 - RNA, 13 nt, Human
ugguacagagaag

SEQ ID NO: 3588535 - RNA, 17 nt, Human
ugguacagagaagccag

SEQ ID NO: 3588536 - RNA, 19 nt, Human
ugguacagagaagccagcu

SEQ ID NO: 3588537 - RNA, 22 nt, Human
ugguacagagaagccagcuugu

SEQ ID NO: 3588538 - RNA, 15 nt, Human
ugguacauggccagu

SEQ ID NO: 3588539 - RNA, 16 nt, Human
ugguacauggccagug

SEQ ID NO: 3588540 - RNA, 17 nt, Human
ugguacaugucuuccau

SEQ ID NO: 3588541 - RNA, 21 nt, Human
ugguaccaaucaugaaucuuu

SEQ ID NO: 3588542 - RNA, 13 nt, Human
ugguaccagauaa

SEQ ID NO: 3588543 - RNA, 18 nt, Human
ugguaccagauaacuuuu

SEQ ID NO: 3588544 - RNA, 15 nt, Human
ugguaccagcccugg

SEQ ID NO: 3588545 - RNA, 21 nt, Human
ugguaccagcccuggggcugg

SEQ ID NO: 3588546 - RNA, 13 nt, Human
ugguacccagcca

SEQ ID NO: 3588547 - RNA, 21 nt, Human
ugguacccagccaucugccca

SEQ ID NO: 3588548 - RNA, 22 nt, Human
ugguacccagccaucugcccag

SEQ ID NO: 3588549 - RNA, 16 nt, Human
ugguacccuccuggcu

SEQ ID NO: 3588550 - RNA, 14 nt, Human
ugguacccucugga

SEQ ID NO: 3588551 - RNA, 15 nt, Human
ugguaccuugcacac

SEQ ID NO: 3588552 - RNA, 20 nt, Human
ugguacgugacccucugcug

SEQ ID NO: 3588553 - RNA, 20 nt, Human
ugguacuacuagaugucuuu

SEQ ID NO: 3588554 - RNA, 20 nt, Human
ugguacuauaaaagcuuucu

SEQ ID NO: 3588555 - RNA, 17 nt, Human
ugguacucauuaaaaaa

SEQ ID NO: 3588556 - RNA, 21 nt, Human
ugguacuguacagcuggcucu

SEQ ID NO: 3588557 - RNA, 19 nt, Human
ugguacuugcugcuauuuu

SEQ ID NO: 3588558 - RNA, 22 nt, Human
ugguacuuuuaugauguauauu

SEQ ID NO: 3588559 - RNA, 18 nt, Human
ugguacuuuugagugugu

SEQ ID NO: 3588560 - RNA, 20 nt, Human
ugguacuuuugagugugugu

SEQ ID NO: 3588561 - RNA, 17 nt, Human
ugguagauuaaauauag

SEQ ID NO: 3588562 - RNA, 14 nt, Human
ugguagcucaggug

SEQ ID NO: 3588563 - RNA, 20 nt, Human
ugguagcuuuucccuucuuu

SEQ ID NO: 3588564 - RNA, 17 nt, Human
ugguaggaauagcaugu

SEQ ID NO: 3588565 - RNA, 16 nt, Human
ugguaggaccaagcau

SEQ ID NO: 3588566 - RNA, 22 nt, Human
ugguaggaucagcccucauuuu

SEQ ID NO: 3588567 - RNA, 16 nt, Human
ugguaggcauuuccua

SEQ ID NO: 3588568 - RNA, 17 nt, Human
ugguagggacuuaaaaa

SEQ ID NO: 3588569 - RNA, 19 nt, Human
ugguagggggaaaaugugu

SEQ ID NO: 3588570 - RNA, 18 nt, Human
ugguaguaaaacacagag

SEQ ID NO: 3588571 - RNA, 22 nt, Human
ugguaguaaucacaguuggccu

SEQ ID NO: 3588572 - RNA, 22 nt, Human
ugguaguacuccugcaaaauuu

SEQ ID NO: 3588573 - RNA, 21 nt, Human
ugguagucuaaccaaaugcau

SEQ ID NO: 3588574 - RNA, 22 nt, Human
ugguagucuaaccaaaugcauc

SEQ ID NO: 3588575 - RNA, 20 nt, Human
ugguagugguuguaucugug

SEQ ID NO: 3588576 - RNA, 20 nt, Human
ugguaguuaguagcauguug

SEQ ID NO: 3588577 - RNA, 14 nt, Human
ugguaguuucugug

SEQ ID NO: 3588578 - RNA, 17 nt, Human
ugguaguuuuuucaucu

SEQ ID NO: 3588579 - RNA, 19 nt, Human
ugguauaaguaacuuuauu

SEQ ID NO: 3588580 - RNA, 13 nt, Human
ugguauagaaaug

SEQ ID NO: 3588581 - RNA, 16 nt, Human
ugguauagaaaugcug

SEQ ID NO: 3588582 - RNA, 16 nt, Human
ugguauauccaaaagc

SEQ ID NO: 3588583 - RNA, 14 nt, Human
ugguaucaaaauua

SEQ ID NO: 3588584 - RNA, 16 nt, Human
ugguaucaaaauuaca

SEQ ID NO: 3588585 - RNA, 15 nt, Human
ugguaucuaauucuu

SEQ ID NO: 3588586 - RNA, 16 nt, Human
ugguaucucagaaagu

SEQ ID NO: 3588587 - RNA, 23 nt, Human
ugguaucuguucuuuaauuuauu

SEQ ID NO: 3588588 - RNA, 16 nt, Human
ugguaucuuaaagugu

SEQ ID NO: 3588589 - RNA, 12 nt, Human
ugggcuccugga

SEQ ID NO: 3588590 - RNA, 12 nt, Human
ugggcuccuggc

SEQ ID NO: 3588591 - RNA, 15 nt, Human
ugggcucgucuuugc

SEQ ID NO: 3588592 - RNA, 21 nt, Human
ugggcucuccaccucagccuu

SEQ ID NO: 3588593 - RNA, 23 nt, Human
ugggcucuccaccucagccuugg

SEQ ID NO: 3588594 - RNA, 14 nt, Human
ugggcucuccgggg

SEQ ID NO: 3588595 - RNA, 15 nt, Human
ugggcucucgcggcc

SEQ ID NO: 3588596 - RNA, 21 nt, Human
ugggcucugaguaccccugcu

SEQ ID NO: 3588597 - RNA, 11 nt, Human
ugggcucugau

SEQ ID NO: 3588598 - RNA, 13 nt, Human
ugggcucugccac

SEQ ID NO: 3588599 - RNA, 21 nt, Human
ugggcucugugggcugcacuc

SEQ ID NO: 3588600 - RNA, 17 nt, Human
ugggcugaacacuccaa

SEQ ID NO: 3588601 - RNA, 18 nt, Human
ugggcugaauguauguaa

SEQ ID NO: 3588602 - RNA, 21 nt, Human
ugggcugaauguauguaaaua

SEQ ID NO: 3588603 - RNA, 14 nt, Human
ugggcugagacugg

SEQ ID NO: 3588604 - RNA, 12 nt, Human
ugggcugaggga

SEQ ID NO: 3588605 - RNA, 20 nt, Human
ugggcugcacucugugccca

SEQ ID NO: 3588606 - RNA, 22 nt, Human
ugggcugcacucugugcccaug

SEQ ID NO: 3588607 - RNA, 16 nt, Human
ugggcuggaugagcuc

SEQ ID NO: 3588608 - RNA, 18 nt, Human
ugggcuggaugagcuccc

SEQ ID NO: 3588609 - RNA, 14 nt, Human
ugggcugggcacug

SEQ ID NO: 3588610 - RNA, 20 nt, Human
ugggcugggcccucucuucu

SEQ ID NO: 3588611 - RNA, 23 nt, Human
ugggcuggguucuacccaggugc

SEQ ID NO: 3588612 - RNA, 14 nt, Human
ugggcugguaucuc

SEQ ID NO: 3588613 - RNA, 22 nt, Human
ugggcugguauugguggcuuuc

SEQ ID NO: 3588614 - RNA, 14 nt, Human
ugggcuuagagcag

SEQ ID NO: 3588615 - RNA, 21 nt, Human
ugggcuuauaucuggccucug

SEQ ID NO: 3588616 - RNA, 22 nt, Human
ugggcuuauaucuggccucugc

SEQ ID NO: 3588617 - RNA, 17 nt, Human
ugggcuucacuguauaa

SEQ ID NO: 3588618 - RNA, 14 nt, Human
ugggcuucagcugc

SEQ ID NO: 3588619 - RNA, 17 nt, Human
ugggcuucaguggcagc

SEQ ID NO: 3588620 - RNA, 21 nt, Human
ugggcuucaguggcagcugcu

SEQ ID NO: 3588621 - RNA, 13 nt, Human
ugggcuucaucug

SEQ ID NO: 3588622 - RNA, 23 nt, Human
ugggcuuccauuugugugugugc

SEQ ID NO: 3588623 - RNA, 13 nt, Human
ugggcuucccaag

SEQ ID NO: 3588624 - RNA, 13 nt, Human
ugggcuugauucu

SEQ ID NO: 3588625 - RNA, 21 nt, Human
ugggcuugcuauucugucccu

SEQ ID NO: 3588626 - RNA, 17 nt, Human
ugggcuuggccugcugu

SEQ ID NO: 3588627 - RNA, 13 nt, Human
ugggcuugggccu

SEQ ID NO: 3588628 - RNA, 15 nt, Human
ugggcuugggccuag

SEQ ID NO: 3588629 - RNA, 18 nt, Human
ugggcuugggccuaggcu

SEQ ID NO: 3588630 - RNA, 23 nt, Human
ugggcuuggggaccagagcugcc

SEQ ID NO: 3588631 - RNA, 17 nt, Human
ugggcuugucuguagau

SEQ ID NO: 3588632 - RNA, 21 nt, Human
ugggcuugucuguagauuuua

SEQ ID NO: 3588633 - RNA, 22 nt, Human
ugggcuuguggggccugggagg

SEQ ID NO: 3588634 - RNA, 20 nt, Human
ugggcuuugauuccaucucc

SEQ ID NO: 3588635 - RNA, 20 nt, Human
ugggcuuuuggggagccaga

SEQ ID NO: 3588636 - RNA, 21 nt, Human
ugggcuuuuggggagccagaa

SEQ ID NO: 3588637 - RNA, 17 nt, Human
uggggaaaaaaaucauc

SEQ ID NO: 3588638 - RNA, 21 nt, Human
uggggaaacaacauuuauaug

SEQ ID NO: 3588639 - RNA, 19 nt, Human
uggggaaagacacugccug

SEQ ID NO: 3588640 - RNA, 20 nt, Human
uggggaaagggguuggggug

SEQ ID NO: 3588641 - RNA, 13 nt, Human
uggggaagacagu

SEQ ID NO: 3588642 - RNA, 14 nt, Human
uggggaagacagug

SEQ ID NO: 3588643 - RNA, 24 nt, Human
uggggaagacccauuccuucccag

SEQ ID NO: 3588644 - RNA, 16 nt, Human
uggggaagacuguggc

SEQ ID NO: 3588645 - RNA, 15 nt, Human
uggggaagagagccu

SEQ ID NO: 3588646 - RNA, 13 nt, Human
uggggaaggaggc

SEQ ID NO: 3588647 - RNA, 15 nt, Human
uggggaaugaagaua

SEQ ID NO: 3588648 - RNA, 21 nt, Human
uggggacagauucagucuugc

SEQ ID NO: 3588649 - RNA, 17 nt, Human
uggggacaugggucgcc

SEQ ID NO: 3588650 - RNA, 22 nt, Human
uggggacccaggcuccgcccuu

SEQ ID NO: 3588651 - RNA, 13 nt, Human
uggggaccucagg

SEQ ID NO: 3588652 - RNA, 16 nt, Human
uggggaccucaggccu

SEQ ID NO: 3588653 - RNA, 23 nt, Human
uggggaccucaggccugggggcu

SEQ ID NO: 3588654 - RNA, 18 nt, Human
uggggaccugguacccuc

SEQ ID NO: 3588655 - RNA, 20 nt, Human
uggggacggggggccccagu

SEQ ID NO: 3588656 - RNA, 20 nt, Human
uggggacguccugccaccug

SEQ ID NO: 3588657 - RNA, 21 nt, Human
uggggacguccugccaccugg

SEQ ID NO: 3588658 - RNA, 22 nt, Human
uggggacuccggcugugcuggg

SEQ ID NO: 3588659 - RNA, 14 nt, Human
uggggacuuggccu

SEQ ID NO: 3588660 - RNA, 16 nt, Human
uggggacuugugucug

SEQ ID NO: 3588661 - RNA, 12 nt, Human
uggggagaaagu

SEQ ID NO: 3588662 - RNA, 23 nt, Human
uggggagacauaaccacugcuuc

SEQ ID NO: 3588663 - RNA, 13 nt, Human
uggggagagacgg

SEQ ID NO: 3588664 - RNA, 15 nt, Human
uggggagaggaacuc

SEQ ID NO: 3588665 - RNA, 23 nt, Human
uggggagaucggggccagaggca

SEQ ID NO: 3588666 - RNA, 23 nt, Human
uggggagcuuggcugagggucug

SEQ ID NO: 3588667 - RNA, 18 nt, Human
uggggaggacaaaacuuc

SEQ ID NO: 3588668 - RNA, 12 nt, Human
uggggaggagga

SEQ ID NO: 3588669 - RNA, 22 nt, Human
uggggagggauucugguuccag

SEQ ID NO: 3588670 - RNA, 22 nt, Human
uggggagggauuuggggcucag

SEQ ID NO: 3588671 - RNA, 17 nt, Human
uggggagggccguaccc

SEQ ID NO: 3588672 - RNA, 22 nt, Human
uggggaggggcgcuggcccagc

SEQ ID NO: 3588673 - RNA, 16 nt, Human
uggggaggugucacau

SEQ ID NO: 3588674 - RNA, 19 nt, Human
uggggaguaggacauacca

SEQ ID NO: 3588675 - RNA, 13 nt, Human
uggggagugggac

SEQ ID NO: 3588676 - RNA, 19 nt, Human
uggggaguuaagaccuggc

SEQ ID NO: 3588677 - RNA, 19 nt, Human
uggggaguuuagggugggg

SEQ ID NO: 3588678 - RNA, 16 nt, Human
uggggauaaaaugacu

SEQ ID NO: 3588679 - RNA, 20 nt, Human
uggggauaaaaugacuacuu

SEQ ID NO: 3588680 - RNA, 16 nt, Human
uggggauagaugugug

SEQ ID NO: 3588681 - RNA, 21 nt, Human
uggggauccccgccuggccag

SEQ ID NO: 3588682 - RNA, 23 nt, Human
uggggauccccgccuggccagga

SEQ ID NO: 3588683 - RNA, 20 nt, Human
uggggaucccucccccccau

SEQ ID NO: 3588684 - RNA, 22 nt, Human
uggggaugguaguuuuuucauc

SEQ ID NO: 3588685 - RNA, 15 nt, Human
uggggaugugggagg

SEQ ID NO: 3588686 - RNA, 16 nt, Human
uggggauucagauuuc

SEQ ID NO: 3588687 - RNA, 18 nt, Human
uggggauucagauuucuc

SEQ ID NO: 3588688 - RNA, 12 nt, Human
uggggcaaggcu

SEQ ID NO: 3588689 - RNA, 15 nt, Human
uggggcaagucaugu

SEQ ID NO: 3588690 - RNA, 19 nt, Human
uggggcagaaaucugagga

SEQ ID NO: 3588691 - RNA, 13 nt, Human
uggggcagagccu

SEQ ID NO: 3588692 - RNA, 14 nt, Human
uggggcagagccuc

SEQ ID NO: 3588693 - RNA, 15 nt, Human
uggggcagcuccucu

SEQ ID NO: 3588694 - RNA, 12 nt, Human
uggggcaggagu

SEQ ID NO: 3588695 - RNA, 14 nt, Human
uggggcaggaguag

SEQ ID NO: 3588696 - RNA, 18 nt, Human
uggggcaggaguagcuga

SEQ ID NO: 3588697 - RNA, 12 nt, Human
uggggcaggcag

SEQ ID NO: 3588698 - RNA, 14 nt, Human
uggggcaggcagug

SEQ ID NO: 3588699 - RNA, 21 nt, Human
uggggcaggccaccuggcucu

SEQ ID NO: 3588700 - RNA, 17 nt, Human
uggggcaggcugggcca

SEQ ID NO: 3588701 - RNA, 13 nt, Human
uggggcagggagc

SEQ ID NO: 3588702 - RNA, 16 nt, Human
uggggcaggggccggg

SEQ ID NO: 3588703 - RNA, 18 nt, Human
uggggcaggggccggggg

SEQ ID NO: 3588704 - RNA, 22 nt, Human
uggggcagucaccugcccagau

SEQ ID NO: 3588705 - RNA, 18 nt, Human
uggggcagugcuuggccc

SEQ ID NO: 3588706 - RNA, 22 nt, Human
uggggcagugcuuggcccagga

SEQ ID NO: 3588707 - RNA, 13 nt, Human
uggggccacagcc

SEQ ID NO: 3588708 - RNA, 14 nt, Human
uggggccacagcca

SEQ ID NO: 3588709 - RNA, 16 nt, Human
uggggccacagccaga

SEQ ID NO: 3588710 - RNA, 21 nt, Human
uggggccaccaaagcugccca

SEQ ID NO: 3588711 - RNA, 13 nt, Human
uggggccagaucc

SEQ ID NO: 3588712 - RNA, 15 nt, Human
uggggccagauccag

SEQ ID NO: 3588713 - RNA, 19 nt, Human
uggggccagauccagccug

SEQ ID NO: 3588714 - RNA, 21 nt, Human
uggggccagauccagccuggg

SEQ ID NO: 3588715 - RNA, 13 nt, Human
uggggccaggccg

SEQ ID NO: 3588716 - RNA, 17 nt, Human
uggggccaggcuggguc

SEQ ID NO: 3588717 - RNA, 22 nt, Human
uggggccaggcugggucgcccu

SEQ ID NO: 3588718 - RNA, 15 nt, Human
uggggccaggucacc

SEQ ID NO: 3588719 - RNA, 20 nt, Human
uggggccaguuggucccccu

SEQ ID NO: 3588720 - RNA, 20 nt, Human
uggggccaugccuccucagg

SEQ ID NO: 3588721 - RNA, 19 nt, Human
uggggcccagugcauggug

SEQ ID NO: 3588722 - RNA, 22 nt, Human
uggggcccagugcaugguggcc

SEQ ID NO: 3588723 - RNA, 22 nt, Human
uggggccccuuuuuacuccccu

SEQ ID NO: 3588724 - RNA, 20 nt, Human
uggggcccuaauucagccau

SEQ ID NO: 3588725 - RNA, 21 nt, Human
uggggcccuaauucagccaug

SEQ ID NO: 3588726 - RNA, 17 nt, Human
uggggccuaauaaaacu

SEQ ID NO: 3588727 - RNA, 16 nt, Human
uggggccuagacucug

SEQ ID NO: 3588728 - RNA, 22 nt, Human
uggggccuaucagugugccccc

SEQ ID NO: 3588729 - RNA, 14 nt, Human
uggggccuccagaa

SEQ ID NO: 3588730 - RNA, 11 nt, Human
uggggccucug

SEQ ID NO: 3588731 - RNA, 20 nt, Human
uggggccuggaccugccucc

SEQ ID NO: 3588732 - RNA, 22 nt, Human
uggggccugggacaacugcucc

SEQ ID NO: 3588733 - RNA, 22 nt, Human
uggggccuguggaaugagugug

SEQ ID NO: 3588734 - RNA, 13 nt, Human
uggggcgaggcag

SEQ ID NO: 3588735 - RNA, 15 nt, Human
uggggcgaggcagag

SEQ ID NO: 3588736 - RNA, 18 nt, Human
uggggcgaggcagaggac

SEQ ID NO: 3588737 - RNA, 19 nt, Human
uggggcgaggcagaggaca

SEQ ID NO: 3588738 - RNA, 19 nt, Human
ugguucuuaguucucacug

SEQ ID NO: 3588739 - RNA, 15 nt, Human
ugguucuugagggga

SEQ ID NO: 3588740 - RNA, 19 nt, Human
ugguucuuguauuaagaau

SEQ ID NO: 3588741 - RNA, 16 nt, Human
ugguugaaaauaaaaa

SEQ ID NO: 3588742 - RNA, 22 nt, Human
ugguugagguggaagcccuccu

SEQ ID NO: 3588743 - RNA, 14 nt, Human
ugguugaugccaaa

SEQ ID NO: 3588744 - RNA, 16 nt, Human
ugguuggagaauuuag

SEQ ID NO: 3588745 - RNA, 16 nt, Human
ugguugggaaugagga

SEQ ID NO: 3588746 - RNA, 19 nt, Human
ugguuggggcccugcccug

SEQ ID NO: 3588747 - RNA, 19 nt, Human
ugguuggguggcaauucca

SEQ ID NO: 3588748 - RNA, 14 nt, Human
ugguuguaucugug

SEQ ID NO: 3588749 - RNA, 16 nt, Human
ugguuguauuagaugu

SEQ ID NO: 3588750 - RNA, 15 nt, Human
ugguugugucugcuu

SEQ ID NO: 3588751 - RNA, 14 nt, Human
ugguugugucuuuu

SEQ ID NO: 3588752 - RNA, 23 nt, Human
ugguuuaaaagacacacuugucc

SEQ ID NO: 3588753 - RNA, 17 nt, Human
ugguuuaaagaaagugu

SEQ ID NO: 3588754 - RNA, 17 nt, Human
ugguuuacacuuuaugc

SEQ ID NO: 3588755 - RNA, 13 nt, Human
ugguuuacauuua

SEQ ID NO: 3588756 - RNA, 14 nt, Human
ugguuuacauuuaa

SEQ ID NO: 3588757 - RNA, 15 nt, Human
ugguuuacuuucaaa

SEQ ID NO: 3588758 - RNA, 14 nt, Human
ugguuuaguguaaa

SEQ ID NO: 3588759 - RNA, 20 nt, Human
ugguuuaguguaaaaaugag

SEQ ID NO: 3588760 - RNA, 21 nt, Human
ugguuucacggugccagguuu

SEQ ID NO: 3588761 - RNA, 16 nt, Human
ugguuucacuggccca

SEQ ID NO: 3588762 - RNA, 20 nt, Human
ugguuucagcacuagccaaa

SEQ ID NO: 3588763 - RNA, 12 nt, Human
ugguuucauguu

SEQ ID NO: 3588764 - RNA, 16 nt, Human
ugguuuccaaggagcu

SEQ ID NO: 3588765 - RNA, 17 nt, Human
ugguuucccaagagcua

SEQ ID NO: 3588766 - RNA, 22 nt, Human
ugguuuccuccauuugagaaaa

SEQ ID NO: 3588767 - RNA, 20 nt, Human
ugguuuccugcccugggagg

SEQ ID NO: 3588768 - RNA, 15 nt, Human
ugguuucucauucuu

SEQ ID NO: 3588769 - RNA, 16 nt, Human
ugguuucucauucuug

SEQ ID NO: 3588770 - RNA, 15 nt, Human
ugguuucucuucucc

SEQ ID NO: 3588771 - RNA, 19 nt, Human
ugguuucucuucuccccuu

SEQ ID NO: 3588772 - RNA, 23 nt, Human
ugguuucuucaacaggagaauuu

SEQ ID NO: 3588773 - RNA, 21 nt, Human
ugguuugagacacugguuuac

SEQ ID NO: 3588774 - RNA, 20 nt, Human
ugguuugauggugacuuccu

SEQ ID NO: 3588775 - RNA, 15 nt, Human
ugguuugcagagcuu

SEQ ID NO: 3588776 - RNA, 19 nt, Human
ugguuugcagaugacaaaa

SEQ ID NO: 3588777 - RNA, 17 nt, Human
ugguuuggaauauuaaa

SEQ ID NO: 3588778 - RNA, 22 nt, Human
ugguuuggaaugcuucuucuca

SEQ ID NO: 3588779 - RNA, 22 nt, Human
ugguuuggcccuucuccuuuug

SEQ ID NO: 3588780 - RNA, 23 nt, Human
ugguuuggcccuucuccuuuuga

SEQ ID NO: 3588781 - RNA, 17 nt, Human
ugguuugggggagaaga

SEQ ID NO: 3588782 - RNA, 17 nt, Human
ugguuugguuccucucu

SEQ ID NO: 3588783 - RNA, 14 nt, Human
ugguuuuaaaauac

SEQ ID NO: 3588784 - RNA, 21 nt, Human
ugguuuuaaaauacuguagau

SEQ ID NO: 3588785 - RNA, 12 nt, Human
ugguuuuaacaa

SEQ ID NO: 3588786 - RNA, 18 nt, Human
ugguuuuaacaauuuccu

SEQ ID NO: 3588787 - RNA, 21 nt, Human
ugguuuuaauugaaggaaaga

SEQ ID NO: 3588788 - RNA, 14 nt, Human
ugguuuuagauuuu

SEQ ID NO: 3588789 - RNA, 16 nt, Human
ugguuuuauacugaag

SEQ ID NO: 3588790 - RNA, 23 nt, Human
ugguuuuauacugaaggaaaaac

SEQ ID NO: 3588791 - RNA, 12 nt, Human
ugguuuuaugau

SEQ ID NO: 3588792 - RNA, 17 nt, Human
ugguuuucaaaauaaaa

SEQ ID NO: 3588793 - RNA, 16 nt, Human
ugguuuuccuaaaugc

SEQ ID NO: 3588794 - RNA, 19 nt, Human
ugguuuucuccaagagcua

SEQ ID NO: 3588795 - RNA, 13 nt, Human
ugguuuucuguuc

SEQ ID NO: 3588796 - RNA, 13 nt, Human
ugguuuucuguuu

SEQ ID NO: 3588797 - RNA, 14 nt, Human
ugguuuucuuaagg

SEQ ID NO: 3588798 - RNA, 21 nt, Human
ugguuuucuucuucucguccu

SEQ ID NO: 3588799 - RNA, 19 nt, Human
ugguuuucuuguguguuua

SEQ ID NO: 3588800 - RNA, 18 nt, Human
ugguuuucuuuugccaug

SEQ ID NO: 3588801 - RNA, 16 nt, Human
ugguuuugugccaucu

SEQ ID NO: 3588802 - RNA, 17 nt, Human
ugguuuuuguagccuuc

SEQ ID NO: 3588803 - RNA, 22 nt, Human
ugguuuuuguagccuuccucca

SEQ ID NO: 3588804 - RNA, 13 nt, Human
uguaaaaaaaaaa

SEQ ID NO: 3588805 - RNA, 14 nt, Human
uguaaaaaaaccac

SEQ ID NO: 3588806 - RNA, 19 nt, Human
uguaaaaacagcauugcuu

SEQ ID NO: 3588807 - RNA, 22 nt, Human
uguaaaaacagcauugcuuucu

SEQ ID NO: 3588808 - RNA, 23 nt, Human
uguaaaaacagcauugcuuucug

SEQ ID NO: 3588809 - RNA, 12 nt, Human
uguaaaaagaaa

SEQ ID NO: 3588810 - RNA, 16 nt, Human
uguaaaaaucuuuuga

SEQ ID NO: 3588811 - RNA, 11 nt, Human
uguaaaaauga

SEQ ID NO: 3588812 - RNA, 15 nt, Human
uguaaaacaaaaaac

SEQ ID NO: 3588813 - RNA, 23 nt, Human
uguaaaacaaaaauguaaugauc

SEQ ID NO: 3588814 - RNA, 12 nt, Human
uguaaaacaggu

SEQ ID NO: 3588815 - RNA, 18 nt, Human
uguaaaaccugucaauga

SEQ ID NO: 3588816 - RNA, 18 nt, Human
uguaaaacuuuauuuuau

SEQ ID NO: 3588817 - RNA, 23 nt, Human
uguaaaacuuuauuuuauauaau

SEQ ID NO: 3588818 - RNA, 12 nt, Human
uguaaaagaaau

SEQ ID NO: 3588819 - RNA, 13 nt, Human
uguaaaagaaauc

SEQ ID NO: 3588820 - RNA, 19 nt, Human
uguaaaagaacaguaaaca

SEQ ID NO: 3588821 - RNA, 12 nt, Human
uguaaaagcaag

SEQ ID NO: 3588822 - RNA, 17 nt, Human
uguaaaagcauuuugua

SEQ ID NO: 3588823 - RNA, 18 nt, Human
uguaaaauaagaaugauu

SEQ ID NO: 3588824 - RNA, 21 nt, Human
uguaaaauagcuuguauagug

SEQ ID NO: 3588825 - RNA, 11 nt, Human
uguaaaauaua

SEQ ID NO: 3588826 - RNA, 21 nt, Human
uguaaaauauagcuguacaaa

SEQ ID NO: 3588827 - RNA, 19 nt, Human
uguaaaauauuuugaauca

SEQ ID NO: 3588828 - RNA, 21 nt, Human
uguaaaauauuuugaaucaau

SEQ ID NO: 3588829 - RNA, 21 nt, Human
uguaaaaucuuucuuucuuag

SEQ ID NO: 3588830 - RNA, 23 nt, Human
uguaaaaucuuucuuucuuagaa

SEQ ID NO: 3588831 - RNA, 14 nt, Human
uguaaaaugaaauu

SEQ ID NO: 3588832 - RNA, 19 nt, Human
uguaaaaugacaaucaugu

SEQ ID NO: 3588833 - RNA, 11 nt, Human
uguaaaauggu

SEQ ID NO: 3588834 - RNA, 19 nt, Human
uguaaaauguauuaugucc

SEQ ID NO: 3588835 - RNA, 15 nt, Human
uguaaacaaacucuu

SEQ ID NO: 3588836 - RNA, 18 nt, Human
uguaaacagccucuuuuu

SEQ ID NO: 3588837 - RNA, 12 nt, Human
uguaaacagugc

SEQ ID NO: 3588838 - RNA, 22 nt, Human
uguaaacauguguuuuaauucc

SEQ ID NO: 3588839 - RNA, 13 nt, Human
uguaaacauuuau

SEQ ID NO: 3588840 - RNA, 23 nt, Human
uguaaaccacaaggcuguugcau

SEQ ID NO: 3588841 - RNA, 16 nt, Human
uguaaacucaaaacuu

SEQ ID NO: 3588842 - RNA, 21 nt, Human
uguaaacucaaaacuuaacau

SEQ ID NO: 3588843 - RNA, 18 nt, Human
uguaaacugcauuagaaa

SEQ ID NO: 3588844 - RNA, 20 nt, Human
uguaaacuggaauuaaaagg

SEQ ID NO: 3588845 - RNA, 19 nt, Human
uguaaacuguacuagucug

SEQ ID NO: 3588846 - RNA, 14 nt, Human
uguaaacugugcac

SEQ ID NO: 3588847 - RNA, 15 nt, Human
uguaaacugugcacc

SEQ ID NO: 3588848 - RNA, 14 nt, Human
uguaaacuguguau

SEQ ID NO: 3588849 - RNA, 19 nt, Human
uguaaacuguguauuccaa

SEQ ID NO: 3588850 - RNA, 14 nt, Human
uguaaacuuugaaa

SEQ ID NO: 3588851 - RNA, 17 nt, Human
uguaaacuuugaaauau

SEQ ID NO: 3588852 - RNA, 13 nt, Human
uguaaagaaagag

SEQ ID NO: 3588853 - RNA, 15 nt, Human
uguaaagaaagagag

SEQ ID NO: 3588854 - RNA, 16 nt, Human
uguaaagaaagagaga

SEQ ID NO: 3588855 - RNA, 19 nt, Human
uguaaagaaagagagaaaa

SEQ ID NO: 3588856 - RNA, 20 nt, Human
uguaaagaaagagagaaaau

SEQ ID NO: 3588857 - RNA, 12 nt, Human
uguaaagacugg

SEQ ID NO: 3588858 - RNA, 21 nt, Human
uguaaagagaccuaccucagg

SEQ ID NO: 3588859 - RNA, 15 nt, Human
uguaaagcaauaaaa

SEQ ID NO: 3588860 - RNA, 12 nt, Human
uguaaagcauuc

SEQ ID NO: 3588861 - RNA, 17 nt, Human
uguaaagcauuccaaca

SEQ ID NO: 3588862 - RNA, 18 nt, Human
uguaaagcauuccaacaa

SEQ ID NO: 3588863 - RNA, 13 nt, Human
uguaaagccaugc

SEQ ID NO: 3588864 - RNA, 21 nt, Human
uguaaaggagucaaaacuaca

SEQ ID NO: 3588865 - RNA, 18 nt, Human
uguaaaguauguaaacag

SEQ ID NO: 3588866 - RNA, 16 nt, Human
uguaaaguguaaaucc

SEQ ID NO: 3588867 - RNA, 13 nt, Human
uguaaaguguggu

SEQ ID NO: 3588868 - RNA, 22 nt, Human
uguaaaguguggucccaacagg

SEQ ID NO: 3588869 - RNA, 20 nt, Human
uguaaagugugugauugaag

SEQ ID NO: 3588870 - RNA, 20 nt, Human
uguaaaguugguuggauaag

SEQ ID NO: 3588871 - RNA, 18 nt, Human
uguaaauaaagcccuggg

SEQ ID NO: 3588872 - RNA, 21 nt, Human
uguaaauaaccccauucuuug

SEQ ID NO: 3588873 - RNA, 15 nt, Human
uguaaauaagagauu

SEQ ID NO: 3588874 - RNA, 22 nt, Human
uguaaauaauacauuauauuuc

SEQ ID NO: 3588875 - RNA, 13 nt, Human
uguaaauacauaa

SEQ ID NO: 3588876 - RNA, 11 nt, Human
uguaaauacca

SEQ ID NO: 3588877 - RNA, 15 nt, Human
uguaaauaccauuga

SEQ ID NO: 3588878 - RNA, 15 nt, Human
uguaaauacccauau

SEQ ID NO: 3588879 - RNA, 13 nt, Human
uguaaauauaaag

SEQ ID NO: 3588880 - RNA, 13 nt, Human
uguaaauauauaa

SEQ ID NO: 3588881 - RNA, 14 nt, Human
uguaaauauauaaa

SEQ ID NO: 3588882 - RNA, 16 nt, Human
uguaaauauauaaaua

SEQ ID NO: 3588883 - RNA, 18 nt, Human
uguaaauauauaaauaua

SEQ ID NO: 3588884 - RNA, 16 nt, Human
uguaaauauucuauau

SEQ ID NO: 3588885 - RNA, 20 nt, Human
uguaaauauucuauaugaau

SEQ ID NO: 3588886 - RNA, 15 nt, Human
uguaaauauugugug

SEQ ID NO: 3588887 - RNA, 13 nt, Human
uguaaauauuuau

SEQ ID NO: 3588888 - RNA, 18 nt, Human
uguaaauauuuauuuaug

SEQ ID NO: 3588889 - RNA, 21 nt, Human
ugguaugaacuugaggacaca

SEQ ID NO: 3588890 - RNA, 14 nt, Human
ugguaugagcugag

SEQ ID NO: 3588891 - RNA, 15 nt, Human
ugguaugagcugagg

SEQ ID NO: 3588892 - RNA, 16 nt, Human
ugguaugagcugaggg

SEQ ID NO: 3588893 - RNA, 18 nt, Human
ugguaugaucacggcuca

SEQ ID NO: 3588894 - RNA, 14 nt, Human
ugguauggguuucu

SEQ ID NO: 3588895 - RNA, 21 nt, Human
ugguaugugacaugcgggcug

SEQ ID NO: 3588896 - RNA, 12 nt, Human
ugguaugugugu

SEQ ID NO: 3588897 - RNA, 21 nt, Human
ugguauguuuucaggcuagau

SEQ ID NO: 3588898 - RNA, 15 nt, Human
ugguauuaaaugcca

SEQ ID NO: 3588899 - RNA, 22 nt, Human
ugguauuguauuuauucaauaa

SEQ ID NO: 3588900 - RNA, 13 nt, Human
ugguauuuucaau

SEQ ID NO: 3588901 - RNA, 18 nt, Human
ugguauuuuuuuaaauca

SEQ ID NO: 3588902 - RNA, 16 nt, Human
uggucaaacaaacucu

SEQ ID NO: 3588903 - RNA, 21 nt, Human
uggucaaacaaacucucugaa

SEQ ID NO: 3588904 - RNA, 14 nt, Human
uggucaaaccgcac

SEQ ID NO: 3588905 - RNA, 17 nt, Human
uggucaaaccgcacuca

SEQ ID NO: 3588906 - RNA, 21 nt, Human
uggucaaaccgcacucaccca

SEQ ID NO: 3588907 - RNA, 16 nt, Human
uggucaaccuccugga

SEQ ID NO: 3588908 - RNA, 23 nt, Human
uggucaagggcugucauugcaca

SEQ ID NO: 3588909 - RNA, 15 nt, Human
uggucacacacugau

SEQ ID NO: 3588910 - RNA, 12 nt, Human
uggucacagaga

SEQ ID NO: 3588911 - RNA, 14 nt, Human
uggucacagccagg

SEQ ID NO: 3588912 - RNA, 18 nt, Human
uggucacagccuccucug

SEQ ID NO: 3588913 - RNA, 13 nt, Human
uggucacagcugu

SEQ ID NO: 3588914 - RNA, 17 nt, Human
uggucacaggaaguaga

SEQ ID NO: 3588915 - RNA, 19 nt, Human
uggucacaggacucugccu

SEQ ID NO: 3588916 - RNA, 22 nt, Human
uggucacaggacucugccuccu

SEQ ID NO: 3588917 - RNA, 14 nt, Human
uggucaccagcucc

SEQ ID NO: 3588918 - RNA, 23 nt, Human
uggucaccuaggaagccucagau

SEQ ID NO: 3588919 - RNA, 19 nt, Human
uggucacguuuggugcuuc

SEQ ID NO: 3588920 - RNA, 15 nt, Human
uggucacugcuguca

SEQ ID NO: 3588921 - RNA, 15 nt, Human
uggucagauuugaac

SEQ ID NO: 3588922 - RNA, 16 nt, Human
uggucagauuugaacu

SEQ ID NO: 3588923 - RNA, 22 nt, Human
uggucagauuugaacucuucaa

SEQ ID NO: 3588924 - RNA, 11 nt, Human
uggucagccca

SEQ ID NO: 3588925 - RNA, 12 nt, Human
uggucagcccaa

SEQ ID NO: 3588926 - RNA, 15 nt, Human
uggucagcccuaggg

SEQ ID NO: 3588927 - RNA, 15 nt, Human
uggucaggcccuggu

SEQ ID NO: 3588928 - RNA, 22 nt, Human
uggucaguuugguuguguaaga

SEQ ID NO: 3588929 - RNA, 21 nt, Human
ugguccaaaagauugcugaaa

SEQ ID NO: 3588930 - RNA, 23 nt, Human
ugguccaaaagauugcugaaauu

SEQ ID NO: 3588931 - RNA, 15 nt, Human
ugguccaacugcaac

SEQ ID NO: 3588932 - RNA, 15 nt, Human
ugguccaauuaguuu

SEQ ID NO: 3588933 - RNA, 16 nt, Human
ugguccacuuuuccag

SEQ ID NO: 3588934 - RNA, 22 nt, Human
ugguccagcuugcucuucagug

SEQ ID NO: 3588935 - RNA, 16 nt, Human
ugguccaggagaaggc

SEQ ID NO: 3588936 - RNA, 19 nt, Human
ugguccauagagagcaaga

SEQ ID NO: 3588937 - RNA, 15 nt, Human
ugguccaugcagggg

SEQ ID NO: 3588938 - RNA, 21 nt, Human
uggucccaacaggaggacaau

SEQ ID NO: 3588939 - RNA, 17 nt, Human
uggucccacaucccugg

SEQ ID NO: 3588940 - RNA, 21 nt, Human
uggucccacaucccugggccu

SEQ ID NO: 3588941 - RNA, 13 nt, Human
uggucccacccca

SEQ ID NO: 3588942 - RNA, 15 nt, Human
uggucccaccccaca

SEQ ID NO: 3588943 - RNA, 13 nt, Human
uggucccauccag

SEQ ID NO: 3588944 - RNA, 15 nt, Human
uggucccauccaggc

SEQ ID NO: 3588945 - RNA, 16 nt, Human
uggucccauccaggca

SEQ ID NO: 3588946 - RNA, 22 nt, Human
ugguccccuccuucccaaguga

SEQ ID NO: 3588947 - RNA, 13 nt, Human
uggucccugagga

SEQ ID NO: 3588948 - RNA, 13 nt, Human
uggucccugccuu

SEQ ID NO: 3588949 - RNA, 12 nt, Human
uggucccugggu

SEQ ID NO: 3588950 - RNA, 19 nt, Human
ugguccggacacuccuaga

SEQ ID NO: 3588951 - RNA, 19 nt, Human
ugguccgugcuaaggacuu

SEQ ID NO: 3588952 - RNA, 20 nt, Human
ugguccgugggacggugccc

SEQ ID NO: 3588953 - RNA, 16 nt, Human
ugguccuaaaagcaaa

SEQ ID NO: 3588954 - RNA, 23 nt, Human
ugguccuaaaagcaaaauaaaaa

SEQ ID NO: 3588955 - RNA, 19 nt, Human
ugguccuaagucccugccc

SEQ ID NO: 3588956 - RNA, 16 nt, Human
ugguccuauggccuca

SEQ ID NO: 3588957 - RNA, 14 nt, Human
ugguccucuugcca

SEQ ID NO: 3588958 - RNA, 15 nt, Human
ugguccucuugccau

SEQ ID NO: 3588959 - RNA, 12 nt, Human
ugguccugacuc

SEQ ID NO: 3588960 - RNA, 19 nt, Human
ugguccuggggcucugugc

SEQ ID NO: 3588961 - RNA, 16 nt, Human
ugguccuguccccgca

SEQ ID NO: 3588962 - RNA, 20 nt, Human
ugguccuuuacacucaggcu

SEQ ID NO: 3588963 - RNA, 16 nt, Human
uggucgaggaguaaca

SEQ ID NO: 3588964 - RNA, 18 nt, Human
uggucgccuuccaccucu

SEQ ID NO: 3588965 - RNA, 17 nt, Human
uggucggaaaacaugcu

SEQ ID NO: 3588966 - RNA, 22 nt, Human
uggucguuuuuuuuuuguuugu

SEQ ID NO: 3588967 - RNA, 18 nt, Human
uggucuaaaaauaaacca

SEQ ID NO: 3588968 - RNA, 12 nt, Human
uggucuaaaacu

SEQ ID NO: 3588969 - RNA, 14 nt, Human
uggucuaauguuua

SEQ ID NO: 3588970 - RNA, 19 nt, Human
uggucuaauguuuaagcag

SEQ ID NO: 3588971 - RNA, 16 nt, Human
uggucucaaacucuug

SEQ ID NO: 3588972 - RNA, 17 nt, Human
uggucucaaacucuuga

SEQ ID NO: 3588973 - RNA, 14 nt, Human
uggucucacccugg

SEQ ID NO: 3588974 - RNA, 15 nt, Human
uggucucacccugga

SEQ ID NO: 3588975 - RNA, 23 nt, Human
uggucucccauaugcagaaauag

SEQ ID NO: 3588976 - RNA, 17 nt, Human
uggucuccucagccucc

SEQ ID NO: 3588977 - RNA, 23 nt, Human
uggucuccucagccuccucaucu

SEQ ID NO: 3588978 - RNA, 18 nt, Human
uggucuccugcccccaca

SEQ ID NO: 3588979 - RNA, 15 nt, Human
uggucucgaacuccu

SEQ ID NO: 3588980 - RNA, 20 nt, Human
uggucucgaacuccugaccu

SEQ ID NO: 3588981 - RNA, 22 nt, Human
uggucucgucuuccgucucccc

SEQ ID NO: 3588982 - RNA, 17 nt, Human
uggucucuaggcugggg

SEQ ID NO: 3588983 - RNA, 13 nt, Human
uggucucugccau

SEQ ID NO: 3588984 - RNA, 13 nt, Human
uggucucuugcuu

SEQ ID NO: 3588985 - RNA, 12 nt, Human
uggucugaaugu

SEQ ID NO: 3588986 - RNA, 14 nt, Human
uggucugaauguuc

SEQ ID NO: 3588987 - RNA, 16 nt, Human
uggucugaauguucug

SEQ ID NO: 3588988 - RNA, 21 nt, Human
uggucugaauguucugacauu

SEQ ID NO: 3588989 - RNA, 16 nt, Human
uggucugacccacugc

SEQ ID NO: 3588990 - RNA, 14 nt, Human
uggucugcaggcag

SEQ ID NO: 3588991 - RNA, 18 nt, Human
uggucugccaggccccca

SEQ ID NO: 3588992 - RNA, 11 nt, Human
uggucugcugu

SEQ ID NO: 3588993 - RNA, 16 nt, Human
uggucugguugggcag

SEQ ID NO: 3588994 - RNA, 22 nt, Human
uggucugugagaugcuagaacu

SEQ ID NO: 3588995 - RNA, 14 nt, Human
uggucuguuggcag

SEQ ID NO: 3588996 - RNA, 16 nt, Human
uggucuuaagaaaugu

SEQ ID NO: 3588997 - RNA, 20 nt, Human
uggucuugaaguccuggcuu

SEQ ID NO: 3588998 - RNA, 17 nt, Human
uggucuugagaugucuu

SEQ ID NO: 3588999 - RNA, 23 nt, Human
uggucuuguaagagcuauacagu

SEQ ID NO: 3589000 - RNA, 20 nt, Human
uggucuuucuuacaaggaag

SEQ ID NO: 3589001 - RNA, 10 nt, Human
uggucuuuga

SEQ ID NO: 3589002 - RNA, 14 nt, Human
uggucuuuguaaga

SEQ ID NO: 3589003 - RNA, 21 nt, Human
uggucuuuguaagaguguaga

SEQ ID NO: 3589004 - RNA, 22 nt, Human
uggucuuuguaagaguguagaa

SEQ ID NO: 3589005 - RNA, 12 nt, Human
uggucuuuuccu

SEQ ID NO: 3589006 - RNA, 22 nt, Human
uggugaaaagcagguugauaaa

SEQ ID NO: 3589007 - RNA, 18 nt, Human
uggugaaauuuauuaguu

SEQ ID NO: 3589008 - RNA, 19 nt, Human
uggugaaauuuauuaguua

SEQ ID NO: 3589009 - RNA, 19 nt, Human
uggugacaggacgcugacc

SEQ ID NO: 3589010 - RNA, 13 nt, Human
uggugaccucugc

SEQ ID NO: 3589011 - RNA, 21 nt, Human
uggugaccuuccaagagccug

SEQ ID NO: 3589012 - RNA, 18 nt, Human
uggugacugcgaucuuca

SEQ ID NO: 3589013 - RNA, 17 nt, Human
uguaaauauuuuaaaga

SEQ ID NO: 3589014 - RNA, 10 nt, Human
uguaaauccc

SEQ ID NO: 3589015 - RNA, 13 nt, Human
uguaaaucugcca

SEQ ID NO: 3589016 - RNA, 15 nt, Human
uguaaaucugccaca

SEQ ID NO: 3589017 - RNA, 16 nt, Human
uguaaaucugccacaa

SEQ ID NO: 3589018 - RNA, 17 nt, Human
uguaaaugguguacaua

SEQ ID NO: 3589019 - RNA, 16 nt, Human
uguaaaugucucacug

SEQ ID NO: 3589020 - RNA, 15 nt, Human
uguaaauguguugga

SEQ ID NO: 3589021 - RNA, 17 nt, Human
uguaaauguuaguuucu

SEQ ID NO: 3589022 - RNA, 22 nt, Human
uguaaauguuaguuucuuggua

SEQ ID NO: 3589023 - RNA, 22 nt, Human
uguaaauguuauuucugcaaac

SEQ ID NO: 3589024 - RNA, 14 nt, Human
uguaaauuaacuuu

SEQ ID NO: 3589025 - RNA, 16 nt, Human
uguaaauuaacuuuua

SEQ ID NO: 3589026 - RNA, 17 nt, Human
uguaaauuaacuuuuau

SEQ ID NO: 3589027 - RNA, 23 nt, Human
uguaaauuaggaggcucaacaau

SEQ ID NO: 3589028 - RNA, 15 nt, Human
uguaaauuauauuug

SEQ ID NO: 3589029 - RNA, 14 nt, Human
uguaaauuaucagg

SEQ ID NO: 3589030 - RNA, 13 nt, Human
uguaaauucugau

SEQ ID NO: 3589031 - RNA, 22 nt, Human
uguaaauugacuguacuaggcc

SEQ ID NO: 3589032 - RNA, 11 nt, Human
uguaaauuggc

SEQ ID NO: 3589033 - RNA, 18 nt, Human
uguaaauuuguacuauuu

SEQ ID NO: 3589034 - RNA, 17 nt, Human
uguaacaagaaaggaga

SEQ ID NO: 3589035 - RNA, 18 nt, Human
uguaacaagaaaggagag

SEQ ID NO: 3589036 - RNA, 19 nt, Human
uguaacaauuguguagccu

SEQ ID NO: 3589037 - RNA, 15 nt, Human
uguaacacaagccac

SEQ ID NO: 3589038 - RNA, 20 nt, Human
uguaacacaagccacagaag

SEQ ID NO: 3589039 - RNA, 21 nt, Human
uguaacacaagccacagaagc

SEQ ID NO: 3589040 - RNA, 23 nt, Human
uguaacacagcugagagacuuuu

SEQ ID NO: 3589041 - RNA, 20 nt, Human
uguaacaccaugauuaacca

SEQ ID NO: 3589042 - RNA, 18 nt, Human
uguaacacuuuacaaugu

SEQ ID NO: 3589043 - RNA, 22 nt, Human
uguaacagaaagggcaacaaua

SEQ ID NO: 3589044 - RNA, 23 nt, Human
uguaacagaaagggcaacaauaa

SEQ ID NO: 3589045 - RNA, 13 nt, Human
uguaacagacauu

SEQ ID NO: 3589046 - RNA, 16 nt, Human
uguaacagacauuguu

SEQ ID NO: 3589047 - RNA, 14 nt, Human
uguaacagcuccuu

SEQ ID NO: 3589048 - RNA, 18 nt, Human
uguaacaggucuccucuu

SEQ ID NO: 3589049 - RNA, 16 nt, Human
uguaacagucugaucg

SEQ ID NO: 3589050 - RNA, 17 nt, Human
uguaacauacuggccug

SEQ ID NO: 3589051 - RNA, 14 nt, Human
uguaacauaugcaa

SEQ ID NO: 3589052 - RNA, 20 nt, Human
uguaacauccaauaggaaug

SEQ ID NO: 3589053 - RNA, 17 nt, Human
uguaacauucuauuuca

SEQ ID NO: 3589054 - RNA, 18 nt, Human
uguaaccacaacuuucac

SEQ ID NO: 3589055 - RNA, 12 nt, Human
uguaaccucagc

SEQ ID NO: 3589056 - RNA, 16 nt, Human
uguaaccucagcucug

SEQ ID NO: 3589057 - RNA, 13 nt, Human
uguaaccugagau

SEQ ID NO: 3589058 - RNA, 15 nt, Human
uguaacgaaacacuu

SEQ ID NO: 3589059 - RNA, 14 nt, Human
uguaacgccugcuu

SEQ ID NO: 3589060 - RNA, 22 nt, Human
uguaacgugugcuguguuugcu

SEQ ID NO: 3589061 - RNA, 18 nt, Human
uguaacguugcuguggga

SEQ ID NO: 3589062 - RNA, 14 nt, Human
uguaacuaaaauaa

SEQ ID NO: 3589063 - RNA, 15 nt, Human
uguaacuaaaauaau

SEQ ID NO: 3589064 - RNA, 16 nt, Human
uguaacuacuuuauaa

SEQ ID NO: 3589065 - RNA, 17 nt, Human
uguaacuacuuuauaac

SEQ ID NO: 3589066 - RNA, 23 nt, Human
uguaacuauagacuggaaaaaau

SEQ ID NO: 3589067 - RNA, 19 nt, Human
uguaacucuaaaagauccu

SEQ ID NO: 3589068 - RNA, 20 nt, Human
uguaacucuaaaagauccuu

SEQ ID NO: 3589069 - RNA, 15 nt, Human
uguaacugccaggcu

SEQ ID NO: 3589070 - RNA, 16 nt, Human
uguaacugccuagaaa

SEQ ID NO: 3589071 - RNA, 23 nt, Human
uguaacugcucuugggcaauauu

SEQ ID NO: 3589072 - RNA, 12 nt, Human
uguaacugcuga

SEQ ID NO: 3589073 - RNA, 21 nt, Human
uguaacuggcaguuuuccauu

SEQ ID NO: 3589074 - RNA, 23 nt, Human
uguaacugucagccgggcccuga

SEQ ID NO: 3589075 - RNA, 20 nt, Human
uguaacuguuaccauuggaa

SEQ ID NO: 3589076 - RNA, 21 nt, Human
uguaacuguuuagaugaaugu

SEQ ID NO: 3589077 - RNA, 17 nt, Human
uguaacuuauauugaag

SEQ ID NO: 3589078 - RNA, 18 nt, Human
uguaacuuauauugaaga

SEQ ID NO: 3589079 - RNA, 15 nt, Human
uguaacuuauguaga

SEQ ID NO: 3589080 - RNA, 16 nt, Human
uguaacuuauguagau

SEQ ID NO: 3589081 - RNA, 15 nt, Human
uguaacuuccaaaua

SEQ ID NO: 3589082 - RNA, 17 nt, Human
uguaacuuccaaauaaa

SEQ ID NO: 3589083 - RNA, 19 nt, Human
uguaacuuccaaauaaaua

SEQ ID NO: 3589084 - RNA, 19 nt, Human
uguaacuuccaugugaggg

SEQ ID NO: 3589085 - RNA, 22 nt, Human
uguaacuugcuuaaauuucuua

SEQ ID NO: 3589086 - RNA, 17 nt, Human
uguaagaaaauaucacu

SEQ ID NO: 3589087 - RNA, 17 nt, Human
uguaagaaacacacuga

SEQ ID NO: 3589088 - RNA, 12 nt, Human
uguaagaaaccu

SEQ ID NO: 3589089 - RNA, 17 nt, Human
uguaagaaauacagacu

SEQ ID NO: 3589090 - RNA, 18 nt, Human
uguaagaaauacuguaca

SEQ ID NO: 3589091 - RNA, 21 nt, Human
uguaagaacaacuaccugagc

SEQ ID NO: 3589092 - RNA, 19 nt, Human
uguaagaacuacaaacaaa

SEQ ID NO: 3589093 - RNA, 19 nt, Human
uguaagaagagacugggaa

SEQ ID NO: 3589094 - RNA, 21 nt, Human
uguaagaagagacugggaaga

SEQ ID NO: 3589095 - RNA, 18 nt, Human
uguaagaauucagaagac

SEQ ID NO: 3589096 - RNA, 17 nt, Human
uguaagaauucugauug

SEQ ID NO: 3589097 - RNA, 11 nt, Human
uguaagacauu

SEQ ID NO: 3589098 - RNA, 22 nt, Human
uguaagacccuuauugcugucc

SEQ ID NO: 3589099 - RNA, 23 nt, Human
uguaagagagaugagcacuucua

SEQ ID NO: 3589100 - RNA, 17 nt, Human
uguaagagcuauacagu

SEQ ID NO: 3589101 - RNA, 21 nt, Human
uguaagagcuuuacaaaaaga

SEQ ID NO: 3589102 - RNA, 15 nt, Human
uguaagaguguuuau

SEQ ID NO: 3589103 - RNA, 13 nt, Human
uguaagauaaaaa

SEQ ID NO: 3589104 - RNA, 22 nt, Human
uguaagauauuugcaguuuuuc

SEQ ID NO: 3589105 - RNA, 19 nt, Human
uguaagaucguucucugcc

SEQ ID NO: 3589106 - RNA, 20 nt, Human
uguaagauuauagauucuaa

SEQ ID NO: 3589107 - RNA, 20 nt, Human
uguaagcauacuuuguaaau

SEQ ID NO: 3589108 - RNA, 22 nt, Human
uguaagcauacuuuguaaauag

SEQ ID NO: 3589109 - RNA, 17 nt, Human
uguaagcguauggcuuu

SEQ ID NO: 3589110 - RNA, 19 nt, Human
uguaagcucuuugaaacaa

SEQ ID NO: 3589111 - RNA, 16 nt, Human
uguaagcugaaaauau

SEQ ID NO: 3589112 - RNA, 15 nt, Human
uguaaggaaugauua

SEQ ID NO: 3589113 - RNA, 19 nt, Human
uguaaggauccggaaagaa

SEQ ID NO: 3589114 - RNA, 14 nt, Human
uguaaggcaugaag

SEQ ID NO: 3589115 - RNA, 22 nt, Human
uguaaggccaaguacacugaga

SEQ ID NO: 3589116 - RNA, 18 nt, Human
uguaaggcucuagaucau

SEQ ID NO: 3589117 - RNA, 20 nt, Human
uguaaggcuguguaagauuu

SEQ ID NO: 3589118 - RNA, 19 nt, Human
uguaagguauaucauucua

SEQ ID NO: 3589119 - RNA, 17 nt, Human
uguaaguaaacugcccu

SEQ ID NO: 3589120 - RNA, 21 nt, Human
uguaaguaaaugucuguggcc

SEQ ID NO: 3589121 - RNA, 16 nt, Human
uguaagucaguguuga

SEQ ID NO: 3589122 - RNA, 17 nt, Human
uguaagugagugugcug

SEQ ID NO: 3589123 - RNA, 21 nt, Human
uguaagugagugugcugcugu

SEQ ID NO: 3589124 - RNA, 19 nt, Human
uguaaguuuaugucuaaag

SEQ ID NO: 3589125 - RNA, 20 nt, Human
uguaaguuuaugucuaaaga

SEQ ID NO: 3589126 - RNA, 14 nt, Human
uguaaguuucaggu

SEQ ID NO: 3589127 - RNA, 18 nt, Human
uguaaguuucaggugaca

SEQ ID NO: 3589128 - RNA, 20 nt, Human
uguaaguuucaggugacaug

SEQ ID NO: 3589129 - RNA, 21 nt, Human
uguaaguuucaggugacaugu

SEQ ID NO: 3589130 - RNA, 23 nt, Human
uguaaguuucaggugacauguga

SEQ ID NO: 3589131 - RNA, 22 nt, Human
uguaauaaacccuuaacuggca

SEQ ID NO: 3589132 - RNA, 23 nt, Human
uguaauaaacccuuaacuggcau

SEQ ID NO: 3589133 - RNA, 17 nt, Human
uguaauaaacuuuaaua

SEQ ID NO: 3589134 - RNA, 13 nt, Human
uguaauaaaguau

SEQ ID NO: 3589135 - RNA, 15 nt, Human
uguaauaaaguauau

SEQ ID NO: 3589136 - RNA, 13 nt, Human
uguaauaaagugu

SEQ ID NO: 3589137 - RNA, 14 nt, Human
uguaauaaaguguu

SEQ ID NO: 3589138 - RNA, 18 nt, Human
uguaauaaaguguuuuca

SEQ ID NO: 3589139 - RNA, 19 nt, Human
uguaauaaaguguuuucag

SEQ ID NO: 3589140 - RNA, 13 nt, Human
uguaauaaauaug

SEQ ID NO: 3589141 - RNA, 21 nt, Human
uguaauaagacuuagauugug

SEQ ID NO: 3589142 - RNA, 16 nt, Human
uguaauaauaccucaa

SEQ ID NO: 3589143 - RNA, 21 nt, Human
uguaauaauaccucaauguuu

SEQ ID NO: 3589144 - RNA, 12 nt, Human
uguaauaaugga

SEQ ID NO: 3589145 - RNA, 16 nt, Human
uguaauagaaaacuga

SEQ ID NO: 3589146 - RNA, 18 nt, Human
uguaauagauguuugaua

SEQ ID NO: 3589147 - RNA, 17 nt, Human
uguaauauaaagauguu

SEQ ID NO: 3589148 - RNA, 19 nt, Human
uguaauauuacuuuaacau

SEQ ID NO: 3589149 - RNA, 15 nt, Human
uguaauauuuacaau

SEQ ID NO: 3589150 - RNA, 17 nt, Human
uguaauauuuacaaugu

SEQ ID NO: 3589151 - RNA, 14 nt, Human
uguaaucaauaaac

SEQ ID NO: 3589152 - RNA, 14 nt, Human
uguaaucacagcua

SEQ ID NO: 3589153 - RNA, 15 nt, Human
uguaaucacagcuac

SEQ ID NO: 3589154 - RNA, 17 nt, Human
uguaaucccagcacacu

SEQ ID NO: 3589155 - RNA, 16 nt, Human
uguaaucccagcacuu

SEQ ID NO: 3589156 - RNA, 21 nt, Human
uguaaucccagcuacucagga

SEQ ID NO: 3589157 - RNA, 19 nt, Human
uguaaucccagcuacucgg

SEQ ID NO: 3589158 - RNA, 16 nt, Human
uguaauccgaaucucu

SEQ ID NO: 3589159 - RNA, 19 nt, Human
uguaaucguuaugugugua

SEQ ID NO: 3589160 - RNA, 17 nt, Human
uguaaucucguuucaaa

SEQ ID NO: 3589161 - RNA, 18 nt, Human
uguaaucucguuucaaaa

SEQ ID NO: 3589162 - RNA, 15 nt, Human
ugucugcagccuuga

SEQ ID NO: 3589163 - RNA, 16 nt, Human
ugucugcagugugccc

SEQ ID NO: 3589164 - RNA, 19 nt, Human
ugucugccaaccuaaaacu

SEQ ID NO: 3589165 - RNA, 13 nt, Human
ugucugcccccuc

SEQ ID NO: 3589166 - RNA, 11 nt, Human
ugucugcccuu

SEQ ID NO: 3589167 - RNA, 16 nt, Human
ugucugcccuucaccc

SEQ ID NO: 3589168 - RNA, 15 nt, Human
ugucugccucuuaga

SEQ ID NO: 3589169 - RNA, 21 nt, Human
ugucugcgugguuccuuucuc

SEQ ID NO: 3589170 - RNA, 23 nt, Human
ugucugcuuaguaucucaucaac

SEQ ID NO: 3589171 - RNA, 19 nt, Human
ugucugcuuucuccauugu

SEQ ID NO: 3589172 - RNA, 17 nt, Human
ugucuggaagaugggga

SEQ ID NO: 3589173 - RNA, 21 nt, Human
ugucuggagaccaccagggca

SEQ ID NO: 3589174 - RNA, 14 nt, Human
ugucuggaucagua

SEQ ID NO: 3589175 - RNA, 14 nt, Human
ugucuggcaaggac

SEQ ID NO: 3589176 - RNA, 20 nt, Human
ugucuggcaaggacuuugua

SEQ ID NO: 3589177 - RNA, 19 nt, Human
ugucuggcaaugccacagc

SEQ ID NO: 3589178 - RNA, 17 nt, Human
ugucuggcacagccugc

SEQ ID NO: 3589179 - RNA, 18 nt, Human
ugucuggcacagccugca

SEQ ID NO: 3589180 - RNA, 23 nt, Human
ugucuggcugaggauuucaagcc

SEQ ID NO: 3589181 - RNA, 15 nt, Human
ugucugggugcuacu

SEQ ID NO: 3589182 - RNA, 19 nt, Human
ugucuggguuugagaaaug

SEQ ID NO: 3589183 - RNA, 16 nt, Human
ugucugguuaaaaaau

SEQ ID NO: 3589184 - RNA, 13 nt, Human
ugucugguucuca

SEQ ID NO: 3589185 - RNA, 22 nt, Human
ugucugguucucaauuccaaca

SEQ ID NO: 3589186 - RNA, 22 nt, Human
ugucuguaaaucuaacauuauu

SEQ ID NO: 3589187 - RNA, 20 nt, Human
ugucuguacacguguccugu

SEQ ID NO: 3589188 - RNA, 21 nt, Human
ugucuguacacguguccugua

SEQ ID NO: 3589189 - RNA, 15 nt, Human
ugucuguacuaaaaa

SEQ ID NO: 3589190 - RNA, 19 nt, Human
ugucuguagagggcccugg

SEQ ID NO: 3589191 - RNA, 23 nt, Human
ugucuguagagggcccugguguu

SEQ ID NO: 3589192 - RNA, 16 nt, Human
ugucugucccaguuaa

SEQ ID NO: 3589193 - RNA, 19 nt, Human
ugucugucucuccaucugu

SEQ ID NO: 3589194 - RNA, 14 nt, Human
ugucugucuuccuu

SEQ ID NO: 3589195 - RNA, 19 nt, Human
ugucugugaacagagagac

SEQ ID NO: 3589196 - RNA, 18 nt, Human
ugucugugaagugagacc

SEQ ID NO: 3589197 - RNA, 11 nt, Human
ugucugugcua

SEQ ID NO: 3589198 - RNA, 17 nt, Human
ugucuguggauggucau

SEQ ID NO: 3589199 - RNA, 19 nt, Human
ugucuguggcaaaaguuua

SEQ ID NO: 3589200 - RNA, 12 nt, Human
ugucugugugca

SEQ ID NO: 3589201 - RNA, 21 nt, Human
ugucugugugcaagugugugc

SEQ ID NO: 3589202 - RNA, 12 nt, Human
ugucuguuacac

SEQ ID NO: 3589203 - RNA, 22 nt, Human
ugucuguuaccaugucacugug

SEQ ID NO: 3589204 - RNA, 23 nt, Human
ugucuguuaccaugucacugugg

SEQ ID NO: 3589205 - RNA, 13 nt, Human
ugucuguucuaca

SEQ ID NO: 3589206 - RNA, 16 nt, Human
ugucuguuuaagaaaa

SEQ ID NO: 3589207 - RNA, 21 nt, Human
ugucuguuuaagaaaaguauu

SEQ ID NO: 3589208 - RNA, 16 nt, Human
ugucuguuuguucucu

SEQ ID NO: 3589209 - RNA, 15 nt, Human
ugucuguuuguuuca

SEQ ID NO: 3589210 - RNA, 16 nt, Human
ugucuguuuguuucaa

SEQ ID NO: 3589211 - RNA, 22 nt, Human
ugucuguuuguuucaagaaccu

SEQ ID NO: 3589212 - RNA, 18 nt, Human
ugucuuaaacuaaaugug

SEQ ID NO: 3589213 - RNA, 20 nt, Human
ugucuuaaugaaguuugaau

SEQ ID NO: 3589214 - RNA, 12 nt, Human
ugucuuaauuaa

SEQ ID NO: 3589215 - RNA, 14 nt, Human
ugucuuaauuaagu

SEQ ID NO: 3589216 - RNA, 21 nt, Human
ugucuuaauuaaguaaacuaa

SEQ ID NO: 3589217 - RNA, 20 nt, Human
ugucuuaauuucuaucuugu

SEQ ID NO: 3589218 - RNA, 19 nt, Human
ugucuuaauuuuugaaaaa

SEQ ID NO: 3589219 - RNA, 17 nt, Human
ugucuuauggauucauu

SEQ ID NO: 3589220 - RNA, 20 nt, Human
ugucuucaaggcuucagucu

SEQ ID NO: 3589221 - RNA, 21 nt, Human
ugucuucaauuuguauaaaau

SEQ ID NO: 3589222 - RNA, 22 nt, Human
ugucuucauaccuacauguauu

SEQ ID NO: 3589223 - RNA, 12 nt, Human
ugucuucaugua

SEQ ID NO: 3589224 - RNA, 21 nt, Human
ugucuucauuucauuguauga

SEQ ID NO: 3589225 - RNA, 15 nt, Human
ugucuuccacuuugc

SEQ ID NO: 3589226 - RNA, 12 nt, Human
ugucuuccauaa

SEQ ID NO: 3589227 - RNA, 13 nt, Human
ugucuucccaggg

SEQ ID NO: 3589228 - RNA, 16 nt, Human
ugucuucccaggguag

SEQ ID NO: 3589229 - RNA, 21 nt, Human
ugucuucccaggguagcccgc

SEQ ID NO: 3589230 - RNA, 19 nt, Human
ugucuuccuauuucagaag

SEQ ID NO: 3589231 - RNA, 16 nt, Human
ugucuuccucaaaaua

SEQ ID NO: 3589232 - RNA, 13 nt, Human
ugucuuccugugg

SEQ ID NO: 3589233 - RNA, 17 nt, Human
ugucuuccuuugcuucc

SEQ ID NO: 3589234 - RNA, 21 nt, Human
ugucuucucaggcucugcccu

SEQ ID NO: 3589235 - RNA, 12 nt, Human
ugucuucucccu

SEQ ID NO: 3589236 - RNA, 13 nt, Human
ugucuucugccug

SEQ ID NO: 3589237 - RNA, 15 nt, Human
ugucuucugccuguu

SEQ ID NO: 3589238 - RNA, 23 nt, Human
ugucuucugcuuuguugugugcc

SEQ ID NO: 3589239 - RNA, 12 nt, Human
ugucuucuguau

SEQ ID NO: 3589240 - RNA, 17 nt, Human
ugucuucuguauauaaa

SEQ ID NO: 3589241 - RNA, 16 nt, Human
ugucuucuucugugcu

SEQ ID NO: 3589242 - RNA, 19 nt, Human
ugucuugaaagauucaggu

SEQ ID NO: 3589243 - RNA, 16 nt, Human
ugucuugagcucuauu

SEQ ID NO: 3589244 - RNA, 22 nt, Human
ugucuugaugcaugcacuguuc

SEQ ID NO: 3589245 - RNA, 17 nt, Human
ugucuugcaauggcagc

SEQ ID NO: 3589246 - RNA, 21 nt, Human
ugucuugcaauggcagccuug

SEQ ID NO: 3589247 - RNA, 15 nt, Human
ugucuugccuuuuuc

SEQ ID NO: 3589248 - RNA, 16 nt, Human
ugucuugccuuuuuca

SEQ ID NO: 3589249 - RNA, 20 nt, Human
ugucuugcuguugacauauu

SEQ ID NO: 3589250 - RNA, 21 nt, Human
ugucuugggcagagcuggcuc

SEQ ID NO: 3589251 - RNA, 20 nt, Human
ugucuuguacauguguagcc

SEQ ID NO: 3589252 - RNA, 16 nt, Human
ugucuuguguuuuugu

SEQ ID NO: 3589253 - RNA, 14 nt, Human
ugucuuguucuguc

SEQ ID NO: 3589254 - RNA, 16 nt, Human
ugucuuuaaaagagag

SEQ ID NO: 3589255 - RNA, 12 nt, Human
ugucuuuauaug

SEQ ID NO: 3589256 - RNA, 11 nt, Human
ugucuuucaaa

SEQ ID NO: 3589257 - RNA, 16 nt, Human
ugucuuucagauacau

SEQ ID NO: 3589258 - RNA, 20 nt, Human
ugucuuucagauacaugguu

SEQ ID NO: 3589259 - RNA, 22 nt, Human
ugucuuuccuaagaccuggggu

SEQ ID NO: 3589260 - RNA, 13 nt, Human
ugucuuuccugaa

SEQ ID NO: 3589261 - RNA, 22 nt, Human
ugucuuuccugaaccaugugga

SEQ ID NO: 3589262 - RNA, 16 nt, Human
ugucuuucuaagaaau

SEQ ID NO: 3589263 - RNA, 12 nt, Human
ugucuuucugag

SEQ ID NO: 3589264 - RNA, 17 nt, Human
ugucuuucuugcucccu

SEQ ID NO: 3589265 - RNA, 15 nt, Human
ugucuuucuuuggug

SEQ ID NO: 3589266 - RNA, 13 nt, Human
ugucuuuggaaaa

SEQ ID NO: 3589267 - RNA, 16 nt, Human
ugucuuuggacccuga

SEQ ID NO: 3589268 - RNA, 22 nt, Human
ugucuuuggacccugaggccca

SEQ ID NO: 3589269 - RNA, 20 nt, Human
ugucuuugguccucuugcca

SEQ ID NO: 3589270 - RNA, 15 nt, Human
ugucuuuuaaaaugc

SEQ ID NO: 3589271 - RNA, 14 nt, Human
ugucuuuuaaugcu

SEQ ID NO: 3589272 - RNA, 20 nt, Human
ugucuuuuaaugcuucauuc

SEQ ID NO: 3589273 - RNA, 16 nt, Human
ugucuuuucuugcaug

SEQ ID NO: 3589274 - RNA, 21 nt, Human
ugucuuuucuugcaugaggcu

SEQ ID NO: 3589275 - RNA, 22 nt, Human
ugucuuuucuuggcaaaagccu

SEQ ID NO: 3589276 - RNA, 14 nt, Human
ugucuuuugcauga

SEQ ID NO: 3589277 - RNA, 23 nt, Human
ugucuuuuucuggacugaagccu

SEQ ID NO: 3589278 - RNA, 14 nt, Human
ugucuuuuuuugua

SEQ ID NO: 3589279 - RNA, 18 nt, Human
ugucuuuuuuuuaaugug

SEQ ID NO: 3589280 - RNA, 14 nt, Human
ugugaaaaaaauaa

SEQ ID NO: 3589281 - RNA, 13 nt, Human
ugugaaaaaucug

SEQ ID NO: 3589282 - RNA, 17 nt, Human
ugugaaaaucaaauaca

SEQ ID NO: 3589283 - RNA, 13 nt, Human
ugugaaaaugggu

SEQ ID NO: 3589284 - RNA, 14 nt, Human
ugugaaacagacuu

SEQ ID NO: 3589285 - RNA, 19 nt, Human
ugugaaacuggcacugaau

SEQ ID NO: 3589286 - RNA, 20 nt, Human
ugugaaagggagaagugaca

SEQ ID NO: 3589287 - RNA, 22 nt, Human
ugugaaagucagaugcccagag

SEQ ID NO: 3589288 - RNA, 17 nt, Human
ugugaaaguuuugagua

SEQ ID NO: 3589289 - RNA, 21 nt, Human
ugugaaauaguucaaagccaa

SEQ ID NO: 3589290 - RNA, 14 nt, Human
ugugaaauaucauc

SEQ ID NO: 3589291 - RNA, 14 nt, Human
ugugaaaugaaaac

SEQ ID NO: 3589292 - RNA, 14 nt, Human
ugugaaaugcuggc

SEQ ID NO: 3589293 - RNA, 13 nt, Human
ugugaaauuccca

SEQ ID NO: 3589294 - RNA, 14 nt, Human
ugugaaauuuacau

SEQ ID NO: 3589295 - RNA, 15 nt, Human
ugugaaauuuuucau

SEQ ID NO: 3589296 - RNA, 20 nt, Human
ugugaacaaaagaugcucuu

SEQ ID NO: 3589297 - RNA, 23 nt, Human
ugugaacaagcuucaguaaguua

SEQ ID NO: 3589298 - RNA, 22 nt, Human
ugugaacaguuguguuugaagc

SEQ ID NO: 3589299 - RNA, 14 nt, Human
ugugaacauggacu

SEQ ID NO: 3589300 - RNA, 14 nt, Human
ugugaacauuugug

SEQ ID NO: 3589301 - RNA, 23 nt, Human
ugugaaccaccacacccagccca

SEQ ID NO: 3589302 - RNA, 13 nt, Human
ugugaacccagga

SEQ ID NO: 3589303 - RNA, 14 nt, Human
ugugaacccaggac

SEQ ID NO: 3589304 - RNA, 18 nt, Human
ugugaacccuggggccug

SEQ ID NO: 3589305 - RNA, 22 nt, Human
ugugaacccuggggccugacug

SEQ ID NO: 3589306 - RNA, 20 nt, Human
ugugaacuagggaagcucag

SEQ ID NO: 3589307 - RNA, 12 nt, Human
ugugaacucauu

SEQ ID NO: 3589308 - RNA, 15 nt, Human
ugugaacugacaggc

SEQ ID NO: 3589309 - RNA, 19 nt, Human
ugugaacuggacccuguug

SEQ ID NO: 3589310 - RNA, 12 nt, Human
ugugaacuugaa

SEQ ID NO: 3589311 - RNA, 15 nt, Human
ugugaacuuguagcu

SEQ ID NO: 3589312 - RNA, 12 nt, Human
uguauauacuuu

SEQ ID NO: 3589313 - RNA, 11 nt, Human
uguauauauac

SEQ ID NO: 3589314 - RNA, 20 nt, Human
uguauauauaccugcgcuug

SEQ ID NO: 3589315 - RNA, 22 nt, Human
uguauauauguguauauauaca

SEQ ID NO: 3589316 - RNA, 18 nt, Human
uguauauauuuccuauau

SEQ ID NO: 3589317 - RNA, 14 nt, Human
uguauaucagaaaa

SEQ ID NO: 3589318 - RNA, 18 nt, Human
uguauaugaacuuaacau

SEQ ID NO: 3589319 - RNA, 22 nt, Human
uguauauuauuucuaggaagaa

SEQ ID NO: 3589320 - RNA, 16 nt, Human
uguauauuauuuggca

SEQ ID NO: 3589321 - RNA, 12 nt, Human
uguauauucacu

SEQ ID NO: 3589322 - RNA, 20 nt, Human
uguauauugguuuuaugaug

SEQ ID NO: 3589323 - RNA, 17 nt, Human
uguauauuguaauuuaa

SEQ ID NO: 3589324 - RNA, 18 nt, Human
uguauauuuguaaagcua

SEQ ID NO: 3589325 - RNA, 13 nt, Human
uguauauuuguau

SEQ ID NO: 3589326 - RNA, 15 nt, Human
uguauauuuguauga

SEQ ID NO: 3589327 - RNA, 18 nt, Human
uguauauuuguaugauau

SEQ ID NO: 3589328 - RNA, 23 nt, Human
uguauauuugugauagcacuuuc

SEQ ID NO: 3589329 - RNA, 13 nt, Human
uguaucaaaaugc

SEQ ID NO: 3589330 - RNA, 18 nt, Human
uguaucaaaaugcucuua

SEQ ID NO: 3589331 - RNA, 23 nt, Human
uguaucaaaaugcucuuauuuca

SEQ ID NO: 3589332 - RNA, 15 nt, Human
uguaucaaacuagug

SEQ ID NO: 3589333 - RNA, 21 nt, Human
uguaucaaauacauuuaaaac

SEQ ID NO: 3589334 - RNA, 18 nt, Human
uguaucaacccagaaaca

SEQ ID NO: 3589335 - RNA, 15 nt, Human
uguaucacaaaucuu

SEQ ID NO: 3589336 - RNA, 23 nt, Human
uguaucacucugugucugagugg

SEQ ID NO: 3589337 - RNA, 19 nt, Human
uguaucaguggauuuccca

SEQ ID NO: 3589338 - RNA, 13 nt, Human
uguaucaguguuu

SEQ ID NO: 3589339 - RNA, 13 nt, Human
uguaucauaauua

SEQ ID NO: 3589340 - RNA, 17 nt, Human
uguauccaguacauuua

SEQ ID NO: 3589341 - RNA, 20 nt, Human
uguauccauuaucaugugua

SEQ ID NO: 3589342 - RNA, 15 nt, Human
uguaucccaugagcc

SEQ ID NO: 3589343 - RNA, 16 nt, Human
uguaucccaugagccu

SEQ ID NO: 3589344 - RNA, 23 nt, Human
uguaucccaugagccucagcauc

SEQ ID NO: 3589345 - RNA, 20 nt, Human
uguauccccccccuguauag

SEQ ID NO: 3589346 - RNA, 14 nt, Human
uguauccccugcag

SEQ ID NO: 3589347 - RNA, 20 nt, Human
uguaucccuucucacagcac

SEQ ID NO: 3589348 - RNA, 17 nt, Human
uguauccuggaacaaua

SEQ ID NO: 3589349 - RNA, 13 nt, Human
uguauccuggggc

SEQ ID NO: 3589350 - RNA, 19 nt, Human
uguauccuggggcucccuu

SEQ ID NO: 3589351 - RNA, 19 nt, Human
uguaucgauguuuuauuau

SEQ ID NO: 3589352 - RNA, 17 nt, Human
uguaucggagacaguga

SEQ ID NO: 3589353 - RNA, 20 nt, Human
uguaucgggaagauuucuaa

SEQ ID NO: 3589354 - RNA, 16 nt, Human
uguaucguauagcugu

SEQ ID NO: 3589355 - RNA, 22 nt, Human
uguaucguauagcuguauugaa

SEQ ID NO: 3589356 - RNA, 15 nt, Human
uguaucuaagaauaa

SEQ ID NO: 3589357 - RNA, 19 nt, Human
uguaucuaagaauaauaaa

SEQ ID NO: 3589358 - RNA, 21 nt, Human
uguaucuaagaauaauaaaau

SEQ ID NO: 3589359 - RNA, 20 nt, Human
uguaucuacaucuuuuuuca

SEQ ID NO: 3589360 - RNA, 17 nt, Human
uguaucucugaagcaug

SEQ ID NO: 3589361 - RNA, 23 nt, Human
uguaucucugaagcauguuucau

SEQ ID NO: 3589362 - RNA, 15 nt, Human
uguaucugaaaguca

SEQ ID NO: 3589363 - RNA, 23 nt, Human
uguaucugaguugccaagacaaa

SEQ ID NO: 3589364 - RNA, 20 nt, Human
uguaucugauagcucuuugg

SEQ ID NO: 3589365 - RNA, 17 nt, Human
uguaucugcaggcagac

SEQ ID NO: 3589366 - RNA, 18 nt, Human
uguaucugcaggcagaca

SEQ ID NO: 3589367 - RNA, 14 nt, Human
uguaucugucuuuc

SEQ ID NO: 3589368 - RNA, 16 nt, Human
uguaucugucuuucca

SEQ ID NO: 3589369 - RNA, 20 nt, Human
uguaucugucuuuccacucu

SEQ ID NO: 3589370 - RNA, 13 nt, Human
uguaucuguguag

SEQ ID NO: 3589371 - RNA, 18 nt, Human
uguaucuuccauauuugg

SEQ ID NO: 3589372 - RNA, 21 nt, Human
uguaucuuccauauuuggaag

SEQ ID NO: 3589373 - RNA, 15 nt, Human
uguaugaucaaaugu

SEQ ID NO: 3589374 - RNA, 20 nt, Human
uguaugaucaaauguuuaau

SEQ ID NO: 3589375 - RNA, 15 nt, Human
uguaugauucccagc

SEQ ID NO: 3589376 - RNA, 19 nt, Human
uguaugcaagcaguuucaa

SEQ ID NO: 3589377 - RNA, 20 nt, Human
uguaugcaagcaguuucaau

SEQ ID NO: 3589378 - RNA, 17 nt, Human
uguaugcacacacauau

SEQ ID NO: 3589379 - RNA, 16 nt, Human
uguaugcacaguaaaa

SEQ ID NO: 3589380 - RNA, 18 nt, Human
uguaugccaagugagaag

SEQ ID NO: 3589381 - RNA, 21 nt, Human
uguaugccuuuaaaucuguga

SEQ ID NO: 3589382 - RNA, 23 nt, Human
uguaugccuuuaaaucugugaug

SEQ ID NO: 3589383 - RNA, 23 nt, Human
uguaugcugaucaucgccagagg

SEQ ID NO: 3589384 - RNA, 13 nt, Human
uguaugcugcuuu

SEQ ID NO: 3589385 - RNA, 16 nt, Human
uguaugcugcuuuucu

SEQ ID NO: 3589386 - RNA, 23 nt, Human
uguauggaaauaaauguaucaua

SEQ ID NO: 3589387 - RNA, 14 nt, Human
uguaugggcaaaaa

SEQ ID NO: 3589388 - RNA, 23 nt, Human
uguauggguguguguuuguguga

SEQ ID NO: 3589389 - RNA, 15 nt, Human
uguaugguucugugc

SEQ ID NO: 3589390 - RNA, 22 nt, Human
uguaugguuuuugagauauuaa

SEQ ID NO: 3589391 - RNA, 10 nt, Human
uguauguaaa

SEQ ID NO: 3589392 - RNA, 14 nt, Human
uguauguaaaugug

SEQ ID NO: 3589393 - RNA, 22 nt, Human
uguauguaaaugugcauucuuu

SEQ ID NO: 3589394 - RNA, 14 nt, Human
uguauguagaagca

SEQ ID NO: 3589395 - RNA, 17 nt, Human
uguauguauuagugaua

SEQ ID NO: 3589396 - RNA, 16 nt, Human
uguaugucagaagugc

SEQ ID NO: 3589397 - RNA, 13 nt, Human
uguaugucuguca

SEQ ID NO: 3589398 - RNA, 16 nt, Human
uguaugugccauuuau

SEQ ID NO: 3589399 - RNA, 12 nt, Human
uguauguggggg

SEQ ID NO: 3589400 - RNA, 20 nt, Human
uguaugugggggucugugug

SEQ ID NO: 3589401 - RNA, 22 nt, Human
uguaugugggggucuguguguu

SEQ ID NO: 3589402 - RNA, 14 nt, Human
uguauguguaagua

SEQ ID NO: 3589403 - RNA, 21 nt, Human
uguauuguaccuuuuaacacc

SEQ ID NO: 3589404 - RNA, 18 nt, Human
uguauuguauauuacaau

SEQ ID NO: 3589405 - RNA, 18 nt, Human
uguauugugucuuuugca

SEQ ID NO: 3589406 - RNA, 20 nt, Human
uguauugugucuuuugcaug

SEQ ID NO: 3589407 - RNA, 15 nt, Human
uguauuguucccagu

SEQ ID NO: 3589408 - RNA, 19 nt, Human
uguauuguucccagugaca

SEQ ID NO: 3589409 - RNA, 18 nt, Human
uguauuguugaaaaaguu

SEQ ID NO: 3589410 - RNA, 20 nt, Human
uguauuguugaaaaaguuug

SEQ ID NO: 3589411 - RNA, 22 nt, Human
uguauuguugaaaaaguuuguu

SEQ ID NO: 3589412 - RNA, 15 nt, Human
uguauuuaaaugaaa

SEQ ID NO: 3589413 - RNA, 15 nt, Human
uguauuuaacagaaa

SEQ ID NO: 3589414 - RNA, 18 nt, Human
uguauuuaacagggaggg

SEQ ID NO: 3589415 - RNA, 16 nt, Human
uguauuuaagcaaaua

SEQ ID NO: 3589416 - RNA, 20 nt, Human
uguauuuaagcaaauacuua

SEQ ID NO: 3589417 - RNA, 19 nt, Human
uguauuuaauuguaaacug

SEQ ID NO: 3589418 - RNA, 20 nt, Human
uguauuuacgcuuugauuca

SEQ ID NO: 3589419 - RNA, 21 nt, Human
uguauuuacgcuuugauucau

SEQ ID NO: 3589420 - RNA, 23 nt, Human
uguauuuacgcuuugauucauag

SEQ ID NO: 3589421 - RNA, 14 nt, Human
uguauuuauaaaua

SEQ ID NO: 3589422 - RNA, 17 nt, Human
uguauuuaugugugagg

SEQ ID NO: 3589423 - RNA, 13 nt, Human
uguauuuauucaa

SEQ ID NO: 3589424 - RNA, 14 nt, Human
uguauuuauucaau

SEQ ID NO: 3589425 - RNA, 19 nt, Human
uguauuuauucaauaaagu

SEQ ID NO: 3589426 - RNA, 22 nt, Human
uguauuuauucaauaaaguauu

SEQ ID NO: 3589427 - RNA, 14 nt, Human
uguauuuauucuuu

SEQ ID NO: 3589428 - RNA, 18 nt, Human
uguauuuauuuuccuccc

SEQ ID NO: 3589429 - RNA, 15 nt, Human
uguauuuccagugca

SEQ ID NO: 3589430 - RNA, 18 nt, Human
uguauuucuuauacgcuu

SEQ ID NO: 3589431 - RNA, 15 nt, Human
uguauuugagcauau

SEQ ID NO: 3589432 - RNA, 12 nt, Human
uguauuugugac

SEQ ID NO: 3589433 - RNA, 15 nt, Human
uguauuugugacuaa

SEQ ID NO: 3589434 - RNA, 16 nt, Human
uguauuugugacuaau

SEQ ID NO: 3589435 - RNA, 22 nt, Human
uguauuugugacuaauuguaua

SEQ ID NO: 3589436 - RNA, 20 nt, Human
uguauuuguuaaugguuuga

SEQ ID NO: 3589437 - RNA, 18 nt, Human
uguauuuguucauguuug

SEQ ID NO: 3589438 - RNA, 19 nt, Human
uguauuuguucauguuugg

SEQ ID NO: 3589439 - RNA, 14 nt, Human
uguauuuguuugca

SEQ ID NO: 3589440 - RNA, 19 nt, Human
uguauuuuaaaagaaugau

SEQ ID NO: 3589441 - RNA, 14 nt, Human
uguauuuuaacuca

SEQ ID NO: 3589442 - RNA, 15 nt, Human
uguauuuuaacucau

SEQ ID NO: 3589443 - RNA, 22 nt, Human
uguauuuuauaaaauuaaagaa

SEQ ID NO: 3589444 - RNA, 13 nt, Human
uguauuuuaugua

SEQ ID NO: 3589445 - RNA, 19 nt, Human
uguauuuuauguauguuua

SEQ ID NO: 3589446 - RNA, 17 nt, Human
uguauuuuccaagugug

SEQ ID NO: 3589447 - RNA, 20 nt, Human
uguauuuuccaagugugcau

SEQ ID NO: 3589448 - RNA, 22 nt, Human
uguauuuuccaagugugcauau

SEQ ID NO: 3589449 - RNA, 22 nt, Human
uguauuuucuucaccucugcua

SEQ ID NO: 3589450 - RNA, 22 nt, Human
uguauuuuguuuuugucuuaaa

SEQ ID NO: 3589451 - RNA, 17 nt, Human
uguauuuuuaaagcaug

SEQ ID NO: 3589452 - RNA, 18 nt, Human
uguauuuuucaauaauaa

SEQ ID NO: 3589453 - RNA, 21 nt, Human
uguauuuuuccucuuucacuu

SEQ ID NO: 3589454 - RNA, 14 nt, Human
uguauuuuugucaa

SEQ ID NO: 3589455 - RNA, 17 nt, Human
uguauuuuuuaaugcua

SEQ ID NO: 3589456 - RNA, 18 nt, Human
uguauuuuuucuugcauu

SEQ ID NO: 3589457 - RNA, 20 nt, Human
uguauuuuuucuugcauuga

SEQ ID NO: 3589458 - RNA, 14 nt, Human
ugucaaaacacugu

SEQ ID NO: 3589459 - RNA, 18 nt, Human
ugucaaaacacuguggaa

SEQ ID NO: 3589460 - RNA, 17 nt, Human
ugucaaaaguuggacua

SEQ ID NO: 3589461 - RNA, 16 nt, Human
ugucaaacaaagccag

SEQ ID NO: 3589462 - RNA, 17 nt, Human
ugucaaacaaagccaga

SEQ ID NO: 3589463 - RNA, 12 nt, Human
ugucaaacauua

SEQ ID NO: 3589464 - RNA, 16 nt, Human
ugucaaacuguagaaa

SEQ ID NO: 3589465 - RNA, 14 nt, Human
ugucaaagaaucaa

SEQ ID NO: 3589466 - RNA, 17 nt, Human
ugucaaagagagggcuu

SEQ ID NO: 3589467 - RNA, 15 nt, Human
ugucaaaguggugag

SEQ ID NO: 3589468 - RNA, 17 nt, Human
ugucaaaugaugugcaa

SEQ ID NO: 3589469 - RNA, 22 nt, Human
ugucaacaccccuguguggaug

SEQ ID NO: 3589470 - RNA, 17 nt, Human
ugucaacaugaacaaau

SEQ ID NO: 3589471 - RNA, 14 nt, Human
ugucaacauuguga

SEQ ID NO: 3589472 - RNA, 14 nt, Human
ugucaaccagacag

SEQ ID NO: 3589473 - RNA, 15 nt, Human
ugucaaccagacaga

SEQ ID NO: 3589474 - RNA, 20 nt, Human
ugucaaccagacagaggguc

SEQ ID NO: 3589475 - RNA, 20 nt, Human
ugucaaccccaaguuaguuc

SEQ ID NO: 3589476 - RNA, 15 nt, Human
ugucaacuaugauau

SEQ ID NO: 3589477 - RNA, 18 nt, Human
ugucaacuucuggcuccu

SEQ ID NO: 3589478 - RNA, 20 nt, Human
ugucaacuucuggcuccuca

SEQ ID NO: 3589479 - RNA, 21 nt, Human
ugucaagaauagcauuguaaa

SEQ ID NO: 3589480 - RNA, 22 nt, Human
ugucaagaguaguuauauaauu

SEQ ID NO: 3589481 - RNA, 17 nt, Human
ugucaagagucgcugug

SEQ ID NO: 3589482 - RNA, 19 nt, Human
ugucaagagucgcugugcc

SEQ ID NO: 3589483 - RNA, 16 nt, Human
ugucaagauucagcua

SEQ ID NO: 3589484 - RNA, 17 nt, Human
ugucaagccugugcaaa

SEQ ID NO: 3589485 - RNA, 14 nt, Human
ugucaagcugcucu

SEQ ID NO: 3589486 - RNA, 18 nt, Human
ugucaagcugcucugagc

SEQ ID NO: 3589487 - RNA, 23 nt, Human
ugucaagggcagcuuugcucaua

SEQ ID NO: 3589488 - RNA, 21 nt, Human
ugucaaggguucaagauuguu

SEQ ID NO: 3589489 - RNA, 14 nt, Human
ugucaaguugugcu

SEQ ID NO: 3589490 - RNA, 16 nt, Human
ugucaaguugugcuug

SEQ ID NO: 3589491 - RNA, 18 nt, Human
ugucaauaaacaacagcu

SEQ ID NO: 3589492 - RNA, 14 nt, Human
ugucaauauuaaau

SEQ ID NO: 3589493 - RNA, 18 nt, Human
ugucaauauuaaauacag

SEQ ID NO: 3589494 - RNA, 19 nt, Human
ugucaauauuaaauacaga

SEQ ID NO: 3589495 - RNA, 21 nt, Human
ugucaauauuaaauacagaca

SEQ ID NO: 3589496 - RNA, 20 nt, Human
ugucaaucagccuaguugau

SEQ ID NO: 3589497 - RNA, 16 nt, Human
ugucaauuuauaauga

SEQ ID NO: 3589498 - RNA, 23 nt, Human
ugucaauuucccugacuccucua

SEQ ID NO: 3589499 - RNA, 15 nt, Human
ugucaauuucugugu

SEQ ID NO: 3589500 - RNA, 13 nt, Human
ugucacaauaaau

SEQ ID NO: 3589501 - RNA, 21 nt, Human
ugucacaaugagauugaauuu

SEQ ID NO: 3589502 - RNA, 17 nt, Human
ugucacacacuuuggcu

SEQ ID NO: 3589503 - RNA, 15 nt, Human
ugucacacagggcag

SEQ ID NO: 3589504 - RNA, 13 nt, Human
ugucacaggcagg

SEQ ID NO: 3589505 - RNA, 14 nt, Human
ugucacaggcaggu

SEQ ID NO: 3589506 - RNA, 11 nt, Human
ugucacagggc

SEQ ID NO: 3589507 - RNA, 13 nt, Human
ugucacagggcca

SEQ ID NO: 3589508 - RNA, 18 nt, Human
ugucacaguaaaaauaaa

SEQ ID NO: 3589509 - RNA, 15 nt, Human
ugucacaucagauaa

SEQ ID NO: 3589510 - RNA, 16 nt, Human
ugucacauugcauucu

SEQ ID NO: 3589511 - RNA, 19 nt, Human
ugucacauugcauucuauu

SEQ ID NO: 3589512 - RNA, 22 nt, Human
ugucacauugcauucuauugcc

SEQ ID NO: 3589513 - RNA, 15 nt, Human
ugucaccaaggaaac

SEQ ID NO: 3589514 - RNA, 23 nt, Human
ugucaccaaggaaacgcuaccuc

SEQ ID NO: 3589515 - RNA, 23 nt, Human
ugucaccaauguacccaccgggc

SEQ ID NO: 3589516 - RNA, 19 nt, Human
ugucaccaccuucccagcu

SEQ ID NO: 3589517 - RNA, 18 nt, Human
ugucacccuccaccucuu

SEQ ID NO: 3589518 - RNA, 22 nt, Human
ugucacccuccaccucuucacc

SEQ ID NO: 3589519 - RNA, 19 nt, Human
ugucaccguggaccuuccu

SEQ ID NO: 3589520 - RNA, 20 nt, Human
ugucaccguggaccuuccug

SEQ ID NO: 3589521 - RNA, 13 nt, Human
ugucaccuucacc

SEQ ID NO: 3589522 - RNA, 14 nt, Human
ugucacgaauaugg

SEQ ID NO: 3589523 - RNA, 18 nt, Human
ugucacgaauauggacau

SEQ ID NO: 3589524 - RNA, 19 nt, Human
ugucacgaauauggacaua

SEQ ID NO: 3589525 - RNA, 15 nt, Human
ugucacguacugucu

SEQ ID NO: 3589526 - RNA, 18 nt, Human
ugucacguacugucugau

SEQ ID NO: 3589527 - RNA, 20 nt, Human
ugucacguuuuguuuugugc

SEQ ID NO: 3589528 - RNA, 14 nt, Human
ugucacuaaagcag

SEQ ID NO: 3589529 - RNA, 22 nt, Human
ugucacuacucacagucucuuu

SEQ ID NO: 3589530 - RNA, 20 nt, Human
ugucacuagaauggauaaaa

SEQ ID NO: 3589531 - RNA, 20 nt, Human
ugucacucaaggcggugcuu

SEQ ID NO: 3589532 - RNA, 22 nt, Human
ugucacucaaggcggugcuuga

SEQ ID NO: 3589533 - RNA, 15 nt, Human
ugucacucauugcug

SEQ ID NO: 3589534 - RNA, 21 nt, Human
ugucacucauugcugagccuc

SEQ ID NO: 3589535 - RNA, 17 nt, Human
ugucacugacacacacg

SEQ ID NO: 3589536 - RNA, 13 nt, Human
ugucacuggcugc

SEQ ID NO: 3589537 - RNA, 16 nt, Human
ugucacuggcugccuc

SEQ ID NO: 3589538 - RNA, 19 nt, Human
ugucacuggcugccuccac

SEQ ID NO: 3589539 - RNA, 21 nt, Human
ugucacuggcugccuccacuc

SEQ ID NO: 3589540 - RNA, 22 nt, Human
ugucacuggcugccuccacucc

SEQ ID NO: 3589541 - RNA, 21 nt, Human
ugucacugguagaccaaaaua

SEQ ID NO: 3589542 - RNA, 19 nt, Human
ugucacugucccuccuggu

SEQ ID NO: 3589543 - RNA, 18 nt, Human
ugucacuguuucucugcu

SEQ ID NO: 3589544 - RNA, 18 nt, Human
ugucacuugugcuuugcu

SEQ ID NO: 3589545 - RNA, 20 nt, Human
ugucacuugugcuuugcucu

SEQ ID NO: 3589546 - RNA, 14 nt, Human
ugucacuuugcucu

SEQ ID NO: 3589547 - RNA, 11 nt, Human
uguuguucugu

SEQ ID NO: 3589548 - RNA, 19 nt, Human
uguuguucuuggcaauaaa

SEQ ID NO: 3589549 - RNA, 16 nt, Human
uguuguucuuucagaa

SEQ ID NO: 3589550 - RNA, 19 nt, Human
uguuguugaaagguuuuuu

SEQ ID NO: 3589551 - RNA, 21 nt, Human
uguuguuuccuaauaucaaau

SEQ ID NO: 3589552 - RNA, 17 nt, Human
uguuguuucuuaaauaa

SEQ ID NO: 3589553 - RNA, 15 nt, Human
uguuguuuguaaaua

SEQ ID NO: 3589554 - RNA, 12 nt, Human
uguuguuuguuu

SEQ ID NO: 3589555 - RNA, 14 nt, Human
uguuguuuguuuag

SEQ ID NO: 3589556 - RNA, 14 nt, Human
uguuguuuuguaca

SEQ ID NO: 3589557 - RNA, 16 nt, Human
uguuuaaaaaaguuua

SEQ ID NO: 3589558 - RNA, 21 nt, Human
uguuuaaaaaaguuuaaaaug

SEQ ID NO: 3589559 - RNA, 22 nt, Human
uguuuaaaaaccgaauaaaugu

SEQ ID NO: 3589560 - RNA, 18 nt, Human
uguuuaaaacuucaguuu

SEQ ID NO: 3589561 - RNA, 12 nt, Human
uguuuaaaauaa

SEQ ID NO: 3589562 - RNA, 22 nt, Human
uguuuaaaauaaaaugaaaauu

SEQ ID NO: 3589563 - RNA, 14 nt, Human
uguuuaaaaucauu

SEQ ID NO: 3589564 - RNA, 23 nt, Human
uguuuaaaguucaacauguuauu

SEQ ID NO: 3589565 - RNA, 12 nt, Human
uguuuaaauaaa

SEQ ID NO: 3589566 - RNA, 17 nt, Human
uguuuaaauaaaguauc

SEQ ID NO: 3589567 - RNA, 20 nt, Human
uguuuaaauaaaguaucaug

SEQ ID NO: 3589568 - RNA, 22 nt, Human
uguuuaaauaaaguaucaugca

SEQ ID NO: 3589569 - RNA, 11 nt, Human
uguuuaaauau

SEQ ID NO: 3589570 - RNA, 16 nt, Human
uguuuaacuucuuaua

SEQ ID NO: 3589571 - RNA, 14 nt, Human
uguuuaagaaaagu

SEQ ID NO: 3589572 - RNA, 22 nt, Human
uguuuaagaaaaguauuuugaa

SEQ ID NO: 3589573 - RNA, 18 nt, Human
uguuuaagacacuuccgu

SEQ ID NO: 3589574 - RNA, 21 nt, Human
uguuuaagauuuaauuugcca

SEQ ID NO: 3589575 - RNA, 18 nt, Human
uguuuaagcagaauugga

SEQ ID NO: 3589576 - RNA, 21 nt, Human
uguuuaagugaauugacuuau

SEQ ID NO: 3589577 - RNA, 23 nt, Human
uguuuaauacucauccuuguaua

SEQ ID NO: 3589578 - RNA, 17 nt, Human
uguuuaauauuuaaaca

SEQ ID NO: 3589579 - RNA, 14 nt, Human
uguuuaaucauaua

SEQ ID NO: 3589580 - RNA, 15 nt, Human
uguuuaaucauauaa

SEQ ID NO: 3589581 - RNA, 15 nt, Human
uguuuaaugguaguu

SEQ ID NO: 3589582 - RNA, 22 nt, Human
uguuuaaugugaacuuguagcu

SEQ ID NO: 3589583 - RNA, 15 nt, Human
uguuuaauuucuuca

SEQ ID NO: 3589584 - RNA, 19 nt, Human
uguuuaauuuuuauuucuu

SEQ ID NO: 3589585 - RNA, 15 nt, Human
uguuuacagauaauu

SEQ ID NO: 3589586 - RNA, 17 nt, Human
uguuuacagauccccaa

SEQ ID NO: 3589587 - RNA, 22 nt, Human
uguuuacagcacuacucugugc

SEQ ID NO: 3589588 - RNA, 23 nt, Human
uguuuacagggagccuccugccc

SEQ ID NO: 3589589 - RNA, 21 nt, Human
uguuuacaucaguuuuaacga

SEQ ID NO: 3589590 - RNA, 22 nt, Human
uguuuacauguguagccuaugu

SEQ ID NO: 3589591 - RNA, 15 nt, Human
uguuuaccuuucucu

SEQ ID NO: 3589592 - RNA, 23 nt, Human
uguuuaccuuucucucucuaagg

SEQ ID NO: 3589593 - RNA, 15 nt, Human
uguuuacugcaaggu

SEQ ID NO: 3589594 - RNA, 16 nt, Human
uguuuacuuaaagauu

SEQ ID NO: 3589595 - RNA, 18 nt, Human
uguuuacuuaaagauuua

SEQ ID NO: 3589596 - RNA, 14 nt, Human
uguuuagaauugaa

SEQ ID NO: 3589597 - RNA, 17 nt, Human
uguuuagaauugaaggu

SEQ ID NO: 3589598 - RNA, 19 nt, Human
uguuuagacuuuaacauaa

SEQ ID NO: 3589599 - RNA, 16 nt, Human
uguuuagaguugcaau

SEQ ID NO: 3589600 - RNA, 16 nt, Human
uguuuagcaaauacau

SEQ ID NO: 3589601 - RNA, 17 nt, Human
uguuuagcagcagccuu

SEQ ID NO: 3589602 - RNA, 16 nt, Human
uguuuaguagcaguga

SEQ ID NO: 3589603 - RNA, 18 nt, Human
uguuuaguagcagugauu

SEQ ID NO: 3589604 - RNA, 13 nt, Human
uguuuagucuugu

SEQ ID NO: 3589605 - RNA, 18 nt, Human
uguuuagucuugucucag

SEQ ID NO: 3589606 - RNA, 17 nt, Human
uguuuagugauauuaca

SEQ ID NO: 3589607 - RNA, 16 nt, Human
uguuuauaaacauugu

SEQ ID NO: 3589608 - RNA, 22 nt, Human
uguuuauaacuauucaguugug

SEQ ID NO: 3589609 - RNA, 15 nt, Human
uguuuauacagcuca

SEQ ID NO: 3589610 - RNA, 21 nt, Human
uguuuauagcaaacuuggaau

SEQ ID NO: 3589611 - RNA, 22 nt, Human
uguuuauaucugcaaaaaaccu

SEQ ID NO: 3589612 - RNA, 14 nt, Human
uguuuauauguguu

SEQ ID NO: 3589613 - RNA, 17 nt, Human
uguuuaucagauacauc

SEQ ID NO: 3589614 - RNA, 15 nt, Human
uguuuauccuuucau

SEQ ID NO: 3589615 - RNA, 18 nt, Human
uguuuauccuuucauaua

SEQ ID NO: 3589616 - RNA, 16 nt, Human
uguuuaucuagaugua

SEQ ID NO: 3589617 - RNA, 18 nt, Human
uguuuaucuagauguaaa

SEQ ID NO: 3589618 - RNA, 12 nt, Human
uguuuaugaaaa

SEQ ID NO: 3589619 - RNA, 13 nt, Human
uguuuaugaaaau

SEQ ID NO: 3589620 - RNA, 21 nt, Human
uguuuaugaaaauaaauagcu

SEQ ID NO: 3589621 - RNA, 21 nt, Human
uguuuaugcaaggaaggaaag

SEQ ID NO: 3589622 - RNA, 14 nt, Human
uguuuaugcuuuug

SEQ ID NO: 3589623 - RNA, 24 nt, Human
uguuuauggccucagcugccucac

SEQ ID NO: 3589624 - RNA, 16 nt, Human
uguuuauguaauuuca

SEQ ID NO: 3589625 - RNA, 18 nt, Human
uguuuauguuguuuauaa

SEQ ID NO: 3589626 - RNA, 14 nt, Human
uguuuauuaaauag

SEQ ID NO: 3589627 - RNA, 14 nt, Human
uguuuauuaaucuu

SEQ ID NO: 3589628 - RNA, 15 nt, Human
uguuuauuaaucuua

SEQ ID NO: 3589629 - RNA, 14 nt, Human
uguugaacaaaaua

SEQ ID NO: 3589630 - RNA, 19 nt, Human
uguugaacaaaauaaauug

SEQ ID NO: 3589631 - RNA, 20 nt, Human
uguugaacagguguuuuucc

SEQ ID NO: 3589632 - RNA, 13 nt, Human
uguugaagagcag

SEQ ID NO: 3589633 - RNA, 23 nt, Human
uguugaaggaacuugucucuuca

SEQ ID NO: 3589634 - RNA, 15 nt, Human
uguugaauucuuuug

SEQ ID NO: 3589635 - RNA, 22 nt, Human
uguugacaaaauuuucucauuu

SEQ ID NO: 3589636 - RNA, 15 nt, Human
uguugacaacuguga

SEQ ID NO: 3589637 - RNA, 18 nt, Human
uguugacaacugugacug

SEQ ID NO: 3589638 - RNA, 16 nt, Human
uguugacaguucugaa

SEQ ID NO: 3589639 - RNA, 19 nt, Human
uguugacauauuuaauguu

SEQ ID NO: 3589640 - RNA, 20 nt, Human
uguugacauauuuaauguuu

SEQ ID NO: 3589641 - RNA, 18 nt, Human
uguugacauuaagaaugu

SEQ ID NO: 3589642 - RNA, 14 nt, Human
uguugacauucuga

SEQ ID NO: 3589643 - RNA, 16 nt, Human
uguugacauucugaau

SEQ ID NO: 3589644 - RNA, 15 nt, Human
uguugacauuuguuu

SEQ ID NO: 3589645 - RNA, 20 nt, Human
uguugacuuauuuucucugu

SEQ ID NO: 3589646 - RNA, 22 nt, Human
uguugacuuauuuucucugugu

SEQ ID NO: 3589647 - RNA, 18 nt, Human
uguugagaauugugcuca

SEQ ID NO: 3589648 - RNA, 15 nt, Human
uguugagagugugac

SEQ ID NO: 3589649 - RNA, 14 nt, Human
uguugagcaagcag

SEQ ID NO: 3589650 - RNA, 16 nt, Human
uguugagcaucacaga

SEQ ID NO: 3589651 - RNA, 17 nt, Human
uguugagccaggccugg

SEQ ID NO: 3589652 - RNA, 19 nt, Human
uguugagguggucugaaug

SEQ ID NO: 3589653 - RNA, 19 nt, Human
uguugauaaauuccacugg

SEQ ID NO: 3589654 - RNA, 21 nt, Human
uguugauacuguugcacgugu

SEQ ID NO: 3589655 - RNA, 23 nt, Human
uguugauacuguugcacgugugu

SEQ ID NO: 3589656 - RNA, 19 nt, Human
uguugaucauguacuuuuu

SEQ ID NO: 3589657 - RNA, 22 nt, Human
uguugaucauguacuuuuuagu

SEQ ID NO: 3589658 - RNA, 16 nt, Human
uguugauccauccagc

SEQ ID NO: 3589659 - RNA, 19 nt, Human
uguugauccauccagcuug

SEQ ID NO: 3589660 - RNA, 22 nt, Human
uguugaugcaauccuuacaaau

SEQ ID NO: 3589661 - RNA, 22 nt, Human
uguugauguaucugaguugcca

SEQ ID NO: 3589662 - RNA, 14 nt, Human
uguugauuaaaaca

SEQ ID NO: 3589663 - RNA, 20 nt, Human
uguugauugcaggaauaagg

SEQ ID NO: 3589664 - RNA, 11 nt, Human
uguugauuucu

SEQ ID NO: 3589665 - RNA, 15 nt, Human
uguugauuuucuguu

SEQ ID NO: 3589666 - RNA, 18 nt, Human
uguugauuuucuguugua

SEQ ID NO: 3589667 - RNA, 22 nt, Human
uguugauuuuuacuguguuuua

SEQ ID NO: 3589668 - RNA, 15 nt, Human
uguugcaagauguga

SEQ ID NO: 3589669 - RNA, 17 nt, Human
uguugcaagugcaauaa

SEQ ID NO: 3589670 - RNA, 20 nt, Human
uguugcaauuaggauuuuga

SEQ ID NO: 3589671 - RNA, 21 nt, Human
uguugcacacccacucagcuc

SEQ ID NO: 3589672 - RNA, 22 nt, Human
uguugcacacccacucagcucc

SEQ ID NO: 3589673 - RNA, 14 nt, Human
uguugcacccagcc

SEQ ID NO: 3589674 - RNA, 18 nt, Human
uguugcacccagcccugg

SEQ ID NO: 3589675 - RNA, 14 nt, Human
uguugcacgugugu

SEQ ID NO: 3589676 - RNA, 13 nt, Human
uguugcacugaag

SEQ ID NO: 3589677 - RNA, 18 nt, Human
uguugcauagguuagaua

SEQ ID NO: 3589678 - RNA, 14 nt, Human
uguugcaugggcua

SEQ ID NO: 3589679 - RNA, 14 nt, Human
uguugcauguuuga

SEQ ID NO: 3589680 - RNA, 16 nt, Human
uguugcauuauucauu

SEQ ID NO: 3589681 - RNA, 23 nt, Human
uguugccaaauauguccuggggu

SEQ ID NO: 3589682 - RNA, 16 nt, Human
uguugccaagagcccg

SEQ ID NO: 3589683 - RNA, 12 nt, Human
uguugcccaggc

SEQ ID NO: 3589684 - RNA, 17 nt, Human
uguugcccaggcagguc

SEQ ID NO: 3589685 - RNA, 19 nt, Human
uguugcccaggcuggagug

SEQ ID NO: 3589686 - RNA, 21 nt, Human
uguugccccuuucucuuuucc

SEQ ID NO: 3589687 - RNA, 21 nt, Human
uguugcccuuucuguaccauu

SEQ ID NO: 3589688 - RNA, 18 nt, Human
uguugccuuuaugguuuc

SEQ ID NO: 3589689 - RNA, 21 nt, Human
uguugcuaagccccagcaagc

SEQ ID NO: 3589690 - RNA, 22 nt, Human
uguugcuaagccccagcaagca

SEQ ID NO: 3589691 - RNA, 23 nt, Human
uguugcucaguguuuuugugaau

SEQ ID NO: 3589692 - RNA, 14 nt, Human
uguugcucccugug

SEQ ID NO: 3589693 - RNA, 15 nt, Human
uguugcucuaggaag

SEQ ID NO: 3589694 - RNA, 20 nt, Human
uguugcucuaggaagacauu

SEQ ID NO: 3589695 - RNA, 21 nt, Human
uguugcucucugugucugaga

SEQ ID NO: 3589696 - RNA, 11 nt, Human
uguugcugaau

SEQ ID NO: 3589697 - RNA, 13 nt, Human
uguugcugaauag

SEQ ID NO: 3589698 - RNA, 23 nt, Human
uguugcugaauaggcgaucacaa

SEQ ID NO: 3589699 - RNA, 14 nt, Human
uguugcugauuuua

SEQ ID NO: 3589700 - RNA, 19 nt, Human
uguugcuguacaaaagcaa

SEQ ID NO: 3589701 - RNA, 14 nt, Human
uguugcuuacaauu

SEQ ID NO: 3589702 - RNA, 16 nt, Human
uguugcuuacaauuuu

SEQ ID NO: 3589703 - RNA, 23 nt, Human
uguugcuugaauagcaauagcau

SEQ ID NO: 3589704 - RNA, 21 nt, Human
uguuggaagcuuguuuuccag

SEQ ID NO: 3589705 - RNA, 12 nt, Human
uguuggaaugaa

SEQ ID NO: 3589706 - RNA, 22 nt, Human
uguuggacaaaugugaagaugc

SEQ ID NO: 3589707 - RNA, 22 nt, Human
uguuggacaagcuucugagacg

SEQ ID NO: 3589708 - RNA, 13 nt, Human
uguuggacccgcu

SEQ ID NO: 3589709 - RNA, 19 nt, Human
uguuggacccgcucuggac

SEQ ID NO: 3589710 - RNA, 16 nt, Human
uguuggagaagaacug

SEQ ID NO: 3589711 - RNA, 11 nt, Human
uguuggaucuu

SEQ ID NO: 3589712 - RNA, 21 nt, Human
uguuggaucuucaauggcuuu

SEQ ID NO: 3589713 - RNA, 17 nt, Human
uguuggauuuuugucuu

SEQ ID NO: 3589714 - RNA, 21 nt, Human
uguuggcacucacagaccugg

SEQ ID NO: 3589715 - RNA, 22 nt, Human
uguuggcacucacagaccugga

SEQ ID NO: 3589716 - RNA, 15 nt, Human
uguuggcagaugcag

SEQ ID NO: 3589717 - RNA, 15 nt, Human
uguguccaucccagc

SEQ ID NO: 3589718 - RNA, 16 nt, Human
uguguccaucccagcg

SEQ ID NO: 3589719 - RNA, 20 nt, Human
uguguccaugcgcucagggc

SEQ ID NO: 3589720 - RNA, 21 nt, Human
ugugucccagaagaugacuga

SEQ ID NO: 3589721 - RNA, 17 nt, Human
ugugucccucucucugg

SEQ ID NO: 3589722 - RNA, 15 nt, Human
uguguccggcccagu

SEQ ID NO: 3589723 - RNA, 17 nt, Human
uguguccuccaggagcu

SEQ ID NO: 3589724 - RNA, 20 nt, Human
uguguccugaaacgcuccuu

SEQ ID NO: 3589725 - RNA, 14 nt, Human
uguguccugguucc

SEQ ID NO: 3589726 - RNA, 20 nt, Human
uguguccuugcaccugcauc

SEQ ID NO: 3589727 - RNA, 16 nt, Human
ugugucuaagauucua

SEQ ID NO: 3589728 - RNA, 17 nt, Human
ugugucuaagauucuag

SEQ ID NO: 3589729 - RNA, 13 nt, Human
ugugucuacagag

SEQ ID NO: 3589730 - RNA, 21 nt, Human
ugugucuacagagaaccugga

SEQ ID NO: 3589731 - RNA, 13 nt, Human
ugugucuccugca

SEQ ID NO: 3589732 - RNA, 16 nt, Human
ugugucucuuuucucu

SEQ ID NO: 3589733 - RNA, 19 nt, Human
ugugucugcgucuguguug

SEQ ID NO: 3589734 - RNA, 14 nt, Human
ugugucugcucagu

SEQ ID NO: 3589735 - RNA, 21 nt, Human
ugugucuguacacguguccug

SEQ ID NO: 3589736 - RNA, 20 nt, Human
ugugucuugcaauggcagcc

SEQ ID NO: 3589737 - RNA, 14 nt, Human
ugugucuuuugcau

SEQ ID NO: 3589738 - RNA, 22 nt, Human
ugugugaaaggaagcuccacug

SEQ ID NO: 3589739 - RNA, 20 nt, Human
ugugugaaauaccagugugg

SEQ ID NO: 3589740 - RNA, 13 nt, Human
ugugugaaggcag

SEQ ID NO: 3589741 - RNA, 22 nt, Human
ugugugaaugaacacucuuuug

SEQ ID NO: 3589742 - RNA, 12 nt, Human
ugugugaaugug

SEQ ID NO: 3589743 - RNA, 13 nt, Human
ugugugaaugugg

SEQ ID NO: 3589744 - RNA, 16 nt, Human
ugugugaccaacugug

SEQ ID NO: 3589745 - RNA, 19 nt, Human
ugugugaccaacuguguug

SEQ ID NO: 3589746 - RNA, 22 nt, Human
ugugugaccccuccuggggcca

SEQ ID NO: 3589747 - RNA, 23 nt, Human
ugugugaccccuccuggggccag

SEQ ID NO: 3589748 - RNA, 18 nt, Human
ugugugacucuuuagcaa

SEQ ID NO: 3589749 - RNA, 17 nt, Human
ugugugagcaagcauuu

SEQ ID NO: 3589750 - RNA, 12 nt, Human
ugugugauaaau

SEQ ID NO: 3589751 - RNA, 18 nt, Human
ugugugauauuucagaaa

SEQ ID NO: 3589752 - RNA, 20 nt, Human
ugugugauauuucagaaaua

SEQ ID NO: 3589753 - RNA, 15 nt, Human
ugugugaugugacau

SEQ ID NO: 3589754 - RNA, 14 nt, Human
ugugugaugugcau

SEQ ID NO: 3589755 - RNA, 14 nt, Human
ugugugauugaagg

SEQ ID NO: 3589756 - RNA, 18 nt, Human
ugugugauugacagcuuu

SEQ ID NO: 3589757 - RNA, 21 nt, Human
ugugugauugacagcuuugcu

SEQ ID NO: 3589758 - RNA, 16 nt, Human
ugugugcaaaagcagu

SEQ ID NO: 3589759 - RNA, 17 nt, Human
ugugugcaccuuaccaa

SEQ ID NO: 3589760 - RNA, 19 nt, Human
ugugugcacuuuuuuucua

SEQ ID NO: 3589761 - RNA, 13 nt, Human
ugugugcagugaa

SEQ ID NO: 3589762 - RNA, 21 nt, Human
ugugugccauagaguuuaaca

SEQ ID NO: 3589763 - RNA, 20 nt, Human
ugugugccucuagcugaauu

SEQ ID NO: 3589764 - RNA, 18 nt, Human
ugugugcgagugugugca

SEQ ID NO: 3589765 - RNA, 19 nt, Human
ugugugcggagucauuuug

SEQ ID NO: 3589766 - RNA, 17 nt, Human
ugugugcucauguaugu

SEQ ID NO: 3589767 - RNA, 22 nt, Human
ugugugcugugguuccuggggu

SEQ ID NO: 3589768 - RNA, 20 nt, Human
ugugugcuuuuuuugugugu

SEQ ID NO: 3589769 - RNA, 17 nt, Human
uguguggacucaagucc

SEQ ID NO: 3589770 - RNA, 16 nt, Human
uguguggacugugaug

SEQ ID NO: 3589771 - RNA, 19 nt, Human
uguguggacugugaugcca

SEQ ID NO: 3589772 - RNA, 20 nt, Human
uguguggagucauuucugau

SEQ ID NO: 3589773 - RNA, 14 nt, Human
uguguggauucuuu

SEQ ID NO: 3589774 - RNA, 18 nt, Human
uguguggccacuucuguc

SEQ ID NO: 3589775 - RNA, 20 nt, Human
uguguggccacuucugucca

SEQ ID NO: 3589776 - RNA, 11 nt, Human
uguguggccug

SEQ ID NO: 3589777 - RNA, 20 nt, Human
uguguggcuuucagagccuc

SEQ ID NO: 3589778 - RNA, 15 nt, Human
ugugugguagaaaca

SEQ ID NO: 3589779 - RNA, 14 nt, Human
uguguggucagugg

SEQ ID NO: 3589780 - RNA, 14 nt, Human
ugugugguggccuc

SEQ ID NO: 3589781 - RNA, 20 nt, Human
ugugugguggguucuuugga

SEQ ID NO: 3589782 - RNA, 22 nt, Human
ugugugguuuaguguaaaaaug

SEQ ID NO: 3589783 - RNA, 23 nt, Human
ugugugguuuaguguaaaaauga

SEQ ID NO: 3589784 - RNA, 15 nt, Human
uguguguauauaugu

SEQ ID NO: 3589785 - RNA, 17 nt, Human
uguguguaugcugcuuu

SEQ ID NO: 3589786 - RNA, 11 nt, Human
uguguguaugu

SEQ ID NO: 3589787 - RNA, 14 nt, Human
uguguguauuugcu

SEQ ID NO: 3589788 - RNA, 16 nt, Human
uguguguccaaaacug

SEQ ID NO: 3589789 - RNA, 21 nt, Human
uguguguccaaaacugccuca

SEQ ID NO: 3589790 - RNA, 16 nt, Human
ugugugucccaggcag

SEQ ID NO: 3589791 - RNA, 19 nt, Human
ugugugucccaggcaggga

SEQ ID NO: 3589792 - RNA, 16 nt, Human
ugugugucuuaauuau

SEQ ID NO: 3589793 - RNA, 17 nt, Human
ugugugugaaaaugugu

SEQ ID NO: 3589794 - RNA, 14 nt, Human
ugugugugcccucu

SEQ ID NO: 3589795 - RNA, 22 nt, Human
ugugugugcccucugggcucug

SEQ ID NO: 3589796 - RNA, 9 nt, Human
ugugugugu

SEQ ID NO: 3589797 - RNA, 14 nt, Human
uguguguguaugcu

SEQ ID NO: 3589798 - RNA, 14 nt, Human
uguguguguaugug

SEQ ID NO: 3589799 - RNA, 15 nt, Human
uguguguguauguga

SEQ ID NO: 3589800 - RNA, 15 nt, Human
ugugugugugcacau

SEQ ID NO: 3589801 - RNA, 12 nt, Human
ugugugugugua

SEQ ID NO: 3589802 - RNA, 14 nt, Human
ugugugugugugug

SEQ ID NO: 3589803 - RNA, 19 nt, Human
uguguguuccaaguuucca

SEQ ID NO: 3589804 - RNA, 11 nt, Human
uguguguuccu

SEQ ID NO: 3589805 - RNA, 15 nt, Human
uguguguugauacug

SEQ ID NO: 3589806 - RNA, 17 nt, Human
uguguguugauacuguu

SEQ ID NO: 3589807 - RNA, 19 nt, Human
uguguguugauacuguugc

SEQ ID NO: 3589808 - RNA, 16 nt, Human
uguguguugccacagg

SEQ ID NO: 3589809 - RNA, 15 nt, Human
uguguguuuaaauaa

SEQ ID NO: 3589810 - RNA, 16 nt, Human
uguguguuuaaauaaa

SEQ ID NO: 3589811 - RNA, 19 nt, Human
uguguguuuaaauaaagua

SEQ ID NO: 3589812 - RNA, 13 nt, Human
uguguuaauuuaa

SEQ ID NO: 3589813 - RNA, 18 nt, Human
uguguuaauuuaaguuuu

SEQ ID NO: 3589814 - RNA, 23 nt, Human
uguguuaccugaaaacacugugc

SEQ ID NO: 3589815 - RNA, 23 nt, Human
uguguuacuaaaaaaaagaugaa

SEQ ID NO: 3589816 - RNA, 22 nt, Human
uguguuaucacccagaagaaaa

SEQ ID NO: 3589817 - RNA, 19 nt, Human
uguguuaugcaaaagcaag

SEQ ID NO: 3589818 - RNA, 18 nt, Human
uguguuccaaguuuccaa

SEQ ID NO: 3589819 - RNA, 16 nt, Human
uguguucccauuucag

SEQ ID NO: 3589820 - RNA, 18 nt, Human
uguguucccuuugucuuu

SEQ ID NO: 3589821 - RNA, 15 nt, Human
uguguuccuggcaau

SEQ ID NO: 3589822 - RNA, 20 nt, Human
uguguucgcgugugugggug

SEQ ID NO: 3589823 - RNA, 15 nt, Human
uguguucguucuugu

SEQ ID NO: 3589824 - RNA, 17 nt, Human
uguguucguucuuguuc

SEQ ID NO: 3589825 - RNA, 13 nt, Human
uguguucuaucca

SEQ ID NO: 3589826 - RNA, 18 nt, Human
uguguucuguuuguuaaa

SEQ ID NO: 3589827 - RNA, 21 nt, Human
uguguucuguuuguuaaaacu

SEQ ID NO: 3589828 - RNA, 16 nt, Human
uguguugaaaaccaaa

SEQ ID NO: 3589829 - RNA, 15 nt, Human
uguguugauacuguu

SEQ ID NO: 3589830 - RNA, 16 nt, Human
uguguugauacuguug

SEQ ID NO: 3589831 - RNA, 17 nt, Human
uguguugauacuguugc

SEQ ID NO: 3589832 - RNA, 21 nt, Human
uguguugauacuguugcacgu

SEQ ID NO: 3589833 - RNA, 22 nt, Human
uguguugauacuguugcacgug

SEQ ID NO: 3589834 - RNA, 24 nt, Human
uguguugcauuauucauuuaguga

SEQ ID NO: 3589835 - RNA, 18 nt, Human
uguguugccacuuuccaa

SEQ ID NO: 3589836 - RNA, 19 nt, Human
uguguuggacagagaaggg

SEQ ID NO: 3589837 - RNA, 22 nt, Human
uguguugggauugagucugugc

SEQ ID NO: 3589838 - RNA, 19 nt, Human
uguguuggggccuuggccu

SEQ ID NO: 3589839 - RNA, 23 nt, Human
uguguuguugcuucuugugaagg

SEQ ID NO: 3589840 - RNA, 13 nt, Human
uguguuuaaauaa

SEQ ID NO: 3589841 - RNA, 12 nt, Human
uguguuuauuca

SEQ ID NO: 3589842 - RNA, 14 nt, Human
uguguuuauucaaa

SEQ ID NO: 3589843 - RNA, 21 nt, Human
uguguuucacaguuugaaaua

SEQ ID NO: 3589844 - RNA, 20 nt, Human
uguguuucuaugugacaauu

SEQ ID NO: 3589845 - RNA, 13 nt, Human
uguguuugaagca

SEQ ID NO: 3589846 - RNA, 16 nt, Human
uguguuugcuccccuu

SEQ ID NO: 3589847 - RNA, 15 nt, Human
uguguuugcuuucug

SEQ ID NO: 3589848 - RNA, 23 nt, Human
uguguuugguuuacauuuaaagc

SEQ ID NO: 3589849 - RNA, 14 nt, Human
uguguuugucauua

SEQ ID NO: 3589850 - RNA, 14 nt, Human
uguguuuguuccua

SEQ ID NO: 3589851 - RNA, 13 nt, Human
uguguuuucugaa

SEQ ID NO: 3589852 - RNA, 23 nt, Human
uguguuuucugaauaacauuugu

SEQ ID NO: 3589853 - RNA, 16 nt, Human
uguguuuugaaagaau

SEQ ID NO: 3589854 - RNA, 19 nt, Human
uguguuuugcaagccagau

SEQ ID NO: 3589855 - RNA, 14 nt, Human
uguguuuuucuauu

SEQ ID NO: 3589856 - RNA, 14 nt, Human
uguguuuuucucca

SEQ ID NO: 3589857 - RNA, 18 nt, Human
uguguuuuucuccagugc

SEQ ID NO: 3589858 - RNA, 13 nt, Human
uguguuuuugaaa

SEQ ID NO: 3589859 - RNA, 16 nt, Human
uguguuuuuuaagaua

SEQ ID NO: 3589860 - RNA, 17 nt, Human
uguguuuuuuaagauag

SEQ ID NO: 3589861 - RNA, 23 nt, Human
uguuaaaaaaauaagaagaaugc

SEQ ID NO: 3589862 - RNA, 16 nt, Human
uguuaaaaauaaaucc

SEQ ID NO: 3589863 - RNA, 18 nt, Human
uguuaaaacacuucuguc

SEQ ID NO: 3589864 - RNA, 12 nt, Human
uguuaaaauaac

SEQ ID NO: 3589865 - RNA, 23 nt, Human
uguuaaaaugcaugauugcagaa

SEQ ID NO: 3589866 - RNA, 23 nt, Human
uguuaaaauguauucuuaaauuc

SEQ ID NO: 3589867 - RNA, 18 nt, Human
uguuaaaccaugggauaa

SEQ ID NO: 3589868 - RNA, 12 nt, Human
uguuaaacuguu

SEQ ID NO: 3589869 - RNA, 16 nt, Human
uguuaaauaaauugua

SEQ ID NO: 3589870 - RNA, 15 nt, Human
uguuaaauaaggccu

SEQ ID NO: 3589871 - RNA, 23 nt, Human
uguuaaauaauauggcuaugcuu

SEQ ID NO: 3589872 - RNA, 18 nt, Human
uguuaaauacaggaaaca

SEQ ID NO: 3589873 - RNA, 15 nt, Human
uguuaaauuaauuau

SEQ ID NO: 3589874 - RNA, 19 nt, Human
uguuaaauuuguaaguuuc

SEQ ID NO: 3589875 - RNA, 19 nt, Human
uguuaacaaugccuauugu

SEQ ID NO: 3589876 - RNA, 23 nt, Human
uguuaacaaugccuauuguaaua

SEQ ID NO: 3589877 - RNA, 13 nt, Human
uguuaacagaagg

SEQ ID NO: 3589878 - RNA, 15 nt, Human
uguuaacauuccaag

SEQ ID NO: 3589879 - RNA, 21 nt, Human
uguuaacauuccaagacucua

SEQ ID NO: 3589880 - RNA, 16 nt, Human
uguuaaccaaggaaau

SEQ ID NO: 3589881 - RNA, 17 nt, Human
uguuaacugaauaccac

SEQ ID NO: 3589882 - RNA, 16 nt, Human
uguuaacugagugccu

SEQ ID NO: 3589883 - RNA, 14 nt, Human
uguuaacuuauuca

SEQ ID NO: 3589884 - RNA, 23 nt, Human
uguuaagaauugaccaucugcuu

SEQ ID NO: 3589885 - RNA, 13 nt, Human
uguuaagcucugc

SEQ ID NO: 3589886 - RNA, 14 nt, Human
uguuaagcucugcu

SEQ ID NO: 3589887 - RNA, 15 nt, Human
uguuaaggaaacucu

SEQ ID NO: 3589888 - RNA, 16 nt, Human
uguuaaggaaacucuu

SEQ ID NO: 3589889 - RNA, 17 nt, Human
uguuaaggaaacucuua

SEQ ID NO: 3589890 - RNA, 21 nt, Human
uguuaaggaaacucuuaucuc

SEQ ID NO: 3589891 - RNA, 22 nt, Human
uguuaaggaaacucuuaucuca

SEQ ID NO: 3589892 - RNA, 23 nt, Human
uguuaaggaaacucuuaucucag

SEQ ID NO: 3589893 - RNA, 22 nt, Human
uguuaagguggauugaggccag

SEQ ID NO: 3589894 - RNA, 17 nt, Human
uguuaaguauuuucaua

SEQ ID NO: 3589895 - RNA, 18 nt, Human
uguuaaguccucccugac

SEQ ID NO: 3589896 - RNA, 22 nt, Human
uguuaaguccucccugacuuuu

SEQ ID NO: 3589897 - RNA, 17 nt, Human
uguuaaguuauagugaa

SEQ ID NO: 3589898 - RNA, 16 nt, Human
uguuaauaaucucaca

SEQ ID NO: 3589899 - RNA, 14 nt, Human
uguuaauacaaggu

SEQ ID NO: 3589900 - RNA, 17 nt, Human
uguuaauacaagguaua

SEQ ID NO: 3589901 - RNA, 13 nt, Human
uguuaauaucacu

SEQ ID NO: 3589902 - RNA, 18 nt, Human
ugugaagagggagaagca

SEQ ID NO: 3589903 - RNA, 22 nt, Human
ugugaagaugauauacuauuuu

SEQ ID NO: 3589904 - RNA, 15 nt, Human
ugugauggagugcug

SEQ ID NO: 3589905 - RNA, 17 nt, Human
ugugauggggcccugcc

SEQ ID NO: 3589906 - RNA, 19 nt, Human
ugugauggggcccugccuc

SEQ ID NO: 3589907 - RNA, 21 nt, Human
uuauagaagaaugcaugcuuu

SEQ ID NO: 3589908 - RNA, 16 nt, Human
uuauagaaguuuagau

SEQ ID NO: 3589909 - RNA, 21 nt, Human
uuauagaggcuagcuucugcu

SEQ ID NO: 3589910 - RNA, 23 nt, Human
uuauagaguguacuuaacuauuc

SEQ ID NO: 3589911 - RNA, 21 nt, Human
uuauagaucccccagacuuua

SEQ ID NO: 3589912 - RNA, 13 nt, Human
uuauagauucuaa

SEQ ID NO: 3589913 - RNA, 16 nt, Human
uuauagccgaaaugau

SEQ ID NO: 3589914 - RNA, 15 nt, Human
uuauagccucugucu

SEQ ID NO: 3589915 - RNA, 19 nt, Human
uuauagccucugucuggca

SEQ ID NO: 3589916 - RNA, 12 nt, Human
uuauagcucuaa

SEQ ID NO: 3589917 - RNA, 17 nt, Human
uuauagcucuaauguuu

SEQ ID NO: 3589918 - RNA, 16 nt, Human
uuauaggaucauuugu

SEQ ID NO: 3589919 - RNA, 22 nt, Human
uuauagguaaucaaugaauauu

SEQ ID NO: 3589920 - RNA, 14 nt, Human
uuauaggugagaaa

SEQ ID NO: 3589921 - RNA, 19 nt, Human
uuauagguggccucuccuu

SEQ ID NO: 3589922 - RNA, 16 nt, Human
uuauaguacugacaga

SEQ ID NO: 3589923 - RNA, 22 nt, Human
uuauagucauuuauuuuaaaaa

SEQ ID NO: 3589924 - RNA, 20 nt, Human
uuauagucuaagacuauaua

SEQ ID NO: 3589925 - RNA, 13 nt, Human
uuauagugcaaua

SEQ ID NO: 3589926 - RNA, 13 nt, Human
uuauaguggaaaa

SEQ ID NO: 3589927 - RNA, 16 nt, Human
uuauaguggaaaaaca

SEQ ID NO: 3589928 - RNA, 20 nt, Human
uuauagugguguuuuaaaga

SEQ ID NO: 3589929 - RNA, 13 nt, Human
uuauaguuacugu

SEQ ID NO: 3589930 - RNA, 14 nt, Human
uuauaguuacugug

SEQ ID NO: 3589931 - RNA, 15 nt, Human
uuauaguuuauacag

SEQ ID NO: 3589932 - RNA, 16 nt, Human
uuauaguuugggcuuc

SEQ ID NO: 3589933 - RNA, 14 nt, Human
uuauauaaaugcuu

SEQ ID NO: 3589934 - RNA, 13 nt, Human
uuauauaaaugua

SEQ ID NO: 3589935 - RNA, 18 nt, Human
uuauauaacuguauuuga

SEQ ID NO: 3589936 - RNA, 22 nt, Human
uuauauaacuguauuugaaaua

SEQ ID NO: 3589937 - RNA, 14 nt, Human
uuauauaaguauuc

SEQ ID NO: 3589938 - RNA, 21 nt, Human
uuauauaauaucuaaaguuau

SEQ ID NO: 3589939 - RNA, 12 nt, Human
uuauauaauugu

SEQ ID NO: 3589940 - RNA, 16 nt, Human
uuauauaauuguugaa

SEQ ID NO: 3589941 - RNA, 19 nt, Human
uuauauagauuauaacuug

SEQ ID NO: 3589942 - RNA, 19 nt, Human
uuauauagcaagacauuau

SEQ ID NO: 3589943 - RNA, 17 nt, Human
uuauauagcaucuggaa

SEQ ID NO: 3589944 - RNA, 13 nt, Human
uuauauagcuuga

SEQ ID NO: 3589945 - RNA, 12 nt, Human
uuauauauauaa

SEQ ID NO: 3589946 - RNA, 18 nt, Human
uuauauaucccugauaaa

SEQ ID NO: 3589947 - RNA, 19 nt, Human
uuauauaucccugauaaau

SEQ ID NO: 3589948 - RNA, 15 nt, Human
uuauauaugaaaacu

SEQ ID NO: 3589949 - RNA, 12 nt, Human
uuauauauguga

SEQ ID NO: 3589950 - RNA, 23 nt, Human
uuauauaugugaacauuuaucaa

SEQ ID NO: 3589951 - RNA, 16 nt, Human
uuauauauuauaugga

SEQ ID NO: 3589952 - RNA, 17 nt, Human
uuauauauuauauggaa

SEQ ID NO: 3589953 - RNA, 12 nt, Human
uuauaucaaagu

SEQ ID NO: 3589954 - RNA, 13 nt, Human
uuauaucaaagua

SEQ ID NO: 3589955 - RNA, 15 nt, Human
uuauaucaaaguauu

SEQ ID NO: 3589956 - RNA, 15 nt, Human
uuauaucagccugag

SEQ ID NO: 3589957 - RNA, 16 nt, Human
uuauaucagccugagu

SEQ ID NO: 3589958 - RNA, 19 nt, Human
uuauaucaguccucuuuca

SEQ ID NO: 3589959 - RNA, 15 nt, Human
uuauaucauauguau

SEQ ID NO: 3589960 - RNA, 21 nt, Human
uuauaucaucagcauaccuuu

SEQ ID NO: 3589961 - RNA, 17 nt, Human
uuauauccauuuuuauc

SEQ ID NO: 3589962 - RNA, 23 nt, Human
uuauaucuauauuuuacauaaau

SEQ ID NO: 3589963 - RNA, 23 nt, Human
uuauaucuccuuuguauucuguc

SEQ ID NO: 3589964 - RNA, 14 nt, Human
uuauaucugaggaa

SEQ ID NO: 3589965 - RNA, 20 nt, Human
uuauaucugaggaauucugu

SEQ ID NO: 3589966 - RNA, 13 nt, Human
uuauaucuguaug

SEQ ID NO: 3589967 - RNA, 21 nt, Human
uuauaugaacauacaaaugca

SEQ ID NO: 3589968 - RNA, 19 nt, Human
uuauaugaagaaaaucacu

SEQ ID NO: 3589969 - RNA, 20 nt, Human
uuauaugcuuuauuaauguu

SEQ ID NO: 3589970 - RNA, 19 nt, Human
uuauauggaaauauauauu

SEQ ID NO: 3589971 - RNA, 13 nt, Human
uuauauggaaauu

SEQ ID NO: 3589972 - RNA, 22 nt, Human
uuauauguacccucugaaauac

SEQ ID NO: 3589973 - RNA, 14 nt, Human
uuauauguaccgua

SEQ ID NO: 3589974 - RNA, 22 nt, Human
uuauauguauccaguacauuua

SEQ ID NO: 3589975 - RNA, 23 nt, Human
uuauauguauccaguacauuuaa

SEQ ID NO: 3589976 - RNA, 14 nt, Human
uuauauguaugugu

SEQ ID NO: 3589977 - RNA, 16 nt, Human
uuauauguauguguuu

SEQ ID NO: 3589978 - RNA, 17 nt, Human
uuauauguauguguuua

SEQ ID NO: 3589979 - RNA, 19 nt, Human
uuauauguauguguuuaga

SEQ ID NO: 3589980 - RNA, 21 nt, Human
uuauauguauguguuuagaau

SEQ ID NO: 3589981 - RNA, 16 nt, Human
uuauaugucaaagcag

SEQ ID NO: 3589982 - RNA, 14 nt, Human
uuauauguguugaa

SEQ ID NO: 3589983 - RNA, 19 nt, Human
uuauauguguugaaaacca

SEQ ID NO: 3589984 - RNA, 15 nt, Human
uuauauuaaaauaug

SEQ ID NO: 3589985 - RNA, 20 nt, Human
uuauauuaaaauauggcuau

SEQ ID NO: 3589986 - RNA, 16 nt, Human
uuauuucaauguaauu

SEQ ID NO: 3589987 - RNA, 18 nt, Human
uuauuucaauguaauuaa

SEQ ID NO: 3589988 - RNA, 20 nt, Human
uuauuucacuuuagaugcug

SEQ ID NO: 3589989 - RNA, 17 nt, Human
uuauuucagauuuugau

SEQ ID NO: 3589990 - RNA, 18 nt, Human
uuauuucagauuuugaua

SEQ ID NO: 3589991 - RNA, 18 nt, Human
uuauuucauaaacaacuu

SEQ ID NO: 3589992 - RNA, 19 nt, Human
uuauuuccaaauaaaauga

SEQ ID NO: 3589993 - RNA, 18 nt, Human
uuauuuccaguguucuau

SEQ ID NO: 3589994 - RNA, 21 nt, Human
uuauuuccaucaugucagagc

SEQ ID NO: 3589995 - RNA, 22 nt, Human
uuauuucccuacauuaaacaug

SEQ ID NO: 3589996 - RNA, 19 nt, Human
uuauuuccuaguucuguag

SEQ ID NO: 3589997 - RNA, 11 nt, Human
uuauuuccuau

SEQ ID NO: 3589998 - RNA, 17 nt, Human
uuauuuccuuuguccuu

SEQ ID NO: 3589999 - RNA, 14 nt, Human
uuauuucuaaaaua

SEQ ID NO: 3590000 - RNA, 18 nt, Human
uuauuucuagcuuuuuaa

SEQ ID NO: 3590001 - RNA, 18 nt, Human
uuauuucuaguccaaaau

SEQ ID NO: 3590002 - RNA, 22 nt, Human
uuauuucuaguccaaaauuaca

SEQ ID NO: 3590003 - RNA, 11 nt, Human
uuauuucugca

SEQ ID NO: 3590004 - RNA, 16 nt, Human
uuauuucugucauuca

SEQ ID NO: 3590005 - RNA, 22 nt, Human
uuauuugaaaacauauaaagca

SEQ ID NO: 3590006 - RNA, 14 nt, Human
uuauuugaaugacu

SEQ ID NO: 3590007 - RNA, 12 nt, Human
uuauuugagaag

SEQ ID NO: 3590008 - RNA, 18 nt, Human
uuauuugcagagacagga

SEQ ID NO: 3590009 - RNA, 21 nt, Human
uuauuugcagugcaguauaga

SEQ ID NO: 3590010 - RNA, 21 nt, Human
uuauuugcauguuauguuuaa

SEQ ID NO: 3590011 - RNA, 20 nt, Human
uuauuuggaaaggaaugcaa

SEQ ID NO: 3590012 - RNA, 18 nt, Human
uuauuugguucccuuccu

SEQ ID NO: 3590013 - RNA, 15 nt, Human
uuauuuguaaauuua

SEQ ID NO: 3590014 - RNA, 17 nt, Human
uuauuuguaauagaugu

SEQ ID NO: 3590015 - RNA, 14 nt, Human
uuauuuguacaguu

SEQ ID NO: 3590016 - RNA, 21 nt, Human
uuauuuguguaauagaaaacu

SEQ ID NO: 3590017 - RNA, 22 nt, Human
uuauuuguguuuuaauuuaaac

SEQ ID NO: 3590018 - RNA, 14 nt, Human
uuauuuguugagag

SEQ ID NO: 3590019 - RNA, 19 nt, Human
uuauuuguugagaguguga

SEQ ID NO: 3590020 - RNA, 17 nt, Human
uuauuuuaaaaaaugaa

SEQ ID NO: 3590021 - RNA, 17 nt, Human
uuauuuuaaacaaaaua

SEQ ID NO: 3590022 - RNA, 21 nt, Human
uuauuuuaaauuauaaggacu

SEQ ID NO: 3590023 - RNA, 12 nt, Human
uuauuuuaagac

SEQ ID NO: 3590024 - RNA, 19 nt, Human
uuauuuuaauaauguuuca

SEQ ID NO: 3590025 - RNA, 17 nt, Human
uuauuuuaaugugauga

SEQ ID NO: 3590026 - RNA, 17 nt, Human
uuauuuuaauucaguug

SEQ ID NO: 3590027 - RNA, 12 nt, Human
uuauuuuagcag

SEQ ID NO: 3590028 - RNA, 16 nt, Human
uuauuuuagcaguucu

SEQ ID NO: 3590029 - RNA, 13 nt, Human
uuauuuuauuaug

SEQ ID NO: 3590030 - RNA, 15 nt, Human
uuauuuuauuaugaa

SEQ ID NO: 3590031 - RNA, 17 nt, Human
uuauuuucaaaaccagg

SEQ ID NO: 3590032 - RNA, 15 nt, Human
uuauuuucaaguagc

SEQ ID NO: 3590033 - RNA, 12 nt, Human
uuauuuucacug

SEQ ID NO: 3590034 - RNA, 12 nt, Human
uuauuuucagua

SEQ ID NO: 3590035 - RNA, 12 nt, Human
uuauuuucauua

SEQ ID NO: 3590036 - RNA, 13 nt, Human
uuauuuuccaaaa

SEQ ID NO: 3590037 - RNA, 18 nt, Human
uuauuuuccccuaucauu

SEQ ID NO: 3590038 - RNA, 15 nt, Human
uuauuuuccucccca

SEQ ID NO: 3590039 - RNA, 12 nt, Human
uuauuuucuaca

SEQ ID NO: 3590040 - RNA, 19 nt, Human
uuauuuucuacguuucuuu

SEQ ID NO: 3590041 - RNA, 15 nt, Human
uuauuuucugucaga

SEQ ID NO: 3590042 - RNA, 20 nt, Human
uuauuuucuuuugaauuguu

SEQ ID NO: 3590043 - RNA, 22 nt, Human
uuauuuugaaaagcuucuuaau

SEQ ID NO: 3590044 - RNA, 21 nt, Human
uuauuuugagauguaaaaaga

SEQ ID NO: 3590045 - RNA, 12 nt, Human
uuauuuugcaac

SEQ ID NO: 3590046 - RNA, 22 nt, Human
uuauuuuggaaaauaaauuauu

SEQ ID NO: 3590047 - RNA, 15 nt, Human
uuauuuuggggucuc

SEQ ID NO: 3590048 - RNA, 13 nt, Human
uuauuuuguaauu

SEQ ID NO: 3590049 - RNA, 17 nt, Human
uuauuuuguaauuauga

SEQ ID NO: 3590050 - RNA, 14 nt, Human
uuauuuuguguaaa

SEQ ID NO: 3590051 - RNA, 17 nt, Human
uuauuuuguucauacau

SEQ ID NO: 3590052 - RNA, 16 nt, Human
uuauuuuuaagaaaga

SEQ ID NO: 3590053 - RNA, 14 nt, Human
uuauuuuuagaauu

SEQ ID NO: 3590054 - RNA, 22 nt, Human
uuauuuuuagaauuuugugaaa

SEQ ID NO: 3590055 - RNA, 17 nt, Human
uuauuuuuagacagagu

SEQ ID NO: 3590056 - RNA, 14 nt, Human
uuauuuuuauaauu

SEQ ID NO: 3590057 - RNA, 18 nt, Human
uuauuuuuauaauuguac

SEQ ID NO: 3590058 - RNA, 21 nt, Human
uuauuuuuauaauuguacaaa

SEQ ID NO: 3590059 - RNA, 15 nt, Human
uuauuuuuauacagu

SEQ ID NO: 3590060 - RNA, 16 nt, Human
uuauuuuuauacagua

SEQ ID NO: 3590061 - RNA, 20 nt, Human
uuauuuuuauacaguaguga

SEQ ID NO: 3590062 - RNA, 14 nt, Human
uuauuuuucauauu

SEQ ID NO: 3590063 - RNA, 22 nt, Human
uuauuuuucuaagguucucaua

SEQ ID NO: 3590064 - RNA, 23 nt, Human
uuauuuuuggcguggcugacuua

SEQ ID NO: 3590065 - RNA, 14 nt, Human
uuauuuuuuaauua

SEQ ID NO: 3590066 - RNA, 13 nt, Human
uuauuuuuuauug

SEQ ID NO: 3590067 - RNA, 13 nt, Human
uuauuuuuucaga

SEQ ID NO: 3590068 - RNA, 19 nt, Human
uuauuuuuucagaccgaaa

SEQ ID NO: 3590069 - RNA, 21 nt, Human
uuauuuuuuggacuucaaagc

SEQ ID NO: 3590070 - RNA, 17 nt, Human
uuauuuuuuuaaaauuu

SEQ ID NO: 3590071 - RNA, 19 nt, Human
uuauuuuuuuuaauuguau

SEQ ID NO: 3590072 - RNA, 18 nt, Human
uuauuuuuuuuuuuugaa

SEQ ID NO: 3590073 - RNA, 20 nt, Human
uuauuuuuuuuuuuugaaaa

SEQ ID NO: 3590074 - RNA, 17 nt, Human
uucaaaaaaacacuagu

SEQ ID NO: 3590075 - RNA, 18 nt, Human
uucaaaaaaauaaaauaa

SEQ ID NO: 3590076 - RNA, 17 nt, Human
uucaaaaacacaguguu

SEQ ID NO: 3590077 - RNA, 23 nt, Human
uucaaaaacacaguguuuuugua

SEQ ID NO: 3590078 - RNA, 14 nt, Human
uucaaaaacuguuu

SEQ ID NO: 3590079 - RNA, 21 nt, Human
uucaaaaagucacaguuaagg

SEQ ID NO: 3590080 - RNA, 14 nt, Human
uucaaaaaucugaa

SEQ ID NO: 3590081 - RNA, 17 nt, Human
uucaaaaauguacaaaa

SEQ ID NO: 3590082 - RNA, 21 nt, Human
uucaaaaauguacaaaauaaa

SEQ ID NO: 3590083 - RNA, 18 nt, Human
uucaaaacauugugccau

SEQ ID NO: 3590084 - RNA, 20 nt, Human
uucaaaaguauuuuccugua

SEQ ID NO: 3590085 - RNA, 12 nt, Human
uucaaaaguucc

SEQ ID NO: 3590086 - RNA, 16 nt, Human
uucaaaaguuccaaga

SEQ ID NO: 3590087 - RNA, 16 nt, Human
uucaaaaguugaaauu

SEQ ID NO: 3590088 - RNA, 20 nt, Human
uucaaaaguuuguuugcuua

SEQ ID NO: 3590089 - RNA, 20 nt, Human
uucaaaauaggguauauuuu

SEQ ID NO: 3590090 - RNA, 16 nt, Human
uucaaaauauguucuu

SEQ ID NO: 3590091 - RNA, 23 nt, Human
uucaaaauauugagcagaauuca

SEQ ID NO: 3590092 - RNA, 13 nt, Human
uucaaaaugauuu

SEQ ID NO: 3590093 - RNA, 17 nt, Human
uucaaaaugcuuuuuau

SEQ ID NO: 3590094 - RNA, 11 nt, Human
uucaaaauguc

SEQ ID NO: 3590095 - RNA, 14 nt, Human
uucaaaaugucugu

SEQ ID NO: 3590096 - RNA, 15 nt, Human
uucaaaauguuaucu

SEQ ID NO: 3590097 - RNA, 23 nt, Human
uucaaaauguuaucuucucaagu

SEQ ID NO: 3590098 - RNA, 19 nt, Human
uucaaacugugaagcauuu

SEQ ID NO: 3590099 - RNA, 17 nt, Human
uucaaacuuacuauuuu

SEQ ID NO: 3590100 - RNA, 15 nt, Human
uucaaagagaaaaca

SEQ ID NO: 3590101 - RNA, 18 nt, Human
uucaaagaugcugugagu

SEQ ID NO: 3590102 - RNA, 12 nt, Human
uucaaagcaauu

SEQ ID NO: 3590103 - RNA, 19 nt, Human
uucaaagcaccaaaauaag

SEQ ID NO: 3590104 - RNA, 23 nt, Human
uucaaagcauggacauuuagaag

SEQ ID NO: 3590105 - RNA, 17 nt, Human
uucaaagccuucucccu

SEQ ID NO: 3590106 - RNA, 12 nt, Human
uucaaagguucu

SEQ ID NO: 3590107 - RNA, 17 nt, Human
uucaaagucaugauguu

SEQ ID NO: 3590108 - RNA, 21 nt, Human
uucaaagucaugauguuuuua

SEQ ID NO: 3590109 - RNA, 19 nt, Human
uucaaagucucaaugaaau

SEQ ID NO: 3590110 - RNA, 15 nt, Human
uucaaaguugccuaa

SEQ ID NO: 3590111 - RNA, 16 nt, Human
uucaaaguuuuguugu

SEQ ID NO: 3590112 - RNA, 20 nt, Human
uucaaaguuuuguuguacuu

SEQ ID NO: 3590113 - RNA, 18 nt, Human
uucaaauagggucuaacu

SEQ ID NO: 3590114 - RNA, 23 nt, Human
uucaaauccuuccaaaaauuauu

SEQ ID NO: 3590115 - RNA, 17 nt, Human
uucaaauccuugaagau

SEQ ID NO: 3590116 - RNA, 17 nt, Human
uucaaauggaguuggag

SEQ ID NO: 3590117 - RNA, 19 nt, Human
uucaaaugggcugcugcuu

SEQ ID NO: 3590118 - RNA, 21 nt, Human
uucaaauguguuuugguccug

SEQ ID NO: 3590119 - RNA, 22 nt, Human
uucaaauuccuauuuuuaaaua

SEQ ID NO: 3590120 - RNA, 19 nt, Human
uucaaauucuucugaacuc

SEQ ID NO: 3590121 - RNA, 14 nt, Human
uucaaauugugugu

SEQ ID NO: 3590122 - RNA, 11 nt, Human
uucaaauuuag

SEQ ID NO: 3590123 - RNA, 22 nt, Human
uucaaauuugucugguuaaaaa

SEQ ID NO: 3590124 - RNA, 12 nt, Human
uucaacaaacau

SEQ ID NO: 3590125 - RNA, 20 nt, Human
uucaacaaacauuugcugaa

SEQ ID NO: 3590126 - RNA, 20 nt, Human
uucaacaaggcuugcugcag

SEQ ID NO: 3590127 - RNA, 19 nt, Human
uucaacagcaagugugaau

SEQ ID NO: 3590128 - RNA, 16 nt, Human
uucaacagugaagaca

SEQ ID NO: 3590129 - RNA, 14 nt, Human
uucaacauccugcc

SEQ ID NO: 3590130 - RNA, 17 nt, Human
uucaacauguuauuugu

SEQ ID NO: 3590131 - RNA, 19 nt, Human
uucaaccacuguaaaauga

SEQ ID NO: 3590132 - RNA, 14 nt, Human
uucaaccagauaac

SEQ ID NO: 3590133 - RNA, 14 nt, Human
uucaaccauggacu

SEQ ID NO: 3590134 - RNA, 16 nt, Human
uucaacgcagcccugc

SEQ ID NO: 3590135 - RNA, 19 nt, Human
uucaacgcagcccugcuuu

SEQ ID NO: 3590136 - RNA, 20 nt, Human
uucaacgcagcccugcuuug

SEQ ID NO: 3590137 - RNA, 18 nt, Human
uucaacguuucuucacuu

SEQ ID NO: 3590138 - RNA, 12 nt, Human
uucaacuauuuu

SEQ ID NO: 3590139 - RNA, 13 nt, Human
uucaacucagacu

SEQ ID NO: 3590140 - RNA, 14 nt, Human
uucaacugaaaaga

SEQ ID NO: 3590141 - RNA, 14 nt, Human
uucaacuuaacuau

SEQ ID NO: 3590142 - RNA, 19 nt, Human
uucaacuuauuaacaauua

SEQ ID NO: 3590143 - RNA, 15 nt, Human
uucaacuuugaauaa

SEQ ID NO: 3590144 - RNA, 19 nt, Human
uucaacuuugaauaaagaa

SEQ ID NO: 3590145 - RNA, 22 nt, Human
uucaacuuugaauaaagaauac

SEQ ID NO: 3590146 - RNA, 17 nt, Human
uucaagaaaaaauaaau

SEQ ID NO: 3590147 - RNA, 23 nt, Human
uucaagaaaaaauaaauggaaau

SEQ ID NO: 3590148 - RNA, 22 nt, Human
uucaagaaaacaacuucaauau

SEQ ID NO: 3590149 - RNA, 19 nt, Human
uucaagaaaaguaagcccu

SEQ ID NO: 3590150 - RNA, 20 nt, Human
uucaagaaacugaggaauuu

SEQ ID NO: 3590151 - RNA, 11 nt, Human
uucaagaaaug

SEQ ID NO: 3590152 - RNA, 14 nt, Human
uucaagaaaugaag

SEQ ID NO: 3590153 - RNA, 19 nt, Human
uucaagaaaugaagagcug

SEQ ID NO: 3590154 - RNA, 23 nt, Human
uucaagaaguccccucuccucca

SEQ ID NO: 3590155 - RNA, 23 nt, Human
uucaagaaugcaguacuaacauu

SEQ ID NO: 3590156 - RNA, 22 nt, Human
uucaagaggagcccccacccug

SEQ ID NO: 3590157 - RNA, 21 nt, Human
uucaagaucuaaaucauauau

SEQ ID NO: 3590158 - RNA, 11 nt, Human
uucaagauucc

SEQ ID NO: 3590159 - RNA, 14 nt, Human
uucaagcaauccuc

SEQ ID NO: 3590160 - RNA, 17 nt, Human
uucaagcacuuacagcu

SEQ ID NO: 3590161 - RNA, 22 nt, Human
uucaagcagucgugccuguguc

SEQ ID NO: 3590162 - RNA, 21 nt, Human
uucaagcgauucuccugccuc

SEQ ID NO: 3590163 - RNA, 20 nt, Human
uucaaggaacuugaaaaaua

SEQ ID NO: 3590164 - RNA, 11 nt, Human
uucaaggaagg

SEQ ID NO: 3590165 - RNA, 16 nt, Human
uucaaggaauuucuua

SEQ ID NO: 3590166 - RNA, 19 nt, Human
uucaaggauccugagccag

SEQ ID NO: 3590167 - RNA, 20 nt, Human
uucaaggcaucaugcagagu

SEQ ID NO: 3590168 - RNA, 16 nt, Human
uucaaggcuuccacug

SEQ ID NO: 3590169 - RNA, 16 nt, Human
uucaagguaaaauucu

SEQ ID NO: 3590170 - RNA, 20 nt, Human
uucaagguaaaauucuaaau

SEQ ID NO: 3590171 - RNA, 17 nt, Human
uucaaggucugcuuuuc

SEQ ID NO: 3590172 - RNA, 18 nt, Human
uucaagguggccaaauua

SEQ ID NO: 3590173 - RNA, 20 nt, Human
uucaagguggccaaauuauu

SEQ ID NO: 3590174 - RNA, 22 nt, Human
uucaagguggccaaauuauuug

SEQ ID NO: 3590175 - RNA, 15 nt, Human
uucaaguaauucugc

SEQ ID NO: 3590176 - RNA, 18 nt, Human
uucaaguaauucugcugu

SEQ ID NO: 3590177 - RNA, 21 nt, Human
uucaaguacuguaacuguguc

SEQ ID NO: 3590178 - RNA, 20 nt, Human
uucaaguagcugggauuuua

SEQ ID NO: 3590179 - RNA, 17 nt, Human
uucaagugaaucuaaaa

SEQ ID NO: 3590180 - RNA, 20 nt, Human
uucaagugauucucaugccu

SEQ ID NO: 3590181 - RNA, 21 nt, Human
uucaagugccuuucugcaguu

SEQ ID NO: 3590182 - RNA, 23 nt, Human
uucaauaaaaaaaagaaaugaaa

SEQ ID NO: 3590183 - RNA, 19 nt, Human
uucaauaaagcacugagca

SEQ ID NO: 3590184 - RNA, 16 nt, Human
uucaauaaagcauuua

SEQ ID NO: 3590185 - RNA, 18 nt, Human
uucaauaaagcauuuaua

SEQ ID NO: 3590186 - RNA, 12 nt, Human
uucaauaaagua

SEQ ID NO: 3590187 - RNA, 19 nt, Human
uucaauaaaguaucuacau

SEQ ID NO: 3590188 - RNA, 21 nt, Human
uucaauaaaguauuuaauuag

SEQ ID NO: 3590189 - RNA, 14 nt, Human
uucaauaaaguuug

SEQ ID NO: 3590190 - RNA, 15 nt, Human
uucaauaaaguuuga

SEQ ID NO: 3590191 - RNA, 12 nt, Human
uucaauaacugg

SEQ ID NO: 3590192 - RNA, 22 nt, Human
uucaauaacuggaacacucuau

SEQ ID NO: 3590193 - RNA, 16 nt, Human
uucaauaauaaauauu

SEQ ID NO: 3590194 - RNA, 13 nt, Human
uucaauacaaaca

SEQ ID NO: 3590195 - RNA, 23 nt, Human
uucaauacaaacaaucucuuaaa

SEQ ID NO: 3590196 - RNA, 18 nt, Human
uucaauaggaaaaacuga

SEQ ID NO: 3590197 - RNA, 22 nt, Human
uucaauaggaaaaacugauuuu

SEQ ID NO: 3590198 - RNA, 18 nt, Human
uucaauaguaauauaaua

SEQ ID NO: 3590199 - RNA, 18 nt, Human
uucaauauaagcuuuucu

SEQ ID NO: 3590200 - RNA, 19 nt, Human
uucaauauaagcuuuucuu

SEQ ID NO: 3590201 - RNA, 18 nt, Human
uucaauauauugaacuuu

SEQ ID NO: 3590202 - RNA, 19 nt, Human
uucaauauugacauuugua

SEQ ID NO: 3590203 - RNA, 21 nt, Human
uucaauauugacauuuguagu

SEQ ID NO: 3590204 - RNA, 22 nt, Human
uucaauauugacauuuguaguu

SEQ ID NO: 3590205 - RNA, 22 nt, Human
uucaauccuugaagguauaucu

SEQ ID NO: 3590206 - RNA, 20 nt, Human
uucaaucucccgcugcugcu

SEQ ID NO: 3590207 - RNA, 23 nt, Human
uucaaugaucuagguuuaacuca

SEQ ID NO: 3590208 - RNA, 16 nt, Human
uucaauggcugcugaa

SEQ ID NO: 3590209 - RNA, 23 nt, Human
uucaaugguuugcaaggaagcca

SEQ ID NO: 3590210 - RNA, 16 nt, Human
uucaauguaauuaaac

SEQ ID NO: 3590211 - RNA, 20 nt, Human
uucaauguuuuuaaaaaucu

SEQ ID NO: 3590212 - RNA, 11 nt, Human
uucaauuaaac

SEQ ID NO: 3590213 - RNA, 18 nt, Human
uucaauuaaacggauuau

SEQ ID NO: 3590214 - RNA, 14 nt, Human
uucaauuaaagaaa

SEQ ID NO: 3590215 - RNA, 21 nt, Human
uucaauuaauauuaauuuucu

SEQ ID NO: 3590216 - RNA, 14 nt, Human
uucaauuauuuccc

SEQ ID NO: 3590217 - RNA, 17 nt, Human
uucaauucaacacuccc

SEQ ID NO: 3590218 - RNA, 19 nt, Human
uucaauucagugcuguacu

SEQ ID NO: 3590219 - RNA, 15 nt, Human
uucaauugcaucucc

SEQ ID NO: 3590220 - RNA, 16 nt, Human
uucaauuuauugcaca

SEQ ID NO: 3590221 - RNA, 18 nt, Human
uucaauuuauugcacaaa

SEQ ID NO: 3590222 - RNA, 20 nt, Human
uucaauuuauugcacaaaau

SEQ ID NO: 3590223 - RNA, 17 nt, Human
uucaauuuccaagagcu

SEQ ID NO: 3590224 - RNA, 12 nt, Human
uucaauuuguuc

SEQ ID NO: 3590225 - RNA, 17 nt, Human
uucacaaacagaaaaca

SEQ ID NO: 3590226 - RNA, 15 nt, Human
uucacaaacuuuuau

SEQ ID NO: 3590227 - RNA, 18 nt, Human
uucacaaaguaauuugga

SEQ ID NO: 3590228 - RNA, 13 nt, Human
uucacaaauaaua

SEQ ID NO: 3590229 - RNA, 22 nt, Human
uucacaagacccaaaaggcaga

SEQ ID NO: 3590230 - RNA, 16 nt, Human
uucacaagcugccucc

SEQ ID NO: 3590231 - RNA, 17 nt, Human
uucacaagcugccuccc

SEQ ID NO: 3590232 - RNA, 20 nt, Human
uucacacacagacuguuguc

SEQ ID NO: 3590233 - RNA, 14 nt, Human
uucacacagauaga

SEQ ID NO: 3590234 - RNA, 17 nt, Human
uucacaccccaccugcg

SEQ ID NO: 3590235 - RNA, 19 nt, Human
uucacaccccaccugcgcu

SEQ ID NO: 3590236 - RNA, 18 nt, Human
uucacacgcuguucuaau

SEQ ID NO: 3590237 - RNA, 14 nt, Human
uucacacucucaca

SEQ ID NO: 3590238 - RNA, 22 nt, Human
uucacacucucacauguuuaga

SEQ ID NO: 3590239 - RNA, 13 nt, Human
uucacagaaaaua

SEQ ID NO: 3590240 - RNA, 21 nt, Human
uucacagagugugcuggagga

SEQ ID NO: 3590241 - RNA, 17 nt, Human
uucacagcuccucccac

SEQ ID NO: 3590242 - RNA, 20 nt, Human
uuaaaaaaaauccuucuaau

SEQ ID NO: 3590243 - RNA, 19 nt, Human
uuaaaaaaaggcauuguuu

SEQ ID NO: 3590244 - RNA, 12 nt, Human
uuaaaaaaauaa

SEQ ID NO: 3590245 - RNA, 18 nt, Human
uuaaaaaaauaaaacauu

SEQ ID NO: 3590246 - RNA, 19 nt, Human
uuaaaaaaauaaaacauuu

SEQ ID NO: 3590247 - RNA, 12 nt, Human
uuaaaaaaauca

SEQ ID NO: 3590248 - RNA, 21 nt, Human
uuaaaaaaauugguuggagaa

SEQ ID NO: 3590249 - RNA, 16 nt, Human
uuaaaaaaauuuaagu

SEQ ID NO: 3590250 - RNA, 11 nt, Human
uuaaaaaacaa

SEQ ID NO: 3590251 - RNA, 13 nt, Human
uuaaaaaacuaaa

SEQ ID NO: 3590252 - RNA, 13 nt, Human
uuaaaaaacuuca

SEQ ID NO: 3590253 - RNA, 13 nt, Human
uuaaaaaagauaa

SEQ ID NO: 3590254 - RNA, 17 nt, Human
uuaaaaaagauaaacac

SEQ ID NO: 3590255 - RNA, 23 nt, Human
uuaaaaaauaggugguagauauu

SEQ ID NO: 3590256 - RNA, 14 nt, Human
uuaaaaaauauuuu

SEQ ID NO: 3590257 - RNA, 16 nt, Human
uuaaaaaauauuuucu

SEQ ID NO: 3590258 - RNA, 12 nt, Human
uuaaaaaaugaa

SEQ ID NO: 3590259 - RNA, 12 nt, Human
uuaaaaaauguc

SEQ ID NO: 3590260 - RNA, 17 nt, Human
uuaaaaaauuuuugaaa

SEQ ID NO: 3590261 - RNA, 22 nt, Human
uuaaaaacaacgaaagaaggca

SEQ ID NO: 3590262 - RNA, 16 nt, Human
uuaaaaacauagaaaa

SEQ ID NO: 3590263 - RNA, 18 nt, Human
uuaaaaaccuguucaagu

SEQ ID NO: 3590264 - RNA, 17 nt, Human
uuaaaaagaaacaagau

SEQ ID NO: 3590265 - RNA, 14 nt, Human
uuaaaaagaaaucu

SEQ ID NO: 3590266 - RNA, 23 nt, Human
uuaaaaagauaaaaaaacagcuu

SEQ ID NO: 3590267 - RNA, 13 nt, Human
uuaaaaagauucu

SEQ ID NO: 3590268 - RNA, 13 nt, Human
uuaaaaagccagu

SEQ ID NO: 3590269 - RNA, 19 nt, Human
uuaaaaaggaacugcagca

SEQ ID NO: 3590270 - RNA, 20 nt, Human
uuaaaaaggcaguuugcaaa

SEQ ID NO: 3590271 - RNA, 22 nt, Human
uuaaaaaggcaguuugcaaaaa

SEQ ID NO: 3590272 - RNA, 14 nt, Human
uuaaaaagucuuca

SEQ ID NO: 3590273 - RNA, 20 nt, Human
uuaaaaaguuaaucuucaug

SEQ ID NO: 3590274 - RNA, 20 nt, Human
uuaaaaaguuauaaccaacu

SEQ ID NO: 3590275 - RNA, 15 nt, Human
uuaaaaauaagucaa

SEQ ID NO: 3590276 - RNA, 13 nt, Human
uuaaaaauauaaa

SEQ ID NO: 3590277 - RNA, 13 nt, Human
uuaaaaauaucaa

SEQ ID NO: 3590278 - RNA, 18 nt, Human
uuaaaaauaucaaauuaa

SEQ ID NO: 3590279 - RNA, 22 nt, Human
uuaaaaauauggaacuucuaau

SEQ ID NO: 3590280 - RNA, 12 nt, Human
uuaaaaaucaac

SEQ ID NO: 3590281 - RNA, 16 nt, Human
uuaaaaaucucaaauu

SEQ ID NO: 3590282 - RNA, 19 nt, Human
uuaaaaaucucaaauuucu

SEQ ID NO: 3590283 - RNA, 15 nt, Human
uuaaaaaugcaaauc

SEQ ID NO: 3590284 - RNA, 10 nt, Human
uuaaaaaugg

SEQ ID NO: 3590285 - RNA, 12 nt, Human
uuaaaaauggua

SEQ ID NO: 3590286 - RNA, 14 nt, Human
uuaaaaaugguaaa

SEQ ID NO: 3590287 - RNA, 22 nt, Human
uuaaaaaugguaaaauugcaug

SEQ ID NO: 3590288 - RNA, 19 nt, Human
uuaaaaaugguaucaaaau

SEQ ID NO: 3590289 - RNA, 20 nt, Human
uuaaaaaugguaucaaaauu

SEQ ID NO: 3590290 - RNA, 13 nt, Human
uuaaaaauguaaa

SEQ ID NO: 3590291 - RNA, 21 nt, Human
uuaaaaauguuaaaauguauu

SEQ ID NO: 3590292 - RNA, 15 nt, Human
uuaaaaauuuacuac

SEQ ID NO: 3590293 - RNA, 23 nt, Human
uuaaaaauuuacuacaauaugua

SEQ ID NO: 3590294 - RNA, 20 nt, Human
uuaaaacaagaaaguuuccc

SEQ ID NO: 3590295 - RNA, 20 nt, Human
uuaaaacaauauuguuucua

SEQ ID NO: 3590296 - RNA, 19 nt, Human
uuaaaacacguuuuaagga

SEQ ID NO: 3590297 - RNA, 20 nt, Human
uuaaaacacuucuguccugu

SEQ ID NO: 3590298 - RNA, 12 nt, Human
uuaaaacacuuu

SEQ ID NO: 3590299 - RNA, 21 nt, Human
uuaaaacagacacuggcaugg

SEQ ID NO: 3590300 - RNA, 22 nt, Human
uuaaaacaguauuuauuuugua

SEQ ID NO: 3590301 - RNA, 18 nt, Human
uuaaaacaucauuccuuu

SEQ ID NO: 3590302 - RNA, 14 nt, Human
uuaaaaccaaagag

SEQ ID NO: 3590303 - RNA, 21 nt, Human
uuaaaaccugcuuuucaaugu

SEQ ID NO: 3590304 - RNA, 14 nt, Human
uuaaaacucagccu

SEQ ID NO: 3590305 - RNA, 14 nt, Human
uuaaaacugaaguc

SEQ ID NO: 3590306 - RNA, 18 nt, Human
uuaaaacugaagucugaa

SEQ ID NO: 3590307 - RNA, 21 nt, Human
uuaaaacugaagucugaaauu

SEQ ID NO: 3590308 - RNA, 14 nt, Human
uuaaaacuggaccu

SEQ ID NO: 3590309 - RNA, 23 nt, Human
uuaaaacuuaaccgcaucagaag

SEQ ID NO: 3590310 - RNA, 14 nt, Human
uuaaaacuucaucu

SEQ ID NO: 3590311 - RNA, 14 nt, Human
uuaaaacuucuuaa

SEQ ID NO: 3590312 - RNA, 14 nt, Human
uuaaaagaaaaaau

SEQ ID NO: 3590313 - RNA, 18 nt, Human
uuaaaagaaaaaaugaca

SEQ ID NO: 3590314 - RNA, 22 nt, Human
uuaaaagaaaauaaaaaaaaga

SEQ ID NO: 3590315 - RNA, 20 nt, Human
uuaaaagaaaggguucugua

SEQ ID NO: 3590316 - RNA, 13 nt, Human
uuaaaagaaugac

SEQ ID NO: 3590317 - RNA, 13 nt, Human
uuaaaagaaugau

SEQ ID NO: 3590318 - RNA, 22 nt, Human
uuaaaagaaugggcaguuacau

SEQ ID NO: 3590319 - RNA, 14 nt, Human
uuaaaagacacugu

SEQ ID NO: 3590320 - RNA, 12 nt, Human
uuaaaagacuca

SEQ ID NO: 3590321 - RNA, 14 nt, Human
uuaaaagacucauc

SEQ ID NO: 3590322 - RNA, 18 nt, Human
uuaaaagauaaauauuau

SEQ ID NO: 3590323 - RNA, 17 nt, Human
uuaaaagauacaguuac

SEQ ID NO: 3590324 - RNA, 18 nt, Human
uuaaaagaugaaaauauu

SEQ ID NO: 3590325 - RNA, 21 nt, Human
uuaaaagaugcaauguagagg

SEQ ID NO: 3590326 - RNA, 22 nt, Human
uuaaaagaugcuuuuaacagag

SEQ ID NO: 3590327 - RNA, 13 nt, Human
uuaaaagauuuuu

SEQ ID NO: 3590328 - RNA, 14 nt, Human
uuaaaagcaaauca

SEQ ID NO: 3590329 - RNA, 18 nt, Human
uuaaaagcaaaucauuug

SEQ ID NO: 3590330 - RNA, 12 nt, Human
uuaaaagccauc

SEQ ID NO: 3590331 - RNA, 21 nt, Human
uuaaaagccuuggccucagag

SEQ ID NO: 3590332 - RNA, 18 nt, Human
uuaaaaguaaaaugucuu

SEQ ID NO: 3590333 - RNA, 16 nt, Human
uuaaaagugucaagcu

SEQ ID NO: 3590334 - RNA, 19 nt, Human
uuaaaaguuucaaugugau

SEQ ID NO: 3590335 - RNA, 15 nt, Human
uuaaaauaaaaugaa

SEQ ID NO: 3590336 - RNA, 20 nt, Human
uuaaaauaaaaugaaaauug

SEQ ID NO: 3590337 - RNA, 19 nt, Human
uuaaaauaaacaguuguga

SEQ ID NO: 3590338 - RNA, 20 nt, Human
uuaaaauaaacaguugugaa

SEQ ID NO: 3590339 - RNA, 14 nt, Human
uuaaaauaaauauu

SEQ ID NO: 3590340 - RNA, 13 nt, Human
uuaaaauacaaga

SEQ ID NO: 3590341 - RNA, 12 nt, Human
uuaaaauagaaa

SEQ ID NO: 3590342 - RNA, 22 nt, Human
uuaaaauagcaacacucuauau

SEQ ID NO: 3590343 - RNA, 21 nt, Human
uuaaaauagcguucuuguaau

SEQ ID NO: 3590344 - RNA, 23 nt, Human
uuaaaauaggggauauuuaaggu

SEQ ID NO: 3590345 - RNA, 12 nt, Human
uuaaaauauaau

SEQ ID NO: 3590346 - RNA, 22 nt, Human
uuaaaauauagauguguuuuau

SEQ ID NO: 3590347 - RNA, 14 nt, Human
uuaaaauaugcacu

SEQ ID NO: 3590348 - RNA, 15 nt, Human
uuaaaauaugcacua

SEQ ID NO: 3590349 - RNA, 19 nt, Human
uuaaaauauuccugcauuu

SEQ ID NO: 3590350 - RNA, 14 nt, Human
uuaaaauauuuuau

SEQ ID NO: 3590351 - RNA, 12 nt, Human
uuaaaaucacua

SEQ ID NO: 3590352 - RNA, 19 nt, Human
uuaaaaucacuaacauuau

SEQ ID NO: 3590353 - RNA, 21 nt, Human
uuaaaaucacuaacauuauau

SEQ ID NO: 3590354 - RNA, 13 nt, Human
uuaaaauccucaa

SEQ ID NO: 3590355 - RNA, 24 nt, Human
uuaaaaucuauucuguguugcauu

SEQ ID NO: 3590356 - RNA, 13 nt, Human
uuaaaaucuuauu

SEQ ID NO: 3590357 - RNA, 20 nt, Human
uuaaaaugcaauauuuguaa

SEQ ID NO: 3590358 - RNA, 23 nt, Human
uuaaaaugcaauauuuguaaggc

SEQ ID NO: 3590359 - RNA, 21 nt, Human
uuaaaaugcaugauugcagaa

SEQ ID NO: 3590360 - RNA, 17 nt, Human
uuaaaauguaaagccau

SEQ ID NO: 3590361 - RNA, 24 nt, Human
uuaaaauguaagauuauagauucu

SEQ ID NO: 3590362 - RNA, 22 nt, Human
uuaaaauguauaaguugaggca

SEQ ID NO: 3590363 - RNA, 14 nt, Human
uuaaaauguaugca

SEQ ID NO: 3590364 - RNA, 17 nt, Human
uuaaaaugugcaguaau

SEQ ID NO: 3590365 - RNA, 16 nt, Human
uuaaaauuacaacuaa

SEQ ID NO: 3590366 - RNA, 23 nt, Human
uuaaaauuaucaauaucuaauau

SEQ ID NO: 3590367 - RNA, 16 nt, Human
uuaaaauuaugaaucu

SEQ ID NO: 3590368 - RNA, 22 nt, Human
uuaaaauuaugaaucugauuuu

SEQ ID NO: 3590369 - RNA, 15 nt, Human
uuaaaauugcuaugu

SEQ ID NO: 3590370 - RNA, 13 nt, Human
uuaaaauugugau

SEQ ID NO: 3590371 - RNA, 18 nt, Human
uuaaaauugugauguguc

SEQ ID NO: 3590372 - RNA, 13 nt, Human
uuaaaauuuauau

SEQ ID NO: 3590373 - RNA, 13 nt, Human
uuaaaauuucaua

SEQ ID NO: 3590374 - RNA, 13 nt, Human
uuaaaauuugaaa

SEQ ID NO: 3590375 - RNA, 20 nt, Human
uuaaaauuuuguauguuaaa

SEQ ID NO: 3590376 - RNA, 16 nt, Human
uuaaacaaaccagaau

SEQ ID NO: 3590377 - RNA, 16 nt, Human
uuaaacaauaaagcaa

SEQ ID NO: 3590378 - RNA, 14 nt, Human
uuaaacacaaagug

SEQ ID NO: 3590379 - RNA, 12 nt, Human
uuaaacacacag

SEQ ID NO: 3590380 - RNA, 16 nt, Human
uuaaacagauuuuuac

SEQ ID NO: 3590381 - RNA, 16 nt, Human
uuaaacaggcccagca

SEQ ID NO: 3590382 - RNA, 13 nt, Human
uuaaacauaaaua

SEQ ID NO: 3590383 - RNA, 21 nt, Human
uuaaacaugcuguacauacuu

SEQ ID NO: 3590384 - RNA, 20 nt, Human
uuaaacauugguucuuguau

SEQ ID NO: 3590385 - RNA, 14 nt, Human
uuaaaccacuuaaa

SEQ ID NO: 3590386 - RNA, 19 nt, Human
uuaaaccagauuggagcaa

SEQ ID NO: 3590387 - RNA, 14 nt, Human
uuaaaccaucuccc

SEQ ID NO: 3590388 - RNA, 15 nt, Human
uuaaaccaucucccu

SEQ ID NO: 3590389 - RNA, 22 nt, Human
uuaaaccaugggauaaaugcca

SEQ ID NO: 3590390 - RNA, 17 nt, Human
uuaaaccgccaaggcug

SEQ ID NO: 3590391 - RNA, 18 nt, Human
uuaaaccucucuucuacc

SEQ ID NO: 3590392 - RNA, 21 nt, Human
uuaaaccugucuccacugugc

SEQ ID NO: 3590393 - RNA, 14 nt, Human
uuaaaccuuuuuug

SEQ ID NO: 3590394 - RNA, 18 nt, Human
uuaaacgauuuuuaaaau

SEQ ID NO: 3590395 - RNA, 21 nt, Human
uuaaacggauuauuuuuucag

SEQ ID NO: 3590396 - RNA, 22 nt, Human
uuaaacggauuauuuuuucaga

SEQ ID NO: 3590397 - RNA, 16 nt, Human
uuaaacguaugcaugu

SEQ ID NO: 3590398 - RNA, 20 nt, Human
uuaaacuaaggcccucuuga

SEQ ID NO: 3590399 - RNA, 15 nt, Human
uuaaacuacagguag

SEQ ID NO: 3590400 - RNA, 22 nt, Human
uuaaacuacauuagguugugaa

SEQ ID NO: 3590401 - RNA, 23 nt, Human
uuaaacuacauuagguugugaau

SEQ ID NO: 3590402 - RNA, 16 nt, Human
uuaaacuagaugaccu

SEQ ID NO: 3590403 - RNA, 20 nt, Human
uuaaacuagaugaccucauu

SEQ ID NO: 3590404 - RNA, 22 nt, Human
uuaaacuagcauaucugccuuu

SEQ ID NO: 3590405 - RNA, 13 nt, Human
uuaaacucaggga

SEQ ID NO: 3590406 - RNA, 22 nt, Human
uuaaacucagggacagagccau

SEQ ID NO: 3590407 - RNA, 19 nt, Human
uuaaacugguauuuuaucu

SEQ ID NO: 3590408 - RNA, 17 nt, Human
uuaaacuguacaguguc

SEQ ID NO: 3590409 - RNA, 21 nt, Human
uuaaacuguacagugucuuuu

SEQ ID NO: 3590410 - RNA, 16 nt, Human
uuaaacuuauaaauca

SEQ ID NO: 3590411 - RNA, 18 nt, Human
uuaaacuuccaaagaaag

SEQ ID NO: 3590412 - RNA, 15 nt, Human
uuaaacuucucugaa

SEQ ID NO: 3590413 - RNA, 17 nt, Human
uuaaacuugcaucacuu

SEQ ID NO: 3590414 - RNA, 18 nt, Human
uuaaagaaaaaaauguau

SEQ ID NO: 3590415 - RNA, 21 nt, Human
uuaaagaaaaaaauguauuuu

SEQ ID NO: 3590416 - RNA, 17 nt, Human
uuaaagaaaaaaauuga

SEQ ID NO: 3590417 - RNA, 11 nt, Human
uuaaagaaagu

SEQ ID NO: 3590418 - RNA, 12 nt, Human
uuaaagaaagug

SEQ ID NO: 3590419 - RNA, 13 nt, Human
uuaaagaagacau

SEQ ID NO: 3590420 - RNA, 19 nt, Human
uuaaagaaguaugggaaau

SEQ ID NO: 3590421 - RNA, 19 nt, Human
uuaaagaaguauuuuuaga

SEQ ID NO: 3590422 - RNA, 16 nt, Human
uuaaagaauaugaaac

SEQ ID NO: 3590423 - RNA, 17 nt, Human
uuaaagaaucauuauuu

SEQ ID NO: 3590424 - RNA, 14 nt, Human
uuaaagaauucaaa

SEQ ID NO: 3590425 - RNA, 20 nt, Human
uuaaagaauucaaauuuuau

SEQ ID NO: 3590426 - RNA, 17 nt, Human
uuaaagaauuucuuuau

SEQ ID NO: 3590427 - RNA, 21 nt, Human
uuaaagacaaagacaaauucu

SEQ ID NO: 3590428 - RNA, 11 nt, Human
uuaaagacaga

SEQ ID NO: 3590429 - RNA, 18 nt, Human
uuaaagacaggagacaaa

SEQ ID NO: 3590430 - RNA, 15 nt, Human
uuaaagagaaugagu

SEQ ID NO: 3590431 - RNA, 13 nt, Human
uuaaagagagguu

SEQ ID NO: 3590432 - RNA, 19 nt, Human
uuaaagauauuguucaaac

SEQ ID NO: 3590433 - RNA, 18 nt, Human
uuaaagaucaugacauau

SEQ ID NO: 3590434 - RNA, 22 nt, Human
uuaaagaucuguaaguaacuuc

SEQ ID NO: 3590435 - RNA, 16 nt, Human
uuaaagauguagcaaa

SEQ ID NO: 3590436 - RNA, 17 nt, Human
uuaaagcaaaaaaugaa

SEQ ID NO: 3590437 - RNA, 16 nt, Human
uuaaagcaagcaacac

SEQ ID NO: 3590438 - RNA, 21 nt, Human
uuaaagcagagggacuuugua

SEQ ID NO: 3590439 - RNA, 14 nt, Human
uuaaagcagucacu

SEQ ID NO: 3590440 - RNA, 22 nt, Human
uuaaagccacaaccacauacaa

SEQ ID NO: 3590441 - RNA, 12 nt, Human
uuaaagccaugu

SEQ ID NO: 3590442 - RNA, 14 nt, Human
uuaaagccauguuu

SEQ ID NO: 3590443 - RNA, 14 nt, Human
uuaaagccuccuca

SEQ ID NO: 3590444 - RNA, 18 nt, Human
uuaaagccuuuaguauca

SEQ ID NO: 3590445 - RNA, 22 nt, Human
uuaaagccuuuaguaucagugu

SEQ ID NO: 3590446 - RNA, 15 nt, Human
uuaaagcuuccauug

SEQ ID NO: 3590447 - RNA, 12 nt, Human
uuaaaggaaaaa

SEQ ID NO: 3590448 - RNA, 16 nt, Human
uuaaaggaaaaaaugu

SEQ ID NO: 3590449 - RNA, 20 nt, Human
uuaaaggaagguucuggugu

SEQ ID NO: 3590450 - RNA, 15 nt, Human
uuaaaggaagucagu

SEQ ID NO: 3590451 - RNA, 18 nt, Human
uuaaaggcaccaucuaau

SEQ ID NO: 3590452 - RNA, 18 nt, Human
uuaaaggcccagccccua

SEQ ID NO: 3590453 - RNA, 15 nt, Human
uuaaaggcuucucuc

SEQ ID NO: 3590454 - RNA, 17 nt, Human
uuaaaggcuucucucuc

SEQ ID NO: 3590455 - RNA, 13 nt, Human
uuaaagggaagaa

SEQ ID NO: 3590456 - RNA, 22 nt, Human
uuaaagggaagaaaacacuguu

SEQ ID NO: 3590457 - RNA, 21 nt, Human
uuaaaggggagaccucagaag

SEQ ID NO: 3590458 - RNA, 20 nt, Human
uuaaaguaauuguuccagag

SEQ ID NO: 3590459 - RNA, 20 nt, Human
uuaaaguaugcauuauuaaa

SEQ ID NO: 3590460 - RNA, 18 nt, Human
uuaaaguauguuauugca

SEQ ID NO: 3590461 - RNA, 14 nt, Human
uuaaaguauuuucu

SEQ ID NO: 3590462 - RNA, 13 nt, Human
uuaaagugaauug

SEQ ID NO: 3590463 - RNA, 17 nt, Human
uuaaagugauacugaaa

SEQ ID NO: 3590464 - RNA, 21 nt, Human
uuaaagugcuaagguucuaag

SEQ ID NO: 3590465 - RNA, 22 nt, Human
uuaaagugcuaagguucuaagg

SEQ ID NO: 3590466 - RNA, 20 nt, Human
uuaaaguguauuauaacagu

SEQ ID NO: 3590467 - RNA, 14 nt, Human
uuaaaguguuucag

SEQ ID NO: 3590468 - RNA, 13 nt, Human
uuaaaguugaauu

SEQ ID NO: 3590469 - RNA, 16 nt, Human
uuaaaguugaauuuau

SEQ ID NO: 3590470 - RNA, 12 nt, Human
uuaaaguuucaa

SEQ ID NO: 3590471 - RNA, 14 nt, Human
uuaaaguuucaaaa

SEQ ID NO: 3590472 - RNA, 20 nt, Human
uuaaaguuucaaaaaucuga

SEQ ID NO: 3590473 - RNA, 21 nt, Human
uuaaaguuucaaaaaucugaa

SEQ ID NO: 3590474 - RNA, 11 nt, Human
uuaaauaaaag

SEQ ID NO: 3590475 - RNA, 22 nt, Human
uuaaauaaaagaaaugcacaau

SEQ ID NO: 3590476 - RNA, 15 nt, Human
uuaaauaaaauaacc

SEQ ID NO: 3590477 - RNA, 14 nt, Human
uuaaauaaacuuuu

SEQ ID NO: 3590478 - RNA, 19 nt, Human
uuaaauaaaguaucaugca

SEQ ID NO: 3590479 - RNA, 13 nt, Human
uuaaauaaaucau

SEQ ID NO: 3590480 - RNA, 20 nt, Human
uuaauuucugccauuucaug

SEQ ID NO: 3590481 - RNA, 14 nt, Human
uuaauuucuucaaa

SEQ ID NO: 3590482 - RNA, 13 nt, Human
uuaauuugaaaua

SEQ ID NO: 3590483 - RNA, 18 nt, Human
uuaauuugaugaaagcug

SEQ ID NO: 3590484 - RNA, 15 nt, Human
uuaaauaaaucauaa

SEQ ID NO: 3590485 - RNA, 20 nt, Human
uuaaauaaaugucauuaaaa

SEQ ID NO: 3590486 - RNA, 21 nt, Human
uuaaauaaaugucauuaaaau

SEQ ID NO: 3590487 - RNA, 18 nt, Human
uuaaauaaauuguauauu

SEQ ID NO: 3590488 - RNA, 17 nt, Human
uuaaauaagaaacuuuu

SEQ ID NO: 3590489 - RNA, 15 nt, Human
uuaaauaagauucua

SEQ ID NO: 3590490 - RNA, 15 nt, Human
uuaaauaauauggcu

SEQ ID NO: 3590491 - RNA, 13 nt, Human
uuaaauaauguga

SEQ ID NO: 3590492 - RNA, 21 nt, Human
uuaaauaaugugaaacuggau

SEQ ID NO: 3590493 - RNA, 17 nt, Human
uuaaauacagacacuaa

SEQ ID NO: 3590494 - RNA, 19 nt, Human
uuaaauagaguauaugcac

SEQ ID NO: 3590495 - RNA, 18 nt, Human
uuaaauagaguuugcuau

SEQ ID NO: 3590496 - RNA, 14 nt, Human
uuaaauagaugaca

SEQ ID NO: 3590497 - RNA, 15 nt, Human
uuaaauagcuuuugu

SEQ ID NO: 3590498 - RNA, 18 nt, Human
uuaaauaggauauuaaca

SEQ ID NO: 3590499 - RNA, 15 nt, Human
uuaaauauaauaugc

SEQ ID NO: 3590500 - RNA, 12 nt, Human
uuaaauauaauu

SEQ ID NO: 3590501 - RNA, 17 nt, Human
uuaaauauaauucugua

SEQ ID NO: 3590502 - RNA, 17 nt, Human
uuaaauauagauuagaa

SEQ ID NO: 3590503 - RNA, 12 nt, Human
uuaaauauaguu

SEQ ID NO: 3590504 - RNA, 18 nt, Human
uuaaauauauguauguaa

SEQ ID NO: 3590505 - RNA, 13 nt, Human
uuaaauauauuuu

SEQ ID NO: 3590506 - RNA, 18 nt, Human
uuaaauaucaaucauuuu

SEQ ID NO: 3590507 - RNA, 17 nt, Human
uuaaauaucuuuuaugu

SEQ ID NO: 3590508 - RNA, 19 nt, Human
uuaaauaucuuuuauguuu

SEQ ID NO: 3590509 - RNA, 17 nt, Human
uuaaauauuuacauaug

SEQ ID NO: 3590510 - RNA, 18 nt, Human
uuaaauauuuucuauuuu

SEQ ID NO: 3590511 - RNA, 13 nt, Human
uuaaaucauuuua

SEQ ID NO: 3590512 - RNA, 18 nt, Human
uuaaaucauuuuaggaaa

SEQ ID NO: 3590513 - RNA, 21 nt, Human
uuaaaucauuuuaggaaagga

SEQ ID NO: 3590514 - RNA, 12 nt, Human
uuaaauccuguu

SEQ ID NO: 3590515 - RNA, 21 nt, Human
uuaaaucuaugaaguauauaa

SEQ ID NO: 3590516 - RNA, 18 nt, Human
uuaaaucuguuuuucuaa

SEQ ID NO: 3590517 - RNA, 15 nt, Human
uuaaaugaaagcaug

SEQ ID NO: 3590518 - RNA, 23 nt, Human
uuaaaugaaauuguaaaaccugu

SEQ ID NO: 3590519 - RNA, 13 nt, Human
uuaaaugcccagc

SEQ ID NO: 3590520 - RNA, 17 nt, Human
uuaaaugcccagccccu

SEQ ID NO: 3590521 - RNA, 18 nt, Human
uuaaaugcccagccccuu

SEQ ID NO: 3590522 - RNA, 12 nt, Human
uuaaaugcugcu

SEQ ID NO: 3590523 - RNA, 16 nt, Human
uuaaaugcuucauuug

SEQ ID NO: 3590524 - RNA, 20 nt, Human
uuaaauggaaaaaaugaugu

SEQ ID NO: 3590525 - RNA, 13 nt, Human
uuaaauggacaga

SEQ ID NO: 3590526 - RNA, 21 nt, Human
uuaaauguacagacauauuua

SEQ ID NO: 3590527 - RNA, 15 nt, Human
uuaaauguagaaagu

SEQ ID NO: 3590528 - RNA, 22 nt, Human
uuaaauguagcuucagucauua

SEQ ID NO: 3590529 - RNA, 20 nt, Human
uuaaaugucaaaugugaauu

SEQ ID NO: 3590530 - RNA, 19 nt, Human
uuaaaugucuuauauagca

SEQ ID NO: 3590531 - RNA, 14 nt, Human
uuaaauguuaugua

SEQ ID NO: 3590532 - RNA, 18 nt, Human
uuaaauguuuuguaaacu

SEQ ID NO: 3590533 - RNA, 20 nt, Human
uuaaauguuuuguaaacuuu

SEQ ID NO: 3590534 - RNA, 21 nt, Human
uuaaauguuuuguaaacuuug

SEQ ID NO: 3590535 - RNA, 12 nt, Human
uuaaauuaaaca

SEQ ID NO: 3590536 - RNA, 22 nt, Human
uuaaauuaauaucuuucugcac

SEQ ID NO: 3590537 - RNA, 17 nt, Human
uuaaauuaguuugugaa

SEQ ID NO: 3590538 - RNA, 13 nt, Human
uuaaauuauaagg

SEQ ID NO: 3590539 - RNA, 14 nt, Human
uuaaauuauaagga

SEQ ID NO: 3590540 - RNA, 15 nt, Human
uuaaauuauaaggac

SEQ ID NO: 3590541 - RNA, 17 nt, Human
uuaaauuauaaggacug

SEQ ID NO: 3590542 - RNA, 19 nt, Human
uuaaauuauaaggacugca

SEQ ID NO: 3590543 - RNA, 20 nt, Human
uuaaauuauaaggacugcau

SEQ ID NO: 3590544 - RNA, 21 nt, Human
uuaaauuauguuuuuauuaag

SEQ ID NO: 3590545 - RNA, 23 nt, Human
uuaaauucuccaguuuuuuguua

SEQ ID NO: 3590546 - RNA, 14 nt, Human
uuaaauucugagac

SEQ ID NO: 3590547 - RNA, 14 nt, Human
uuaaauugcucaca

SEQ ID NO: 3590548 - RNA, 15 nt, Human
uuaaauuuaaagaua

SEQ ID NO: 3590549 - RNA, 17 nt, Human
uuaaauuuguaaguuuc

SEQ ID NO: 3590550 - RNA, 19 nt, Human
uuaaauuuguugacaaaau

SEQ ID NO: 3590551 - RNA, 20 nt, Human
uuaaauuuuacccuuuagac

SEQ ID NO: 3590552 - RNA, 23 nt, Human
uuaaauuuuacccuuuagacugu

SEQ ID NO: 3590553 - RNA, 16 nt, Human
uuaaauuuucuucagu

SEQ ID NO: 3590554 - RNA, 20 nt, Human
uuaaauuuugaguucuacau

SEQ ID NO: 3590555 - RNA, 22 nt, Human
uuaaauuuuuuuguaugaaaac

SEQ ID NO: 3590556 - RNA, 16 nt, Human
uuaaauuuuuuuuaca

SEQ ID NO: 3590557 - RNA, 18 nt, Human
uuaaauuuuuuuuacauu

SEQ ID NO: 3590558 - RNA, 11 nt, Human
uuaacaaauaa

SEQ ID NO: 3590559 - RNA, 21 nt, Human
uuaacaaauaugcuaauuugg

SEQ ID NO: 3590560 - RNA, 18 nt, Human
uuaacaaauguaucacua

SEQ ID NO: 3590561 - RNA, 22 nt, Human
uuaacaacaauaacacugucuc

SEQ ID NO: 3590562 - RNA, 19 nt, Human
uuaacaacauguuuccagc

SEQ ID NO: 3590563 - RNA, 14 nt, Human
uuaacaagaacuuu

SEQ ID NO: 3590564 - RNA, 19 nt, Human
uuaacaagcucccaggccg

SEQ ID NO: 3590565 - RNA, 23 nt, Human
uuaacaauaacuacuguguuccu

SEQ ID NO: 3590566 - RNA, 18 nt, Human
uuaacaaugcgaauggua

SEQ ID NO: 3590567 - RNA, 23 nt, Human
uuaacaauuucuguccuucagau

SEQ ID NO: 3590568 - RNA, 17 nt, Human
uuaacacauuuuguaua

SEQ ID NO: 3590569 - RNA, 19 nt, Human
uuaacaccugauguguaca

SEQ ID NO: 3590570 - RNA, 20 nt, Human
uuaacaccugauguguacau

SEQ ID NO: 3590571 - RNA, 20 nt, Human
uuaacagaagggagggcaga

SEQ ID NO: 3590572 - RNA, 14 nt, Human
uuaacagagacaga

SEQ ID NO: 3590573 - RNA, 21 nt, Human
uuaacagagacagauaacucu

SEQ ID NO: 3590574 - RNA, 13 nt, Human
uuaacagagucug

SEQ ID NO: 3590575 - RNA, 23 nt, Human
uuaacaggcaaacauuuucucuu

SEQ ID NO: 3590576 - RNA, 22 nt, Human
uuaacagggucucuagugcugu

SEQ ID NO: 3590577 - RNA, 15 nt, Human
uuaacagucauuuaa

SEQ ID NO: 3590578 - RNA, 14 nt, Human
uuaacaguuuucca

SEQ ID NO: 3590579 - RNA, 20 nt, Human
uuaacaguuuuccaugaaaa

SEQ ID NO: 3590580 - RNA, 21 nt, Human
uuaacaguuuuccaugaaaac

SEQ ID NO: 3590581 - RNA, 13 nt, Human
uuaacauaagcua

SEQ ID NO: 3590582 - RNA, 15 nt, Human
uuaacauaagcuauu

SEQ ID NO: 3590583 - RNA, 22 nt, Human
uuaacauaccuaagaaguacau

SEQ ID NO: 3590584 - RNA, 17 nt, Human
uuaacauaguaaguuca

SEQ ID NO: 3590585 - RNA, 23 nt, Human
uuaacauaguaaguucagcacuu

SEQ ID NO: 3590586 - RNA, 18 nt, Human
uuaacauauaauauaugu

SEQ ID NO: 3590587 - RNA, 13 nt, Human
uuaacaucaguuu

SEQ ID NO: 3590588 - RNA, 13 nt, Human
uuaacaucuuuuu

SEQ ID NO: 3590589 - RNA, 18 nt, Human
uuaacauguuaaaccaug

SEQ ID NO: 3590590 - RNA, 13 nt, Human
uuaacauuauuua

SEQ ID NO: 3590591 - RNA, 15 nt, Human
uuaacauucauagag

SEQ ID NO: 3590592 - RNA, 14 nt, Human
uuaacauuccaaga

SEQ ID NO: 3590593 - RNA, 17 nt, Human
uuaacauuccaagacuc

SEQ ID NO: 3590594 - RNA, 19 nt, Human
uuaacauuccaagacucua

SEQ ID NO: 3590595 - RNA, 14 nt, Human
uuaacauugaccaa

SEQ ID NO: 3590596 - RNA, 19 nt, Human
uuaacauugaccaagaacu

SEQ ID NO: 3590597 - RNA, 23 nt, Human
uuaacauugaccaagaacugcau

SEQ ID NO: 3590598 - RNA, 15 nt, Human
uuaacauuucuaacu

SEQ ID NO: 3590599 - RNA, 23 nt, Human
uuaacauuugccuugcagaacug

SEQ ID NO: 3590600 - RNA, 22 nt, Human
uuaaccagucugaaguuucauu

SEQ ID NO: 3590601 - RNA, 13 nt, Human
uuaaccauugucu

SEQ ID NO: 3590602 - RNA, 19 nt, Human
uuaaccauugucuuguucu

SEQ ID NO: 3590603 - RNA, 18 nt, Human
uuaaccccgucaacaaau

SEQ ID NO: 3590604 - RNA, 21 nt, Human
uuaacccuucaucuuccugug

SEQ ID NO: 3590605 - RNA, 20 nt, Human
uuaaccgaugcuuuaccaaa

SEQ ID NO: 3590606 - RNA, 15 nt, Human
uuaaccuaccuguaa

SEQ ID NO: 3590607 - RNA, 20 nt, Human
uuaacgugggauucagagaa

SEQ ID NO: 3590608 - RNA, 20 nt, Human
uuaacuaaauuuuaaagcca

SEQ ID NO: 3590609 - RNA, 13 nt, Human
uuaacuacauuua

SEQ ID NO: 3590610 - RNA, 16 nt, Human
uuaacuacauuuauga

SEQ ID NO: 3590611 - RNA, 16 nt, Human
uuaacuacccuuaauu

SEQ ID NO: 3590612 - RNA, 12 nt, Human
uuaacuagaauu

SEQ ID NO: 3590613 - RNA, 21 nt, Human
uuaacuagaauuuauucaauu

SEQ ID NO: 3590614 - RNA, 15 nt, Human
uuaacuauaaauaug

SEQ ID NO: 3590615 - RNA, 15 nt, Human
uuaacuauguacaau

SEQ ID NO: 3590616 - RNA, 18 nt, Human
uuaacuauguacaauauu

SEQ ID NO: 3590617 - RNA, 14 nt, Human
uuaacuauugcauu

SEQ ID NO: 3590618 - RNA, 14 nt, Human
uuaacucaggacuc

SEQ ID NO: 3590619 - RNA, 19 nt, Human
uuaacucaggacuccagcc

SEQ ID NO: 3590620 - RNA, 12 nt, Human
uuaacucagucu

SEQ ID NO: 3590621 - RNA, 16 nt, Human
uuaacucauuagacug

SEQ ID NO: 3590622 - RNA, 13 nt, Human
uuaacucuacugu

SEQ ID NO: 3590623 - RNA, 17 nt, Human
uuaacucucuuuauguc

SEQ ID NO: 3590624 - RNA, 16 nt, Human
uuaacugaacaauggc

SEQ ID NO: 3590625 - RNA, 21 nt, Human
uuaacugaagauguugagaaa

SEQ ID NO: 3590626 - RNA, 20 nt, Human
uuaacugaauaccacucugu

SEQ ID NO: 3590627 - RNA, 22 nt, Human
uuaacugaauaccacucuguaa

SEQ ID NO: 3590628 - RNA, 20 nt, Human
uuaacugacaagcuccauuu

SEQ ID NO: 3590629 - RNA, 19 nt, Human
uuaacugccguaauuuaac

SEQ ID NO: 3590630 - RNA, 15 nt, Human
uuaacugcuuccuau

SEQ ID NO: 3590631 - RNA, 23 nt, Human
uuaacuggugcacuuuguaaauu

SEQ ID NO: 3590632 - RNA, 14 nt, Human
uuaacuuaguuuug

SEQ ID NO: 3590633 - RNA, 22 nt, Human
uuaacuucagagggaaaguaaa

SEQ ID NO: 3590634 - RNA, 16 nt, Human
uuaaucaauuaauuuu

SEQ ID NO: 3590635 - RNA, 17 nt, Human
uuaaucaauuaauuuuu

SEQ ID NO: 3590636 - RNA, 11 nt, Human
uuaaucacugu

SEQ ID NO: 3590637 - RNA, 13 nt, Human
uuaaucacugugu

SEQ ID NO: 3590638 - RNA, 15 nt, Human
uuaaucagaagaaaa

SEQ ID NO: 3590639 - RNA, 22 nt, Human
uuaaucaguucauuagaaauau

SEQ ID NO: 3590640 - RNA, 18 nt, Human
uuaaucauaguuacugug

SEQ ID NO: 3590641 - RNA, 19 nt, Human
uuaaucauaguuacugugu

SEQ ID NO: 3590642 - RNA, 15 nt, Human
uuaaucauauaaaua

SEQ ID NO: 3590643 - RNA, 17 nt, Human
uuaaucaugaaugugua

SEQ ID NO: 3590644 - RNA, 23 nt, Human
uuaaucauuaggugugacugaau

SEQ ID NO: 3590645 - RNA, 12 nt, Human
uuaauccaaugg

SEQ ID NO: 3590646 - RNA, 17 nt, Human
uuaauccacacaucagu

SEQ ID NO: 3590647 - RNA, 21 nt, Human
uuaauccaguuauaagaagaa

SEQ ID NO: 3590648 - RNA, 18 nt, Human
uuaauccccaguaaaauu

SEQ ID NO: 3590649 - RNA, 20 nt, Human
uuaauccuucuaguuuccca

SEQ ID NO: 3590650 - RNA, 23 nt, Human
uuaauccuuuguuuucugacuaa

SEQ ID NO: 3590651 - RNA, 21 nt, Human
uuaaucuacugcauuuaggga

SEQ ID NO: 3590652 - RNA, 15 nt, Human
uuaaucucuguuaug

SEQ ID NO: 3590653 - RNA, 22 nt, Human
uuaaucucuguuauguacugua

SEQ ID NO: 3590654 - RNA, 16 nt, Human
uuaaucugaaauucua

SEQ ID NO: 3590655 - RNA, 16 nt, Human
uuaaucuguauuuccc

SEQ ID NO: 3590656 - RNA, 20 nt, Human
uuaaucuguuuauuuacaag

SEQ ID NO: 3590657 - RNA, 16 nt, Human
uuaaucuuaguguaug

SEQ ID NO: 3590658 - RNA, 21 nt, Human
uuaaucuuaguguaugauuac

SEQ ID NO: 3590659 - RNA, 16 nt, Human
uuaaucuuggauagcu

SEQ ID NO: 3590660 - RNA, 17 nt, Human
uuaaucuuugaaagguu

SEQ ID NO: 3590661 - RNA, 18 nt, Human
uuaaucuuuucacaaaua

SEQ ID NO: 3590662 - RNA, 15 nt, Human
uuaaugaaaauaaga

SEQ ID NO: 3590663 - RNA, 14 nt, Human
uuaaugaaaauguc

SEQ ID NO: 3590664 - RNA, 16 nt, Human
uuaaugaaaaugucag

SEQ ID NO: 3590665 - RNA, 17 nt, Human
uuaaugaagaucuaaau

SEQ ID NO: 3590666 - RNA, 18 nt, Human
uuaaugaagaucuaaaua

SEQ ID NO: 3590667 - RNA, 14 nt, Human
uuaaugaaguuuga

SEQ ID NO: 3590668 - RNA, 17 nt, Human
uuaaugaaugcuuaaag

SEQ ID NO: 3590669 - RNA, 14 nt, Human
uuaaugacacuugu

SEQ ID NO: 3590670 - RNA, 19 nt, Human
uuaaugacacuugucccca

SEQ ID NO: 3590671 - RNA, 19 nt, Human
uuaaugacagagccagugg

SEQ ID NO: 3590672 - RNA, 21 nt, Human
uuaaugagacuuuaaaagcau

SEQ ID NO: 3590673 - RNA, 17 nt, Human
uuaaugauaaguaaaug

SEQ ID NO: 3590674 - RNA, 21 nt, Human
uuaaugauaaguaaaugcuag

SEQ ID NO: 3590675 - RNA, 14 nt, Human
uuaaugauuccuau

SEQ ID NO: 3590676 - RNA, 11 nt, Human
uuaaugcacuu

SEQ ID NO: 3590677 - RNA, 13 nt, Human
uuaaugcacuuuc

SEQ ID NO: 3590678 - RNA, 18 nt, Human
uuaaugcaucuagauuau

SEQ ID NO: 3590679 - RNA, 18 nt, Human
uuaaugcauuaaaccugu

SEQ ID NO: 3590680 - RNA, 19 nt, Human
uuaaugcauuaaaccuguc

SEQ ID NO: 3590681 - RNA, 19 nt, Human
uuaaugccugcuuuuugga

SEQ ID NO: 3590682 - RNA, 15 nt, Human
uuaaugccuuuaaag

SEQ ID NO: 3590683 - RNA, 17 nt, Human
uuaaugcuaaucuugug

SEQ ID NO: 3590684 - RNA, 16 nt, Human
uuaaugcugccuuuuc

SEQ ID NO: 3590685 - RNA, 13 nt, Human
uuaaugcuucauu

SEQ ID NO: 3590686 - RNA, 18 nt, Human
uuaaugcuuuuauauuuu

SEQ ID NO: 3590687 - RNA, 19 nt, Human
uuaauggacaugagauaau

SEQ ID NO: 3590688 - RNA, 21 nt, Human
uuaauggacuuauuucuucaa

SEQ ID NO: 3590689 - RNA, 16 nt, Human
uuaauggauuguuaau

SEQ ID NO: 3590690 - RNA, 20 nt, Human
uuaauggauuguuaauuuca

SEQ ID NO: 3590691 - RNA, 23 nt, Human
uuaauggcaaggcagcccugucu

SEQ ID NO: 3590692 - RNA, 14 nt, Human
uuaauggcacugau

SEQ ID NO: 3590693 - RNA, 22 nt, Human
uuaauggccggcuggaaaugcu

SEQ ID NO: 3590694 - RNA, 21 nt, Human
uuaauguauauaaaaauggcu

SEQ ID NO: 3590695 - RNA, 17 nt, Human
uuaauguaucaaacugu

SEQ ID NO: 3590696 - RNA, 17 nt, Human
uuaauguauguuaccaa

SEQ ID NO: 3590697 - RNA, 17 nt, Human
uuaauguauuuguucau

SEQ ID NO: 3590698 - RNA, 23 nt, Human
uuaauguauuuguucauguuugg

SEQ ID NO: 3590699 - RNA, 13 nt, Human
uuaaugugaugau

SEQ ID NO: 3590700 - RNA, 14 nt, Human
uuaaugugcugugu

SEQ ID NO: 3590701 - RNA, 16 nt, Human
uuaaugugcuguguaa

SEQ ID NO: 3590702 - RNA, 22 nt, Human
uuaaugugcuguguaaaguuag

SEQ ID NO: 3590703 - RNA, 14 nt, Human
uuaauguguaaaga

SEQ ID NO: 3590704 - RNA, 14 nt, Human
uuaauguugauuuc

SEQ ID NO: 3590705 - RNA, 15 nt, Human
uuaauguugauuucu

SEQ ID NO: 3590706 - RNA, 21 nt, Human
uuaauguugauuucuaguuau

SEQ ID NO: 3590707 - RNA, 17 nt, Human
uuaauguuuauuccuga

SEQ ID NO: 3590708 - RNA, 18 nt, Human
uuaauguuuuaaauguac

SEQ ID NO: 3590709 - RNA, 13 nt, Human
uuaauuaaaugca

SEQ ID NO: 3590710 - RNA, 22 nt, Human
uuaauuaaccccauaauuagau

SEQ ID NO: 3590711 - RNA, 16 nt, Human
uuaauuaagacugaaa

SEQ ID NO: 3590712 - RNA, 14 nt, Human
uuaauuaaguaaac

SEQ ID NO: 3590713 - RNA, 16 nt, Human
uuaauuaauuugauua

SEQ ID NO: 3590714 - RNA, 20 nt, Human
uuaauuaauuugauuaacaa

SEQ ID NO: 3590715 - RNA, 21 nt, Human
uuaauuaauuugauuaacaaa

SEQ ID NO: 3590716 - RNA, 21 nt, Human
uuaauuacucagcagaauggu

SEQ ID NO: 3590717 - RNA, 14 nt, Human
uuaauuacuuaaaa

SEQ ID NO: 3590718 - RNA, 19 nt, Human
uuaauuagccagugaaaaa

SEQ ID NO: 3590719 - RNA, 14 nt, Human
uuaauuaggaaaaa

SEQ ID NO: 3590720 - RNA, 19 nt, Human
uuaauuagggguugcuaag

SEQ ID NO: 3590721 - RNA, 18 nt, Human
uuaauuagguuaacuaug

SEQ ID NO: 3590722 - RNA, 13 nt, Human
uuaauuagugcua

SEQ ID NO: 3590723 - RNA, 20 nt, Human
uuaauuagugcuaaguguga

SEQ ID NO: 3590724 - RNA, 16 nt, Human
uuaauuauuaacuaca

SEQ ID NO: 3590725 - RNA, 14 nt, Human
uuaauuauuauuua

SEQ ID NO: 3590726 - RNA, 15 nt, Human
uuaauucaugaggag

SEQ ID NO: 3590727 - RNA, 13 nt, Human
uuaauucauguuu

SEQ ID NO: 3590728 - RNA, 22 nt, Human
uuaauuccaugaaucgcuucuc

SEQ ID NO: 3590729 - RNA, 15 nt, Human
uuaauuccuuuccag

SEQ ID NO: 3590730 - RNA, 12 nt, Human
uuaauucucuuu

SEQ ID NO: 3590731 - RNA, 22 nt, Human
uuaauucuguucugauauuaau

SEQ ID NO: 3590732 - RNA, 13 nt, Human
uuaauugaaaaga

SEQ ID NO: 3590733 - RNA, 21 nt, Human
uuaauugaaaagaaguagugu

SEQ ID NO: 3590734 - RNA, 20 nt, Human
uuaauugaaagaauguaaag

SEQ ID NO: 3590735 - RNA, 17 nt, Human
uuaauugauagaauaaa

SEQ ID NO: 3590736 - RNA, 12 nt, Human
uuaauugcugag

SEQ ID NO: 3590737 - RNA, 12 nt, Human
uuaauugcugca

SEQ ID NO: 3590738 - RNA, 13 nt, Human
uuaauugcugcaa

SEQ ID NO: 3590739 - RNA, 18 nt, Human
uuaauugggccagcuuuu

SEQ ID NO: 3590740 - RNA, 15 nt, Human
uuaauuguaaaguaa

SEQ ID NO: 3590741 - RNA, 14 nt, Human
uuaauuguaaucug

SEQ ID NO: 3590742 - RNA, 12 nt, Human
uuaauugucaug

SEQ ID NO: 3590743 - RNA, 14 nt, Human
uuaauugucauggu

SEQ ID NO: 3590744 - RNA, 15 nt, Human
uuaauuguucauuuu

SEQ ID NO: 3590745 - RNA, 13 nt, Human
uuaauuguuguuu

SEQ ID NO: 3590746 - RNA, 20 nt, Human
uuaauuguuguuucuuucua

SEQ ID NO: 3590747 - RNA, 12 nt, Human
uuaauuguuuaa

SEQ ID NO: 3590748 - RNA, 23 nt, Human
uuaauuuaaaugauuuaaauuua

SEQ ID NO: 3590749 - RNA, 13 nt, Human
uuaauuuaaguuu

SEQ ID NO: 3590750 - RNA, 16 nt, Human
uuaauuuaaguuuuga

SEQ ID NO: 3590751 - RNA, 14 nt, Human
uuaauuuacaaaaa

SEQ ID NO: 3590752 - RNA, 17 nt, Human
uuaauuuaguaaaccaa

SEQ ID NO: 3590753 - RNA, 14 nt, Human
uuaauuuaucagau

SEQ ID NO: 3590754 - RNA, 15 nt, Human
uuaauuuaucuaaau

SEQ ID NO: 3590755 - RNA, 17 nt, Human
uuaauuuaucuaaauua

SEQ ID NO: 3590756 - RNA, 15 nt, Human
uuaauuuaugaguuu

SEQ ID NO: 3590757 - RNA, 18 nt, Human
uuaauuuaugaguuuuug

SEQ ID NO: 3590758 - RNA, 20 nt, Human
uuaauuuaugaguuuuugau

SEQ ID NO: 3590759 - RNA, 14 nt, Human
uuaauuuauuauua

SEQ ID NO: 3590760 - RNA, 19 nt, Human
uuaauuuauuauugaaauu

SEQ ID NO: 3590761 - RNA, 14 nt, Human
uuaauuucaguaag

SEQ ID NO: 3590762 - RNA, 14 nt, Human
uuaauuucaguccu

SEQ ID NO: 3590763 - RNA, 18 nt, Human
uuaauuuccuuuuugaca

SEQ ID NO: 3590764 - RNA, 13 nt, Human
uuaauuucugcca

SEQ ID NO: 3590765 - RNA, 15 nt, Human
aauuggggauucuua

SEQ ID NO: 3590766 - RNA, 16 nt, Human
aauuggggauucuuaa

SEQ ID NO: 3590767 - RNA, 22 nt, Human
aauuggguggggggcuucauac

SEQ ID NO: 3590768 - RNA, 21 nt, Human
aauugguaaaacucacuguga

SEQ ID NO: 3590769 - RNA, 21 nt, Human
aauugguuggagaauuuaggu

SEQ ID NO: 3590770 - RNA, 15 nt, Human
aauuguaaacuguac

SEQ ID NO: 3590771 - RNA, 17 nt, Human
aauuguaaauugaauca

SEQ ID NO: 3590772 - RNA, 13 nt, Human
aauuguacaaaau

SEQ ID NO: 3590773 - RNA, 18 nt, Human
aauuguacaaaauuaagc

SEQ ID NO: 3590774 - RNA, 17 nt, Human
aauuguacuaaagccaa

SEQ ID NO: 3590775 - RNA, 13 nt, Human
aauuguauaacag

SEQ ID NO: 3590776 - RNA, 13 nt, Human
aauuguauagaga

SEQ ID NO: 3590777 - RNA, 16 nt, Human
aauuguauagagauau

SEQ ID NO: 3590778 - RNA, 23 nt, Human
aauuguauagagauaugcagaag

SEQ ID NO: 3590779 - RNA, 14 nt, Human
acucuccaaccugg

SEQ ID NO: 3590780 - RNA, 17 nt, Human
acucuccaaccuggaca

SEQ ID NO: 3590781 - RNA, 13 nt, Human
acucuccaucuua

SEQ ID NO: 3590782 - RNA, 22 nt, Human
acucuccauuuaauaauuauau

SEQ ID NO: 3590783 - RNA, 23 nt, Human
acucucccauggcuuaaugcuuc

SEQ ID NO: 3590784 - RNA, 12 nt, Human
acucuccccaca

SEQ ID NO: 3590785 - RNA, 15 nt, Human
acucuccccacacua

SEQ ID NO: 3590786 - RNA, 22 nt, Human
acucuccccacgagggcuggcu

SEQ ID NO: 3590787 - RNA, 12 nt, Human
acucuccuagag

SEQ ID NO: 3590788 - RNA, 13 nt, Human
acucuccuagaga

SEQ ID NO: 3590789 - RNA, 23 nt, Human
acucuccuagagacagaagcagg

SEQ ID NO: 3590790 - RNA, 15 nt, Human
acucuccuaugccuu

SEQ ID NO: 3590791 - RNA, 14 nt, Human
acucuccucaucuc

SEQ ID NO: 3590792 - RNA, 15 nt, Human
acucuccucaucucu

SEQ ID NO: 3590793 - RNA, 14 nt, Human
acucuccuccagag

SEQ ID NO: 3590794 - RNA, 22 nt, Human
acucuccucggcccccuccauc

SEQ ID NO: 3590795 - RNA, 14 nt, Human
acucuccucugccu

SEQ ID NO: 3590796 - RNA, 16 nt, Human
acucuccucugccuca

SEQ ID NO: 3590797 - RNA, 16 nt, Human
acucuccucugcugcu

SEQ ID NO: 3590798 - RNA, 17 nt, Human
acucuccucugcugcug

SEQ ID NO: 3590799 - RNA, 18 nt, Human
acucuccucugcugcugg

SEQ ID NO: 3590800 - RNA, 13 nt, Human
acucuccugcccc

SEQ ID NO: 3590801 - RNA, 23 nt, Human
acucuccugccuugaaaaagaca

SEQ ID NO: 3590802 - RNA, 11 nt, Human
acucuccuggg

SEQ ID NO: 3590803 - RNA, 16 nt, Human
acucuccuugcaguuc

SEQ ID NO: 3590804 - RNA, 15 nt, Human
acucuccuugguguc

SEQ ID NO: 3590805 - RNA, 17 nt, Human
acucucgcaucuuccca

SEQ ID NO: 3590806 - RNA, 19 nt, Human
acucucucuuguucuuacu

SEQ ID NO: 3590807 - RNA, 19 nt, Human
acucucugaaccccucccu

SEQ ID NO: 3590808 - RNA, 13 nt, Human
acucucuucccuu

SEQ ID NO: 3590809 - RNA, 16 nt, Human
acucucuucccuuucc

SEQ ID NO: 3590810 - RNA, 20 nt, Human
acucucuucccuuuccccag

SEQ ID NO: 3590811 - RNA, 21 nt, Human
acucucuucccuuuccccagc

SEQ ID NO: 3590812 - RNA, 13 nt, Human
acucucuucuucu

SEQ ID NO: 3590813 - RNA, 17 nt, Human
acucucuucuucucaua

SEQ ID NO: 3590814 - RNA, 9 nt, Human
acucugaac

SEQ ID NO: 3590815 - RNA, 16 nt, Human
acucugaacuuuggag

SEQ ID NO: 3590816 - RNA, 16 nt, Human
acucugaagccucugg

SEQ ID NO: 3590817 - RNA, 23 nt, Human
acucugaagcugacgaacuucca

SEQ ID NO: 3590818 - RNA, 23 nt, Human
acucugaauaagcacuuuuuaaa

SEQ ID NO: 3590819 - RNA, 18 nt, Human
acucugaauuuaucuuug

SEQ ID NO: 3590820 - RNA, 17 nt, Human
acucugacaacagacuu

SEQ ID NO: 3590821 - RNA, 22 nt, Human
acucugacaacagacuucugaa

SEQ ID NO: 3590822 - RNA, 22 nt, Human
acucugagacucgcgacaaugc

SEQ ID NO: 3590823 - RNA, 11 nt, Human
acucugagccc

SEQ ID NO: 3590824 - RNA, 12 nt, Human
acucugagccca

SEQ ID NO: 3590825 - RNA, 22 nt, Human
acucugagugcaaacuucagag

SEQ ID NO: 3590826 - RNA, 20 nt, Human
acucugaguguuuuaugaga

SEQ ID NO: 3590827 - RNA, 21 nt, Human
acucugaguguuuuaugagaa

SEQ ID NO: 3590828 - RNA, 14 nt, Human
acucugauagaauu

SEQ ID NO: 3590829 - RNA, 14 nt, Human
acucugauguaaau

SEQ ID NO: 3590830 - RNA, 17 nt, Human
acucugauguaaaugaa

SEQ ID NO: 3590831 - RNA, 18 nt, Human
acucugauguaaaugaag

SEQ ID NO: 3590832 - RNA, 14 nt, Human
acucugcacauacg

SEQ ID NO: 3590833 - RNA, 13 nt, Human
acucugcacaugu

SEQ ID NO: 3590834 - RNA, 19 nt, Human
acucugcacaugucuugua

SEQ ID NO: 3590835 - RNA, 23 nt, Human
acucugcacuacuccucugcagu

SEQ ID NO: 3590836 - RNA, 12 nt, Human
acucugcagccu

SEQ ID NO: 3590837 - RNA, 13 nt, Human
acucugcagccuc

SEQ ID NO: 3590838 - RNA, 20 nt, Human
acucugcauccagagauuca

SEQ ID NO: 3590839 - RNA, 16 nt, Human
acucugccacuuuauu

SEQ ID NO: 3590840 - RNA, 17 nt, Human
acucugccacuuuauuu

SEQ ID NO: 3590841 - RNA, 20 nt, Human
acucugccagggcagugcua

SEQ ID NO: 3590842 - RNA, 13 nt, Human
acucugccccccc

SEQ ID NO: 3590843 - RNA, 18 nt, Human
acucugcccccugcuggc

SEQ ID NO: 3590844 - RNA, 21 nt, Human
acucugcccccugcuggcucu

SEQ ID NO: 3590845 - RNA, 12 nt, Human
acucugccuccu

SEQ ID NO: 3590846 - RNA, 12 nt, Human
acucugccucug

SEQ ID NO: 3590847 - RNA, 14 nt, Human
acucugccugcccu

SEQ ID NO: 3590848 - RNA, 14 nt, Human
acucugcucuugca

SEQ ID NO: 3590849 - RNA, 9 nt, Human
acucugcug

SEQ ID NO: 3590850 - RNA, 14 nt, Human
acucugcugagggu

SEQ ID NO: 3590851 - RNA, 12 nt, Human
acucugcuucuc

SEQ ID NO: 3590852 - RNA, 15 nt, Human
acucugcuucucuga

SEQ ID NO: 3590853 - RNA, 20 nt, Human
acucugcuucucugacuucu

SEQ ID NO: 3590854 - RNA, 16 nt, Human
acucugcuugauuuuu

SEQ ID NO: 3590855 - RNA, 18 nt, Human
acucugcuugauuuuugc

SEQ ID NO: 3590856 - RNA, 13 nt, Human
acucugcuuguua

SEQ ID NO: 3590857 - RNA, 17 nt, Human
acucuggaaaaggcaua

SEQ ID NO: 3590858 - RNA, 23 nt, Human
acucuggacuuucucuaauaaua

SEQ ID NO: 3590859 - RNA, 21 nt, Human
acucuggagguuuguuuagaa

SEQ ID NO: 3590860 - RNA, 21 nt, Human
acucuggauucagccuucuuu

SEQ ID NO: 3590861 - RNA, 14 nt, Human
acucuggcagccac

SEQ ID NO: 3590862 - RNA, 15 nt, Human
acucuggcagccaca

SEQ ID NO: 3590863 - RNA, 16 nt, Human
acucuggcagcucaga

SEQ ID NO: 3590864 - RNA, 15 nt, Human
acucuggcccuggcc

SEQ ID NO: 3590865 - RNA, 12 nt, Human
acucuggccucu

SEQ ID NO: 3590866 - RNA, 13 nt, Human
acucuggccucug

SEQ ID NO: 3590867 - RNA, 12 nt, Human
acucuggcuggu

SEQ ID NO: 3590868 - RNA, 15 nt, Human
acucuggcuuggccu

SEQ ID NO: 3590869 - RNA, 22 nt, Human
acucuggcuuggccuaucuccu

SEQ ID NO: 3590870 - RNA, 13 nt, Human
acucugggaaaua

SEQ ID NO: 3590871 - RNA, 17 nt, Human
acucugggcugcuaccc

SEQ ID NO: 3590872 - RNA, 23 nt, Human
acucugggcuguaacguggcacu

SEQ ID NO: 3590873 - RNA, 17 nt, Human
acucugggguuuuuacu

SEQ ID NO: 3590874 - RNA, 17 nt, Human
acucuggugccuccaga

SEQ ID NO: 3590875 - RNA, 15 nt, Human
acucugguuucucau

SEQ ID NO: 3590876 - RNA, 13 nt, Human
acucuguaauugc

SEQ ID NO: 3590877 - RNA, 14 nt, Human
acucuguaauugca

SEQ ID NO: 3590878 - RNA, 15 nt, Human
acucuguaauugcaa

SEQ ID NO: 3590879 - RNA, 16 nt, Human
acucugucagauggga

SEQ ID NO: 3590880 - RNA, 11 nt, Human
acucuguccag

SEQ ID NO: 3590881 - RNA, 23 nt, Human
acucuguccugaaggccugaggu

SEQ ID NO: 3590882 - RNA, 19 nt, Human
acucugucgcccagucugg

SEQ ID NO: 3590883 - RNA, 21 nt, Human
acucugucuaaaaaacaaaac

SEQ ID NO: 3590884 - RNA, 20 nt, Human
acucugucucaguccaugaa

SEQ ID NO: 3590885 - RNA, 22 nt, Human
acucugucuucaccugauucaa

SEQ ID NO: 3590886 - RNA, 14 nt, Human
acucugugccagag

SEQ ID NO: 3590887 - RNA, 15 nt, Human
acucugugccagagc

SEQ ID NO: 3590888 - RNA, 13 nt, Human
acucugugcccau

SEQ ID NO: 3590889 - RNA, 21 nt, Human
acucugugcccaugggcacug

SEQ ID NO: 3590890 - RNA, 23 nt, Human
acucugugcccaugggcacugcu

SEQ ID NO: 3590891 - RNA, 20 nt, Human
acucugugccugaccuugag

SEQ ID NO: 3590892 - RNA, 15 nt, Human
acucugugcuggcca

SEQ ID NO: 3590893 - RNA, 16 nt, Human
acucuguggggccuug

SEQ ID NO: 3590894 - RNA, 17 nt, Human
acucuguggggccuugg

SEQ ID NO: 3590895 - RNA, 17 nt, Human
acucugugucccccguc

SEQ ID NO: 3590896 - RNA, 18 nt, Human
acucuguucauuccucca

SEQ ID NO: 3590897 - RNA, 16 nt, Human
acucuguuccuggcuc

SEQ ID NO: 3590898 - RNA, 13 nt, Human
acucuguuguacu

SEQ ID NO: 3590899 - RNA, 19 nt, Human
acucuguuguacuauggaa

SEQ ID NO: 3590900 - RNA, 21 nt, Human
acucuuaaaaauguuuuuuca

SEQ ID NO: 3590901 - RNA, 14 nt, Human
acucuuaaaaccca

SEQ ID NO: 3590902 - RNA, 12 nt, Human
acucuuaaagca

SEQ ID NO: 3590903 - RNA, 21 nt, Human
acucuuaagaagacugcauua

SEQ ID NO: 3590904 - RNA, 18 nt, Human
acucuuaaguuucucagc

SEQ ID NO: 3590905 - RNA, 17 nt, Human
acucuuauaucuauauu

SEQ ID NO: 3590906 - RNA, 12 nt, Human
acucuuaucuca

SEQ ID NO: 3590907 - RNA, 13 nt, Human
acucuuaucucag

SEQ ID NO: 3590908 - RNA, 16 nt, Human
acucuuauugcccacg

SEQ ID NO: 3590909 - RNA, 21 nt, Human
acucuuauugcccacgcugga

SEQ ID NO: 3590910 - RNA, 15 nt, Human
acucuucacucuuca

SEQ ID NO: 3590911 - RNA, 16 nt, Human
acucuucagagaaauc

SEQ ID NO: 3590912 - RNA, 20 nt, Human
acucuucccccacuccucuu

SEQ ID NO: 3590913 - RNA, 15 nt, Human
acucuucccucaaau

SEQ ID NO: 3590914 - RNA, 14 nt, Human
acucuucccucucu

SEQ ID NO: 3590915 - RNA, 23 nt, Human
acucuucccugaacuuccugcuu

SEQ ID NO: 3590916 - RNA, 21 nt, Human
acucuuccgaaaaauccucuu

SEQ ID NO: 3590917 - RNA, 22 nt, Human
acucuuccuauuuuuguaguga

SEQ ID NO: 3590918 - RNA, 18 nt, Human
acucuucuaugacccagc

SEQ ID NO: 3590919 - RNA, 17 nt, Human
acucuucucauuacuug

SEQ ID NO: 3590920 - RNA, 16 nt, Human
acucuucucucugcuc

SEQ ID NO: 3590921 - RNA, 19 nt, Human
acucuucuugauuaaaagu

SEQ ID NO: 3590922 - RNA, 19 nt, Human
acucuugaaaaaugcaugu

SEQ ID NO: 3590923 - RNA, 21 nt, Human
acucuugaaaaaugcauguug

SEQ ID NO: 3590924 - RNA, 15 nt, Human
acucuugaguuguuu

SEQ ID NO: 3590925 - RNA, 19 nt, Human
acucuugcuauugaauuga

SEQ ID NO: 3590926 - RNA, 14 nt, Human
acucuugcucuuuc

SEQ ID NO: 3590927 - RNA, 22 nt, Human
acucuuggagccugcagagcug

SEQ ID NO: 3590928 - RNA, 23 nt, Human
acucuuggagccugcagagcugc

SEQ ID NO: 3590929 - RNA, 13 nt, Human
acucuuguaagau

SEQ ID NO: 3590930 - RNA, 21 nt, Human
agcuauuuuccaggcuucugc

SEQ ID NO: 3590931 - RNA, 21 nt, Human
agcuauuuuuacuagaacaca

SEQ ID NO: 3590932 - RNA, 15 nt, Human
agcucaaaggcacag

SEQ ID NO: 3590933 - RNA, 14 nt, Human
agcucaaagguuug

SEQ ID NO: 3590934 - RNA, 21 nt, Human
agcucaaagguuuggaaggag

SEQ ID NO: 3590935 - RNA, 23 nt, Human
agcucaaagguuuggaaggagca

SEQ ID NO: 3590936 - RNA, 20 nt, Human
agcucaagcaggaaguucaa

SEQ ID NO: 3590937 - RNA, 19 nt, Human
agcucaagggacaaggaca

SEQ ID NO: 3590938 - RNA, 18 nt, Human
agcucaagucuucccuga

SEQ ID NO: 3590939 - RNA, 23 nt, Human
agcucaagucuucccugaucaag

SEQ ID NO: 3590940 - RNA, 12 nt, Human
agcucaaugagc

SEQ ID NO: 3590941 - RNA, 21 nt, Human
agcucacaauaaaaauggcuc

SEQ ID NO: 3590942 - RNA, 18 nt, Human
agcucacagugcugugug

SEQ ID NO: 3590943 - RNA, 23 nt, Human
agcucacaguuccucgcccuggg

SEQ ID NO: 3590944 - RNA, 13 nt, Human
agcucaccagccc

SEQ ID NO: 3590945 - RNA, 15 nt, Human
agcucaccagcccca

SEQ ID NO: 3590946 - RNA, 19 nt, Human
agcucaccagccccagugc

SEQ ID NO: 3590947 - RNA, 17 nt, Human
agcucacccaauaaaca

SEQ ID NO: 3590948 - RNA, 21 nt, Human
agcucacccaauaaacauuaa

SEQ ID NO: 3590949 - RNA, 15 nt, Human
agcucaccucucccu

SEQ ID NO: 3590950 - RNA, 19 nt, Human
agcucaccucucccuugga

SEQ ID NO: 3590951 - RNA, 16 nt, Human
agcucaccuguugcuu

SEQ ID NO: 3590952 - RNA, 22 nt, Human
agcucaccuguugcuuacaauu

SEQ ID NO: 3590953 - RNA, 23 nt, Human
agcucaccuguugcuuacaauuu

SEQ ID NO: 3590954 - RNA, 13 nt, Human
agcucacuacccu

SEQ ID NO: 3590955 - RNA, 17 nt, Human
agcucacugaaaagacu

SEQ ID NO: 3590956 - RNA, 18 nt, Human
agcucagaaaauaucccu

SEQ ID NO: 3590957 - RNA, 21 nt, Human
agcucagaaaauaucccuccu

SEQ ID NO: 3590958 - RNA, 23 nt, Human
agcucagaaggcucuucugacua

SEQ ID NO: 3590959 - RNA, 16 nt, Human
agcucagaauccaagu

SEQ ID NO: 3590960 - RNA, 17 nt, Human
agcucagacccccacuc

SEQ ID NO: 3590961 - RNA, 18 nt, Human
agcucagacccccacucu

SEQ ID NO: 3590962 - RNA, 14 nt, Human
agcucagagagggc

SEQ ID NO: 3590963 - RNA, 13 nt, Human
agcucagcacugc

SEQ ID NO: 3590964 - RNA, 22 nt, Human
agcucagccccgagcugucccc

SEQ ID NO: 3590965 - RNA, 23 nt, Human
agcucagcugcauuccgcagccc

SEQ ID NO: 3590966 - RNA, 22 nt, Human
agcucagcuuuuugucuuuucu

SEQ ID NO: 3590967 - RNA, 20 nt, Human
agcucaggaaccgaggcagg

SEQ ID NO: 3590968 - RNA, 13 nt, Human
agcucaggacaga

SEQ ID NO: 3590969 - RNA, 13 nt, Human
agcucaggaucuc

SEQ ID NO: 3590970 - RNA, 22 nt, Human
agcucaggaugagggaaaagaa

SEQ ID NO: 3590971 - RNA, 17 nt, Human
agcucagggccuggcuc

SEQ ID NO: 3590972 - RNA, 17 nt, Human
agcucaggggcagcuca

SEQ ID NO: 3590973 - RNA, 10 nt, Human
agcucaggug

SEQ ID NO: 3590974 - RNA, 16 nt, Human
agcucaggugggcgug

SEQ ID NO: 3590975 - RNA, 18 nt, Human
agcucaggugucccugca

SEQ ID NO: 3590976 - RNA, 21 nt, Human
agcucagucccaucagagagc

SEQ ID NO: 3590977 - RNA, 18 nt, Human
agcucagucuucccuagg

SEQ ID NO: 3590978 - RNA, 21 nt, Human
agcucagucuucccuagggcu

SEQ ID NO: 3590979 - RNA, 22 nt, Human
agcucagucuucccuagggcug

SEQ ID NO: 3590980 - RNA, 21 nt, Human
agcucaguucuagucucucug

SEQ ID NO: 3590981 - RNA, 14 nt, Human
agcucauauuuugu

SEQ ID NO: 3590982 - RNA, 15 nt, Human
agcucauauuuugua

SEQ ID NO: 3590983 - RNA, 20 nt, Human
agcucaucucagcuccugaa

SEQ ID NO: 3590984 - RNA, 14 nt, Human
agcucaucucuguc

SEQ ID NO: 3590985 - RNA, 22 nt, Human
agcucaugugcauuauuuucca

SEQ ID NO: 3590986 - RNA, 19 nt, Human
agcucauuaaacuuuuuua

SEQ ID NO: 3590987 - RNA, 16 nt, Human
agcucauucauuuuau

SEQ ID NO: 3590988 - RNA, 17 nt, Human
agcucauucauuuuaua

SEQ ID NO: 3590989 - RNA, 21 nt, Human
agcucauucuccuuguguuac

SEQ ID NO: 3590990 - RNA, 18 nt, Human
agcuccaagaauuucuag

SEQ ID NO: 3590991 - RNA, 20 nt, Human
agcuccaagaccuguugguu

SEQ ID NO: 3590992 - RNA, 23 nt, Human
agcuccacacccucucccaggac

SEQ ID NO: 3590993 - RNA, 11 nt, Human
agcuccacucu

SEQ ID NO: 3590994 - RNA, 12 nt, Human
agcuccacucug

SEQ ID NO: 3590995 - RNA, 13 nt, Human
agcuccacucugc

SEQ ID NO: 3590996 - RNA, 14 nt, Human
agcuccacucugcu

SEQ ID NO: 3590997 - RNA, 16 nt, Human
agcuccacucugcuuc

SEQ ID NO: 3590998 - RNA, 19 nt, Human
agcuccacucugcuucucu

SEQ ID NO: 3590999 - RNA, 22 nt, Human
agcuccacucugcuucucugac

SEQ ID NO: 3591000 - RNA, 18 nt, Human
agcuccacugucacccuc

SEQ ID NO: 3591001 - RNA, 23 nt, Human
agcuccacugucacccuccaccu

SEQ ID NO: 3591002 - RNA, 17 nt, Human
agcuccagacccccagc

SEQ ID NO: 3591003 - RNA, 18 nt, Human
agcuccagacccccagca

SEQ ID NO: 3591004 - RNA, 23 nt, Human
agcuccagacccccagcaacccu

SEQ ID NO: 3591005 - RNA, 13 nt, Human
agcuccagccuga

SEQ ID NO: 3591006 - RNA, 14 nt, Human
agcuccagccugac

SEQ ID NO: 3591007 - RNA, 15 nt, Human
agcuccagccugaca

SEQ ID NO: 3591008 - RNA, 23 nt, Human
agcuccaguggaagaagaaaaca

SEQ ID NO: 3591009 - RNA, 15 nt, Human
agcuccaguguccug

SEQ ID NO: 3591010 - RNA, 22 nt, Human
agcuccauacacacgcugccuu

SEQ ID NO: 3591011 - RNA, 16 nt, Human
agcuccaucuccacuc

SEQ ID NO: 3591012 - RNA, 21 nt, Human
agcuccaucuccacuccagau

SEQ ID NO: 3591013 - RNA, 20 nt, Human
agcucccaagggauggugcc

SEQ ID NO: 3591014 - RNA, 17 nt, Human
agcucccacaagccucu

SEQ ID NO: 3591015 - RNA, 18 nt, Human
agcucccacaagccucug

SEQ ID NO: 3591016 - RNA, 20 nt, Human
agcucccacaagccucugcc

SEQ ID NO: 3591017 - RNA, 19 nt, Human
agcucccacaagccugagg

SEQ ID NO: 3591018 - RNA, 17 nt, Human
agcucccacuucugcca

SEQ ID NO: 3591019 - RNA, 19 nt, Human
agcucccacuucugccaga

SEQ ID NO: 3591020 - RNA, 23 nt, Human
agcucccaggcauuccccaggag

SEQ ID NO: 3591021 - RNA, 15 nt, Human
agcucccaggugcag

SEQ ID NO: 3591022 - RNA, 22 nt, Human
agcucccaggugcagccagagg

SEQ ID NO: 3591023 - RNA, 20 nt, Human
agcucccauucuauguguca

SEQ ID NO: 3591024 - RNA, 18 nt, Human
agcucccauuucuacucu

SEQ ID NO: 3591025 - RNA, 22 nt, Human
agcuccccaaaaaccucacccg

SEQ ID NO: 3591026 - RNA, 17 nt, Human
agcuccccaccacccca

SEQ ID NO: 3591027 - RNA, 13 nt, Human
agcuccccagagu

SEQ ID NO: 3591028 - RNA, 19 nt, Human
agcucccccagcaaagccc

SEQ ID NO: 3591029 - RNA, 14 nt, Human
agcucccccagcuc

SEQ ID NO: 3591030 - RNA, 23 nt, Human
agcucccccgggaggggcccgcu

SEQ ID NO: 3591031 - RNA, 15 nt, Human
agcucccccucccuc

SEQ ID NO: 3591032 - RNA, 15 nt, Human
agcucccccuguccc

SEQ ID NO: 3591033 - RNA, 17 nt, Human
agcucccccuguccccu

SEQ ID NO: 3591034 - RNA, 23 nt, Human
agcucccccuguccccucagcuc

SEQ ID NO: 3591035 - RNA, 20 nt, Human
agcuccccgcuucugccugc

SEQ ID NO: 3591036 - RNA, 13 nt, Human
agcuccccuccuc

SEQ ID NO: 3591037 - RNA, 20 nt, Human
agcuccccucggagaagagc

SEQ ID NO: 3591038 - RNA, 20 nt, Human
agcucccucaaagaggcagu

SEQ ID NO: 3591039 - RNA, 12 nt, Human
agcucccugcca

SEQ ID NO: 3591040 - RNA, 13 nt, Human
agcucccugccaa

SEQ ID NO: 3591041 - RNA, 16 nt, Human
agcucccuggcuucug

SEQ ID NO: 3591042 - RNA, 13 nt, Human
agcucccuucucu

SEQ ID NO: 3591043 - RNA, 15 nt, Human
agcuccgcaggacuu

SEQ ID NO: 3591044 - RNA, 23 nt, Human
agcuccgcuuucuacccagcgag

SEQ ID NO: 3591045 - RNA, 14 nt, Human
agcuccguggagca

SEQ ID NO: 3591046 - RNA, 15 nt, Human
agcuccuagcagaga

SEQ ID NO: 3591047 - RNA, 15 nt, Human
agcuccucacugugg

SEQ ID NO: 3591048 - RNA, 15 nt, Human
agcugacaucuugaa

SEQ ID NO: 3591049 - RNA, 12 nt, Human
agcugacaugga

SEQ ID NO: 3591050 - RNA, 14 nt, Human
agcugacauggaaa

SEQ ID NO: 3591051 - RNA, 22 nt, Human
agcugaccagccgugagcaugu

SEQ ID NO: 3591052 - RNA, 17 nt, Human
agcugaccucuguuguc

SEQ ID NO: 3591053 - RNA, 15 nt, Human
agcugacgaggcugg

SEQ ID NO: 3591054 - RNA, 19 nt, Human
agcugacuuggcuggugug

SEQ ID NO: 3591055 - RNA, 15 nt, Human
agcugacuuuucugu

SEQ ID NO: 3591056 - RNA, 16 nt, Human
agcugagaacuccuga

SEQ ID NO: 3591057 - RNA, 18 nt, Human
agcugagaacuccugacu

SEQ ID NO: 3591058 - RNA, 18 nt, Human
agcugagaauagaaggaa

SEQ ID NO: 3591059 - RNA, 20 nt, Human
agcugagaauagaaggaaac

SEQ ID NO: 3591060 - RNA, 23 nt, Human
agcugagaauagaaggaaacuag

SEQ ID NO: 3591061 - RNA, 21 nt, Human
agcugagaucgugccacugca

SEQ ID NO: 3591062 - RNA, 20 nt, Human
agcugagcacccagcucugu

SEQ ID NO: 3591063 - RNA, 15 nt, Human
agcugagcaggccac

SEQ ID NO: 3591064 - RNA, 13 nt, Human
agcugagccaggc

SEQ ID NO: 3591065 - RNA, 20 nt, Human
agcugagcucacaaggcagc

SEQ ID NO: 3591066 - RNA, 21 nt, Human
agcugagcucacaaggcagca

SEQ ID NO: 3591067 - RNA, 15 nt, Human
agcugaggcagcagu

SEQ ID NO: 3591068 - RNA, 17 nt, Human
agcugaggccacacuca

SEQ ID NO: 3591069 - RNA, 21 nt, Human
agcugaggccacacucagcac

SEQ ID NO: 3591070 - RNA, 22 nt, Human
agcugaggggggccgugcccag

SEQ ID NO: 3591071 - RNA, 23 nt, Human
agcugaggucucuugagggagcu

SEQ ID NO: 3591072 - RNA, 12 nt, Human
agcugaggugcc

SEQ ID NO: 3591073 - RNA, 19 nt, Human
agcugaggugcccaggaga

SEQ ID NO: 3591074 - RNA, 19 nt, Human
agcugaguauuaaaaugua

SEQ ID NO: 3591075 - RNA, 22 nt, Human
agcugaguauuaaaauguaugc

SEQ ID NO: 3591076 - RNA, 20 nt, Human
agcugagucucccuaaggca

SEQ ID NO: 3591077 - RNA, 15 nt, Human
agcugagugagcuga

SEQ ID NO: 3591078 - RNA, 16 nt, Human
agcugaguuguugugg

SEQ ID NO: 3591079 - RNA, 13 nt, Human
agcugaguuuccu

SEQ ID NO: 3591080 - RNA, 20 nt, Human
agcugauacuucauuuaaaa

SEQ ID NO: 3591081 - RNA, 14 nt, Human
agcugauauaaauu

SEQ ID NO: 3591082 - RNA, 15 nt, Human
agcugauauaaauuc

SEQ ID NO: 3591083 - RNA, 16 nt, Human
agcugauauaaauucu

SEQ ID NO: 3591084 - RNA, 18 nt, Human
agcugauauaaauucugu

SEQ ID NO: 3591085 - RNA, 12 nt, Human
agcugaugaaac

SEQ ID NO: 3591086 - RNA, 20 nt, Human
agcugaugaacuuauucugu

SEQ ID NO: 3591087 - RNA, 22 nt, Human
agcugaugacucaagauuccca

SEQ ID NO: 3591088 - RNA, 17 nt, Human
agcugauggagaaggaa

SEQ ID NO: 3591089 - RNA, 16 nt, Human
agcugauuaaaugaca

SEQ ID NO: 3591090 - RNA, 22 nt, Human
agcugauuacugucaauaaaca

SEQ ID NO: 3591091 - RNA, 19 nt, Human
agcugauuuuaacaauaac

SEQ ID NO: 3591092 - RNA, 18 nt, Human
agcugcaaaaauaaucau

SEQ ID NO: 3591093 - RNA, 13 nt, Human
agcugcaaaggac

SEQ ID NO: 3591094 - RNA, 15 nt, Human
agcugcaaaggacag

SEQ ID NO: 3591095 - RNA, 17 nt, Human
agaaaauauauguauuu

SEQ ID NO: 3591096 - RNA, 23 nt, Human
agaaaauauauguauuuuuauau

SEQ ID NO: 3591097 - RNA, 19 nt, Human
agaaaauauuuugucuaaa

SEQ ID NO: 3591098 - RNA, 17 nt, Human
agaaaaucaucaagaag

SEQ ID NO: 3591099 - RNA, 16 nt, Human
agaaaaugaaaaacaa

SEQ ID NO: 3591100 - RNA, 17 nt, Human
agaaaaugaaaugcaua

SEQ ID NO: 3591101 - RNA, 16 nt, Human
agaaaauguugagaau

SEQ ID NO: 3591102 - RNA, 22 nt, Human
agaaaauuaagggccgauuuaa

SEQ ID NO: 3591103 - RNA, 15 nt, Human
agaaaauucaauugu

SEQ ID NO: 3591104 - RNA, 18 nt, Human
agaaaauucaauuguaaa

SEQ ID NO: 3591105 - RNA, 15 nt, Human
agaaaauuccuauaa

SEQ ID NO: 3591106 - RNA, 22 nt, Human
agaaaauuccuauaaggaagau

SEQ ID NO: 3591107 - RNA, 23 nt, Human
agaaaauucugugccuuguuuuu

SEQ ID NO: 3591108 - RNA, 14 nt, Human
agaaaauugaauuu

SEQ ID NO: 3591109 - RNA, 19 nt, Human
agaaaauugaauuuaacaa

SEQ ID NO: 3591110 - RNA, 13 nt, Human
agaaaauugaguu

SEQ ID NO: 3591111 - RNA, 22 nt, Human
agaaaauugaguugcacuuauu

SEQ ID NO: 3591112 - RNA, 18 nt, Human
agaaaauugcugugccuc

SEQ ID NO: 3591113 - RNA, 22 nt, Human
agaaaauuuuuguaguagcguu

SEQ ID NO: 3591114 - RNA, 15 nt, Human
agaaacaaacaaaag

SEQ ID NO: 3591115 - RNA, 13 nt, Human
agaaacaaagaug

SEQ ID NO: 3591116 - RNA, 17 nt, Human
agaaacaaagauguuau

SEQ ID NO: 3591117 - RNA, 15 nt, Human
agaaacaauaaagag

SEQ ID NO: 3591118 - RNA, 16 nt, Human
agaaacaauaaagaga

SEQ ID NO: 3591119 - RNA, 15 nt, Human
agaaacaauuucugu

SEQ ID NO: 3591120 - RNA, 16 nt, Human
agaaacacaacuauau

SEQ ID NO: 3591121 - RNA, 22 nt, Human
agaaacacacugaggcagggaa

SEQ ID NO: 3591122 - RNA, 18 nt, Human
agaaacacccacaggcau

SEQ ID NO: 3591123 - RNA, 20 nt, Human
agaaacaccuagaucagaac

SEQ ID NO: 3591124 - RNA, 23 nt, Human
agaaacacguaucccaccugaca

SEQ ID NO: 3591125 - RNA, 11 nt, Human
agaaacacuga

SEQ ID NO: 3591126 - RNA, 16 nt, Human
agaaacacugaaaaga

SEQ ID NO: 3591127 - RNA, 15 nt, Human
agaaacacugccuuu

SEQ ID NO: 3591128 - RNA, 15 nt, Human
agaaacacuuucucu

SEQ ID NO: 3591129 - RNA, 15 nt, Human
agaaacagauaccau

SEQ ID NO: 3591130 - RNA, 11 nt, Human
agaaacagcuu

SEQ ID NO: 3591131 - RNA, 15 nt, Human
agaaacagcuuucaa

SEQ ID NO: 3591132 - RNA, 16 nt, Human
agaaacagcuuucaag

SEQ ID NO: 3591133 - RNA, 20 nt, Human
agaaacagcuuucaagugcc

SEQ ID NO: 3591134 - RNA, 17 nt, Human
agaaacaguugguaacu

SEQ ID NO: 3591135 - RNA, 18 nt, Human
agaaacaguugguaacuu

SEQ ID NO: 3591136 - RNA, 17 nt, Human
agaaacauaaauaaaau

SEQ ID NO: 3591137 - RNA, 16 nt, Human
agaaacaucaguuacu

SEQ ID NO: 3591138 - RNA, 21 nt, Human
agaaacaucaguuacucugaa

SEQ ID NO: 3591139 - RNA, 23 nt, Human
agaaacaucaguuacucugaagg

SEQ ID NO: 3591140 - RNA, 15 nt, Human
agaaacaugacacug

SEQ ID NO: 3591141 - RNA, 14 nt, Human
agaaacauugaaga

SEQ ID NO: 3591142 - RNA, 12 nt, Human
agaaacauuuau

SEQ ID NO: 3591143 - RNA, 19 nt, Human
agaaacauuuauauugaua

SEQ ID NO: 3591144 - RNA, 14 nt, Human
agaaaccagcuucc

SEQ ID NO: 3591145 - RNA, 22 nt, Human
agaaaccagcuuccuucagaga

SEQ ID NO: 3591146 - RNA, 16 nt, Human
agaaacccaagcuccu

SEQ ID NO: 3591147 - RNA, 16 nt, Human
agaaacccgacagagg

SEQ ID NO: 3591148 - RNA, 15 nt, Human
agaaaccuacugccc

SEQ ID NO: 3591149 - RNA, 20 nt, Human
agaaaccuuauuguaccucu

SEQ ID NO: 3591150 - RNA, 18 nt, Human
agaaaccuuuuuaaaaau

SEQ ID NO: 3591151 - RNA, 21 nt, Human
agaaacgaguuggugucuuuc

SEQ ID NO: 3591152 - RNA, 16 nt, Human
agaaacgucuucuaaa

SEQ ID NO: 3591153 - RNA, 21 nt, Human
agaaacguuuggaacaaucua

SEQ ID NO: 3591154 - RNA, 16 nt, Human
agaaacugaggaauuu

SEQ ID NO: 3591155 - RNA, 17 nt, Human
agaaacuggaaauacua

SEQ ID NO: 3591156 - RNA, 13 nt, Human
agaaacuggaacu

SEQ ID NO: 3591157 - RNA, 20 nt, Human
agaaacuguagucucaggac

SEQ ID NO: 3591158 - RNA, 22 nt, Human
agaaacuuaucuuacaaagugu

SEQ ID NO: 3591159 - RNA, 20 nt, Human
agaaacuuauuucucauauc

SEQ ID NO: 3591160 - RNA, 23 nt, Human
agaaacuuguucuuccaaagcag

SEQ ID NO: 3591161 - RNA, 18 nt, Human
agaaacuuuauacauuag

SEQ ID NO: 3591162 - RNA, 22 nt, Human
agaaacuuuauucaaguaaaaa

SEQ ID NO: 3591163 - RNA, 23 nt, Human
agaaacuuuuaucuauucugaga

SEQ ID NO: 3591164 - RNA, 23 nt, Human
agaaacuuuuguaaagaaauuua

SEQ ID NO: 3591165 - RNA, 14 nt, Human
agaaagaaaaucag

SEQ ID NO: 3591166 - RNA, 16 nt, Human
agaaagaaaaugaaga

SEQ ID NO: 3591167 - RNA, 20 nt, Human
agaaagaaacccgacagagg

SEQ ID NO: 3591168 - RNA, 12 nt, Human
agaaagaaaguu

SEQ ID NO: 3591169 - RNA, 12 nt, Human
agaaagaaauua

SEQ ID NO: 3591170 - RNA, 16 nt, Human
agaaagaacuaucuuc

SEQ ID NO: 3591171 - RNA, 12 nt, Human
agaaagaagaga

SEQ ID NO: 3591172 - RNA, 13 nt, Human
agaaagaagagac

SEQ ID NO: 3591173 - RNA, 15 nt, Human
agaaagaagaugaau

SEQ ID NO: 3591174 - RNA, 12 nt, Human
agaaagaaggaa

SEQ ID NO: 3591175 - RNA, 13 nt, Human
agaaagaaggaag

SEQ ID NO: 3591176 - RNA, 22 nt, Human
agaaagaauguuacugccuuaa

SEQ ID NO: 3591177 - RNA, 15 nt, Human
agaaagacagagcug

SEQ ID NO: 3591178 - RNA, 23 nt, Human
agaaagacuauucaaacagucuc

SEQ ID NO: 3591179 - RNA, 22 nt, Human
agaaagacuugguugguagggu

SEQ ID NO: 3591180 - RNA, 12 nt, Human
agaaagagagaa

SEQ ID NO: 3591181 - RNA, 16 nt, Human
agaaagagagaaaaua

SEQ ID NO: 3591182 - RNA, 17 nt, Human
agaaagagagaaaauaa

SEQ ID NO: 3591183 - RNA, 22 nt, Human
agaaagagagaaaauaaaaagu

SEQ ID NO: 3591184 - RNA, 22 nt, Human
agaaagaggugaccccagggca

SEQ ID NO: 3591185 - RNA, 23 nt, Human
agaaagaguuugagaccugaaua

SEQ ID NO: 3591186 - RNA, 21 nt, Human
agaaagcaaaauuauguuugc

SEQ ID NO: 3591187 - RNA, 18 nt, Human
agaaagcagaacagugau

SEQ ID NO: 3591188 - RNA, 14 nt, Human
agaaagcauuugaa

SEQ ID NO: 3591189 - RNA, 16 nt, Human
agaaagcauuugaaug

SEQ ID NO: 3591190 - RNA, 21 nt, Human
agaaagcauuugaaugcauuu

SEQ ID NO: 3591191 - RNA, 15 nt, Human
agaaagccaggcagg

SEQ ID NO: 3591192 - RNA, 11 nt, Human
agccccugucc

SEQ ID NO: 3591193 - RNA, 20 nt, Human
agccccugucuagagaggga

SEQ ID NO: 3591194 - RNA, 21 nt, Human
agccccugucuagagagggag

SEQ ID NO: 3591195 - RNA, 14 nt, Human
agccccuguggaga

SEQ ID NO: 3591196 - RNA, 15 nt, Human
agccccuucucagaa

SEQ ID NO: 3591197 - RNA, 15 nt, Human
agccccuucugcuca

SEQ ID NO: 3591198 - RNA, 16 nt, Human
agccccuucugcucag

SEQ ID NO: 3591199 - RNA, 23 nt, Human
agccccuuuuucauauguugcuc

SEQ ID NO: 3591200 - RNA, 14 nt, Human
agcccgaauacaaa

SEQ ID NO: 3591201 - RNA, 21 nt, Human
agcccgauccuccccuggacu

SEQ ID NO: 3591202 - RNA, 21 nt, Human
agcccgcacccccacccuuug

SEQ ID NO: 3591203 - RNA, 21 nt, Human
agcccgcaugcagcagcuugc

SEQ ID NO: 3591204 - RNA, 18 nt, Human
agcccgccugacagaaac

SEQ ID NO: 3591205 - RNA, 14 nt, Human
agcccgccugccag

SEQ ID NO: 3591206 - RNA, 16 nt, Human
agcccgccugccaguc

SEQ ID NO: 3591207 - RNA, 18 nt, Human
agcccgccugccaguccu

SEQ ID NO: 3591208 - RNA, 19 nt, Human
agcccgccugccaguccua

SEQ ID NO: 3591209 - RNA, 23 nt, Human
agcccgccugccaguccuagcug

SEQ ID NO: 3591210 - RNA, 20 nt, Human
agcccgcggggacauuggga

SEQ ID NO: 3591211 - RNA, 14 nt, Human
agcccgcuaggcuc

SEQ ID NO: 3591212 - RNA, 14 nt, Human
agcccggccgcucc

SEQ ID NO: 3591213 - RNA, 11 nt, Human
agcccggccug

SEQ ID NO: 3591214 - RNA, 21 nt, Human
agcccggcgccaccauccugc

SEQ ID NO: 3591215 - RNA, 15 nt, Human
agcccggcuccuggu

SEQ ID NO: 3591216 - RNA, 15 nt, Human
agcccggcugguuuu

SEQ ID NO: 3591217 - RNA, 15 nt, Human
agcccgggaaaggag

SEQ ID NO: 3591218 - RNA, 14 nt, Human
agcccgggagccua

SEQ ID NO: 3591219 - RNA, 15 nt, Human
agcccgggagccuag

SEQ ID NO: 3591220 - RNA, 17 nt, Human
agcccgggagccuagga

SEQ ID NO: 3591221 - RNA, 20 nt, Human
agcccgggagccuaggacca

SEQ ID NO: 3591222 - RNA, 14 nt, Human
agcccgggcucugc

SEQ ID NO: 3591223 - RNA, 15 nt, Human
agcccgggcucugcc

SEQ ID NO: 3591224 - RNA, 19 nt, Human
acucuagucaaugacauga

SEQ ID NO: 3591225 - RNA, 20 nt, Human
acucuagucaaugacaugaa

SEQ ID NO: 3591226 - RNA, 18 nt, Human
acucuauaagauuccaaa

SEQ ID NO: 3591227 - RNA, 22 nt, Human
acucuauaagcaaauugcuuuu

SEQ ID NO: 3591228 - RNA, 16 nt, Human
acucuauauuguucag

SEQ ID NO: 3591229 - RNA, 21 nt, Human
acucuaucaaguauuauaccu

SEQ ID NO: 3591230 - RNA, 23 nt, Human
acucuaucaaguauuauaccuuu

SEQ ID NO: 3591231 - RNA, 20 nt, Human
acucuaucggagaacaugaa

SEQ ID NO: 3591232 - RNA, 16 nt, Human
acucuaugccccaaau

SEQ ID NO: 3591233 - RNA, 20 nt, Human
acucuaugccccaaauauag

SEQ ID NO: 3591234 - RNA, 16 nt, Human
acucucagaggcccca

SEQ ID NO: 3591235 - RNA, 17 nt, Human
acucucagaggccccaa

SEQ ID NO: 3591236 - RNA, 21 nt, Human
acucucaggaaaugcugaccc

SEQ ID NO: 3591237 - RNA, 22 nt, Human
acucucaggaaaugcugaccca

SEQ ID NO: 3591238 - RNA, 19 nt, Human
acucucaggaucaagaaag

SEQ ID NO: 3591239 - RNA, 16 nt, Human
acucucauuccccagg

SEQ ID NO: 3591240 - RNA, 23 nt, Human
acucuccagggguccuaggccuc

SEQ ID NO: 3591241 - RNA, 14 nt, Human
acucuccccacacu

SEQ ID NO: 3591242 - RNA, 19 nt, Human
acucuccccacgagggcug

SEQ ID NO: 3591243 - RNA, 14 nt, Human
acucucccccaccc

SEQ ID NO: 3591244 - RNA, 22 nt, Human
acucucccccacccccuccccg

SEQ ID NO: 3591245 - RNA, 21 nt, Human
acucuccuagagacagaagca

SEQ ID NO: 3591246 - RNA, 20 nt, Human
acucuccuaggcauucugga

SEQ ID NO: 3591247 - RNA, 12 nt, Human
acucuccucugc

SEQ ID NO: 3591248 - RNA, 21 nt, Human
acucuccucugcugcuggcug

SEQ ID NO: 3591249 - RNA, 14 nt, Human
acucuccugccuug

SEQ ID NO: 3591250 - RNA, 12 nt, Human
acucuccugggc

SEQ ID NO: 3591251 - RNA, 14 nt, Human
acucuccugggccc

SEQ ID NO: 3591252 - RNA, 17 nt, Human
acucuccugggccccuc

SEQ ID NO: 3591253 - RNA, 17 nt, Human
acucuccuugcuaccca

SEQ ID NO: 3591254 - RNA, 16 nt, Human
acucuccuuggugucg

SEQ ID NO: 3591255 - RNA, 18 nt, Human
acucucgcaucuucccaa

SEQ ID NO: 3591256 - RNA, 14 nt, Human
acucucuaccagau

SEQ ID NO: 3591257 - RNA, 13 nt, Human
acucucuccaccc

SEQ ID NO: 3591258 - RNA, 21 nt, Human
acucucuccacccuauaugua

SEQ ID NO: 3591259 - RNA, 21 nt, Human
acucucugaaccccucccucc

SEQ ID NO: 3591260 - RNA, 20 nt, Human
acucucuuauugccucacuu

SEQ ID NO: 3591261 - RNA, 23 nt, Human
acucucuuauugccucacuucag

SEQ ID NO: 3591262 - RNA, 20 nt, Human
acucugaaacacacugaaag

SEQ ID NO: 3591263 - RNA, 17 nt, Human
acucugaagccucuggg

SEQ ID NO: 3591264 - RNA, 19 nt, Human
acucugaagccucugggaa

SEQ ID NO: 3591265 - RNA, 12 nt, Human
acucugaagcug

SEQ ID NO: 3591266 - RNA, 21 nt, Human
acucugaagggcaucaugcau

SEQ ID NO: 3591267 - RNA, 19 nt, Human
acucugaauuuaucuuuga

SEQ ID NO: 3591268 - RNA, 20 nt, Human
acucugacaacagacuucug

SEQ ID NO: 3591269 - RNA, 19 nt, Human
acucugacaagggcugacc

SEQ ID NO: 3591270 - RNA, 19 nt, Human
acucugacgcaaaaccacu

SEQ ID NO: 3591271 - RNA, 11 nt, Human
acucugagacu

SEQ ID NO: 3591272 - RNA, 13 nt, Human
acucugagcccau

SEQ ID NO: 3591273 - RNA, 18 nt, Human
acucugagcgggaggcag

SEQ ID NO: 3591274 - RNA, 22 nt, Human
acucugagcgggaggcagaguu

SEQ ID NO: 3591275 - RNA, 22 nt, Human
acucugaguuuaccauuuguaa

SEQ ID NO: 3591276 - RNA, 22 nt, Human
acucugauagaauuauuucaca

SEQ ID NO: 3591277 - RNA, 11 nt, Human
acucugcacau

SEQ ID NO: 3591278 - RNA, 18 nt, Human
acucugcacaugucuugu

SEQ ID NO: 3591279 - RNA, 22 nt, Human
acucugcacaugucuuguacau

SEQ ID NO: 3591280 - RNA, 15 nt, Human
acucugcacuacucc

SEQ ID NO: 3591281 - RNA, 19 nt, Human
acucugcacuacuccucug

SEQ ID NO: 3591282 - RNA, 13 nt, Human
acucugcagacug

SEQ ID NO: 3591283 - RNA, 17 nt, Human
acucugcagacugcuag

SEQ ID NO: 3591284 - RNA, 14 nt, Human
acucugcagccuca

SEQ ID NO: 3591285 - RNA, 17 nt, Human
acucugcagccucagag

SEQ ID NO: 3591286 - RNA, 16 nt, Human
acucugccagccacau

SEQ ID NO: 3591287 - RNA, 18 nt, Human
acucugccagggcagugc

SEQ ID NO: 3591288 - RNA, 17 nt, Human
acucugcccccugcugg

SEQ ID NO: 3591289 - RNA, 18 nt, Human
acucugcccuacucacuc

SEQ ID NO: 3591290 - RNA, 16 nt, Human
acucugccuccucuuc

SEQ ID NO: 3591291 - RNA, 11 nt, Human
acucugccucu

SEQ ID NO: 3591292 - RNA, 16 nt, Human
acucugcuaccuugcc

SEQ ID NO: 3591293 - RNA, 18 nt, Human
acucugcucgccuuagca

SEQ ID NO: 3591294 - RNA, 11 nt, Human
acucugcucug

SEQ ID NO: 3591295 - RNA, 12 nt, Human
acucugcucuga

SEQ ID NO: 3591296 - RNA, 13 nt, Human
acucugcucugau

SEQ ID NO: 3591297 - RNA, 16 nt, Human
acucugcucugaugca

SEQ ID NO: 3591298 - RNA, 20 nt, Human
acucugcucugcccuuguuc

SEQ ID NO: 3591299 - RNA, 15 nt, Human
acucugcugaggguc

SEQ ID NO: 3591300 - RNA, 20 nt, Human
acucugcugaggguccagaa

SEQ ID NO: 3591301 - RNA, 14 nt, Human
acucugcugcuuag

SEQ ID NO: 3591302 - RNA, 14 nt, Human
acucugcuucucug

SEQ ID NO: 3591303 - RNA, 16 nt, Human
acucugcuucucugac

SEQ ID NO: 3591304 - RNA, 21 nt, Human
acucugcuucucugacuucug

SEQ ID NO: 3591305 - RNA, 14 nt, Human
acucugcuuugacu

SEQ ID NO: 3591306 - RNA, 20 nt, Human
acucugcuuugacugagcag

SEQ ID NO: 3591307 - RNA, 23 nt, Human
acucugcuuugacugagcagacu

SEQ ID NO: 3591308 - RNA, 14 nt, Human
acucuggacuuucu

SEQ ID NO: 3591309 - RNA, 17 nt, Human
acucuggauucagccuu

SEQ ID NO: 3591310 - RNA, 20 nt, Human
acucuggauucagccuucuu

SEQ ID NO: 3591311 - RNA, 14 nt, Human
acucuggcaaagcu

SEQ ID NO: 3591312 - RNA, 16 nt, Human
acucuggcaaagcuuu

SEQ ID NO: 3591313 - RNA, 22 nt, Human
acucuggcagcaccgccucuuc

SEQ ID NO: 3591314 - RNA, 13 nt, Human
acucuggcagcca

SEQ ID NO: 3591315 - RNA, 16 nt, Human
acucuggcagccacac

SEQ ID NO: 3591316 - RNA, 15 nt, Human
acucuggcagcucag

SEQ ID NO: 3591317 - RNA, 20 nt, Human
acucuggcagcucagagagg

SEQ ID NO: 3591318 - RNA, 13 nt, Human
acucuggcccugg

SEQ ID NO: 3591319 - RNA, 17 nt, Human
acucuggcccuggcccu

SEQ ID NO: 3591320 - RNA, 22 nt, Human
acucuggcugguuuggaaugcu

SEQ ID NO: 3591321 - RNA, 23 nt, Human
acucuggcugguuuggaaugcuu

SEQ ID NO: 3591322 - RNA, 15 nt, Human
acucuggcuuccagg

SEQ ID NO: 3591323 - RNA, 17 nt, Human
acucuggcuuccaggua

SEQ ID NO: 3591324 - RNA, 17 nt, Human
acucuggcuuuuggaag

SEQ ID NO: 3591325 - RNA, 22 nt, Human
acucugggaacuucuuugcagu

SEQ ID NO: 3591326 - RNA, 23 nt, Human
acucugggcucaagcaauccucu

SEQ ID NO: 3591327 - RNA, 17 nt, Human
acucuggggugcugccu

SEQ ID NO: 3591328 - RNA, 19 nt, Human
acucuggguccuuccugaa

SEQ ID NO: 3591329 - RNA, 20 nt, Human
acucuggugagucaccacuu

SEQ ID NO: 3591330 - RNA, 16 nt, Human
acucuggugccuccag

SEQ ID NO: 3591331 - RNA, 19 nt, Human
acucugguggcacaggagu

SEQ ID NO: 3591332 - RNA, 17 nt, Human
acucugguuucucauuc

SEQ ID NO: 3591333 - RNA, 16 nt, Human
acucuguaacaucacu

SEQ ID NO: 3591334 - RNA, 23 nt, Human
acucugucaauuucccugacucc

SEQ ID NO: 3591335 - RNA, 11 nt, Human
acucuguccug

SEQ ID NO: 3591336 - RNA, 17 nt, Human
agaucacgccacugcac

SEQ ID NO: 3591337 - RNA, 17 nt, Human
agaucacuguuuagauu

SEQ ID NO: 3591338 - RNA, 18 nt, Human
agaucacuguuuagauuu

SEQ ID NO: 3591339 - RNA, 20 nt, Human
agaucacuguuuagauuugc

SEQ ID NO: 3591340 - RNA, 11 nt, Human
agaucacuuuc

SEQ ID NO: 3591341 - RNA, 15 nt, Human
agaucacuuugcucu

SEQ ID NO: 3591342 - RNA, 20 nt, Human
agaucagaaaaauggagcaa

SEQ ID NO: 3591343 - RNA, 21 nt, Human
agaucagaaaaauggagcaaa

SEQ ID NO: 3591344 - RNA, 22 nt, Human
agaucagaugcuccaagauucu

SEQ ID NO: 3591345 - RNA, 13 nt, Human
agaucagccuggg

SEQ ID NO: 3591346 - RNA, 18 nt, Human
agaucaggaagagaagga

SEQ ID NO: 3591347 - RNA, 18 nt, Human
agaucaguguaccauuug

SEQ ID NO: 3591348 - RNA, 19 nt, Human
agaucauagauuucugauu

SEQ ID NO: 3591349 - RNA, 13 nt, Human
agaucauaguuuu

SEQ ID NO: 3591350 - RNA, 20 nt, Human
agaucauaguuuuauuuaua

SEQ ID NO: 3591351 - RNA, 18 nt, Human
agaucauauacgugaaaa

SEQ ID NO: 3591352 - RNA, 13 nt, Human
agaucauccuuuc

SEQ ID NO: 3591353 - RNA, 18 nt, Human
agaucauccuuuccagca

SEQ ID NO: 3591354 - RNA, 17 nt, Human
agaucauggaacacaaa

SEQ ID NO: 3591355 - RNA, 16 nt, Human
agaucauuuguucugg

SEQ ID NO: 3591356 - RNA, 16 nt, Human
agaucauuuugaaauu

SEQ ID NO: 3591357 - RNA, 12 nt, Human
agauccaaagac

SEQ ID NO: 3591358 - RNA, 14 nt, Human
agauccaaagacuc

SEQ ID NO: 3591359 - RNA, 15 nt, Human
agauccacacacaga

SEQ ID NO: 3591360 - RNA, 14 nt, Human
agauccagccuggg

SEQ ID NO: 3591361 - RNA, 12 nt, Human
agauccaggacu

SEQ ID NO: 3591362 - RNA, 13 nt, Human
agauccaggacua

SEQ ID NO: 3591363 - RNA, 15 nt, Human
agauccaggagcucc

SEQ ID NO: 3591364 - RNA, 21 nt, Human
agaucccagaaggaccuccug

SEQ ID NO: 3591365 - RNA, 16 nt, Human
agaucccaggccccug

SEQ ID NO: 3591366 - RNA, 20 nt, Human
agaucccaggccccuggagg

SEQ ID NO: 3591367 - RNA, 21 nt, Human
agauccccaaaacaggccagg

SEQ ID NO: 3591368 - RNA, 15 nt, Human
agaucccccagaaaa

SEQ ID NO: 3591369 - RNA, 17 nt, Human
acugcagggccaggacu

SEQ ID NO: 3591370 - RNA, 20 nt, Human
acugcagggccaggacugag

SEQ ID NO: 3591371 - RNA, 21 nt, Human
acugcagggguuauguggaag

SEQ ID NO: 3591372 - RNA, 13 nt, Human
acugcagucacug

SEQ ID NO: 3591373 - RNA, 17 nt, Human
acugcaguccuggagca

SEQ ID NO: 3591374 - RNA, 20 nt, Human
acugcauaccaaccugggca

SEQ ID NO: 3591375 - RNA, 13 nt, Human
acugcauacuuuu

SEQ ID NO: 3591376 - RNA, 17 nt, Human
acugcauacuuuuuaaa

SEQ ID NO: 3591377 - RNA, 15 nt, Human
acugcauccagccug

SEQ ID NO: 3591378 - RNA, 17 nt, Human
acugcauccuccgccuc

SEQ ID NO: 3591379 - RNA, 20 nt, Human
acugcauccuccgccucccg

SEQ ID NO: 3591380 - RNA, 12 nt, Human
acugcaugcacu

SEQ ID NO: 3591381 - RNA, 18 nt, Human
acugcaugcacuucuuac

SEQ ID NO: 3591382 - RNA, 14 nt, Human
acugcaugcccaga

SEQ ID NO: 3591383 - RNA, 20 nt, Human
acugcauggaccuaacauuc

SEQ ID NO: 3591384 - RNA, 16 nt, Human
acugcaugguaauuua

SEQ ID NO: 3591385 - RNA, 14 nt, Human
acugcauguauaaa

SEQ ID NO: 3591386 - RNA, 15 nt, Human
acugcauguauaaau

SEQ ID NO: 3591387 - RNA, 20 nt, Human
acugcauguauaaaugaagu

SEQ ID NO: 3591388 - RNA, 19 nt, Human
agcaauucuccugccucag

SEQ ID NO: 3591389 - RNA, 20 nt, Human
agcaauucuccugccucagc

SEQ ID NO: 3591390 - RNA, 19 nt, Human
agcaauuuaaauguuauga

SEQ ID NO: 3591391 - RNA, 17 nt, Human
agcaauuuaacuagaca

SEQ ID NO: 3591392 - RNA, 19 nt, Human
agcaauuuaacuagacaca

SEQ ID NO: 3591393 - RNA, 22 nt, Human
agcaauuuaacuagacacagau

SEQ ID NO: 3591394 - RNA, 24 nt, Human
agcaauuuaauauuuugcacaguu

SEQ ID NO: 3591395 - RNA, 22 nt, Human
agcaauuucccccuaaaccaac

SEQ ID NO: 3591396 - RNA, 12 nt, Human
agcaauuuuccu

SEQ ID NO: 3591397 - RNA, 13 nt, Human
agcaauuuuccuu

SEQ ID NO: 3591398 - RNA, 14 nt, Human
agcaauuuuccuug

SEQ ID NO: 3591399 - RNA, 17 nt, Human
agcaauuuuccuugaag

SEQ ID NO: 3591400 - RNA, 12 nt, Human
agcacaaaauuc

SEQ ID NO: 3591401 - RNA, 12 nt, Human
agcacaaacaca

SEQ ID NO: 3591402 - RNA, 13 nt, Human
agcacaaacacaa

SEQ ID NO: 3591403 - RNA, 15 nt, Human
agcacaaacacaagg

SEQ ID NO: 3591404 - RNA, 14 nt, Human
agcacaaacauuuu

SEQ ID NO: 3591405 - RNA, 18 nt, Human
agcacaacccccagcucc

SEQ ID NO: 3591406 - RNA, 18 nt, Human
agcacaagaagcgugaga

SEQ ID NO: 3591407 - RNA, 17 nt, Human
agcacaaguuauuuaaa

SEQ ID NO: 3591408 - RNA, 17 nt, Human
agcacaauaaauggcug

SEQ ID NO: 3591409 - RNA, 14 nt, Human
agcacacacuuuug

SEQ ID NO: 3591410 - RNA, 17 nt, Human
agcacacucuggucuug

SEQ ID NO: 3591411 - RNA, 22 nt, Human
agcacacugcuugugaaaggaa

SEQ ID NO: 3591412 - RNA, 16 nt, Human
agcacagaaaacuaga

SEQ ID NO: 3591413 - RNA, 15 nt, Human
agcacagacccugcc

SEQ ID NO: 3591414 - RNA, 16 nt, Human
agcacagacccugccc

SEQ ID NO: 3591415 - RNA, 12 nt, Human
agcacagagagg

SEQ ID NO: 3591416 - RNA, 19 nt, Human
agcacagagagggggccac

SEQ ID NO: 3591417 - RNA, 20 nt, Human
agcacagagagggggccacc

SEQ ID NO: 3591418 - RNA, 21 nt, Human
agcacagagagggggccaccu

SEQ ID NO: 3591419 - RNA, 19 nt, Human
agcacagagagucuggaua

SEQ ID NO: 3591420 - RNA, 19 nt, Human
agcacagauaaaaagugga

SEQ ID NO: 3591421 - RNA, 22 nt, Human
agcacagcaaggaggcuggcug

SEQ ID NO: 3591422 - RNA, 23 nt, Human
agcacagcaaggaggcuggcugg

SEQ ID NO: 3591423 - RNA, 13 nt, Human
agcacagcagccu

SEQ ID NO: 3591424 - RNA, 13 nt, Human
agcacagcagcuu

SEQ ID NO: 3591425 - RNA, 12 nt, Human
agcacagccaac

SEQ ID NO: 3591426 - RNA, 23 nt, Human
agcacagccaacacgcaccugcc

SEQ ID NO: 3591427 - RNA, 10 nt, Human
agcacagccc

SEQ ID NO: 3591428 - RNA, 15 nt, Human
agcacagcucccuuc

SEQ ID NO: 3591429 - RNA, 18 nt, Human
agcacagcuuagauuuca

SEQ ID NO: 3591430 - RNA, 16 nt, Human
agcacagcuucauuuc

SEQ ID NO: 3591431 - RNA, 18 nt, Human
agcacagcuugaccugag

SEQ ID NO: 3591432 - RNA, 13 nt, Human
agcacaggagaca

SEQ ID NO: 3591433 - RNA, 13 nt, Human
agcacaggcagcu

SEQ ID NO: 3591434 - RNA, 12 nt, Human
agcacaggcuaa

SEQ ID NO: 3591435 - RNA, 18 nt, Human
agcacaggcugagugcag

SEQ ID NO: 3591436 - RNA, 19 nt, Human
agcacaggcugagugcagg

SEQ ID NO: 3591437 - RNA, 20 nt, Human
agcacaggcugagugcaggc

SEQ ID NO: 3591438 - RNA, 16 nt, Human
agcacaggucccaccu

SEQ ID NO: 3591439 - RNA, 20 nt, Human
agcacaggucccaccuccag

SEQ ID NO: 3591440 - RNA, 19 nt, Human
agcacaggugggcuuccca

SEQ ID NO: 3591441 - RNA, 15 nt, Human
agcacagugccugca

SEQ ID NO: 3591442 - RNA, 16 nt, Human
agcacagugguggcag

SEQ ID NO: 3591443 - RNA, 20 nt, Human
agcacagugguggcagggcc

SEQ ID NO: 3591444 - RNA, 14 nt, Human
agcacaguuugaac

SEQ ID NO: 3591445 - RNA, 12 nt, Human
agcacaguuugu

SEQ ID NO: 3591446 - RNA, 16 nt, Human
agcacauauggaauuu

SEQ ID NO: 3591447 - RNA, 18 nt, Human
agcacauauuagugcagc

SEQ ID NO: 3591448 - RNA, 17 nt, Human
agcacauauuuucuguu

SEQ ID NO: 3591449 - RNA, 23 nt, Human
agcacaucucaacaggccucagg

SEQ ID NO: 3591450 - RNA, 13 nt, Human
agcacaugccucu

SEQ ID NO: 3591451 - RNA, 18 nt, Human
agcacaugccucucucag

SEQ ID NO: 3591452 - RNA, 16 nt, Human
agcacaugcuggccag

SEQ ID NO: 3591453 - RNA, 19 nt, Human
agcacaugcuggccagccu

SEQ ID NO: 3591454 - RNA, 16 nt, Human
agcaccaaaauaagaa

SEQ ID NO: 3591455 - RNA, 18 nt, Human
agcaccaaaauaagaaaa

SEQ ID NO: 3591456 - RNA, 20 nt, Human
agcaccaaaauaagaaaaga

SEQ ID NO: 3591457 - RNA, 17 nt, Human
agcaccaaaucaaaauc

SEQ ID NO: 3591458 - RNA, 17 nt, Human
agcaccaagcucaaagc

SEQ ID NO: 3591459 - RNA, 16 nt, Human
agcaccaccaggucuc

SEQ ID NO: 3591460 - RNA, 20 nt, Human
agcaccaccaggucucccgg

SEQ ID NO: 3591461 - RNA, 16 nt, Human
agcaccacccuccuuc

SEQ ID NO: 3591462 - RNA, 20 nt, Human
agcaccagcuucuccaggcu

SEQ ID NO: 3591463 - RNA, 12 nt, Human
agcaccagggaa

SEQ ID NO: 3591464 - RNA, 15 nt, Human
agcaccagggacuau

SEQ ID NO: 3591465 - RNA, 15 nt, Human
agcaccauccccucc

SEQ ID NO: 3591466 - RNA, 16 nt, Human
agcaccauccccuccg

SEQ ID NO: 3591467 - RNA, 16 nt, Human
agcaccaucucuccuc

SEQ ID NO: 3591468 - RNA, 21 nt, Human
agcacccauuucaauguguau

SEQ ID NO: 3591469 - RNA, 19 nt, Human
agcaccccaugccaaagcu

SEQ ID NO: 3591470 - RNA, 20 nt, Human
agcacccccacgcccucauu

SEQ ID NO: 3591471 - RNA, 18 nt, Human
agcaccccuacucacaua

SEQ ID NO: 3591472 - RNA, 13 nt, Human
agcaccccugucu

SEQ ID NO: 3591473 - RNA, 12 nt, Human
agcaccccuucc

SEQ ID NO: 3591474 - RNA, 13 nt, Human
agcaccccuucca

SEQ ID NO: 3591475 - RNA, 13 nt, Human
agcacccugaggg

SEQ ID NO: 3591476 - RNA, 15 nt, Human
agcacccugagggcg

SEQ ID NO: 3591477 - RNA, 18 nt, Human
agcaccgaggggccuuug

SEQ ID NO: 3591478 - RNA, 18 nt, Human
agcaccgccucuucccgc

SEQ ID NO: 3591479 - RNA, 16 nt, Human
agcaccggaccagccu

SEQ ID NO: 3591480 - RNA, 17 nt, Human
agcaccggaccagccug

SEQ ID NO: 3591481 - RNA, 23 nt, Human
agcaccggaccagccuggcccac

SEQ ID NO: 3591482 - RNA, 21 nt, Human
agcaccgugucaagcugcucu

SEQ ID NO: 3591483 - RNA, 18 nt, Human
agcaccguucugugcaca

SEQ ID NO: 3591484 - RNA, 18 nt, Human
agcaccuaguccagugac

SEQ ID NO: 3591485 - RNA, 15 nt, Human
agcaccuccaggccu

SEQ ID NO: 3591486 - RNA, 16 nt, Human
agcaccucccagcccc

SEQ ID NO: 3591487 - RNA, 17 nt, Human
agcaccucccagccccu

SEQ ID NO: 3591488 - RNA, 18 nt, Human
agcaccucccagccccug

SEQ ID NO: 3591489 - RNA, 14 nt, Human
agcaccuccucagc

SEQ ID NO: 3591490 - RNA, 16 nt, Human
agcaccuccugccucg

SEQ ID NO: 3591491 - RNA, 15 nt, Human
agcaccugccaggga

SEQ ID NO: 3591492 - RNA, 18 nt, Human
agcaccugcccuaccugc

SEQ ID NO: 3591493 - RNA, 11 nt, Human
agcaccugccg

SEQ ID NO: 3591494 - RNA, 16 nt, Human
agcaccugccgaccuc

SEQ ID NO: 3591495 - RNA, 19 nt, Human
agcaccugccgaccucguc

SEQ ID NO: 3591496 - RNA, 22 nt, Human
agcaccugucuccuuucacccc

SEQ ID NO: 3591497 - RNA, 18 nt, Human
agcaccuuccucacuucc

SEQ ID NO: 3591498 - RNA, 15 nt, Human
agcaccuugugccug

SEQ ID NO: 3591499 - RNA, 17 nt, Human
agcaccuugugccuggg

SEQ ID NO: 3591500 - RNA, 17 nt, Human
agcacgaaauguuauuu

SEQ ID NO: 3591501 - RNA, 19 nt, Human
agcacgaauguuccccuca

SEQ ID NO: 3591502 - RNA, 17 nt, Human
agcacgauuucuguuua

SEQ ID NO: 3591503 - RNA, 14 nt, Human
agcacggacaauaa

SEQ ID NO: 3591504 - RNA, 15 nt, Human
agcacggcucugucc

SEQ ID NO: 3591505 - RNA, 18 nt, Human
agcacgggacggaagugc

SEQ ID NO: 3591506 - RNA, 18 nt, Human
agcacgguggugaggcag

SEQ ID NO: 3591507 - RNA, 17 nt, Human
agcacgugguaaaacac

SEQ ID NO: 3591508 - RNA, 14 nt, Human
agcacuaaagcagu

SEQ ID NO: 3591509 - RNA, 20 nt, Human
agcacuaaagcaguggacac

SEQ ID NO: 3591510 - RNA, 16 nt, Human
agcacuaacguaaaua

SEQ ID NO: 3591511 - RNA, 17 nt, Human
agcacuacauaaacuga

SEQ ID NO: 3591512 - RNA, 16 nt, Human
agcacuacuggguguc

SEQ ID NO: 3591513 - RNA, 15 nt, Human
agcacuagagaaugc

SEQ ID NO: 3591514 - RNA, 16 nt, Human
agcacuagccaaaccu

SEQ ID NO: 3591515 - RNA, 14 nt, Human
agcagccagcucuc

SEQ ID NO: 3591516 - RNA, 21 nt, Human
agcagcccaagcuucccucca

SEQ ID NO: 3591517 - RNA, 12 nt, Human
agcagcccaccc

SEQ ID NO: 3591518 - RNA, 20 nt, Human
agcagcccacccugcugcug

SEQ ID NO: 3591519 - RNA, 21 nt, Human
agcagcccgcugaguggacug

SEQ ID NO: 3591520 - RNA, 14 nt, Human
agcagcccugcccc

SEQ ID NO: 3591521 - RNA, 19 nt, Human
agcagcccuggagucaugc

SEQ ID NO: 3591522 - RNA, 20 nt, Human
agcagccgccuuaagcugau

SEQ ID NO: 3591523 - RNA, 21 nt, Human
agcagccgccuuaagcugauc

SEQ ID NO: 3591524 - RNA, 21 nt, Human
agcagccucgccccuggcaga

SEQ ID NO: 3591525 - RNA, 21 nt, Human
agcagccucuccccaggucca

SEQ ID NO: 3591526 - RNA, 16 nt, Human
agcagccugcuuccca

SEQ ID NO: 3591527 - RNA, 19 nt, Human
agcagccuggagcccugga

SEQ ID NO: 3591528 - RNA, 20 nt, Human
agcagccuggagcccuggag

SEQ ID NO: 3591529 - RNA, 14 nt, Human
agcagccuggcucc

SEQ ID NO: 3591530 - RNA, 13 nt, Human
agcagccuguggc

SEQ ID NO: 3591531 - RNA, 14 nt, Human
agcagccuguggca

SEQ ID NO: 3591532 - RNA, 11 nt, Human
agcagccuuuc

SEQ ID NO: 3591533 - RNA, 18 nt, Human
agcagcgaccaccccugc

SEQ ID NO: 3591534 - RNA, 21 nt, Human
agcagcggggcgaagcccagg

SEQ ID NO: 3591535 - RNA, 22 nt, Human
agcagcgguuuggggagcagag

SEQ ID NO: 3591536 - RNA, 19 nt, Human
agcagcguuucuaugacac

SEQ ID NO: 3591537 - RNA, 17 nt, Human
agcagcuaaauuuucug

SEQ ID NO: 3591538 - RNA, 20 nt, Human
agcagcuagaaaacauuuuu

SEQ ID NO: 3591539 - RNA, 17 nt, Human
agcagcuaucucucagu

SEQ ID NO: 3591540 - RNA, 12 nt, Human
agcagcucuccc

SEQ ID NO: 3591541 - RNA, 13 nt, Human
agcagcucuugcu

SEQ ID NO: 3591542 - RNA, 12 nt, Human
agcagcugagca

SEQ ID NO: 3591543 - RNA, 17 nt, Human
agcagcugagcagggcc

SEQ ID NO: 3591544 - RNA, 18 nt, Human
agcagcugagcagggccg

SEQ ID NO: 3591545 - RNA, 17 nt, Human
agcaagcuuaauggcug

SEQ ID NO: 3591546 - RNA, 23 nt, Human
agcaagcuuuuacaacagugcug

SEQ ID NO: 3591547 - RNA, 17 nt, Human
agcaagcuuuuuuauuu

SEQ ID NO: 3591548 - RNA, 21 nt, Human
agcaaggaagauauacaugaa

SEQ ID NO: 3591549 - RNA, 21 nt, Human
agcaaggaagguaaaaaguua

SEQ ID NO: 3591550 - RNA, 22 nt, Human
agcaaggaagguaaaaaguuaa

SEQ ID NO: 3591551 - RNA, 17 nt, Human
agcaaggagauuuacaa

SEQ ID NO: 3591552 - RNA, 15 nt, Human
agcaaggccaccucu

SEQ ID NO: 3591553 - RNA, 19 nt, Human
agcaaggccaccucuuccu

SEQ ID NO: 3591554 - RNA, 20 nt, Human
agcaaggcccgagcagcuga

SEQ ID NO: 3591555 - RNA, 20 nt, Human
agcaaggcgcuaacuugcuu

SEQ ID NO: 3591556 - RNA, 20 nt, Human
agcaagggugaugggaaagc

SEQ ID NO: 3591557 - RNA, 16 nt, Human
agcaaggucauuucuu

SEQ ID NO: 3591558 - RNA, 20 nt, Human
agcaaggucauuucuucagu

SEQ ID NO: 3591559 - RNA, 20 nt, Human
agcaaggucuugcucuccua

SEQ ID NO: 3591560 - RNA, 14 nt, Human
agcaagguggagug

SEQ ID NO: 3591561 - RNA, 13 nt, Human
agcaaguaaaaag

SEQ ID NO: 3591562 - RNA, 15 nt, Human
agcaagucugcaggu

SEQ ID NO: 3591563 - RNA, 14 nt, Human
agcaagugaauuuu

SEQ ID NO: 3591564 - RNA, 13 nt, Human
agcaagugagagc

SEQ ID NO: 3591565 - RNA, 14 nt, Human
agcaagugagagcu

SEQ ID NO: 3591566 - RNA, 15 nt, Human
agcaagugagagcug

SEQ ID NO: 3591567 - RNA, 18 nt, Human
agcaagugagagcugggu

SEQ ID NO: 3591568 - RNA, 22 nt, Human
agcaagugagagcuggguguca

SEQ ID NO: 3591569 - RNA, 23 nt, Human
agcaaguucuagagaagaggcug

SEQ ID NO: 3591570 - RNA, 20 nt, Human
agcaaguucugagagccagg

SEQ ID NO: 3591571 - RNA, 15 nt, Human
agcaaguuuucuucc

SEQ ID NO: 3591572 - RNA, 16 nt, Human
agcaauaaagaagagu

SEQ ID NO: 3591573 - RNA, 13 nt, Human
agcaauaaaugaa

SEQ ID NO: 3591574 - RNA, 12 nt, Human
agcaauagaaac

SEQ ID NO: 3591575 - RNA, 23 nt, Human
agcaauauauuaccagcaagaau

SEQ ID NO: 3591576 - RNA, 15 nt, Human
agcaauauguaaaua

SEQ ID NO: 3591577 - RNA, 21 nt, Human
agcaauauucuuggagauuga

SEQ ID NO: 3591578 - RNA, 19 nt, Human
agcaauauuguauauuuuu

SEQ ID NO: 3591579 - RNA, 18 nt, Human
agcaauauuuaaggagau

SEQ ID NO: 3591580 - RNA, 20 nt, Human
agcaauccauguuaguuuuu

SEQ ID NO: 3591581 - RNA, 23 nt, Human
agcaauccauguuaguuuuuacu

SEQ ID NO: 3591582 - RNA, 18 nt, Human
agcaaucucuucauuauu

SEQ ID NO: 3591583 - RNA, 21 nt, Human
agcaaugacaucucaggggcc

SEQ ID NO: 3591584 - RNA, 19 nt, Human
agcaaugauguccagaaga

SEQ ID NO: 3591585 - RNA, 15 nt, Human
agcaaugcuguugga

SEQ ID NO: 3591586 - RNA, 13 nt, Human
agcaaugucugug

SEQ ID NO: 3591587 - RNA, 13 nt, Human
agcaauuaaaaau

SEQ ID NO: 3591588 - RNA, 21 nt, Human
agcaauuacaacggagucaaa

SEQ ID NO: 3591589 - RNA, 15 nt, Human
agcaauuaugaaaau

SEQ ID NO: 3591590 - RNA, 17 nt, Human
agcaauuaugaaaauaa

SEQ ID NO: 3591591 - RNA, 20 nt, Human
agcaauuccaugcuauaaaa

SEQ ID NO: 3591592 - RNA, 13 nt, Human
agcaauuuaaaug

SEQ ID NO: 3591593 - RNA, 18 nt, Human
agcaauuuuccuugaagc

SEQ ID NO: 3591594 - RNA, 11 nt, Human
agcacaaaauu

SEQ ID NO: 3591595 - RNA, 20 nt, Human
agcacaaaauucaaagcaug

SEQ ID NO: 3591596 - RNA, 22 nt, Human
agcacaaaauucaaagcaugga

SEQ ID NO: 3591597 - RNA, 16 nt, Human
agcacaaacacaaggu

SEQ ID NO: 3591598 - RNA, 18 nt, Human
agcacaaacacaagguca

SEQ ID NO: 3591599 - RNA, 15 nt, Human
agcacaaacauuuuu

SEQ ID NO: 3591600 - RNA, 19 nt, Human
agcacaaagacccuggcuu

SEQ ID NO: 3591601 - RNA, 13 nt, Human
agcacaaauuagu

SEQ ID NO: 3591602 - RNA, 19 nt, Human
agcacaaauuaguuauaua

SEQ ID NO: 3591603 - RNA, 14 nt, Human
agcacaacccccag

SEQ ID NO: 3591604 - RNA, 19 nt, Human
agcacaacccccagcuccc

SEQ ID NO: 3591605 - RNA, 18 nt, Human
agcacaaccuucaagcug

SEQ ID NO: 3591606 - RNA, 11 nt, Human
agcacaagaag

SEQ ID NO: 3591607 - RNA, 12 nt, Human
agcacaagaagc

SEQ ID NO: 3591608 - RNA, 13 nt, Human
agcacaagaagcg

SEQ ID NO: 3591609 - RNA, 21 nt, Human
agcacaaguguaaugaauacc

SEQ ID NO: 3591610 - RNA, 18 nt, Human
agcacaaguuauuuaaau

SEQ ID NO: 3591611 - RNA, 19 nt, Human
agcacaauuugcacuaaau

SEQ ID NO: 3591612 - RNA, 20 nt, Human
agcacacacuuuugguuaag

SEQ ID NO: 3591613 - RNA, 22 nt, Human
agcacaccaaucuuacuuugua

SEQ ID NO: 3591614 - RNA, 14 nt, Human
agcacacucauccc

SEQ ID NO: 3591615 - RNA, 23 nt, Human
agcacacuugacaucaacugcau

SEQ ID NO: 3591616 - RNA, 17 nt, Human
agcacagacccugcccu

SEQ ID NO: 3591617 - RNA, 18 nt, Human
agcacagacccugcccug

SEQ ID NO: 3591618 - RNA, 12 nt, Human
agcacagagagu

SEQ ID NO: 3591619 - RNA, 17 nt, Human
agcacagauaaaaagug

SEQ ID NO: 3591620 - RNA, 21 nt, Human
agcacagauaaaaaguggaau

SEQ ID NO: 3591621 - RNA, 17 nt, Human
agcacagauggccagcc

SEQ ID NO: 3591622 - RNA, 15 nt, Human
agcacagauuuuaau

SEQ ID NO: 3591623 - RNA, 16 nt, Human
agcacagauuuuaauu

SEQ ID NO: 3591624 - RNA, 17 nt, Human
agcacagauuuuaauug

SEQ ID NO: 3591625 - RNA, 21 nt, Human
agcacagauuuuaauugucau

SEQ ID NO: 3591626 - RNA, 24 nt, Human
agcacagcaaggaggcuggcuggg

SEQ ID NO: 3591627 - RNA, 21 nt, Human
agcacagcagccccugcacaa

SEQ ID NO: 3591628 - RNA, 15 nt, Human
agcacagcagccugg

SEQ ID NO: 3591629 - RNA, 13 nt, Human
agcacagcccucc

SEQ ID NO: 3591630 - RNA, 15 nt, Human
agcacagcucccugc

SEQ ID NO: 3591631 - RNA, 14 nt, Human
agcacagcucccuu

SEQ ID NO: 3591632 - RNA, 16 nt, Human
agcacagcucccuucu

SEQ ID NO: 3591633 - RNA, 21 nt, Human
agcacagcuucauuuccugug

SEQ ID NO: 3591634 - RNA, 12 nt, Human
agcacaggcagc

SEQ ID NO: 3591635 - RNA, 15 nt, Human
agcacaggcagcugg

SEQ ID NO: 3591636 - RNA, 17 nt, Human
agcacaggcuaauuuuu

SEQ ID NO: 3591637 - RNA, 21 nt, Human
agcacaggcugagugcaggcc

SEQ ID NO: 3591638 - RNA, 23 nt, Human
agcacaggcugagugcaggccca

SEQ ID NO: 3591639 - RNA, 15 nt, Human
agcacaggugggcuu

SEQ ID NO: 3591640 - RNA, 19 nt, Human
agcacagucugaugacaca

SEQ ID NO: 3591641 - RNA, 14 nt, Human
agcacagugccugc

SEQ ID NO: 3591642 - RNA, 17 nt, Human
agcacagugguggcagg

SEQ ID NO: 3591643 - RNA, 18 nt, Human
agcacagugguggcaggg

SEQ ID NO: 3591644 - RNA, 22 nt, Human
agcacaguguuaaaugaaauug

SEQ ID NO: 3591645 - RNA, 17 nt, Human
agcacaguuugaacaaa

SEQ ID NO: 3591646 - RNA, 20 nt, Human
agcacaucucaacaggccuc

SEQ ID NO: 3591647 - RNA, 23 nt, Human
agcacaucugcauuuucacccca

SEQ ID NO: 3591648 - RNA, 14 nt, Human
agcacaugccucuc

SEQ ID NO: 3591649 - RNA, 19 nt, Human
agcacaugccucucucagg

SEQ ID NO: 3591650 - RNA, 21 nt, Human
agcacaugccucucucaggcc

SEQ ID NO: 3591651 - RNA, 22 nt, Human
agcacaugccucucucaggcca

SEQ ID NO: 3591652 - RNA, 23 nt, Human
agcacaugccucucucaggccaa

SEQ ID NO: 3591653 - RNA, 21 nt, Human
agcacaugcuggccagccugg

SEQ ID NO: 3591654 - RNA, 14 nt, Human
agcaccaagcaugu

SEQ ID NO: 3591655 - RNA, 16 nt, Human
agcaccaaucaugaau

SEQ ID NO: 3591656 - RNA, 15 nt, Human
agcaccaccaggucu

SEQ ID NO: 3591657 - RNA, 23 nt, Human
agcaccacccuagucccuucccc

SEQ ID NO: 3591658 - RNA, 18 nt, Human
agcaccacccuccuuccc

SEQ ID NO: 3591659 - RNA, 12 nt, Human
acugcuauuuuu

SEQ ID NO: 3591660 - RNA, 22 nt, Human
acugcucagaacuugcugcugu

SEQ ID NO: 3591661 - RNA, 21 nt, Human
acugcucaggcugcagcugga

SEQ ID NO: 3591662 - RNA, 20 nt, Human
acugcuccccagcccuggcu

SEQ ID NO: 3591663 - RNA, 20 nt, Human
acugcucccuaagccagccu

SEQ ID NO: 3591664 - RNA, 17 nt, Human
acugcuccguggaggag

SEQ ID NO: 3591665 - RNA, 23 nt, Human
acugcuccguggaggagguuggg

SEQ ID NO: 3591666 - RNA, 18 nt, Human
acugcuccugagccccca

SEQ ID NO: 3591667 - RNA, 20 nt, Human
acugcuccugagcccccagc

SEQ ID NO: 3591668 - RNA, 21 nt, Human
acugcucucaccuugguuccu

SEQ ID NO: 3591669 - RNA, 22 nt, Human
acugcucucaccuugguuccug

SEQ ID NO: 3591670 - RNA, 19 nt, Human
acugcugagauacauacag

SEQ ID NO: 3591671 - RNA, 13 nt, Human
acugcugcugccu

SEQ ID NO: 3591672 - RNA, 20 nt, Human
acugcugcuucauguuugcc

SEQ ID NO: 3591673 - RNA, 20 nt, Human
acugcuggacgucuuucuuu

SEQ ID NO: 3591674 - RNA, 22 nt, Human
acugcuggacgucuuucuuuuu

SEQ ID NO: 3591675 - RNA, 12 nt, Human
acugcugggugg

SEQ ID NO: 3591676 - RNA, 16 nt, Human
acugcuggguggccca

SEQ ID NO: 3591677 - RNA, 21 nt, Human
acugcugugcugugcccaagu

SEQ ID NO: 3591678 - RNA, 16 nt, Human
acugcuguggccagga

SEQ ID NO: 3591679 - RNA, 17 nt, Human
acugcuguggccaggag

SEQ ID NO: 3591680 - RNA, 18 nt, Human
acugcuguuauauuucau

SEQ ID NO: 3591681 - RNA, 20 nt, Human
acugcuguuauauuucauca

SEQ ID NO: 3591682 - RNA, 17 nt, Human
acugcuuccagugaggc

SEQ ID NO: 3591683 - RNA, 16 nt, Human
acugcuucccauccua

SEQ ID NO: 3591684 - RNA, 17 nt, Human
acugcuuccuuucuuga

SEQ ID NO: 3591685 - RNA, 23 nt, Human
acugcuugaacuaggcugagcaa

SEQ ID NO: 3591686 - RNA, 18 nt, Human
acugcuugaggaaaacaa

SEQ ID NO: 3591687 - RNA, 16 nt, Human
acugcuugaugaagca

SEQ ID NO: 3591688 - RNA, 20 nt, Human
acugcuugcccuaagcagaa

SEQ ID NO: 3591689 - RNA, 22 nt, Human
acugcuugcccuaagcagaaag

SEQ ID NO: 3591690 - RNA, 18 nt, Human
acugcuuguguuuuuaac

SEQ ID NO: 3591691 - RNA, 13 nt, Human
acugcuuguuucc

SEQ ID NO: 3591692 - RNA, 17 nt, Human
acugcuuucuuucguuu

SEQ ID NO: 3591693 - RNA, 22 nt, Human
acugcuuugggauuuaauuucc

SEQ ID NO: 3591694 - RNA, 18 nt, Human
acugcuuuuaacuucuga

SEQ ID NO: 3591695 - RNA, 17 nt, Human
acugcuuuuggccugga

SEQ ID NO: 3591696 - RNA, 16 nt, Human
acugcuuuuggucugu

SEQ ID NO: 3591697 - RNA, 17 nt, Human
acuggaaaacagaacac

SEQ ID NO: 3591698 - RNA, 16 nt, Human
agcacuacauaaacug

SEQ ID NO: 3591699 - RNA, 21 nt, Human
agcacuacauaaacugacuuu

SEQ ID NO: 3591700 - RNA, 18 nt, Human
agcacuacugggugucau

SEQ ID NO: 3591701 - RNA, 23 nt, Human
agcacuacugggugucauuucau

SEQ ID NO: 3591702 - RNA, 13 nt, Human
agcacuagagaau

SEQ ID NO: 3591703 - RNA, 16 nt, Human
agcacuagagaaugca

SEQ ID NO: 3591704 - RNA, 17 nt, Human
agcacuagagaaugcac

SEQ ID NO: 3591705 - RNA, 20 nt, Human
agcacuagccaaaccucacc

SEQ ID NO: 3591706 - RNA, 15 nt, Human
agcacuaggcaccca

SEQ ID NO: 3591707 - RNA, 17 nt, Human
agcacuaugcuuuccuu

SEQ ID NO: 3591708 - RNA, 14 nt, Human
agcacucacaugcu

SEQ ID NO: 3591709 - RNA, 19 nt, Human
agcacucaggcucuccauu

SEQ ID NO: 3591710 - RNA, 19 nt, Human
agcacucccaagucuacag

SEQ ID NO: 3591711 - RNA, 19 nt, Human
agcacuccucccugaugua

SEQ ID NO: 3591712 - RNA, 19 nt, Human
agcacucgcuagcaguggc

SEQ ID NO: 3591713 - RNA, 23 nt, Human
agcacucugaguuuaccauuugu

SEQ ID NO: 3591714 - RNA, 22 nt, Human
agcacugaaaauaccaucaggc

SEQ ID NO: 3591715 - RNA, 16 nt, Human
agcacugaaccuggga

SEQ ID NO: 3591716 - RNA, 14 nt, Human
agcacugacagauu

SEQ ID NO: 3591717 - RNA, 18 nt, Human
agcacugacagauuucca

SEQ ID NO: 3591718 - RNA, 12 nt, Human
agcacugaccug

SEQ ID NO: 3591719 - RNA, 13 nt, Human
agcacugaccugu

SEQ ID NO: 3591720 - RNA, 22 nt, Human
agcacugaccugucaugccccc

SEQ ID NO: 3591721 - RNA, 17 nt, Human
agcacugacuucuaagu

SEQ ID NO: 3591722 - RNA, 11 nt, Human
agcacugagca

SEQ ID NO: 3591723 - RNA, 11 nt, Human
agcacugagga

SEQ ID NO: 3591724 - RNA, 14 nt, Human
agcacugccaccag

SEQ ID NO: 3591725 - RNA, 15 nt, Human
agcacugccaggagg

SEQ ID NO: 3591726 - RNA, 16 nt, Human
agcacugccaggaggg

SEQ ID NO: 3591727 - RNA, 19 nt, Human
agcacugccugcucccauc

SEQ ID NO: 3591728 - RNA, 16 nt, Human
agcacuggagugcagg

SEQ ID NO: 3591729 - RNA, 22 nt, Human
agcacuggagugcagggaggag

SEQ ID NO: 3591730 - RNA, 18 nt, Human
agcacuggcucucuccag

SEQ ID NO: 3591731 - RNA, 15 nt, Human
agcacugggcucccg

SEQ ID NO: 3591732 - RNA, 21 nt, Human
agcacugggcucccgggcccc

SEQ ID NO: 3591733 - RNA, 19 nt, Human
agcacugucccuugccuca

SEQ ID NO: 3591734 - RNA, 22 nt, Human
agcacugucccuugccucaaug

SEQ ID NO: 3591735 - RNA, 15 nt, Human
agcacugugcuaaua

SEQ ID NO: 3591736 - RNA, 19 nt, Human
agcacugugcucagggcua

SEQ ID NO: 3591737 - RNA, 20 nt, Human
agcacuguugauguaucuga

SEQ ID NO: 3591738 - RNA, 15 nt, Human
agcacuguuuucuag

SEQ ID NO: 3591739 - RNA, 22 nt, Human
agcacuguuuucuaguguauca

SEQ ID NO: 3591740 - RNA, 19 nt, Human
agcacuucaucuggcugcc

SEQ ID NO: 3591741 - RNA, 19 nt, Human
agcacuuccaaaauucuua

SEQ ID NO: 3591742 - RNA, 20 nt, Human
agcacuuccuugccagucuu

SEQ ID NO: 3591743 - RNA, 15 nt, Human
agcacuucuuuuucu

SEQ ID NO: 3591744 - RNA, 16 nt, Human
agcacuuguccagcug

SEQ ID NO: 3591745 - RNA, 21 nt, Human
agcacuuuagaauaugccuug

SEQ ID NO: 3591746 - RNA, 16 nt, Human
agcacuuucauugcca

SEQ ID NO: 3591747 - RNA, 20 nt, Human
agcacuuugaaauaccucau

SEQ ID NO: 3591748 - RNA, 15 nt, Human
agcacuuugcaagga

SEQ ID NO: 3591749 - RNA, 17 nt, Human
agcacuuugggaggccg

SEQ ID NO: 3591750 - RNA, 20 nt, Human
agcacuuugggaggccgagg

SEQ ID NO: 3591751 - RNA, 14 nt, Human
agcacuuuuuaaaa

SEQ ID NO: 3591752 - RNA, 22 nt, Human
agcagaaaacuggcccugcccu

SEQ ID NO: 3591753 - RNA, 18 nt, Human
agcagaaauccaagcacc

SEQ ID NO: 3591754 - RNA, 19 nt, Human
agcagaaaugccuuacccu

SEQ ID NO: 3591755 - RNA, 14 nt, Human
agcagaaauucugu

SEQ ID NO: 3591756 - RNA, 14 nt, Human
agcagaacagugau

SEQ ID NO: 3591757 - RNA, 23 nt, Human
agcagaacugcuauuuuucaucc

SEQ ID NO: 3591758 - RNA, 16 nt, Human
agcagaaggauuuuuu

SEQ ID NO: 3591759 - RNA, 12 nt, Human
agcagaaggggg

SEQ ID NO: 3591760 - RNA, 16 nt, Human
agcagaaggggguggu

SEQ ID NO: 3591761 - RNA, 22 nt, Human
agcagaaggggguggugucucc

SEQ ID NO: 3591762 - RNA, 12 nt, Human
agcagaauaaag

SEQ ID NO: 3591763 - RNA, 19 nt, Human
agcagaauagcaaggugcu

SEQ ID NO: 3591764 - RNA, 14 nt, Human
agcagaauucauuc

SEQ ID NO: 3591765 - RNA, 13 nt, Human
agcagacauuguc

SEQ ID NO: 3591766 - RNA, 17 nt, Human
agcagacauugucagca

SEQ ID NO: 3591767 - RNA, 23 nt, Human
agcagaccauuggggcucccagc

SEQ ID NO: 3591768 - RNA, 18 nt, Human
agcagacugaucaggacc

SEQ ID NO: 3591769 - RNA, 19 nt, Human
agcagacuggugagcagac

SEQ ID NO: 3591770 - RNA, 22 nt, Human
agcagagaaugaaagggcccag

SEQ ID NO: 3591771 - RNA, 21 nt, Human
agcagagaauucucuuaucca

SEQ ID NO: 3591772 - RNA, 19 nt, Human
agcagagaccaucccugaa

SEQ ID NO: 3591773 - RNA, 19 nt, Human
agcagagagcauuauaauc

SEQ ID NO: 3591774 - RNA, 19 nt, Human
agcagagcaagucugcagg

SEQ ID NO: 3591775 - RNA, 15 nt, Human
agcagagcaggggca

SEQ ID NO: 3591776 - RNA, 17 nt, Human
agcagagcugauggaga

SEQ ID NO: 3591777 - RNA, 23 nt, Human
agcagagcugauggagaaggaag

SEQ ID NO: 3591778 - RNA, 16 nt, Human
agcagaggaccagggc

SEQ ID NO: 3591779 - RNA, 12 nt, Human
agcagaggaggg

SEQ ID NO: 3591780 - RNA, 15 nt, Human
agcagaggaggggcc

SEQ ID NO: 3591781 - RNA, 13 nt, Human
agcagaggcagcg

SEQ ID NO: 3591782 - RNA, 19 nt, Human
agcagaggcuggccucaga

SEQ ID NO: 3591783 - RNA, 13 nt, Human
agcagaggucucc

SEQ ID NO: 3591784 - RNA, 16 nt, Human
agcagagugcacagcu

SEQ ID NO: 3591785 - RNA, 12 nt, Human
agcagaguuaaa

SEQ ID NO: 3591786 - RNA, 13 nt, Human
agcagaguuuuca

SEQ ID NO: 3591787 - RNA, 19 nt, Human
agcagaguuuucauuaaau

SEQ ID NO: 3591788 - RNA, 15 nt, Human
agcagauacugcugu

SEQ ID NO: 3591789 - RNA, 18 nt, Human
agcagaucuguuuugugg

SEQ ID NO: 3591790 - RNA, 18 nt, Human
agcagaugcaaagaggca

SEQ ID NO: 3591791 - RNA, 19 nt, Human
agcagaugcaaagaggcaa

SEQ ID NO: 3591792 - RNA, 20 nt, Human
agcagaugcaaagaggcaag

SEQ ID NO: 3591793 - RNA, 21 nt, Human
agcagaugcagagagccauuu

SEQ ID NO: 3591794 - RNA, 13 nt, Human
agcagaugcuggu

SEQ ID NO: 3591795 - RNA, 14 nt, Human
agcagauuauucac

SEQ ID NO: 3591796 - RNA, 15 nt, Human
agcagauuauucacu

SEQ ID NO: 3591797 - RNA, 13 nt, Human
agcagauuggaag

SEQ ID NO: 3591798 - RNA, 18 nt, Human
agcagauuuaacaauucc

SEQ ID NO: 3591799 - RNA, 13 nt, Human
agcagauuuuaau

SEQ ID NO: 3591800 - RNA, 20 nt, Human
agcagcaaauuuucagcauu

SEQ ID NO: 3591801 - RNA, 17 nt, Human
agcagcaacuuguccua

SEQ ID NO: 3591802 - RNA, 15 nt, Human
agcagcaagaaaaaa

SEQ ID NO: 3591803 - RNA, 18 nt, Human
agccaucaccuuagacca

SEQ ID NO: 3591804 - RNA, 13 nt, Human
agccaucauggau

SEQ ID NO: 3591805 - RNA, 14 nt, Human
agccaucccagccu

SEQ ID NO: 3591806 - RNA, 22 nt, Human
agccaucggugaaacuaacaga

SEQ ID NO: 3591807 - RNA, 21 nt, Human
agccaucucaugaggggagag

SEQ ID NO: 3591808 - RNA, 23 nt, Human
agccaucucaugaggggagagga

SEQ ID NO: 3591809 - RNA, 19 nt, Human
agccaucugcccaggggug

SEQ ID NO: 3591810 - RNA, 15 nt, Human
agccaucuugguaaa

SEQ ID NO: 3591811 - RNA, 19 nt, Human
agccaucuugguaaauuuc

SEQ ID NO: 3591812 - RNA, 17 nt, Human
agccaugaccuuacauu

SEQ ID NO: 3591813 - RNA, 19 nt, Human
agccaugaggaguugcugu

SEQ ID NO: 3591814 - RNA, 18 nt, Human
agccaugauaacugcaau

SEQ ID NO: 3591815 - RNA, 14 nt, Human
agccaugccagcug

SEQ ID NO: 3591816 - RNA, 21 nt, Human
agccaugccagcuggccuuug

SEQ ID NO: 3591817 - RNA, 18 nt, Human
agccauggacucuacacu

SEQ ID NO: 3591818 - RNA, 22 nt, Human
agccaugggcacaaagggccca

SEQ ID NO: 3591819 - RNA, 23 nt, Human
agccauguacagacagagaauau

SEQ ID NO: 3591820 - RNA, 17 nt, Human
agccauguauaaaugug

SEQ ID NO: 3591821 - RNA, 15 nt, Human
agccaugucuucucc

SEQ ID NO: 3591822 - RNA, 16 nt, Human
agccaugucuucuccc

SEQ ID NO: 3591823 - RNA, 14 nt, Human
agccauguuuaaga

SEQ ID NO: 3591824 - RNA, 15 nt, Human
agccauguuuaagau

SEQ ID NO: 3591825 - RNA, 22 nt, Human
agccauguuuaagauuuaauuu

SEQ ID NO: 3591826 - RNA, 22 nt, Human
agccauguuuauuacaguauaa

SEQ ID NO: 3591827 - RNA, 14 nt, Human
agccauuaaaugaa

SEQ ID NO: 3591828 - RNA, 18 nt, Human
agccauuaaaugaauauu

SEQ ID NO: 3591829 - RNA, 22 nt, Human
agccauuaaaugaauauuuuga

SEQ ID NO: 3591830 - RNA, 20 nt, Human
agccauuaccauggagacaa

SEQ ID NO: 3591831 - RNA, 22 nt, Human
agccauuccugguacccagcca

SEQ ID NO: 3591832 - RNA, 21 nt, Human
agccauuggcuauuuaaaacu

SEQ ID NO: 3591833 - RNA, 14 nt, Human
agccauuucuuguu

SEQ ID NO: 3591834 - RNA, 19 nt, Human
agccauuugucccaagugc

SEQ ID NO: 3591835 - RNA, 20 nt, Human
agccauuuuggggggccccc

SEQ ID NO: 3591836 - RNA, 15 nt, Human
agccauuuugugaau

SEQ ID NO: 3591837 - RNA, 19 nt, Human
agccauuuugugaauggau

SEQ ID NO: 3591838 - RNA, 18 nt, Human
agccauuuuucaaagcaa

SEQ ID NO: 3591839 - RNA, 17 nt, Human
agcccaaaccaccagaa

SEQ ID NO: 3591840 - RNA, 23 nt, Human
agcccaaaggggacaggccucac

SEQ ID NO: 3591841 - RNA, 16 nt, Human
agcccaaccucuuccu

SEQ ID NO: 3591842 - RNA, 15 nt, Human
agcccaagcuucccu

SEQ ID NO: 3591843 - RNA, 23 nt, Human
agcccaagguuuaaacuucucug

SEQ ID NO: 3591844 - RNA, 21 nt, Human
agcccaaguucaugcagcugu

SEQ ID NO: 3591845 - RNA, 23 nt, Human
agcccaaguucaugcagcugugg

SEQ ID NO: 3591846 - RNA, 16 nt, Human
agcccaauaaaccucu

SEQ ID NO: 3591847 - RNA, 16 nt, Human
agcccaauccagguac

SEQ ID NO: 3591848 - RNA, 22 nt, Human
agcccacagguguccccagccc

SEQ ID NO: 3591849 - RNA, 16 nt, Human
agcccaccccccucau

SEQ ID NO: 3591850 - RNA, 23 nt, Human
agcccaccccucaacaccucugc

SEQ ID NO: 3591851 - RNA, 23 nt, Human
agcccacccuccugucuucccag

SEQ ID NO: 3591852 - RNA, 16 nt, Human
agcccacccugcugcc

SEQ ID NO: 3591853 - RNA, 22 nt, Human
agcccacccugcugcuggugca

SEQ ID NO: 3591854 - RNA, 20 nt, Human
agcccacgacacugcagccc

SEQ ID NO: 3591855 - RNA, 15 nt, Human
agcccacgcccccac

SEQ ID NO: 3591856 - RNA, 20 nt, Human
agcccacgcccccacuggug

SEQ ID NO: 3591857 - RNA, 21 nt, Human
agcccacgcugacuacagggc

SEQ ID NO: 3591858 - RNA, 22 nt, Human
agcccacgcugacuacagggcc

SEQ ID NO: 3591859 - RNA, 20 nt, Human
agcccacggcuaagaggcug

SEQ ID NO: 3591860 - RNA, 22 nt, Human
agcccacggcuaagaggcugcu

SEQ ID NO: 3591861 - RNA, 16 nt, Human
agcccacgucacgugu

SEQ ID NO: 3591862 - RNA, 23 nt, Human
agcccacgucacguguagugucc

SEQ ID NO: 3591863 - RNA, 14 nt, Human
agcccacuggauca

SEQ ID NO: 3591864 - RNA, 14 nt, Human
agcccacuguacuu

SEQ ID NO: 3591865 - RNA, 14 nt, Human
agcccacuucugcc

SEQ ID NO: 3591866 - RNA, 17 nt, Human
agcccagaaaaggacag

SEQ ID NO: 3591867 - RNA, 11 nt, Human
agcccagagaa

SEQ ID NO: 3591868 - RNA, 12 nt, Human
agcccagagaca

SEQ ID NO: 3591869 - RNA, 12 nt, Human
agcccagagacu

SEQ ID NO: 3591870 - RNA, 17 nt, Human
agcccagagccuggcug

SEQ ID NO: 3591871 - RNA, 12 nt, Human
agcccagaggag

SEQ ID NO: 3591872 - RNA, 17 nt, Human
agcccagagggucuggg

SEQ ID NO: 3591873 - RNA, 20 nt, Human
agcccagagggucugggggc

SEQ ID NO: 3591874 - RNA, 13 nt, Human
agcccagagguaa

SEQ ID NO: 3591875 - RNA, 16 nt, Human
agcccagagguaacag

SEQ ID NO: 3591876 - RNA, 17 nt, Human
agcccagagucccccca

SEQ ID NO: 3591877 - RNA, 17 nt, Human
agcccagauuccccugu

SEQ ID NO: 3591878 - RNA, 20 nt, Human
agcccagauuccccuguguc

SEQ ID NO: 3591879 - RNA, 21 nt, Human
agcccagauuccccuguguca

SEQ ID NO: 3591880 - RNA, 21 nt, Human
agcccagauugugccacugcu

SEQ ID NO: 3591881 - RNA, 15 nt, Human
agcccagcacugcuu

SEQ ID NO: 3591882 - RNA, 11 nt, Human
agcccagccag

SEQ ID NO: 3591883 - RNA, 15 nt, Human
agcccagcccagcug

SEQ ID NO: 3591884 - RNA, 16 nt, Human
agcccagcccagcugc

SEQ ID NO: 3591885 - RNA, 14 nt, Human
agcccagcuccagg

SEQ ID NO: 3591886 - RNA, 16 nt, Human
agcccagcuccagggc

SEQ ID NO: 3591887 - RNA, 18 nt, Human
agcccagcuccagggcca

SEQ ID NO: 3591888 - RNA, 18 nt, Human
agcccagcugcucugccc

SEQ ID NO: 3591889 - RNA, 19 nt, Human
agcccagcugcucugccca

SEQ ID NO: 3591890 - RNA, 22 nt, Human
agcccagcugcucugcccagag

SEQ ID NO: 3591891 - RNA, 13 nt, Human
agcccagcugggu

SEQ ID NO: 3591892 - RNA, 20 nt, Human
agcccagcugggucaggcag

SEQ ID NO: 3591893 - RNA, 21 nt, Human
agcccagcugggucaggcagg

SEQ ID NO: 3591894 - RNA, 19 nt, Human
agcauucuuagccuguggc

SEQ ID NO: 3591895 - RNA, 16 nt, Human
agcauucuugucacaa

SEQ ID NO: 3591896 - RNA, 21 nt, Human
agcauucuugucacaauaaau

SEQ ID NO: 3591897 - RNA, 22 nt, Human
agcauucuuuggaguuaaaaug

SEQ ID NO: 3591898 - RNA, 15 nt, Human
agcauugauauuugu

SEQ ID NO: 3591899 - RNA, 19 nt, Human
agcauugauauuugugcau

SEQ ID NO: 3591900 - RNA, 13 nt, Human
agcauugccauuc

SEQ ID NO: 3591901 - RNA, 12 nt, Human
agcauugccugg

SEQ ID NO: 3591902 - RNA, 17 nt, Human
agcauugccuggccuuc

SEQ ID NO: 3591903 - RNA, 15 nt, Human
agcauugcuggacuc

SEQ ID NO: 3591904 - RNA, 16 nt, Human
agcauugcuguuaugu

SEQ ID NO: 3591905 - RNA, 20 nt, Human
agcauugcuguuaugucugu

SEQ ID NO: 3591906 - RNA, 23 nt, Human
agcauugcuguuaugucuguuua

SEQ ID NO: 3591907 - RNA, 13 nt, Human
agcauugcuuucu

SEQ ID NO: 3591908 - RNA, 17 nt, Human
agcauuguaaaagcauu

SEQ ID NO: 3591909 - RNA, 17 nt, Human
agcauuguaaaugugcu

SEQ ID NO: 3591910 - RNA, 22 nt, Human
agcauuguaagcguauggcuuu

SEQ ID NO: 3591911 - RNA, 20 nt, Human
agcauuguagugcuuugaga

SEQ ID NO: 3591912 - RNA, 22 nt, Human
agcauugucuauuuuucucuuc

SEQ ID NO: 3591913 - RNA, 17 nt, Human
agcauuguuugcuuauu

SEQ ID NO: 3591914 - RNA, 22 nt, Human
agcauuguuugcuuauuguucc

SEQ ID NO: 3591915 - RNA, 23 nt, Human
agcauuuaaccccccuguacaca

SEQ ID NO: 3591916 - RNA, 14 nt, Human
agcauuuccaacac

SEQ ID NO: 3591917 - RNA, 18 nt, Human
agcauuuccaacaccaca

SEQ ID NO: 3591918 - RNA, 20 nt, Human
agcauuucgcgauggacaga

SEQ ID NO: 3591919 - RNA, 14 nt, Human
agcauuucucauca

SEQ ID NO: 3591920 - RNA, 13 nt, Human
agcauuucugaag

SEQ ID NO: 3591921 - RNA, 21 nt, Human
agcauuugacccuugcuguga

SEQ ID NO: 3591922 - RNA, 17 nt, Human
agcauuugacuuucugu

SEQ ID NO: 3591923 - RNA, 14 nt, Human
agcauuugauaaug

SEQ ID NO: 3591924 - RNA, 15 nt, Human
agcauuugauaauga

SEQ ID NO: 3591925 - RNA, 19 nt, Human
agcauuugauaaugauaaa

SEQ ID NO: 3591926 - RNA, 12 nt, Human
agcauuugauau

SEQ ID NO: 3591927 - RNA, 15 nt, Human
agcauuugaucuguu

SEQ ID NO: 3591928 - RNA, 13 nt, Human
agcauuuggugcu

SEQ ID NO: 3591929 - RNA, 16 nt, Human
agcauuugucaacaaa

SEQ ID NO: 3591930 - RNA, 16 nt, Human
agcauuuguguguuac

SEQ ID NO: 3591931 - RNA, 17 nt, Human
agcauuuguuucuacuu

SEQ ID NO: 3591932 - RNA, 20 nt, Human
agcauuuuauaaaucgcuuu

SEQ ID NO: 3591933 - RNA, 13 nt, Human
agcauuuuucaau

SEQ ID NO: 3591934 - RNA, 16 nt, Human
agcauuuuucaauaua

SEQ ID NO: 3591935 - RNA, 18 nt, Human
agccaaaaauagcuaaau

SEQ ID NO: 3591936 - RNA, 15 nt, Human
agccaaaacugagca

SEQ ID NO: 3591937 - RNA, 15 nt, Human
agccaaaauuaaggu

SEQ ID NO: 3591938 - RNA, 17 nt, Human
agccaaaauuaaggugu

SEQ ID NO: 3591939 - RNA, 22 nt, Human
agccaaacacacagaaggggac

SEQ ID NO: 3591940 - RNA, 19 nt, Human
agccaaacccaugaggcaa

SEQ ID NO: 3591941 - RNA, 14 nt, Human
agccaaacccuguc

SEQ ID NO: 3591942 - RNA, 11 nt, Human
agccaaagagu

SEQ ID NO: 3591943 - RNA, 20 nt, Human
agccaaauguaauugaauaa

SEQ ID NO: 3591944 - RNA, 16 nt, Human
agccaaauuuaucaaa

SEQ ID NO: 3591945 - RNA, 23 nt, Human
agccaacacccugucuaaaaaac

SEQ ID NO: 3591946 - RNA, 19 nt, Human
agccaacacgcaccugccu

SEQ ID NO: 3591947 - RNA, 18 nt, Human
agccaacagaagcuucca

SEQ ID NO: 3591948 - RNA, 15 nt, Human
agccaacagguggca

SEQ ID NO: 3591949 - RNA, 21 nt, Human
agccaacagguggcaggacca

SEQ ID NO: 3591950 - RNA, 16 nt, Human
agccaacuagccccug

SEQ ID NO: 3591951 - RNA, 12 nt, Human
agccaacuccau

SEQ ID NO: 3591952 - RNA, 13 nt, Human
agccaacugcugc

SEQ ID NO: 3591953 - RNA, 20 nt, Human
agccaacuuggcuuucccgg

SEQ ID NO: 3591954 - RNA, 15 nt, Human
agccaacuuuugcau

SEQ ID NO: 3591955 - RNA, 19 nt, Human
agccaagauugcgccauug

SEQ ID NO: 3591956 - RNA, 22 nt, Human
agccaagauuuuccucuuguga

SEQ ID NO: 3591957 - RNA, 14 nt, Human
agccaagcacagug

SEQ ID NO: 3591958 - RNA, 16 nt, Human
agccaagcacaguggu

SEQ ID NO: 3591959 - RNA, 17 nt, Human
agccaagcacaguggug

SEQ ID NO: 3591960 - RNA, 21 nt, Human
agccaagcuagaauucccucu

SEQ ID NO: 3591961 - RNA, 15 nt, Human
agccaagcucugcag

SEQ ID NO: 3591962 - RNA, 16 nt, Human
agccaagcucugcagu

SEQ ID NO: 3591963 - RNA, 17 nt, Human
agccaagcuuguuauca

SEQ ID NO: 3591964 - RNA, 15 nt, Human
agccaagcuuuaaau

SEQ ID NO: 3591965 - RNA, 19 nt, Human
agccaaggagucacugaga

SEQ ID NO: 3591966 - RNA, 22 nt, Human
agccaaggauagaagcugcagu

SEQ ID NO: 3591967 - RNA, 17 nt, Human
agccaaggccaaaggaa

SEQ ID NO: 3591968 - RNA, 21 nt, Human
agccaaggcucuguuuaugcu

SEQ ID NO: 3591969 - RNA, 20 nt, Human
agccaagggaaccugugucc

SEQ ID NO: 3591970 - RNA, 20 nt, Human
agccaagggauggacaucuu

SEQ ID NO: 3591971 - RNA, 23 nt, Human
agccaagggcaacagaucaguaa

SEQ ID NO: 3591972 - RNA, 18 nt, Human
agccaaggguucagagac

SEQ ID NO: 3591973 - RNA, 22 nt, Human
agccaaggguucagagacucag

SEQ ID NO: 3591974 - RNA, 20 nt, Human
agccaaggugggcugagccc

SEQ ID NO: 3591975 - RNA, 20 nt, Human
agccaaguagccucuccugu

SEQ ID NO: 3591976 - RNA, 21 nt, Human
agccaagucagcuuugccuuc

SEQ ID NO: 3591977 - RNA, 23 nt, Human
agccaagucagcuuugccuucca

SEQ ID NO: 3591978 - RNA, 15 nt, Human
agccaaguccagauu

SEQ ID NO: 3591979 - RNA, 13 nt, Human
agccaagugcagg

SEQ ID NO: 3591980 - RNA, 18 nt, Human
agccaagugccaaaugcu

SEQ ID NO: 3591981 - RNA, 19 nt, Human
agccaagugccaaaugcuc

SEQ ID NO: 3591982 - RNA, 15 nt, Human
agccaauccccuccu

SEQ ID NO: 3591983 - RNA, 18 nt, Human
agccaauccccuccuugg

SEQ ID NO: 3591984 - RNA, 20 nt, Human
agccaauccccuccuugggc

SEQ ID NO: 3591985 - RNA, 13 nt, Human
agccaaugcuguc

SEQ ID NO: 3591986 - RNA, 13 nt, Human
agccaaugcuuac

SEQ ID NO: 3591987 - RNA, 20 nt, Human
agccaaugucuccuccccuu

SEQ ID NO: 3591988 - RNA, 14 nt, Human
agccaauguuuucc

SEQ ID NO: 3591989 - RNA, 16 nt, Human
agccaauucagacagg

SEQ ID NO: 3591990 - RNA, 17 nt, Human
agccaauucagacaggc

SEQ ID NO: 3591991 - RNA, 20 nt, Human
agccaauuuuucugcacuga

SEQ ID NO: 3591992 - RNA, 23 nt, Human
agccaauuuuucugcacugagca

SEQ ID NO: 3591993 - RNA, 15 nt, Human
agccacaagucuucc

SEQ ID NO: 3591994 - RNA, 13 nt, Human
agccacacacaca

SEQ ID NO: 3591995 - RNA, 17 nt, Human
agccacaccaggauaga

SEQ ID NO: 3591996 - RNA, 24 nt, Human
agccacaccaggauagagacugga

SEQ ID NO: 3591997 - RNA, 18 nt, Human
agccacacuucucaggac

SEQ ID NO: 3591998 - RNA, 10 nt, Human
agccacagaa

SEQ ID NO: 3591999 - RNA, 23 nt, Human
agccacagaagccaggagcaaau

SEQ ID NO: 3592000 - RNA, 20 nt, Human
agccacagcagcauuuuuau

SEQ ID NO: 3592001 - RNA, 16 nt, Human
agccacagcccaggcc

SEQ ID NO: 3592002 - RNA, 14 nt, Human
agccacaggccuga

SEQ ID NO: 3592003 - RNA, 22 nt, Human
agccacaggccugagauuucau

SEQ ID NO: 3592004 - RNA, 13 nt, Human
agccacaguggga

SEQ ID NO: 3592005 - RNA, 22 nt, Human
agccacaguuuccucaucuguc

SEQ ID NO: 3592006 - RNA, 14 nt, Human
agccacauuauuuc

SEQ ID NO: 3592007 - RNA, 22 nt, Human
agccacauuuggaauacuuuuu

SEQ ID NO: 3592008 - RNA, 20 nt, Human
agccaccaacauacucccau

SEQ ID NO: 3592009 - RNA, 23 nt, Human
agccaccaacauacucccaucug

SEQ ID NO: 3592010 - RNA, 17 nt, Human
agccaccacaccuggcu

SEQ ID NO: 3592011 - RNA, 15 nt, Human
agccacccaaagcag

SEQ ID NO: 3592012 - RNA, 13 nt, Human
agccaccccugag

SEQ ID NO: 3592013 - RNA, 18 nt, Human
agccacccugaggagucu

SEQ ID NO: 3592014 - RNA, 20 nt, Human
agccacccugaggagucuga

SEQ ID NO: 3592015 - RNA, 22 nt, Human
agccacccugaggagucugagg

SEQ ID NO: 3592016 - RNA, 14 nt, Human
agccacccugaguu

SEQ ID NO: 3592017 - RNA, 20 nt, Human
agccaccgaagccgccugug

SEQ ID NO: 3592018 - RNA, 22 nt, Human
agccaccgaagccgccugugga

SEQ ID NO: 3592019 - RNA, 18 nt, Human
agccaccgugccuggcca

SEQ ID NO: 3592020 - RNA, 14 nt, Human
agccaccugaguuc

SEQ ID NO: 3592021 - RNA, 18 nt, Human
agccaccugucccaccuc

SEQ ID NO: 3592022 - RNA, 23 nt, Human
agccaccuuuugggaauguuuua

SEQ ID NO: 3592023 - RNA, 19 nt, Human
agccacggggacucagccc

SEQ ID NO: 3592024 - RNA, 15 nt, Human
agccacgguguucug

SEQ ID NO: 3592025 - RNA, 21 nt, Human
agccacguuccuuacugcaga

SEQ ID NO: 3592026 - RNA, 19 nt, Human
agccacuaaccuugccugg

SEQ ID NO: 3592027 - RNA, 20 nt, Human
agccacuaaccuugccuggu

SEQ ID NO: 3592028 - RNA, 22 nt, Human
agccacuaagaaccccucugcu

SEQ ID NO: 3592029 - RNA, 11 nt, Human
agccacucccc

SEQ ID NO: 3592030 - RNA, 13 nt, Human
agccacuccccag

SEQ ID NO: 3592031 - RNA, 14 nt, Human
agccacuccccagc

SEQ ID NO: 3592032 - RNA, 22 nt, Human
agccacuccccagccagccugg

SEQ ID NO: 3592033 - RNA, 16 nt, Human
agccacucucuucccu

SEQ ID NO: 3592034 - RNA, 12 nt, Human
agccacugaagc

SEQ ID NO: 3592035 - RNA, 18 nt, Human
agccacugcaccgggcca

SEQ ID NO: 3592036 - RNA, 20 nt, Human
agccacugcaccgggccaca

SEQ ID NO: 3592037 - RNA, 15 nt, Human
agccacugccucucc

SEQ ID NO: 3592038 - RNA, 13 nt, Human
agccacuuaccuu

SEQ ID NO: 3592039 - RNA, 16 nt, Human
agccacuuaccuucaa

SEQ ID NO: 3592040 - RNA, 18 nt, Human
agccacuuaccuucaaua

SEQ ID NO: 3592041 - RNA, 21 nt, Human
agccacuuaccuucaauaaag

SEQ ID NO: 3592042 - RNA, 23 nt, Human
agccacuuaccuucaauaaagua

SEQ ID NO: 3592043 - RNA, 21 nt, Human
agcccagcuuuuccugggaca

SEQ ID NO: 3592044 - RNA, 14 nt, Human
agcccaggaaaggc

SEQ ID NO: 3592045 - RNA, 18 nt, Human
agcccaggaaaggcucca

SEQ ID NO: 3592046 - RNA, 19 nt, Human
agcccaggaaaggcuccag

SEQ ID NO: 3592047 - RNA, 21 nt, Human
agcccaggaaaggcuccagga

SEQ ID NO: 3592048 - RNA, 23 nt, Human
agcccaggaaaggcuccaggagc

SEQ ID NO: 3592049 - RNA, 14 nt, Human
agcccaggagagag

SEQ ID NO: 3592050 - RNA, 15 nt, Human
agcccaggagagaga

SEQ ID NO: 3592051 - RNA, 17 nt, Human
agcccaggagagagaaa

SEQ ID NO: 3592052 - RNA, 19 nt, Human
agcccaggagagagaaagc

SEQ ID NO: 3592053 - RNA, 14 nt, Human
agcccaggagccca

SEQ ID NO: 3592054 - RNA, 16 nt, Human
agcccaggagcccauu

SEQ ID NO: 3592055 - RNA, 23 nt, Human
agcccaggagcuccccuccccaa

SEQ ID NO: 3592056 - RNA, 17 nt, Human
agcccaggaggacugcc

SEQ ID NO: 3592057 - RNA, 12 nt, Human
agcccaggaggg

SEQ ID NO: 3592058 - RNA, 19 nt, Human
agcccaggagggagcagag

SEQ ID NO: 3592059 - RNA, 23 nt, Human
agcccaggagggcauccauacca

SEQ ID NO: 3592060 - RNA, 20 nt, Human
agcccaggagucccacucca

SEQ ID NO: 3592061 - RNA, 23 nt, Human
agcccaggauacuggcacagagg

SEQ ID NO: 3592062 - RNA, 14 nt, Human
agcccaggccagga

SEQ ID NO: 3592063 - RNA, 16 nt, Human
agcccaggccaggacu

SEQ ID NO: 3592064 - RNA, 20 nt, Human
agcccaggcucggccugccc

SEQ ID NO: 3592065 - RNA, 18 nt, Human
agcccagggagcggaaag

SEQ ID NO: 3592066 - RNA, 22 nt, Human
agcccagggagcggaaagcagc

SEQ ID NO: 3592067 - RNA, 15 nt, Human
agcccagggcuccug

SEQ ID NO: 3592068 - RNA, 17 nt, Human
agcccagggcuccugca

SEQ ID NO: 3592069 - RNA, 10 nt, Human
agcccagggu

SEQ ID NO: 3592070 - RNA, 18 nt, Human
agcccaggguucccccag

SEQ ID NO: 3592071 - RNA, 22 nt, Human
agcccaggguucccccagcccu

SEQ ID NO: 3592072 - RNA, 15 nt, Human
agcccaguagaccuu

SEQ ID NO: 3592073 - RNA, 16 nt, Human
agcccauacucagccu

SEQ ID NO: 3592074 - RNA, 17 nt, Human
agcccauacucagccug

SEQ ID NO: 3592075 - RNA, 16 nt, Human
agcccauccauaguaa

SEQ ID NO: 3592076 - RNA, 19 nt, Human
agcccaucgccacaaacuc

SEQ ID NO: 3592077 - RNA, 17 nt, Human
agcccaugaguccuuga

SEQ ID NO: 3592078 - RNA, 11 nt, Human
agcccaugccc

SEQ ID NO: 3592079 - RNA, 22 nt, Human
agcccaugcccaccugcccauc

SEQ ID NO: 3592080 - RNA, 19 nt, Human
agcccauggagauugaccu

SEQ ID NO: 3592081 - RNA, 21 nt, Human
agcccauguggagucagccuc

SEQ ID NO: 3592082 - RNA, 21 nt, Human
agcccauguucugcccccagc

SEQ ID NO: 3592083 - RNA, 22 nt, Human
agcccauucauuccauucugga

SEQ ID NO: 3592084 - RNA, 16 nt, Human
agcccauuguggccua

SEQ ID NO: 3592085 - RNA, 22 nt, Human
agcccauuguggccuaagaggc

SEQ ID NO: 3592086 - RNA, 19 nt, Human
agcccauuucuccagaacc

SEQ ID NO: 3592087 - RNA, 20 nt, Human
agcccauuuggagggccugg

SEQ ID NO: 3592088 - RNA, 21 nt, Human
agcccauuuggagggccuggg

SEQ ID NO: 3592089 - RNA, 23 nt, Human
agcccauuugggcagagaggcug

SEQ ID NO: 3592090 - RNA, 17 nt, Human
accaacccuguuuccug

SEQ ID NO: 3592091 - RNA, 16 nt, Human
accaacccuucccuga

SEQ ID NO: 3592092 - RNA, 21 nt, Human
accaacgcgaaaccaauuccu

SEQ ID NO: 3592093 - RNA, 23 nt, Human
accaacugaaggcuaaaaagcaa

SEQ ID NO: 3592094 - RNA, 17 nt, Human
accaacuggaagcacag

SEQ ID NO: 3592095 - RNA, 20 nt, Human
accaacuggcccucuucuua

SEQ ID NO: 3592096 - RNA, 20 nt, Human
accaacugugaugucacuga

SEQ ID NO: 3592097 - RNA, 13 nt, Human
accaacuguguug

SEQ ID NO: 3592098 - RNA, 12 nt, Human
accaacuuacaa

SEQ ID NO: 3592099 - RNA, 22 nt, Human
accaacuugguucugcuucaau

SEQ ID NO: 3592100 - RNA, 14 nt, Human
accaacuuucugua

SEQ ID NO: 3592101 - RNA, 15 nt, Human
accaagaaagcucac

SEQ ID NO: 3592102 - RNA, 11 nt, Human
accaagaagau

SEQ ID NO: 3592103 - RNA, 17 nt, Human
accaagaauugauuggg

SEQ ID NO: 3592104 - RNA, 16 nt, Human
accaagacucugaaau

SEQ ID NO: 3592105 - RNA, 20 nt, Human
accaagagagaaagaaguag

SEQ ID NO: 3592106 - RNA, 22 nt, Human
accaagagauugcuaauugcug

SEQ ID NO: 3592107 - RNA, 16 nt, Human
accaagaggcugguuu

SEQ ID NO: 3592108 - RNA, 21 nt, Human
accaagauacuuaagugcugc

SEQ ID NO: 3592109 - RNA, 19 nt, Human
accaagauggcccauccug

SEQ ID NO: 3592110 - RNA, 19 nt, Human
accaagauuggccugaggc

SEQ ID NO: 3592111 - RNA, 14 nt, Human
accaagcacagcag

SEQ ID NO: 3592112 - RNA, 16 nt, Human
accaagcacagcagcc

SEQ ID NO: 3592113 - RNA, 13 nt, Human
accaagcaggaag

SEQ ID NO: 3592114 - RNA, 17 nt, Human
accaagcaggaagcuca

SEQ ID NO: 3592115 - RNA, 14 nt, Human
accaagccguggcu

SEQ ID NO: 3592116 - RNA, 16 nt, Human
accaagccguggcuuc

SEQ ID NO: 3592117 - RNA, 17 nt, Human
accaagccguggcuucc

SEQ ID NO: 3592118 - RNA, 18 nt, Human
accaagccuggucagccc

SEQ ID NO: 3592119 - RNA, 15 nt, Human
accaagcuauccugg

SEQ ID NO: 3592120 - RNA, 14 nt, Human
accaagcuauuccu

SEQ ID NO: 3592121 - RNA, 21 nt, Human
accaagcuauuccuuucccuu

SEQ ID NO: 3592122 - RNA, 18 nt, Human
accaagcugaguuuccua

SEQ ID NO: 3592123 - RNA, 14 nt, Human
accaagcugcugug

SEQ ID NO: 3592124 - RNA, 14 nt, Human
accaagcugugcca

SEQ ID NO: 3592125 - RNA, 18 nt, Human
accaagcugugccacccu

SEQ ID NO: 3592126 - RNA, 19 nt, Human
accaagcugugccacccug

SEQ ID NO: 3592127 - RNA, 23 nt, Human
accaagcugugccacccugggcu

SEQ ID NO: 3592128 - RNA, 11 nt, Human
accaaggaaac

SEQ ID NO: 3592129 - RNA, 16 nt, Human
accaaggaccccucac

SEQ ID NO: 3592130 - RNA, 18 nt, Human
accaaggaccccucaccu

SEQ ID NO: 3592131 - RNA, 17 nt, Human
accaaggcaaggcaggu

SEQ ID NO: 3592132 - RNA, 23 nt, Human
accaaggcugagacagugaauuu

SEQ ID NO: 3592133 - RNA, 19 nt, Human
accaaggcugauuaaacca

SEQ ID NO: 3592134 - RNA, 23 nt, Human
accaaguuauaaaucaaugucac

SEQ ID NO: 3592135 - RNA, 22 nt, Human
accaaguuauauaaagagaaaa

SEQ ID NO: 3592136 - RNA, 17 nt, Human
accaauaaaauaauuuu

SEQ ID NO: 3592137 - RNA, 14 nt, Human
accaauagauuccc

SEQ ID NO: 3592138 - RNA, 20 nt, Human
accaauauuauacuaagaaa

SEQ ID NO: 3592139 - RNA, 15 nt, Human
accaauauuguacag

SEQ ID NO: 3592140 - RNA, 16 nt, Human
accaauauuguacagu

SEQ ID NO: 3592141 - RNA, 17 nt, Human
accaauauuguacaguu

SEQ ID NO: 3592142 - RNA, 13 nt, Human
accaauauuugua

SEQ ID NO: 3592143 - RNA, 19 nt, Human
accaaucaagauaaaggac

SEQ ID NO: 3592144 - RNA, 18 nt, Human
accaaucuuacuuuguaa

SEQ ID NO: 3592145 - RNA, 23 nt, Human
accaaucuuacuuuguaaauucu

SEQ ID NO: 3592146 - RNA, 14 nt, Human
accaaugaaaaaau

SEQ ID NO: 3592147 - RNA, 16 nt, Human
accaaugccaagauaa

SEQ ID NO: 3592148 - RNA, 18 nt, Human
accaaugcuuuuaucaaa

SEQ ID NO: 3592149 - RNA, 16 nt, Human
accaauuauuuucauc

SEQ ID NO: 3592150 - RNA, 13 nt, Human
accaauugugcug

SEQ ID NO: 3592151 - RNA, 20 nt, Human
accaauuguguccugaaaau

SEQ ID NO: 3592152 - RNA, 15 nt, Human
accaauuuuaacuua

SEQ ID NO: 3592153 - RNA, 14 nt, Human
accacaaaaauuga

SEQ ID NO: 3592154 - RNA, 14 nt, Human
accacaaacuguaa

SEQ ID NO: 3592155 - RNA, 18 nt, Human
accacaaauagugcucgc

SEQ ID NO: 3592156 - RNA, 21 nt, Human
accacaacaugaggccacugg

SEQ ID NO: 3592157 - RNA, 16 nt, Human
accacaacugacacag

SEQ ID NO: 3592158 - RNA, 14 nt, Human
accacacaaagaca

SEQ ID NO: 3592159 - RNA, 23 nt, Human
accacacaacauccaaguggccu

SEQ ID NO: 3592160 - RNA, 13 nt, Human
accacacacaaca

SEQ ID NO: 3592161 - RNA, 15 nt, Human
accacacaucccagc

SEQ ID NO: 3592162 - RNA, 13 nt, Human
accacacccagcc

SEQ ID NO: 3592163 - RNA, 15 nt, Human
accacacccagccca

SEQ ID NO: 3592164 - RNA, 23 nt, Human
accacacccagcccacuucugcc

SEQ ID NO: 3592165 - RNA, 17 nt, Human
accacacccagccucag

SEQ ID NO: 3592166 - RNA, 16 nt, Human
accacaccucccugaa

SEQ ID NO: 3592167 - RNA, 14 nt, Human
accacacuccagcu

SEQ ID NO: 3592168 - RNA, 13 nt, Human
acuuuaucacauu

SEQ ID NO: 3592169 - RNA, 14 nt, Human
acuuuaucacauua

SEQ ID NO: 3592170 - RNA, 21 nt, Human
acuuuaucacauuauuugcau

SEQ ID NO: 3592171 - RNA, 20 nt, Human
acuuuaucacuuuuugaacu

SEQ ID NO: 3592172 - RNA, 16 nt, Human
acuuuaucaugaaugc

SEQ ID NO: 3592173 - RNA, 19 nt, Human
acuuuaugcagcuuccuuu

SEQ ID NO: 3592174 - RNA, 20 nt, Human
acuuuaugccggaugugcuu

SEQ ID NO: 3592175 - RNA, 21 nt, Human
acuuuaugccggaugugcuuu

SEQ ID NO: 3592176 - RNA, 16 nt, Human
acuuuaugcuaaguga

SEQ ID NO: 3592177 - RNA, 13 nt, Human
acuuuauguguaa

SEQ ID NO: 3592178 - RNA, 16 nt, Human
acuuuauguguaaaua

SEQ ID NO: 3592179 - RNA, 21 nt, Human
acuuuauguguaaauacauaa

SEQ ID NO: 3592180 - RNA, 16 nt, Human
acuuuauuagcagcug

SEQ ID NO: 3592181 - RNA, 12 nt, Human
acuuuauuuacu

SEQ ID NO: 3592182 - RNA, 20 nt, Human
acuuuauuuauacacugucu

SEQ ID NO: 3592183 - RNA, 21 nt, Human
acuuuauuuccaaguuguuca

SEQ ID NO: 3592184 - RNA, 16 nt, Human
acuuuauuucucucau

SEQ ID NO: 3592185 - RNA, 15 nt, Human
acuuuauuuuguguu

SEQ ID NO: 3592186 - RNA, 21 nt, Human
acuuucaaaucgguccccugu

SEQ ID NO: 3592187 - RNA, 16 nt, Human
acuuucaagaacuugu

SEQ ID NO: 3592188 - RNA, 11 nt, Human
acuuucaaucu

SEQ ID NO: 3592189 - RNA, 17 nt, Human
acuuucacauagauguc

SEQ ID NO: 3592190 - RNA, 11 nt, Human
acuuucagcug

SEQ ID NO: 3592191 - RNA, 18 nt, Human
acuuucagguacuaaaua

SEQ ID NO: 3592192 - RNA, 17 nt, Human
acuuucauuuuuuucca

SEQ ID NO: 3592193 - RNA, 16 nt, Human
acuuuccacccccucc

SEQ ID NO: 3592194 - RNA, 22 nt, Human
acuuuccacuucuuccuuucuc

SEQ ID NO: 3592195 - RNA, 15 nt, Human
acuuuccauuacaag

SEQ ID NO: 3592196 - RNA, 16 nt, Human
acuuucccagguucug

SEQ ID NO: 3592197 - RNA, 13 nt, Human
acuuucccuaccc

SEQ ID NO: 3592198 - RNA, 21 nt, Human
acuuucccuacccucuagaga

SEQ ID NO: 3592199 - RNA, 23 nt, Human
acuuucccuugcuuuucccucuu

SEQ ID NO: 3592200 - RNA, 21 nt, Human
acuuuccgaaaaauaaagaca

SEQ ID NO: 3592201 - RNA, 19 nt, Human
acuuuccuccugaggcuuu

SEQ ID NO: 3592202 - RNA, 14 nt, Human
acuuuccugcaacu

SEQ ID NO: 3592203 - RNA, 17 nt, Human
acuuuccuggaugucug

SEQ ID NO: 3592204 - RNA, 19 nt, Human
acuuuccuuuccccagccc

SEQ ID NO: 3592205 - RNA, 22 nt, Human
acuuuccuuuccccagcccagg

SEQ ID NO: 3592206 - RNA, 17 nt, Human
acuuucuacucauuuua

SEQ ID NO: 3592207 - RNA, 19 nt, Human
acuuucuacucauuuuaau

SEQ ID NO: 3592208 - RNA, 16 nt, Human
acuuucuagccagagg

SEQ ID NO: 3592209 - RNA, 17 nt, Human
acuuucuagccagagga

SEQ ID NO: 3592210 - RNA, 14 nt, Human
acuuucucaguuuu

SEQ ID NO: 3592211 - RNA, 19 nt, Human
acuuucucuaauaauaaau

SEQ ID NO: 3592212 - RNA, 14 nt, Human
acuuucugccugga

SEQ ID NO: 3592213 - RNA, 12 nt, Human
acuuucuguuaa

SEQ ID NO: 3592214 - RNA, 13 nt, Human
acuuucuguuaaa

SEQ ID NO: 3592215 - RNA, 16 nt, Human
acuuucuguuaaaaug

SEQ ID NO: 3592216 - RNA, 14 nt, Human
acuuucuguuaugg

SEQ ID NO: 3592217 - RNA, 22 nt, Human
acuuucuguuggauuccaugcu

SEQ ID NO: 3592218 - RNA, 14 nt, Human
acuuucuucaggua

SEQ ID NO: 3592219 - RNA, 18 nt, Human
acuuucuucugaauauuu

SEQ ID NO: 3592220 - RNA, 16 nt, Human
acuuucuuuagucuuu

SEQ ID NO: 3592221 - RNA, 22 nt, Human
acuuucuuucucacuaaaucuu

SEQ ID NO: 3592222 - RNA, 20 nt, Human
acuuugaaaggagaugucuu

SEQ ID NO: 3592223 - RNA, 21 nt, Human
acuuugaaauaccucauguuu

SEQ ID NO: 3592224 - RNA, 22 nt, Human
acuuugaaauaccucauguuua

SEQ ID NO: 3592225 - RNA, 15 nt, Human
acuuugaauaaagaa

SEQ ID NO: 3592226 - RNA, 19 nt, Human
acuuugaauaaagaauacu

SEQ ID NO: 3592227 - RNA, 20 nt, Human
acuuugaauaaagaauacuu

SEQ ID NO: 3592228 - RNA, 23 nt, Human
acuuugaauuuuagcacauugca

SEQ ID NO: 3592229 - RNA, 21 nt, Human
acuuugacagcgcacagcugc

SEQ ID NO: 3592230 - RNA, 18 nt, Human
acuuugacaguguuuuua

SEQ ID NO: 3592231 - RNA, 16 nt, Human
acuuugaccucugcag

SEQ ID NO: 3592232 - RNA, 18 nt, Human
acuuugaccucugcagca

SEQ ID NO: 3592233 - RNA, 19 nt, Human
acuuugaccucugcagcaa

SEQ ID NO: 3592234 - RNA, 23 nt, Human
acuuugaccucugcagcaauaaa

SEQ ID NO: 3592235 - RNA, 22 nt, Human
acuuugacgagucaccuuccag

SEQ ID NO: 3592236 - RNA, 21 nt, Human
acuuugacuuuuugcauuuaa

SEQ ID NO: 3592237 - RNA, 16 nt, Human
acuuugaggugucuca

SEQ ID NO: 3592238 - RNA, 11 nt, Human
acuuugauguc

SEQ ID NO: 3592239 - RNA, 12 nt, Human
acuuugauguca

SEQ ID NO: 3592240 - RNA, 17 nt, Human
acuuugaugucagcagu

SEQ ID NO: 3592241 - RNA, 15 nt, Human
acuuugaugucaugu

SEQ ID NO: 3592242 - RNA, 21 nt, Human
acuuugaugucauguguuccc

SEQ ID NO: 3592243 - RNA, 17 nt, Human
acuuugauucacauguu

SEQ ID NO: 3592244 - RNA, 19 nt, Human
acuuugcacugauauauca

SEQ ID NO: 3592245 - RNA, 23 nt, Human
acuuugcagccggcacagggucu

SEQ ID NO: 3592246 - RNA, 19 nt, Human
acuuugccagcuuuuccuc

SEQ ID NO: 3592247 - RNA, 16 nt, Human
acuuugccuccugugu

SEQ ID NO: 3592248 - RNA, 17 nt, Human
acuuugcuaaagacaug

SEQ ID NO: 3592249 - RNA, 14 nt, Human
acuuugcucugggu

SEQ ID NO: 3592250 - RNA, 15 nt, Human
acuuugcucuuucuu

SEQ ID NO: 3592251 - RNA, 17 nt, Human
acuuugcucuuucuuga

SEQ ID NO: 3592252 - RNA, 19 nt, Human
acuuugcuguuccuuacuu

SEQ ID NO: 3592253 - RNA, 14 nt, Human
acuuugcuucccau

SEQ ID NO: 3592254 - RNA, 11 nt, Human
acuuugcuugc

SEQ ID NO: 3592255 - RNA, 20 nt, Human
acuuugcuugcuuugaagua

SEQ ID NO: 3592256 - RNA, 17 nt, Human
acuuugcuuuaauauaa

SEQ ID NO: 3592257 - RNA, 21 nt, Human
acuuugcuuuaauauaaaugc

SEQ ID NO: 3592258 - RNA, 18 nt, Human
acuuuggaaaaugcauug

SEQ ID NO: 3592259 - RNA, 14 nt, Human
acuuuggaaagacu

SEQ ID NO: 3592260 - RNA, 17 nt, Human
acuuuggaaagacuuuu

SEQ ID NO: 3592261 - RNA, 13 nt, Human
acuuuggaaagag

SEQ ID NO: 3592262 - RNA, 22 nt, Human
acuuuggaaccagacucuugcc

SEQ ID NO: 3592263 - RNA, 18 nt, Human
acuuuggaguccccucac

SEQ ID NO: 3592264 - RNA, 23 nt, Human
acuuuggaguccccucaccuccu

SEQ ID NO: 3592265 - RNA, 17 nt, Human
acuuuggauaauaagga

SEQ ID NO: 3592266 - RNA, 19 nt, Human
acuuuggcuuauaauucuu

SEQ ID NO: 3592267 - RNA, 23 nt, Human
acuuuggcuuauaauucuuucaa

SEQ ID NO: 3592268 - RNA, 19 nt, Human
acuuugggaaaacauguua

SEQ ID NO: 3592269 - RNA, 21 nt, Human
acuuugggaggccgaggcggg

SEQ ID NO: 3592270 - RNA, 17 nt, Human
acuuugguaccagauaa

SEQ ID NO: 3592271 - RNA, 19 nt, Human
acuuugguaccagauaacu

SEQ ID NO: 3592272 - RNA, 22 nt, Human
acuuugguagcugggaaagcau

SEQ ID NO: 3592273 - RNA, 13 nt, Human
acuuugguuauuu

SEQ ID NO: 3592274 - RNA, 22 nt, Human
acuuugguuauuuuacuuuuug

SEQ ID NO: 3592275 - RNA, 14 nt, Human
acuuugguuucuga

SEQ ID NO: 3592276 - RNA, 21 nt, Human
acuuuguaaaaaucuuuugaa

SEQ ID NO: 3592277 - RNA, 12 nt, Human
acuuuguaaaua

SEQ ID NO: 3592278 - RNA, 23 nt, Human
acuuuguaaauaggauuuuuaga

SEQ ID NO: 3592279 - RNA, 12 nt, Human
acuuuguaaauu

SEQ ID NO: 3592280 - RNA, 13 nt, Human
acuuuguaaauuc

SEQ ID NO: 3592281 - RNA, 18 nt, Human
acuuuguaaauucugauu

SEQ ID NO: 3592282 - RNA, 22 nt, Human
acuuuguaccccccaaccccug

SEQ ID NO: 3592283 - RNA, 19 nt, Human
acuuuguauaaaagggacu

SEQ ID NO: 3592284 - RNA, 16 nt, Human
acuuuguauacaagua

SEQ ID NO: 3592285 - RNA, 16 nt, Human
acuuuguauacuuuaa

SEQ ID NO: 3592286 - RNA, 18 nt, Human
acuuuguauaguuaugua

SEQ ID NO: 3592287 - RNA, 20 nt, Human
acuuuguaugauauuccaua

SEQ ID NO: 3592288 - RNA, 22 nt, Human
acuuuguaugauauuccauagu

SEQ ID NO: 3592289 - RNA, 19 nt, Human
acuuuguaugucauuuccu

SEQ ID NO: 3592290 - RNA, 22 nt, Human
acuuuguaugucauuuccuuca

SEQ ID NO: 3592291 - RNA, 15 nt, Human
acuuuguauuguccu

SEQ ID NO: 3592292 - RNA, 15 nt, Human
acuuugucagaggca

SEQ ID NO: 3592293 - RNA, 16 nt, Human
acuuugucuaagaaac

SEQ ID NO: 3592294 - RNA, 20 nt, Human
acuuugucuaagaaacauug

SEQ ID NO: 3592295 - RNA, 15 nt, Human
acuuugucugaaaaa

SEQ ID NO: 3592296 - RNA, 18 nt, Human
acuuugugcauucuggau

SEQ ID NO: 3592297 - RNA, 19 nt, Human
acuuuguggaugucuuccu

SEQ ID NO: 3592298 - RNA, 20 nt, Human
acuuuguuaguuucuccaag

SEQ ID NO: 3592299 - RNA, 11 nt, Human
acuuuguucac

SEQ ID NO: 3592300 - RNA, 16 nt, Human
acugugcaguugcugu

SEQ ID NO: 3592301 - RNA, 17 nt, Human
acugugcauagugcugg

SEQ ID NO: 3592302 - RNA, 23 nt, Human
acugugccacaaugcaguucuga

SEQ ID NO: 3592303 - RNA, 18 nt, Human
acugugcccugguggaga

SEQ ID NO: 3592304 - RNA, 15 nt, Human
acugugccucagaga

SEQ ID NO: 3592305 - RNA, 18 nt, Human
acugugccucagagacca

SEQ ID NO: 3592306 - RNA, 19 nt, Human
acugugccucagagaccag

SEQ ID NO: 3592307 - RNA, 20 nt, Human
acugugccucagagaccagg

SEQ ID NO: 3592308 - RNA, 17 nt, Human
acugugcguggggcucc

SEQ ID NO: 3592309 - RNA, 13 nt, Human
acugugcugaaug

SEQ ID NO: 3592310 - RNA, 15 nt, Human
acugugcuggagcca

SEQ ID NO: 3592311 - RNA, 17 nt, Human
acugugcuguuguucuc

SEQ ID NO: 3592312 - RNA, 15 nt, Human
accccgggcucucug

SEQ ID NO: 3592313 - RNA, 16 nt, Human
accccgggcucucugc

SEQ ID NO: 3592314 - RNA, 18 nt, Human
accccgggcucucugcug

SEQ ID NO: 3592315 - RNA, 15 nt, Human
acuuaauaacugugu

SEQ ID NO: 3592316 - RNA, 17 nt, Human
acuuaauacuaccuuga

SEQ ID NO: 3592317 - RNA, 21 nt, Human
acuuaauacuaccuugaaaau

SEQ ID NO: 3592318 - RNA, 13 nt, Human
acuuaaucuaaau

SEQ ID NO: 3592319 - RNA, 16 nt, Human
acuuaaugaaaacaau

SEQ ID NO: 3592320 - RNA, 18 nt, Human
acuuaaugaaaacaaugc

SEQ ID NO: 3592321 - RNA, 13 nt, Human
acuuaaugaauga

SEQ ID NO: 3592322 - RNA, 16 nt, Human
acuuaaugagacuuua

SEQ ID NO: 3592323 - RNA, 16 nt, Human
acuuaauguauguuac

SEQ ID NO: 3592324 - RNA, 13 nt, Human
acuuaauucuguu

SEQ ID NO: 3592325 - RNA, 17 nt, Human
acuuacacuuuaugcac

SEQ ID NO: 3592326 - RNA, 17 nt, Human
acuuacagcaaauccuu

SEQ ID NO: 3592327 - RNA, 17 nt, Human
acuuacagcucuggcca

SEQ ID NO: 3592328 - RNA, 15 nt, Human
acuuacaucaugugu

SEQ ID NO: 3592329 - RNA, 17 nt, Human
acuuacaugauucauuu

SEQ ID NO: 3592330 - RNA, 21 nt, Human
acuuacauucucuaauaagaa

SEQ ID NO: 3592331 - RNA, 22 nt, Human
acuuaccaggcaccaaaagaag

SEQ ID NO: 3592332 - RNA, 20 nt, Human
acuuaccgcguaaugcgcca

SEQ ID NO: 3592333 - RNA, 23 nt, Human
acuuaccugaagggguuuucuug

SEQ ID NO: 3592334 - RNA, 17 nt, Human
acuuaccuucaauaaag

SEQ ID NO: 3592335 - RNA, 22 nt, Human
acuuacuaaaauauauauagaa

SEQ ID NO: 3592336 - RNA, 15 nt, Human
acuuacuguacauga

SEQ ID NO: 3592337 - RNA, 16 nt, Human
acuuacuguacaugaa

SEQ ID NO: 3592338 - RNA, 24 nt, Human
acuuacuguuguccuaugggaguc

SEQ ID NO: 3592339 - RNA, 16 nt, Human
acuuacuguuucuguc

SEQ ID NO: 3592340 - RNA, 13 nt, Human
acuuacuuuuucu

SEQ ID NO: 3592341 - RNA, 16 nt, Human
acuuagaaagcagggg

SEQ ID NO: 3592342 - RNA, 19 nt, Human
acuuagaaagcaggggcua

SEQ ID NO: 3592343 - RNA, 22 nt, Human
acuuagaaggauugaacuucuu

SEQ ID NO: 3592344 - RNA, 13 nt, Human
acuuagaggaaau

SEQ ID NO: 3592345 - RNA, 20 nt, Human
acuuagagguggggagcaga

SEQ ID NO: 3592346 - RNA, 15 nt, Human
acuuagaguuucugu

SEQ ID NO: 3592347 - RNA, 18 nt, Human
acuuagaguuucuguuug

SEQ ID NO: 3592348 - RNA, 20 nt, Human
acuuagaguuucuguuugau

SEQ ID NO: 3592349 - RNA, 18 nt, Human
acuuagaucuccaggaga

SEQ ID NO: 3592350 - RNA, 19 nt, Human
acuuagauuuuacaugaag

SEQ ID NO: 3592351 - RNA, 20 nt, Human
acuuagauuuuacaugaagu

SEQ ID NO: 3592352 - RNA, 14 nt, Human
acuuagcauccuaa

SEQ ID NO: 3592353 - RNA, 21 nt, Human
acuuagcauccuaagaaauau

SEQ ID NO: 3592354 - RNA, 15 nt, Human
acuuagcaugcacaa

SEQ ID NO: 3592355 - RNA, 20 nt, Human
acuuagcauuuucugcaucu

SEQ ID NO: 3592356 - RNA, 16 nt, Human
acuuagcuaucagaag

SEQ ID NO: 3592357 - RNA, 14 nt, Human
acuuagcuuaucaa

SEQ ID NO: 3592358 - RNA, 20 nt, Human
acuuagcuuaucaauuuguc

SEQ ID NO: 3592359 - RNA, 22 nt, Human
acuuagcuuaucaauuugucau

SEQ ID NO: 3592360 - RNA, 16 nt, Human
acuuaggcuuuguagc

SEQ ID NO: 3592361 - RNA, 18 nt, Human
acuuagguaagaagauuc

SEQ ID NO: 3592362 - RNA, 15 nt, Human
acuuaguagauuaaa

SEQ ID NO: 3592363 - RNA, 20 nt, Human
acuuaguagauuaaaaauua

SEQ ID NO: 3592364 - RNA, 16 nt, Human
acuuaguauugcaaag

SEQ ID NO: 3592365 - RNA, 17 nt, Human
acuuagucaauaagaaa

SEQ ID NO: 3592366 - RNA, 20 nt, Human
acuuagugcggacaaguuuu

SEQ ID NO: 3592367 - RNA, 18 nt, Human
acuuauaaagaagguugg

SEQ ID NO: 3592368 - RNA, 13 nt, Human
acuuauaaggugu

SEQ ID NO: 3592369 - RNA, 23 nt, Human
acuuauaagugaagugauacuau

SEQ ID NO: 3592370 - RNA, 17 nt, Human
acuuauaauuuuccuaa

SEQ ID NO: 3592371 - RNA, 11 nt, Human
acuuauaccug

SEQ ID NO: 3592372 - RNA, 15 nt, Human
acuuauaguacauga

SEQ ID NO: 3592373 - RNA, 17 nt, Human
acuuauaucaucagcau

SEQ ID NO: 3592374 - RNA, 18 nt, Human
acuuauauggaaauucug

SEQ ID NO: 3592375 - RNA, 18 nt, Human
acuuauauugaagacaau

SEQ ID NO: 3592376 - RNA, 20 nt, Human
acuuauauugaagacaauuu

SEQ ID NO: 3592377 - RNA, 19 nt, Human
acuuauauuguaagaaaua

SEQ ID NO: 3592378 - RNA, 20 nt, Human
acuuauauuguaagaaauac

SEQ ID NO: 3592379 - RNA, 19 nt, Human
acuuauauuuucguaugaa

SEQ ID NO: 3592380 - RNA, 14 nt, Human
acuuaucccucucc

SEQ ID NO: 3592381 - RNA, 18 nt, Human
acuuauccuaaaacaaau

SEQ ID NO: 3592382 - RNA, 18 nt, Human
acuuaucuuacaaagugu

SEQ ID NO: 3592383 - RNA, 20 nt, Human
acuuaucuuacaaaguguau

SEQ ID NO: 3592384 - RNA, 22 nt, Human
acuuaucuuacaaaguguauuu

SEQ ID NO: 3592385 - RNA, 14 nt, Human
acuuaucuuaugcc

SEQ ID NO: 3592386 - RNA, 17 nt, Human
acuuaugaaugauuugc

SEQ ID NO: 3592387 - RNA, 13 nt, Human
acuuaugaauguu

SEQ ID NO: 3592388 - RNA, 14 nt, Human
acuuaugaauguuu

SEQ ID NO: 3592389 - RNA, 15 nt, Human
acuuaugaauguuuc

SEQ ID NO: 3592390 - RNA, 17 nt, Human
acuuaugauuucaugug

SEQ ID NO: 3592391 - RNA, 13 nt, Human
acuuauguagaua

SEQ ID NO: 3592392 - RNA, 12 nt, Human
acuuauuaacaa

SEQ ID NO: 3592393 - RNA, 22 nt, Human
acuuauuaaucuguaugaagau

SEQ ID NO: 3592394 - RNA, 20 nt, Human
acuuauuacaauuuguucau

SEQ ID NO: 3592395 - RNA, 14 nt, Human
acuuauuacugcua

SEQ ID NO: 3592396 - RNA, 16 nt, Human
acuuauuaucuucagg

SEQ ID NO: 3592397 - RNA, 15 nt, Human
acuuauucauugugg

SEQ ID NO: 3592398 - RNA, 20 nt, Human
acuuauucauugugguuauu

SEQ ID NO: 3592399 - RNA, 15 nt, Human
acuuauugcugauuu

SEQ ID NO: 3592400 - RNA, 21 nt, Human
acuuauugcugauuuuaaugg

SEQ ID NO: 3592401 - RNA, 13 nt, Human
acuuauugcuuug

SEQ ID NO: 3592402 - RNA, 23 nt, Human
acuuauuguagcauccuggaaua

SEQ ID NO: 3592403 - RNA, 17 nt, Human
acuuauuuaugaaccug

SEQ ID NO: 3592404 - RNA, 17 nt, Human
acuuauuuuauuuccau

SEQ ID NO: 3592405 - RNA, 21 nt, Human
acuuauuuuuuucugauugua

SEQ ID NO: 3592406 - RNA, 21 nt, Human
acuucaaaaacugucaaagaa

SEQ ID NO: 3592407 - RNA, 15 nt, Human
acuucaaaaguauuu

SEQ ID NO: 3592408 - RNA, 16 nt, Human
acuucaaaaguauuuu

SEQ ID NO: 3592409 - RNA, 15 nt, Human
acuucaaaaguuugu

SEQ ID NO: 3592410 - RNA, 16 nt, Human
acuucaaacugagauc

SEQ ID NO: 3592411 - RNA, 15 nt, Human
acuucaaagcaagcu

SEQ ID NO: 3592412 - RNA, 17 nt, Human
acuucaaauccuugaag

SEQ ID NO: 3592413 - RNA, 19 nt, Human
acuucaaauccuugaagau

SEQ ID NO: 3592414 - RNA, 19 nt, Human
acuucaacauuuacaugua

SEQ ID NO: 3592415 - RNA, 23 nt, Human
acuucaagcauggcuauuuuaua

SEQ ID NO: 3592416 - RNA, 13 nt, Human
acuucaaggccca

SEQ ID NO: 3592417 - RNA, 16 nt, Human
acuucaaggugacaga

SEQ ID NO: 3592418 - RNA, 23 nt, Human
acuucaagugcaugcucucugca

SEQ ID NO: 3592419 - RNA, 15 nt, Human
acuucaaugauagua

SEQ ID NO: 3592420 - RNA, 19 nt, Human
acuucaaugggcucuucca

SEQ ID NO: 3592421 - RNA, 19 nt, Human
acuucacacacaggcaacu

SEQ ID NO: 3592422 - RNA, 23 nt, Human
acuucacauauugauuuccguua

SEQ ID NO: 3592423 - RNA, 18 nt, Human
acuucacauuaaaaaaug

SEQ ID NO: 3592424 - RNA, 16 nt, Human
acuucacgcccuuggc

SEQ ID NO: 3592425 - RNA, 13 nt, Human
acuucacugugcu

SEQ ID NO: 3592426 - RNA, 24 nt, Human
acuucacugugcuguuguuaugau

SEQ ID NO: 3592427 - RNA, 17 nt, Human
acuucacuuuaauucuc

SEQ ID NO: 3592428 - RNA, 13 nt, Human
acuucagacugaa

SEQ ID NO: 3592429 - RNA, 19 nt, Human
acuucagacugaacaugua

SEQ ID NO: 3592430 - RNA, 20 nt, Human
acuucagagagcugguaguu

SEQ ID NO: 3592431 - RNA, 14 nt, Human
acuucagauugaac

SEQ ID NO: 3592432 - RNA, 15 nt, Human
acuucagcaagagag

SEQ ID NO: 3592433 - RNA, 16 nt, Human
acuucagcaagagaga

SEQ ID NO: 3592434 - RNA, 18 nt, Human
acuucagcaagagagaac

SEQ ID NO: 3592435 - RNA, 16 nt, Human
acuucagcugacuuuu

SEQ ID NO: 3592436 - RNA, 14 nt, Human
acuucaggcucuuc

SEQ ID NO: 3592437 - RNA, 16 nt, Human
acuucaggcucuucuc

SEQ ID NO: 3592438 - RNA, 20 nt, Human
acuucaggcuugauaauacu

SEQ ID NO: 3592439 - RNA, 20 nt, Human
acuucagggcagauuuuagu

SEQ ID NO: 3592440 - RNA, 21 nt, Human
acuucagggcagauuuuaguu

SEQ ID NO: 3592441 - RNA, 18 nt, Human
acuucagguauaccucac

SEQ ID NO: 3592442 - RNA, 20 nt, Human
acuucagguauaccucacuu

SEQ ID NO: 3592443 - RNA, 19 nt, Human
acuucaguauguugucaaa

SEQ ID NO: 3592444 - RNA, 23 nt, Human
acuucaguauguugucaaagaga

SEQ ID NO: 3592445 - RNA, 19 nt, Human
acuucaguccugcuccaga

SEQ ID NO: 3592446 - RNA, 15 nt, Human
acuucaguccuggga

SEQ ID NO: 3592447 - RNA, 15 nt, Human
acuucaucaaacaug

SEQ ID NO: 3592448 - RNA, 20 nt, Human
acuucaucaaacauggguuu

SEQ ID NO: 3592449 - RNA, 21 nt, Human
acuucaucuggcugccuuugc

SEQ ID NO: 3592450 - RNA, 16 nt, Human
acuucaugcaggugaa

SEQ ID NO: 3592451 - RNA, 23 nt, Human
acuucauggccuuugauaaaugu

SEQ ID NO: 3592452 - RNA, 13 nt, Human
acuucauguaaag

SEQ ID NO: 3592453 - RNA, 21 nt, Human
acuucauuauuuuaaaaauau

SEQ ID NO: 3592454 - RNA, 14 nt, Human
acuuccaaaauucu

SEQ ID NO: 3592455 - RNA, 15 nt, Human
acuuccaaaauucuu

SEQ ID NO: 3592456 - RNA, 16 nt, Human
agaaaaagcaaaaggc

SEQ ID NO: 3592457 - RNA, 14 nt, Human
agaaaaagggucaa

SEQ ID NO: 3592458 - RNA, 18 nt, Human
agaaaaauaucuguaaga

SEQ ID NO: 3592459 - RNA, 21 nt, Human
agaaaaaugagcauacaucuu

SEQ ID NO: 3592460 - RNA, 20 nt, Human
agaaaaauucagcaaaccau

SEQ ID NO: 3592461 - RNA, 12 nt, Human
agaaaacaaaaa

SEQ ID NO: 3592462 - RNA, 21 nt, Human
agaaaacaagcaaguucugag

SEQ ID NO: 3592463 - RNA, 19 nt, Human
agaaaacaaggaugaauua

SEQ ID NO: 3592464 - RNA, 21 nt, Human
agaaaacacuguuaucauuuu

SEQ ID NO: 3592465 - RNA, 15 nt, Human
agaaaacagaaaaaa

SEQ ID NO: 3592466 - RNA, 16 nt, Human
agaaaacagaaaacaa

SEQ ID NO: 3592467 - RNA, 23 nt, Human
agaaaacauaaucuucugccuuc

SEQ ID NO: 3592468 - RNA, 12 nt, Human
agaaaacaucua

SEQ ID NO: 3592469 - RNA, 11 nt, Human
agaaaacauug

SEQ ID NO: 3592470 - RNA, 23 nt, Human
agaaaacauuuuuuuuuuaaauc

SEQ ID NO: 3592471 - RNA, 20 nt, Human
agaaaaccagcucagcacug

SEQ ID NO: 3592472 - RNA, 16 nt, Human
agaaaaccuuucuuca

SEQ ID NO: 3592473 - RNA, 18 nt, Human
agaaaacuagaauuucau

SEQ ID NO: 3592474 - RNA, 16 nt, Human
agaaaacugaaaaucu

SEQ ID NO: 3592475 - RNA, 14 nt, Human
agaaaacugugauu

SEQ ID NO: 3592476 - RNA, 20 nt, Human
agaaaacuuuguuaggccaa

SEQ ID NO: 3592477 - RNA, 17 nt, Human
agaaaacuuuuaugcaa

SEQ ID NO: 3592478 - RNA, 9 nt, Human
agaaaagaa

SEQ ID NO: 3592479 - RNA, 10 nt, Human
agaaaagaaa

SEQ ID NO: 3592480 - RNA, 18 nt, Human
agaaaagaaaaaaaaaga

SEQ ID NO: 3592481 - RNA, 17 nt, Human
agaaaagaacuggaaac

SEQ ID NO: 3592482 - RNA, 19 nt, Human
agaaaagacgcaccagccc

SEQ ID NO: 3592483 - RNA, 15 nt, Human
agaaaagagaagaag

SEQ ID NO: 3592484 - RNA, 23 nt, Human
agaaaagagauauuuuaaaauga

SEQ ID NO: 3592485 - RNA, 16 nt, Human
agaaaagaugcacuuu

SEQ ID NO: 3592486 - RNA, 19 nt, Human
agaaaagaugcacuuugcu

SEQ ID NO: 3592487 - RNA, 12 nt, Human
agaaaagauuuu

SEQ ID NO: 3592488 - RNA, 15 nt, Human
agaaaagauuuuaau

SEQ ID NO: 3592489 - RNA, 12 nt, Human
agaaaagcacac

SEQ ID NO: 3592490 - RNA, 15 nt, Human
agaaaagcaccugcc

SEQ ID NO: 3592491 - RNA, 18 nt, Human
agaaaagcaccugccgac

SEQ ID NO: 3592492 - RNA, 13 nt, Human
agaaaagcuauaa

SEQ ID NO: 3592493 - RNA, 13 nt, Human
agaaaaggaaaag

SEQ ID NO: 3592494 - RNA, 20 nt, Human
agaaaagggaacugaacauu

SEQ ID NO: 3592495 - RNA, 23 nt, Human
agaaaagggaaguugugccuuuu

SEQ ID NO: 3592496 - RNA, 13 nt, Human
agaaaaggucuug

SEQ ID NO: 3592497 - RNA, 21 nt, Human
agaaaaggugauaaaaucaua

SEQ ID NO: 3592498 - RNA, 15 nt, Human
agaaaaguaagcccu

SEQ ID NO: 3592499 - RNA, 14 nt, Human
agaaaaguagacaa

SEQ ID NO: 3592500 - RNA, 17 nt, Human
agaaaaguauguucuaa

SEQ ID NO: 3592501 - RNA, 18 nt, Human
agaaaaguauuuugaagu

SEQ ID NO: 3592502 - RNA, 14 nt, Human
agaaaagugaauug

SEQ ID NO: 3592503 - RNA, 19 nt, Human
agaaaagugaauugaaguu

SEQ ID NO: 3592504 - RNA, 12 nt, Human
agaaaauaaaaa

SEQ ID NO: 3592505 - RNA, 18 nt, Human
agaaaauaaaaaaaagaa

SEQ ID NO: 3592506 - RNA, 21 nt, Human
agaaaauaaaaaaaagaaaaa

SEQ ID NO: 3592507 - RNA, 22 nt, Human
agaaaauaaaaaaaagaaaaaa

SEQ ID NO: 3592508 - RNA, 15 nt, Human
agaaaauaaaaaguu

SEQ ID NO: 3592509 - RNA, 18 nt, Human
agaaaauaaaauuaagaa

SEQ ID NO: 3592510 - RNA, 21 nt, Human
agaaaauaaaauuaagaaugu

SEQ ID NO: 3592511 - RNA, 14 nt, Human
agaaaauaacaaua

SEQ ID NO: 3592512 - RNA, 18 nt, Human
agaaaauacuuaaauguu

SEQ ID NO: 3592513 - RNA, 19 nt, Human
agaaaauacuuaaauguua

SEQ ID NO: 3592514 - RNA, 19 nt, Human
agaaaauaguggugugauu

SEQ ID NO: 3592515 - RNA, 10 nt, Human
agaaaauaua

SEQ ID NO: 3592516 - RNA, 13 nt, Human
agaaaauauacug

SEQ ID NO: 3592517 - RNA, 15 nt, Human
agaaaauauacugua

SEQ ID NO: 3592518 - RNA, 18 nt, Human
agaaaauauacuguaaag

SEQ ID NO: 3592519 - RNA, 22 nt, Human
agaaaauauacuguaaagaaag

SEQ ID NO: 3592520 - RNA, 17 nt, Human
accuaggcuaggguggg

SEQ ID NO: 3592521 - RNA, 24 nt, Human
accuagggaggaccuuaucugugc

SEQ ID NO: 3592522 - RNA, 20 nt, Human
accuagggauguucuggccc

SEQ ID NO: 3592523 - RNA, 15 nt, Human
accuaguagucauuu

SEQ ID NO: 3592524 - RNA, 13 nt, Human
accuagucuaagg

SEQ ID NO: 3592525 - RNA, 17 nt, Human
accuaguggcuguccag

SEQ ID NO: 3592526 - RNA, 19 nt, Human
accuaguggcuguccagug

SEQ ID NO: 3592527 - RNA, 22 nt, Human
accuaguggcuguccagugccc

SEQ ID NO: 3592528 - RNA, 18 nt, Human
accuaguuaaagaaagga

SEQ ID NO: 3592529 - RNA, 16 nt, Human
accuauaaaguaaagc

SEQ ID NO: 3592530 - RNA, 19 nt, Human
accuauaaaguaaagcuaa

SEQ ID NO: 3592531 - RNA, 15 nt, Human
accuauagucccagc

SEQ ID NO: 3592532 - RNA, 22 nt, Human
accuauagucccagcuacucag

SEQ ID NO: 3592533 - RNA, 12 nt, Human
accuauccacac

SEQ ID NO: 3592534 - RNA, 15 nt, Human
accuaucucguggga

SEQ ID NO: 3592535 - RNA, 18 nt, Human
accuaucucgugggagag

SEQ ID NO: 3592536 - RNA, 19 nt, Human
accuaugucauuucauuuc

SEQ ID NO: 3592537 - RNA, 12 nt, Human
accuauguuugc

SEQ ID NO: 3592538 - RNA, 16 nt, Human
accuauuaucccagcu

SEQ ID NO: 3592539 - RNA, 19 nt, Human
accuauuucucuuucuuua

SEQ ID NO: 3592540 - RNA, 20 nt, Human
accuauuuugaaaaauuccu

SEQ ID NO: 3592541 - RNA, 20 nt, Human
accuauuuuugacauggaaa

SEQ ID NO: 3592542 - RNA, 22 nt, Human
accucaaaugaugugccugcuu

SEQ ID NO: 3592543 - RNA, 15 nt, Human
accucaaauuuaaag

SEQ ID NO: 3592544 - RNA, 17 nt, Human
accucaaccauccuggc

SEQ ID NO: 3592545 - RNA, 21 nt, Human
accucaacccccauuucuauu

SEQ ID NO: 3592546 - RNA, 22 nt, Human
accucaacccccauuucuauuu

SEQ ID NO: 3592547 - RNA, 23 nt, Human
accucaaccuguaaauuauuuua

SEQ ID NO: 3592548 - RNA, 14 nt, Human
accucaagcugcau

SEQ ID NO: 3592549 - RNA, 20 nt, Human
accucaagggggacugucuu

SEQ ID NO: 3592550 - RNA, 20 nt, Human
accucaauuuucacuguguc

SEQ ID NO: 3592551 - RNA, 14 nt, Human
accucacagugacc

SEQ ID NO: 3592552 - RNA, 22 nt, Human
accucacaugcauacauacaca

SEQ ID NO: 3592553 - RNA, 17 nt, Human
accucaccaacuccuag

SEQ ID NO: 3592554 - RNA, 12 nt, Human
accucaccccac

SEQ ID NO: 3592555 - RNA, 23 nt, Human
accucaccccgaggcccugcaug

SEQ ID NO: 3592556 - RNA, 14 nt, Human
accucaccuagaaa

SEQ ID NO: 3592557 - RNA, 16 nt, Human
accucacgcaccuccc

SEQ ID NO: 3592558 - RNA, 22 nt, Human
accucacgcaccucccauccua

SEQ ID NO: 3592559 - RNA, 21 nt, Human
accucacucagaaguccagag

SEQ ID NO: 3592560 - RNA, 22 nt, Human
accucacucagcaccacucaag

SEQ ID NO: 3592561 - RNA, 18 nt, Human
accucacucuugccaacc

SEQ ID NO: 3592562 - RNA, 17 nt, Human
accucagaccccggggu

SEQ ID NO: 3592563 - RNA, 22 nt, Human
accucagaggcuguucuugggg

SEQ ID NO: 3592564 - RNA, 18 nt, Human
accucagaguauggagcu

SEQ ID NO: 3592565 - RNA, 19 nt, Human
accucagaguccaggcccc

SEQ ID NO: 3592566 - RNA, 15 nt, Human
accucagauggcagc

SEQ ID NO: 3592567 - RNA, 18 nt, Human
accucagauggcagcuuu

SEQ ID NO: 3592568 - RNA, 19 nt, Human
accucagauggcagcuuuu

SEQ ID NO: 3592569 - RNA, 22 nt, Human
accucagauggcagcuuuuaaa

SEQ ID NO: 3592570 - RNA, 10 nt, Human
accucagccu

SEQ ID NO: 3592571 - RNA, 13 nt, Human
accucagccuaga

SEQ ID NO: 3592572 - RNA, 11 nt, Human
accucagccuc

SEQ ID NO: 3592573 - RNA, 12 nt, Human
accucagccucc

SEQ ID NO: 3592574 - RNA, 23 nt, Human
accucagccugcacagugucccc

SEQ ID NO: 3592575 - RNA, 13 nt, Human
accucagccuggc

SEQ ID NO: 3592576 - RNA, 16 nt, Human
accucagccuggccag

SEQ ID NO: 3592577 - RNA, 17 nt, Human
accucagccuggccaga

SEQ ID NO: 3592578 - RNA, 12 nt, Human
accucagccugu

SEQ ID NO: 3592579 - RNA, 17 nt, Human
accucagccugugcugc

SEQ ID NO: 3592580 - RNA, 18 nt, Human
accucagccugugcugcc

SEQ ID NO: 3592581 - RNA, 12 nt, Human
accucagcucug

SEQ ID NO: 3592582 - RNA, 14 nt, Human
accucagcucuggg

SEQ ID NO: 3592583 - RNA, 15 nt, Human
accucagcucuggga

SEQ ID NO: 3592584 - RNA, 22 nt, Human
accucagcucugggagaggauu

SEQ ID NO: 3592585 - RNA, 13 nt, Human
accucagcugcuu

SEQ ID NO: 3592586 - RNA, 16 nt, Human
accucaggaaagaaua

SEQ ID NO: 3592587 - RNA, 12 nt, Human
accucaggccug

SEQ ID NO: 3592588 - RNA, 14 nt, Human
accucaggccuggg

SEQ ID NO: 3592589 - RNA, 16 nt, Human
accucagggcucccag

SEQ ID NO: 3592590 - RNA, 16 nt, Human
accucagguugcuggu

SEQ ID NO: 3592591 - RNA, 15 nt, Human
accucagucaguauu

SEQ ID NO: 3592592 - RNA, 18 nt, Human
accucaguucauuguggu

SEQ ID NO: 3592593 - RNA, 16 nt, Human
accucaguucccuugg

SEQ ID NO: 3592594 - RNA, 14 nt, Human
accucaucaggaug

SEQ ID NO: 3592595 - RNA, 15 nt, Human
accucauccaaacaa

SEQ ID NO: 3592596 - RNA, 16 nt, Human
accucaugcaucucca

SEQ ID NO: 3592597 - RNA, 16 nt, Human
accucaugcccacccc

SEQ ID NO: 3592598 - RNA, 23 nt, Human
accucaugcccacccccugcccu

SEQ ID NO: 3592599 - RNA, 15 nt, Human
accucauguuuauga

SEQ ID NO: 3592600 - RNA, 18 nt, Human
accucauguuuaugaaaa

SEQ ID NO: 3592601 - RNA, 21 nt, Human
accucauuaaccgaugcuuua

SEQ ID NO: 3592602 - RNA, 18 nt, Human
agaacuacaaacaaaauu

SEQ ID NO: 3592603 - RNA, 22 nt, Human
agaacuacucagggaaugaagg

SEQ ID NO: 3592604 - RNA, 20 nt, Human
agaacuagagguuuuaugau

SEQ ID NO: 3592605 - RNA, 23 nt, Human
agaacuagagguuuuaugauauu

SEQ ID NO: 3592606 - RNA, 19 nt, Human
agaacuagccaaaccagga

SEQ ID NO: 3592607 - RNA, 22 nt, Human
agaacuagugguggcucugaga

SEQ ID NO: 3592608 - RNA, 17 nt, Human
agaacuaucuucaucug

SEQ ID NO: 3592609 - RNA, 19 nt, Human
agaacuaucuucaucugag

SEQ ID NO: 3592610 - RNA, 17 nt, Human
agaacuauguuuuuguu

SEQ ID NO: 3592611 - RNA, 17 nt, Human
agaacuauuuuauucua

SEQ ID NO: 3592612 - RNA, 14 nt, Human
agaacucacugggg

SEQ ID NO: 3592613 - RNA, 16 nt, Human
agaacucacuggggcc

SEQ ID NO: 3592614 - RNA, 19 nt, Human
agaacucacuggggccuac

SEQ ID NO: 3592615 - RNA, 23 nt, Human
agaacucaucacuguggcugucu

SEQ ID NO: 3592616 - RNA, 22 nt, Human
agaacucauguuauuuuuuaac

SEQ ID NO: 3592617 - RNA, 17 nt, Human
agaacuccaggcccucc

SEQ ID NO: 3592618 - RNA, 15 nt, Human
agaacucccuuucaa

SEQ ID NO: 3592619 - RNA, 11 nt, Human
agaacuccuag

SEQ ID NO: 3592620 - RNA, 13 nt, Human
agaacuccugacu

SEQ ID NO: 3592621 - RNA, 23 nt, Human
agaacucuccaucuuauuuucau

SEQ ID NO: 3592622 - RNA, 17 nt, Human
agaacucugccugcccu

SEQ ID NO: 3592623 - RNA, 14 nt, Human
agaacucuuucaaa

SEQ ID NO: 3592624 - RNA, 10 nt, Human
agaacugaaa

SEQ ID NO: 3592625 - RNA, 15 nt, Human
agaacugaaaacaua

SEQ ID NO: 3592626 - RNA, 12 nt, Human
agaacugaaaag

SEQ ID NO: 3592627 - RNA, 14 nt, Human
agaacugaaaagag

SEQ ID NO: 3592628 - RNA, 20 nt, Human
agaacugaaaggcuuuucaa

SEQ ID NO: 3592629 - RNA, 15 nt, Human
agaacugagcuccuc

SEQ ID NO: 3592630 - RNA, 21 nt, Human
agaacugcacaugaagaaaua

SEQ ID NO: 3592631 - RNA, 15 nt, Human
agaacugcaggcccu

SEQ ID NO: 3592632 - RNA, 20 nt, Human
agaacugcaggcccuggccu

SEQ ID NO: 3592633 - RNA, 19 nt, Human
agaacugcauauguuucgc

SEQ ID NO: 3592634 - RNA, 20 nt, Human
agaacugcauggaccuaaca

SEQ ID NO: 3592635 - RNA, 23 nt, Human
agaacugcuuucuuucguuuguu

SEQ ID NO: 3592636 - RNA, 17 nt, Human
agaacuggacucaggau

SEQ ID NO: 3592637 - RNA, 20 nt, Human
agaacuggacucaggaugcc

SEQ ID NO: 3592638 - RNA, 12 nt, Human
agaacuggguaa

SEQ ID NO: 3592639 - RNA, 19 nt, Human
agaacuguaugucagacau

SEQ ID NO: 3592640 - RNA, 19 nt, Human
agaacugucggaggaaaga

SEQ ID NO: 3592641 - RNA, 13 nt, Human
agaacugugccac

SEQ ID NO: 3592642 - RNA, 22 nt, Human
agaacuuagccuuuaccuguga

SEQ ID NO: 3592643 - RNA, 14 nt, Human
agaacuucagaaag

SEQ ID NO: 3592644 - RNA, 17 nt, Human
agaacuucagaaagacu

SEQ ID NO: 3592645 - RNA, 14 nt, Human
agaacuucauggau

SEQ ID NO: 3592646 - RNA, 23 nt, Human
agaacuucccugauugaccugcu

SEQ ID NO: 3592647 - RNA, 22 nt, Human
agaacuugaagccugcuccuuc

SEQ ID NO: 3592648 - RNA, 16 nt, Human
agaacuugcugcuguc

SEQ ID NO: 3592649 - RNA, 18 nt, Human
agaacuuggauguaccug

SEQ ID NO: 3592650 - RNA, 15 nt, Human
agaacuuucauuuuu

SEQ ID NO: 3592651 - RNA, 16 nt, Human
agaacuuugaaggaca

SEQ ID NO: 3592652 - RNA, 15 nt, Human
agaacuuuguauagu

SEQ ID NO: 3592653 - RNA, 21 nt, Human
agaacuuuugguaagggaaaa

SEQ ID NO: 3592654 - RNA, 10 nt, Human
agaacuuuuu

SEQ ID NO: 3592655 - RNA, 14 nt, Human
agaacuuuuuuaaa

SEQ ID NO: 3592656 - RNA, 21 nt, Human
agaacuuuuuuaaauaaacuu

SEQ ID NO: 3592657 - RNA, 23 nt, Human
agaacuuuuuuaaauaaacuuuu

SEQ ID NO: 3592658 - RNA, 15 nt, Human
agaagaaaaagaagc

SEQ ID NO: 3592659 - RNA, 15 nt, Human
agaagaaaagagaag

SEQ ID NO: 3592660 - RNA, 17 nt, Human
agaagaaaagagaagaa

SEQ ID NO: 3592661 - RNA, 17 nt, Human
agaagaaaauucuccug

SEQ ID NO: 3592662 - RNA, 16 nt, Human
agaagaaagaacggaa

SEQ ID NO: 3592663 - RNA, 14 nt, Human
agaagaaauaaaua

SEQ ID NO: 3592664 - RNA, 18 nt, Human
agaagaaaugaaauuuua

SEQ ID NO: 3592665 - RNA, 19 nt, Human
agaagaaaugaaauuuuac

SEQ ID NO: 3592666 - RNA, 18 nt, Human
agaagaaauucugucaua

SEQ ID NO: 3592667 - RNA, 19 nt, Human
agaagaacuagagguuuua

SEQ ID NO: 3592668 - RNA, 20 nt, Human
agaagaacuguguuucaagu

SEQ ID NO: 3592669 - RNA, 13 nt, Human
agaagaagaaaag

SEQ ID NO: 3592670 - RNA, 16 nt, Human
agaagaagagaagcug

SEQ ID NO: 3592671 - RNA, 18 nt, Human
agaagaagagaagcugcu

SEQ ID NO: 3592672 - RNA, 20 nt, Human
agaagaagagaagcugcuga

SEQ ID NO: 3592673 - RNA, 13 nt, Human
agaagaaggaaau

SEQ ID NO: 3592674 - RNA, 18 nt, Human
agaagaaggaaaugaauu

SEQ ID NO: 3592675 - RNA, 13 nt, Human
agaagaaggcagc

SEQ ID NO: 3592676 - RNA, 21 nt, Human
agaagaaggcagcagguggca

SEQ ID NO: 3592677 - RNA, 16 nt, Human
agaagaagucagagag

SEQ ID NO: 3592678 - RNA, 20 nt, Human
agaagaauacaaacauauuu

SEQ ID NO: 3592679 - RNA, 14 nt, Human
agaagaauauucag

SEQ ID NO: 3592680 - RNA, 19 nt, Human
agaagaauugaacccagga

SEQ ID NO: 3592681 - RNA, 20 nt, Human
agaagaauugaacccaggag

SEQ ID NO: 3592682 - RNA, 23 nt, Human
agaagaauuuucagaccccagcg

SEQ ID NO: 3592683 - RNA, 15 nt, Human
agaagacaauugaca

SEQ ID NO: 3592684 - RNA, 15 nt, Human
agaagacaugaacca

SEQ ID NO: 3592685 - RNA, 16 nt, Human
agaagacaugaaccaa

SEQ ID NO: 3592686 - RNA, 16 nt, Human
agaagacauggagacu

SEQ ID NO: 3592687 - RNA, 13 nt, Human
agaagacauguuu

SEQ ID NO: 3592688 - RNA, 14 nt, Human
agaagacauguuuu

SEQ ID NO: 3592689 - RNA, 17 nt, Human
agaagacauguuuuaga

SEQ ID NO: 3592690 - RNA, 21 nt, Human
agaagaccacaaaaauugacu

SEQ ID NO: 3592691 - RNA, 14 nt, Human
agaagacucuacca

SEQ ID NO: 3592692 - RNA, 19 nt, Human
agaagacucuaccagacug

SEQ ID NO: 3592693 - RNA, 20 nt, Human
agaagacucuaccagacugu

SEQ ID NO: 3592694 - RNA, 16 nt, Human
agaagagaagcugcug

SEQ ID NO: 3592695 - RNA, 23 nt, Human
agaagagaaugcacaaacagagg

SEQ ID NO: 3592696 - RNA, 21 nt, Human
agaagagaggagaggagagag

SEQ ID NO: 3592697 - RNA, 23 nt, Human
agaagagagggugaguccuccag

SEQ ID NO: 3592698 - RNA, 14 nt, Human
agaagagccacagu

SEQ ID NO: 3592699 - RNA, 22 nt, Human
agaagagccacagugagggaga

SEQ ID NO: 3592700 - RNA, 12 nt, Human
agaagagcccca

SEQ ID NO: 3592701 - RNA, 17 nt, Human
agaagagccccacucuc

SEQ ID NO: 3592702 - RNA, 14 nt, Human
agaagagcgcagug

SEQ ID NO: 3592703 - RNA, 13 nt, Human
agaagagcuguuc

SEQ ID NO: 3592704 - RNA, 22 nt, Human
agaagagcuguucacagccaga

SEQ ID NO: 3592705 - RNA, 17 nt, Human
agaagaggcuggugcug

SEQ ID NO: 3592706 - RNA, 22 nt, Human
agaagaggcuggugcuguggcc

SEQ ID NO: 3592707 - RNA, 24 nt, Human
agaagagggccugugggagccugc

SEQ ID NO: 3592708 - RNA, 15 nt, Human
agaagaggguguguu

SEQ ID NO: 3592709 - RNA, 17 nt, Human
agaagaggguguguuug

SEQ ID NO: 3592710 - RNA, 13 nt, Human
agaagaguggcag

SEQ ID NO: 3592711 - RNA, 19 nt, Human
agaagaguugugcacgcag

SEQ ID NO: 3592712 - RNA, 13 nt, Human
agaagauaauugu

SEQ ID NO: 3592713 - RNA, 13 nt, Human
agaagauagcagg

SEQ ID NO: 3592714 - RNA, 17 nt, Human
agaagauagucuuggaa

SEQ ID NO: 3592715 - RNA, 20 nt, Human
agaagaucaacgccucacug

SEQ ID NO: 3592716 - RNA, 13 nt, Human
agaagaugaaugg

SEQ ID NO: 3592717 - RNA, 22 nt, Human
agaagauguugaagaauacagu

SEQ ID NO: 3592718 - RNA, 14 nt, Human
agaagauguuuaac

SEQ ID NO: 3592719 - RNA, 22 nt, Human
agaagauguuuaacuuaaucaa

SEQ ID NO: 3592720 - RNA, 22 nt, Human
agaagauucuucccauucucca

SEQ ID NO: 3592721 - RNA, 13 nt, Human
agaagcagcucuu

SEQ ID NO: 3592722 - RNA, 15 nt, Human
agaagcaguggccuu

SEQ ID NO: 3592723 - RNA, 15 nt, Human
agaagcaugaaaaag

SEQ ID NO: 3592724 - RNA, 16 nt, Human
agaagcaugaaaaagc

SEQ ID NO: 3592725 - RNA, 13 nt, Human
agaagcauuccuu

SEQ ID NO: 3592726 - RNA, 15 nt, Human
agaagcauuccuucu

SEQ ID NO: 3592727 - RNA, 17 nt, Human
agaagcauuccuucuuu

SEQ ID NO: 3592728 - RNA, 24 nt, Human
agaagcauuccuucuuugauaaug

SEQ ID NO: 3592729 - RNA, 15 nt, Human
agaagcauuuguauu

SEQ ID NO: 3592730 - RNA, 19 nt, Human
agaagcauuuguauuuugu

SEQ ID NO: 3592731 - RNA, 19 nt, Human
agaagccaagggaaagggg

SEQ ID NO: 3592732 - RNA, 18 nt, Human
agaagccacaggccugag

SEQ ID NO: 3592733 - RNA, 19 nt, Human
agaagccacaggccugaga

SEQ ID NO: 3592734 - RNA, 13 nt, Human
agaagccagcuug

SEQ ID NO: 3592735 - RNA, 19 nt, Human
agaagccagcuuguuuaca

SEQ ID NO: 3592736 - RNA, 21 nt, Human
agaagccagcuuguuuacaug

SEQ ID NO: 3592737 - RNA, 22 nt, Human
agaagccaggaauuucccagga

SEQ ID NO: 3592738 - RNA, 12 nt, Human
agaagccaggag

SEQ ID NO: 3592739 - RNA, 14 nt, Human
agaagccaggagca

SEQ ID NO: 3592740 - RNA, 20 nt, Human
agaagccaggagcaaauguu

SEQ ID NO: 3592741 - RNA, 22 nt, Human
agaagccaucaccucagauggc

SEQ ID NO: 3592742 - RNA, 11 nt, Human
agaagccauug

SEQ ID NO: 3592743 - RNA, 18 nt, Human
agaagcccaauauuauaa

SEQ ID NO: 3592744 - RNA, 12 nt, Human
agaagcccagaa

SEQ ID NO: 3592745 - RNA, 16 nt, Human
agaagcccaggaaagg

SEQ ID NO: 3592746 - RNA, 22 nt, Human
agaagcccaggaaaggcuccag

SEQ ID NO: 3592747 - RNA, 21 nt, Human
acgcugguagagauggaggag

SEQ ID NO: 3592748 - RNA, 11 nt, Human
acgcugugcug

SEQ ID NO: 3592749 - RNA, 12 nt, Human
acgcugugcugc

SEQ ID NO: 3592750 - RNA, 18 nt, Human
acgcugugcugcccugcc

SEQ ID NO: 3592751 - RNA, 12 nt, Human
acgcuucugaau

SEQ ID NO: 3592752 - RNA, 22 nt, Human
acgcuucugaaugcugcuacuu

SEQ ID NO: 3592753 - RNA, 14 nt, Human
agacaugaauauga

SEQ ID NO: 3592754 - RNA, 15 nt, Human
agacaugauuuccuu

SEQ ID NO: 3592755 - RNA, 22 nt, Human
agacaugauuuccuugaaugug

SEQ ID NO: 3592756 - RNA, 14 nt, Human
agacaugcagagau

SEQ ID NO: 3592757 - RNA, 13 nt, Human
agacauggagacu

SEQ ID NO: 3592758 - RNA, 22 nt, Human
agacauggagacuccugcccug

SEQ ID NO: 3592759 - RNA, 19 nt, Human
agacauggagguucuaagg

SEQ ID NO: 3592760 - RNA, 21 nt, Human
agacauggcuuucagaaaacg

SEQ ID NO: 3592761 - RNA, 16 nt, Human
agacauggggaggaag

SEQ ID NO: 3592762 - RNA, 18 nt, Human
agacauggggaggaagga

SEQ ID NO: 3592763 - RNA, 12 nt, Human
agacaugguggc

SEQ ID NO: 3592764 - RNA, 18 nt, Human
agacaugguggggucucc

SEQ ID NO: 3592765 - RNA, 20 nt, Human
agacaugucuguucuacaua

SEQ ID NO: 3592766 - RNA, 12 nt, Human
agacaugugaca

SEQ ID NO: 3592767 - RNA, 15 nt, Human
agacaugugucaaca

SEQ ID NO: 3592768 - RNA, 23 nt, Human
agacauguuuuagacaaauacuc

SEQ ID NO: 3592769 - RNA, 18 nt, Human
agacauguuuuccgugaa

SEQ ID NO: 3592770 - RNA, 22 nt, Human
agacauuaacucauuagacugg

SEQ ID NO: 3592771 - RNA, 17 nt, Human
agacauuccaaaacgaa

SEQ ID NO: 3592772 - RNA, 21 nt, Human
agacauucucgcuucccugaa

SEQ ID NO: 3592773 - RNA, 19 nt, Human
agacauucuuccaaaaaga

SEQ ID NO: 3592774 - RNA, 16 nt, Human
agacauugucaauaaa

SEQ ID NO: 3592775 - RNA, 23 nt, Human
agacauuucucuuacugcaaaug

SEQ ID NO: 3592776 - RNA, 19 nt, Human
agacauuucuuuucuuuuu

SEQ ID NO: 3592777 - RNA, 21 nt, Human
agacauuucuuuucuuuuuac

SEQ ID NO: 3592778 - RNA, 22 nt, Human
agacauuuguaaauguaaaacu

SEQ ID NO: 3592779 - RNA, 18 nt, Human
agaccaaacagugcuguu

SEQ ID NO: 3592780 - RNA, 17 nt, Human
agaccaagacucugaaa

SEQ ID NO: 3592781 - RNA, 16 nt, Human
agaccaagcuugucca

SEQ ID NO: 3592782 - RNA, 13 nt, Human
agaccacaucuuu

SEQ ID NO: 3592783 - RNA, 23 nt, Human
agaccacaucuuuaucuguucuu

SEQ ID NO: 3592784 - RNA, 15 nt, Human
agaccaccaccucag

SEQ ID NO: 3592785 - RNA, 16 nt, Human
agaccaccacuucgaa

SEQ ID NO: 3592786 - RNA, 19 nt, Human
agaccacccauaucaugca

SEQ ID NO: 3592787 - RNA, 14 nt, Human
agaccaccccgccu

SEQ ID NO: 3592788 - RNA, 16 nt, Human
agaccaccccgccugc

SEQ ID NO: 3592789 - RNA, 23 nt, Human
agaccacgcccguccugccugug

SEQ ID NO: 3592790 - RNA, 14 nt, Human
agaccacugccaua

SEQ ID NO: 3592791 - RNA, 17 nt, Human
agaccagacuguggaga

SEQ ID NO: 3592792 - RNA, 18 nt, Human
agaccagacuguggagaa

SEQ ID NO: 3592793 - RNA, 16 nt, Human
agaccagagcucugga

SEQ ID NO: 3592794 - RNA, 15 nt, Human
agaccagcagacaga

SEQ ID NO: 3592795 - RNA, 21 nt, Human
agaccagcagacagagccagg

SEQ ID NO: 3592796 - RNA, 22 nt, Human
agaccagccuggccaacauggc

SEQ ID NO: 3592797 - RNA, 13 nt, Human
agaccagcucuuc

SEQ ID NO: 3592798 - RNA, 16 nt, Human
agaccaggauuucuaa

SEQ ID NO: 3592799 - RNA, 17 nt, Human
agaccaggcaaagcaag

SEQ ID NO: 3592800 - RNA, 13 nt, Human
agaccaggcccug

SEQ ID NO: 3592801 - RNA, 15 nt, Human
agaccaggcuguguc

SEQ ID NO: 3592802 - RNA, 12 nt, Human
agaccagggcuc

SEQ ID NO: 3592803 - RNA, 22 nt, Human
agaccaguuagauuauugaaau

SEQ ID NO: 3592804 - RNA, 19 nt, Human
agaccaguugggagcacug

SEQ ID NO: 3592805 - RNA, 21 nt, Human
agaccaguugggagcacugga

SEQ ID NO: 3592806 - RNA, 13 nt, Human
agaccauaauguu

SEQ ID NO: 3592807 - RNA, 17 nt, Human
agaccauccaccaggcc

SEQ ID NO: 3592808 - RNA, 18 nt, Human
agaccaucccugaaggcc

SEQ ID NO: 3592809 - RNA, 23 nt, Human
agaccaucccugaaggccccgcc

SEQ ID NO: 3592810 - RNA, 14 nt, Human
agaccauccuggcu

SEQ ID NO: 3592811 - RNA, 18 nt, Human
agaccauuggggcuccca

SEQ ID NO: 3592812 - RNA, 22 nt, Human
agacccaacacaugggaccuau

SEQ ID NO: 3592813 - RNA, 13 nt, Human
agacccaccccac

SEQ ID NO: 3592814 - RNA, 18 nt, Human
agacccaccccaccugca

SEQ ID NO: 3592815 - RNA, 20 nt, Human
agacccaccccaccugcagg

SEQ ID NO: 3592816 - RNA, 12 nt, Human
agaccccaccca

SEQ ID NO: 3592817 - RNA, 23 nt, Human
agaccccacccaagcuuggcagc

SEQ ID NO: 3592818 - RNA, 13 nt, Human
agaccccaggcug

SEQ ID NO: 3592819 - RNA, 19 nt, Human
agacccccggaacaagccu

SEQ ID NO: 3592820 - RNA, 13 nt, Human
agacccccuggag

SEQ ID NO: 3592821 - RNA, 15 nt, Human
agacccccuggagac

SEQ ID NO: 3592822 - RNA, 17 nt, Human
agaccccucuggccagg

SEQ ID NO: 3592823 - RNA, 22 nt, Human
agaccccucuggccaggaugga

SEQ ID NO: 3592824 - RNA, 13 nt, Human
agaccccuggcug

SEQ ID NO: 3592825 - RNA, 21 nt, Human
agaccccuggcuuuucacugc

SEQ ID NO: 3592826 - RNA, 23 nt, Human
agaccccugucuuugcugagagc

SEQ ID NO: 3592827 - RNA, 14 nt, Human
agacccggcugcgu

SEQ ID NO: 3592828 - RNA, 16 nt, Human
agacccuaccccacca

SEQ ID NO: 3592829 - RNA, 24 nt, Human
agacccucaugcugccaauauccu

SEQ ID NO: 3592830 - RNA, 19 nt, Human
agacccucgcccaacucca

SEQ ID NO: 3592831 - RNA, 14 nt, Human
agacccucguggcc

SEQ ID NO: 3592832 - RNA, 12 nt, Human
agacccucucaa

SEQ ID NO: 3592833 - RNA, 16 nt, Human
agacccucucaaacua

SEQ ID NO: 3592834 - RNA, 16 nt, Human
agacccucugccacca

SEQ ID NO: 3592835 - RNA, 20 nt, Human
agacccucugccaccagaga

SEQ ID NO: 3592836 - RNA, 12 nt, Human
agacccugcccu

SEQ ID NO: 3592837 - RNA, 14 nt, Human
agacccugcccugu

SEQ ID NO: 3592838 - RNA, 16 nt, Human
agacccugcccugugg

SEQ ID NO: 3592839 - RNA, 22 nt, Human
agacccugggugggcucugugc

SEQ ID NO: 3592840 - RNA, 12 nt, Human
agacccugucuc

SEQ ID NO: 3592841 - RNA, 21 nt, Human
agacccuuauugcuguccugg

SEQ ID NO: 3592842 - RNA, 22 nt, Human
agacccuuguggucccacccca

SEQ ID NO: 3592843 - RNA, 22 nt, Human
agacccuuucuucagcucugaa

SEQ ID NO: 3592844 - RNA, 17 nt, Human
agacccuuuuggguuuc

SEQ ID NO: 3592845 - RNA, 17 nt, Human
agaccgaacuguuguau

SEQ ID NO: 3592846 - RNA, 16 nt, Human
agaccgagugaaccua

SEQ ID NO: 3592847 - RNA, 17 nt, Human
agaccgcucucuuuucu

SEQ ID NO: 3592848 - RNA, 16 nt, Human
agaccggaagcuccug

SEQ ID NO: 3592849 - RNA, 20 nt, Human
agaccggccugccaggagga

SEQ ID NO: 3592850 - RNA, 23 nt, Human
agaccggccugccaggaggaccc

SEQ ID NO: 3592851 - RNA, 14 nt, Human
agaccguccucacc

SEQ ID NO: 3592852 - RNA, 19 nt, Human
agaccguccucaccccugu

SEQ ID NO: 3592853 - RNA, 23 nt, Human
agaccgucgggggcugaggggca

SEQ ID NO: 3592854 - RNA, 14 nt, Human
agaccgucuuccuc

SEQ ID NO: 3592855 - RNA, 18 nt, Human
agaccgucuuccuccaac

SEQ ID NO: 3592856 - RNA, 18 nt, Human
agaccgugaagauacuuu

SEQ ID NO: 3592857 - RNA, 21 nt, Human
agaccgugaagauacuuugua

SEQ ID NO: 3592858 - RNA, 12 nt, Human
agaccuaaccag

SEQ ID NO: 3592859 - RNA, 18 nt, Human
agaccuaaugcuccuugu

SEQ ID NO: 3592860 - RNA, 11 nt, Human
agaccuacagg

SEQ ID NO: 3592861 - RNA, 16 nt, Human
agaccuacaggcugac

SEQ ID NO: 3592862 - RNA, 22 nt, Human
agaccuacagggggucuggcug

SEQ ID NO: 3592863 - RNA, 23 nt, Human
agaccuacagggggucuggcugg

SEQ ID NO: 3592864 - RNA, 14 nt, Human
agaccuaccucagg

SEQ ID NO: 3592865 - RNA, 16 nt, Human
agaccuaccucagguu

SEQ ID NO: 3592866 - RNA, 15 nt, Human
agaccuacuguucua

SEQ ID NO: 3592867 - RNA, 21 nt, Human
agaccuacuguucuaaagcuc

SEQ ID NO: 3592868 - RNA, 12 nt, Human
agaccucagcca

SEQ ID NO: 3592869 - RNA, 12 nt, Human
agaccucagccu

SEQ ID NO: 3592870 - RNA, 13 nt, Human
agaccucagccug

SEQ ID NO: 3592871 - RNA, 19 nt, Human
agaccucagccugugcugc

SEQ ID NO: 3592872 - RNA, 20 nt, Human
agaccucagccugugcugcc

SEQ ID NO: 3592873 - RNA, 13 nt, Human
agaccucagggca

SEQ ID NO: 3592874 - RNA, 17 nt, Human
agaccucaucaggauga

SEQ ID NO: 3592875 - RNA, 18 nt, Human
agaccucaucaggaugaa

SEQ ID NO: 3592876 - RNA, 22 nt, Human
agaccucaucaggaugaaccca

SEQ ID NO: 3592877 - RNA, 14 nt, Human
agaccuccccagcc

SEQ ID NO: 3592878 - RNA, 15 nt, Human
agaccuccccagccc

SEQ ID NO: 3592879 - RNA, 16 nt, Human
agaccucgagcagaug

SEQ ID NO: 3592880 - RNA, 19 nt, Human
agaccucuacugccuugga

SEQ ID NO: 3592881 - RNA, 13 nt, Human
agaccugaagaau

SEQ ID NO: 3592882 - RNA, 19 nt, Human
agaccugacaccuuucaua

SEQ ID NO: 3592883 - RNA, 19 nt, Human
agaccugauccuggaggcc

SEQ ID NO: 3592884 - RNA, 23 nt, Human
agaccugauccuggaggcccagu

SEQ ID NO: 3592885 - RNA, 12 nt, Human
agaccugccccu

SEQ ID NO: 3592886 - RNA, 13 nt, Human
agaccugccccuc

SEQ ID NO: 3592887 - RNA, 20 nt, Human
agaccuggaagaacaggccu

SEQ ID NO: 3592888 - RNA, 21 nt, Human
agaccuggaagaacaggccuc

SEQ ID NO: 3592889 - RNA, 19 nt, Human
agaccuggacacaggccug

SEQ ID NO: 3592890 - RNA, 19 nt, Human
agaccuggagccccugggu

SEQ ID NO: 3592891 - RNA, 20 nt, Human
agaccuggagccccugggug

SEQ ID NO: 3592892 - RNA, 21 nt, Human
agacugcuucccauccuaccc

SEQ ID NO: 3592893 - RNA, 17 nt, Human
agacuggaaaaaaugag

SEQ ID NO: 3592894 - RNA, 13 nt, Human
agacuggaacuug

SEQ ID NO: 3592895 - RNA, 17 nt, Human
agacuggaagcacagcu

SEQ ID NO: 3592896 - RNA, 21 nt, Human
agacuggaaguucauaccuaa

SEQ ID NO: 3592897 - RNA, 13 nt, Human
agacuggacagcu

SEQ ID NO: 3592898 - RNA, 14 nt, Human
agacuggagcaucu

SEQ ID NO: 3592899 - RNA, 18 nt, Human
agacuggagcaucugacu

SEQ ID NO: 3592900 - RNA, 11 nt, Human
agacuggaggg

SEQ ID NO: 3592901 - RNA, 21 nt, Human
agacuggauaguccgucucug

SEQ ID NO: 3592902 - RNA, 15 nt, Human
agacuggcacaguuu

SEQ ID NO: 3592903 - RNA, 21 nt, Human
agacuggcacaguuuucugag

SEQ ID NO: 3592904 - RNA, 16 nt, Human
agacuggccugaggag

SEQ ID NO: 3592905 - RNA, 18 nt, Human
agacuggcgugaacccag

SEQ ID NO: 3592906 - RNA, 22 nt, Human
agacuggcgugaacccaggagg

SEQ ID NO: 3592907 - RNA, 23 nt, Human
agacuggcgugaacccaggaggc

SEQ ID NO: 3592908 - RNA, 11 nt, Human
agacuggcuuu

SEQ ID NO: 3592909 - RNA, 22 nt, Human
agacuggcuuuuauuaaugcac

SEQ ID NO: 3592910 - RNA, 23 nt, Human
agacuggcuuuuauuaaugcacu

SEQ ID NO: 3592911 - RNA, 19 nt, Human
agacugggaaggcuuggga

SEQ ID NO: 3592912 - RNA, 16 nt, Human
agacugggcugaggga

SEQ ID NO: 3592913 - RNA, 18 nt, Human
agacuggggggcuugaaa

SEQ ID NO: 3592914 - RNA, 17 nt, Human
agacugguccugugugc

SEQ ID NO: 3592915 - RNA, 17 nt, Human
agacuggugacugauuc

SEQ ID NO: 3592916 - RNA, 23 nt, Human
agacuggugagcagacugguggg

SEQ ID NO: 3592917 - RNA, 15 nt, Human
agacugguuuucugc

SEQ ID NO: 3592918 - RNA, 16 nt, Human
agacuguacaaaguag

SEQ ID NO: 3592919 - RNA, 22 nt, Human
agacuguagauugcuucuguag

SEQ ID NO: 3592920 - RNA, 23 nt, Human
agacuguagauugcuucuguagu

SEQ ID NO: 3592921 - RNA, 21 nt, Human
agacugucagcuuccaaacau

SEQ ID NO: 3592922 - RNA, 20 nt, Human
acguuccgggcaaaugccag

SEQ ID NO: 3592923 - RNA, 18 nt, Human
acguuccuauugucauua

SEQ ID NO: 3592924 - RNA, 20 nt, Human
acguuccuauugucauuaaa

SEQ ID NO: 3592925 - RNA, 21 nt, Human
acguuccuauugucauuaaag

SEQ ID NO: 3592926 - RNA, 18 nt, Human
acguuccuuacugcagaa

SEQ ID NO: 3592927 - RNA, 14 nt, Human
acguucggggcaug

SEQ ID NO: 3592928 - RNA, 15 nt, Human
acguucucacaccca

SEQ ID NO: 3592929 - RNA, 16 nt, Human
acguugagccccugga

SEQ ID NO: 3592930 - RNA, 11 nt, Human
acguugcugug

SEQ ID NO: 3592931 - RNA, 15 nt, Human
acguugcugugggaa

SEQ ID NO: 3592932 - RNA, 19 nt, Human
acguuggacuuuucguuaa

SEQ ID NO: 3592933 - RNA, 21 nt, Human
acguuggacuuuucguuaaca

SEQ ID NO: 3592934 - RNA, 19 nt, Human
acguuggagaagcccgugu

SEQ ID NO: 3592935 - RNA, 13 nt, Human
acguugugcauuu

SEQ ID NO: 3592936 - RNA, 13 nt, Human
acguuuaaaguuc

SEQ ID NO: 3592937 - RNA, 14 nt, Human
acguuuaaaguucu

SEQ ID NO: 3592938 - RNA, 15 nt, Human
acguuuaaaguucug

SEQ ID NO: 3592939 - RNA, 23 nt, Human
acguuuaagccaaaacaauguuu

SEQ ID NO: 3592940 - RNA, 18 nt, Human
acguuuacaagccccccc

SEQ ID NO: 3592941 - RNA, 16 nt, Human
acguuuauaaacagaa

SEQ ID NO: 3592942 - RNA, 15 nt, Human
acguuuccugagaag

SEQ ID NO: 3592943 - RNA, 14 nt, Human
acguuucuaaaggc

SEQ ID NO: 3592944 - RNA, 16 nt, Human
acguuucuaaaggcua

SEQ ID NO: 3592945 - RNA, 12 nt, Human
acguuucuucac

SEQ ID NO: 3592946 - RNA, 13 nt, Human
acguuuguaugug

SEQ ID NO: 3592947 - RNA, 12 nt, Human
acguuuuaagga

SEQ ID NO: 3592948 - RNA, 14 nt, Human
acguuuuaaggacu

SEQ ID NO: 3592949 - RNA, 18 nt, Human
acguuuuaaggacugacu

SEQ ID NO: 3592950 - RNA, 14 nt, Human
acguuuuauaagca

SEQ ID NO: 3592951 - RNA, 15 nt, Human
acguuuuauuguguu

SEQ ID NO: 3592952 - RNA, 16 nt, Human
acguuuuauuguguuu

SEQ ID NO: 3592953 - RNA, 13 nt, Human
acguuuucuaauu

SEQ ID NO: 3592954 - RNA, 20 nt, Human
acguuuuguuugaaaaagca

SEQ ID NO: 3592955 - RNA, 20 nt, Human
acguuuuuaauauaaagccu

SEQ ID NO: 3592956 - RNA, 14 nt, Human
acguuuuuccuuua

SEQ ID NO: 3592957 - RNA, 15 nt, Human
acuaaaaaaaagaug

SEQ ID NO: 3592958 - RNA, 17 nt, Human
acuaaaaaaaagaugaa

SEQ ID NO: 3592959 - RNA, 16 nt, Human
acuaaaaagaaggaaa

SEQ ID NO: 3592960 - RNA, 17 nt, Human
acuaaaaagaaggaaaa

SEQ ID NO: 3592961 - RNA, 20 nt, Human
acuaaaaaguauaaaauagu

SEQ ID NO: 3592962 - RNA, 21 nt, Human
acuaaaaaguauaaaauagua

SEQ ID NO: 3592963 - RNA, 13 nt, Human
acuaaaaauauua

SEQ ID NO: 3592964 - RNA, 15 nt, Human
acuaaaaaugcaaaa

SEQ ID NO: 3592965 - RNA, 19 nt, Human
acuaaaacaaagccacuuu

SEQ ID NO: 3592966 - RNA, 15 nt, Human
acuaaaagacauuug

SEQ ID NO: 3592967 - RNA, 11 nt, Human
acuaaaagaua

SEQ ID NO: 3592968 - RNA, 14 nt, Human
acuaaaauaauuuu

SEQ ID NO: 3592969 - RNA, 16 nt, Human
acuaaaauaauuuugu

SEQ ID NO: 3592970 - RNA, 19 nt, Human
acuaaaauaauuuuguaau

SEQ ID NO: 3592971 - RNA, 20 nt, Human
acuaaaauaauuuuguaaug

SEQ ID NO: 3592972 - RNA, 16 nt, Human
acuaaaauguaucuaa

SEQ ID NO: 3592973 - RNA, 13 nt, Human
acuaaacauuuug

SEQ ID NO: 3592974 - RNA, 14 nt, Human
acuaaacauuuugu

SEQ ID NO: 3592975 - RNA, 23 nt, Human
acuaaacucucuuugggaauguu

SEQ ID NO: 3592976 - RNA, 22 nt, Human
acuaaacucugaauaagcacuu

SEQ ID NO: 3592977 - RNA, 17 nt, Human
acuaaacucuuaccaua

SEQ ID NO: 3592978 - RNA, 20 nt, Human
acuaaacuuuuuuucuguac

SEQ ID NO: 3592979 - RNA, 18 nt, Human
acuaaagaagaucuguaa

SEQ ID NO: 3592980 - RNA, 17 nt, Human
acuaaagcaggccuuuu

SEQ ID NO: 3592981 - RNA, 20 nt, Human
acuaaagcaggccuuuugau

SEQ ID NO: 3592982 - RNA, 20 nt, Human
acuaaagcaugaaaugugaa

SEQ ID NO: 3592983 - RNA, 23 nt, Human
acuaaagccaaacauauauauac

SEQ ID NO: 3592984 - RNA, 12 nt, Human
acuaaagccuuu

SEQ ID NO: 3592985 - RNA, 22 nt, Human
acuaaagguggccacaaauucu

SEQ ID NO: 3592986 - RNA, 14 nt, Human
acuaaaguauguaa

SEQ ID NO: 3592987 - RNA, 15 nt, Human
acuaaaucagagaca

SEQ ID NO: 3592988 - RNA, 19 nt, Human
acuaaaucagagacaaaau

SEQ ID NO: 3592989 - RNA, 14 nt, Human
acuaaaucucuaau

SEQ ID NO: 3592990 - RNA, 19 nt, Human
acuaaaucuguaagcucuu

SEQ ID NO: 3592991 - RNA, 23 nt, Human
acuaaaucuguaagcucuuugaa

SEQ ID NO: 3592992 - RNA, 14 nt, Human
acuaaauguuaaag

SEQ ID NO: 3592993 - RNA, 15 nt, Human
acuaaauguuaaaga

SEQ ID NO: 3592994 - RNA, 13 nt, Human
acuaaauguucua

SEQ ID NO: 3592995 - RNA, 15 nt, Human
acuaaauuugauacu

SEQ ID NO: 3592996 - RNA, 24 nt, Human
acuaaauuuggggacagauucagu

SEQ ID NO: 3592997 - RNA, 13 nt, Human
acuaaauuuuaaa

SEQ ID NO: 3592998 - RNA, 20 nt, Human
acuaacaaaguuuucaugug

SEQ ID NO: 3592999 - RNA, 18 nt, Human
acuaacaaccaaagacua

SEQ ID NO: 3593000 - RNA, 19 nt, Human
acuaacacucagaagccug

SEQ ID NO: 3593001 - RNA, 13 nt, Human
acuaacagauaag

SEQ ID NO: 3593002 - RNA, 17 nt, Human
acuaacaggcuuaguga

SEQ ID NO: 3593003 - RNA, 18 nt, Human
acuaacaggcuuagugau

SEQ ID NO: 3593004 - RNA, 15 nt, Human
acuaacauauaaugu

SEQ ID NO: 3593005 - RNA, 17 nt, Human
acuaacauauaauguug

SEQ ID NO: 3593006 - RNA, 17 nt, Human
acuaacauguccugccu

SEQ ID NO: 3593007 - RNA, 18 nt, Human
acuaaccaagcugaguuu

SEQ ID NO: 3593008 - RNA, 12 nt, Human
acuaaccacgcu

SEQ ID NO: 3593009 - RNA, 21 nt, Human
acuaaccauguguuauguuuu

SEQ ID NO: 3593010 - RNA, 21 nt, Human
acuaaccccaacgcacaggaa

SEQ ID NO: 3593011 - RNA, 22 nt, Human
acuaaccuuccaaaaauuacuu

SEQ ID NO: 3593012 - RNA, 20 nt, Human
acuaacuagacaccaaaguu

SEQ ID NO: 3593013 - RNA, 22 nt, Human
acuaacuagacaccaaaguucu

SEQ ID NO: 3593014 - RNA, 12 nt, Human
acuaacuagagc

SEQ ID NO: 3593015 - RNA, 17 nt, Human
acuaacuaucaaauaga

SEQ ID NO: 3593016 - RNA, 18 nt, Human
acuaacucaaauacacau

SEQ ID NO: 3593017 - RNA, 22 nt, Human
acuaacucaaauacacauuugc

SEQ ID NO: 3593018 - RNA, 22 nt, Human
acuaacucaccagccccacugc

SEQ ID NO: 3593019 - RNA, 21 nt, Human
acuaacuccugagaaauguua

SEQ ID NO: 3593020 - RNA, 23 nt, Human
acuaacuuauuuauguuaaaaga

SEQ ID NO: 3593021 - RNA, 13 nt, Human
acuaacuucuaaa

SEQ ID NO: 3593022 - RNA, 16 nt, Human
acuaacuucuaaaacu

SEQ ID NO: 3593023 - RNA, 19 nt, Human
acuaacuucuaaaacugua

SEQ ID NO: 3593024 - RNA, 12 nt, Human
acuaagaaacuu

SEQ ID NO: 3593025 - RNA, 15 nt, Human
acuaagaaacuuuug

SEQ ID NO: 3593026 - RNA, 23 nt, Human
acuaagaaauauuccaaaugucu

SEQ ID NO: 3593027 - RNA, 14 nt, Human
acuaagaagaaaau

SEQ ID NO: 3593028 - RNA, 16 nt, Human
acuaagagagaaugag

SEQ ID NO: 3593029 - RNA, 15 nt, Human
acuaagaggcaaacc

SEQ ID NO: 3593030 - RNA, 19 nt, Human
acuaagaucgguuaacaaa

SEQ ID NO: 3593031 - RNA, 12 nt, Human
acuaagcagagg

SEQ ID NO: 3593032 - RNA, 15 nt, Human
acuaagcagaggagg

SEQ ID NO: 3593033 - RNA, 19 nt, Human
acuaagcagaggaggggcc

SEQ ID NO: 3593034 - RNA, 12 nt, Human
acuaagcauuuc

SEQ ID NO: 3593035 - RNA, 18 nt, Human
acuaagccagcaccggac

SEQ ID NO: 3593036 - RNA, 22 nt, Human
acuaagcccugucgagacacuu

SEQ ID NO: 3593037 - RNA, 15 nt, Human
acuggccaccaggcu

SEQ ID NO: 3593038 - RNA, 16 nt, Human
acuggccaccaggcug

SEQ ID NO: 3593039 - RNA, 17 nt, Human
acuggccaccaggcugg

SEQ ID NO: 3593040 - RNA, 11 nt, Human
acuggccaggg

SEQ ID NO: 3593041 - RNA, 23 nt, Human
acuggccaguggcuggaucugug

SEQ ID NO: 3593042 - RNA, 16 nt, Human
acuggccauggccugc

SEQ ID NO: 3593043 - RNA, 14 nt, Human
acuggcccucuucu

SEQ ID NO: 3593044 - RNA, 16 nt, Human
acuggcccucuucuua

SEQ ID NO: 3593045 - RNA, 17 nt, Human
acuggcccucuucuuac

SEQ ID NO: 3593046 - RNA, 22 nt, Human
acuggccggucugcaagucaga

SEQ ID NO: 3593047 - RNA, 17 nt, Human
acuggccucaaagcaag

SEQ ID NO: 3593048 - RNA, 22 nt, Human
acuggccucaaagcaagcauuc

SEQ ID NO: 3593049 - RNA, 16 nt, Human
acuggccucgccuggc

SEQ ID NO: 3593050 - RNA, 17 nt, Human
acuggccucgccuggcc

SEQ ID NO: 3593051 - RNA, 22 nt, Human
acuggccucgccuggccugagg

SEQ ID NO: 3593052 - RNA, 23 nt, Human
acuggccucgccuggccugaggu

SEQ ID NO: 3593053 - RNA, 16 nt, Human
acuggccucugcugau

SEQ ID NO: 3593054 - RNA, 17 nt, Human
acuggccugaggagcag

SEQ ID NO: 3593055 - RNA, 19 nt, Human
acuggccuucugaugaaau

SEQ ID NO: 3593056 - RNA, 19 nt, Human
acuggcgacacguagcagc

SEQ ID NO: 3593057 - RNA, 21 nt, Human
acuggcgugaacccaggaggc

SEQ ID NO: 3593058 - RNA, 18 nt, Human
acuggcuagaguccucac

SEQ ID NO: 3593059 - RNA, 18 nt, Human
acuggcucacccaguccu

SEQ ID NO: 3593060 - RNA, 22 nt, Human
acuggcucauauuccugcagcc

SEQ ID NO: 3593061 - RNA, 12 nt, Human
acuggcucucca

SEQ ID NO: 3593062 - RNA, 17 nt, Human
acuggcucuccaagugc

SEQ ID NO: 3593063 - RNA, 14 nt, Human
acuggcucucucca

SEQ ID NO: 3593064 - RNA, 23 nt, Human
acuggcucucuccaggauccaga

SEQ ID NO: 3593065 - RNA, 12 nt, Human
acuggcugccuc

SEQ ID NO: 3593066 - RNA, 14 nt, Human
acuggcugccucca

SEQ ID NO: 3593067 - RNA, 16 nt, Human
acuggcugccuccacu

SEQ ID NO: 3593068 - RNA, 19 nt, Human
acuggcugccuccacuccc

SEQ ID NO: 3593069 - RNA, 22 nt, Human
acuggcugccuccacucccacu

SEQ ID NO: 3593070 - RNA, 21 nt, Human
acuggcugucaguaugacauu

SEQ ID NO: 3593071 - RNA, 18 nt, Human
acuggcuuaccuccucau

SEQ ID NO: 3593072 - RNA, 13 nt, Human
acuggcuuuggcu

SEQ ID NO: 3593073 - RNA, 16 nt, Human
acuggcuuuggcuucu

SEQ ID NO: 3593074 - RNA, 19 nt, Human
acuggcuuugucccacagc

SEQ ID NO: 3593075 - RNA, 21 nt, Human
acuggcuuugucccacagcuu

SEQ ID NO: 3593076 - RNA, 16 nt, Human
acugggaacagaacuc

SEQ ID NO: 3593077 - RNA, 17 nt, Human
acugggaaccccuuucc

SEQ ID NO: 3593078 - RNA, 22 nt, Human
acugggaagauaggcucugcac

SEQ ID NO: 3593079 - RNA, 23 nt, Human
acugggaagauaggcucugcaca

SEQ ID NO: 3593080 - RNA, 16 nt, Human
acugggaagugacuua

SEQ ID NO: 3593081 - RNA, 17 nt, Human
acugggagaaaugaaaa

SEQ ID NO: 3593082 - RNA, 15 nt, Human
acugggagcccccag

SEQ ID NO: 3593083 - RNA, 23 nt, Human
acugggagccuacccacccccag

SEQ ID NO: 3593084 - RNA, 23 nt, Human
acugggcaugagggguuccuccc

SEQ ID NO: 3593085 - RNA, 20 nt, Human
acugggccauguugugccuc

SEQ ID NO: 3593086 - RNA, 21 nt, Human
acugggccuuagugggccagg

SEQ ID NO: 3593087 - RNA, 21 nt, Human
acugggcugaacacuccaauu

SEQ ID NO: 3593088 - RNA, 22 nt, Human
acugggcuuggggaccagagcu

SEQ ID NO: 3593089 - RNA, 13 nt, Human
acuggggagcccg

SEQ ID NO: 3593090 - RNA, 21 nt, Human
acuggggagcccgucucagug

SEQ ID NO: 3593091 - RNA, 12 nt, Human
acuggggcacuu

SEQ ID NO: 3593092 - RNA, 16 nt, Human
acauuguguugacauu

SEQ ID NO: 3593093 - RNA, 17 nt, Human
acauuguuaagaaaaau

SEQ ID NO: 3593094 - RNA, 16 nt, Human
acauuguucaauuaga

SEQ ID NO: 3593095 - RNA, 18 nt, Human
acauuuaaaacauuaaaa

SEQ ID NO: 3593096 - RNA, 17 nt, Human
acauuuaaaauugcuau

SEQ ID NO: 3593097 - RNA, 19 nt, Human
acauuuaaagcauugcugu

SEQ ID NO: 3593098 - RNA, 20 nt, Human
acauuuaagagacagucacc

SEQ ID NO: 3593099 - RNA, 16 nt, Human
acauuuaauaucuuca

SEQ ID NO: 3593100 - RNA, 11 nt, Human
acauuuaauug

SEQ ID NO: 3593101 - RNA, 16 nt, Human
acauuuacaaacugaa

SEQ ID NO: 3593102 - RNA, 17 nt, Human
acauuuacaaacugaag

SEQ ID NO: 3593103 - RNA, 12 nt, Human
acauuuacaguc

SEQ ID NO: 3593104 - RNA, 21 nt, Human
acauuuacaguccuucaaaau

SEQ ID NO: 3593105 - RNA, 18 nt, Human
acauuuaccaaucauauu

SEQ ID NO: 3593106 - RNA, 21 nt, Human
acauuuagagaacuguggccg

SEQ ID NO: 3593107 - RNA, 17 nt, Human
acauuuagucucuuuau

SEQ ID NO: 3593108 - RNA, 20 nt, Human
acauuuauaauguuugcuau

SEQ ID NO: 3593109 - RNA, 14 nt, Human
acauuuauuuccuc

SEQ ID NO: 3593110 - RNA, 15 nt, Human
acauuuauuuccucc

SEQ ID NO: 3593111 - RNA, 15 nt, Human
acauuuauuuuauga

SEQ ID NO: 3593112 - RNA, 18 nt, Human
acauuuauuuuaugagaa

SEQ ID NO: 3593113 - RNA, 22 nt, Human
acauuuauuuuuuuuaaagaaa

SEQ ID NO: 3593114 - RNA, 15 nt, Human
acauuucacugucug

SEQ ID NO: 3593115 - RNA, 15 nt, Human
acauuucccugugcu

SEQ ID NO: 3593116 - RNA, 19 nt, Human
acauuuccgccacaucccu

SEQ ID NO: 3593117 - RNA, 20 nt, Human
acauuucuauagccaaaaau

SEQ ID NO: 3593118 - RNA, 22 nt, Human
acauuucuccuuugauaaaaua

SEQ ID NO: 3593119 - RNA, 23 nt, Human
acauuucucuaagagaacaaugu

SEQ ID NO: 3593120 - RNA, 23 nt, Human
acauuucuuagacuacauuuaga

SEQ ID NO: 3593121 - RNA, 15 nt, Human
acauuucuuuucuuu

SEQ ID NO: 3593122 - RNA, 20 nt, Human
acauuucuuuucuuuuuaca

SEQ ID NO: 3593123 - RNA, 19 nt, Human
acauuugagucccuuccag

SEQ ID NO: 3593124 - RNA, 20 nt, Human
acauuugaugcaugucuuuu

SEQ ID NO: 3593125 - RNA, 16 nt, Human
acauuugcucauggaa

SEQ ID NO: 3593126 - RNA, 22 nt, Human
acauuugcuguuuuaaacauua

SEQ ID NO: 3593127 - RNA, 21 nt, Human
acauuuggaacuaacacguga

SEQ ID NO: 3593128 - RNA, 15 nt, Human
acauuuggaauacuu

SEQ ID NO: 3593129 - RNA, 17 nt, Human
acauuuggaauacuuuu

SEQ ID NO: 3593130 - RNA, 18 nt, Human
acauuuggaauacuuuuu

SEQ ID NO: 3593131 - RNA, 22 nt, Human
acauuuggaggcaauccuaccu

SEQ ID NO: 3593132 - RNA, 19 nt, Human
acauuugggagacauguga

SEQ ID NO: 3593133 - RNA, 18 nt, Human
acauuuggguaaaucaug

SEQ ID NO: 3593134 - RNA, 18 nt, Human
acauuuggguuacuauuu

SEQ ID NO: 3593135 - RNA, 14 nt, Human
acauuugguaaugu

SEQ ID NO: 3593136 - RNA, 19 nt, Human
acauuugguaauguuuuua

SEQ ID NO: 3593137 - RNA, 14 nt, Human
acauuugucauuuu

SEQ ID NO: 3593138 - RNA, 19 nt, Human
acauuugugauauauguau

SEQ ID NO: 3593139 - RNA, 19 nt, Human
acauuugugccgacacugu

SEQ ID NO: 3593140 - RNA, 21 nt, Human
acauuugugccgacacuguuc

SEQ ID NO: 3593141 - RNA, 19 nt, Human
acauuuguucuauagcuuu

SEQ ID NO: 3593142 - RNA, 23 nt, Human
acauuuguuugguuauagugcaa

SEQ ID NO: 3593143 - RNA, 23 nt, Human
acauuuuaaaaacauagaaaaau

SEQ ID NO: 3593144 - RNA, 20 nt, Human
acauuuuaaauaaaagaaaa

SEQ ID NO: 3593145 - RNA, 18 nt, Human
acauuuuaaauggacaga

SEQ ID NO: 3593146 - RNA, 13 nt, Human
acauuuuaacaag

SEQ ID NO: 3593147 - RNA, 15 nt, Human
acauuuuaacaagaa

SEQ ID NO: 3593148 - RNA, 17 nt, Human
acauuuuaacaagaaga

SEQ ID NO: 3593149 - RNA, 18 nt, Human
acauuuuaacaagaagau

SEQ ID NO: 3593150 - RNA, 12 nt, Human
acauuuuaacau

SEQ ID NO: 3593151 - RNA, 13 nt, Human
acauuuuaacaug

SEQ ID NO: 3593152 - RNA, 13 nt, Human
acauuuuaauuca

SEQ ID NO: 3593153 - RNA, 16 nt, Human
acauuuuacacacugu

SEQ ID NO: 3593154 - RNA, 20 nt, Human
acauuuuauggugccuagua

SEQ ID NO: 3593155 - RNA, 13 nt, Human
acauuuuauuaag

SEQ ID NO: 3593156 - RNA, 18 nt, Human
acauuuuauuuuauuaug

SEQ ID NO: 3593157 - RNA, 22 nt, Human
acauuuucagaaauauucauga

SEQ ID NO: 3593158 - RNA, 14 nt, Human
acauuuucagccaa

SEQ ID NO: 3593159 - RNA, 12 nt, Human
acauuuucagug

SEQ ID NO: 3593160 - RNA, 17 nt, Human
acauuuugaaagucugu

SEQ ID NO: 3593161 - RNA, 12 nt, Human
acauuuugagaa

SEQ ID NO: 3593162 - RNA, 18 nt, Human
acauuuuggugagaaaug

SEQ ID NO: 3593163 - RNA, 12 nt, Human
acauuuuguaua

SEQ ID NO: 3593164 - RNA, 18 nt, Human
acauuuuguucuuacaca

SEQ ID NO: 3593165 - RNA, 19 nt, Human
acauuuuguucuuacacau

SEQ ID NO: 3593166 - RNA, 17 nt, Human
acauuuuguuguaaaaa

SEQ ID NO: 3593167 - RNA, 21 nt, Human
acauuuuguuguaaaaagaaa

SEQ ID NO: 3593168 - RNA, 21 nt, Human
acauuuuuaagugcugcauuu

SEQ ID NO: 3593169 - RNA, 12 nt, Human
acauuuuuacaa

SEQ ID NO: 3593170 - RNA, 15 nt, Human
acauuuuuacaauaa

SEQ ID NO: 3593171 - RNA, 18 nt, Human
acauuuuuagccuguguc

SEQ ID NO: 3593172 - RNA, 16 nt, Human
acauuuuuauaccugu

SEQ ID NO: 3593173 - RNA, 19 nt, Human
acauuuuucaacuuugaau

SEQ ID NO: 3593174 - RNA, 21 nt, Human
acauuuuucaacuuugaauaa

SEQ ID NO: 3593175 - RNA, 22 nt, Human
acauuuuucaacuuugaauaaa

SEQ ID NO: 3593176 - RNA, 21 nt, Human
acauuuuuccguuugcuuuug

SEQ ID NO: 3593177 - RNA, 12 nt, Human
acauuuuuuaaa

SEQ ID NO: 3593178 - RNA, 17 nt, Human
acauuuuuuaaaugcac

SEQ ID NO: 3593179 - RNA, 21 nt, Human
acauuuuuuaaaugcaccugg

SEQ ID NO: 3593180 - RNA, 14 nt, Human
acauuuuuuaagcu

SEQ ID NO: 3593181 - RNA, 14 nt, Human
acaguauuuuccca

SEQ ID NO: 3593182 - RNA, 16 nt, Human
acagucaaaacagaga

SEQ ID NO: 3593183 - RNA, 16 nt, Human
acagucaaaauaauuc

SEQ ID NO: 3593184 - RNA, 18 nt, Human
acagucaaggaguggcuu

SEQ ID NO: 3593185 - RNA, 13 nt, Human
acagucacaaauu

SEQ ID NO: 3593186 - RNA, 20 nt, Human
acagucacugccacuuugca

SEQ ID NO: 3593187 - RNA, 18 nt, Human
acagucagcucuucaucu

SEQ ID NO: 3593188 - RNA, 15 nt, Human
acagucagguugaag

SEQ ID NO: 3593189 - RNA, 16 nt, Human
acagucagguugaaga

SEQ ID NO: 3593190 - RNA, 14 nt, Human
acagucaucaucag

SEQ ID NO: 3593191 - RNA, 18 nt, Human
acagucaucaucagggcc

SEQ ID NO: 3593192 - RNA, 21 nt, Human
acagucaucaucagggccugg

SEQ ID NO: 3593193 - RNA, 17 nt, Human
acagucaucgcucgugu

SEQ ID NO: 3593194 - RNA, 15 nt, Human
acaguccagccugga

SEQ ID NO: 3593195 - RNA, 19 nt, Human
acagucccacugugcaggu

SEQ ID NO: 3593196 - RNA, 15 nt, Human
acagucccugccaau

SEQ ID NO: 3593197 - RNA, 17 nt, Human
acaguccgucaaaacag

SEQ ID NO: 3593198 - RNA, 21 nt, Human
acaguccgucaaaacagauug

SEQ ID NO: 3593199 - RNA, 18 nt, Human
acaguccuaacugguaua

SEQ ID NO: 3593200 - RNA, 19 nt, Human
acaguccuaacugguauag

SEQ ID NO: 3593201 - RNA, 15 nt, Human
acaguccucccaucu

SEQ ID NO: 3593202 - RNA, 22 nt, Human
acaguccuuaccagcagagcac

SEQ ID NO: 3593203 - RNA, 18 nt, Human
acagucuaauuuuuauuc

SEQ ID NO: 3593204 - RNA, 19 nt, Human
acagucuccggccucucca

SEQ ID NO: 3593205 - RNA, 19 nt, Human
acagucucuuuaaucuuca

SEQ ID NO: 3593206 - RNA, 13 nt, Human
acagucugucuuc

SEQ ID NO: 3593207 - RNA, 23 nt, Human
acagucuucauuuuuuuuaauug

SEQ ID NO: 3593208 - RNA, 21 nt, Human
acagucuuccacaaagaaaau

SEQ ID NO: 3593209 - RNA, 15 nt, Human
acagucuuguauuaa

SEQ ID NO: 3593210 - RNA, 22 nt, Human
acagucuuguauuaaguuguua

SEQ ID NO: 3593211 - RNA, 14 nt, Human
acagugaagacaga

SEQ ID NO: 3593212 - RNA, 19 nt, Human
acagugaagacagaaguuu

SEQ ID NO: 3593213 - RNA, 21 nt, Human
acagugaagacagaaguuugc

SEQ ID NO: 3593214 - RNA, 17 nt, Human
acagugaaggcuguccu

SEQ ID NO: 3593215 - RNA, 14 nt, Human
acagugacccuucc

SEQ ID NO: 3593216 - RNA, 16 nt, Human
acagugacccuuccca

SEQ ID NO: 3593217 - RNA, 18 nt, Human
acagugacucgggcuccu

SEQ ID NO: 3593218 - RNA, 19 nt, Human
acagugacucgggcuccug

SEQ ID NO: 3593219 - RNA, 14 nt, Human
acagugacuucuga

SEQ ID NO: 3593220 - RNA, 12 nt, Human
acagugagccug

SEQ ID NO: 3593221 - RNA, 17 nt, Human
acagugaggugcccagc

SEQ ID NO: 3593222 - RNA, 23 nt, Human
acagugaucaaguuauuuuuaau

SEQ ID NO: 3593223 - RNA, 24 nt, Human
acagugaugcugugcuaugaauuu

SEQ ID NO: 3593224 - RNA, 22 nt, Human
acagugauuuuuuuuuagaaca

SEQ ID NO: 3593225 - RNA, 13 nt, Human
acagugcacauga

SEQ ID NO: 3593226 - RNA, 20 nt, Human
acagugcagagccuucucag

SEQ ID NO: 3593227 - RNA, 21 nt, Human
acagugcagagccuucucaga

SEQ ID NO: 3593228 - RNA, 20 nt, Human
acagugcauauuccuuucua

SEQ ID NO: 3593229 - RNA, 15 nt, Human
acagugcaucucagc

SEQ ID NO: 3593230 - RNA, 18 nt, Human
acagugcaucucagccca

SEQ ID NO: 3593231 - RNA, 16 nt, Human
acagugccauugucuu

SEQ ID NO: 3593232 - RNA, 18 nt, Human
acagugccauugucuuua

SEQ ID NO: 3593233 - RNA, 11 nt, Human
acagugccugc

SEQ ID NO: 3593234 - RNA, 13 nt, Human
acagugccugcug

SEQ ID NO: 3593235 - RNA, 21 nt, Human
acagugccuucaauaaauggu

SEQ ID NO: 3593236 - RNA, 14 nt, Human
acagugcuaaaaau

SEQ ID NO: 3593237 - RNA, 16 nt, Human
acagugcucuuuucuc

SEQ ID NO: 3593238 - RNA, 20 nt, Human
acagugcugaccagacagcc

SEQ ID NO: 3593239 - RNA, 21 nt, Human
acagugcugcagcucccuggc

SEQ ID NO: 3593240 - RNA, 14 nt, Human
acagugcugucuga

SEQ ID NO: 3593241 - RNA, 22 nt, Human
acagugcugucugaucugugcu

SEQ ID NO: 3593242 - RNA, 13 nt, Human
acagugcugugug

SEQ ID NO: 3593243 - RNA, 14 nt, Human
acagugcuucagcc

SEQ ID NO: 3593244 - RNA, 22 nt, Human
acagugcuucagccugaggcug

SEQ ID NO: 3593245 - RNA, 21 nt, Human
acagugcuugccacagagcgg

SEQ ID NO: 3593246 - RNA, 21 nt, Human
acagugcuuuuaagugaaaau

SEQ ID NO: 3593247 - RNA, 18 nt, Human
acaguggaaccagcccag

SEQ ID NO: 3593248 - RNA, 18 nt, Human
acaguggaacuacauuag

SEQ ID NO: 3593249 - RNA, 17 nt, Human
acaguggagugcaaaag

SEQ ID NO: 3593250 - RNA, 19 nt, Human
acaguggagugcaaaaggc

SEQ ID NO: 3593251 - RNA, 15 nt, Human
acaguggauugcuca

SEQ ID NO: 3593252 - RNA, 12 nt, Human
acaguggcagga

SEQ ID NO: 3593253 - RNA, 13 nt, Human
acaguggcaggac

SEQ ID NO: 3593254 - RNA, 12 nt, Human
acagugggaaau

SEQ ID NO: 3593255 - RNA, 15 nt, Human
acagugggaaauauu

SEQ ID NO: 3593256 - RNA, 18 nt, Human
acagugggaacucugaca

SEQ ID NO: 3593257 - RNA, 17 nt, Human
acagugggagccagggc

SEQ ID NO: 3593258 - RNA, 15 nt, Human
acaguggggaaugaa

SEQ ID NO: 3593259 - RNA, 19 nt, Human
acaguggggaaugaagaua

SEQ ID NO: 3593260 - RNA, 14 nt, Human
acagugggugcccc

SEQ ID NO: 3593261 - RNA, 15 nt, Human
acaguggguggugga

SEQ ID NO: 3593262 - RNA, 17 nt, Human
acagugguggcaacauu

SEQ ID NO: 3593263 - RNA, 21 nt, Human
acagugguggcaacauucauu

SEQ ID NO: 3593264 - RNA, 13 nt, Human
acagugguggcag

SEQ ID NO: 3593265 - RNA, 15 nt, Human
acagugguggcaggg

SEQ ID NO: 3593266 - RNA, 16 nt, Human
acagugguggcagggc

SEQ ID NO: 3593267 - RNA, 19 nt, Human
acagugguucuacaaucua

SEQ ID NO: 3593268 - RNA, 23 nt, Human
acagugguucuacaaucuauuua

SEQ ID NO: 3593269 - RNA, 22 nt, Human
acagugguuuuauacugaagga

SEQ ID NO: 3593270 - RNA, 15 nt, Human
acaguguacagucuu

SEQ ID NO: 3593271 - RNA, 18 nt, Human
acaguguacagucuugua

SEQ ID NO: 3593272 - RNA, 19 nt, Human
acaguguaccauuaaaaua

SEQ ID NO: 3593273 - RNA, 20 nt, Human
acaguguaccauuaaaauau

SEQ ID NO: 3593274 - RNA, 15 nt, Human
acagugucugggcug

SEQ ID NO: 3593275 - RNA, 16 nt, Human
acagugucugggcuga

SEQ ID NO: 3593276 - RNA, 23 nt, Human
acagugucuguaucggagacagu

SEQ ID NO: 3593277 - RNA, 22 nt, Human
acagugugcaaggcagccgugg

SEQ ID NO: 3593278 - RNA, 22 nt, Human
acaguguguggucaacauuucu

SEQ ID NO: 3593279 - RNA, 20 nt, Human
acaguguuauuuucuuugaa

SEQ ID NO: 3593280 - RNA, 13 nt, Human
acaguguucuguu

SEQ ID NO: 3593281 - RNA, 15 nt, Human
acaguguucuguuua

SEQ ID NO: 3593282 - RNA, 21 nt, Human
acaguguugaaaauguucaga

SEQ ID NO: 3593283 - RNA, 14 nt, Human
acaguguuuauccu

SEQ ID NO: 3593284 - RNA, 18 nt, Human
acaguguuuauccuuuca

SEQ ID NO: 3593285 - RNA, 15 nt, Human
acaguguuucccaua

SEQ ID NO: 3593286 - RNA, 16 nt, Human
acaguguuucccauaa

SEQ ID NO: 3593287 - RNA, 19 nt, Human
acaguguuucgacagcuga

SEQ ID NO: 3593288 - RNA, 20 nt, Human
acaguguuuuuguaaagugu

SEQ ID NO: 3593289 - RNA, 14 nt, Human
acaguuaacuuuca

SEQ ID NO: 3593290 - RNA, 16 nt, Human
acaguuaacuuucaga

SEQ ID NO: 3593291 - RNA, 15 nt, Human
acaguuaagagaaau

SEQ ID NO: 3593292 - RNA, 20 nt, Human
acaguuacuuuuccuugcau

SEQ ID NO: 3593293 - RNA, 23 nt, Human
acaguuacuuuuccuugcauaca

SEQ ID NO: 3593294 - RNA, 17 nt, Human
acaguuauaaaauuaaa

SEQ ID NO: 3593295 - RNA, 17 nt, Human
acaguuaucuaaguuaa

SEQ ID NO: 3593296 - RNA, 18 nt, Human
acaguuauuuauagucau

SEQ ID NO: 3593297 - RNA, 23 nt, Human
acaguuauuuauagucauuuauu

SEQ ID NO: 3593298 - RNA, 22 nt, Human
acaguucaaaauucuaaaugua

SEQ ID NO: 3593299 - RNA, 12 nt, Human
acaguucaagaa

SEQ ID NO: 3593300 - RNA, 16 nt, Human
acaguucaagaaagcu

SEQ ID NO: 3593301 - RNA, 20 nt, Human
acaguucaagaaagcuucaa

SEQ ID NO: 3593302 - RNA, 23 nt, Human
acaguucaauaaacuuaacuuua

SEQ ID NO: 3593303 - RNA, 14 nt, Human
acucagaagccugg

SEQ ID NO: 3593304 - RNA, 17 nt, Human
acucagaagggagcuag

SEQ ID NO: 3593305 - RNA, 14 nt, Human
acucagaauucucu

SEQ ID NO: 3593306 - RNA, 19 nt, Human
acucagacaggaaagggaa

SEQ ID NO: 3593307 - RNA, 15 nt, Human
acucagaucacuacu

SEQ ID NO: 3593308 - RNA, 16 nt, Human
acucagaucacuacug

SEQ ID NO: 3593309 - RNA, 17 nt, Human
acucagaucacuacugc

SEQ ID NO: 3593310 - RNA, 18 nt, Human
acucagaucacuacugca

SEQ ID NO: 3593311 - RNA, 19 nt, Human
acucagaucacuacugcag

SEQ ID NO: 3593312 - RNA, 12 nt, Human
acucagauccag

SEQ ID NO: 3593313 - RNA, 14 nt, Human
acucagauccaggg

SEQ ID NO: 3593314 - RNA, 19 nt, Human
acucagcagcccuccucac

SEQ ID NO: 3593315 - RNA, 20 nt, Human
acucagcagcccuccucacc

SEQ ID NO: 3593316 - RNA, 22 nt, Human
acucagcagcccuccucacccc

SEQ ID NO: 3593317 - RNA, 23 nt, Human
acucagcagcccuccucaccccg

SEQ ID NO: 3593318 - RNA, 22 nt, Human
acucagccaagcacaguggugg

SEQ ID NO: 3593319 - RNA, 23 nt, Human
acucagccaagcacagugguggc

SEQ ID NO: 3593320 - RNA, 12 nt, Human
acucagccccua

SEQ ID NO: 3593321 - RNA, 17 nt, Human
acucagcccucauuggc

SEQ ID NO: 3593322 - RNA, 15 nt, Human
acucagcccugaggu

SEQ ID NO: 3593323 - RNA, 13 nt, Human
acucagcccuggg

SEQ ID NO: 3593324 - RNA, 14 nt, Human
acucagcccugggc

SEQ ID NO: 3593325 - RNA, 15 nt, Human
acaugacaacuuugc

SEQ ID NO: 3593326 - RNA, 14 nt, Human
acaugacacugaaa

SEQ ID NO: 3593327 - RNA, 15 nt, Human
acaugacacugaaau

SEQ ID NO: 3593328 - RNA, 17 nt, Human
acaugacacugaaaugc

SEQ ID NO: 3593329 - RNA, 14 nt, Human
acuauuuucuacaa

SEQ ID NO: 3593330 - RNA, 18 nt, Human
acuauuuuuauuuauauu

SEQ ID NO: 3593331 - RNA, 20 nt, Human
acuauuuuuguuuuuauuaa

SEQ ID NO: 3593332 - RNA, 13 nt, Human
acucaaaaagcug

SEQ ID NO: 3593333 - RNA, 20 nt, Human
acucaaaacccaucugggcu

SEQ ID NO: 3593334 - RNA, 15 nt, Human
acucaaaacuuaaca

SEQ ID NO: 3593335 - RNA, 16 nt, Human
acucaaacucuuaaaa

SEQ ID NO: 3593336 - RNA, 14 nt, Human
acucaaacugagga

SEQ ID NO: 3593337 - RNA, 23 nt, Human
acucaaacugaggaauuucaccu

SEQ ID NO: 3593338 - RNA, 17 nt, Human
acucaaacuucuggcuc

SEQ ID NO: 3593339 - RNA, 17 nt, Human
acucaaaggguggaaua

SEQ ID NO: 3593340 - RNA, 22 nt, Human
acucaaaucuuaagaaauaaau

SEQ ID NO: 3593341 - RNA, 21 nt, Human
acucaaauggggccagaucca

SEQ ID NO: 3593342 - RNA, 14 nt, Human
acucaaauuuuggc

SEQ ID NO: 3593343 - RNA, 15 nt, Human
acucaacaugaguca

SEQ ID NO: 3593344 - RNA, 17 nt, Human
acucaacauguuacuga

SEQ ID NO: 3593345 - RNA, 22 nt, Human
acucaacauguuacugaccagc

SEQ ID NO: 3593346 - RNA, 15 nt, Human
acucaaccaaauggu

SEQ ID NO: 3593347 - RNA, 15 nt, Human
acucaacccucucag

SEQ ID NO: 3593348 - RNA, 20 nt, Human
acucaacugggcucuguccc

SEQ ID NO: 3593349 - RNA, 14 nt, Human
acucaagaagcagg

SEQ ID NO: 3593350 - RNA, 16 nt, Human
acucaagaagcaggcu

SEQ ID NO: 3593351 - RNA, 19 nt, Human
acucaagaagcaggcuaca

SEQ ID NO: 3593352 - RNA, 15 nt, Human
acucaagauucccag

SEQ ID NO: 3593353 - RNA, 16 nt, Human
acucaagauucccagg

SEQ ID NO: 3593354 - RNA, 17 nt, Human
acucaagauucccagga

SEQ ID NO: 3593355 - RNA, 18 nt, Human
acucaagauucccaggag

SEQ ID NO: 3593356 - RNA, 19 nt, Human
acucaagauucccaggagu

SEQ ID NO: 3593357 - RNA, 23 nt, Human
acucaagauucccaggaguucug

SEQ ID NO: 3593358 - RNA, 19 nt, Human
acucaagccaagcagccaa

SEQ ID NO: 3593359 - RNA, 22 nt, Human
acucaagccaagcagccaagcu

SEQ ID NO: 3593360 - RNA, 20 nt, Human
acucaagguucccagagaug

SEQ ID NO: 3593361 - RNA, 18 nt, Human
acucaaguugauuagaaa

SEQ ID NO: 3593362 - RNA, 18 nt, Human
acucaauaaaaucaugua

SEQ ID NO: 3593363 - RNA, 23 nt, Human
acucaauauuuuccaugaaaaug

SEQ ID NO: 3593364 - RNA, 17 nt, Human
acucaaugcuuuauuug

SEQ ID NO: 3593365 - RNA, 18 nt, Human
acucaauguuacuaucug

SEQ ID NO: 3593366 - RNA, 14 nt, Human
acucaauuucuccc

SEQ ID NO: 3593367 - RNA, 14 nt, Human
acucacacagccag

SEQ ID NO: 3593368 - RNA, 19 nt, Human
acucacacaggcauuuccu

SEQ ID NO: 3593369 - RNA, 17 nt, Human
acucacaccacuagccu

SEQ ID NO: 3593370 - RNA, 22 nt, Human
acucacagaccuggagccccug

SEQ ID NO: 3593371 - RNA, 18 nt, Human
acucacagagacacaggg

SEQ ID NO: 3593372 - RNA, 21 nt, Human
acucacagagucaaggccugc

SEQ ID NO: 3593373 - RNA, 13 nt, Human
acucacagccagc

SEQ ID NO: 3593374 - RNA, 15 nt, Human
acucacaggaaggag

SEQ ID NO: 3593375 - RNA, 14 nt, Human
acucaccagcccca

SEQ ID NO: 3593376 - RNA, 20 nt, Human
acucaccagccccacugcca

SEQ ID NO: 3593377 - RNA, 23 nt, Human
acucaccaguguccccuccacug

SEQ ID NO: 3593378 - RNA, 13 nt, Human
acucaccaucugu

SEQ ID NO: 3593379 - RNA, 13 nt, Human
acucaccccagcc

SEQ ID NO: 3593380 - RNA, 14 nt, Human
acucaccccagccc

SEQ ID NO: 3593381 - RNA, 15 nt, Human
acucaccccagcccc

SEQ ID NO: 3593382 - RNA, 16 nt, Human
acucaccccagcccca

SEQ ID NO: 3593383 - RNA, 19 nt, Human
acucaccccggcagacgcc

SEQ ID NO: 3593384 - RNA, 16 nt, Human
acucaccucugccuca

SEQ ID NO: 3593385 - RNA, 14 nt, Human
acucaccugccccu

SEQ ID NO: 3593386 - RNA, 18 nt, Human
acucaccugcuggccccu

SEQ ID NO: 3593387 - RNA, 19 nt, Human
acucaccugcuggccccuc

SEQ ID NO: 3593388 - RNA, 20 nt, Human
acucaccugcuggccccuca

SEQ ID NO: 3593389 - RNA, 14 nt, Human
acucaccuggggcu

SEQ ID NO: 3593390 - RNA, 19 nt, Human
acucaccuggggcugcugg

SEQ ID NO: 3593391 - RNA, 20 nt, Human
acucaccuggggcugcuggc

SEQ ID NO: 3593392 - RNA, 15 nt, Human
acucaccuguuacuu

SEQ ID NO: 3593393 - RNA, 14 nt, Human
acucaccuugaaca

SEQ ID NO: 3593394 - RNA, 23 nt, Human
acucacgauaaauaaucggccca

SEQ ID NO: 3593395 - RNA, 18 nt, Human
acucacuaauucauuaau

SEQ ID NO: 3593396 - RNA, 14 nt, Human
acucacuaggcccc

SEQ ID NO: 3593397 - RNA, 21 nt, Human
acucacuaggcccccacuugc

SEQ ID NO: 3593398 - RNA, 15 nt, Human
acucacucaaguuca

SEQ ID NO: 3593399 - RNA, 13 nt, Human
acucacuccugag

SEQ ID NO: 3593400 - RNA, 18 nt, Human
acucacuccuuuuaaaga

SEQ ID NO: 3593401 - RNA, 19 nt, Human
acucacuccuuuuaaagaa

SEQ ID NO: 3593402 - RNA, 12 nt, Human
acucacugaagc

SEQ ID NO: 3593403 - RNA, 14 nt, Human
acucacugaagccu

SEQ ID NO: 3593404 - RNA, 15 nt, Human
acucacugaagccug

SEQ ID NO: 3593405 - RNA, 19 nt, Human
acucacugaagccugcguu

SEQ ID NO: 3593406 - RNA, 15 nt, Human
acucacuggcagccc

SEQ ID NO: 3593407 - RNA, 22 nt, Human
acucacuggggccuacagcuuu

SEQ ID NO: 3593408 - RNA, 14 nt, Human
acucagaaacauca

SEQ ID NO: 3593409 - RNA, 15 nt, Human
acucagaaagccaac

SEQ ID NO: 3593410 - RNA, 18 nt, Human
acucagaagacacugaug

SEQ ID NO: 3593411 - RNA, 15 nt, Human
acucagaagccucug

SEQ ID NO: 3593412 - RNA, 16 nt, Human
acucagaagccucugg

SEQ ID NO: 3593413 - RNA, 20 nt, Human
acucagaagccucuggguca

SEQ ID NO: 3593414 - RNA, 13 nt, Human
acucagaagccug

SEQ ID NO: 3593415 - RNA, 17 nt, Human
acucagaagccugaggc

SEQ ID NO: 3593416 - RNA, 18 nt, Human
acucagaagccugaggcu

SEQ ID NO: 3593417 - RNA, 21 nt, Human
acucagaagccugggggccug

SEQ ID NO: 3593418 - RNA, 23 nt, Human
acucagaagccugggggccuggc

SEQ ID NO: 3593419 - RNA, 16 nt, Human
acucagaaguccagag

SEQ ID NO: 3593420 - RNA, 22 nt, Human
acucagaauucucuaguuugau

SEQ ID NO: 3593421 - RNA, 18 nt, Human
acucagacauuggcaccu

SEQ ID NO: 3593422 - RNA, 12 nt, Human
acucagaccuga

SEQ ID NO: 3593423 - RNA, 12 nt, Human
acucagagcagu

SEQ ID NO: 3593424 - RNA, 20 nt, Human
acucagagcucucucuacag

SEQ ID NO: 3593425 - RNA, 21 nt, Human
acucagagcucucucuacaga

SEQ ID NO: 3593426 - RNA, 14 nt, Human
acucagagggagga

SEQ ID NO: 3593427 - RNA, 22 nt, Human
acucagaguucuauacuguaaa

SEQ ID NO: 3593428 - RNA, 22 nt, Human
acucagauaagguaaaaugcca

SEQ ID NO: 3593429 - RNA, 21 nt, Human
acucagaucacuacugcaguc

SEQ ID NO: 3593430 - RNA, 11 nt, Human
acucagaucca

SEQ ID NO: 3593431 - RNA, 16 nt, Human
acucagauccagggac

SEQ ID NO: 3593432 - RNA, 21 nt, Human
acucagauggaaccgcaggaa

SEQ ID NO: 3593433 - RNA, 14 nt, Human
acucagcaccacuc

SEQ ID NO: 3593434 - RNA, 22 nt, Human
acucagcaccacucaagaccaa

SEQ ID NO: 3593435 - RNA, 15 nt, Human
acucagcagcccucc

SEQ ID NO: 3593436 - RNA, 17 nt, Human
acucagcagcccuccuc

SEQ ID NO: 3593437 - RNA, 17 nt, Human
acucagccacccugagu

SEQ ID NO: 3593438 - RNA, 15 nt, Human
acucagccccuagga

SEQ ID NO: 3593439 - RNA, 14 nt, Human
acucagcccugagg

SEQ ID NO: 3593440 - RNA, 12 nt, Human
acucagcccugg

SEQ ID NO: 3593441 - RNA, 21 nt, Human
acucagccugcaguuaauuag

SEQ ID NO: 3593442 - RNA, 16 nt, Human
acucagccugcugccc

SEQ ID NO: 3593443 - RNA, 16 nt, Human
acucagccugggacag

SEQ ID NO: 3593444 - RNA, 11 nt, Human
acucagccuuc

SEQ ID NO: 3593445 - RNA, 19 nt, Human
acucagcuguccugcagca

SEQ ID NO: 3593446 - RNA, 20 nt, Human
acucagcuuucuuuaaaguu

SEQ ID NO: 3593447 - RNA, 13 nt, Human
acucaggaagaac

SEQ ID NO: 3593448 - RNA, 12 nt, Human
acucaggacucc

SEQ ID NO: 3593449 - RNA, 15 nt, Human
acucaggacuccagc

SEQ ID NO: 3593450 - RNA, 18 nt, Human
acucaggaggcugagggg

SEQ ID NO: 3593451 - RNA, 14 nt, Human
acucaggaugccca

SEQ ID NO: 3593452 - RNA, 18 nt, Human
acucaggaugcccagggc

SEQ ID NO: 3593453 - RNA, 22 nt, Human
acucaggauuuaaaaacuggaa

SEQ ID NO: 3593454 - RNA, 16 nt, Human
acucaggcccaaagcc

SEQ ID NO: 3593455 - RNA, 17 nt, Human
acucaggcccaaagccu

SEQ ID NO: 3593456 - RNA, 22 nt, Human
acucaggcccccaccuggcuca

SEQ ID NO: 3593457 - RNA, 20 nt, Human
acucaggcgggacagugcug

SEQ ID NO: 3593458 - RNA, 12 nt, Human
acucaggcugga

SEQ ID NO: 3593459 - RNA, 23 nt, Human
acucaggcuuucacuauuuccuu

SEQ ID NO: 3593460 - RNA, 20 nt, Human
acucagggacagagccaugc

SEQ ID NO: 3593461 - RNA, 21 nt, Human
acucagggaggcuaaaucagu

SEQ ID NO: 3593462 - RNA, 17 nt, Human
acucagggcagcgccag

SEQ ID NO: 3593463 - RNA, 20 nt, Human
acucagggcagcgccaggcu

SEQ ID NO: 3593464 - RNA, 22 nt, Human
acucagggccccagcacuaaag

SEQ ID NO: 3593465 - RNA, 16 nt, Human
acucagggcuccuccc

SEQ ID NO: 3593466 - RNA, 22 nt, Human
acucagggcuccucccagcuug

SEQ ID NO: 3593467 - RNA, 18 nt, Human
acucagggcuucuaguuu

SEQ ID NO: 3593468 - RNA, 15 nt, Human
acucaggggucacug

SEQ ID NO: 3593469 - RNA, 15 nt, Human
acucagguggcccua

SEQ ID NO: 3593470 - RNA, 18 nt, Human
agcauccuggcacccggc

SEQ ID NO: 3593471 - RNA, 23 nt, Human
agcauccuggcacccggccccug

SEQ ID NO: 3593472 - RNA, 20 nt, Human
agcauccuuaaguaucagaa

SEQ ID NO: 3593473 - RNA, 21 nt, Human
agcauccuuuucugcagaggg

SEQ ID NO: 3593474 - RNA, 22 nt, Human
agcaucggacaagacccccagc

SEQ ID NO: 3593475 - RNA, 19 nt, Human
agcaucggccuagggcccc

SEQ ID NO: 3593476 - RNA, 13 nt, Human
agcaucuaaacuu

SEQ ID NO: 3593477 - RNA, 17 nt, Human
agcaucuaaacuuuaau

SEQ ID NO: 3593478 - RNA, 20 nt, Human
agcaucuaaguuauaagacu

SEQ ID NO: 3593479 - RNA, 15 nt, Human
agcaucuacuucagg

SEQ ID NO: 3593480 - RNA, 13 nt, Human
agcaucuaucaga

SEQ ID NO: 3593481 - RNA, 15 nt, Human
agcaucuaucucauc

SEQ ID NO: 3593482 - RNA, 13 nt, Human
agcaucucccagu

SEQ ID NO: 3593483 - RNA, 22 nt, Human
agcaucucccucacugaaacca

SEQ ID NO: 3593484 - RNA, 18 nt, Human
agcaucucuaccuucucc

SEQ ID NO: 3593485 - RNA, 13 nt, Human
agcaucugcuaau

SEQ ID NO: 3593486 - RNA, 17 nt, Human
agcaucuggaagagcua

SEQ ID NO: 3593487 - RNA, 15 nt, Human
agcaucugucccccu

SEQ ID NO: 3593488 - RNA, 20 nt, Human
agcaucuuccagaaguguga

SEQ ID NO: 3593489 - RNA, 22 nt, Human
agcaucuuccagaagugugauu

SEQ ID NO: 3593490 - RNA, 23 nt, Human
agcaucuuccagaagugugauug

SEQ ID NO: 3593491 - RNA, 15 nt, Human
agcaucuucuggagu

SEQ ID NO: 3593492 - RNA, 15 nt, Human
agcaucuugcauuau

SEQ ID NO: 3593493 - RNA, 19 nt, Human
agcaucuuggggggguggc

SEQ ID NO: 3593494 - RNA, 23 nt, Human
agcaucuuggggggguggccgcu

SEQ ID NO: 3593495 - RNA, 23 nt, Human
agcaugaagucuuaaggacaaag

SEQ ID NO: 3593496 - RNA, 14 nt, Human
agcaugacagaaaa

SEQ ID NO: 3593497 - RNA, 18 nt, Human
agcaugacagaaaauaug

SEQ ID NO: 3593498 - RNA, 20 nt, Human
agcaugacagccugcagcag

SEQ ID NO: 3593499 - RNA, 20 nt, Human
agcaugacauaacagugcag

SEQ ID NO: 3593500 - RNA, 14 nt, Human
agcaugacauuucu

SEQ ID NO: 3593501 - RNA, 16 nt, Human
agcaugacccagguca

SEQ ID NO: 3593502 - RNA, 18 nt, Human
agcaugaccugugaccag

SEQ ID NO: 3593503 - RNA, 22 nt, Human
agcaugaccugugaccagcacu

SEQ ID NO: 3593504 - RNA, 13 nt, Human
agcaugaggaacu

SEQ ID NO: 3593505 - RNA, 18 nt, Human
agcaugagguaucuaagg

SEQ ID NO: 3593506 - RNA, 20 nt, Human
agcaugauuuauacucauuu

SEQ ID NO: 3593507 - RNA, 18 nt, Human
agcaugcaauacauacca

SEQ ID NO: 3593508 - RNA, 18 nt, Human
agcaugcacaaaguguau

SEQ ID NO: 3593509 - RNA, 17 nt, Human
agcaugcagcuuugcaa

SEQ ID NO: 3593510 - RNA, 18 nt, Human
agcaugccaacaagaaug

SEQ ID NO: 3593511 - RNA, 20 nt, Human
agcaugccaacaagaaugca

SEQ ID NO: 3593512 - RNA, 17 nt, Human
agcaugccaauuucucu

SEQ ID NO: 3593513 - RNA, 15 nt, Human
agcaugccuucaaau

SEQ ID NO: 3593514 - RNA, 22 nt, Human
agcaugcuugugaaaauguguu

SEQ ID NO: 3593515 - RNA, 19 nt, Human
agcauggaacacuucgagu

SEQ ID NO: 3593516 - RNA, 23 nt, Human
agcauggacuaaccccaacgcac

SEQ ID NO: 3593517 - RNA, 17 nt, Human
agcauggcacucccucc

SEQ ID NO: 3593518 - RNA, 20 nt, Human
agcauggcacucccuccagc

SEQ ID NO: 3593519 - RNA, 23 nt, Human
agcauggcacucccuccagcaca

SEQ ID NO: 3593520 - RNA, 18 nt, Human
agcauggcauauuuuuca

SEQ ID NO: 3593521 - RNA, 19 nt, Human
agcauggcauauuuuucac

SEQ ID NO: 3593522 - RNA, 21 nt, Human
agcauggcauauuuuucacau

SEQ ID NO: 3593523 - RNA, 22 nt, Human
agcauggcauauuuuucacaua

SEQ ID NO: 3593524 - RNA, 16 nt, Human
agcauggcugugagga

SEQ ID NO: 3593525 - RNA, 19 nt, Human
agcaugggccuggccaccu

SEQ ID NO: 3593526 - RNA, 22 nt, Human
agcauggucccacaucccuggg

SEQ ID NO: 3593527 - RNA, 23 nt, Human
agcauggucccacaucccugggc

SEQ ID NO: 3593528 - RNA, 15 nt, Human
agcauggugcaugcc

SEQ ID NO: 3593529 - RNA, 21 nt, Human
agcauguaauguuaauguuau

SEQ ID NO: 3593530 - RNA, 19 nt, Human
agcauguacaguguucugu

SEQ ID NO: 3593531 - RNA, 21 nt, Human
agcauguacugagccuuguaa

SEQ ID NO: 3593532 - RNA, 15 nt, Human
agcauguaggagaau

SEQ ID NO: 3593533 - RNA, 16 nt, Human
agcauguauugugucu

SEQ ID NO: 3593534 - RNA, 20 nt, Human
agcaugucgucaaagcugaa

SEQ ID NO: 3593535 - RNA, 16 nt, Human
agcaugucuuauuuaa

SEQ ID NO: 3593536 - RNA, 17 nt, Human
agcaugugcccuccuga

SEQ ID NO: 3593537 - RNA, 18 nt, Human
agcaugugccuuaaugcu

SEQ ID NO: 3593538 - RNA, 16 nt, Human
agcauguguuaaucuu

SEQ ID NO: 3593539 - RNA, 22 nt, Human
agcauguguuugguucuggggc

SEQ ID NO: 3593540 - RNA, 19 nt, Human
agcauguugagccaggccu

SEQ ID NO: 3593541 - RNA, 21 nt, Human
agcauguugagccaggccugg

SEQ ID NO: 3593542 - RNA, 23 nt, Human
agcauguuguagauacaaucagc

SEQ ID NO: 3593543 - RNA, 18 nt, Human
agcauguuucauguuuug

SEQ ID NO: 3593544 - RNA, 21 nt, Human
agcauguuucauguuuuguga

SEQ ID NO: 3593545 - RNA, 15 nt, Human
agcauguuugcugaa

SEQ ID NO: 3593546 - RNA, 14 nt, Human
agcauguuuuguau

SEQ ID NO: 3593547 - RNA, 15 nt, Human
agcauguuuuguaua

SEQ ID NO: 3593548 - RNA, 17 nt, Human
agcauuaacuucucugg

SEQ ID NO: 3593549 - RNA, 20 nt, Human
agcauuaagcuguuccuguu

SEQ ID NO: 3593550 - RNA, 15 nt, Human
agcauuacaaauugc

SEQ ID NO: 3593551 - RNA, 23 nt, Human
agcauuaccucuuuggaaaagga

SEQ ID NO: 3593552 - RNA, 19 nt, Human
agcauuacgugagccaggu

SEQ ID NO: 3593553 - RNA, 17 nt, Human
agcauuacucuuguaag

SEQ ID NO: 3593554 - RNA, 16 nt, Human
agcauuagugggaaaa

SEQ ID NO: 3593555 - RNA, 19 nt, Human
agcauuaugauguggguca

SEQ ID NO: 3593556 - RNA, 22 nt, Human
agcauucaauuuauucaagaaa

SEQ ID NO: 3593557 - RNA, 15 nt, Human
agcauucagaagaaa

SEQ ID NO: 3593558 - RNA, 19 nt, Human
agcauucagaagaaaaaga

SEQ ID NO: 3593559 - RNA, 21 nt, Human
agcauucagaagaaaaagaag

SEQ ID NO: 3593560 - RNA, 14 nt, Human
agcauucagagagc

SEQ ID NO: 3593561 - RNA, 17 nt, Human
agcauucagagagcagc

SEQ ID NO: 3593562 - RNA, 17 nt, Human
agcauuccaacaaaggg

SEQ ID NO: 3593563 - RNA, 15 nt, Human
agcauuccuucuuug

SEQ ID NO: 3593564 - RNA, 14 nt, Human
agcauuccuuuuga

SEQ ID NO: 3593565 - RNA, 17 nt, Human
agcauucuuagccugug

SEQ ID NO: 3593566 - RNA, 19 nt, Human
agcauucuuuggaguuaaa

SEQ ID NO: 3593567 - RNA, 24 nt, Human
agcauucuuuggaguuaaaaugca

SEQ ID NO: 3593568 - RNA, 15 nt, Human
agcauugaaauuaua

SEQ ID NO: 3593569 - RNA, 13 nt, Human
agcauugcaugga

SEQ ID NO: 3593570 - RNA, 14 nt, Human
agcauugccauucc

SEQ ID NO: 3593571 - RNA, 14 nt, Human
agcauugcugguuc

SEQ ID NO: 3593572 - RNA, 17 nt, Human
agcauugcuguuauguc

SEQ ID NO: 3593573 - RNA, 17 nt, Human
agcauugcuuucugaaa

SEQ ID NO: 3593574 - RNA, 21 nt, Human
agcauugcuuuuauuuugaaa

SEQ ID NO: 3593575 - RNA, 23 nt, Human
agcauuggauacagcaguagaca

SEQ ID NO: 3593576 - RNA, 21 nt, Human
agcauugggugagguaauaaa

SEQ ID NO: 3593577 - RNA, 14 nt, Human
agcauuguaaaaua

SEQ ID NO: 3593578 - RNA, 20 nt, Human
aguauuauaaauuauguuua

SEQ ID NO: 3593579 - RNA, 14 nt, Human
aguauuauaccuuu

SEQ ID NO: 3593580 - RNA, 15 nt, Human
aguauuauaccuuuu

SEQ ID NO: 3593581 - RNA, 23 nt, Human
aguauuaucuuguucaggaaaag

SEQ ID NO: 3593582 - RNA, 18 nt, Human
aguauuauucuacuauac

SEQ ID NO: 3593583 - RNA, 15 nt, Human
aguauuauuuuccaa

SEQ ID NO: 3593584 - RNA, 18 nt, Human
aguauuauuuuccaaaag

SEQ ID NO: 3593585 - RNA, 21 nt, Human
aguauuccaccuuaaauuaaa

SEQ ID NO: 3593586 - RNA, 22 nt, Human
aguauuccaccuuaaauuaaac

SEQ ID NO: 3593587 - RNA, 22 nt, Human
aguauuccauugugugagugua

SEQ ID NO: 3593588 - RNA, 17 nt, Human
aguauucuaauaagcua

SEQ ID NO: 3593589 - RNA, 16 nt, Human
aguauucucuuuucaa

SEQ ID NO: 3593590 - RNA, 13 nt, Human
aguauucugccuu

SEQ ID NO: 3593591 - RNA, 18 nt, Human
aguauugaagcauuuuau

SEQ ID NO: 3593592 - RNA, 21 nt, Human
aguauugaagcauuuuauaaa

SEQ ID NO: 3593593 - RNA, 17 nt, Human
aguauugacaaaauguu

SEQ ID NO: 3593594 - RNA, 18 nt, Human
aguauugacaaaauguua

SEQ ID NO: 3593595 - RNA, 22 nt, Human
aguauugacaaaauguuauuuc

SEQ ID NO: 3593596 - RNA, 23 nt, Human
aguauugauucugcuugagaaua

SEQ ID NO: 3593597 - RNA, 16 nt, Human
aguauugccaaacauu

SEQ ID NO: 3593598 - RNA, 22 nt, Human
aguauugcucacccagugcccu

SEQ ID NO: 3593599 - RNA, 18 nt, Human
aguauuggggucugaccc

SEQ ID NO: 3593600 - RNA, 12 nt, Human
aguauuguaaau

SEQ ID NO: 3593601 - RNA, 14 nt, Human
aguauuguaaauua

SEQ ID NO: 3593602 - RNA, 15 nt, Human
aguauuguaaauuau

SEQ ID NO: 3593603 - RNA, 16 nt, Human
aguauuguaaauuaua

SEQ ID NO: 3593604 - RNA, 11 nt, Human
aguauuguaca

SEQ ID NO: 3593605 - RNA, 15 nt, Human
aguauuguuguccuu

SEQ ID NO: 3593606 - RNA, 16 nt, Human
aguauuguuguccuuu

SEQ ID NO: 3593607 - RNA, 20 nt, Human
aguauuguuguccuuuucau

SEQ ID NO: 3593608 - RNA, 12 nt, Human
aguauuguuuaa

SEQ ID NO: 3593609 - RNA, 14 nt, Human
aguauuguuuaaaa

SEQ ID NO: 3593610 - RNA, 16 nt, Human
aguauuguuuaaaaug

SEQ ID NO: 3593611 - RNA, 19 nt, Human
aguauuuaauuagugcuaa

SEQ ID NO: 3593612 - RNA, 17 nt, Human
aguauuuauauauuuau

SEQ ID NO: 3593613 - RNA, 13 nt, Human
agucaugcauaaa

SEQ ID NO: 3593614 - RNA, 21 nt, Human
agucaugcauaaauaugcagu

SEQ ID NO: 3593615 - RNA, 19 nt, Human
agucaugcuccccugugcc

SEQ ID NO: 3593616 - RNA, 23 nt, Human
agucaugcuccccugugccagcc

SEQ ID NO: 3593617 - RNA, 12 nt, Human
agucauggagaa

SEQ ID NO: 3593618 - RNA, 13 nt, Human
agucauggcugug

SEQ ID NO: 3593619 - RNA, 18 nt, Human
agucauguaaauacuguu

SEQ ID NO: 3593620 - RNA, 20 nt, Human
agucauguaagcugaaaaua

SEQ ID NO: 3593621 - RNA, 11 nt, Human
agucauguaug

SEQ ID NO: 3593622 - RNA, 12 nt, Human
agucauguaugu

SEQ ID NO: 3593623 - RNA, 13 nt, Human
agucaugugcauu

SEQ ID NO: 3593624 - RNA, 14 nt, Human
agucaugugggcca

SEQ ID NO: 3593625 - RNA, 16 nt, Human
agucauuaaauuacua

SEQ ID NO: 3593626 - RNA, 14 nt, Human
agucauuagacucc

SEQ ID NO: 3593627 - RNA, 18 nt, Human
agucauuagacuccuccu

SEQ ID NO: 3593628 - RNA, 12 nt, Human
agucauuccuuc

SEQ ID NO: 3593629 - RNA, 14 nt, Human
agucauucuucccu

SEQ ID NO: 3593630 - RNA, 13 nt, Human
agucauucuuuaa

SEQ ID NO: 3593631 - RNA, 15 nt, Human
agucauuggcugucu

SEQ ID NO: 3593632 - RNA, 20 nt, Human
agucauuggcuuuauccucu

SEQ ID NO: 3593633 - RNA, 22 nt, Human
agucauuggcuuuauccucuuu

SEQ ID NO: 3593634 - RNA, 20 nt, Human
agucauuguaauguugugaa

SEQ ID NO: 3593635 - RNA, 13 nt, Human
agucauuguaugu

SEQ ID NO: 3593636 - RNA, 15 nt, Human
agucauuuacuaaac

SEQ ID NO: 3593637 - RNA, 16 nt, Human
agucauuuauuuuaaa

SEQ ID NO: 3593638 - RNA, 22 nt, Human
agucauuugcgcacaacuuaaa

SEQ ID NO: 3593639 - RNA, 19 nt, Human
agucauuugcugagcaugu

SEQ ID NO: 3593640 - RNA, 21 nt, Human
agucauuuuaacuuuaucaca

SEQ ID NO: 3593641 - RNA, 14 nt, Human
agucauuuuuacaa

SEQ ID NO: 3593642 - RNA, 21 nt, Human
aguccaaaaagcuccuggggc

SEQ ID NO: 3593643 - RNA, 16 nt, Human
aguccaaauguccucc

SEQ ID NO: 3593644 - RNA, 23 nt, Human
aguccaaauguccuccagaagcc

SEQ ID NO: 3593645 - RNA, 17 nt, Human
aguccaacaauguuguu

SEQ ID NO: 3593646 - RNA, 18 nt, Human
aguccaacguggggcagc

SEQ ID NO: 3593647 - RNA, 23 nt, Human
aguccaacguggggcagcacaga

SEQ ID NO: 3593648 - RNA, 18 nt, Human
aguccaaggaaaccacag

SEQ ID NO: 3593649 - RNA, 16 nt, Human
aguccaagguuuaaag

SEQ ID NO: 3593650 - RNA, 20 nt, Human
aguccaaucucauggagaag

SEQ ID NO: 3593651 - RNA, 14 nt, Human
aguccaauguggca

SEQ ID NO: 3593652 - RNA, 16 nt, Human
aguccacccugccugc

SEQ ID NO: 3593653 - RNA, 14 nt, Human
aguccacucccagu

SEQ ID NO: 3593654 - RNA, 20 nt, Human
aguccagaaacuguucccac

SEQ ID NO: 3593655 - RNA, 22 nt, Human
aguccagauuuacacugggaga

SEQ ID NO: 3593656 - RNA, 23 nt, Human
aguccagauuuacacugggagag

SEQ ID NO: 3593657 - RNA, 15 nt, Human
aguccagccuggaga

SEQ ID NO: 3593658 - RNA, 22 nt, Human
aguccaggaugcuaacaucuaa

SEQ ID NO: 3593659 - RNA, 14 nt, Human
aguccaggcacagg

SEQ ID NO: 3593660 - RNA, 16 nt, Human
aguccaggcacaggau

SEQ ID NO: 3593661 - RNA, 19 nt, Human
aguccaggcacaggaugcu

SEQ ID NO: 3593662 - RNA, 18 nt, Human
aguccaggccccaaaacc

SEQ ID NO: 3593663 - RNA, 23 nt, Human
aguccaggccccaaaaccacagc

SEQ ID NO: 3593664 - RNA, 14 nt, Human
aguccagguccugg

SEQ ID NO: 3593665 - RNA, 17 nt, Human
aguccagguccuggugg

SEQ ID NO: 3593666 - RNA, 21 nt, Human
aguccaggucgggcucagcuc

SEQ ID NO: 3593667 - RNA, 23 nt, Human
aguccaggucgggcucagcucug

SEQ ID NO: 3593668 - RNA, 23 nt, Human
aguccauauuucaauuuccaaga

SEQ ID NO: 3593669 - RNA, 13 nt, Human
aguccaucagccu

SEQ ID NO: 3593670 - RNA, 20 nt, Human
aguccaugcaugacagccuc

SEQ ID NO: 3593671 - RNA, 21 nt, Human
aguccaugcaugacagccucu

SEQ ID NO: 3593672 - RNA, 15 nt, Human
aguccauucucccag

SEQ ID NO: 3593673 - RNA, 16 nt, Human
aguccauugaaaggga

SEQ ID NO: 3593674 - RNA, 16 nt, Human
aguccauuuauauaug

SEQ ID NO: 3593675 - RNA, 18 nt, Human
aguccauuuauauaugaa

SEQ ID NO: 3593676 - RNA, 14 nt, Human
agucccaagcggug

SEQ ID NO: 3593677 - RNA, 16 nt, Human
agucccaccuuggcug

SEQ ID NO: 3593678 - RNA, 18 nt, Human
agucccacuccaagccag

SEQ ID NO: 3593679 - RNA, 19 nt, Human
agucccacuccaagccagc

SEQ ID NO: 3593680 - RNA, 12 nt, Human
agucccacugcc

SEQ ID NO: 3593681 - RNA, 20 nt, Human
agucccacugccucagguuc

SEQ ID NO: 3593682 - RNA, 14 nt, Human
agucccagcagcca

SEQ ID NO: 3593683 - RNA, 22 nt, Human
agucccagcuacucagaagccu

SEQ ID NO: 3593684 - RNA, 18 nt, Human
agucccaggcugagccuc

SEQ ID NO: 3593685 - RNA, 21 nt, Human
agucccagguuggcucugcca

SEQ ID NO: 3593686 - RNA, 22 nt, Human
agucccagguuggcucugccag

SEQ ID NO: 3593687 - RNA, 13 nt, Human
agucccaguggga

SEQ ID NO: 3593688 - RNA, 17 nt, Human
agucccaucugcuucag

SEQ ID NO: 3593689 - RNA, 20 nt, Human
aguccccaccccugccccca

SEQ ID NO: 3593690 - RNA, 23 nt, Human
aguccccagcccuucacauuuuu

SEQ ID NO: 3593691 - RNA, 22 nt, Human
agucccccaacagaugcuuuuc

SEQ ID NO: 3593692 - RNA, 18 nt, Human
agucccccaaccccagcc

SEQ ID NO: 3593693 - RNA, 18 nt, Human
agucccccaacucugagc

SEQ ID NO: 3593694 - RNA, 22 nt, Human
agucccccaacucugagcccau

SEQ ID NO: 3593695 - RNA, 14 nt, Human
aguccccccacucc

SEQ ID NO: 3593696 - RNA, 19 nt, Human
agucccccuauccuuggca

SEQ ID NO: 3593697 - RNA, 18 nt, Human
aguccccgugccccgccu

SEQ ID NO: 3593698 - RNA, 16 nt, Human
aguccccucaccuccu

SEQ ID NO: 3593699 - RNA, 18 nt, Human
aguccccuccccggcccu

SEQ ID NO: 3593700 - RNA, 16 nt, Human
aguccccucuccucca

SEQ ID NO: 3593701 - RNA, 14 nt, Human
aguccccuguuugu

SEQ ID NO: 3593702 - RNA, 19 nt, Human
agucccugacucucuguga

SEQ ID NO: 3593703 - RNA, 21 nt, Human
agucccugacucucugugacc

SEQ ID NO: 3593704 - RNA, 12 nt, Human
agucccugccaa

SEQ ID NO: 3593705 - RNA, 14 nt, Human
agucccugccaaug

SEQ ID NO: 3593706 - RNA, 16 nt, Human
agucccugccaaugga

SEQ ID NO: 3593707 - RNA, 22 nt, Human
agucccugccacgaauuucugu

SEQ ID NO: 3593708 - RNA, 12 nt, Human
agucccugcccc

SEQ ID NO: 3593709 - RNA, 21 nt, Human
agucccugccuggaccagccu

SEQ ID NO: 3593710 - RNA, 20 nt, Human
agucccugggggaagcccug

SEQ ID NO: 3593711 - RNA, 18 nt, Human
agucccugucaccucuuc

SEQ ID NO: 3593712 - RNA, 13 nt, Human
agucccuguuuuc

SEQ ID NO: 3593713 - RNA, 15 nt, Human
agucccuuccccucc

SEQ ID NO: 3593714 - RNA, 17 nt, Human
agucccuuccccucccu

SEQ ID NO: 3593715 - RNA, 13 nt, Human
agucccuuuaaag

SEQ ID NO: 3593716 - RNA, 20 nt, Human
aguccgaccuggccugucug

SEQ ID NO: 3593717 - RNA, 17 nt, Human
aguccgcagaagcccug

SEQ ID NO: 3593718 - RNA, 20 nt, Human
aguccgugcugacagcugcu

SEQ ID NO: 3593719 - RNA, 13 nt, Human
aguccgugggacg

SEQ ID NO: 3593720 - RNA, 22 nt, Human
aguccuacuuuacauaugcuuu

SEQ ID NO: 3593721 - RNA, 16 nt, Human
aguccuagaauguuuc

SEQ ID NO: 3593722 - RNA, 17 nt, Human
aguccuagccacucagg

SEQ ID NO: 3593723 - RNA, 16 nt, Human
aguccuagcugcacag

SEQ ID NO: 3593724 - RNA, 13 nt, Human
aguccuagugaac

SEQ ID NO: 3593725 - RNA, 16 nt, Human
aguccuaguuuuccua

SEQ ID NO: 3593726 - RNA, 22 nt, Human
aguccuaucugggcuuccugga

SEQ ID NO: 3593727 - RNA, 24 nt, Human
aguccuaucugggcuuccuggagc

SEQ ID NO: 3593728 - RNA, 15 nt, Human
aguccuauggaaacc

SEQ ID NO: 3593729 - RNA, 19 nt, Human
aguccuauucaaauuccua

SEQ ID NO: 3593730 - RNA, 23 nt, Human
aguccucaaagcuuuuugaaaac

SEQ ID NO: 3593731 - RNA, 18 nt, Human
aguccucacucccagucc

SEQ ID NO: 3593732 - RNA, 17 nt, Human
aguccucauaaaaagca

SEQ ID NO: 3593733 - RNA, 18 nt, Human
aguccucauaaaaagcaa

SEQ ID NO: 3593734 - RNA, 20 nt, Human
aguccuccagaacucuuccu

SEQ ID NO: 3593735 - RNA, 21 nt, Human
aguccuccccucacagccucu

SEQ ID NO: 3593736 - RNA, 23 nt, Human
aguccuccgguugcauacuggac

SEQ ID NO: 3593737 - RNA, 15 nt, Human
agcauuguaaaauaa

SEQ ID NO: 3593738 - RNA, 22 nt, Human
agcauuguagugcuuugagaga

SEQ ID NO: 3593739 - RNA, 15 nt, Human
agcauugucuauuuu

SEQ ID NO: 3593740 - RNA, 17 nt, Human
agcauugugaacugaca

SEQ ID NO: 3593741 - RNA, 23 nt, Human
agcauugugugugcagacuucag

SEQ ID NO: 3593742 - RNA, 22 nt, Human
agcauuuaaccccccuguacac

SEQ ID NO: 3593743 - RNA, 16 nt, Human
agcauuuacugugucu

SEQ ID NO: 3593744 - RNA, 22 nt, Human
agcauuuagauguauagguuga

SEQ ID NO: 3593745 - RNA, 16 nt, Human
agcauuuaucauucuu

SEQ ID NO: 3593746 - RNA, 17 nt, Human
agcauuuaugguaauca

SEQ ID NO: 3593747 - RNA, 13 nt, Human
agcauuuauguuu

SEQ ID NO: 3593748 - RNA, 21 nt, Human
agcauuucauucuucucuagc

SEQ ID NO: 3593749 - RNA, 22 nt, Human
agcauuuccaacaccacagaca

SEQ ID NO: 3593750 - RNA, 20 nt, Human
agcauuucuuuucuggccaa

SEQ ID NO: 3593751 - RNA, 17 nt, Human
agcauuugaaugcauuu

SEQ ID NO: 3593752 - RNA, 22 nt, Human
agcauuugaucuguugcaagcc

SEQ ID NO: 3593753 - RNA, 13 nt, Human
agcauuuguauuu

SEQ ID NO: 3593754 - RNA, 17 nt, Human
agcauuuguguugaaga

SEQ ID NO: 3593755 - RNA, 14 nt, Human
agcauuuuauaaau

SEQ ID NO: 3593756 - RNA, 17 nt, Human
agcauuuuccucugcuu

SEQ ID NO: 3593757 - RNA, 21 nt, Human
aguccuggagcaaucacagau

SEQ ID NO: 3593758 - RNA, 22 nt, Human
aguccuggagcaaucacagaug

SEQ ID NO: 3593759 - RNA, 17 nt, Human
aguccuggaugauacua

SEQ ID NO: 3593760 - RNA, 22 nt, Human
aguccuggaugauacuaauaaa

SEQ ID NO: 3593761 - RNA, 21 nt, Human
aguccuggcaugggaaugaau

SEQ ID NO: 3593762 - RNA, 22 nt, Human
aguccuggcaugggaaugaaug

SEQ ID NO: 3593763 - RNA, 13 nt, Human
aguccuggcccaa

SEQ ID NO: 3593764 - RNA, 15 nt, Human
aguccuggcuucagg

SEQ ID NO: 3593765 - RNA, 21 nt, Human
aguccugggagaaccucaggc

SEQ ID NO: 3593766 - RNA, 19 nt, Human
aguccugggauuacaggug

SEQ ID NO: 3593767 - RNA, 12 nt, Human
aguccuguaaug

SEQ ID NO: 3593768 - RNA, 15 nt, Human
aguccuguaugucug

SEQ ID NO: 3593769 - RNA, 16 nt, Human
aguccuguaugucugu

SEQ ID NO: 3593770 - RNA, 23 nt, Human
aguccuguaugucugucauugua

SEQ ID NO: 3593771 - RNA, 15 nt, Human
aguccugugcugaau

SEQ ID NO: 3593772 - RNA, 14 nt, Human
aguccuuaaaaauc

SEQ ID NO: 3593773 - RNA, 24 nt, Human
aguccuuaaaauguaagauuauag

SEQ ID NO: 3593774 - RNA, 19 nt, Human
aguccuuaccagcagagca

SEQ ID NO: 3593775 - RNA, 16 nt, Human
aguccuuaucuagcug

SEQ ID NO: 3593776 - RNA, 11 nt, Human
aguccuuccac

SEQ ID NO: 3593777 - RNA, 17 nt, Human
aguccuugaaaauauuu

SEQ ID NO: 3593778 - RNA, 15 nt, Human
aguccuugcaagaau

SEQ ID NO: 3593779 - RNA, 18 nt, Human
aguccuugcaagaaucag

SEQ ID NO: 3593780 - RNA, 12 nt, Human
aguccuugcuug

SEQ ID NO: 3593781 - RNA, 13 nt, Human
aguccuugcuugg

SEQ ID NO: 3593782 - RNA, 18 nt, Human
aguccuugcuuggcugcu

SEQ ID NO: 3593783 - RNA, 14 nt, Human
aguccuuggccugc

SEQ ID NO: 3593784 - RNA, 18 nt, Human
aguccuuuaauuaagacu

SEQ ID NO: 3593785 - RNA, 15 nt, Human
aguccuuuuguaaag

SEQ ID NO: 3593786 - RNA, 16 nt, Human
aguccuuuuguaaagu

SEQ ID NO: 3593787 - RNA, 22 nt, Human
aguccuuuuguaaagugaagaa

SEQ ID NO: 3593788 - RNA, 18 nt, Human
agucgaauuaauagcuuu

SEQ ID NO: 3593789 - RNA, 16 nt, Human
agucgaggacagggag

SEQ ID NO: 3593790 - RNA, 19 nt, Human
agucgauagagcuguauua

SEQ ID NO: 3593791 - RNA, 21 nt, Human
agucgccuuucagcaggcagc

SEQ ID NO: 3593792 - RNA, 13 nt, Human
agucgcgcugccu

SEQ ID NO: 3593793 - RNA, 19 nt, Human
agucgcugugguuguuuua

SEQ ID NO: 3593794 - RNA, 15 nt, Human
agucggaacagcaga

SEQ ID NO: 3593795 - RNA, 18 nt, Human
agucguacagaaagcugc

SEQ ID NO: 3593796 - RNA, 21 nt, Human
agucguccuuacuccuguggg

SEQ ID NO: 3593797 - RNA, 22 nt, Human
agucguccuuacuccuguggga

SEQ ID NO: 3593798 - RNA, 16 nt, Human
agucgucgcacagucu

SEQ ID NO: 3593799 - RNA, 21 nt, Human
agucgugagcucuugugagga

SEQ ID NO: 3593800 - RNA, 14 nt, Human
agucuaaaguuuac

SEQ ID NO: 3593801 - RNA, 18 nt, Human
agucuaaaguuuacagua

SEQ ID NO: 3593802 - RNA, 13 nt, Human
agucuacucuuaa

SEQ ID NO: 3593803 - RNA, 20 nt, Human
agucuacucuuaagccaucu

SEQ ID NO: 3593804 - RNA, 15 nt, Human
agucuagauucaaag

SEQ ID NO: 3593805 - RNA, 13 nt, Human
agucuagauucuc

SEQ ID NO: 3593806 - RNA, 14 nt, Human
agucuagauucucu

SEQ ID NO: 3593807 - RNA, 16 nt, Human
agucuagauucucugg

SEQ ID NO: 3593808 - RNA, 16 nt, Human
agucuagcacucauuu

SEQ ID NO: 3593809 - RNA, 20 nt, Human
agucuagcacucauuuucua

SEQ ID NO: 3593810 - RNA, 23 nt, Human
agucuaucaaccccagacacugg

SEQ ID NO: 3593811 - RNA, 14 nt, Human
agucuaucauuguu

SEQ ID NO: 3593812 - RNA, 14 nt, Human
agucuauccacaga

SEQ ID NO: 3593813 - RNA, 19 nt, Human
agucuaucugguauuaaau

SEQ ID NO: 3593814 - RNA, 17 nt, Human
agucuauucauuauauu

SEQ ID NO: 3593815 - RNA, 13 nt, Human
agucuauugucuc

SEQ ID NO: 3593816 - RNA, 14 nt, Human
agucucacuccccu

SEQ ID NO: 3593817 - RNA, 21 nt, Human
agucucacuccccuccuuucc

SEQ ID NO: 3593818 - RNA, 16 nt, Human
agucucacuguugccc

SEQ ID NO: 3593819 - RNA, 17 nt, Human
agucucacuguugccca

SEQ ID NO: 3593820 - RNA, 19 nt, Human
agucucacuguugcccagg

SEQ ID NO: 3593821 - RNA, 21 nt, Human
agucucacuguugcccaggcu

SEQ ID NO: 3593822 - RNA, 18 nt, Human
agucucagcuaagcucac

SEQ ID NO: 3593823 - RNA, 22 nt, Human
agucucaggaaaucaaauaugc

SEQ ID NO: 3593824 - RNA, 13 nt, Human
agucucaggagca

SEQ ID NO: 3593825 - RNA, 18 nt, Human
agucucaguuuguguguc

SEQ ID NO: 3593826 - RNA, 20 nt, Human
agucucaguuugugugucuu

SEQ ID NO: 3593827 - RNA, 21 nt, Human
agucucaguuugugugucuua

SEQ ID NO: 3593828 - RNA, 15 nt, Human
agucuccaccaggaa

SEQ ID NO: 3593829 - RNA, 16 nt, Human
agucuccaccaggaac

SEQ ID NO: 3593830 - RNA, 12 nt, Human
agucuccagccc

SEQ ID NO: 3593831 - RNA, 22 nt, Human
agucuccagugguugcuguuga

SEQ ID NO: 3593832 - RNA, 13 nt, Human
agucucccaggga

SEQ ID NO: 3593833 - RNA, 15 nt, Human
agucucccucacagc

SEQ ID NO: 3593834 - RNA, 17 nt, Human
agucuccggccucucca

SEQ ID NO: 3593835 - RNA, 11 nt, Human
agucuccucaa

SEQ ID NO: 3593836 - RNA, 23 nt, Human
agucuccucaauuuuugucucag

SEQ ID NO: 3593837 - RNA, 19 nt, Human
agucuccucuuuaaaacaa

SEQ ID NO: 3593838 - RNA, 20 nt, Human
agucuccucuuuaaaacaaa

SEQ ID NO: 3593839 - RNA, 22 nt, Human
agucuccucuuuaaaacaaaac

SEQ ID NO: 3593840 - RNA, 20 nt, Human
agucucgcucugucacccag

SEQ ID NO: 3593841 - RNA, 20 nt, Human
agucucgucucuuuuacccu

SEQ ID NO: 3593842 - RNA, 15 nt, Human
agucucuauaccaau

SEQ ID NO: 3593843 - RNA, 17 nt, Human
agucucuauaccaauaa

SEQ ID NO: 3593844 - RNA, 17 nt, Human
agucucuaucauuaaag

SEQ ID NO: 3593845 - RNA, 22 nt, Human
agucucuauuuaaauucuuuuu

SEQ ID NO: 3593846 - RNA, 17 nt, Human
agucucucuuaaaguug

SEQ ID NO: 3593847 - RNA, 23 nt, Human
agucucucuuaaaguuggaauuu

SEQ ID NO: 3593848 - RNA, 19 nt, Human
agucucugaagugaaacug

SEQ ID NO: 3593849 - RNA, 23 nt, Human
agucucugaggggcuaccaggaa

SEQ ID NO: 3593850 - RNA, 17 nt, Human
agucucugccuugccuu

SEQ ID NO: 3593851 - RNA, 13 nt, Human
agucucugcucca

SEQ ID NO: 3593852 - RNA, 16 nt, Human
agucucugugcuuuga

SEQ ID NO: 3593853 - RNA, 17 nt, Human
agucucuuguauuaaac

SEQ ID NO: 3593854 - RNA, 22 nt, Human
agucucuuuaaucuucaguuuu

SEQ ID NO: 3593855 - RNA, 23 nt, Human
agucucuuuaaucuucaguuuua

SEQ ID NO: 3593856 - RNA, 16 nt, Human
agucucuuuauuccua

SEQ ID NO: 3593857 - RNA, 17 nt, Human
agucucuuuauuccuag

SEQ ID NO: 3593858 - RNA, 23 nt, Human
agucucuuuucuuuagagcauug

SEQ ID NO: 3593859 - RNA, 20 nt, Human
agucucuuuuuuacaaaggc

SEQ ID NO: 3593860 - RNA, 21 nt, Human
agucucuuuuuuacaaaggcu

SEQ ID NO: 3593861 - RNA, 22 nt, Human
agucucuuuuuuacaaaggcug

SEQ ID NO: 3593862 - RNA, 21 nt, Human
agucucuuuuuuuggcccagg

SEQ ID NO: 3593863 - RNA, 15 nt, Human
agucugaaggcuggg

SEQ ID NO: 3593864 - RNA, 18 nt, Human
agucugaaguuucauuua

SEQ ID NO: 3593865 - RNA, 17 nt, Human
agucugaaugcugccac

SEQ ID NO: 3593866 - RNA, 16 nt, Human
agucugaauuuuuaaa

SEQ ID NO: 3593867 - RNA, 16 nt, Human
agucugagagaggcca

SEQ ID NO: 3593868 - RNA, 18 nt, Human
agucugaggccguugcug

SEQ ID NO: 3593869 - RNA, 17 nt, Human
agucugagggcuuguag

SEQ ID NO: 3593870 - RNA, 17 nt, Human
agucugagguccugagc

SEQ ID NO: 3593871 - RNA, 22 nt, Human
agucugauccaggaggccgggg

SEQ ID NO: 3593872 - RNA, 21 nt, Human
agucugaucgugacgcugaau

SEQ ID NO: 3593873 - RNA, 20 nt, Human
agucugauucccaagcucug

SEQ ID NO: 3593874 - RNA, 21 nt, Human
agucugauucccaagcucugc

SEQ ID NO: 3593875 - RNA, 18 nt, Human
agucugcauuacauuccu

SEQ ID NO: 3593876 - RNA, 14 nt, Human
agucugccacccag

SEQ ID NO: 3593877 - RNA, 17 nt, Human
agucugcugcccuccau

SEQ ID NO: 3593878 - RNA, 20 nt, Human
agucugcugcccuccauccc

SEQ ID NO: 3593879 - RNA, 17 nt, Human
agucugcuuagaaauaa

SEQ ID NO: 3593880 - RNA, 19 nt, Human
agucugcuuauccuuccac

SEQ ID NO: 3593881 - RNA, 17 nt, Human
agucuggaaugcagugg

SEQ ID NO: 3593882 - RNA, 19 nt, Human
agucuggagugggcagagc

SEQ ID NO: 3593883 - RNA, 21 nt, Human
agucuggauaacuuccacagg

SEQ ID NO: 3593884 - RNA, 23 nt, Human
agucuggauaacuuccacagggu

SEQ ID NO: 3593885 - RNA, 21 nt, Human
agucuggcuguacccaggaau

SEQ ID NO: 3593886 - RNA, 21 nt, Human
agucugggacacaaaacuccg

SEQ ID NO: 3593887 - RNA, 15 nt, Human
agucuggugaagcuc

SEQ ID NO: 3593888 - RNA, 17 nt, Human
agucuguacuaaacagu

SEQ ID NO: 3593889 - RNA, 15 nt, Human
agucuguccugugac

SEQ ID NO: 3593890 - RNA, 18 nt, Human
agucugucucugucaugg

SEQ ID NO: 3593891 - RNA, 14 nt, Human
agucugucuucugu

SEQ ID NO: 3593892 - RNA, 19 nt, Human
agucugugugaugaacuuu

SEQ ID NO: 3593893 - RNA, 21 nt, Human
agucugugugaugaacuuucu

SEQ ID NO: 3593894 - RNA, 17 nt, Human
agucugugugggacugu

SEQ ID NO: 3593895 - RNA, 19 nt, Human
agucugugugggacuguac

SEQ ID NO: 3593896 - RNA, 20 nt, Human
agccagacacucugcucugc

SEQ ID NO: 3593897 - RNA, 13 nt, Human
agccagacagacc

SEQ ID NO: 3593898 - RNA, 15 nt, Human
agccagacagacccu

SEQ ID NO: 3593899 - RNA, 21 nt, Human
agccagacagcaacggggagg

SEQ ID NO: 3593900 - RNA, 16 nt, Human
aguccccaggccccag

SEQ ID NO: 3593901 - RNA, 19 nt, Human
aguccccaggccccaggaa

SEQ ID NO: 3593902 - RNA, 18 nt, Human
aguccccauugaggcuug

SEQ ID NO: 3593903 - RNA, 19 nt, Human
agucccccaacucugagcc

SEQ ID NO: 3593904 - RNA, 18 nt, Human
agucccccagagauguca

SEQ ID NO: 3593905 - RNA, 18 nt, Human
agucccccuauccuuggc

SEQ ID NO: 3593906 - RNA, 19 nt, Human
aguccccgaguuuccccag

SEQ ID NO: 3593907 - RNA, 16 nt, Human
aguccccguggccauc

SEQ ID NO: 3593908 - RNA, 13 nt, Human
aguccccucccau

SEQ ID NO: 3593909 - RNA, 21 nt, Human
aguccccucccaucugggagu

SEQ ID NO: 3593910 - RNA, 21 nt, Human
aguccccuccccggcccuacc

SEQ ID NO: 3593911 - RNA, 14 nt, Human
agucccgccccucu

SEQ ID NO: 3593912 - RNA, 20 nt, Human
agucccugaggcaggucccc

SEQ ID NO: 3593913 - RNA, 22 nt, Human
agucccugaggcagguccccag

SEQ ID NO: 3593914 - RNA, 19 nt, Human
agucccugcacagugacuu

SEQ ID NO: 3593915 - RNA, 21 nt, Human
agucccugggggaagcccugg

SEQ ID NO: 3593916 - RNA, 22 nt, Human
agucccugggggaagcccugga

SEQ ID NO: 3593917 - RNA, 14 nt, Human
agucccugucaccu

SEQ ID NO: 3593918 - RNA, 19 nt, Human
agucccugucaccucuucc

SEQ ID NO: 3593919 - RNA, 21 nt, Human
agucccugugaagacugggug

SEQ ID NO: 3593920 - RNA, 17 nt, Human
agucccuguuuucugag

SEQ ID NO: 3593921 - RNA, 19 nt, Human
agucccuguuuucugagcc

SEQ ID NO: 3593922 - RNA, 22 nt, Human
agucccuguuuucugagcccgg

SEQ ID NO: 3593923 - RNA, 19 nt, Human
agucccuuccacaccccca

SEQ ID NO: 3593924 - RNA, 14 nt, Human
agucccuuccaggc

SEQ ID NO: 3593925 - RNA, 21 nt, Human
agucccuuccccucccuggcu

SEQ ID NO: 3593926 - RNA, 21 nt, Human
aguccgaccuggccugucugu

SEQ ID NO: 3593927 - RNA, 15 nt, Human
aguccgcagaagccc

SEQ ID NO: 3593928 - RNA, 22 nt, Human
aguccggacccaccucaccccg

SEQ ID NO: 3593929 - RNA, 23 nt, Human
aguccgugggacgggaugguucu

SEQ ID NO: 3593930 - RNA, 19 nt, Human
aguccguguggauccaaug

SEQ ID NO: 3593931 - RNA, 12 nt, Human
aguccuagcugc

SEQ ID NO: 3593932 - RNA, 15 nt, Human
aguccuagcugcaca

SEQ ID NO: 3593933 - RNA, 20 nt, Human
aguccuagcugcacagggca

SEQ ID NO: 3593934 - RNA, 22 nt, Human
aguccuagcugcacagggcagc

SEQ ID NO: 3593935 - RNA, 16 nt, Human
aguccuagugaaccuc

SEQ ID NO: 3593936 - RNA, 15 nt, Human
aguccuaucugggcu

SEQ ID NO: 3593937 - RNA, 19 nt, Human
aguccuaucugggcuuccu

SEQ ID NO: 3593938 - RNA, 18 nt, Human
aguccuauucaaauuccu

SEQ ID NO: 3593939 - RNA, 19 nt, Human
aguccucaaagcuuuuuga

SEQ ID NO: 3593940 - RNA, 20 nt, Human
aguccucaaggggccauccu

SEQ ID NO: 3593941 - RNA, 16 nt, Human
agugcuaagguucuaa

SEQ ID NO: 3593942 - RNA, 17 nt, Human
agugcuaagguucuaag

SEQ ID NO: 3593943 - RNA, 13 nt, Human
agugcuaagugug

SEQ ID NO: 3593944 - RNA, 15 nt, Human
agugcuaagugugaa

SEQ ID NO: 3593945 - RNA, 16 nt, Human
agugcuaagugugaac

SEQ ID NO: 3593946 - RNA, 16 nt, Human
agugcuacagggucca

SEQ ID NO: 3593947 - RNA, 23 nt, Human
agugcuagugagcugggcauggu

SEQ ID NO: 3593948 - RNA, 15 nt, Human
agugcuauauauaua

SEQ ID NO: 3593949 - RNA, 14 nt, Human
agugcucaucuguu

SEQ ID NO: 3593950 - RNA, 11 nt, Human
agugcucccuc

SEQ ID NO: 3593951 - RNA, 14 nt, Human
agugcucccucaca

SEQ ID NO: 3593952 - RNA, 16 nt, Human
agugcucgcuguugcu

SEQ ID NO: 3593953 - RNA, 18 nt, Human
agugcucgcuuucuaugu

SEQ ID NO: 3593954 - RNA, 17 nt, Human
agugcucugaucccucu

SEQ ID NO: 3593955 - RNA, 16 nt, Human
agugcugaacagugga

SEQ ID NO: 3593956 - RNA, 19 nt, Human
agugcugaauuucccucuc

SEQ ID NO: 3593957 - RNA, 15 nt, Human
agugcugagauuaca

SEQ ID NO: 3593958 - RNA, 21 nt, Human
agugcugcagcucccuggcuu

SEQ ID NO: 3593959 - RNA, 22 nt, Human
agugcugcagcucccuggcuuc

SEQ ID NO: 3593960 - RNA, 23 nt, Human
agugcugcagcucccuggcuucu

SEQ ID NO: 3593961 - RNA, 16 nt, Human
agugcugcaucuuaua

SEQ ID NO: 3593962 - RNA, 22 nt, Human
agugcugcaucuuauagcacuu

SEQ ID NO: 3593963 - RNA, 15 nt, Human
agugcugcuuugcca

SEQ ID NO: 3593964 - RNA, 20 nt, Human
agugcugggauuacaggugu

SEQ ID NO: 3593965 - RNA, 21 nt, Human
agugcugggauuacaggugug

SEQ ID NO: 3593966 - RNA, 12 nt, Human
agugcuguauaa

SEQ ID NO: 3593967 - RNA, 13 nt, Human
agugcuguauaaa

SEQ ID NO: 3593968 - RNA, 14 nt, Human
agugcuguauaaaa

SEQ ID NO: 3593969 - RNA, 22 nt, Human
agugcuguauaaaaucagccaa

SEQ ID NO: 3593970 - RNA, 19 nt, Human
agugcuguccaugcuucuc

SEQ ID NO: 3593971 - RNA, 20 nt, Human
agugcugucugaucugugcu

SEQ ID NO: 3593972 - RNA, 14 nt, Human
agugcugugaaaaa

SEQ ID NO: 3593973 - RNA, 18 nt, Human
agugcugugcaagguauu

SEQ ID NO: 3593974 - RNA, 21 nt, Human
agugcuguuuauuaaucuuag

SEQ ID NO: 3593975 - RNA, 15 nt, Human
agugcuguuuuguua

SEQ ID NO: 3593976 - RNA, 17 nt, Human
agugcuuaaaaaucauu

SEQ ID NO: 3593977 - RNA, 15 nt, Human
agugcuuagcaaaaa

SEQ ID NO: 3593978 - RNA, 15 nt, Human
agugcuucagccuga

SEQ ID NO: 3593979 - RNA, 19 nt, Human
agugcuucagccugaggcu

SEQ ID NO: 3593980 - RNA, 20 nt, Human
agugcuucagccugaggcug

SEQ ID NO: 3593981 - RNA, 17 nt, Human
agugcuuccaaggcaga

SEQ ID NO: 3593982 - RNA, 14 nt, Human
agugcuucucuaca

SEQ ID NO: 3593983 - RNA, 21 nt, Human
agugcuucuuacuauuaagca

SEQ ID NO: 3593984 - RNA, 16 nt, Human
agugcuugccacagag

SEQ ID NO: 3593985 - RNA, 17 nt, Human
agugcuugccacagagc

SEQ ID NO: 3593986 - RNA, 19 nt, Human
agugcuugccacagagcgg

SEQ ID NO: 3593987 - RNA, 13 nt, Human
agugcuugcuuuu

SEQ ID NO: 3593988 - RNA, 13 nt, Human
agugcuuggaaca

SEQ ID NO: 3593989 - RNA, 12 nt, Human
agugcuuggccc

SEQ ID NO: 3593990 - RNA, 15 nt, Human
agugcuuggcccagg

SEQ ID NO: 3593991 - RNA, 13 nt, Human
agugcuuguguaa

SEQ ID NO: 3593992 - RNA, 22 nt, Human
agugcuuguguaauuuauguga

SEQ ID NO: 3593993 - RNA, 22 nt, Human
agugcuuuccuuuuuuaaaaau

SEQ ID NO: 3593994 - RNA, 23 nt, Human
agugcuuuuaagugaaaaugguc

SEQ ID NO: 3593995 - RNA, 13 nt, Human
aguggaaaaacac

SEQ ID NO: 3593996 - RNA, 14 nt, Human
aguggaaaaggcac

SEQ ID NO: 3593997 - RNA, 23 nt, Human
aguggaaaauaggcuuuuuaauc

SEQ ID NO: 3593998 - RNA, 20 nt, Human
aguggaaacuauguguuuuu

SEQ ID NO: 3593999 - RNA, 16 nt, Human
aguggaaccagcccag

SEQ ID NO: 3594000 - RNA, 24 nt, Human
aguggaacgaaaaugaaagcuacu

SEQ ID NO: 3594001 - RNA, 16 nt, Human
aguggaagaagaggga

SEQ ID NO: 3594002 - RNA, 17 nt, Human
aguggaaguaguggagc

SEQ ID NO: 3594003 - RNA, 21 nt, Human
aguggaaguauguauauuaaa

SEQ ID NO: 3594004 - RNA, 22 nt, Human
aguggaaguauguauauuaaaa

SEQ ID NO: 3594005 - RNA, 17 nt, Human
aguggaauaguauccuc

SEQ ID NO: 3594006 - RNA, 21 nt, Human
aguggaauaguauccuccagg

SEQ ID NO: 3594007 - RNA, 14 nt, Human
aguggaauuucuug

SEQ ID NO: 3594008 - RNA, 19 nt, Human
aguggacaaauuuugaguu

SEQ ID NO: 3594009 - RNA, 21 nt, Human
aguggacccugaaaugugugu

SEQ ID NO: 3594010 - RNA, 21 nt, Human
aguggaccgcccuuuuccccu

SEQ ID NO: 3594011 - RNA, 19 nt, Human
aguggaccuugagaccaca

SEQ ID NO: 3594012 - RNA, 16 nt, Human
aguggacucagggcag

SEQ ID NO: 3594013 - RNA, 20 nt, Human
aguggacuggaggagcuggg

SEQ ID NO: 3594014 - RNA, 19 nt, Human
aguggacuggaguggagca

SEQ ID NO: 3594015 - RNA, 20 nt, Human
aguggacuuuccacccccuc

SEQ ID NO: 3594016 - RNA, 19 nt, Human
aguggagaacugggcuugc

SEQ ID NO: 3594017 - RNA, 12 nt, Human
aguggagaggga

SEQ ID NO: 3594018 - RNA, 20 nt, Human
aguggagccugacagccaga

SEQ ID NO: 3594019 - RNA, 14 nt, Human
aguggaggugcugc

SEQ ID NO: 3594020 - RNA, 22 nt, Human
aguggagguuaaggcugaggaa

SEQ ID NO: 3594021 - RNA, 20 nt, Human
aguggagucugccacccagg

SEQ ID NO: 3594022 - RNA, 18 nt, Human
aguggaucuccaaggacc

SEQ ID NO: 3594023 - RNA, 20 nt, Human
aguggaugauguuucgugaa

SEQ ID NO: 3594024 - RNA, 17 nt, Human
aguggauggaaggggcu

SEQ ID NO: 3594025 - RNA, 21 nt, Human
aguggauuguaggugcaagau

SEQ ID NO: 3594026 - RNA, 15 nt, Human
aguggauuucccauc

SEQ ID NO: 3594027 - RNA, 23 nt, Human
aguggcaagaccaaaaugacaau

SEQ ID NO: 3594028 - RNA, 13 nt, Human
aguggcaccuguc

SEQ ID NO: 3594029 - RNA, 22 nt, Human
aguggcaccugucugcuccagc

SEQ ID NO: 3594030 - RNA, 20 nt, Human
aguggcacgucaucuaguuu

SEQ ID NO: 3594031 - RNA, 14 nt, Human
aguggcagcccagc

SEQ ID NO: 3594032 - RNA, 15 nt, Human
aguggcagcccagcc

SEQ ID NO: 3594033 - RNA, 16 nt, Human
aguggcagcccagcca

SEQ ID NO: 3594034 - RNA, 17 nt, Human
aguggcagcccagccag

SEQ ID NO: 3594035 - RNA, 13 nt, Human
aguggcagcugcu

SEQ ID NO: 3594036 - RNA, 13 nt, Human
aguggcaggacag

SEQ ID NO: 3594037 - RNA, 23 nt, Human
aguggcaggcagaggcccaggcu

SEQ ID NO: 3594038 - RNA, 12 nt, Human
aguggcagggca

SEQ ID NO: 3594039 - RNA, 13 nt, Human
aguggcagggcuc

SEQ ID NO: 3594040 - RNA, 17 nt, Human
aguggcagggcucagga

SEQ ID NO: 3594041 - RNA, 18 nt, Human
aguggcagggcucaggau

SEQ ID NO: 3594042 - RNA, 13 nt, Human
aguggcauaaaaa

SEQ ID NO: 3594043 - RNA, 15 nt, Human
aguggcaucaucuca

SEQ ID NO: 3594044 - RNA, 16 nt, Human
agucuauccacagaga

SEQ ID NO: 3594045 - RNA, 14 nt, Human
agucuauuagccac

SEQ ID NO: 3594046 - RNA, 22 nt, Human
agucucacaugauuccagccau

SEQ ID NO: 3594047 - RNA, 24 nt, Human
agucucacaugauuccagccauca

SEQ ID NO: 3594048 - RNA, 20 nt, Human
agucucaccauuuccccagg

SEQ ID NO: 3594049 - RNA, 22 nt, Human
agucucaccauuuccccagggc

SEQ ID NO: 3594050 - RNA, 16 nt, Human
agucucacuccccucc

SEQ ID NO: 3594051 - RNA, 18 nt, Human
agucucacuguugcccag

SEQ ID NO: 3594052 - RNA, 20 nt, Human
agucucacuguugcccaggc

SEQ ID NO: 3594053 - RNA, 19 nt, Human
agucucacuuugucgccca

SEQ ID NO: 3594054 - RNA, 19 nt, Human
agucucagaaugucauuuu

SEQ ID NO: 3594055 - RNA, 11 nt, Human
agucucagcua

SEQ ID NO: 3594056 - RNA, 17 nt, Human
agucucaggagcauggg

SEQ ID NO: 3594057 - RNA, 18 nt, Human
agucucaggagucucugg

SEQ ID NO: 3594058 - RNA, 10 nt, Human
agucucaguu

SEQ ID NO: 3594059 - RNA, 19 nt, Human
agucucauagguuaaaaaa

SEQ ID NO: 3594060 - RNA, 19 nt, Human
agucuccagugguugcugu

SEQ ID NO: 3594061 - RNA, 14 nt, Human
agucucccaaggcu

SEQ ID NO: 3594062 - RNA, 20 nt, Human
agucucccucacagcacaga

SEQ ID NO: 3594063 - RNA, 23 nt, Human
agucucccucacagcacagagaa

SEQ ID NO: 3594064 - RNA, 18 nt, Human
agucucccucccuugggg

SEQ ID NO: 3594065 - RNA, 15 nt, Human
agucucccuuccuau

SEQ ID NO: 3594066 - RNA, 17 nt, Human
agucucccuuucccuuc

SEQ ID NO: 3594067 - RNA, 19 nt, Human
agucuccggccucuccagc

SEQ ID NO: 3594068 - RNA, 13 nt, Human
agucuccucuuua

SEQ ID NO: 3594069 - RNA, 15 nt, Human
agucuccucuuuaaa

SEQ ID NO: 3594070 - RNA, 16 nt, Human
agucuccucuuuaaaa

SEQ ID NO: 3594071 - RNA, 18 nt, Human
agucuccucuuuaaaaca

SEQ ID NO: 3594072 - RNA, 21 nt, Human
agucuccuuugcacugagggc

SEQ ID NO: 3594073 - RNA, 23 nt, Human
agucucgcucuguugcccaggcu

SEQ ID NO: 3594074 - RNA, 19 nt, Human
agucucuauaccaauaaag

SEQ ID NO: 3594075 - RNA, 21 nt, Human
agucucuauaccaauaaagug

SEQ ID NO: 3594076 - RNA, 15 nt, Human
agucucuaucauuaa

SEQ ID NO: 3594077 - RNA, 16 nt, Human
agucucuaucauuaaa

SEQ ID NO: 3594078 - RNA, 21 nt, Human
agucucuaucauuaaaguucu

SEQ ID NO: 3594079 - RNA, 15 nt, Human
agucucuauuuaaau

SEQ ID NO: 3594080 - RNA, 18 nt, Human
agucucuauuuaaauucu

SEQ ID NO: 3594081 - RNA, 21 nt, Human
agucucuauuuaaauucuuuu

SEQ ID NO: 3594082 - RNA, 11 nt, Human
agucucuccug

SEQ ID NO: 3594083 - RNA, 13 nt, Human
agucucuccugua

SEQ ID NO: 3594084 - RNA, 21 nt, Human
agucucucuucucuccagcug

SEQ ID NO: 3594085 - RNA, 11 nt, Human
agucucugagc

SEQ ID NO: 3594086 - RNA, 13 nt, Human
agucucugagcag

SEQ ID NO: 3594087 - RNA, 15 nt, Human
agucucugagggcuu

SEQ ID NO: 3594088 - RNA, 19 nt, Human
agucucugagggcuuccuu

SEQ ID NO: 3594089 - RNA, 16 nt, Human
agucucugaggggcua

SEQ ID NO: 3594090 - RNA, 22 nt, Human
agucucugaggggcuaccagga

SEQ ID NO: 3594091 - RNA, 13 nt, Human
agucucugccuug

SEQ ID NO: 3594092 - RNA, 15 nt, Human
agucucugcuccacc

SEQ ID NO: 3594093 - RNA, 16 nt, Human
agucucuggggcaggc

SEQ ID NO: 3594094 - RNA, 18 nt, Human
agucucuggggcaggcug

SEQ ID NO: 3594095 - RNA, 11 nt, Human
agucucuguga

SEQ ID NO: 3594096 - RNA, 12 nt, Human
agucucugugag

SEQ ID NO: 3594097 - RNA, 14 nt, Human
agucucuucuccac

SEQ ID NO: 3594098 - RNA, 18 nt, Human
agucucuucuccacugga

SEQ ID NO: 3594099 - RNA, 17 nt, Human
agucucuugauucauaa

SEQ ID NO: 3594100 - RNA, 15 nt, Human
agucucuuuaaucuu

SEQ ID NO: 3594101 - RNA, 18 nt, Human
agucucuuuauuccuagu

SEQ ID NO: 3594102 - RNA, 23 nt, Human
agucucuuuauuccuaguuggug

SEQ ID NO: 3594103 - RNA, 21 nt, Human
agucucuuuucuuuagagcau

SEQ ID NO: 3594104 - RNA, 16 nt, Human
agucucuuuuuuacaa

SEQ ID NO: 3594105 - RNA, 17 nt, Human
agucucuuuuuuacaaa

SEQ ID NO: 3594106 - RNA, 19 nt, Human
agucucuuuuuuacaaagg

SEQ ID NO: 3594107 - RNA, 23 nt, Human
agugugccccccauccuggccca

SEQ ID NO: 3594108 - RNA, 22 nt, Human
agugugcgugguggucccuggg

SEQ ID NO: 3594109 - RNA, 23 nt, Human
agugugcgugguggucccugggu

SEQ ID NO: 3594110 - RNA, 14 nt, Human
agugugcuaaaaau

SEQ ID NO: 3594111 - RNA, 13 nt, Human
agugugcuggagg

SEQ ID NO: 3594112 - RNA, 15 nt, Human
agugugcuggaggac

SEQ ID NO: 3594113 - RNA, 22 nt, Human
agugugcuucuguuaucaaaca

SEQ ID NO: 3594114 - RNA, 14 nt, Human
aguguggacucugg

SEQ ID NO: 3594115 - RNA, 17 nt, Human
aguguggaguggguaau

SEQ ID NO: 3594116 - RNA, 17 nt, Human
aguguggcaguuuggca

SEQ ID NO: 3594117 - RNA, 14 nt, Human
aguguggccaggcu

SEQ ID NO: 3594118 - RNA, 14 nt, Human
aguguggcuccccu

SEQ ID NO: 3594119 - RNA, 17 nt, Human
agugugggaagggagag

SEQ ID NO: 3594120 - RNA, 20 nt, Human
agugugggaggcuccuguua

SEQ ID NO: 3594121 - RNA, 18 nt, Human
agugugggcuugaccagg

SEQ ID NO: 3594122 - RNA, 15 nt, Human
agugugggucugugu

SEQ ID NO: 3594123 - RNA, 19 nt, Human
agugugggucugugugugu

SEQ ID NO: 3594124 - RNA, 23 nt, Human
agugugguguuuccugcaggcca

SEQ ID NO: 3594125 - RNA, 20 nt, Human
agugugguguuuccuggcac

SEQ ID NO: 3594126 - RNA, 12 nt, Human
agugugguuuuc

SEQ ID NO: 3594127 - RNA, 17 nt, Human
agugugguuuucuguuu

SEQ ID NO: 3594128 - RNA, 12 nt, Human
aguguguaaaca

SEQ ID NO: 3594129 - RNA, 11 nt, Human
aguguguauua

SEQ ID NO: 3594130 - RNA, 18 nt, Human
aguguguccaagugugug

SEQ ID NO: 3594131 - RNA, 17 nt, Human
agugugucuaaauuuga

SEQ ID NO: 3594132 - RNA, 13 nt, Human
agugugucuccug

SEQ ID NO: 3594133 - RNA, 20 nt, Human
agugugucuuagugugugca

SEQ ID NO: 3594134 - RNA, 18 nt, Human
agugugugcacaugugug

SEQ ID NO: 3594135 - RNA, 17 nt, Human
agugugugcaugugugc

SEQ ID NO: 3594136 - RNA, 21 nt, Human
aguguguggcuuucagagccu

SEQ ID NO: 3594137 - RNA, 12 nt, Human
agugugugugcg

SEQ ID NO: 3594138 - RNA, 16 nt, Human
agugugugugugcaug

SEQ ID NO: 3594139 - RNA, 13 nt, Human
aguguguucugau

SEQ ID NO: 3594140 - RNA, 20 nt, Human
aguguuaauacuaguuguga

SEQ ID NO: 3594141 - RNA, 12 nt, Human
aguguuaaucaa

SEQ ID NO: 3594142 - RNA, 20 nt, Human
aguguuaaucaauuuaaacc

SEQ ID NO: 3594143 - RNA, 19 nt, Human
aguguuaggccuggcacag

SEQ ID NO: 3594144 - RNA, 19 nt, Human
aguguuagggaagggccug

SEQ ID NO: 3594145 - RNA, 15 nt, Human
aguguuauaugaaca

SEQ ID NO: 3594146 - RNA, 16 nt, Human
aguguuauaugaacau

SEQ ID NO: 3594147 - RNA, 20 nt, Human
aguguuauaugaacauacaa

SEQ ID NO: 3594148 - RNA, 16 nt, Human
aguguuaucagucaua

SEQ ID NO: 3594149 - RNA, 23 nt, Human
aguguuaucagucauaacuaaau

SEQ ID NO: 3594150 - RNA, 14 nt, Human
aguguuaugagcca

SEQ ID NO: 3594151 - RNA, 22 nt, Human
aguguuauuuucuuugaaauug

SEQ ID NO: 3594152 - RNA, 15 nt, Human
aguguucacaaccug

SEQ ID NO: 3594153 - RNA, 18 nt, Human
aguguucugccagaucuu

SEQ ID NO: 3594154 - RNA, 19 nt, Human
aguguucugucugacuuuc

SEQ ID NO: 3594155 - RNA, 18 nt, Human
aguguucuguuacaaaau

SEQ ID NO: 3594156 - RNA, 12 nt, Human
aguguugaaggg

SEQ ID NO: 3594157 - RNA, 17 nt, Human
aguguuggaaaaaauuu

SEQ ID NO: 3594158 - RNA, 14 nt, Human
aguguuggagaaga

SEQ ID NO: 3594159 - RNA, 17 nt, Human
aguguuggagaagaacu

SEQ ID NO: 3594160 - RNA, 21 nt, Human
aguguugguauauuuuauauu

SEQ ID NO: 3594161 - RNA, 16 nt, Human
aguguuguggauuuaa

SEQ ID NO: 3594162 - RNA, 20 nt, Human
aguguuguggauuuaacaga

SEQ ID NO: 3594163 - RNA, 15 nt, Human
aguguuguuuguaaa

SEQ ID NO: 3594164 - RNA, 12 nt, Human
aguguuuaaaug

SEQ ID NO: 3594165 - RNA, 18 nt, Human
aguguuuauccuuucaua

SEQ ID NO: 3594166 - RNA, 19 nt, Human
aguguuuauuuuucauauu

SEQ ID NO: 3594167 - RNA, 21 nt, Human
aguguuucagcuaagggaaga

SEQ ID NO: 3594168 - RNA, 13 nt, Human
aguguuuccuuuu

SEQ ID NO: 3594169 - RNA, 16 nt, Human
aguguuuccuuuuugg

SEQ ID NO: 3594170 - RNA, 17 nt, Human
aguguuucuaauaaacu

SEQ ID NO: 3594171 - RNA, 13 nt, Human
aguguuucugugc

SEQ ID NO: 3594172 - RNA, 12 nt, Human
aguguuucuguu

SEQ ID NO: 3594173 - RNA, 14 nt, Human
aguguuucuguuau

SEQ ID NO: 3594174 - RNA, 15 nt, Human
aguguuuuaaauucu

SEQ ID NO: 3594175 - RNA, 18 nt, Human
aguguuuuaaauucugag

SEQ ID NO: 3594176 - RNA, 19 nt, Human
aguguuuuaagaaauguag

SEQ ID NO: 3594177 - RNA, 21 nt, Human
aguguuuuaagaaauguaguu

SEQ ID NO: 3594178 - RNA, 21 nt, Human
aguguuuuaugagaaagccuu

SEQ ID NO: 3594179 - RNA, 16 nt, Human
aguguuuucaauuuua

SEQ ID NO: 3594180 - RNA, 17 nt, Human
aguguuuucagaagaaa

SEQ ID NO: 3594181 - RNA, 13 nt, Human
aguguuuucagag

SEQ ID NO: 3594182 - RNA, 15 nt, Human
aguguuuucucugaa

SEQ ID NO: 3594183 - RNA, 18 nt, Human
aguguuuuggacuccauc

SEQ ID NO: 3594184 - RNA, 20 nt, Human
aguguuuuggacuccaucuc

SEQ ID NO: 3594185 - RNA, 22 nt, Human
aguguuuuggacuccaucucuc

SEQ ID NO: 3594186 - RNA, 23 nt, Human
aguguuuuggacuccaucucuca

SEQ ID NO: 3594187 - RNA, 21 nt, Human
aguguuuuuaccucugucuug

SEQ ID NO: 3594188 - RNA, 17 nt, Human
aguuaaaaguaaaagag

SEQ ID NO: 3594189 - RNA, 13 nt, Human
aguggccuggcca

SEQ ID NO: 3594190 - RNA, 13 nt, Human
aguggccuggcuc

SEQ ID NO: 3594191 - RNA, 18 nt, Human
aguggccuuccccagcau

SEQ ID NO: 3594192 - RNA, 19 nt, Human
aguggcgugaucucagcuc

SEQ ID NO: 3594193 - RNA, 20 nt, Human
aguggcgugaucucagcuca

SEQ ID NO: 3594194 - RNA, 21 nt, Human
aguggcuccucccggugccca

SEQ ID NO: 3594195 - RNA, 15 nt, Human
aguggcucgccaggc

SEQ ID NO: 3594196 - RNA, 12 nt, Human
aguggcugcugc

SEQ ID NO: 3594197 - RNA, 13 nt, Human
aguggcugcugcc

SEQ ID NO: 3594198 - RNA, 19 nt, Human
aguggcugcugcccaggcc

SEQ ID NO: 3594199 - RNA, 22 nt, Human
aguggcugcugcccaggcccag

SEQ ID NO: 3594200 - RNA, 13 nt, Human
aguggcuggggca

SEQ ID NO: 3594201 - RNA, 15 nt, Human
aguggcugguccagg

SEQ ID NO: 3594202 - RNA, 17 nt, Human
aguggcugguccagggc

SEQ ID NO: 3594203 - RNA, 19 nt, Human
aguggcugguccagggcua

SEQ ID NO: 3594204 - RNA, 18 nt, Human
aguggcuguccagugccc

SEQ ID NO: 3594205 - RNA, 18 nt, Human
aguggcuucacuccugcu

SEQ ID NO: 3594206 - RNA, 19 nt, Human
aguggcuucacuccugcug

SEQ ID NO: 3594207 - RNA, 17 nt, Human
aguggcuucaucuguca

SEQ ID NO: 3594208 - RNA, 20 nt, Human
aguggcuucauuagagcagg

SEQ ID NO: 3594209 - RNA, 19 nt, Human
aguggcuugaaaucuuuuu

SEQ ID NO: 3594210 - RNA, 21 nt, Human
aguggcuuuuuuccuccugug

SEQ ID NO: 3594211 - RNA, 19 nt, Human
agugggaaaaauguaggag

SEQ ID NO: 3594212 - RNA, 20 nt, Human
agugggaacgugacugcccc

SEQ ID NO: 3594213 - RNA, 17 nt, Human
agugggaagcccauccu

SEQ ID NO: 3594214 - RNA, 21 nt, Human
agugggaagcccauccugacc

SEQ ID NO: 3594215 - RNA, 15 nt, Human
agugggacagcccag

SEQ ID NO: 3594216 - RNA, 22 nt, Human
agugggacagcccagagccugg

SEQ ID NO: 3594217 - RNA, 23 nt, Human
agugggacccauagaucuucuga

SEQ ID NO: 3594218 - RNA, 12 nt, Human
agugggagaaaa

SEQ ID NO: 3594219 - RNA, 15 nt, Human
agugggagaaggcag

SEQ ID NO: 3594220 - RNA, 14 nt, Human
agugggagccaggg

SEQ ID NO: 3594221 - RNA, 16 nt, Human
agugggagcugccugu

SEQ ID NO: 3594222 - RNA, 12 nt, Human
agugggaggggc

SEQ ID NO: 3594223 - RNA, 12 nt, Human
agugggagguca

SEQ ID NO: 3594224 - RNA, 22 nt, Human
agugggauaaaggcccagacuc

SEQ ID NO: 3594225 - RNA, 19 nt, Human
agugggccaggacaggccc

SEQ ID NO: 3594226 - RNA, 12 nt, Human
agugggccaggg

SEQ ID NO: 3594227 - RNA, 14 nt, Human
agugggccagggcu

SEQ ID NO: 3594228 - RNA, 22 nt, Human
agugggccagggcugcccugag

SEQ ID NO: 3594229 - RNA, 22 nt, Human
agugggcccaaugcacuuuguu

SEQ ID NO: 3594230 - RNA, 18 nt, Human
agugggcccacccggugg

SEQ ID NO: 3594231 - RNA, 19 nt, Human
agugggcccuccgacagcc

SEQ ID NO: 3594232 - RNA, 20 nt, Human
aguggggagacaccucagag

SEQ ID NO: 3594233 - RNA, 14 nt, Human
aguggggaggggcu

SEQ ID NO: 3594234 - RNA, 12 nt, Human
aguggggccugu

SEQ ID NO: 3594235 - RNA, 15 nt, Human
aguggggccugugga

SEQ ID NO: 3594236 - RNA, 15 nt, Human
aguggggcucgccau

SEQ ID NO: 3594237 - RNA, 16 nt, Human
agugggggagagcagg

SEQ ID NO: 3594238 - RNA, 21 nt, Human
agugggggagagcaggcuggc

SEQ ID NO: 3594239 - RNA, 23 nt, Human
agugggggagagcaggcuggcag

SEQ ID NO: 3594240 - RNA, 19 nt, Human
agugggggaguggccacag

SEQ ID NO: 3594241 - RNA, 18 nt, Human
agugggggaucacagccu

SEQ ID NO: 3594242 - RNA, 20 nt, Human
agugggggaucacagccucu

SEQ ID NO: 3594243 - RNA, 18 nt, Human
aguggggggaacgcccac

SEQ ID NO: 3594244 - RNA, 19 nt, Human
aguggggggaacgcccacu

SEQ ID NO: 3594245 - RNA, 16 nt, Human
aguggggguggggggu

SEQ ID NO: 3594246 - RNA, 20 nt, Human
aguggggucucccucuccug

SEQ ID NO: 3594247 - RNA, 16 nt, Human
aguggggugcugggag

SEQ ID NO: 3594248 - RNA, 21 nt, Human
aguggggugcugggaggaggg

SEQ ID NO: 3594249 - RNA, 20 nt, Human
agugggguuaucucuguguu

SEQ ID NO: 3594250 - RNA, 14 nt, Human
agugggucccacuu

SEQ ID NO: 3594251 - RNA, 17 nt, Human
agugggucccacuuccc

SEQ ID NO: 3594252 - RNA, 22 nt, Human
agugggucccacuuccccuccu

SEQ ID NO: 3594253 - RNA, 19 nt, Human
agugggugagaugcuggag

SEQ ID NO: 3594254 - RNA, 16 nt, Human
agugguaagcucuggc

SEQ ID NO: 3594255 - RNA, 18 nt, Human
agugguauagaaaugcug

SEQ ID NO: 3594256 - RNA, 18 nt, Human
agugguccauggaaugcu

SEQ ID NO: 3594257 - RNA, 16 nt, Human
aguggucccugcccuc

SEQ ID NO: 3594258 - RNA, 20 nt, Human
aguggucuuuccuaucaugg

SEQ ID NO: 3594259 - RNA, 15 nt, Human
aguggucuuucugga

SEQ ID NO: 3594260 - RNA, 18 nt, Human
aguggucuuucuggagag

SEQ ID NO: 3594261 - RNA, 20 nt, Human
aguggucuuucuggagaggu

SEQ ID NO: 3594262 - RNA, 16 nt, Human
aguggucuuuguaaga

SEQ ID NO: 3594263 - RNA, 19 nt, Human
aguggucuuuguaagagug

SEQ ID NO: 3594264 - RNA, 23 nt, Human
aguggugccaucauugcugucug

SEQ ID NO: 3594265 - RNA, 16 nt, Human
aguggugcucaguugu

SEQ ID NO: 3594266 - RNA, 22 nt, Human
agugguggcagugcagcaacca

SEQ ID NO: 3594267 - RNA, 14 nt, Human
agugguggcucuga

SEQ ID NO: 3594268 - RNA, 20 nt, Human
aguggugguaacccuggugg

SEQ ID NO: 3594269 - RNA, 22 nt, Human
agugguguuuuaaagagaaugu

SEQ ID NO: 3594270 - RNA, 16 nt, Human
agugguuuuaauaaaa

SEQ ID NO: 3594271 - RNA, 16 nt, Human
aguguaaaaaugagaa

SEQ ID NO: 3594272 - RNA, 18 nt, Human
aguguaaagcauuccaac

SEQ ID NO: 3594273 - RNA, 20 nt, Human
aguguaaagcauuccaacaa

SEQ ID NO: 3594274 - RNA, 20 nt, Human
aguguaacaagaaaggagag

SEQ ID NO: 3594275 - RNA, 22 nt, Human
aguguaacaauuguguagccuu

SEQ ID NO: 3594276 - RNA, 16 nt, Human
aguguaacagcugagg

SEQ ID NO: 3594277 - RNA, 22 nt, Human
aguguaacauaugcaaacauaa

SEQ ID NO: 3594278 - RNA, 16 nt, Human
aguguaacuugcuuaa

SEQ ID NO: 3594279 - RNA, 15 nt, Human
aguguaauaauauga

SEQ ID NO: 3594280 - RNA, 16 nt, Human
aguguaauuucuuugc

SEQ ID NO: 3594281 - RNA, 16 nt, Human
aguguacagccagacc

SEQ ID NO: 3594282 - RNA, 13 nt, Human
aguguacagucuu

SEQ ID NO: 3594283 - RNA, 15 nt, Human
aguguacagucuugu

SEQ ID NO: 3594284 - RNA, 17 nt, Human
aguguacagucuuguau

SEQ ID NO: 3594285 - RNA, 14 nt, Human
aguguacauagugu

SEQ ID NO: 3594286 - RNA, 16 nt, Human
aguguacauaguguaa

SEQ ID NO: 3594287 - RNA, 20 nt, Human
aguguacauuucuauaaaua

SEQ ID NO: 3594288 - RNA, 12 nt, Human
aguguaccauua

SEQ ID NO: 3594289 - RNA, 18 nt, Human
aguguaccauuaaaauau

SEQ ID NO: 3594290 - RNA, 16 nt, Human
aguguaccauuugccu

SEQ ID NO: 3594291 - RNA, 19 nt, Human
aguguacccccgcccaggc

SEQ ID NO: 3594292 - RNA, 22 nt, Human
aguguacccccgcccaggcugg

SEQ ID NO: 3594293 - RNA, 23 nt, Human
aguguaccgcgucuacccuggga

SEQ ID NO: 3594294 - RNA, 14 nt, Human
aguguaccuccucu

SEQ ID NO: 3594295 - RNA, 15 nt, Human
aguguaccuccucuc

SEQ ID NO: 3594296 - RNA, 21 nt, Human
aguguaccuccucucaguguu

SEQ ID NO: 3594297 - RNA, 22 nt, Human
aguguaccuccucucaguguuu

SEQ ID NO: 3594298 - RNA, 13 nt, Human
aguguaccugugu

SEQ ID NO: 3594299 - RNA, 16 nt, Human
aguguacuaauuaaca

SEQ ID NO: 3594300 - RNA, 20 nt, Human
aguguagaaccuaauucaau

SEQ ID NO: 3594301 - RNA, 20 nt, Human
aguguagaagcauuccuucu

SEQ ID NO: 3594302 - RNA, 14 nt, Human
aguguagauuuuau

SEQ ID NO: 3594303 - RNA, 15 nt, Human
aguguagauuuuaua

SEQ ID NO: 3594304 - RNA, 19 nt, Human
aguguagcauccuaaagau

SEQ ID NO: 3594305 - RNA, 16 nt, Human
aguguagccagguccc

SEQ ID NO: 3594306 - RNA, 17 nt, Human
aguguagccaggucccc

SEQ ID NO: 3594307 - RNA, 23 nt, Human
aguguagccaggucccccugcag

SEQ ID NO: 3594308 - RNA, 16 nt, Human
aguguagccccaagaa

SEQ ID NO: 3594309 - RNA, 15 nt, Human
aguguagccuugccc

SEQ ID NO: 3594310 - RNA, 20 nt, Human
aguguaggcagacacaggga

SEQ ID NO: 3594311 - RNA, 23 nt, Human
aguguaggcagacacagggacuu

SEQ ID NO: 3594312 - RNA, 17 nt, Human
aguuuggauauguaaaa

SEQ ID NO: 3594313 - RNA, 20 nt, Human
aguuuggauauguaaaacau

SEQ ID NO: 3594314 - RNA, 18 nt, Human
aguuuggauucuuaugua

SEQ ID NO: 3594315 - RNA, 11 nt, Human
aguuuggccag

SEQ ID NO: 3594316 - RNA, 13 nt, Human
aguuuggccagaa

SEQ ID NO: 3594317 - RNA, 23 nt, Human
aguuuggcugcugucauaacauc

SEQ ID NO: 3594318 - RNA, 14 nt, Human
aguuugggcuucag

SEQ ID NO: 3594319 - RNA, 15 nt, Human
aguuugggcuucagc

SEQ ID NO: 3594320 - RNA, 20 nt, Human
aguuuggggcaagucaugua

SEQ ID NO: 3594321 - RNA, 22 nt, Human
aguuuggggcaagucauguaaa

SEQ ID NO: 3594322 - RNA, 17 nt, Human
aguuuguaaauguuauu

SEQ ID NO: 3594323 - RNA, 23 nt, Human
aguuuguacagacguaugcuuau

SEQ ID NO: 3594324 - RNA, 18 nt, Human
aguuuguacaugcauuca

SEQ ID NO: 3594325 - RNA, 14 nt, Human
aguuuguagguaaa

SEQ ID NO: 3594326 - RNA, 21 nt, Human
aguuuguagguaaaauguauu

SEQ ID NO: 3594327 - RNA, 22 nt, Human
aguuuguagguaaaauguauuu

SEQ ID NO: 3594328 - RNA, 17 nt, Human
aguuuguaguuguuuua

SEQ ID NO: 3594329 - RNA, 14 nt, Human
aguuuguauaacuu

SEQ ID NO: 3594330 - RNA, 13 nt, Human
aguuugucuauuu

SEQ ID NO: 3594331 - RNA, 16 nt, Human
aguuugucuauuuuaa

SEQ ID NO: 3594332 - RNA, 22 nt, Human
aguuugugugucuuaauuauua

SEQ ID NO: 3594333 - RNA, 16 nt, Human
auaaaauaauuuuuau

SEQ ID NO: 3594334 - RNA, 22 nt, Human
auaaaauaauuuuuauauuuga

SEQ ID NO: 3594335 - RNA, 18 nt, Human
auaaaauacauagugaaa

SEQ ID NO: 3594336 - RNA, 20 nt, Human
auaaaauagcaauccuaaag

SEQ ID NO: 3594337 - RNA, 19 nt, Human
auaaaauaguuguccauau

SEQ ID NO: 3594338 - RNA, 18 nt, Human
auaaaauaucauucagca

SEQ ID NO: 3594339 - RNA, 21 nt, Human
auaaaauaugaagacauaaac

SEQ ID NO: 3594340 - RNA, 19 nt, Human
auaaaauauuuucauacag

SEQ ID NO: 3594341 - RNA, 15 nt, Human
auaaaauauuuucug

SEQ ID NO: 3594342 - RNA, 16 nt, Human
auaaaaucaaaacaag

SEQ ID NO: 3594343 - RNA, 21 nt, Human
auaaaaucaaaacaagugaaa

SEQ ID NO: 3594344 - RNA, 16 nt, Human
auaaaaucaauuuuua

SEQ ID NO: 3594345 - RNA, 18 nt, Human
auaaaaucagccaauuau

SEQ ID NO: 3594346 - RNA, 20 nt, Human
auaaaaucauaaguauuugg

SEQ ID NO: 3594347 - RNA, 22 nt, Human
auaaaaucauaaguauuuggaa

SEQ ID NO: 3594348 - RNA, 18 nt, Human
auaaaauccauacauuug

SEQ ID NO: 3594349 - RNA, 20 nt, Human
auaaaauccuaagacacaaa

SEQ ID NO: 3594350 - RNA, 14 nt, Human
auaaaauccugugc

SEQ ID NO: 3594351 - RNA, 16 nt, Human
auaaaaugaaaauugu

SEQ ID NO: 3594352 - RNA, 17 nt, Human
auaaaaugcuagguucu

SEQ ID NO: 3594353 - RNA, 18 nt, Human
auaaaaugcuagguucua

SEQ ID NO: 3594354 - RNA, 16 nt, Human
auaaaauggcaacaaa

SEQ ID NO: 3594355 - RNA, 16 nt, Human
auaaaauggcuguaau

SEQ ID NO: 3594356 - RNA, 15 nt, Human
auaaaauguguugaa

SEQ ID NO: 3594357 - RNA, 12 nt, Human
auaaaauguuga

SEQ ID NO: 3594358 - RNA, 16 nt, Human
auaaaauguugaaaag

SEQ ID NO: 3594359 - RNA, 19 nt, Human
auaaaauguugaaaaguca

SEQ ID NO: 3594360 - RNA, 16 nt, Human
auaaaauuaaagcuga

SEQ ID NO: 3594361 - RNA, 12 nt, Human
auaaaauuacag

SEQ ID NO: 3594362 - RNA, 12 nt, Human
auaaaauuauag

SEQ ID NO: 3594363 - RNA, 14 nt, Human
auaaaauuauagau

SEQ ID NO: 3594364 - RNA, 19 nt, Human
auaaaauuauagcucuaau

SEQ ID NO: 3594365 - RNA, 13 nt, Human
auaaaauuaugcc

SEQ ID NO: 3594366 - RNA, 13 nt, Human
auaaaauuauuuu

SEQ ID NO: 3594367 - RNA, 22 nt, Human
auaaaauucuauuacaguaugu

SEQ ID NO: 3594368 - RNA, 16 nt, Human
auaaaauuuugcuuuu

SEQ ID NO: 3594369 - RNA, 16 nt, Human
auaaacaaagauucau

SEQ ID NO: 3594370 - RNA, 17 nt, Human
auaaacaagaaaaauaa

SEQ ID NO: 3594371 - RNA, 15 nt, Human
auaaacaagaccacg

SEQ ID NO: 3594372 - RNA, 15 nt, Human
auaaacacauagauu

SEQ ID NO: 3594373 - RNA, 20 nt, Human
auaaacagacuguuaauuau

SEQ ID NO: 3594374 - RNA, 17 nt, Human
auaaacagaugaauaaa

SEQ ID NO: 3594375 - RNA, 19 nt, Human
auaaacaggucaaugaaug

SEQ ID NO: 3594376 - RNA, 17 nt, Human
auaaacaucacacacac

SEQ ID NO: 3594377 - RNA, 23 nt, Human
auaaacauuaagauugaggccug

SEQ ID NO: 3594378 - RNA, 15 nt, Human
auaaaccaaaggaca

SEQ ID NO: 3594379 - RNA, 20 nt, Human
auaaaccaaaggacauuaug

SEQ ID NO: 3594380 - RNA, 21 nt, Human
auaaaccagguuuagacagua

SEQ ID NO: 3594381 - RNA, 19 nt, Human
auaaaccauuuuuguuacu

SEQ ID NO: 3594382 - RNA, 20 nt, Human
auaaaccauuuuuguuacuc

SEQ ID NO: 3594383 - RNA, 22 nt, Human
auaaaccccaccccaaaauuag

SEQ ID NO: 3594384 - RNA, 20 nt, Human
auaaaccuaaaaaagauaua

SEQ ID NO: 3594385 - RNA, 16 nt, Human
auaaaccucaaaaugu

SEQ ID NO: 3594386 - RNA, 18 nt, Human
auaaaccuuaauauuucu

SEQ ID NO: 3594387 - RNA, 22 nt, Human
auaaaccuugucuaugaaauga

SEQ ID NO: 3594388 - RNA, 15 nt, Human
auaaacgauuuaauu

SEQ ID NO: 3594389 - RNA, 20 nt, Human
auaaacgauuuaauucucuu

SEQ ID NO: 3594390 - RNA, 18 nt, Human
auaaacgucuuaaauauu

SEQ ID NO: 3594391 - RNA, 17 nt, Human
auaaacuaauaauugca

SEQ ID NO: 3594392 - RNA, 22 nt, Human
auaaacuaaugguccacaccca

SEQ ID NO: 3594393 - RNA, 16 nt, Human
auaaacuacucuuuga

SEQ ID NO: 3594394 - RNA, 17 nt, Human
auaaacucauuuugcuu

SEQ ID NO: 3594395 - RNA, 12 nt, Human
auaaacugaaaa

SEQ ID NO: 3594396 - RNA, 12 nt, Human
auaaacugacuu

SEQ ID NO: 3594397 - RNA, 13 nt, Human
auaaacugacuuu

SEQ ID NO: 3594398 - RNA, 18 nt, Human
auaaacuggcagcucagc

SEQ ID NO: 3594399 - RNA, 17 nt, Human
auaaacuguccucuuuc

SEQ ID NO: 3594400 - RNA, 12 nt, Human
auaaacugugug

SEQ ID NO: 3594401 - RNA, 21 nt, Human
auaaacuguuucagauuuuuu

SEQ ID NO: 3594402 - RNA, 16 nt, Human
auaaacuuaacuuuaa

SEQ ID NO: 3594403 - RNA, 15 nt, Human
auaaacuuagaauaa

SEQ ID NO: 3594404 - RNA, 15 nt, Human
auaaacuucagcacc

SEQ ID NO: 3594405 - RNA, 21 nt, Human
auaaacuuuaccuuuuuuaua

SEQ ID NO: 3594406 - RNA, 16 nt, Human
auaaacuuuuuuucaa

SEQ ID NO: 3594407 - RNA, 23 nt, Human
auaaacuuuuuuuugagaauggu

SEQ ID NO: 3594408 - RNA, 18 nt, Human
auaaagaaaaaaauacua

SEQ ID NO: 3594409 - RNA, 17 nt, Human
auaaagaaauagaacaa

SEQ ID NO: 3594410 - RNA, 23 nt, Human
auaaagaaggaugaugucuuuuu

SEQ ID NO: 3594411 - RNA, 12 nt, Human
auaaagaauacu

SEQ ID NO: 3594412 - RNA, 20 nt, Human
auaaagaauacuugaacuug

SEQ ID NO: 3594413 - RNA, 23 nt, Human
auaaagaauaggacuuguuuuug

SEQ ID NO: 3594414 - RNA, 12 nt, Human
auaaagaauaua

SEQ ID NO: 3594415 - RNA, 11 nt, Human
auaaagaaugg

SEQ ID NO: 3594416 - RNA, 14 nt, Human
auaaagaccacuuu

SEQ ID NO: 3594417 - RNA, 16 nt, Human
auaaagaccuauaaau

SEQ ID NO: 3594418 - RNA, 22 nt, Human
auaaagacguuuuauaagcauc

SEQ ID NO: 3594419 - RNA, 20 nt, Human
auaaagagaaaauugaauuu

SEQ ID NO: 3594420 - RNA, 21 nt, Human
auaaagagaaaauugaauuua

SEQ ID NO: 3594421 - RNA, 15 nt, Human
auaaagagagaaaaa

SEQ ID NO: 3594422 - RNA, 19 nt, Human
auaaagaggcguugcuuuc

SEQ ID NO: 3594423 - RNA, 19 nt, Human
auaaagaucauguaaaagu

SEQ ID NO: 3594424 - RNA, 21 nt, Human
auaaagaugagugagcaugcc

SEQ ID NO: 3594425 - RNA, 11 nt, Human
auaaagaugau

SEQ ID NO: 3594426 - RNA, 17 nt, Human
auaaagauuuuuuaaua

SEQ ID NO: 3594427 - RNA, 14 nt, Human
auaaagcaaauaga

SEQ ID NO: 3594428 - RNA, 22 nt, Human
auaaagcaacuguuaugaaaua

SEQ ID NO: 3594429 - RNA, 12 nt, Human
auaaagcaauuu

SEQ ID NO: 3594430 - RNA, 14 nt, Human
auaaagcaauuuuc

SEQ ID NO: 3594431 - RNA, 16 nt, Human
auaaagcaauuuuccu

SEQ ID NO: 3594432 - RNA, 19 nt, Human
auaaagcaauuuuccuuga

SEQ ID NO: 3594433 - RNA, 14 nt, Human
auaaagcacagcug

SEQ ID NO: 3594434 - RNA, 14 nt, Human
auaaagcagcguuu

SEQ ID NO: 3594435 - RNA, 18 nt, Human
auaaagcagcguuucuau

SEQ ID NO: 3594436 - RNA, 20 nt, Human
auaaagcagcguuucuauga

SEQ ID NO: 3594437 - RNA, 14 nt, Human
auaaagcaguauuu

SEQ ID NO: 3594438 - RNA, 21 nt, Human
auaaagcauaaguauacaguu

SEQ ID NO: 3594439 - RNA, 17 nt, Human
auaaagcaucuaaacuu

SEQ ID NO: 3594440 - RNA, 13 nt, Human
auaaagcauuuaa

SEQ ID NO: 3594441 - RNA, 18 nt, Human
auaaagcauuuauaaauu

SEQ ID NO: 3594442 - RNA, 20 nt, Human
auaaagcccugggaucacug

SEQ ID NO: 3594443 - RNA, 21 nt, Human
auaaagccucaagguuuuagg

SEQ ID NO: 3594444 - RNA, 18 nt, Human
auaaagcuguguggcagu

SEQ ID NO: 3594445 - RNA, 15 nt, Human
auaaaggaaucuagc

SEQ ID NO: 3594446 - RNA, 14 nt, Human
auaaaggacuguaa

SEQ ID NO: 3594447 - RNA, 14 nt, Human
auaaaggauaaacu

SEQ ID NO: 3594448 - RNA, 13 nt, Human
auaaaggauguga

SEQ ID NO: 3594449 - RNA, 19 nt, Human
auaaaggccccaaauacca

SEQ ID NO: 3594450 - RNA, 20 nt, Human
auaaaggugguaugugugug

SEQ ID NO: 3594451 - RNA, 15 nt, Human
auaaagguucaugca

SEQ ID NO: 3594452 - RNA, 21 nt, Human
auaaagguugacaauaaaugu

SEQ ID NO: 3594453 - RNA, 17 nt, Human
auaaaguaaagcuaaaa

SEQ ID NO: 3594454 - RNA, 18 nt, Human
auaaaguaaauacaugca

SEQ ID NO: 3594455 - RNA, 13 nt, Human
auaaaguaguaaa

SEQ ID NO: 3594456 - RNA, 16 nt, Human
auaaaguaguccugug

SEQ ID NO: 3594457 - RNA, 17 nt, Human
auaaaguaguccuguga

SEQ ID NO: 3594458 - RNA, 11 nt, Human
auaaaguauag

SEQ ID NO: 3594459 - RNA, 14 nt, Human
auaaaguaucuaca

SEQ ID NO: 3594460 - RNA, 16 nt, Human
auaaaguauuccaccu

SEQ ID NO: 3594461 - RNA, 14 nt, Human
auaaaguauucuuu

SEQ ID NO: 3594462 - RNA, 21 nt, Human
auaaaguauuuaauuagugcu

SEQ ID NO: 3594463 - RNA, 19 nt, Human
auaaaguguaacaauugug

SEQ ID NO: 3594464 - RNA, 14 nt, Human
auaaaguuaaaagu

SEQ ID NO: 3594465 - RNA, 16 nt, Human
auaaaguugauaaaga

SEQ ID NO: 3594466 - RNA, 20 nt, Human
auaaaguugauaaagauuuu

SEQ ID NO: 3594467 - RNA, 12 nt, Human
auaaaguuugau

SEQ ID NO: 3594468 - RNA, 19 nt, Human
auaaaguuugcuuagaaaa

SEQ ID NO: 3594469 - RNA, 20 nt, Human
auaaaguuuuauauauuaua

SEQ ID NO: 3594470 - RNA, 15 nt, Human
auaaauaaaaaugga

SEQ ID NO: 3594471 - RNA, 19 nt, Human
auaaauaaaguuuguugaa

SEQ ID NO: 3594472 - RNA, 15 nt, Human
auaaauaaauaaaua

SEQ ID NO: 3594473 - RNA, 17 nt, Human
agcucauuucaugcucu

SEQ ID NO: 3594474 - RNA, 14 nt, Human
agcuccaaccugca

SEQ ID NO: 3594475 - RNA, 22 nt, Human
agcuccaagaccuguugguucc

SEQ ID NO: 3594476 - RNA, 19 nt, Human
agcuccaagcucccaggca

SEQ ID NO: 3594477 - RNA, 17 nt, Human
agcuccacucugcuucu

SEQ ID NO: 3594478 - RNA, 15 nt, Human
auaacguuuuuccuu

SEQ ID NO: 3594479 - RNA, 16 nt, Human
auaacuaaaagguaug

SEQ ID NO: 3594480 - RNA, 21 nt, Human
auaacuaaauuugauacuuau

SEQ ID NO: 3594481 - RNA, 15 nt, Human
auaacuacuguguuc

SEQ ID NO: 3594482 - RNA, 19 nt, Human
auaacuacuguguuccugg

SEQ ID NO: 3594483 - RNA, 20 nt, Human
auaacuagauggugcugaga

SEQ ID NO: 3594484 - RNA, 21 nt, Human
auaacuagauggugcugagaa

SEQ ID NO: 3594485 - RNA, 15 nt, Human
auaacuauguugaua

SEQ ID NO: 3594486 - RNA, 17 nt, Human
auaacuauucaguugug

SEQ ID NO: 3594487 - RNA, 15 nt, Human
auaacucaauggaaa

SEQ ID NO: 3594488 - RNA, 15 nt, Human
auaacucaucauaaa

SEQ ID NO: 3594489 - RNA, 15 nt, Human
aguucagcaaaacug

SEQ ID NO: 3594490 - RNA, 17 nt, Human
aguucagcaccacccua

SEQ ID NO: 3594491 - RNA, 18 nt, Human
aguucagcaccacccuag

SEQ ID NO: 3594492 - RNA, 16 nt, Human
aguucaggagucccaa

SEQ ID NO: 3594493 - RNA, 20 nt, Human
aguucaggagucccaaggaa

SEQ ID NO: 3594494 - RNA, 16 nt, Human
aguucaguaccuggag

SEQ ID NO: 3594495 - RNA, 11 nt, Human
aguucaguggc

SEQ ID NO: 3594496 - RNA, 19 nt, Human
aguucaguggcagggcuca

SEQ ID NO: 3594497 - RNA, 19 nt, Human
aguucaguuuuaccagaug

SEQ ID NO: 3594498 - RNA, 16 nt, Human
aguucauaacagugcc

SEQ ID NO: 3594499 - RNA, 17 nt, Human
aguucauaacagugcca

SEQ ID NO: 3594500 - RNA, 22 nt, Human
aguucauaacagugccauuguc

SEQ ID NO: 3594501 - RNA, 18 nt, Human
aguucauaccuaaguacu

SEQ ID NO: 3594502 - RNA, 20 nt, Human
aguucauaccuaaguacugu

SEQ ID NO: 3594503 - RNA, 19 nt, Human
aguucaucagaguuauggu

SEQ ID NO: 3594504 - RNA, 18 nt, Human
aguucauccaauccucac

SEQ ID NO: 3594505 - RNA, 20 nt, Human
aguucaucccagccccaauu

SEQ ID NO: 3594506 - RNA, 15 nt, Human
aguucaucccuucuc

SEQ ID NO: 3594507 - RNA, 13 nt, Human
aguucaucuugaa

SEQ ID NO: 3594508 - RNA, 13 nt, Human
aguucaucuuuug

SEQ ID NO: 3594509 - RNA, 13 nt, Human
aguucaugagaau

SEQ ID NO: 3594510 - RNA, 22 nt, Human
aguucaugcagcuguggcagag

SEQ ID NO: 3594511 - RNA, 16 nt, Human
aguucauguaaauaau

SEQ ID NO: 3594512 - RNA, 22 nt, Human
aguucauguauguucagaagaa

SEQ ID NO: 3594513 - RNA, 15 nt, Human
aguucauuagaaaua

SEQ ID NO: 3594514 - RNA, 23 nt, Human
aguucauuagaaauauuuuaaaa

SEQ ID NO: 3594515 - RNA, 16 nt, Human
aguucauucagggccg

SEQ ID NO: 3594516 - RNA, 14 nt, Human
aguucauucauauu

SEQ ID NO: 3594517 - RNA, 15 nt, Human
aguucauucauauua

SEQ ID NO: 3594518 - RNA, 16 nt, Human
aguucauucauauuac

SEQ ID NO: 3594519 - RNA, 23 nt, Human
aguucauucauauuacaauauuu

SEQ ID NO: 3594520 - RNA, 15 nt, Human
aguucauugcaauua

SEQ ID NO: 3594521 - RNA, 19 nt, Human
aguuccaagagucuaaaga

SEQ ID NO: 3594522 - RNA, 20 nt, Human
aguuccaagagucuaaagau

SEQ ID NO: 3594523 - RNA, 20 nt, Human
aguuccaaguccaauaagac

SEQ ID NO: 3594524 - RNA, 18 nt, Human
aguuccaccaucaagcca

SEQ ID NO: 3594525 - RNA, 15 nt, Human
aguuccacugagacc

SEQ ID NO: 3594526 - RNA, 20 nt, Human
aguuccacuuauagccucug

SEQ ID NO: 3594527 - RNA, 15 nt, Human
aguuccagaaaguaa

SEQ ID NO: 3594528 - RNA, 17 nt, Human
aguucccaaaagauugc

SEQ ID NO: 3594529 - RNA, 14 nt, Human
aguucccagaauca

SEQ ID NO: 3594530 - RNA, 20 nt, Human
aguucccaucuccuuucucu

SEQ ID NO: 3594531 - RNA, 18 nt, Human
aguucccccaaccucaga

SEQ ID NO: 3594532 - RNA, 18 nt, Human
aguuccccuauguggaag

SEQ ID NO: 3594533 - RNA, 19 nt, Human
aguucccugaaaacccaga

SEQ ID NO: 3594534 - RNA, 20 nt, Human
aguucccugaaaacccagag

SEQ ID NO: 3594535 - RNA, 21 nt, Human
aguucccugaaaacccagaga

SEQ ID NO: 3594536 - RNA, 13 nt, Human
aguucccuuggcc

SEQ ID NO: 3594537 - RNA, 16 nt, Human
aguuccgauuucccag

SEQ ID NO: 3594538 - RNA, 20 nt, Human
aguuccuaagaagcuucuaa

SEQ ID NO: 3594539 - RNA, 17 nt, Human
aguuccuagagaacugu

SEQ ID NO: 3594540 - RNA, 12 nt, Human
aguuccucgccc

SEQ ID NO: 3594541 - RNA, 13 nt, Human
aguuccucgcccu

SEQ ID NO: 3594542 - RNA, 21 nt, Human
aguuccucuaacuuggcucac

SEQ ID NO: 3594543 - RNA, 15 nt, Human
aguuccucuuugcau

SEQ ID NO: 3594544 - RNA, 16 nt, Human
aguuccucuuugcaug

SEQ ID NO: 3594545 - RNA, 21 nt, Human
aguuccucuuugcauggaauu

SEQ ID NO: 3594546 - RNA, 18 nt, Human
aguuccugaugacccagg

SEQ ID NO: 3594547 - RNA, 23 nt, Human
aguuccugcuacaacuucagcag

SEQ ID NO: 3594548 - RNA, 13 nt, Human
aguuccugggaac

SEQ ID NO: 3594549 - RNA, 23 nt, Human
aguuccugucccuucucuuaauu

SEQ ID NO: 3594550 - RNA, 20 nt, Human
aguuccuugaucuguauaua

SEQ ID NO: 3594551 - RNA, 14 nt, Human
aguuccuuuagaaa

SEQ ID NO: 3594552 - RNA, 14 nt, Human
aguucgagaccagc

SEQ ID NO: 3594553 - RNA, 14 nt, Human
aguucgcagccacc

SEQ ID NO: 3594554 - RNA, 16 nt, Human
aguucgccuggagccc

SEQ ID NO: 3594555 - RNA, 20 nt, Human
aguucggugagcuacaaaug

SEQ ID NO: 3594556 - RNA, 19 nt, Human
aguucuaacagugaaguuu

SEQ ID NO: 3594557 - RNA, 18 nt, Human
aguucuaagacucaaaug

SEQ ID NO: 3594558 - RNA, 23 nt, Human
aguucuaagacucaaauguucua

SEQ ID NO: 3594559 - RNA, 15 nt, Human
aguucuaagauucug

SEQ ID NO: 3594560 - RNA, 18 nt, Human
aguucuaauaauuucuaa

SEQ ID NO: 3594561 - RNA, 13 nt, Human
aguucuacagaaa

SEQ ID NO: 3594562 - RNA, 12 nt, Human
aguucuagaaaa

SEQ ID NO: 3594563 - RNA, 15 nt, Human
aguucuagaaaaaca

SEQ ID NO: 3594564 - RNA, 13 nt, Human
aguucuagagaag

SEQ ID NO: 3594565 - RNA, 14 nt, Human
aguucuagagaaga

SEQ ID NO: 3594566 - RNA, 15 nt, Human
aguucuaggaaaaua

SEQ ID NO: 3594567 - RNA, 22 nt, Human
aguucuaggcacuguaguucua

SEQ ID NO: 3594568 - RNA, 15 nt, Human
aguucuaguuugcau

SEQ ID NO: 3594569 - RNA, 15 nt, Human
aguucuauuuaagug

SEQ ID NO: 3594570 - RNA, 12 nt, Human
aguucucacugu

SEQ ID NO: 3594571 - RNA, 19 nt, Human
aguucucacuguucccucu

SEQ ID NO: 3594572 - RNA, 16 nt, Human
aguucucucguaacug

SEQ ID NO: 3594573 - RNA, 14 nt, Human
aguucugaagaaga

SEQ ID NO: 3594574 - RNA, 18 nt, Human
aguucugagcugccagug

SEQ ID NO: 3594575 - RNA, 15 nt, Human
aguucugaguguuuu

SEQ ID NO: 3594576 - RNA, 15 nt, Human
aguucugcaaauaga

SEQ ID NO: 3594577 - RNA, 16 nt, Human
aguucugcagauaaac

SEQ ID NO: 3594578 - RNA, 21 nt, Human
aguucugcagauaaacaguag

SEQ ID NO: 3594579 - RNA, 18 nt, Human
aguucugcagguugaagc

SEQ ID NO: 3594580 - RNA, 21 nt, Human
aguucugcucauucuaaugau

SEQ ID NO: 3594581 - RNA, 12 nt, Human
aguucugcucca

SEQ ID NO: 3594582 - RNA, 14 nt, Human
aguucugcuccaga

SEQ ID NO: 3594583 - RNA, 15 nt, Human
aguucugcuccagac

SEQ ID NO: 3594584 - RNA, 17 nt, Human
aguucugcuccagacag

SEQ ID NO: 3594585 - RNA, 15 nt, Human
aguucugcugaaugc

SEQ ID NO: 3594586 - RNA, 12 nt, Human
aguucugggugc

SEQ ID NO: 3594587 - RNA, 16 nt, Human
aguucuguagaaaugg

SEQ ID NO: 3594588 - RNA, 17 nt, Human
aguucuguagaaauggu

SEQ ID NO: 3594589 - RNA, 16 nt, Human
aguucuguauuugaaa

SEQ ID NO: 3594590 - RNA, 22 nt, Human
aguucuguauuugaaagugccu

SEQ ID NO: 3594591 - RNA, 16 nt, Human
aguucugugguuucau

SEQ ID NO: 3594592 - RNA, 19 nt, Human
aguucugugguuucauguu

SEQ ID NO: 3594593 - RNA, 23 nt, Human
aguucugugguuucauguuaguu

SEQ ID NO: 3594594 - RNA, 15 nt, Human
aguucuguguuuaau

SEQ ID NO: 3594595 - RNA, 22 nt, Human
aguucuguguuuaauuucuuca

SEQ ID NO: 3594596 - RNA, 14 nt, Human
aguucuuaguuaua

SEQ ID NO: 3594597 - RNA, 20 nt, Human
aguucuuaugaggaggggag

SEQ ID NO: 3594598 - RNA, 17 nt, Human
aguucuucgacuguugu

SEQ ID NO: 3594599 - RNA, 18 nt, Human
aguucuucgacuguuguu

SEQ ID NO: 3594600 - RNA, 15 nt, Human
aguucuucgggaaga

SEQ ID NO: 3594601 - RNA, 19 nt, Human
aguucuucgggaagagagg

SEQ ID NO: 3594602 - RNA, 12 nt, Human
aguucuugugcc

SEQ ID NO: 3594603 - RNA, 17 nt, Human
aguucuuuaaaauguaa

SEQ ID NO: 3594604 - RNA, 22 nt, Human
aguucuuuggauucuaaauaca

SEQ ID NO: 3594605 - RNA, 16 nt, Human
aguugaaaauaaagug

SEQ ID NO: 3594606 - RNA, 19 nt, Human
aguugaaaauucauaguaa

SEQ ID NO: 3594607 - RNA, 17 nt, Human
aguugaagacagagcua

SEQ ID NO: 3594608 - RNA, 16 nt, Human
aguugaagcuaagauu

SEQ ID NO: 3594609 - RNA, 19 nt, Human
aguugaaguuaguggaaau

SEQ ID NO: 3594610 - RNA, 22 nt, Human
aguugaaguuaguggaaaucug

SEQ ID NO: 3594611 - RNA, 14 nt, Human
aguugaauacuuga

SEQ ID NO: 3594612 - RNA, 16 nt, Human
aguugaauacuugaac

SEQ ID NO: 3594613 - RNA, 18 nt, Human
aguugaauacuugaacca

SEQ ID NO: 3594614 - RNA, 11 nt, Human
aguugaauuua

SEQ ID NO: 3594615 - RNA, 12 nt, Human
aguugaauuuuu

SEQ ID NO: 3594616 - RNA, 22 nt, Human
aguugaauuuuuuuuaacauuc

SEQ ID NO: 3594617 - RNA, 17 nt, Human
aguugacaccugagaaa

SEQ ID NO: 3594618 - RNA, 13 nt, Human
aguugacagcagg

SEQ ID NO: 3594619 - RNA, 18 nt, Human
aguugacuagaaucgaca

SEQ ID NO: 3594620 - RNA, 17 nt, Human
aguugacucugcucuug

SEQ ID NO: 3594621 - RNA, 16 nt, Human
aguugagccagcagac

SEQ ID NO: 3594622 - RNA, 20 nt, Human
aguugagccagcagacauug

SEQ ID NO: 3594623 - RNA, 13 nt, Human
auaaagcagcguu

SEQ ID NO: 3594624 - RNA, 19 nt, Human
auaaagcagcguuucuaug

SEQ ID NO: 3594625 - RNA, 16 nt, Human
auaaagcaguauuuuu

SEQ ID NO: 3594626 - RNA, 14 nt, Human
auaaagcauuuaua

SEQ ID NO: 3594627 - RNA, 12 nt, Human
auaaagccacug

SEQ ID NO: 3594628 - RNA, 18 nt, Human
auaaagccucaagguuuu

SEQ ID NO: 3594629 - RNA, 18 nt, Human
auaaagccuguauucuca

SEQ ID NO: 3594630 - RNA, 20 nt, Human
auaaagccuuggauguauau

SEQ ID NO: 3594631 - RNA, 22 nt, Human
auaaagcgaaaaacucaaccaa

SEQ ID NO: 3594632 - RNA, 19 nt, Human
auaaagcgauauacagaug

SEQ ID NO: 3594633 - RNA, 21 nt, Human
auaaagcgauauacagaugaa

SEQ ID NO: 3594634 - RNA, 20 nt, Human
auaaaggaaaaaagagaagu

SEQ ID NO: 3594635 - RNA, 18 nt, Human
auaaaggaaaagacacau

SEQ ID NO: 3594636 - RNA, 21 nt, Human
auaaaggauaaacuuuuagaa

SEQ ID NO: 3594637 - RNA, 16 nt, Human
auaaaggcaguuuucu

SEQ ID NO: 3594638 - RNA, 18 nt, Human
auaaaggcaguuuucuaa

SEQ ID NO: 3594639 - RNA, 20 nt, Human
auaaagguuauuuucuccug

SEQ ID NO: 3594640 - RNA, 16 nt, Human
auaaagguugacaaua

SEQ ID NO: 3594641 - RNA, 22 nt, Human
auaaagguugacaauaaaugug

SEQ ID NO: 3594642 - RNA, 16 nt, Human
auaaaguaaauacaug

SEQ ID NO: 3594643 - RNA, 13 nt, Human
auaaaguacuuga

SEQ ID NO: 3594644 - RNA, 14 nt, Human
auaaaguagaaaug

SEQ ID NO: 3594645 - RNA, 18 nt, Human
auaaaguaguaaaaauua

SEQ ID NO: 3594646 - RNA, 17 nt, Human
auaaaguauaauguuua

SEQ ID NO: 3594647 - RNA, 18 nt, Human
auaaaguaucaugcauuc

SEQ ID NO: 3594648 - RNA, 20 nt, Human
auaaaguauuccaccuuaaa

SEQ ID NO: 3594649 - RNA, 15 nt, Human
auaaaguauucuuuu

SEQ ID NO: 3594650 - RNA, 17 nt, Human
auaaaguauuuaauuag

SEQ ID NO: 3594651 - RNA, 18 nt, Human
auaaagugacccugcucu

SEQ ID NO: 3594652 - RNA, 20 nt, Human
auaaagugacccugcucuca

SEQ ID NO: 3594653 - RNA, 20 nt, Human
auaaagugagaaaacuguga

SEQ ID NO: 3594654 - RNA, 23 nt, Human
auaaagugcugcggagcaagagg

SEQ ID NO: 3594655 - RNA, 24 nt, Human
auaaagugcugcggagcaagagga

SEQ ID NO: 3594656 - RNA, 17 nt, Human
auaaagugcuuguguaa

SEQ ID NO: 3594657 - RNA, 18 nt, Human
auaaagugcuuguguaau

SEQ ID NO: 3594658 - RNA, 19 nt, Human
auaaaguguuugaaagcuu

SEQ ID NO: 3594659 - RNA, 16 nt, Human
auaaaguguuuucaga

SEQ ID NO: 3594660 - RNA, 17 nt, Human
auaaaguguuuucagag

SEQ ID NO: 3594661 - RNA, 18 nt, Human
auaaaguguuuucagagc

SEQ ID NO: 3594662 - RNA, 16 nt, Human
auaaaguuagaaucua

SEQ ID NO: 3594663 - RNA, 17 nt, Human
auaaaguuagaaucuau

SEQ ID NO: 3594664 - RNA, 17 nt, Human
auaaaguugauaaagau

SEQ ID NO: 3594665 - RNA, 18 nt, Human
auaaaguuggugacagau

SEQ ID NO: 3594666 - RNA, 13 nt, Human
auaaaguuucuca

SEQ ID NO: 3594667 - RNA, 22 nt, Human
auaaaguuugaucuuccucugc

SEQ ID NO: 3594668 - RNA, 12 nt, Human
auaaaguuugcu

SEQ ID NO: 3594669 - RNA, 14 nt, Human
auaaaguuuuauau

SEQ ID NO: 3594670 - RNA, 18 nt, Human
auaaaguuuuauauauua

SEQ ID NO: 3594671 - RNA, 17 nt, Human
auaaauaaaaauggaua

SEQ ID NO: 3594672 - RNA, 12 nt, Human
auaaauaaaagc

SEQ ID NO: 3594673 - RNA, 14 nt, Human
auaaauaaaaugac

SEQ ID NO: 3594674 - RNA, 13 nt, Human
auaaauaaauaua

SEQ ID NO: 3594675 - RNA, 15 nt, Human
auaaauaaauauaua

SEQ ID NO: 3594676 - RNA, 12 nt, Human
auaaauaaaugu

SEQ ID NO: 3594677 - RNA, 14 nt, Human
auaaauaacuuuuu

SEQ ID NO: 3594678 - RNA, 15 nt, Human
auaaauaaucuguac

SEQ ID NO: 3594679 - RNA, 20 nt, Human
auaaauagaauguaaauguc

SEQ ID NO: 3594680 - RNA, 14 nt, Human
auaaauagagcaau

SEQ ID NO: 3594681 - RNA, 16 nt, Human
auaaauagcuagacug

SEQ ID NO: 3594682 - RNA, 21 nt, Human
auaaauagcuauauccaugua

SEQ ID NO: 3594683 - RNA, 13 nt, Human
auaaauauaucua

SEQ ID NO: 3594684 - RNA, 21 nt, Human
auaaauauaucuaccccagac

SEQ ID NO: 3594685 - RNA, 22 nt, Human
auaaauauauuauuacuuguaa

SEQ ID NO: 3594686 - RNA, 14 nt, Human
auaaauaugagugc

SEQ ID NO: 3594687 - RNA, 14 nt, Human
auaaauaugcagug

SEQ ID NO: 3594688 - RNA, 12 nt, Human
auaaauauuaua

SEQ ID NO: 3594689 - RNA, 19 nt, Human
auaaauauucacacuugaa

SEQ ID NO: 3594690 - RNA, 23 nt, Human
auaaauauugguugggaugacuu

SEQ ID NO: 3594691 - RNA, 20 nt, Human
auaaauauugucuuuuugua

SEQ ID NO: 3594692 - RNA, 23 nt, Human
auaaauauugucuuuuuguaugu

SEQ ID NO: 3594693 - RNA, 20 nt, Human
auaaauauuuauguagaugu

SEQ ID NO: 3594694 - RNA, 12 nt, Human
auaaaucauaaa

SEQ ID NO: 3594695 - RNA, 15 nt, Human
auaaaucauaaaguc

SEQ ID NO: 3594696 - RNA, 16 nt, Human
auaaaucauaaaguca

SEQ ID NO: 3594697 - RNA, 11 nt, Human
auacuguugca

SEQ ID NO: 3594698 - RNA, 12 nt, Human
auacuguugcac

SEQ ID NO: 3594699 - RNA, 18 nt, Human
auacuguugcacgugugu

SEQ ID NO: 3594700 - RNA, 19 nt, Human
auacuguugcacguguguu

SEQ ID NO: 3594701 - RNA, 22 nt, Human
auacuuacauguguguauaugu

SEQ ID NO: 3594702 - RNA, 22 nt, Human
auacuuacauucucuaauaaga

SEQ ID NO: 3594703 - RNA, 20 nt, Human
auacuuaccuagugaaacuu

SEQ ID NO: 3594704 - RNA, 21 nt, Human
auacuuaccuagugaaacuuu

SEQ ID NO: 3594705 - RNA, 18 nt, Human
auacuuagcaaaaagugg

SEQ ID NO: 3594706 - RNA, 23 nt, Human
auacuuagcaaaaaguggggcag

SEQ ID NO: 3594707 - RNA, 19 nt, Human
auacuuauauggaaauucu

SEQ ID NO: 3594708 - RNA, 18 nt, Human
auacuuaucucucugugc

SEQ ID NO: 3594709 - RNA, 14 nt, Human
auacuuauucauug

SEQ ID NO: 3594710 - RNA, 13 nt, Human
auacuuauuuaaa

SEQ ID NO: 3594711 - RNA, 21 nt, Human
auacuuauuuaaauagaugac

SEQ ID NO: 3594712 - RNA, 22 nt, Human
auacuuauuuaaauagaugaca

SEQ ID NO: 3594713 - RNA, 18 nt, Human
auacuuauuuguauaugg

SEQ ID NO: 3594714 - RNA, 12 nt, Human
auacuucaaaag

SEQ ID NO: 3594715 - RNA, 14 nt, Human
auacuucaaaagua

SEQ ID NO: 3594716 - RNA, 19 nt, Human
auacuucgacacuguucuu

SEQ ID NO: 3594717 - RNA, 21 nt, Human
auacuucucaaaccuguuuaa

SEQ ID NO: 3594718 - RNA, 16 nt, Human
auacuucucauuuuuu

SEQ ID NO: 3594719 - RNA, 20 nt, Human
auacuucuuguguguaugca

SEQ ID NO: 3594720 - RNA, 19 nt, Human
auacuugaaaauuaacaug

SEQ ID NO: 3594721 - RNA, 12 nt, Human
auacuugaacaa

SEQ ID NO: 3594722 - RNA, 17 nt, Human
auacuugaaccauaaaa

SEQ ID NO: 3594723 - RNA, 20 nt, Human
auacuugaaccauaaaaugu

SEQ ID NO: 3594724 - RNA, 21 nt, Human
auacuugaacuugccucuuuu

SEQ ID NO: 3594725 - RNA, 17 nt, Human
auacuugaagggccaga

SEQ ID NO: 3594726 - RNA, 20 nt, Human
auacuugaagggccagagcc

SEQ ID NO: 3594727 - RNA, 21 nt, Human
auacuugaagggccagagcca

SEQ ID NO: 3594728 - RNA, 15 nt, Human
auacuuguaauuaug

SEQ ID NO: 3594729 - RNA, 17 nt, Human
auacuuguaauuaugga

SEQ ID NO: 3594730 - RNA, 21 nt, Human
auacuuguaauuauggaguca

SEQ ID NO: 3594731 - RNA, 18 nt, Human
auacuugugguuuucaaa

SEQ ID NO: 3594732 - RNA, 16 nt, Human
auacuuguuuuuguaa

SEQ ID NO: 3594733 - RNA, 14 nt, Human
auacuuuaaaggaa

SEQ ID NO: 3594734 - RNA, 13 nt, Human
auacuuuaaauaa

SEQ ID NO: 3594735 - RNA, 17 nt, Human
auacuuuaaauaauuua

SEQ ID NO: 3594736 - RNA, 20 nt, Human
auacuuuaguagacauuuau

SEQ ID NO: 3594737 - RNA, 15 nt, Human
auacuuuaucaaugu

SEQ ID NO: 3594738 - RNA, 13 nt, Human
auacuuugaaugu

SEQ ID NO: 3594739 - RNA, 15 nt, Human
auacuuugaaugugu

SEQ ID NO: 3594740 - RNA, 10 nt, Human
auacuuugua

SEQ ID NO: 3594741 - RNA, 14 nt, Human
auacuuuguaaaua

SEQ ID NO: 3594742 - RNA, 13 nt, Human
auacuuuguauug

SEQ ID NO: 3594743 - RNA, 18 nt, Human
auacuuuguauuguccua

SEQ ID NO: 3594744 - RNA, 17 nt, Human
auacuuuguauuuugau

SEQ ID NO: 3594745 - RNA, 13 nt, Human
auacuuugucuga

SEQ ID NO: 3594746 - RNA, 16 nt, Human
auacuuuguggaccaa

SEQ ID NO: 3594747 - RNA, 20 nt, Human
auacuuuuacucugccuaca

SEQ ID NO: 3594748 - RNA, 19 nt, Human
auacuuuuuaaauguaaag

SEQ ID NO: 3594749 - RNA, 13 nt, Human
auacuuuuuacaa

SEQ ID NO: 3594750 - RNA, 17 nt, Human
auacuuuuucuaaugag

SEQ ID NO: 3594751 - RNA, 15 nt, Human
auacuuuuucuuuug

SEQ ID NO: 3594752 - RNA, 19 nt, Human
auacuuuuuucuuauuuaa

SEQ ID NO: 3594753 - RNA, 13 nt, Human
auagaaaaacaaa

SEQ ID NO: 3594754 - RNA, 10 nt, Human
auagaaaaau

SEQ ID NO: 3594755 - RNA, 23 nt, Human
auagaaaaauucagcaaaccauu

SEQ ID NO: 3594756 - RNA, 23 nt, Human
auagaaaacaggaaaaaaacuuu

SEQ ID NO: 3594757 - RNA, 17 nt, Human
auagaaaacugaaaauc

SEQ ID NO: 3594758 - RNA, 21 nt, Human
auagaaaaguagacaaucauu

SEQ ID NO: 3594759 - RNA, 13 nt, Human
auagaaaaguuau

SEQ ID NO: 3594760 - RNA, 21 nt, Human
auagaaacaugacacugaccu

SEQ ID NO: 3594761 - RNA, 13 nt, Human
auagaaagaaagu

SEQ ID NO: 3594762 - RNA, 15 nt, Human
auagaaagcuuuguu

SEQ ID NO: 3594763 - RNA, 17 nt, Human
auagaaaguguucuguu

SEQ ID NO: 3594764 - RNA, 18 nt, Human
auagaaaguugcaaggca

SEQ ID NO: 3594765 - RNA, 22 nt, Human
auagaaauaaaggaugugauug

SEQ ID NO: 3594766 - RNA, 20 nt, Human
auagaaauauagccaaaaau

SEQ ID NO: 3594767 - RNA, 18 nt, Human
auagaaauauauacgaac

SEQ ID NO: 3594768 - RNA, 12 nt, Human
auagcccagaca

SEQ ID NO: 3594769 - RNA, 21 nt, Human
auagcccaggauauauuuuau

SEQ ID NO: 3594770 - RNA, 16 nt, Human
auagcccaucccugcc

SEQ ID NO: 3594771 - RNA, 17 nt, Human
auagcccaucccugccu

SEQ ID NO: 3594772 - RNA, 18 nt, Human
auagcccaucccugccug

SEQ ID NO: 3594773 - RNA, 15 nt, Human
auagcccuguccugg

SEQ ID NO: 3594774 - RNA, 23 nt, Human
auagcccuguccuggugguauuu

SEQ ID NO: 3594775 - RNA, 19 nt, Human
auagccgauaucagaauuu

SEQ ID NO: 3594776 - RNA, 12 nt, Human
auagccuauauu

SEQ ID NO: 3594777 - RNA, 19 nt, Human
auagccuauggcagaaaaa

SEQ ID NO: 3594778 - RNA, 15 nt, Human
auagccucugucugg

SEQ ID NO: 3594779 - RNA, 16 nt, Human
auagccucugucuggc

SEQ ID NO: 3594780 - RNA, 18 nt, Human
auagccugccucuucucu

SEQ ID NO: 3594781 - RNA, 11 nt, Human
auagccugugg

SEQ ID NO: 3594782 - RNA, 12 nt, Human
auagccuguggc

SEQ ID NO: 3594783 - RNA, 16 nt, Human
auagcgaggcucuaac

SEQ ID NO: 3594784 - RNA, 20 nt, Human
auagcggguuacuuucacau

SEQ ID NO: 3594785 - RNA, 20 nt, Human
auagcguuggaauuaaaaca

SEQ ID NO: 3594786 - RNA, 16 nt, Human
auagcuaacuguaaau

SEQ ID NO: 3594787 - RNA, 19 nt, Human
auagcuacccaaaagagaa

SEQ ID NO: 3594788 - RNA, 21 nt, Human
auagcuacccaaaagagaaaa

SEQ ID NO: 3594789 - RNA, 14 nt, Human
auagcuacuaauuu

SEQ ID NO: 3594790 - RNA, 16 nt, Human
auagcuagacugguga

SEQ ID NO: 3594791 - RNA, 14 nt, Human
auagcuauauccau

SEQ ID NO: 3594792 - RNA, 16 nt, Human
auagcuauauccaugu

SEQ ID NO: 3594793 - RNA, 20 nt, Human
auagcuauauccauguacug

SEQ ID NO: 3594794 - RNA, 22 nt, Human
auagcuauauccauguacugua

SEQ ID NO: 3594795 - RNA, 13 nt, Human
auagcucaguuua

SEQ ID NO: 3594796 - RNA, 22 nt, Human
auagcucaguuuauccaaggug

SEQ ID NO: 3594797 - RNA, 21 nt, Human
auagcucuaauguuugcauau

SEQ ID NO: 3594798 - RNA, 12 nt, Human
auagcucugggg

SEQ ID NO: 3594799 - RNA, 20 nt, Human
auagcucuuuggcagucuau

SEQ ID NO: 3594800 - RNA, 19 nt, Human
auagcugacccagccccuu

SEQ ID NO: 3594801 - RNA, 21 nt, Human
auagcugagauuccugguucg

SEQ ID NO: 3594802 - RNA, 18 nt, Human
auagcugcauguggcuuu

SEQ ID NO: 3594803 - RNA, 19 nt, Human
auagcugcccauuucguga

SEQ ID NO: 3594804 - RNA, 17 nt, Human
auagcugcuuccagugu

SEQ ID NO: 3594805 - RNA, 17 nt, Human
auagcuggcaagaaugg

SEQ ID NO: 3594806 - RNA, 15 nt, Human
auagcuguacuucuu

SEQ ID NO: 3594807 - RNA, 18 nt, Human
auagcuguauugaaucau

SEQ ID NO: 3594808 - RNA, 22 nt, Human
auagcuucaccccaaucccagc

SEQ ID NO: 3594809 - RNA, 19 nt, Human
auagcuugcgcauucucau

SEQ ID NO: 3594810 - RNA, 22 nt, Human
auagcuuuauuuuuuaaguauu

SEQ ID NO: 3594811 - RNA, 14 nt, Human
auaggaaaaacuga

SEQ ID NO: 3594812 - RNA, 19 nt, Human
auaggaaaaguacauuuaa

SEQ ID NO: 3594813 - RNA, 21 nt, Human
auaggaaaguauuuuuuuaag

SEQ ID NO: 3594814 - RNA, 21 nt, Human
auaggaacauaugaaaauaca

SEQ ID NO: 3594815 - RNA, 17 nt, Human
auaggaaggucauuucc

SEQ ID NO: 3594816 - RNA, 19 nt, Human
auaggaaggucauuuccau

SEQ ID NO: 3594817 - RNA, 22 nt, Human
auaggaaguuagccuuuaucua

SEQ ID NO: 3594818 - RNA, 20 nt, Human
auaggaaucauucagaaaug

SEQ ID NO: 3594819 - RNA, 15 nt, Human
auaggagacuuguag

SEQ ID NO: 3594820 - RNA, 22 nt, Human
auaggagagagaucaugagaaa

SEQ ID NO: 3594821 - RNA, 19 nt, Human
auaggagaggaugagagcc

SEQ ID NO: 3594822 - RNA, 20 nt, Human
auaggagaggaugagagccc

SEQ ID NO: 3594823 - RNA, 17 nt, Human
auaggagggaaaccuuu

SEQ ID NO: 3594824 - RNA, 23 nt, Human
auaggaucauuuguuggaaugaa

SEQ ID NO: 3594825 - RNA, 21 nt, Human
auaggauuuauuuaaaauagc

SEQ ID NO: 3594826 - RNA, 23 nt, Human
auaggauuuauuuaaaauagcaa

SEQ ID NO: 3594827 - RNA, 16 nt, Human
auaggauuuuuagaau

SEQ ID NO: 3594828 - RNA, 14 nt, Human
auaggcaaauuaau

SEQ ID NO: 3594829 - RNA, 17 nt, Human
auaggcacaggaaacca

SEQ ID NO: 3594830 - RNA, 22 nt, Human
auaggcaccuaccaccacgccc

SEQ ID NO: 3594831 - RNA, 15 nt, Human
auaggcaccuuuuac

SEQ ID NO: 3594832 - RNA, 17 nt, Human
auaggcagacuggguuu

SEQ ID NO: 3594833 - RNA, 20 nt, Human
auaggcaggaagcccaauug

SEQ ID NO: 3594834 - RNA, 22 nt, Human
auaggccaaacuggcaaacuuc

SEQ ID NO: 3594835 - RNA, 15 nt, Human
auaggcccacacaca

SEQ ID NO: 3594836 - RNA, 18 nt, Human
auaggcccacacacaggu

SEQ ID NO: 3594837 - RNA, 17 nt, Human
auaggcguaacuaauuu

SEQ ID NO: 3594838 - RNA, 18 nt, Human
auaggcuauuaaaaaagu

SEQ ID NO: 3594839 - RNA, 18 nt, Human
auaggcuauuuucuaaag

SEQ ID NO: 3594840 - RNA, 21 nt, Human
auaggcuauuuucuaaagacu

SEQ ID NO: 3594841 - RNA, 22 nt, Human
auaggcuauuuucuaaagacuu

SEQ ID NO: 3594842 - RNA, 11 nt, Human
auaggcucugc

SEQ ID NO: 3594843 - RNA, 12 nt, Human
auaggcucugca

SEQ ID NO: 3594844 - RNA, 14 nt, Human
auaggcucugcaca

SEQ ID NO: 3594845 - RNA, 22 nt, Human
auaggcucugcacagauggauu

SEQ ID NO: 3594846 - RNA, 13 nt, Human
auaggcuggagaa

SEQ ID NO: 3594847 - RNA, 21 nt, Human
auaggcuggagaagcucaccc

SEQ ID NO: 3594848 - RNA, 15 nt, Human
auaggcuuuuuaauc

SEQ ID NO: 3594849 - RNA, 16 nt, Human
auagggaaaauucuaa

SEQ ID NO: 3594850 - RNA, 17 nt, Human
auagggaauauaucucu

SEQ ID NO: 3594851 - RNA, 23 nt, Human
auagggcaauuaauuccuucagc

SEQ ID NO: 3594852 - RNA, 17 nt, Human
auaggggauauuuaagg

SEQ ID NO: 3594853 - RNA, 20 nt, Human
auaggguuugugacagggcg

SEQ ID NO: 3594854 - RNA, 14 nt, Human
auagguaaucaaug

SEQ ID NO: 3594855 - RNA, 18 nt, Human
auagguagaauguaaagc

SEQ ID NO: 3594856 - RNA, 23 nt, Human
auagguagaauguaaagcuuguc

SEQ ID NO: 3594857 - RNA, 16 nt, Human
auaggucacuggcucu

SEQ ID NO: 3594858 - RNA, 17 nt, Human
auaggucacuggcucuc

SEQ ID NO: 3594859 - RNA, 22 nt, Human
auaggucacuggcucuccaagu

SEQ ID NO: 3594860 - RNA, 18 nt, Human
auagguccagaaguccuu

SEQ ID NO: 3594861 - RNA, 12 nt, Human
auaagaaaagau

SEQ ID NO: 3594862 - RNA, 18 nt, Human
auaagaaaagauguagau

SEQ ID NO: 3594863 - RNA, 22 nt, Human
auaagaaaagauguagauuuau

SEQ ID NO: 3594864 - RNA, 13 nt, Human
auaagaaacuuuu

SEQ ID NO: 3594865 - RNA, 22 nt, Human
auaagaaacuuuuuuauuuaaa

SEQ ID NO: 3594866 - RNA, 15 nt, Human
auaagaaagccugag

SEQ ID NO: 3594867 - RNA, 22 nt, Human
auaagaaagugcgaguccucca

SEQ ID NO: 3594868 - RNA, 17 nt, Human
auaagaaaugcauaugu

SEQ ID NO: 3594869 - RNA, 15 nt, Human
auaagaagaaugcuu

SEQ ID NO: 3594870 - RNA, 22 nt, Human
auaagaaugcugguuuuccuaa

SEQ ID NO: 3594871 - RNA, 12 nt, Human
auaagaauuugc

SEQ ID NO: 3594872 - RNA, 13 nt, Human
auaagaauuugca

SEQ ID NO: 3594873 - RNA, 23 nt, Human
auaagacauaacguuuuuccuuu

SEQ ID NO: 3594874 - RNA, 22 nt, Human
auaagacauaucucuaauucca

SEQ ID NO: 3594875 - RNA, 14 nt, Human
auaagagaaagaaa

SEQ ID NO: 3594876 - RNA, 19 nt, Human
auaagagagccuugguuca

SEQ ID NO: 3594877 - RNA, 19 nt, Human
auaagagagucauaaaccu

SEQ ID NO: 3594878 - RNA, 20 nt, Human
auaagagagucauaaaccuu

SEQ ID NO: 3594879 - RNA, 22 nt, Human
auaagagcaugaaauuuuuaaa

SEQ ID NO: 3594880 - RNA, 22 nt, Human
auaagagcuuccaauuuuccuu

SEQ ID NO: 3594881 - RNA, 17 nt, Human
auaagaugacuguguug

SEQ ID NO: 3594882 - RNA, 13 nt, Human
auaagauuagaau

SEQ ID NO: 3594883 - RNA, 20 nt, Human
auaagauuagaaugaaaauu

SEQ ID NO: 3594884 - RNA, 22 nt, Human
auaagauuccaaaaagcacaua

SEQ ID NO: 3594885 - RNA, 18 nt, Human
auaagcaaauugcuuuuu

SEQ ID NO: 3594886 - RNA, 21 nt, Human
auaagcaaauuucaaaagaca

SEQ ID NO: 3594887 - RNA, 22 nt, Human
auaagcaaauuucaaaagacau

SEQ ID NO: 3594888 - RNA, 13 nt, Human
auaagcaacaauu

SEQ ID NO: 3594889 - RNA, 18 nt, Human
auaagcaacaauuuucag

SEQ ID NO: 3594890 - RNA, 19 nt, Human
auaagcaacaauuuucaga

SEQ ID NO: 3594891 - RNA, 20 nt, Human
auaagcaacaauuuucagau

SEQ ID NO: 3594892 - RNA, 15 nt, Human
auaagcaagagagau

SEQ ID NO: 3594893 - RNA, 17 nt, Human
auaagcacugugcuaau

SEQ ID NO: 3594894 - RNA, 16 nt, Human
auaagcagauuuaaca

SEQ ID NO: 3594895 - RNA, 16 nt, Human
auaagcagguggaucu

SEQ ID NO: 3594896 - RNA, 15 nt, Human
auaagcaguuaugug

SEQ ID NO: 3594897 - RNA, 17 nt, Human
auaagcaucauuauuua

SEQ ID NO: 3594898 - RNA, 19 nt, Human
auaagccaauuuuucugca

SEQ ID NO: 3594899 - RNA, 22 nt, Human
auaagccagacaucaacagaua

SEQ ID NO: 3594900 - RNA, 20 nt, Human
auaagccaguguugccuaag

SEQ ID NO: 3594901 - RNA, 16 nt, Human
auaagccaugagaaug

SEQ ID NO: 3594902 - RNA, 21 nt, Human
auaagccuccauuuaguucuu

SEQ ID NO: 3594903 - RNA, 13 nt, Human
auaagcuaaagag

SEQ ID NO: 3594904 - RNA, 17 nt, Human
auaagcuaaagaggcug

SEQ ID NO: 3594905 - RNA, 17 nt, Human
auaagcuacuagcaaaa

SEQ ID NO: 3594906 - RNA, 18 nt, Human
auaagcuaguugaauacu

SEQ ID NO: 3594907 - RNA, 21 nt, Human
auaagcuaguugaauacuuga

SEQ ID NO: 3594908 - RNA, 22 nt, Human
auaagcuauuugauguaauacu

SEQ ID NO: 3594909 - RNA, 16 nt, Human
auaagcuauuuuucua

SEQ ID NO: 3594910 - RNA, 15 nt, Human
auaagcucagaaucc

SEQ ID NO: 3594911 - RNA, 14 nt, Human
auaccagguugaaa

SEQ ID NO: 3594912 - RNA, 17 nt, Human
auaccagugaaccaaag

SEQ ID NO: 3594913 - RNA, 21 nt, Human
auaccauacucauuucuaaaa

SEQ ID NO: 3594914 - RNA, 18 nt, Human
auaccauuaaaacugcuu

SEQ ID NO: 3594915 - RNA, 20 nt, Human
auaccauuauuaucaaguag

SEQ ID NO: 3594916 - RNA, 22 nt, Human
auaccauucagaucacugaauu

SEQ ID NO: 3594917 - RNA, 22 nt, Human
auaccauuuaguaagaauacca

SEQ ID NO: 3594918 - RNA, 15 nt, Human
auaccauuuccguaa

SEQ ID NO: 3594919 - RNA, 20 nt, Human
auaccauuuuuuaaggaaac

SEQ ID NO: 3594920 - RNA, 22 nt, Human
auaccauuuuuuaaggaaacaa

SEQ ID NO: 3594921 - RNA, 14 nt, Human
auacccaaauccuc

SEQ ID NO: 3594922 - RNA, 23 nt, Human
auacccaaauccucuccagcuau

SEQ ID NO: 3594923 - RNA, 14 nt, Human
auacccacccagaa

SEQ ID NO: 3594924 - RNA, 14 nt, Human
auacccacccccac

SEQ ID NO: 3594925 - RNA, 16 nt, Human
auacccacccccaccc

SEQ ID NO: 3594926 - RNA, 17 nt, Human
auacccacccccaccca

SEQ ID NO: 3594927 - RNA, 17 nt, Human
auacccagaaaguuauu

SEQ ID NO: 3594928 - RNA, 18 nt, Human
auacccauagcuuccaug

SEQ ID NO: 3594929 - RNA, 21 nt, Human
auacccccugcaaagcccagc

SEQ ID NO: 3594930 - RNA, 16 nt, Human
auacccucccucccua

SEQ ID NO: 3594931 - RNA, 22 nt, Human
auacccucccucccuacccuaa

SEQ ID NO: 3594932 - RNA, 19 nt, Human
auacccuggccgcccccug

SEQ ID NO: 3594933 - RNA, 19 nt, Human
auacccuucuuuuaugagc

SEQ ID NO: 3594934 - RNA, 15 nt, Human
auaccuaaguacugu

SEQ ID NO: 3594935 - RNA, 16 nt, Human
auaccuaaguacugua

SEQ ID NO: 3594936 - RNA, 21 nt, Human
auaccuaaguacuguaauaau

SEQ ID NO: 3594937 - RNA, 22 nt, Human
auaccuaaguacuguaauaaua

SEQ ID NO: 3594938 - RNA, 17 nt, Human
auaccuauaaugugugu

SEQ ID NO: 3594939 - RNA, 18 nt, Human
auaccuauaaugugugua

SEQ ID NO: 3594940 - RNA, 19 nt, Human
auaccuauaauguguguau

SEQ ID NO: 3594941 - RNA, 14 nt, Human
auaccucaauguuu

SEQ ID NO: 3594942 - RNA, 16 nt, Human
auaccucaauguuuga

SEQ ID NO: 3594943 - RNA, 15 nt, Human
auaccucacccugcu

SEQ ID NO: 3594944 - RNA, 19 nt, Human
auaccucaggaaagaauag

SEQ ID NO: 3594945 - RNA, 11 nt, Human
auaccugcccu

SEQ ID NO: 3594946 - RNA, 14 nt, Human
auaccugucccccu

SEQ ID NO: 3594947 - RNA, 17 nt, Human
auaccuguuuaaauugc

SEQ ID NO: 3594948 - RNA, 16 nt, Human
auaccuuaaaauuuga

SEQ ID NO: 3594949 - RNA, 20 nt, Human
auaccuuccuucccugggcu

SEQ ID NO: 3594950 - RNA, 14 nt, Human
auaccuuuuauuuu

SEQ ID NO: 3594951 - RNA, 14 nt, Human
auacgaaacacaaa

SEQ ID NO: 3594952 - RNA, 13 nt, Human
auacgacuuuauu

SEQ ID NO: 3594953 - RNA, 17 nt, Human
auacgagagcagagguc

SEQ ID NO: 3594954 - RNA, 13 nt, Human
auacgauaaauaa

SEQ ID NO: 3594955 - RNA, 20 nt, Human
auacgccagaacugcuuuau

SEQ ID NO: 3594956 - RNA, 21 nt, Human
auacgccuguaguccuagcca

SEQ ID NO: 3594957 - RNA, 19 nt, Human
auacgcuacuauaaagaga

SEQ ID NO: 3594958 - RNA, 14 nt, Human
auacgcucagcuca

SEQ ID NO: 3594959 - RNA, 22 nt, Human
auacgcuuuuaaugaaaaggaa

SEQ ID NO: 3594960 - RNA, 13 nt, Human
auacguacacauu

SEQ ID NO: 3594961 - RNA, 18 nt, Human
auacgugggcauucaaau

SEQ ID NO: 3594962 - RNA, 18 nt, Human
auacguuuuucaguuuca

SEQ ID NO: 3594963 - RNA, 19 nt, Human
auacuaaaaagaagugcug

SEQ ID NO: 3594964 - RNA, 14 nt, Human
auacuaaaauaugu

SEQ ID NO: 3594965 - RNA, 20 nt, Human
auacuaaccagcagaaaugc

SEQ ID NO: 3594966 - RNA, 21 nt, Human
auacuaaccagcagaaaugcc

SEQ ID NO: 3594967 - RNA, 17 nt, Human
auacuaagcauugaaug

SEQ ID NO: 3594968 - RNA, 22 nt, Human
auacuagauuugggagaagggc

SEQ ID NO: 3594969 - RNA, 16 nt, Human
auacuagccagagcuc

SEQ ID NO: 3594970 - RNA, 22 nt, Human
auacuagccagagcuccuccuu

SEQ ID NO: 3594971 - RNA, 20 nt, Human
auacuagggagccauuugag

SEQ ID NO: 3594972 - RNA, 21 nt, Human
auacuagggagccauuugaga

SEQ ID NO: 3594973 - RNA, 14 nt, Human
auacuauauuuaug

SEQ ID NO: 3594974 - RNA, 17 nt, Human
auacuauggaauuucuc

SEQ ID NO: 3594975 - RNA, 23 nt, Human
auacuauguggaugugacagugg

SEQ ID NO: 3594976 - RNA, 21 nt, Human
auacuauuaaaaagguuuaca

SEQ ID NO: 3594977 - RNA, 22 nt, Human
auacuauuuaaagccuccucau

SEQ ID NO: 3594978 - RNA, 13 nt, Human
auacuauuuaaga

SEQ ID NO: 3594979 - RNA, 21 nt, Human
auacuauuuaagaugugaaaa

SEQ ID NO: 3594980 - RNA, 22 nt, Human
auacuauuuaagaugugaaaau

SEQ ID NO: 3594981 - RNA, 15 nt, Human
auacuauuuuuacug

SEQ ID NO: 3594982 - RNA, 19 nt, Human
auacuauuuuuacugccac

SEQ ID NO: 3594983 - RNA, 19 nt, Human
auacucaaaugaguaacau

SEQ ID NO: 3594984 - RNA, 20 nt, Human
auacucaaaugaguaacauu

SEQ ID NO: 3594985 - RNA, 12 nt, Human
auacucagccug

SEQ ID NO: 3594986 - RNA, 17 nt, Human
auacucagccugcugcc

SEQ ID NO: 3594987 - RNA, 16 nt, Human
auacucauaaugugaa

SEQ ID NO: 3594988 - RNA, 15 nt, Human
auacucauccuugua

SEQ ID NO: 3594989 - RNA, 11 nt, Human
auacucaugug

SEQ ID NO: 3594990 - RNA, 13 nt, Human
auacucauuagaa

SEQ ID NO: 3594991 - RNA, 20 nt, Human
auacucauuucuaaaagaau

SEQ ID NO: 3594992 - RNA, 23 nt, Human
auacucauuucuaaaagaauauu

SEQ ID NO: 3594993 - RNA, 14 nt, Human
auacucauuucuua

SEQ ID NO: 3594994 - RNA, 13 nt, Human
auacuccagugua

SEQ ID NO: 3594995 - RNA, 21 nt, Human
auacuccaguguacauagugu

SEQ ID NO: 3594996 - RNA, 14 nt, Human
auacucccaucugu

SEQ ID NO: 3594997 - RNA, 16 nt, Human
auacuccuaugcuuua

SEQ ID NO: 3594998 - RNA, 17 nt, Human
auacuccuccaagguua

SEQ ID NO: 3594999 - RNA, 14 nt, Human
auacucuaauucua

SEQ ID NO: 3595000 - RNA, 16 nt, Human
auacucuaauucuaac

SEQ ID NO: 3595001 - RNA, 17 nt, Human
auacucuagaugaaguu

SEQ ID NO: 3595002 - RNA, 15 nt, Human
auacucuagauuuug

SEQ ID NO: 3595003 - RNA, 22 nt, Human
auacucuagauuuuguuuugcu

SEQ ID NO: 3595004 - RNA, 20 nt, Human
auacucucaccauuuggauc

SEQ ID NO: 3595005 - RNA, 15 nt, Human
auacucuuucuguau

SEQ ID NO: 3595006 - RNA, 16 nt, Human
auacucuuucuguaua

SEQ ID NO: 3595007 - RNA, 12 nt, Human
auacugaaccac

SEQ ID NO: 3595008 - RNA, 18 nt, Human
auacugaaccacuuguag

SEQ ID NO: 3595009 - RNA, 11 nt, Human
auacugaagau

SEQ ID NO: 3595010 - RNA, 22 nt, Human
auacugaaggaaaaacacaagc

SEQ ID NO: 3595011 - RNA, 22 nt, Human
auacugacuccaaccauucaaa

SEQ ID NO: 3595012 - RNA, 17 nt, Human
auacugagaaaaccugu

SEQ ID NO: 3595013 - RNA, 14 nt, Human
auacugagggacca

SEQ ID NO: 3595014 - RNA, 13 nt, Human
auacugauggaau

SEQ ID NO: 3595015 - RNA, 14 nt, Human
auacugcaagaaaa

SEQ ID NO: 3595016 - RNA, 13 nt, Human
auacugcacuuac

SEQ ID NO: 3595017 - RNA, 20 nt, Human
auacugcacuuacaauccca

SEQ ID NO: 3595018 - RNA, 15 nt, Human
auacugcauacuuuu

SEQ ID NO: 3595019 - RNA, 15 nt, Human
auacugccagaugcu

SEQ ID NO: 3595020 - RNA, 21 nt, Human
auacugccagaugcugauguu

SEQ ID NO: 3595021 - RNA, 22 nt, Human
auacugcccggggcagcugcca

SEQ ID NO: 3595022 - RNA, 22 nt, Human
auacugcuacagcaauuucuaa

SEQ ID NO: 3595023 - RNA, 16 nt, Human
auacugcuacuguaau

SEQ ID NO: 3595024 - RNA, 20 nt, Human
auacugcuacuguaauuuua

SEQ ID NO: 3595025 - RNA, 19 nt, Human
auacugcuugaauaaacac

SEQ ID NO: 3595026 - RNA, 20 nt, Human
auacugcuuggagcugagca

SEQ ID NO: 3595027 - RNA, 17 nt, Human
auacuggaaguuuugca

SEQ ID NO: 3595028 - RNA, 19 nt, Human
auacuggaaguuuugcauu

SEQ ID NO: 3595029 - RNA, 19 nt, Human
auacuggacucuucaaaaa

SEQ ID NO: 3595030 - RNA, 21 nt, Human
auacuggacucuucaaaaacu

SEQ ID NO: 3595031 - RNA, 13 nt, Human
auacuggcacaga

SEQ ID NO: 3595032 - RNA, 14 nt, Human
auacuggccuggac

SEQ ID NO: 3595033 - RNA, 14 nt, Human
auacuggcugguga

SEQ ID NO: 3595034 - RNA, 13 nt, Human
auacuguaaagaa

SEQ ID NO: 3595035 - RNA, 15 nt, Human
auacuguaaagaaag

SEQ ID NO: 3595036 - RNA, 20 nt, Human
auacuguaaagaaagagaga

SEQ ID NO: 3595037 - RNA, 23 nt, Human
auacuguaaagaaagagagaaaa

SEQ ID NO: 3595038 - RNA, 12 nt, Human
auacuguaacac

SEQ ID NO: 3595039 - RNA, 20 nt, Human
auacuguacaaugacuuuau

SEQ ID NO: 3595040 - RNA, 14 nt, Human
auacuguacagggg

SEQ ID NO: 3595041 - RNA, 16 nt, Human
auacuguacuuaauaa

SEQ ID NO: 3595042 - RNA, 13 nt, Human
auacuguauuaag

SEQ ID NO: 3595043 - RNA, 22 nt, Human
auacuguauuaagagugaaaau

SEQ ID NO: 3595044 - RNA, 20 nt, Human
auacuguuauucuuugcacu

SEQ ID NO: 3595045 - RNA, 22 nt, Human
auacuguuauucuuugcacuuu

SEQ ID NO: 3595046 - RNA, 12 nt, Human
auacuguuugag

SEQ ID NO: 3595047 - RNA, 12 nt, Human
auacuuaaaugu

SEQ ID NO: 3595048 - RNA, 14 nt, Human
auacuuaaauguua

SEQ ID NO: 3595049 - RNA, 17 nt, Human
auacuuaaauguuaugu

SEQ ID NO: 3595050 - RNA, 23 nt, Human
auaugaguguggaagccggaggg

SEQ ID NO: 3595051 - RNA, 22 nt, Human
auaugauagcgggaaaaggaga

SEQ ID NO: 3595052 - RNA, 16 nt, Human
auaugaucugucugug

SEQ ID NO: 3595053 - RNA, 17 nt, Human
auaugaucugucugugg

SEQ ID NO: 3595054 - RNA, 13 nt, Human
auaugauucaaau

SEQ ID NO: 3595055 - RNA, 15 nt, Human
auaugauucugcuuu

SEQ ID NO: 3595056 - RNA, 14 nt, Human
auacuuaagcaaaa

SEQ ID NO: 3595057 - RNA, 23 nt, Human
auacuuacauucucuaauaagaa

SEQ ID NO: 3595058 - RNA, 17 nt, Human
auacuuagcaaaaagug

SEQ ID NO: 3595059 - RNA, 22 nt, Human
auacuuagcaaaguuuuaccug

SEQ ID NO: 3595060 - RNA, 14 nt, Human
auacuuauauuuuc

SEQ ID NO: 3595061 - RNA, 17 nt, Human
auacuuaucucucugug

SEQ ID NO: 3595062 - RNA, 20 nt, Human
auacuuaucucucugugcug

SEQ ID NO: 3595063 - RNA, 21 nt, Human
auacuucaugaaauccugggu

SEQ ID NO: 3595064 - RNA, 20 nt, Human
auacuucauuuaaaaaaauc

SEQ ID NO: 3595065 - RNA, 15 nt, Human
auacuucgacacugu

SEQ ID NO: 3595066 - RNA, 16 nt, Human
auacuugaaaauuaac

SEQ ID NO: 3595067 - RNA, 17 nt, Human
auacuugaacaaaaggg

SEQ ID NO: 3595068 - RNA, 18 nt, Human
auacuugaacaaaagggu

SEQ ID NO: 3595069 - RNA, 13 nt, Human
auacuugaaccau

SEQ ID NO: 3595070 - RNA, 16 nt, Human
auacuugaaccauaaa

SEQ ID NO: 3595071 - RNA, 21 nt, Human
auacuugaacguuuucuaauu

SEQ ID NO: 3595072 - RNA, 14 nt, Human
auacuugaacuugu

SEQ ID NO: 3595073 - RNA, 12 nt, Human
auacuuggauuu

SEQ ID NO: 3595074 - RNA, 17 nt, Human
auacuuggauuuaguuu

SEQ ID NO: 3595075 - RNA, 13 nt, Human
auacuuguaauua

SEQ ID NO: 3595076 - RNA, 16 nt, Human
auacuuguaauuaugg

SEQ ID NO: 3595077 - RNA, 13 nt, Human
auacuugucuguu

SEQ ID NO: 3595078 - RNA, 16 nt, Human
auacuugucuguuuua

SEQ ID NO: 3595079 - RNA, 18 nt, Human
auacuuguuguuuaaugu

SEQ ID NO: 3595080 - RNA, 15 nt, Human
auacuuguuuucaaa

SEQ ID NO: 3595081 - RNA, 19 nt, Human
auacuuguuuuuguaaaga

SEQ ID NO: 3595082 - RNA, 16 nt, Human
auacuuuaaaggaaaa

SEQ ID NO: 3595083 - RNA, 23 nt, Human
auacuuuaaaggaaaaaauguug

SEQ ID NO: 3595084 - RNA, 12 nt, Human
auacuuuacaug

SEQ ID NO: 3595085 - RNA, 14 nt, Human
auacuuuaguauga

SEQ ID NO: 3595086 - RNA, 23 nt, Human
auacuuugaaaggagaugucuug

SEQ ID NO: 3595087 - RNA, 22 nt, Human
auacuuugaauguguuucacag

SEQ ID NO: 3595088 - RNA, 22 nt, Human
auacuuugcagcacagcugaga

SEQ ID NO: 3595089 - RNA, 16 nt, Human
auacuuugcauugucu

SEQ ID NO: 3595090 - RNA, 21 nt, Human
auacuuuuacaaguaacaaaa

SEQ ID NO: 3595091 - RNA, 15 nt, Human
auacuuuuacucugc

SEQ ID NO: 3595092 - RNA, 16 nt, Human
auacuuuuacucugcc

SEQ ID NO: 3595093 - RNA, 12 nt, Human
auacuuuuccuu

SEQ ID NO: 3595094 - RNA, 16 nt, Human
auacuuuugcccuuug

SEQ ID NO: 3595095 - RNA, 20 nt, Human
auacuuuuuacaauuaaaaa

SEQ ID NO: 3595096 - RNA, 18 nt, Human
auacuuuuucuuuuguaa

SEQ ID NO: 3595097 - RNA, 17 nt, Human
auacuuuuuugaaauca

SEQ ID NO: 3595098 - RNA, 14 nt, Human
auacuuuuuuucac

SEQ ID NO: 3595099 - RNA, 15 nt, Human
auacuuuuuuucaca

SEQ ID NO: 3595100 - RNA, 17 nt, Human
auagaaaaaaacauucu

SEQ ID NO: 3595101 - RNA, 11 nt, Human
auagaaacaug

SEQ ID NO: 3595102 - RNA, 21 nt, Human
auagaaacucaccauguaaaa

SEQ ID NO: 3595103 - RNA, 23 nt, Human
auagaaacugucuagcacuuccu

SEQ ID NO: 3595104 - RNA, 16 nt, Human
auagaaagugccagaa

SEQ ID NO: 3595105 - RNA, 15 nt, Human
auagaaaguguucug

SEQ ID NO: 3595106 - RNA, 20 nt, Human
auagaaaguguucuguuaca

SEQ ID NO: 3595107 - RNA, 19 nt, Human
auagaaauaagugguuauu

SEQ ID NO: 3595108 - RNA, 19 nt, Human
auagaaaugcugguuuuuc

SEQ ID NO: 3595109 - RNA, 20 nt, Human
auagaaauggaaauuuugcu

SEQ ID NO: 3595110 - RNA, 16 nt, Human
auagaaauuuccagag

SEQ ID NO: 3595111 - RNA, 17 nt, Human
auagaacagagaaagag

SEQ ID NO: 3595112 - RNA, 14 nt, Human
auagaaccucuuug

SEQ ID NO: 3595113 - RNA, 18 nt, Human
auagaacucugaaaugaa

SEQ ID NO: 3595114 - RNA, 14 nt, Human
auagaacugaauga

SEQ ID NO: 3595115 - RNA, 18 nt, Human
auagaacuggauuuucag

SEQ ID NO: 3595116 - RNA, 14 nt, Human
auagaacuggguaa

SEQ ID NO: 3595117 - RNA, 15 nt, Human
auagaacuggguaaa

SEQ ID NO: 3595118 - RNA, 16 nt, Human
auagaacuggguaaau

SEQ ID NO: 3595119 - RNA, 20 nt, Human
auagaacuggguaaaugcaa

SEQ ID NO: 3595120 - RNA, 23 nt, Human
auagaagaaaaaagaaugucaga

SEQ ID NO: 3595121 - RNA, 15 nt, Human
auagaagaacugcaa

SEQ ID NO: 3595122 - RNA, 13 nt, Human
auagaagaaugca

SEQ ID NO: 3595123 - RNA, 17 nt, Human
auagaagaaugcaugcu

SEQ ID NO: 3595124 - RNA, 23 nt, Human
auagaagcugcagugguauuaau

SEQ ID NO: 3595125 - RNA, 16 nt, Human
auagaaggaggagagg

SEQ ID NO: 3595126 - RNA, 13 nt, Human
auagaagucuuca

SEQ ID NO: 3595127 - RNA, 20 nt, Human
auagaagucuucaugaaaug

SEQ ID NO: 3595128 - RNA, 21 nt, Human
auagaaguuuguccauuugua

SEQ ID NO: 3595129 - RNA, 22 nt, Human
auagaaguuuguccauuuguaa

SEQ ID NO: 3595130 - RNA, 19 nt, Human
auagaauaaaauuuuuaau

SEQ ID NO: 3595131 - RNA, 17 nt, Human
auagaauaaaggcaguu

SEQ ID NO: 3595132 - RNA, 22 nt, Human
auagaauaggcacuuuaaaaca

SEQ ID NO: 3595133 - RNA, 13 nt, Human
auagaauauuuau

SEQ ID NO: 3595134 - RNA, 19 nt, Human
auagaauauuuauuaccuc

SEQ ID NO: 3595135 - RNA, 22 nt, Human
auagaauauuuauuaccucuga

SEQ ID NO: 3595136 - RNA, 18 nt, Human
auagaaugguaucaauaa

SEQ ID NO: 3595137 - RNA, 17 nt, Human
auagaauguaaaugucu

SEQ ID NO: 3595138 - RNA, 22 nt, Human
auagaauuauuucacaaauaau

SEQ ID NO: 3595139 - RNA, 20 nt, Human
auagaauugcaauuuuaaca

SEQ ID NO: 3595140 - RNA, 14 nt, Human
auagacaauugagg

SEQ ID NO: 3595141 - RNA, 14 nt, Human
auagacacauacau

SEQ ID NO: 3595142 - RNA, 22 nt, Human
auagacacuccccgaagucuuu

SEQ ID NO: 3595143 - RNA, 15 nt, Human
auagacagcuuugac

SEQ ID NO: 3595144 - RNA, 16 nt, Human
auagacagcuuugacu

SEQ ID NO: 3595145 - RNA, 22 nt, Human
auagacaguuuguaaauguuau

SEQ ID NO: 3595146 - RNA, 12 nt, Human
auagacaugaaa

SEQ ID NO: 3595147 - RNA, 18 nt, Human
auagaccucuaguagcug

SEQ ID NO: 3595148 - RNA, 15 nt, Human
auagacuaaaugaaa

SEQ ID NO: 3595149 - RNA, 19 nt, Human
auagacuguaacuuccaaa

SEQ ID NO: 3595150 - RNA, 13 nt, Human
auagagaauguuc

SEQ ID NO: 3595151 - RNA, 14 nt, Human
auagagacuguaga

SEQ ID NO: 3595152 - RNA, 14 nt, Human
auagagagagacca

SEQ ID NO: 3595153 - RNA, 16 nt, Human
auagagauguuuuuaa

SEQ ID NO: 3595154 - RNA, 21 nt, Human
auagagcaaaauugauguguu

SEQ ID NO: 3595155 - RNA, 15 nt, Human
auagagcagaaauuc

SEQ ID NO: 3595156 - RNA, 22 nt, Human
auagaggauggucuuacagcag

SEQ ID NO: 3595157 - RNA, 19 nt, Human
auagaggcuaaauuacuca

SEQ ID NO: 3595158 - RNA, 20 nt, Human
auagaggcuagcuucugcuu

SEQ ID NO: 3595159 - RNA, 23 nt, Human
auagaggcuucuccgccagccuc

SEQ ID NO: 3595160 - RNA, 18 nt, Human
auagagguauauuggaag

SEQ ID NO: 3595161 - RNA, 22 nt, Human
auagaggugagggaagccugaa

SEQ ID NO: 3595162 - RNA, 17 nt, Human
auagaguacacugccug

SEQ ID NO: 3595163 - RNA, 13 nt, Human
auagagucuugcu

SEQ ID NO: 3595164 - RNA, 22 nt, Human
auagagugacuccaagaacaau

SEQ ID NO: 3595165 - RNA, 19 nt, Human
auagaguguacuuaacuau

SEQ ID NO: 3595166 - RNA, 16 nt, Human
auagaguguaguuuac

SEQ ID NO: 3595167 - RNA, 23 nt, Human
auagaguguaguuuacagaaaaa

SEQ ID NO: 3595168 - RNA, 21 nt, Human
auagauaaaacaucuuugaaa

SEQ ID NO: 3595169 - RNA, 18 nt, Human
auagauauaaauuuuuaa

SEQ ID NO: 3595170 - RNA, 14 nt, Human
auagauauaaugaa

SEQ ID NO: 3595171 - RNA, 23 nt, Human
auagauauaaugaacaaaauuau

SEQ ID NO: 3595172 - RNA, 15 nt, Human
auagaucacauaaca

SEQ ID NO: 3595173 - RNA, 12 nt, Human
auagaucuucug

SEQ ID NO: 3595174 - RNA, 16 nt, Human
auagaugcaagauauu

SEQ ID NO: 3595175 - RNA, 16 nt, Human
auagaugcuggcccag

SEQ ID NO: 3595176 - RNA, 15 nt, Human
auagaugggaaugaa

SEQ ID NO: 3595177 - RNA, 23 nt, Human
auagaugucccuuucuuggccag

SEQ ID NO: 3595178 - RNA, 18 nt, Human
auagaugucuagguacuu

SEQ ID NO: 3595179 - RNA, 13 nt, Human
auagaugucuuuu

SEQ ID NO: 3595180 - RNA, 21 nt, Human
auagaugucuuuuauagugga

SEQ ID NO: 3595181 - RNA, 14 nt, Human
auagauguugcuaa

SEQ ID NO: 3595182 - RNA, 20 nt, Human
auagauguugcuaacagcaa

SEQ ID NO: 3595183 - RNA, 13 nt, Human
auagauguuuccu

SEQ ID NO: 3595184 - RNA, 23 nt, Human
auagauguuuugguagauuaaau

SEQ ID NO: 3595185 - RNA, 12 nt, Human
auagauuaaauc

SEQ ID NO: 3595186 - RNA, 21 nt, Human
auagauuagaaaaauuccuaa

SEQ ID NO: 3595187 - RNA, 22 nt, Human
auagauuagagaguguugaaac

SEQ ID NO: 3595188 - RNA, 15 nt, Human
auagauuagauuaua

SEQ ID NO: 3595189 - RNA, 14 nt, Human
auagauuauaacuu

SEQ ID NO: 3595190 - RNA, 13 nt, Human
auagauucaccug

SEQ ID NO: 3595191 - RNA, 15 nt, Human
auagauucaccugua

SEQ ID NO: 3595192 - RNA, 14 nt, Human
auagauucuaaaga

SEQ ID NO: 3595193 - RNA, 14 nt, Human
auagauuguccuuu

SEQ ID NO: 3595194 - RNA, 19 nt, Human
auagauugugaauaaugau

SEQ ID NO: 3595195 - RNA, 20 nt, Human
auagauuuauuuuucaguuc

SEQ ID NO: 3595196 - RNA, 23 nt, Human
auagauuuauuuuucaguuccaa

SEQ ID NO: 3595197 - RNA, 19 nt, Human
auagauuucugauuuuaug

SEQ ID NO: 3595198 - RNA, 15 nt, Human
auagauuuuauaaga

SEQ ID NO: 3595199 - RNA, 23 nt, Human
auagcaaaacuuuuaaacuacag

SEQ ID NO: 3595200 - RNA, 16 nt, Human
auagcaaacuuggaau

SEQ ID NO: 3595201 - RNA, 22 nt, Human
auagcaaagcgacguuagucgu

SEQ ID NO: 3595202 - RNA, 14 nt, Human
auagcaaaugacau

SEQ ID NO: 3595203 - RNA, 14 nt, Human
auagcacagacccu

SEQ ID NO: 3595204 - RNA, 18 nt, Human
auagcacagacccugccc

SEQ ID NO: 3595205 - RNA, 14 nt, Human
auauuacaaaaaca

SEQ ID NO: 3595206 - RNA, 22 nt, Human
auauuacaaaaacaaaauaaaa

SEQ ID NO: 3595207 - RNA, 13 nt, Human
auauuacaaugau

SEQ ID NO: 3595208 - RNA, 15 nt, Human
auauuacaaugauca

SEQ ID NO: 3595209 - RNA, 20 nt, Human
auauuacacaaauacuuauu

SEQ ID NO: 3595210 - RNA, 19 nt, Human
auauuaccacagacauacu

SEQ ID NO: 3595211 - RNA, 22 nt, Human
auauuaccacagacauacuaac

SEQ ID NO: 3595212 - RNA, 16 nt, Human
auauuacuagcauaug

SEQ ID NO: 3595213 - RNA, 21 nt, Human
auauuacuguuuauuucuguu

SEQ ID NO: 3595214 - RNA, 17 nt, Human
auauuacuuuaacaugc

SEQ ID NO: 3595215 - RNA, 16 nt, Human
auauuacuuuaucacu

SEQ ID NO: 3595216 - RNA, 14 nt, Human
auauuagaaaacuu

SEQ ID NO: 3595217 - RNA, 15 nt, Human
auauuagaaaggcuc

SEQ ID NO: 3595218 - RNA, 14 nt, Human
auauuagaaguguu

SEQ ID NO: 3595219 - RNA, 16 nt, Human
auauuagacuucuguu

SEQ ID NO: 3595220 - RNA, 21 nt, Human
auauuagacuucuguuuucaa

SEQ ID NO: 3595221 - RNA, 13 nt, Human
auauuagaucaaa

SEQ ID NO: 3595222 - RNA, 15 nt, Human
auauuagaugugauu

SEQ ID NO: 3595223 - RNA, 17 nt, Human
auauuagaugugauuua

SEQ ID NO: 3595224 - RNA, 18 nt, Human
auauuagaugugauuuaa

SEQ ID NO: 3595225 - RNA, 20 nt, Human
auauuagaugugauuuaaua

SEQ ID NO: 3595226 - RNA, 19 nt, Human
auauuauaaaggauaaaga

SEQ ID NO: 3595227 - RNA, 17 nt, Human
auauuauaacuuaaaaa

SEQ ID NO: 3595228 - RNA, 22 nt, Human
auauuauaauuuuuuucaauau

SEQ ID NO: 3595229 - RNA, 15 nt, Human
auauuauauauauau

SEQ ID NO: 3595230 - RNA, 12 nt, Human
auauuauaugga

SEQ ID NO: 3595231 - RNA, 19 nt, Human
auauuauauggaaauauau

SEQ ID NO: 3595232 - RNA, 20 nt, Human
auauuauauggaaauauaua

SEQ ID NO: 3595233 - RNA, 13 nt, Human
auauuauauuugg

SEQ ID NO: 3595234 - RNA, 13 nt, Human
auauuaucuuuuc

SEQ ID NO: 3595235 - RNA, 23 nt, Human
auauuaugaagcuuuuaugugaa

SEQ ID NO: 3595236 - RNA, 21 nt, Human
auauuauguauuuauauuuug

SEQ ID NO: 3595237 - RNA, 17 nt, Human
auauuauguguuuccau

SEQ ID NO: 3595238 - RNA, 17 nt, Human
auauuauuacuuguaaa

SEQ ID NO: 3595239 - RNA, 19 nt, Human
auauuauuagaaauuagaa

SEQ ID NO: 3595240 - RNA, 19 nt, Human
auauuauuaguuuugauuu

SEQ ID NO: 3595241 - RNA, 22 nt, Human
auauuauuaguuuugauuuaau

SEQ ID NO: 3595242 - RNA, 18 nt, Human
auauuauuauaaucuuau

SEQ ID NO: 3595243 - RNA, 20 nt, Human
auauuauucaccauguaaaa

SEQ ID NO: 3595244 - RNA, 17 nt, Human
auauuauucauucauuu

SEQ ID NO: 3595245 - RNA, 22 nt, Human
auauuauuucuaggaagaauuu

SEQ ID NO: 3595246 - RNA, 12 nt, Human
auauuauuuggc

SEQ ID NO: 3595247 - RNA, 16 nt, Human
auauuauuuggcaguu

SEQ ID NO: 3595248 - RNA, 18 nt, Human
auauuauuuggcaguuug

SEQ ID NO: 3595249 - RNA, 18 nt, Human
auauuauuuguguuuccu

SEQ ID NO: 3595250 - RNA, 11 nt, Human
auauucaacca

SEQ ID NO: 3595251 - RNA, 17 nt, Human
auauucaaccauggacu

SEQ ID NO: 3595252 - RNA, 23 nt, Human
auauucaaccauggacuuuauaa

SEQ ID NO: 3595253 - RNA, 20 nt, Human
auauucaauaaagcugcuga

SEQ ID NO: 3595254 - RNA, 13 nt, Human
auauucacaucuu

SEQ ID NO: 3595255 - RNA, 16 nt, Human
auauucagauguaugu

SEQ ID NO: 3595256 - RNA, 13 nt, Human
auauucaggaagc

SEQ ID NO: 3595257 - RNA, 14 nt, Human
auauucaggaagcu

SEQ ID NO: 3595258 - RNA, 19 nt, Human
auauucaggaagcucaggg

SEQ ID NO: 3595259 - RNA, 22 nt, Human
auauucagugcuguggccuggg

SEQ ID NO: 3595260 - RNA, 23 nt, Human
auauucagugcuguggccugggc

SEQ ID NO: 3595261 - RNA, 19 nt, Human
auauucauaguagaacuuu

SEQ ID NO: 3595262 - RNA, 18 nt, Human
auauucaugcuucuuccu

SEQ ID NO: 3595263 - RNA, 19 nt, Human
auauucauguaaacaaaau

SEQ ID NO: 3595264 - RNA, 17 nt, Human
auauucauucauggacc

SEQ ID NO: 3595265 - RNA, 15 nt, Human
auauucauuguauaa

SEQ ID NO: 3595266 - RNA, 16 nt, Human
auauucauuguauaaa

SEQ ID NO: 3595267 - RNA, 21 nt, Human
auauucauuguauaaaaauag

SEQ ID NO: 3595268 - RNA, 13 nt, Human
auauucauuucaa

SEQ ID NO: 3595269 - RNA, 15 nt, Human
auauuccagaucuuu

SEQ ID NO: 3595270 - RNA, 16 nt, Human
auauuccauaguauau

SEQ ID NO: 3595271 - RNA, 17 nt, Human
auauuccauaguauauu

SEQ ID NO: 3595272 - RNA, 23 nt, Human
auauuccauaguauauuaaaaau

SEQ ID NO: 3595273 - RNA, 19 nt, Human
auauuccaugaauguauca

SEQ ID NO: 3595274 - RNA, 23 nt, Human
auauucccuagaaacuuccaaau

SEQ ID NO: 3595275 - RNA, 22 nt, Human
auauuccuauugugcaauguaa

SEQ ID NO: 3595276 - RNA, 21 nt, Human
auauuccugcauuugugaaau

SEQ ID NO: 3595277 - RNA, 14 nt, Human
auauucuaagacuu

SEQ ID NO: 3595278 - RNA, 23 nt, Human
auauucuaagacuuacucuaaga

SEQ ID NO: 3595279 - RNA, 22 nt, Human
auauucuauuacauuuucagug

SEQ ID NO: 3595280 - RNA, 14 nt, Human
auauucuauuuuac

SEQ ID NO: 3595281 - RNA, 16 nt, Human
auauucucagcagagu

SEQ ID NO: 3595282 - RNA, 18 nt, Human
auauucucagcagagugc

SEQ ID NO: 3595283 - RNA, 12 nt, Human
auauucucugua

SEQ ID NO: 3595284 - RNA, 13 nt, Human
auauucucuguac

SEQ ID NO: 3595285 - RNA, 13 nt, Human
auauucucuuugg

SEQ ID NO: 3595286 - RNA, 24 nt, Human
auauucugaagcaacauuuuagcu

SEQ ID NO: 3595287 - RNA, 21 nt, Human
auauucugcucuauuauauaa

SEQ ID NO: 3595288 - RNA, 21 nt, Human
auauucuggccagacucgaug

SEQ ID NO: 3595289 - RNA, 17 nt, Human
auauucuggcugauaaa

SEQ ID NO: 3595290 - RNA, 15 nt, Human
auauucuuucaaagg

SEQ ID NO: 3595291 - RNA, 16 nt, Human
auauugaaaaaaauaa

SEQ ID NO: 3595292 - RNA, 16 nt, Human
auauugaaaaaauaga

SEQ ID NO: 3595293 - RNA, 20 nt, Human
auauugaaaauugaaaagua

SEQ ID NO: 3595294 - RNA, 21 nt, Human
auauugaaaauugaaaaguac

SEQ ID NO: 3595295 - RNA, 18 nt, Human
auauugaacuuuuguacu

SEQ ID NO: 3595296 - RNA, 14 nt, Human
auauugaagacaau

SEQ ID NO: 3595297 - RNA, 15 nt, Human
auauugaagacaauu

SEQ ID NO: 3595298 - RNA, 17 nt, Human
auauugaagacaauuug

SEQ ID NO: 3595299 - RNA, 18 nt, Human
auauugaauauaauauau

SEQ ID NO: 3595300 - RNA, 16 nt, Human
auauugaauuuuuccu

SEQ ID NO: 3595301 - RNA, 21 nt, Human
auauugacaaguuuaaaggcu

SEQ ID NO: 3595302 - RNA, 15 nt, Human
auauugagacaaaaa

SEQ ID NO: 3595303 - RNA, 20 nt, Human
auauugagcaauaugucagu

SEQ ID NO: 3595304 - RNA, 13 nt, Human
auauugagcagaa

SEQ ID NO: 3595305 - RNA, 14 nt, Human
auauugagcagaau

SEQ ID NO: 3595306 - RNA, 21 nt, Human
auauugaggagcacugaaagu

SEQ ID NO: 3595307 - RNA, 17 nt, Human
auauugaggcuuugugu

SEQ ID NO: 3595308 - RNA, 19 nt, Human
auauugaggcuuuguguug

SEQ ID NO: 3595309 - RNA, 18 nt, Human
auauugauaagaucuuuu

SEQ ID NO: 3595310 - RNA, 22 nt, Human
auauugauccagaaagaaaacu

SEQ ID NO: 3595311 - RNA, 14 nt, Human
auauugaugaaaag

SEQ ID NO: 3595312 - RNA, 13 nt, Human
auauugaugugug

SEQ ID NO: 3595313 - RNA, 15 nt, Human
auauugauugggaaa

SEQ ID NO: 3595314 - RNA, 21 nt, Human
auauugauuuccguuaaaaua

SEQ ID NO: 3595315 - RNA, 19 nt, Human
auauugcaaaauacaugaa

SEQ ID NO: 3595316 - RNA, 17 nt, Human
auauugcacaauuauaa

SEQ ID NO: 3595317 - RNA, 15 nt, Human
auauugcacaugucu

SEQ ID NO: 3595318 - RNA, 16 nt, Human
auauugcacaugucuu

SEQ ID NO: 3595319 - RNA, 19 nt, Human
auauugcacaugucuuaau

SEQ ID NO: 3595320 - RNA, 20 nt, Human
auauugcacaugucuuaaug

SEQ ID NO: 3595321 - RNA, 16 nt, Human
auauugccaaugcuac

SEQ ID NO: 3595322 - RNA, 17 nt, Human
auauugcccaggcuggu

SEQ ID NO: 3595323 - RNA, 21 nt, Human
auauugcugaagaaucuacuu

SEQ ID NO: 3595324 - RNA, 18 nt, Human
auauugcugaaugcaaga

SEQ ID NO: 3595325 - RNA, 17 nt, Human
auauugcugauggugca

SEQ ID NO: 3595326 - RNA, 17 nt, Human
auauugcuguauagcuc

SEQ ID NO: 3595327 - RNA, 13 nt, Human
auauugcuuuuuc

SEQ ID NO: 3595328 - RNA, 18 nt, Human
auauugcuuuuucuaaug

SEQ ID NO: 3595329 - RNA, 22 nt, Human
auauugcuuuuucuaauguggu

SEQ ID NO: 3595330 - RNA, 19 nt, Human
auauuggguuccauucuca

SEQ ID NO: 3595331 - RNA, 21 nt, Human
auauugguauauccuuuucug

SEQ ID NO: 3595332 - RNA, 15 nt, Human
auauugguuuuauga

SEQ ID NO: 3595333 - RNA, 17 nt, Human
auauugguuuuaugaug

SEQ ID NO: 3595334 - RNA, 18 nt, Human
auauugguuuuaugauga

SEQ ID NO: 3595335 - RNA, 16 nt, Human
auauuguaaaacaggu

SEQ ID NO: 3595336 - RNA, 12 nt, Human
auauuguacacu

SEQ ID NO: 3595337 - RNA, 13 nt, Human
auauuguacauaa

SEQ ID NO: 3595338 - RNA, 14 nt, Human
auauuguacauaaa

SEQ ID NO: 3595339 - RNA, 16 nt, Human
auauuguacauaaaag

SEQ ID NO: 3595340 - RNA, 17 nt, Human
auauuguacauaaaaga

SEQ ID NO: 3595341 - RNA, 16 nt, Human
auauuguauuacuaga

SEQ ID NO: 3595342 - RNA, 18 nt, Human
auauugucauuccuguau

SEQ ID NO: 3595343 - RNA, 20 nt, Human
auauugucucuuuuuuaagu

SEQ ID NO: 3595344 - RNA, 19 nt, Human
aggagcagugcaggcacag

SEQ ID NO: 3595345 - RNA, 15 nt, Human
aggagccaccaguuc

SEQ ID NO: 3595346 - RNA, 17 nt, Human
aggagccaccaguucuc

SEQ ID NO: 3595347 - RNA, 12 nt, Human
aggagccaggca

SEQ ID NO: 3595348 - RNA, 13 nt, Human
aggagcccaggcc

SEQ ID NO: 3595349 - RNA, 20 nt, Human
aggagcccauacucagccug

SEQ ID NO: 3595350 - RNA, 16 nt, Human
aggagccccauuccug

SEQ ID NO: 3595351 - RNA, 13 nt, Human
aggagcccucauc

SEQ ID NO: 3595352 - RNA, 11 nt, Human
aggagcccugc

SEQ ID NO: 3595353 - RNA, 15 nt, Human
aggagcccugccucu

SEQ ID NO: 3595354 - RNA, 18 nt, Human
aggagcccugggaggcuc

SEQ ID NO: 3595355 - RNA, 19 nt, Human
aggagcccugggaggcucu

SEQ ID NO: 3595356 - RNA, 21 nt, Human
aggagcccuuaucugugcuca

SEQ ID NO: 3595357 - RNA, 23 nt, Human
aggagcccuucuauacccaccca

SEQ ID NO: 3595358 - RNA, 16 nt, Human
aggagccgaagcccag

SEQ ID NO: 3595359 - RNA, 18 nt, Human
aggagccgaagcccaggg

SEQ ID NO: 3595360 - RNA, 14 nt, Human
auagcacaggcuaa

SEQ ID NO: 3595361 - RNA, 17 nt, Human
auagcacaggcuaauuu

SEQ ID NO: 3595362 - RNA, 15 nt, Human
auagcacuuucauug

SEQ ID NO: 3595363 - RNA, 21 nt, Human
auagcacuuugaaauaccuca

SEQ ID NO: 3595364 - RNA, 22 nt, Human
auagcacuuugaaauaccucau

SEQ ID NO: 3595365 - RNA, 16 nt, Human
auagcagacaguguuu

SEQ ID NO: 3595366 - RNA, 14 nt, Human
auagcagauuuuaa

SEQ ID NO: 3595367 - RNA, 22 nt, Human
auagcagauuuuaauuuugaau

SEQ ID NO: 3595368 - RNA, 15 nt, Human
auagcagcaaaaaua

SEQ ID NO: 3595369 - RNA, 19 nt, Human
auagcagcaaaaauauaaa

SEQ ID NO: 3595370 - RNA, 13 nt, Human
auagcagccuuuc

SEQ ID NO: 3595371 - RNA, 19 nt, Human
auagcagccuuucucucuu

SEQ ID NO: 3595372 - RNA, 18 nt, Human
auagcaguauauguuaau

SEQ ID NO: 3595373 - RNA, 13 nt, Human
auagcaucacuua

SEQ ID NO: 3595374 - RNA, 17 nt, Human
auagcaucacuuaaaac

SEQ ID NO: 3595375 - RNA, 20 nt, Human
auagcaucacuuaaaacacg

SEQ ID NO: 3595376 - RNA, 17 nt, Human
auagcauccaaguggca

SEQ ID NO: 3595377 - RNA, 23 nt, Human
auagcauguauugugucuuuugc

SEQ ID NO: 3595378 - RNA, 13 nt, Human
auagcauuaacua

SEQ ID NO: 3595379 - RNA, 16 nt, Human
auagcauucucuauca

SEQ ID NO: 3595380 - RNA, 15 nt, Human
auagcauugucuauu

SEQ ID NO: 3595381 - RNA, 15 nt, Human
auagcauugugaacu

SEQ ID NO: 3595382 - RNA, 17 nt, Human
auagcauuuaugguaau

SEQ ID NO: 3595383 - RNA, 18 nt, Human
auagcauuuuugauuuau

SEQ ID NO: 3595384 - RNA, 19 nt, Human
auagcauuuuugauuuaug

SEQ ID NO: 3595385 - RNA, 12 nt, Human
auagccaaaaau

SEQ ID NO: 3595386 - RNA, 13 nt, Human
auagccaaaaaua

SEQ ID NO: 3595387 - RNA, 16 nt, Human
auagccacauuuggaa

SEQ ID NO: 3595388 - RNA, 22 nt, Human
auagccacauuuggaauacuuu

SEQ ID NO: 3595389 - RNA, 15 nt, Human
auagccacuaaccuu

SEQ ID NO: 3595390 - RNA, 21 nt, Human
auagccacuaaccuugccugg

SEQ ID NO: 3595391 - RNA, 20 nt, Human
auagccauauuuguaaaaug

SEQ ID NO: 3595392 - RNA, 22 nt, Human
auagccauauuuguaaaaugac

SEQ ID NO: 3595393 - RNA, 23 nt, Human
auagccauauuuguaaaaugaca

SEQ ID NO: 3595394 - RNA, 23 nt, Human
auagccauguaucauaauuacca

SEQ ID NO: 3595395 - RNA, 13 nt, Human
auagcccagacac

SEQ ID NO: 3595396 - RNA, 14 nt, Human
auagcccagaucag

SEQ ID NO: 3595397 - RNA, 20 nt, Human
auagcccaggauauauuuua

SEQ ID NO: 3595398 - RNA, 15 nt, Human
auagccccucucccc

SEQ ID NO: 3595399 - RNA, 19 nt, Human
auagccccucuccccgcag

SEQ ID NO: 3595400 - RNA, 14 nt, Human
auagccgggcaugg

SEQ ID NO: 3595401 - RNA, 16 nt, Human
auagccuauauuuaca

SEQ ID NO: 3595402 - RNA, 23 nt, Human
auagccucugucuggcaaugcca

SEQ ID NO: 3595403 - RNA, 18 nt, Human
auagccuggacugcuacc

SEQ ID NO: 3595404 - RNA, 18 nt, Human
auagcgucauaacuagaa

SEQ ID NO: 3595405 - RNA, 12 nt, Human
auagcgugugua

SEQ ID NO: 3595406 - RNA, 15 nt, Human
auagcguucuuguaa

SEQ ID NO: 3595407 - RNA, 17 nt, Human
auagcguucuuguaauu

SEQ ID NO: 3595408 - RNA, 18 nt, Human
auagcguucuuguaauuu

SEQ ID NO: 3595409 - RNA, 13 nt, Human
auagcuaaauacc

SEQ ID NO: 3595410 - RNA, 14 nt, Human
auagcuaaguacac

SEQ ID NO: 3595411 - RNA, 18 nt, Human
auagcuaaguacacaaua

SEQ ID NO: 3595412 - RNA, 16 nt, Human
auagcuacccaaaaga

SEQ ID NO: 3595413 - RNA, 17 nt, Human
auagcuacuaauuuuaa

SEQ ID NO: 3595414 - RNA, 18 nt, Human
auagcuagacuggugacu

SEQ ID NO: 3595415 - RNA, 12 nt, Human
auagcuauuuuu

SEQ ID NO: 3595416 - RNA, 18 nt, Human
auagcuauuuuuauggaa

SEQ ID NO: 3595417 - RNA, 19 nt, Human
auagcucaggugucccugc

SEQ ID NO: 3595418 - RNA, 21 nt, Human
auagcucaggugucccugcac

SEQ ID NO: 3595419 - RNA, 22 nt, Human
auagcucaggugucccugcacu

SEQ ID NO: 3595420 - RNA, 20 nt, Human
auagcuccccgcuucugccu

SEQ ID NO: 3595421 - RNA, 23 nt, Human
auagcuccccgcuucugccugca

SEQ ID NO: 3595422 - RNA, 15 nt, Human
auagcucuaauguuu

SEQ ID NO: 3595423 - RNA, 17 nt, Human
auagcucuaauguuugc

SEQ ID NO: 3595424 - RNA, 20 nt, Human
auagcucuaauguuugcaua

SEQ ID NO: 3595425 - RNA, 22 nt, Human
auagcucuaauguuugcauaua

SEQ ID NO: 3595426 - RNA, 19 nt, Human
auagcucuggggugggcag

SEQ ID NO: 3595427 - RNA, 14 nt, Human
auagcugaucaguu

SEQ ID NO: 3595428 - RNA, 21 nt, Human
auagcugcccauuucgugagc

SEQ ID NO: 3595429 - RNA, 12 nt, Human
auagcugcugcc

SEQ ID NO: 3595430 - RNA, 16 nt, Human
auagcuggcaagaaug

SEQ ID NO: 3595431 - RNA, 15 nt, Human
auagcuguacaaaua

SEQ ID NO: 3595432 - RNA, 22 nt, Human
auagcuguacuucuugaauaua

SEQ ID NO: 3595433 - RNA, 15 nt, Human
auagcuguauugaau

SEQ ID NO: 3595434 - RNA, 16 nt, Human
auagcuguauugaauc

SEQ ID NO: 3595435 - RNA, 16 nt, Human
auagcuuauuauugaa

SEQ ID NO: 3595436 - RNA, 14 nt, Human
auagcuuguauagu

SEQ ID NO: 3595437 - RNA, 17 nt, Human
auagcuuguauagugua

SEQ ID NO: 3595438 - RNA, 20 nt, Human
auagcuuguauaguguaaaa

SEQ ID NO: 3595439 - RNA, 10 nt, Human
auagcuuuau

SEQ ID NO: 3595440 - RNA, 15 nt, Human
auagcuuuauuuuuu

SEQ ID NO: 3595441 - RNA, 18 nt, Human
auagcuuuauuuuuuaag

SEQ ID NO: 3595442 - RNA, 15 nt, Human
auagcuuuuuucucu

SEQ ID NO: 3595443 - RNA, 12 nt, Human
auaggaaaaacu

SEQ ID NO: 3595444 - RNA, 17 nt, Human
auaggaaaaacugauuu

SEQ ID NO: 3595445 - RNA, 18 nt, Human
auaggaaaaguacauuua

SEQ ID NO: 3595446 - RNA, 21 nt, Human
auaggaaaugguauccagaau

SEQ ID NO: 3595447 - RNA, 19 nt, Human
auaggaacuuaaauaaugu

SEQ ID NO: 3595448 - RNA, 13 nt, Human
auaggaagacaca

SEQ ID NO: 3595449 - RNA, 18 nt, Human
auaggaaugugaaagcac

SEQ ID NO: 3595450 - RNA, 21 nt, Human
auaggaauugacccacaagaa

SEQ ID NO: 3595451 - RNA, 16 nt, Human
auaggaccuugggcca

SEQ ID NO: 3595452 - RNA, 17 nt, Human
auaggaccuugggccaa

SEQ ID NO: 3595453 - RNA, 15 nt, Human
auaggacuuguuuuu

SEQ ID NO: 3595454 - RNA, 21 nt, Human
auaggagaggaugagagccca

SEQ ID NO: 3595455 - RNA, 16 nt, Human
auaggagccugcuggu

SEQ ID NO: 3595456 - RNA, 19 nt, Human
auaggaugggcuucugugc

SEQ ID NO: 3595457 - RNA, 20 nt, Human
auaggcagacuggguuucua

SEQ ID NO: 3595458 - RNA, 23 nt, Human
auaggcccaaccaccagaugaga

SEQ ID NO: 3595459 - RNA, 16 nt, Human
auaggcccacacacag

SEQ ID NO: 3595460 - RNA, 17 nt, Human
auaggcccacacacagg

SEQ ID NO: 3595461 - RNA, 14 nt, Human
auaggccugggugc

SEQ ID NO: 3595462 - RNA, 13 nt, Human
auaggcucugcac

SEQ ID NO: 3595463 - RNA, 15 nt, Human
auaggcucugcacag

SEQ ID NO: 3595464 - RNA, 18 nt, Human
auaggcuggagaagcuca

SEQ ID NO: 3595465 - RNA, 15 nt, Human
auagggagaaaccaa

SEQ ID NO: 3595466 - RNA, 22 nt, Human
auagggcaauuaauuccuucag

SEQ ID NO: 3595467 - RNA, 22 nt, Human
auagggcccaugggagggagcu

SEQ ID NO: 3595468 - RNA, 14 nt, Human
auagggcugagcuc

SEQ ID NO: 3595469 - RNA, 16 nt, Human
auagggguguuuauuu

SEQ ID NO: 3595470 - RNA, 14 nt, Human
auagggucuaacuc

SEQ ID NO: 3595471 - RNA, 16 nt, Human
auagggucucuucagg

SEQ ID NO: 3595472 - RNA, 20 nt, Human
auagguaaucaaugaauauu

SEQ ID NO: 3595473 - RNA, 15 nt, Human
auaggucacuccugg

SEQ ID NO: 3595474 - RNA, 19 nt, Human
auaggucacuggcucucca

SEQ ID NO: 3595475 - RNA, 13 nt, Human
auaggucugaaau

SEQ ID NO: 3595476 - RNA, 14 nt, Human
auaggugcuacaaa

SEQ ID NO: 3595477 - RNA, 14 nt, Human
auagguuagauaua

SEQ ID NO: 3595478 - RNA, 16 nt, Human
auagguugagcaauuu

SEQ ID NO: 3595479 - RNA, 24 nt, Human
auagguuuggacaaaauggaauac

SEQ ID NO: 3595480 - RNA, 19 nt, Human
auagguuuuguuugcuauc

SEQ ID NO: 3595481 - RNA, 16 nt, Human
auaguaaaauucuacu

SEQ ID NO: 3595482 - RNA, 13 nt, Human
auaguaaaucacg

SEQ ID NO: 3595483 - RNA, 20 nt, Human
auaguaacugacaugauuag

SEQ ID NO: 3595484 - RNA, 21 nt, Human
auaguaacuucuuauggaauu

SEQ ID NO: 3595485 - RNA, 17 nt, Human
auaguaaguucagcacu

SEQ ID NO: 3595486 - RNA, 13 nt, Human
auaguaauauaau

SEQ ID NO: 3595487 - RNA, 13 nt, Human
auaguaauuugua

SEQ ID NO: 3595488 - RNA, 17 nt, Human
auaguaccaaucauuuu

SEQ ID NO: 3595489 - RNA, 17 nt, Human
auauuuuucacauaucu

SEQ ID NO: 3595490 - RNA, 15 nt, Human
auauuuuucuuaaaa

SEQ ID NO: 3595491 - RNA, 19 nt, Human
auauuuuucuuaaaaagua

SEQ ID NO: 3595492 - RNA, 18 nt, Human
auauuuuugguugucaau

SEQ ID NO: 3595493 - RNA, 23 nt, Human
auauuuuuguagcacugacagau

SEQ ID NO: 3595494 - RNA, 16 nt, Human
auauuuuuguuuguuu

SEQ ID NO: 3595495 - RNA, 23 nt, Human
auauuuuuuaaaauaagucugau

SEQ ID NO: 3595496 - RNA, 18 nt, Human
auauuuuuucagaaauau

SEQ ID NO: 3595497 - RNA, 18 nt, Human
auauuuuuuuccuuacau

SEQ ID NO: 3595498 - RNA, 19 nt, Human
auauuuuuuuccuuacaua

SEQ ID NO: 3595499 - RNA, 15 nt, Human
auauuuuuuuguaga

SEQ ID NO: 3595500 - RNA, 13 nt, Human
aucaaaaaggcuu

SEQ ID NO: 3595501 - RNA, 17 nt, Human
aucaaaaaggcuuauaa

SEQ ID NO: 3595502 - RNA, 16 nt, Human
aucaaaaauauuccau

SEQ ID NO: 3595503 - RNA, 21 nt, Human
aucaaaaccuuucaaauauca

SEQ ID NO: 3595504 - RNA, 21 nt, Human
aucaaaacuuucuuuucugga

SEQ ID NO: 3595505 - RNA, 14 nt, Human
aucaaaagaaagaa

SEQ ID NO: 3595506 - RNA, 16 nt, Human
aucaaaagacaauucu

SEQ ID NO: 3595507 - RNA, 18 nt, Human
aucaaaagggccaaagaa

SEQ ID NO: 3595508 - RNA, 18 nt, Human
aucaaaauaaaaagugac

SEQ ID NO: 3595509 - RNA, 14 nt, Human
aucaaaauagucua

SEQ ID NO: 3595510 - RNA, 15 nt, Human
aucaaaaucucucca

SEQ ID NO: 3595511 - RNA, 17 nt, Human
aucaaaaucucuccacu

SEQ ID NO: 3595512 - RNA, 22 nt, Human
aucaaaaugcuuuuuauuucug

SEQ ID NO: 3595513 - RNA, 12 nt, Human
aucaaaauuaca

SEQ ID NO: 3595514 - RNA, 18 nt, Human
aucaaacauggguuuagu

SEQ ID NO: 3595515 - RNA, 14 nt, Human
auagucaaagagag

SEQ ID NO: 3595516 - RNA, 14 nt, Human
auagucaaauugug

SEQ ID NO: 3595517 - RNA, 19 nt, Human
auagucaauggcuuguuca

SEQ ID NO: 3595518 - RNA, 18 nt, Human
auagucauuuauuuuaaa

SEQ ID NO: 3595519 - RNA, 12 nt, Human
auagucccugcc

SEQ ID NO: 3595520 - RNA, 13 nt, Human
auagucuguguga

SEQ ID NO: 3595521 - RNA, 22 nt, Human
auagucuuggaagcuguuugga

SEQ ID NO: 3595522 - RNA, 17 nt, Human
auagucuuuugcuuuug

SEQ ID NO: 3595523 - RNA, 13 nt, Human
auagugaauacug

SEQ ID NO: 3595524 - RNA, 18 nt, Human
auagugacuaugaacuuc

SEQ ID NO: 3595525 - RNA, 18 nt, Human
auagugacuuuucaagua

SEQ ID NO: 3595526 - RNA, 23 nt, Human
auagugacuuuucaaguauuuaa

SEQ ID NO: 3595527 - RNA, 21 nt, Human
auagugaggcaucgcaaugua

SEQ ID NO: 3595528 - RNA, 12 nt, Human
auagugcaauau

SEQ ID NO: 3595529 - RNA, 20 nt, Human
auagugcaauauauuuugua

SEQ ID NO: 3595530 - RNA, 16 nt, Human
auagugcuauauauau

SEQ ID NO: 3595531 - RNA, 19 nt, Human
auagugcuauauauauaaa

SEQ ID NO: 3595532 - RNA, 20 nt, Human
auagugcugggauggagggg

SEQ ID NO: 3595533 - RNA, 22 nt, Human
auagugcugggauggaggggag

SEQ ID NO: 3595534 - RNA, 22 nt, Human
auaguggacauuguuggcagca

SEQ ID NO: 3595535 - RNA, 13 nt, Human
auaguggccagac

SEQ ID NO: 3595536 - RNA, 15 nt, Human
auagugggauuucca

SEQ ID NO: 3595537 - RNA, 20 nt, Human
auagugggcaccccacugca

SEQ ID NO: 3595538 - RNA, 15 nt, Human
auaguggugugauuu

SEQ ID NO: 3595539 - RNA, 17 nt, Human
auagugguucuuggaaa

SEQ ID NO: 3595540 - RNA, 21 nt, Human
auagugguucuuggaaaaaug

SEQ ID NO: 3595541 - RNA, 13 nt, Human
auaguguaaaaua

SEQ ID NO: 3595542 - RNA, 19 nt, Human
auaguguagcugaggaggc

SEQ ID NO: 3595543 - RNA, 17 nt, Human
auaguguaggcuuuacu

SEQ ID NO: 3595544 - RNA, 16 nt, Human
auaguguccuaugcaa

SEQ ID NO: 3595545 - RNA, 18 nt, Human
auaguguccuaugcaaua

SEQ ID NO: 3595546 - RNA, 13 nt, Human
auagugugaggga

SEQ ID NO: 3595547 - RNA, 12 nt, Human
auaguguguucu

SEQ ID NO: 3595548 - RNA, 21 nt, Human
auaguguguugugcuuucaag

SEQ ID NO: 3595549 - RNA, 22 nt, Human
auaguguguugugcuuucaaga

SEQ ID NO: 3595550 - RNA, 15 nt, Human
auaguguuaaucaau

SEQ ID NO: 3595551 - RNA, 21 nt, Human
auaguguuaaucaauuuaaac

SEQ ID NO: 3595552 - RNA, 17 nt, Human
auaguuaacacacuacc

SEQ ID NO: 3595553 - RNA, 20 nt, Human
auaguuacuccagugccaac

SEQ ID NO: 3595554 - RNA, 15 nt, Human
auaguuacuguaaaa

SEQ ID NO: 3595555 - RNA, 21 nt, Human
auaguuacuguaaaaugcaaa

SEQ ID NO: 3595556 - RNA, 12 nt, Human
auaguuacugug

SEQ ID NO: 3595557 - RNA, 14 nt, Human
auaguuacugugua

SEQ ID NO: 3595558 - RNA, 16 nt, Human
auaguuacuguguaaa

SEQ ID NO: 3595559 - RNA, 18 nt, Human
auaguuacuguguaaacu

SEQ ID NO: 3595560 - RNA, 12 nt, Human
auaguuacuguu

SEQ ID NO: 3595561 - RNA, 14 nt, Human
auaguuauguaaau

SEQ ID NO: 3595562 - RNA, 17 nt, Human
auaguuauguaaauaau

SEQ ID NO: 3595563 - RNA, 19 nt, Human
auaguuauguaaauaauuc

SEQ ID NO: 3595564 - RNA, 15 nt, Human
auaguucaaagccaa

SEQ ID NO: 3595565 - RNA, 17 nt, Human
auaguucccauguuaaa

SEQ ID NO: 3595566 - RNA, 21 nt, Human
auaguuccuaagaagcuucua

SEQ ID NO: 3595567 - RNA, 23 nt, Human
auaguuccuaagaagcuucuaau

SEQ ID NO: 3595568 - RNA, 23 nt, Human
auaguucuagacauggagguucu

SEQ ID NO: 3595569 - RNA, 12 nt, Human
auaguucuaggc

SEQ ID NO: 3595570 - RNA, 21 nt, Human
auaguucuccaguuguaugga

SEQ ID NO: 3595571 - RNA, 12 nt, Human
auaguugaauua

SEQ ID NO: 3595572 - RNA, 17 nt, Human
auaguugagccagcaga

SEQ ID NO: 3595573 - RNA, 21 nt, Human
auaguugcauagcaguauaug

SEQ ID NO: 3595574 - RNA, 19 nt, Human
auaguugcuccgccucugc

SEQ ID NO: 3595575 - RNA, 19 nt, Human
auaguuguagacaaaguac

SEQ ID NO: 3595576 - RNA, 19 nt, Human
auaguuguccauauuuuca

SEQ ID NO: 3595577 - RNA, 18 nt, Human
auaguugugggugggaga

SEQ ID NO: 3595578 - RNA, 16 nt, Human
auaguuuacuauuuua

SEQ ID NO: 3595579 - RNA, 13 nt, Human
auaguuuauugac

SEQ ID NO: 3595580 - RNA, 19 nt, Human
auaguuucuuuauuuugug

SEQ ID NO: 3595581 - RNA, 17 nt, Human
auaguuuggcauuugca

SEQ ID NO: 3595582 - RNA, 20 nt, Human
auaguuugggcuucagccua

SEQ ID NO: 3595583 - RNA, 22 nt, Human
auaguuugggcuucagccuagu

SEQ ID NO: 3595584 - RNA, 13 nt, Human
auaguuugucuau

SEQ ID NO: 3595585 - RNA, 20 nt, Human
auaguuuuaaacucauuuuu

SEQ ID NO: 3595586 - RNA, 16 nt, Human
auaguuuuauuaauaa

SEQ ID NO: 3595587 - RNA, 18 nt, Human
auaguuuuauuuauauuu

SEQ ID NO: 3595588 - RNA, 23 nt, Human
auaguuuucauccauaacugaac

SEQ ID NO: 3595589 - RNA, 13 nt, Human
auaguuuugauga

SEQ ID NO: 3595590 - RNA, 20 nt, Human
auaguuuugaugacuggcau

SEQ ID NO: 3595591 - RNA, 20 nt, Human
auaguuuuuaagguuauuua

SEQ ID NO: 3595592 - RNA, 21 nt, Human
auaguuuuuaccuuuuaugua

SEQ ID NO: 3595593 - RNA, 22 nt, Human
auauaaaaagaaaagauaaaga

SEQ ID NO: 3595594 - RNA, 23 nt, Human
auauaaaaagaaaagauaaagau

SEQ ID NO: 3595595 - RNA, 19 nt, Human
auauaaaaauauauauagu

SEQ ID NO: 3595596 - RNA, 13 nt, Human
auauaaaacugcg

SEQ ID NO: 3595597 - RNA, 19 nt, Human
auauaaaagaucuugcaga

SEQ ID NO: 3595598 - RNA, 15 nt, Human
auauaaaauaaauau

SEQ ID NO: 3595599 - RNA, 18 nt, Human
auauaaaauaaauauaua

SEQ ID NO: 3595600 - RNA, 21 nt, Human
auauaaaauaaauauauauaa

SEQ ID NO: 3595601 - RNA, 12 nt, Human
auauaaaauaac

SEQ ID NO: 3595602 - RNA, 13 nt, Human
auauaaaauaacu

SEQ ID NO: 3595603 - RNA, 13 nt, Human
auauaaaauaaug

SEQ ID NO: 3595604 - RNA, 14 nt, Human
auauaaaauaugaa

SEQ ID NO: 3595605 - RNA, 13 nt, Human
auauaaaaugcca

SEQ ID NO: 3595606 - RNA, 14 nt, Human
auauaaaauggcaa

SEQ ID NO: 3595607 - RNA, 15 nt, Human
auauaaacacuauau

SEQ ID NO: 3595608 - RNA, 13 nt, Human
auauaaacagcuu

SEQ ID NO: 3595609 - RNA, 14 nt, Human
auauaaaccuaaaa

SEQ ID NO: 3595610 - RNA, 20 nt, Human
auauaaaccuaaaaaagaua

SEQ ID NO: 3595611 - RNA, 13 nt, Human
auauaaagaauau

SEQ ID NO: 3595612 - RNA, 14 nt, Human
auauaaagaauaua

SEQ ID NO: 3595613 - RNA, 15 nt, Human
auauaaagaauauau

SEQ ID NO: 3595614 - RNA, 13 nt, Human
auauaaagagaaa

SEQ ID NO: 3595615 - RNA, 15 nt, Human
auauaaagagaaaau

SEQ ID NO: 3595616 - RNA, 20 nt, Human
auauaaagagaaaauugaau

SEQ ID NO: 3595617 - RNA, 21 nt, Human
auauaaagagaaaauugaauu

SEQ ID NO: 3595618 - RNA, 14 nt, Human
auauaaagauguua

SEQ ID NO: 3595619 - RNA, 18 nt, Human
auauaaagcaucuaaacu

SEQ ID NO: 3595620 - RNA, 13 nt, Human
auauaaaggaaaa

SEQ ID NO: 3595621 - RNA, 17 nt, Human
auauaaaguuuuauaua

SEQ ID NO: 3595622 - RNA, 18 nt, Human
auauaaauaaaacauuuu

SEQ ID NO: 3595623 - RNA, 16 nt, Human
auauaaauaaauauau

SEQ ID NO: 3595624 - RNA, 12 nt, Human
auauaaauauau

SEQ ID NO: 3595625 - RNA, 13 nt, Human
auauaaauauaua

SEQ ID NO: 3595626 - RNA, 16 nt, Human
auauaaauauuagaaa

SEQ ID NO: 3595627 - RNA, 18 nt, Human
auauaaauggcugguuuu

SEQ ID NO: 3595628 - RNA, 12 nt, Human
auauaaauggga

SEQ ID NO: 3595629 - RNA, 14 nt, Human
auauaaaugggaac

SEQ ID NO: 3595630 - RNA, 19 nt, Human
auauaaaugggaacauuua

SEQ ID NO: 3595631 - RNA, 17 nt, Human
auauaaaugguuaaaag

SEQ ID NO: 3595632 - RNA, 13 nt, Human
auauaaauucugu

SEQ ID NO: 3595633 - RNA, 17 nt, Human
auauaaauuuuuuuugu

SEQ ID NO: 3595634 - RNA, 17 nt, Human
auauaacaaugcuguau

SEQ ID NO: 3595635 - RNA, 16 nt, Human
auccaaucucaaggaa

SEQ ID NO: 3595636 - RNA, 19 nt, Human
auccaaucuuguuuccaaa

SEQ ID NO: 3595637 - RNA, 22 nt, Human
auccaauguuagagacuuuuuu

SEQ ID NO: 3595638 - RNA, 17 nt, Human
auccacaauaaccaaga

SEQ ID NO: 3595639 - RNA, 16 nt, Human
auccacacacagagga

SEQ ID NO: 3595640 - RNA, 17 nt, Human
auccacagagaguccca

SEQ ID NO: 3595641 - RNA, 19 nt, Human
auccacagagagucccacu

SEQ ID NO: 3595642 - RNA, 22 nt, Human
auccacauacccugaccuggcc

SEQ ID NO: 3595643 - RNA, 16 nt, Human
auccacaugaaaauaa

SEQ ID NO: 3595644 - RNA, 17 nt, Human
auccaccaccucccuca

SEQ ID NO: 3595645 - RNA, 16 nt, Human
auccacccaccucagc

SEQ ID NO: 3595646 - RNA, 13 nt, Human
auccacccagccc

SEQ ID NO: 3595647 - RNA, 19 nt, Human
auccaccguccccucccag

SEQ ID NO: 3595648 - RNA, 22 nt, Human
auccaccuccaucuucuuugca

SEQ ID NO: 3595649 - RNA, 14 nt, Human
auccaccuccuucu

SEQ ID NO: 3595650 - RNA, 17 nt, Human
auccaccugccuuggcu

SEQ ID NO: 3595651 - RNA, 13 nt, Human
auccaccugucuc

SEQ ID NO: 3595652 - RNA, 21 nt, Human
auccacguauuccccuuccca

SEQ ID NO: 3595653 - RNA, 13 nt, Human
auccacucgccuu

SEQ ID NO: 3595654 - RNA, 18 nt, Human
auccacucuacccuccca

SEQ ID NO: 3595655 - RNA, 20 nt, Human
auccacucuacccucccacc

SEQ ID NO: 3595656 - RNA, 22 nt, Human
auccacucugcaggaaauaggc

SEQ ID NO: 3595657 - RNA, 21 nt, Human
auccacuggguguaaacacau

SEQ ID NO: 3595658 - RNA, 22 nt, Human
auccacuucuuucagcagacug

SEQ ID NO: 3595659 - RNA, 17 nt, Human
auccagaaaacugugau

SEQ ID NO: 3595660 - RNA, 10 nt, Human
auccagaaac

SEQ ID NO: 3595661 - RNA, 19 nt, Human
auccagaaacuuguucuuc

SEQ ID NO: 3595662 - RNA, 13 nt, Human
auccagaaagaaa

SEQ ID NO: 3595663 - RNA, 20 nt, Human
auccagaauugaccuuuuga

SEQ ID NO: 3595664 - RNA, 23 nt, Human
auccagacucagagcucucucua

SEQ ID NO: 3595665 - RNA, 19 nt, Human
auccagagauucauuuucu

SEQ ID NO: 3595666 - RNA, 22 nt, Human
auccagagauucauuuucuaga

SEQ ID NO: 3595667 - RNA, 19 nt, Human
auccagagucccugccugg

SEQ ID NO: 3595668 - RNA, 21 nt, Human
auccagagucccugccuggac

SEQ ID NO: 3595669 - RNA, 15 nt, Human
auccagaugguggga

SEQ ID NO: 3595670 - RNA, 16 nt, Human
auccagcagucucugc

SEQ ID NO: 3595671 - RNA, 17 nt, Human
auccagccucuccccug

SEQ ID NO: 3595672 - RNA, 12 nt, Human
auccagccuggg

SEQ ID NO: 3595673 - RNA, 19 nt, Human
auccagccuggggcugagg

SEQ ID NO: 3595674 - RNA, 15 nt, Human
auccagcuauguuau

SEQ ID NO: 3595675 - RNA, 14 nt, Human
auccagcucacuca

SEQ ID NO: 3595676 - RNA, 14 nt, Human
auccagcuggugag

SEQ ID NO: 3595677 - RNA, 11 nt, Human
auccaggaccc

SEQ ID NO: 3595678 - RNA, 18 nt, Human
auccaggacccugccagg

SEQ ID NO: 3595679 - RNA, 14 nt, Human
auccaggagcucca

SEQ ID NO: 3595680 - RNA, 21 nt, Human
auccaggagcuccaguguccu

SEQ ID NO: 3595681 - RNA, 14 nt, Human
auccaggcagaucc

SEQ ID NO: 3595682 - RNA, 12 nt, Human
auccaggccacu

SEQ ID NO: 3595683 - RNA, 12 nt, Human
auccagggacag

SEQ ID NO: 3595684 - RNA, 20 nt, Human
auccagggacagaggcccca

SEQ ID NO: 3595685 - RNA, 21 nt, Human
auccagggacagaggccccag

SEQ ID NO: 3595686 - RNA, 23 nt, Human
auccagggaggcugguccuaugg

SEQ ID NO: 3595687 - RNA, 17 nt, Human
auccagggggcaagagg

SEQ ID NO: 3595688 - RNA, 14 nt, Human
auccagguaaucca

SEQ ID NO: 3595689 - RNA, 14 nt, Human
auccaggucaacag

SEQ ID NO: 3595690 - RNA, 20 nt, Human
auccaggucaacagaaugaa

SEQ ID NO: 3595691 - RNA, 21 nt, Human
auccaggucaacagaaugaaa

SEQ ID NO: 3595692 - RNA, 17 nt, Human
auccagguucagcuugu

SEQ ID NO: 3595693 - RNA, 18 nt, Human
auccaguacauuuaauug

SEQ ID NO: 3595694 - RNA, 16 nt, Human
auccaguaggauccag

SEQ ID NO: 3595695 - RNA, 21 nt, Human
auccaguaucuugaagacuuu

SEQ ID NO: 3595696 - RNA, 19 nt, Human
auccagugaccucucucuc

SEQ ID NO: 3595697 - RNA, 21 nt, Human
auccauaaagaagcaauaaag

SEQ ID NO: 3595698 - RNA, 14 nt, Human
auccauaacugaac

SEQ ID NO: 3595699 - RNA, 14 nt, Human
auccauacauuugu

SEQ ID NO: 3595700 - RNA, 16 nt, Human
auccauaccagcucgc

SEQ ID NO: 3595701 - RNA, 21 nt, Human
auccauacuaacccuuuucca

SEQ ID NO: 3595702 - RNA, 17 nt, Human
auccauaguaacugaca

SEQ ID NO: 3595703 - RNA, 14 nt, Human
auccauagugacuu

SEQ ID NO: 3595704 - RNA, 22 nt, Human
auccauagugacuuuucaagua

SEQ ID NO: 3595705 - RNA, 23 nt, Human
auccauaucuuaaagaaacagcu

SEQ ID NO: 3595706 - RNA, 19 nt, Human
auccauauuaaguaagucu

SEQ ID NO: 3595707 - RNA, 18 nt, Human
auccauauuuuauuacug

SEQ ID NO: 3595708 - RNA, 13 nt, Human
auccaucaggcca

SEQ ID NO: 3595709 - RNA, 14 nt, Human
auccaucagugcca

SEQ ID NO: 3595710 - RNA, 14 nt, Human
auccaucaucaugu

SEQ ID NO: 3595711 - RNA, 17 nt, Human
auccauccagcuugcca

SEQ ID NO: 3595712 - RNA, 13 nt, Human
auauuauuuggca

SEQ ID NO: 3595713 - RNA, 14 nt, Human
auauuauuuggcag

SEQ ID NO: 3595714 - RNA, 17 nt, Human
auauuauuuguguuucc

SEQ ID NO: 3595715 - RNA, 14 nt, Human
auauuauuuuaugu

SEQ ID NO: 3595716 - RNA, 15 nt, Human
auauucacugggcca

SEQ ID NO: 3595717 - RNA, 12 nt, Human
auauucagaauu

SEQ ID NO: 3595718 - RNA, 18 nt, Human
auauucagacaaaaugga

SEQ ID NO: 3595719 - RNA, 22 nt, Human
auauucagacaaaauggauaca

SEQ ID NO: 3595720 - RNA, 14 nt, Human
auauucagagaaua

SEQ ID NO: 3595721 - RNA, 17 nt, Human
auauucagagaauauca

SEQ ID NO: 3595722 - RNA, 17 nt, Human
auauucaggaagcucag

SEQ ID NO: 3595723 - RNA, 19 nt, Human
auauucaggguaaauagga

SEQ ID NO: 3595724 - RNA, 14 nt, Human
auauucauauugga

SEQ ID NO: 3595725 - RNA, 17 nt, Human
auauucauauuggaaaa

SEQ ID NO: 3595726 - RNA, 23 nt, Human
auauucauuguauaaaaauagaa

SEQ ID NO: 3595727 - RNA, 21 nt, Human
auauuccagaucuuucagaaa

SEQ ID NO: 3595728 - RNA, 22 nt, Human
auauuccauaguauauuaaaaa

SEQ ID NO: 3595729 - RNA, 16 nt, Human
auauuccaugaaugua

SEQ ID NO: 3595730 - RNA, 17 nt, Human
auauuccuauugugcaa

SEQ ID NO: 3595731 - RNA, 23 nt, Human
auauuccuauugugcaauguaaa

SEQ ID NO: 3595732 - RNA, 17 nt, Human
auauuccugaaugaaau

SEQ ID NO: 3595733 - RNA, 22 nt, Human
auauuccugaaugaaauaucag

SEQ ID NO: 3595734 - RNA, 21 nt, Human
auauuccugcagccuggaggc

SEQ ID NO: 3595735 - RNA, 23 nt, Human
auauuccuuugcauauuauaaag

SEQ ID NO: 3595736 - RNA, 16 nt, Human
auauucuaaaaccauu

SEQ ID NO: 3595737 - RNA, 23 nt, Human
auauucuaagaaauaucugugaa

SEQ ID NO: 3595738 - RNA, 21 nt, Human
auauucuaguaauaaagacuc

SEQ ID NO: 3595739 - RNA, 15 nt, Human
auauucuauuuuuau

SEQ ID NO: 3595740 - RNA, 21 nt, Human
auauucucacagcuccaagaa

SEQ ID NO: 3595741 - RNA, 23 nt, Human
auauucucacagcuccaagaauu

SEQ ID NO: 3595742 - RNA, 15 nt, Human
auauucucagcagag

SEQ ID NO: 3595743 - RNA, 14 nt, Human
auauucucuguaca

SEQ ID NO: 3595744 - RNA, 16 nt, Human
auauucucuguacaua

SEQ ID NO: 3595745 - RNA, 13 nt, Human
auauucuuauaaa

SEQ ID NO: 3595746 - RNA, 14 nt, Human
auauucuuauguau

SEQ ID NO: 3595747 - RNA, 23 nt, Human
auauucuuauguaugugaaaguu

SEQ ID NO: 3595748 - RNA, 15 nt, Human
auauucuugugcuuu

SEQ ID NO: 3595749 - RNA, 12 nt, Human
auauucuuucaa

SEQ ID NO: 3595750 - RNA, 13 nt, Human
auauucuuucaau

SEQ ID NO: 3595751 - RNA, 14 nt, Human
auauucuuuguuaa

SEQ ID NO: 3595752 - RNA, 20 nt, Human
auauucuuuguuaauuugga

SEQ ID NO: 3595753 - RNA, 14 nt, Human
auauugaaaauuga

SEQ ID NO: 3595754 - RNA, 23 nt, Human
auauugaaaauugaaaaguacaa

SEQ ID NO: 3595755 - RNA, 20 nt, Human
auauugaaaggcaaacauuu

SEQ ID NO: 3595756 - RNA, 12 nt, Human
auauugaacuuu

SEQ ID NO: 3595757 - RNA, 18 nt, Human
auauugaauguuuccaac

SEQ ID NO: 3595758 - RNA, 12 nt, Human
auauugacauuu

SEQ ID NO: 3595759 - RNA, 14 nt, Human
auauugacuuguau

SEQ ID NO: 3595760 - RNA, 15 nt, Human
auauugacuuguaua

SEQ ID NO: 3595761 - RNA, 16 nt, Human
auauugagcagaauuc

SEQ ID NO: 3595762 - RNA, 19 nt, Human
auauugaggccaagaauau

SEQ ID NO: 3595763 - RNA, 22 nt, Human
auauugaggccaagaauauugc

SEQ ID NO: 3595764 - RNA, 19 nt, Human
auauugauaagaucuuuua

SEQ ID NO: 3595765 - RNA, 15 nt, Human
auauugauaugcuua

SEQ ID NO: 3595766 - RNA, 13 nt, Human
auauugaugaaaa

SEQ ID NO: 3595767 - RNA, 19 nt, Human
auauugauugggaaaacau

SEQ ID NO: 3595768 - RNA, 21 nt, Human
auauugauugggaaaacauuu

SEQ ID NO: 3595769 - RNA, 15 nt, Human
auauugauuuauuaa

SEQ ID NO: 3595770 - RNA, 19 nt, Human
auauugauuuccguuaaaa

SEQ ID NO: 3595771 - RNA, 22 nt, Human
auauugauuuccguuaaaauac

SEQ ID NO: 3595772 - RNA, 16 nt, Human
auauugauuucugccu

SEQ ID NO: 3595773 - RNA, 18 nt, Human
auauugcaaaauacauga

SEQ ID NO: 3595774 - RNA, 17 nt, Human
auauugcacaugucuua

SEQ ID NO: 3595775 - RNA, 21 nt, Human
auauugcacaugucuuaauga

SEQ ID NO: 3595776 - RNA, 20 nt, Human
auauugcauacuauuaaaca

SEQ ID NO: 3595777 - RNA, 17 nt, Human
auauugccauuaugcuu

SEQ ID NO: 3595778 - RNA, 16 nt, Human
auauugccgcacuagg

SEQ ID NO: 3595779 - RNA, 23 nt, Human
auauugccuaagaauaaacauuu

SEQ ID NO: 3595780 - RNA, 18 nt, Human
aucccauguaacagaaag

SEQ ID NO: 3595781 - RNA, 23 nt, Human
aucccauguaacagaaagggcaa

SEQ ID NO: 3595782 - RNA, 15 nt, Human
aucccauuuaaaaaa

SEQ ID NO: 3595783 - RNA, 23 nt, Human
auccccaaaacaggccaggugug

SEQ ID NO: 3595784 - RNA, 16 nt, Human
auccccaagccuggca

SEQ ID NO: 3595785 - RNA, 21 nt, Human
auccccaauaauugcagaacu

SEQ ID NO: 3595786 - RNA, 11 nt, Human
auccccacccu

SEQ ID NO: 3595787 - RNA, 14 nt, Human
auccccacccuggg

SEQ ID NO: 3595788 - RNA, 17 nt, Human
auccccaccugucuuca

SEQ ID NO: 3595789 - RNA, 16 nt, Human
auccccacgccacagc

SEQ ID NO: 3595790 - RNA, 16 nt, Human
auccccaucucccugc

SEQ ID NO: 3595791 - RNA, 20 nt, Human
auccccaucucccugccugg

SEQ ID NO: 3595792 - RNA, 14 nt, Human
aucccccaggagaa

SEQ ID NO: 3595793 - RNA, 20 nt, Human
auccccccaucuugcuuccc

SEQ ID NO: 3595794 - RNA, 12 nt, Human
aucccccugccc

SEQ ID NO: 3595795 - RNA, 14 nt, Human
aucccccuugccac

SEQ ID NO: 3595796 - RNA, 18 nt, Human
aucccccuugccacccca

SEQ ID NO: 3595797 - RNA, 18 nt, Human
auccccgcagugugcacu

SEQ ID NO: 3595798 - RNA, 18 nt, Human
auccccgccuggccagga

SEQ ID NO: 3595799 - RNA, 20 nt, Human
auccccgccuggccaggagc

SEQ ID NO: 3595800 - RNA, 22 nt, Human
auccccguuccugacaucacag

SEQ ID NO: 3595801 - RNA, 15 nt, Human
auccccucucccccc

SEQ ID NO: 3595802 - RNA, 20 nt, Human
auccccucugucuacaaaua

SEQ ID NO: 3595803 - RNA, 15 nt, Human
auccccuguagagug

SEQ ID NO: 3595804 - RNA, 13 nt, Human
auccccuuacccu

SEQ ID NO: 3595805 - RNA, 11 nt, Human
auccccuuccu

SEQ ID NO: 3595806 - RNA, 15 nt, Human
auccccuucuccccu

SEQ ID NO: 3595807 - RNA, 12 nt, Human
auccccuugaac

SEQ ID NO: 3595808 - RNA, 13 nt, Human
aucccgaagaaug

SEQ ID NO: 3595809 - RNA, 19 nt, Human
aucccgagcaccuccacau

SEQ ID NO: 3595810 - RNA, 17 nt, Human
aucccgagucugggaca

SEQ ID NO: 3595811 - RNA, 15 nt, Human
aucccgauucacccu

SEQ ID NO: 3595812 - RNA, 16 nt, Human
aucccgccaccuaucu

SEQ ID NO: 3595813 - RNA, 17 nt, Human
aucccggaggaaaucug

SEQ ID NO: 3595814 - RNA, 14 nt, Human
aucccggggguggg

SEQ ID NO: 3595815 - RNA, 14 nt, Human
aucccgugcuuuua

SEQ ID NO: 3595816 - RNA, 16 nt, Human
aucccguguucuccuu

SEQ ID NO: 3595817 - RNA, 18 nt, Human
aucccuaaugugugccau

SEQ ID NO: 3595818 - RNA, 15 nt, Human
aucccuacauguauu

SEQ ID NO: 3595819 - RNA, 21 nt, Human
aucccuagacuuuaggcuuuc

SEQ ID NO: 3595820 - RNA, 19 nt, Human
aucccuagucuucaagcag

SEQ ID NO: 3595821 - RNA, 17 nt, Human
aucccuaugggauucag

SEQ ID NO: 3595822 - RNA, 13 nt, Human
aucccucaccugu

SEQ ID NO: 3595823 - RNA, 14 nt, Human
aucccucaccugua

SEQ ID NO: 3595824 - RNA, 13 nt, Human
aucccucauccuc

SEQ ID NO: 3595825 - RNA, 21 nt, Human
aucccucauccucauacccac

SEQ ID NO: 3595826 - RNA, 17 nt, Human
aucccucaucugucccu

SEQ ID NO: 3595827 - RNA, 15 nt, Human
aucccuccccaguuc

SEQ ID NO: 3595828 - RNA, 18 nt, Human
aucccucccccccaugca

SEQ ID NO: 3595829 - RNA, 11 nt, Human
aucccucccuc

SEQ ID NO: 3595830 - RNA, 21 nt, Human
aucccucccuccaccucccug

SEQ ID NO: 3595831 - RNA, 15 nt, Human
aucccuccuguuggg

SEQ ID NO: 3595832 - RNA, 17 nt, Human
aucccuccuuaagagau

SEQ ID NO: 3595833 - RNA, 24 nt, Human
aucccucgauauuuuuaaagaucu

SEQ ID NO: 3595834 - RNA, 17 nt, Human
aucccucuacagagcuu

SEQ ID NO: 3595835 - RNA, 23 nt, Human
aucccucuacagagcuucccuga

SEQ ID NO: 3595836 - RNA, 15 nt, Human
aucccucuccuaacu

SEQ ID NO: 3595837 - RNA, 15 nt, Human
aucccucugggcacu

SEQ ID NO: 3595838 - RNA, 22 nt, Human
aucccugaaggccccgcccagg

SEQ ID NO: 3595839 - RNA, 22 nt, Human
aucccugaaucccccuugccac

SEQ ID NO: 3595840 - RNA, 16 nt, Human
aucccugaggcuggac

SEQ ID NO: 3595841 - RNA, 22 nt, Human
aucccugauaaauauucacacu

SEQ ID NO: 3595842 - RNA, 20 nt, Human
aucccugaucccauuuuccu

SEQ ID NO: 3595843 - RNA, 19 nt, Human
aucccugauccuaacugaa

SEQ ID NO: 3595844 - RNA, 16 nt, Human
aucccugcucacugca

SEQ ID NO: 3595845 - RNA, 12 nt, Human
aucccuggcccc

SEQ ID NO: 3595846 - RNA, 16 nt, Human
aucccuggcccccucc

SEQ ID NO: 3595847 - RNA, 16 nt, Human
aucccugggcauugcu

SEQ ID NO: 3595848 - RNA, 13 nt, Human
aucccugggccug

SEQ ID NO: 3595849 - RNA, 18 nt, Human
aucccugggccugcugcu

SEQ ID NO: 3595850 - RNA, 22 nt, Human
aucccugggccugcugcugaga

SEQ ID NO: 3595851 - RNA, 20 nt, Human
aucccuguguuaauuuaagu

SEQ ID NO: 3595852 - RNA, 17 nt, Human
aucccuguucauuguaa

SEQ ID NO: 3595853 - RNA, 18 nt, Human
aucccuguuuaauauuua

SEQ ID NO: 3595854 - RNA, 21 nt, Human
aucccuguuuaauauuuaaac

SEQ ID NO: 3595855 - RNA, 14 nt, Human
aucccuuaagaaug

SEQ ID NO: 3595856 - RNA, 21 nt, Human
aucccuuaagaaugaguuucu

SEQ ID NO: 3595857 - RNA, 20 nt, Human
aucccuuaauauccuaaaca

SEQ ID NO: 3595858 - RNA, 22 nt, Human
aucccuuccaccugcucugcug

SEQ ID NO: 3595859 - RNA, 14 nt, Human
aucccuucucuucc

SEQ ID NO: 3595860 - RNA, 15 nt, Human
aucccuucucuucca

SEQ ID NO: 3595861 - RNA, 17 nt, Human
aucccuucucuuccagg

SEQ ID NO: 3595862 - RNA, 22 nt, Human
aucccuucucuuccaggcagcc

SEQ ID NO: 3595863 - RNA, 20 nt, Human
aucccuuggacauuuuaugu

SEQ ID NO: 3595864 - RNA, 15 nt, Human
aucccuuuucuugac

SEQ ID NO: 3595865 - RNA, 18 nt, Human
aucccuuuuugaagugua

SEQ ID NO: 3595866 - RNA, 12 nt, Human
auccgaggcagg

SEQ ID NO: 3595867 - RNA, 13 nt, Human
auccgaggcaggg

SEQ ID NO: 3595868 - RNA, 23 nt, Human
aggcacacagcugcagagacaga

SEQ ID NO: 3595869 - RNA, 12 nt, Human
aggcacacuucu

SEQ ID NO: 3595870 - RNA, 16 nt, Human
aggcacagcaaacugu

SEQ ID NO: 3595871 - RNA, 21 nt, Human
aggcacagccggggccugccu

SEQ ID NO: 3595872 - RNA, 21 nt, Human
aggcacauggaauauauuuua

SEQ ID NO: 3595873 - RNA, 17 nt, Human
aggcaccaaaagaagua

SEQ ID NO: 3595874 - RNA, 14 nt, Human
aggcaccagugucc

SEQ ID NO: 3595875 - RNA, 14 nt, Human
aggcaccaucuccc

SEQ ID NO: 3595876 - RNA, 19 nt, Human
aggcaccauucaggaaccu

SEQ ID NO: 3595877 - RNA, 15 nt, Human
aggcacccaccauca

SEQ ID NO: 3595878 - RNA, 21 nt, Human
aggcacccaccaucaugucug

SEQ ID NO: 3595879 - RNA, 22 nt, Human
aggcacccaccaucaugucugg

SEQ ID NO: 3595880 - RNA, 21 nt, Human
aggcacccauccuagagaaaa

SEQ ID NO: 3595881 - RNA, 22 nt, Human
aggcacccauccuagagaaaac

SEQ ID NO: 3595882 - RNA, 15 nt, Human
aggcacccccuggag

SEQ ID NO: 3595883 - RNA, 16 nt, Human
aggcacccccuggaga

SEQ ID NO: 3595884 - RNA, 19 nt, Human
aggcacccccuggagagaa

SEQ ID NO: 3595885 - RNA, 15 nt, Human
aggcaccgagaaugu

SEQ ID NO: 3595886 - RNA, 18 nt, Human
aggcaccgagaauguugu

SEQ ID NO: 3595887 - RNA, 21 nt, Human
aggcaccuacacucaccugca

SEQ ID NO: 3595888 - RNA, 20 nt, Human
aggcaccuaccaccacgccc

SEQ ID NO: 3595889 - RNA, 17 nt, Human
aggcaccuagcaauucc

SEQ ID NO: 3595890 - RNA, 21 nt, Human
aggcaccuauaaaacagguca

SEQ ID NO: 3595891 - RNA, 20 nt, Human
aggcaccucacaggccccag

SEQ ID NO: 3595892 - RNA, 14 nt, Human
aggcaccucuuccu

SEQ ID NO: 3595893 - RNA, 20 nt, Human
aggcaccugguggccaugcu

SEQ ID NO: 3595894 - RNA, 13 nt, Human
aggcacuagccuu

SEQ ID NO: 3595895 - RNA, 17 nt, Human
aggcacucuagauucca

SEQ ID NO: 3595896 - RNA, 14 nt, Human
aggcacugccugau

SEQ ID NO: 3595897 - RNA, 14 nt, Human
aggcacugcugccc

SEQ ID NO: 3595898 - RNA, 23 nt, Human
aggcacugggggcagcgggggcc

SEQ ID NO: 3595899 - RNA, 16 nt, Human
aggcacuguacuaggc

SEQ ID NO: 3595900 - RNA, 14 nt, Human
aggcacuuauugua

SEQ ID NO: 3595901 - RNA, 18 nt, Human
aggcacuuauuguaaauu

SEQ ID NO: 3595902 - RNA, 15 nt, Human
aggcacuuggcagcc

SEQ ID NO: 3595903 - RNA, 18 nt, Human
aggcacuuggcagccuug

SEQ ID NO: 3595904 - RNA, 23 nt, Human
aggcagaaagcagaggcuggccu

SEQ ID NO: 3595905 - RNA, 14 nt, Human
aggcagaacccugg

SEQ ID NO: 3595906 - RNA, 22 nt, Human
aggcagaacccuggugaggaag

SEQ ID NO: 3595907 - RNA, 22 nt, Human
aggcagaacucaucuagguaaa

SEQ ID NO: 3595908 - RNA, 18 nt, Human
aggcagaauaagaaaaca

SEQ ID NO: 3595909 - RNA, 20 nt, Human
aggcagaauccuggcccucu

SEQ ID NO: 3595910 - RNA, 21 nt, Human
aggcagaauccuggcccucug

SEQ ID NO: 3595911 - RNA, 11 nt, Human
aggcagacacg

SEQ ID NO: 3595912 - RNA, 14 nt, Human
aggcagacagcagc

SEQ ID NO: 3595913 - RNA, 15 nt, Human
aggcagacagcagcu

SEQ ID NO: 3595914 - RNA, 18 nt, Human
aggcagacagcagcucag

SEQ ID NO: 3595915 - RNA, 19 nt, Human
aggcagacagcaggcagcg

SEQ ID NO: 3595916 - RNA, 23 nt, Human
aggcagacagcaggcagcgccaa

SEQ ID NO: 3595917 - RNA, 21 nt, Human
aggcagacucuuuaugcuugc

SEQ ID NO: 3595918 - RNA, 15 nt, Human
aggcagagaaagaag

SEQ ID NO: 3595919 - RNA, 13 nt, Human
aggcagagaaagg

SEQ ID NO: 3595920 - RNA, 13 nt, Human
aggcagagaaauc

SEQ ID NO: 3595921 - RNA, 14 nt, Human
aggcagagaagaaa

SEQ ID NO: 3595922 - RNA, 20 nt, Human
aggcagagagcggucucagg

SEQ ID NO: 3595923 - RNA, 21 nt, Human
aggcagaggcccaggcugccg

SEQ ID NO: 3595924 - RNA, 13 nt, Human
aggcagauacagg

SEQ ID NO: 3595925 - RNA, 16 nt, Human
auauuuucaauucaaa

SEQ ID NO: 3595926 - RNA, 17 nt, Human
auauuuucacaauguca

SEQ ID NO: 3595927 - RNA, 13 nt, Human
auauuuucauucu

SEQ ID NO: 3595928 - RNA, 17 nt, Human
auauuuucauucuccua

SEQ ID NO: 3595929 - RNA, 16 nt, Human
auauuuuccaugaaaa

SEQ ID NO: 3595930 - RNA, 24 nt, Human
auauuuuccuaguagaucuauauu

SEQ ID NO: 3595931 - RNA, 13 nt, Human
auauuuucugugu

SEQ ID NO: 3595932 - RNA, 16 nt, Human
auauuuucuguguguu

SEQ ID NO: 3595933 - RNA, 19 nt, Human
auauuuucuguguguuccu

SEQ ID NO: 3595934 - RNA, 21 nt, Human
auauuuucuuuaaaagacaaa

SEQ ID NO: 3595935 - RNA, 18 nt, Human
auauuuucuuuaaugcuu

SEQ ID NO: 3595936 - RNA, 13 nt, Human
auauuuucuuuuc

SEQ ID NO: 3595937 - RNA, 14 nt, Human
auauuuugaaucaa

SEQ ID NO: 3595938 - RNA, 17 nt, Human
auauuuugauaauaaua

SEQ ID NO: 3595939 - RNA, 18 nt, Human
auauuuugauaauaauau

SEQ ID NO: 3595940 - RNA, 19 nt, Human
auauuuugaucuucaacaa

SEQ ID NO: 3595941 - RNA, 22 nt, Human
auauuuugaucuucaacaaauu

SEQ ID NO: 3595942 - RNA, 21 nt, Human
auauuuugcacaguuagcaaa

SEQ ID NO: 3595943 - RNA, 21 nt, Human
auauuuuguauauaucugcuu

SEQ ID NO: 3595944 - RNA, 16 nt, Human
auauuuuguauuauug

SEQ ID NO: 3595945 - RNA, 18 nt, Human
auauuuuguauuauugcu

SEQ ID NO: 3595946 - RNA, 22 nt, Human
auauuuuguauuauugcuguug

SEQ ID NO: 3595947 - RNA, 17 nt, Human
auauuuugucuaaaaug

SEQ ID NO: 3595948 - RNA, 15 nt, Human
auauuuuuaauaaaa

SEQ ID NO: 3595949 - RNA, 13 nt, Human
auauuuuuagaua

SEQ ID NO: 3595950 - RNA, 17 nt, Human
auauuuuuauaauaaac

SEQ ID NO: 3595951 - RNA, 16 nt, Human
auauuuuuauauuuag

SEQ ID NO: 3595952 - RNA, 19 nt, Human
auauuuuuauauuuccuuu

SEQ ID NO: 3595953 - RNA, 22 nt, Human
auauuuuuaucuauauaaaaua

SEQ ID NO: 3595954 - RNA, 22 nt, Human
auauuuuuaucuuuauaugaag

SEQ ID NO: 3595955 - RNA, 16 nt, Human
auauuuuuauuuuauu

SEQ ID NO: 3595956 - RNA, 18 nt, Human
auauuuuucacauaucua

SEQ ID NO: 3595957 - RNA, 21 nt, Human
auauuuuucaugauuuugaaa

SEQ ID NO: 3595958 - RNA, 14 nt, Human
auauuuuucuuaaa

SEQ ID NO: 3595959 - RNA, 16 nt, Human
auauuuuuguagcacu

SEQ ID NO: 3595960 - RNA, 15 nt, Human
auauuuuuguuuguu

SEQ ID NO: 3595961 - RNA, 17 nt, Human
auauuuuuuaaaaaucu

SEQ ID NO: 3595962 - RNA, 15 nt, Human
auauuuuuuaaaaua

SEQ ID NO: 3595963 - RNA, 20 nt, Human
auauuuuuuguuaaaugauu

SEQ ID NO: 3595964 - RNA, 17 nt, Human
auauuuuuuuaacuuua

SEQ ID NO: 3595965 - RNA, 14 nt, Human
auauuuuuuuaagu

SEQ ID NO: 3595966 - RNA, 17 nt, Human
auauuuuuuuaagucuu

SEQ ID NO: 3595967 - RNA, 16 nt, Human
auauuuuuuuaauuua

SEQ ID NO: 3595968 - RNA, 21 nt, Human
auauuuuuuuccuuacauaaa

SEQ ID NO: 3595969 - RNA, 14 nt, Human
auauuuuuuucuga

SEQ ID NO: 3595970 - RNA, 18 nt, Human
auauuuuuuucugaaauu

SEQ ID NO: 3595971 - RNA, 19 nt, Human
auauuuuuuucugaaauuu

SEQ ID NO: 3595972 - RNA, 22 nt, Human
auauuuuuuuucuuuuuaccca

SEQ ID NO: 3595973 - RNA, 18 nt, Human
auauuuuuuuuuaagcuc

SEQ ID NO: 3595974 - RNA, 21 nt, Human
auauuuuuuuuuaagcucuga

SEQ ID NO: 3595975 - RNA, 12 nt, Human
aucaaaaauaau

SEQ ID NO: 3595976 - RNA, 16 nt, Human
aucaaaacaagugaaa

SEQ ID NO: 3595977 - RNA, 19 nt, Human
aucaaaacucacaagugcu

SEQ ID NO: 3595978 - RNA, 18 nt, Human
aucaaaagacaauucuuu

SEQ ID NO: 3595979 - RNA, 21 nt, Human
aucaaaagacaauucuuuaua

SEQ ID NO: 3595980 - RNA, 23 nt, Human
aucaaaagacaauucuuuauaca

SEQ ID NO: 3595981 - RNA, 22 nt, Human
aucaaaagggccaaagaaccaa

SEQ ID NO: 3595982 - RNA, 16 nt, Human
aucaaaauaaauugaa

SEQ ID NO: 3595983 - RNA, 23 nt, Human
aucaaaaucucuccacuuucagc

SEQ ID NO: 3595984 - RNA, 21 nt, Human
aucaaaaucuguagagcaggg

SEQ ID NO: 3595985 - RNA, 21 nt, Human
aucaaaaugcucuuauuucau

SEQ ID NO: 3595986 - RNA, 23 nt, Human
aucaaaaugcucuuauuucauca

SEQ ID NO: 3595987 - RNA, 14 nt, Human
aucaaaauuacaua

SEQ ID NO: 3595988 - RNA, 22 nt, Human
aucaaacaccaacauaaaaaug

SEQ ID NO: 3595989 - RNA, 21 nt, Human
aucaaacccuagccuugcuug

SEQ ID NO: 3595990 - RNA, 17 nt, Human
aucaaacugaagccaga

SEQ ID NO: 3595991 - RNA, 23 nt, Human
aucaaagagguuuuaaaaaaauc

SEQ ID NO: 3595992 - RNA, 16 nt, Human
aucaaagcaaugcauu

SEQ ID NO: 3595993 - RNA, 17 nt, Human
aucaaagcauagauguu

SEQ ID NO: 3595994 - RNA, 13 nt, Human
aucaaagccaggg

SEQ ID NO: 3595995 - RNA, 16 nt, Human
aucaaagccagggucu

SEQ ID NO: 3595996 - RNA, 12 nt, Human
aucaaaggacac

SEQ ID NO: 3595997 - RNA, 22 nt, Human
aucaaagucauuaaagacagga

SEQ ID NO: 3595998 - RNA, 11 nt, Human
aucaaagugcu

SEQ ID NO: 3595999 - RNA, 20 nt, Human
aucaaaguucugcuuucucc

SEQ ID NO: 3596000 - RNA, 21 nt, Human
aucaaauaaaaauucuagauu

SEQ ID NO: 3596001 - RNA, 15 nt, Human
aucaaauaaagagag

SEQ ID NO: 3596002 - RNA, 17 nt, Human
aucaaauaaguauuuau

SEQ ID NO: 3596003 - RNA, 22 nt, Human
aucaaauacuuuaaaggaaaaa

SEQ ID NO: 3596004 - RNA, 20 nt, Human
aucaaauagaaccacuauga

SEQ ID NO: 3596005 - RNA, 15 nt, Human
aucaaauaugcaaag

SEQ ID NO: 3596006 - RNA, 18 nt, Human
aucaaauaugcaaagcac

SEQ ID NO: 3596007 - RNA, 20 nt, Human
aucaaauaugcaaagcacug

SEQ ID NO: 3596008 - RNA, 21 nt, Human
aucaaauauuagaugugauuu

SEQ ID NO: 3596009 - RNA, 13 nt, Human
aucaaauguuuaa

SEQ ID NO: 3596010 - RNA, 17 nt, Human
aucaaauguuuaaucau

SEQ ID NO: 3596011 - RNA, 16 nt, Human
aucaaauuaauugugu

SEQ ID NO: 3596012 - RNA, 18 nt, Human
aucaaauucuacaacuuu

SEQ ID NO: 3596013 - RNA, 20 nt, Human
aucaaauuucacgucgucuu

SEQ ID NO: 3596014 - RNA, 22 nt, Human
aucaaauuucacgucgucuucu

SEQ ID NO: 3596015 - RNA, 21 nt, Human
aucaaauuuguaggguuucua

SEQ ID NO: 3596016 - RNA, 22 nt, Human
aucaacaauaaaauuuuuuuaa

SEQ ID NO: 3596017 - RNA, 22 nt, Human
aucaacagaagcauuuguauuu

SEQ ID NO: 3596018 - RNA, 14 nt, Human
aucaacagauaaau

SEQ ID NO: 3596019 - RNA, 19 nt, Human
aucaaccccuucgcuccug

SEQ ID NO: 3596020 - RNA, 21 nt, Human
aucaacuaaaguuguacuuua

SEQ ID NO: 3596021 - RNA, 19 nt, Human
auccgccagggcccacacc

SEQ ID NO: 3596022 - RNA, 15 nt, Human
auccgccuuuuguau

SEQ ID NO: 3596023 - RNA, 16 nt, Human
auccgcucucuuccug

SEQ ID NO: 3596024 - RNA, 19 nt, Human
auccgcucucuuccugccc

SEQ ID NO: 3596025 - RNA, 20 nt, Human
auccgcugccagccuugagc

SEQ ID NO: 3596026 - RNA, 13 nt, Human
auccggaaagaag

SEQ ID NO: 3596027 - RNA, 22 nt, Human
auccggaggagaagaaggaaau

SEQ ID NO: 3596028 - RNA, 18 nt, Human
auccguaguuauuuugca

SEQ ID NO: 3596029 - RNA, 16 nt, Human
auccguauauaucccc

SEQ ID NO: 3596030 - RNA, 21 nt, Human
auccgucuuuggccuccucca

SEQ ID NO: 3596031 - RNA, 18 nt, Human
auccuaaagaacaaagua

SEQ ID NO: 3596032 - RNA, 15 nt, Human
auccuaagaaauaug

SEQ ID NO: 3596033 - RNA, 21 nt, Human
auccuaagaaauaugugagau

SEQ ID NO: 3596034 - RNA, 23 nt, Human
auccuaagaaauaugugagauuu

SEQ ID NO: 3596035 - RNA, 20 nt, Human
auccuaagacacaaaugcau

SEQ ID NO: 3596036 - RNA, 18 nt, Human
auccuaagauguguucuu

SEQ ID NO: 3596037 - RNA, 18 nt, Human
auccuaagcaucuaaguu

SEQ ID NO: 3596038 - RNA, 18 nt, Human
auccuaagggucgaaagc

SEQ ID NO: 3596039 - RNA, 21 nt, Human
auccuaagggucgaaagcucu

SEQ ID NO: 3596040 - RNA, 19 nt, Human
auccuaaguuaccuuucua

SEQ ID NO: 3596041 - RNA, 22 nt, Human
auccuaauaaaaaggugaccau

SEQ ID NO: 3596042 - RNA, 19 nt, Human
auccuaaucauccaaugcu

SEQ ID NO: 3596043 - RNA, 12 nt, Human
auccuaaugaau

SEQ ID NO: 3596044 - RNA, 14 nt, Human
auccuacaagacac

SEQ ID NO: 3596045 - RNA, 21 nt, Human
auccuacaaggccuaugagua

SEQ ID NO: 3596046 - RNA, 14 nt, Human
auccuaccaaugca

SEQ ID NO: 3596047 - RNA, 15 nt, Human
auccuaccaaugcau

SEQ ID NO: 3596048 - RNA, 22 nt, Human
auccuaccacaaugcagugccu

SEQ ID NO: 3596049 - RNA, 24 nt, Human
auccuacgaguaauugcauuugcu

SEQ ID NO: 3596050 - RNA, 21 nt, Human
auccuagagauuugguguaca

SEQ ID NO: 3596051 - RNA, 15 nt, Human
auccuagauccuaag

SEQ ID NO: 3596052 - RNA, 13 nt, Human
auccuagauuaua

SEQ ID NO: 3596053 - RNA, 17 nt, Human
auccuagauuauaucaa

SEQ ID NO: 3596054 - RNA, 20 nt, Human
auccuagccuuauccucuga

SEQ ID NO: 3596055 - RNA, 22 nt, Human
auccuagccuuauccucugauc

SEQ ID NO: 3596056 - RNA, 14 nt, Human
auccuagcugugug

SEQ ID NO: 3596057 - RNA, 19 nt, Human
auccuagcugugugcaguc

SEQ ID NO: 3596058 - RNA, 17 nt, Human
auccuagggccuggguu

SEQ ID NO: 3596059 - RNA, 20 nt, Human
auccuagucucuaucauuaa

SEQ ID NO: 3596060 - RNA, 17 nt, Human
auccuaguuuccucucc

SEQ ID NO: 3596061 - RNA, 18 nt, Human
auccuaguuuccucuccu

SEQ ID NO: 3596062 - RNA, 13 nt, Human
auccuauauagaa

SEQ ID NO: 3596063 - RNA, 20 nt, Human
auccuauauagaaugcugca

SEQ ID NO: 3596064 - RNA, 20 nt, Human
auccuaucagccugucucuu

SEQ ID NO: 3596065 - RNA, 13 nt, Human
auccuaugcaaua

SEQ ID NO: 3596066 - RNA, 17 nt, Human
auccuaugcaugguuuc

SEQ ID NO: 3596067 - RNA, 12 nt, Human
auccuaugugau

SEQ ID NO: 3596068 - RNA, 21 nt, Human
aucaaucauuguacaguuugu

SEQ ID NO: 3596069 - RNA, 23 nt, Human
aucaauccugauuccucucuaag

SEQ ID NO: 3596070 - RNA, 16 nt, Human
aucaauccuuuauuau

SEQ ID NO: 3596071 - RNA, 16 nt, Human
aucaaucuugcaugua

SEQ ID NO: 3596072 - RNA, 22 nt, Human
aucaaucuuuaaaccaauugcu

SEQ ID NO: 3596073 - RNA, 16 nt, Human
aucaaugaauauugaa

SEQ ID NO: 3596074 - RNA, 18 nt, Human
aucaaugaauauugaagu

SEQ ID NO: 3596075 - RNA, 14 nt, Human
aucaaugaguguga

SEQ ID NO: 3596076 - RNA, 17 nt, Human
aucaaugugucuuucua

SEQ ID NO: 3596077 - RNA, 16 nt, Human
aucaauguucauugua

SEQ ID NO: 3596078 - RNA, 17 nt, Human
aucaauguucauuguaa

SEQ ID NO: 3596079 - RNA, 14 nt, Human
aucaauuaauuuuu

SEQ ID NO: 3596080 - RNA, 17 nt, Human
aucaauuauaguuucug

SEQ ID NO: 3596081 - RNA, 17 nt, Human
aucaauuuaaguguugg

SEQ ID NO: 3596082 - RNA, 14 nt, Human
aucacaaaguggaa

SEQ ID NO: 3596083 - RNA, 15 nt, Human
aucacaaaguggaac

SEQ ID NO: 3596084 - RNA, 24 nt, Human
aucacaaaguggaacgaaaaugaa

SEQ ID NO: 3596085 - RNA, 19 nt, Human
aucacaaauccaaaggaaa

SEQ ID NO: 3596086 - RNA, 11 nt, Human
aucacaaauga

SEQ ID NO: 3596087 - RNA, 12 nt, Human
aucacaaaugac

SEQ ID NO: 3596088 - RNA, 17 nt, Human
aucacaacacuggcuga

SEQ ID NO: 3596089 - RNA, 22 nt, Human
aucacaacgugcauugugcuuc

SEQ ID NO: 3596090 - RNA, 16 nt, Human
aucacaauuuuuaaug

SEQ ID NO: 3596091 - RNA, 11 nt, Human
aucacacacac

SEQ ID NO: 3596092 - RNA, 21 nt, Human
aucacacccagcccauguggc

SEQ ID NO: 3596093 - RNA, 22 nt, Human
aucacagagacauuccuccgag

SEQ ID NO: 3596094 - RNA, 14 nt, Human
aucacagcagcuuc

SEQ ID NO: 3596095 - RNA, 12 nt, Human
aucacagcugcu

SEQ ID NO: 3596096 - RNA, 18 nt, Human
aucacagcuuguuuugga

SEQ ID NO: 3596097 - RNA, 21 nt, Human
aucacaggcugggcugggcac

SEQ ID NO: 3596098 - RNA, 12 nt, Human
aucacagggccc

SEQ ID NO: 3596099 - RNA, 16 nt, Human
aucacagggccccaga

SEQ ID NO: 3596100 - RNA, 21 nt, Human
aucacagggccccagaaggca

SEQ ID NO: 3596101 - RNA, 17 nt, Human
aucacagggugggccuc

SEQ ID NO: 3596102 - RNA, 19 nt, Human
aucacaggguugggcccag

SEQ ID NO: 3596103 - RNA, 21 nt, Human
aucacaguuuugguugcuuua

SEQ ID NO: 3596104 - RNA, 13 nt, Human
aucacauguaugu

SEQ ID NO: 3596105 - RNA, 16 nt, Human
aucacauuauuugcau

SEQ ID NO: 3596106 - RNA, 22 nt, Human
aucacauugagcugauauaaau

SEQ ID NO: 3596107 - RNA, 19 nt, Human
aucaccacaguaaguuccu

SEQ ID NO: 3596108 - RNA, 13 nt, Human
aucaccagaauaa

SEQ ID NO: 3596109 - RNA, 21 nt, Human
aucaccagcccggccugcucc

SEQ ID NO: 3596110 - RNA, 20 nt, Human
aucaccccaaccccccaaaa

SEQ ID NO: 3596111 - RNA, 19 nt, Human
aucacccuuaccaugugcc

SEQ ID NO: 3596112 - RNA, 19 nt, Human
aucaccgugggcucccuga

SEQ ID NO: 3596113 - RNA, 20 nt, Human
aucaccuagcugaauguuuu

SEQ ID NO: 3596114 - RNA, 15 nt, Human
aucaccuauuuccau

SEQ ID NO: 3596115 - RNA, 15 nt, Human
aucaccucagauggc

SEQ ID NO: 3596116 - RNA, 14 nt, Human
aucaccucaggcca

SEQ ID NO: 3596117 - RNA, 19 nt, Human
aucaccuuagaccaccaag

SEQ ID NO: 3596118 - RNA, 16 nt, Human
aucaccuuaggcaggg

SEQ ID NO: 3596119 - RNA, 18 nt, Human
aucaccuuaggcagggaa

SEQ ID NO: 3596120 - RNA, 14 nt, Human
aucacgccacugca

SEQ ID NO: 3596121 - RNA, 23 nt, Human
aucacgccacugcacuccagccu

SEQ ID NO: 3596122 - RNA, 14 nt, Human
aucacgccuggcua

SEQ ID NO: 3596123 - RNA, 13 nt, Human
aucacgcuuuccu

SEQ ID NO: 3596124 - RNA, 22 nt, Human
aucacggucgccaccuggcauu

SEQ ID NO: 3596125 - RNA, 14 nt, Human
aucacguaaagcua

SEQ ID NO: 3596126 - RNA, 19 nt, Human
aucacguguacuggcuccu

SEQ ID NO: 3596127 - RNA, 17 nt, Human
aucacguuagaggaaaa

SEQ ID NO: 3596128 - RNA, 13 nt, Human
aucacuaacauua

SEQ ID NO: 3596129 - RNA, 14 nt, Human
aucacuaacauuau

SEQ ID NO: 3596130 - RNA, 21 nt, Human
aucacuaacauuauauugcaa

SEQ ID NO: 3596131 - RNA, 14 nt, Human
aucacuacugcagu

SEQ ID NO: 3596132 - RNA, 21 nt, Human
aucacuauccaugcaccaaac

SEQ ID NO: 3596133 - RNA, 15 nt, Human
aucacuaugcauuuu

SEQ ID NO: 3596134 - RNA, 14 nt, Human
aucacucagagcag

SEQ ID NO: 3596135 - RNA, 18 nt, Human
aucacucagagcagucug

SEQ ID NO: 3596136 - RNA, 14 nt, Human
aucacuccccucca

SEQ ID NO: 3596137 - RNA, 14 nt, Human
aucacucugcugcu

SEQ ID NO: 3596138 - RNA, 14 nt, Human
aucacucuugugga

SEQ ID NO: 3596139 - RNA, 21 nt, Human
aucacugaacuuugcugagcc

SEQ ID NO: 3596140 - RNA, 20 nt, Human
aucacugaauuuauaaagua

SEQ ID NO: 3596141 - RNA, 17 nt, Human
aucacugaguuuuccau

SEQ ID NO: 3596142 - RNA, 21 nt, Human
aucacugccagagauaaacua

SEQ ID NO: 3596143 - RNA, 14 nt, Human
aucacugcuugaug

SEQ ID NO: 3596144 - RNA, 10 nt, Human
aucacuggag

SEQ ID NO: 3596145 - RNA, 15 nt, Human
aucacuggagcccag

SEQ ID NO: 3596146 - RNA, 13 nt, Human
aucacuggaugaa

SEQ ID NO: 3596147 - RNA, 22 nt, Human
aucacuggcaaugaaaaauucu

SEQ ID NO: 3596148 - RNA, 23 nt, Human
aucacuggcaaugaaaaauucuc

SEQ ID NO: 3596149 - RNA, 18 nt, Human
aucacuguaucauuuucu

SEQ ID NO: 3596150 - RNA, 12 nt, Human
aucacugucuuu

SEQ ID NO: 3596151 - RNA, 16 nt, Human
aucacugucuuuccua

SEQ ID NO: 3596152 - RNA, 17 nt, Human
aucacuguguauauuug

SEQ ID NO: 3596153 - RNA, 19 nt, Human
aucacuguguauauuugau

SEQ ID NO: 3596154 - RNA, 17 nt, Human
aucacuguuuagauuug

SEQ ID NO: 3596155 - RNA, 18 nt, Human
aucacuguuuagauuugc

SEQ ID NO: 3596156 - RNA, 14 nt, Human
aucacuuaaaacac

SEQ ID NO: 3596157 - RNA, 17 nt, Human
aucacuuaaacuugcau

SEQ ID NO: 3596158 - RNA, 20 nt, Human
aucacuuaggaaauggcuuu

SEQ ID NO: 3596159 - RNA, 18 nt, Human
aucacuucugagaacuca

SEQ ID NO: 3596160 - RNA, 17 nt, Human
aucacuugaauccuagg

SEQ ID NO: 3596161 - RNA, 19 nt, Human
aucacuugaggucaggagu

SEQ ID NO: 3596162 - RNA, 17 nt, Human
aucacuuguacaaaaua

SEQ ID NO: 3596163 - RNA, 22 nt, Human
aucacuugucaauaaaauccau

SEQ ID NO: 3596164 - RNA, 16 nt, Human
aucacuuucucaguuu

SEQ ID NO: 3596165 - RNA, 21 nt, Human
aucacuuucucaguuuucaua

SEQ ID NO: 3596166 - RNA, 15 nt, Human
aucacuuugcucuga

SEQ ID NO: 3596167 - RNA, 16 nt, Human
aucacuuugucuaacu

SEQ ID NO: 3596168 - RNA, 15 nt, Human
aucacuuuucaguga

SEQ ID NO: 3596169 - RNA, 14 nt, Human
aucacuuuucugua

SEQ ID NO: 3596170 - RNA, 17 nt, Human
aucacuuuuugaacuaa

SEQ ID NO: 3596171 - RNA, 18 nt, Human
aucagaaaaauggagcaa

SEQ ID NO: 3596172 - RNA, 15 nt, Human
aucagaaaagggaag

SEQ ID NO: 3596173 - RNA, 16 nt, Human
aucagaaagcuuuauu

SEQ ID NO: 3596174 - RNA, 23 nt, Human
aucagaaagggagggcucugagg

SEQ ID NO: 3596175 - RNA, 21 nt, Human
auccuguguguuaagcucugc

SEQ ID NO: 3596176 - RNA, 14 nt, Human
auccuguguuucua

SEQ ID NO: 3596177 - RNA, 19 nt, Human
auccuguugaaaagccaug

SEQ ID NO: 3596178 - RNA, 18 nt, Human
auccuuaaguaucagaaa

SEQ ID NO: 3596179 - RNA, 19 nt, Human
auccuuaaguaucagaaag

SEQ ID NO: 3596180 - RNA, 18 nt, Human
auccuuagaucuggcaug

SEQ ID NO: 3596181 - RNA, 20 nt, Human
auccuuaucagagcuaaggg

SEQ ID NO: 3596182 - RNA, 23 nt, Human
auccuucaaagucucaaugaaau

SEQ ID NO: 3596183 - RNA, 16 nt, Human
auccuucacugcucac

SEQ ID NO: 3596184 - RNA, 18 nt, Human
auccuuccaaagaauucu

SEQ ID NO: 3596185 - RNA, 12 nt, Human
auccuuccacgg

SEQ ID NO: 3596186 - RNA, 16 nt, Human
auccuuccauuccaca

SEQ ID NO: 3596187 - RNA, 20 nt, Human
auccuuccauuccacacaga

SEQ ID NO: 3596188 - RNA, 23 nt, Human
auccuucccaaguaagaggcugg

SEQ ID NO: 3596189 - RNA, 12 nt, Human
auccuucccacu

SEQ ID NO: 3596190 - RNA, 16 nt, Human
auccuucccuuuggag

SEQ ID NO: 3596191 - RNA, 21 nt, Human
auccuucccuuuggagaugcu

SEQ ID NO: 3596192 - RNA, 12 nt, Human
auccuuccuaua

SEQ ID NO: 3596193 - RNA, 14 nt, Human
auccuuccuauaac

SEQ ID NO: 3596194 - RNA, 22 nt, Human
auccuuccuucccacccaucgc

SEQ ID NO: 3596195 - RNA, 23 nt, Human
auccuucgugaacauccccuccc

SEQ ID NO: 3596196 - RNA, 17 nt, Human
auccuucuaguuuccca

SEQ ID NO: 3596197 - RNA, 19 nt, Human
auccuucuaguuucccaca

SEQ ID NO: 3596198 - RNA, 14 nt, Human
auccuugaagguau

SEQ ID NO: 3596199 - RNA, 14 nt, Human
auccuugacuuuuu

SEQ ID NO: 3596200 - RNA, 22 nt, Human
auccuugccaauagugucaucc

SEQ ID NO: 3596201 - RNA, 17 nt, Human
auccuugggggcuccca

SEQ ID NO: 3596202 - RNA, 15 nt, Human
auccuuggucuuugu

SEQ ID NO: 3596203 - RNA, 17 nt, Human
auccuuggucuuuguau

SEQ ID NO: 3596204 - RNA, 16 nt, Human
auccuuguuucaaaca

SEQ ID NO: 3596205 - RNA, 23 nt, Human
auccuuguuucaaacacaaaugc

SEQ ID NO: 3596206 - RNA, 23 nt, Human
auccuuguuuugaaaaccuaaaa

SEQ ID NO: 3596207 - RNA, 21 nt, Human
auccuuguuuugugacauuuu

SEQ ID NO: 3596208 - RNA, 17 nt, Human
auccuuuaaaauuuaaa

SEQ ID NO: 3596209 - RNA, 17 nt, Human
auccuuuacguguuuaa

SEQ ID NO: 3596210 - RNA, 19 nt, Human
auccuuucacuucuuuccc

SEQ ID NO: 3596211 - RNA, 22 nt, Human
auccuuucacuucuuucccuuc

SEQ ID NO: 3596212 - RNA, 17 nt, Human
auccuuucauauaguua

SEQ ID NO: 3596213 - RNA, 14 nt, Human
aggcugcuuuccaa

SEQ ID NO: 3596214 - RNA, 15 nt, Human
aggcugcuuuccaaa

SEQ ID NO: 3596215 - RNA, 17 nt, Human
aggcugcuuuccaaagc

SEQ ID NO: 3596216 - RNA, 11 nt, Human
aggcuggaagg

SEQ ID NO: 3596217 - RNA, 15 nt, Human
aggcuggaaggagga

SEQ ID NO: 3596218 - RNA, 16 nt, Human
aggcuggacaugcuga

SEQ ID NO: 3596219 - RNA, 16 nt, Human
auccacauguuucaga

SEQ ID NO: 3596220 - RNA, 17 nt, Human
auccacauuguuuuaaa

SEQ ID NO: 3596221 - RNA, 15 nt, Human
auccacauuucuaaa

SEQ ID NO: 3596222 - RNA, 20 nt, Human
auccacccaacccuaucucc

SEQ ID NO: 3596223 - RNA, 13 nt, Human
auccacccaccuc

SEQ ID NO: 3596224 - RNA, 18 nt, Human
auccacccaccucagccu

SEQ ID NO: 3596225 - RNA, 10 nt, Human
auccacccca

SEQ ID NO: 3596226 - RNA, 16 nt, Human
auccaccguccccucc

SEQ ID NO: 3596227 - RNA, 10 nt, Human
auccaccucc

SEQ ID NO: 3596228 - RNA, 12 nt, Human
auccaccuccau

SEQ ID NO: 3596229 - RNA, 13 nt, Human
auccaccuccuuc

SEQ ID NO: 3596230 - RNA, 18 nt, Human
auccaccugucucagccu

SEQ ID NO: 3596231 - RNA, 21 nt, Human
auccaccugucucagccuccc

SEQ ID NO: 3596232 - RNA, 21 nt, Human
auccacuagugcaaaucauag

SEQ ID NO: 3596233 - RNA, 16 nt, Human
auccacucuacccucc

SEQ ID NO: 3596234 - RNA, 21 nt, Human
auccacucuacccucccaccc

SEQ ID NO: 3596235 - RNA, 22 nt, Human
auccacucuacccucccacccc

SEQ ID NO: 3596236 - RNA, 23 nt, Human
auccacucucucuuguucuuacu

SEQ ID NO: 3596237 - RNA, 21 nt, Human
auccacugugccaugugccag

SEQ ID NO: 3596238 - RNA, 14 nt, Human
auccacuucuuuca

SEQ ID NO: 3596239 - RNA, 15 nt, Human
auccacuuuggggga

SEQ ID NO: 3596240 - RNA, 20 nt, Human
auccagaaacuuguucuucc

SEQ ID NO: 3596241 - RNA, 21 nt, Human
auccagaaacuuguucuucca

SEQ ID NO: 3596242 - RNA, 16 nt, Human
auccagaaagaaaacu

SEQ ID NO: 3596243 - RNA, 16 nt, Human
auccagacaucaugaa

SEQ ID NO: 3596244 - RNA, 15 nt, Human
auccagacccggcug

SEQ ID NO: 3596245 - RNA, 19 nt, Human
auccagacccggcugcgug

SEQ ID NO: 3596246 - RNA, 17 nt, Human
auccagagauucauuuu

SEQ ID NO: 3596247 - RNA, 23 nt, Human
auccagagauucauuuucuagau

SEQ ID NO: 3596248 - RNA, 22 nt, Human
auccagaggcaaacggaggcaa

SEQ ID NO: 3596249 - RNA, 20 nt, Human
auccagauacacccaaagua

SEQ ID NO: 3596250 - RNA, 14 nt, Human
auccagaugguggg

SEQ ID NO: 3596251 - RNA, 15 nt, Human
auccagauguggcua

SEQ ID NO: 3596252 - RNA, 18 nt, Human
auccagcagauuauucac

SEQ ID NO: 3596253 - RNA, 19 nt, Human
auccagccggaggccagag

SEQ ID NO: 3596254 - RNA, 14 nt, Human
auccagccucuccc

SEQ ID NO: 3596255 - RNA, 16 nt, Human
auccagccucuccccu

SEQ ID NO: 3596256 - RNA, 17 nt, Human
auccagccuggggucug

SEQ ID NO: 3596257 - RNA, 22 nt, Human
auccagcuccccuucugaauca

SEQ ID NO: 3596258 - RNA, 22 nt, Human
auccagcucuaagucucaacug

SEQ ID NO: 3596259 - RNA, 15 nt, Human
auccaggacccugcc

SEQ ID NO: 3596260 - RNA, 22 nt, Human
auccaggacccugccaggcaca

SEQ ID NO: 3596261 - RNA, 12 nt, Human
auccaggagcuc

SEQ ID NO: 3596262 - RNA, 16 nt, Human
auccaggagcuccagu

SEQ ID NO: 3596263 - RNA, 24 nt, Human
auccaggcagucgggggcuggccu

SEQ ID NO: 3596264 - RNA, 20 nt, Human
auccaggccccucccucucc

SEQ ID NO: 3596265 - RNA, 14 nt, Human
auccaggccggcuu

SEQ ID NO: 3596266 - RNA, 13 nt, Human
auccagggacaga

SEQ ID NO: 3596267 - RNA, 21 nt, Human
auccagguacgcacagacagg

SEQ ID NO: 3596268 - RNA, 19 nt, Human
auccaggucaacagaauga

SEQ ID NO: 3596269 - RNA, 16 nt, Human
auccaguaucuugaag

SEQ ID NO: 3596270 - RNA, 19 nt, Human
auccaguuauaagaagaag

SEQ ID NO: 3596271 - RNA, 16 nt, Human
auccaguucaugagaa

SEQ ID NO: 3596272 - RNA, 17 nt, Human
auccaguuuuguuugga

SEQ ID NO: 3596273 - RNA, 20 nt, Human
auccaguuuuguuuggacca

SEQ ID NO: 3596274 - RNA, 11 nt, Human
auccauaaaga

SEQ ID NO: 3596275 - RNA, 13 nt, Human
auccauaaagaag

SEQ ID NO: 3596276 - RNA, 17 nt, Human
auccauaaagaagcaau

SEQ ID NO: 3596277 - RNA, 19 nt, Human
auccauagcaccuccacau

SEQ ID NO: 3596278 - RNA, 20 nt, Human
auccauaguaacugacauga

SEQ ID NO: 3596279 - RNA, 16 nt, Human
auccauagugacuuuu

SEQ ID NO: 3596280 - RNA, 18 nt, Human
auccauauugagucaaau

SEQ ID NO: 3596281 - RNA, 20 nt, Human
auccauauugagucaaaugg

SEQ ID NO: 3596282 - RNA, 12 nt, Human
auccauccaauc

SEQ ID NO: 3596283 - RNA, 20 nt, Human
auccauccuugccaauagug

SEQ ID NO: 3596284 - RNA, 19 nt, Human
auccaugaguuugcccugg

SEQ ID NO: 3596285 - RNA, 13 nt, Human
auccauggccagc

SEQ ID NO: 3596286 - RNA, 16 nt, Human
auccauggccagcagc

SEQ ID NO: 3596287 - RNA, 21 nt, Human
auccauggccagcagcaccug

SEQ ID NO: 3596288 - RNA, 18 nt, Human
auccauggggucucucac

SEQ ID NO: 3596289 - RNA, 14 nt, Human
auccauguacugua

SEQ ID NO: 3596290 - RNA, 18 nt, Human
auccauguccuaugugug

SEQ ID NO: 3596291 - RNA, 19 nt, Human
auccauguccuauguguga

SEQ ID NO: 3596292 - RNA, 18 nt, Human
auccauguuaguuuuuac

SEQ ID NO: 3596293 - RNA, 19 nt, Human
auccauguuaguuuuuacu

SEQ ID NO: 3596294 - RNA, 15 nt, Human
auccauuaggccagc

SEQ ID NO: 3596295 - RNA, 18 nt, Human
auccauuaucauguguaa

SEQ ID NO: 3596296 - RNA, 20 nt, Human
auccauuucaucuauuucug

SEQ ID NO: 3596297 - RNA, 17 nt, Human
auccauuuccauugcuu

SEQ ID NO: 3596298 - RNA, 13 nt, Human
auccauuuccccu

SEQ ID NO: 3596299 - RNA, 19 nt, Human
auccauuuccccuccuucc

SEQ ID NO: 3596300 - RNA, 12 nt, Human
auccauuucuaa

SEQ ID NO: 3596301 - RNA, 20 nt, Human
aucccaaacccuucagugcc

SEQ ID NO: 3596302 - RNA, 15 nt, Human
aucccaaaguuguug

SEQ ID NO: 3596303 - RNA, 17 nt, Human
aucccaacacugccagc

SEQ ID NO: 3596304 - RNA, 19 nt, Human
aucccaaccagugccaagg

SEQ ID NO: 3596305 - RNA, 21 nt, Human
aucccaaccagugccaaggac

SEQ ID NO: 3596306 - RNA, 17 nt, Human
aucccaagacccagggc

SEQ ID NO: 3596307 - RNA, 16 nt, Human
aucccaaucauuguug

SEQ ID NO: 3596308 - RNA, 15 nt, Human
aucccacccacaugu

SEQ ID NO: 3596309 - RNA, 16 nt, Human
aucccacgcacuccau

SEQ ID NO: 3596310 - RNA, 18 nt, Human
aucccacgcacuccauga

SEQ ID NO: 3596311 - RNA, 23 nt, Human
aucccacggaaaaugccaaucuc

SEQ ID NO: 3596312 - RNA, 16 nt, Human
aucccacuugccccug

SEQ ID NO: 3596313 - RNA, 13 nt, Human
aucccagaaauua

SEQ ID NO: 3596314 - RNA, 20 nt, Human
aucccagagggugggcuuca

SEQ ID NO: 3596315 - RNA, 14 nt, Human
aucccagcaccugc

SEQ ID NO: 3596316 - RNA, 19 nt, Human
aucccagcacuuugggaga

SEQ ID NO: 3596317 - RNA, 12 nt, Human
aucccagcccca

SEQ ID NO: 3596318 - RNA, 16 nt, Human
aucccagcccccugac

SEQ ID NO: 3596319 - RNA, 15 nt, Human
aucccagccuuggca

SEQ ID NO: 3596320 - RNA, 20 nt, Human
aucccagcuacucaagaggc

SEQ ID NO: 3596321 - RNA, 17 nt, Human
aucccagcuacucagga

SEQ ID NO: 3596322 - RNA, 22 nt, Human
aucccagcuucggcauuugauc

SEQ ID NO: 3596323 - RNA, 12 nt, Human
aucccaggacac

SEQ ID NO: 3596324 - RNA, 17 nt, Human
aucccaggauguacaag

SEQ ID NO: 3596325 - RNA, 24 nt, Human
aucccaggccccuggaggcugccu

SEQ ID NO: 3596326 - RNA, 19 nt, Human
aucccaggggaccacaccu

SEQ ID NO: 3596327 - RNA, 16 nt, Human
aucccauaugccuggg

SEQ ID NO: 3596328 - RNA, 17 nt, Human
aucccauaugccugggc

SEQ ID NO: 3596329 - RNA, 15 nt, Human
aucccaucccauccc

SEQ ID NO: 3596330 - RNA, 18 nt, Human
aucccaucccaucccauc

SEQ ID NO: 3596331 - RNA, 23 nt, Human
aucccaucgucucggccuucaca

SEQ ID NO: 3596332 - RNA, 18 nt, Human
aucccaucuaagcugcag

SEQ ID NO: 3596333 - RNA, 19 nt, Human
aucccaugagccucagcau

SEQ ID NO: 3596334 - RNA, 13 nt, Human
aucccauguaaca

SEQ ID NO: 3596335 - RNA, 16 nt, Human
aucccauguaacagaa

SEQ ID NO: 3596336 - RNA, 14 nt, Human
aucccauuauucaa

SEQ ID NO: 3596337 - RNA, 20 nt, Human
aucccauuauucaaaguugc

SEQ ID NO: 3596338 - RNA, 14 nt, Human
aucccauuccaggc

SEQ ID NO: 3596339 - RNA, 15 nt, Human
aucccauuccaggca

SEQ ID NO: 3596340 - RNA, 16 nt, Human
aucccauucugcguca

SEQ ID NO: 3596341 - RNA, 16 nt, Human
aucccauugcccuggu

SEQ ID NO: 3596342 - RNA, 21 nt, Human
aucccauugucuucugaccuc

SEQ ID NO: 3596343 - RNA, 20 nt, Human
auccccaacaugcacugaug

SEQ ID NO: 3596344 - RNA, 16 nt, Human
auccccaagugugaac

SEQ ID NO: 3596345 - RNA, 13 nt, Human
auccccacccuug

SEQ ID NO: 3596346 - RNA, 21 nt, Human
auccccaggggucccagccac

SEQ ID NO: 3596347 - RNA, 15 nt, Human
auccccaguaaaauu

SEQ ID NO: 3596348 - RNA, 17 nt, Human
auccccauccuccagcu

SEQ ID NO: 3596349 - RNA, 18 nt, Human
auccccaucucccugccu

SEQ ID NO: 3596350 - RNA, 13 nt, Human
aucccccaaaguu

SEQ ID NO: 3596351 - RNA, 12 nt, Human
aucccccagaaa

SEQ ID NO: 3596352 - RNA, 12 nt, Human
aucccccagacu

SEQ ID NO: 3596353 - RNA, 13 nt, Human
aucccccugcccu

SEQ ID NO: 3596354 - RNA, 14 nt, Human
aucccccugcccuc

SEQ ID NO: 3596355 - RNA, 15 nt, Human
aucccccugcccucg

SEQ ID NO: 3596356 - RNA, 14 nt, Human
auccccgccuggcc

SEQ ID NO: 3596357 - RNA, 19 nt, Human
auccccguuccugacauca

SEQ ID NO: 3596358 - RNA, 13 nt, Human
auccccuaaaaua

SEQ ID NO: 3596359 - RNA, 14 nt, Human
aucuuuucauacau

SEQ ID NO: 3596360 - RNA, 13 nt, Human
aucuuuucauucu

SEQ ID NO: 3596361 - RNA, 18 nt, Human
aucuuuucuuuagagaac

SEQ ID NO: 3596362 - RNA, 20 nt, Human
aucuuuucuuuagagaacug

SEQ ID NO: 3596363 - RNA, 23 nt, Human
aucuuuucuuuagagaacugaaa

SEQ ID NO: 3596364 - RNA, 23 nt, Human
aucuuuugugagauguaauuguu

SEQ ID NO: 3596365 - RNA, 22 nt, Human
aucuuuuguuacucuugggaca

SEQ ID NO: 3596366 - RNA, 16 nt, Human
aucuuuuguucccauc

SEQ ID NO: 3596367 - RNA, 18 nt, Human
aucuuuuuuagcauaaaa

SEQ ID NO: 3596368 - RNA, 19 nt, Human
aucuuuuuuagcauaaaau

SEQ ID NO: 3596369 - RNA, 15 nt, Human
augaaaaagaagaau

SEQ ID NO: 3596370 - RNA, 14 nt, Human
augaaaaagcaugu

SEQ ID NO: 3596371 - RNA, 16 nt, Human
augaaaaagcauguac

SEQ ID NO: 3596372 - RNA, 18 nt, Human
augaaaaagcauguacag

SEQ ID NO: 3596373 - RNA, 18 nt, Human
augaaaaauuuaagcauu

SEQ ID NO: 3596374 - RNA, 19 nt, Human
augaaaaauuuaagcauug

SEQ ID NO: 3596375 - RNA, 15 nt, Human
aggcuggacuccaga

SEQ ID NO: 3596376 - RNA, 22 nt, Human
aggcuggacuccagaucugcac

SEQ ID NO: 3596377 - RNA, 14 nt, Human
aggcuggagaagcu

SEQ ID NO: 3596378 - RNA, 15 nt, Human
aggcuggagcccagg

SEQ ID NO: 3596379 - RNA, 18 nt, Human
aggcuggagcccagggag

SEQ ID NO: 3596380 - RNA, 12 nt, Human
aggcuggagcug

SEQ ID NO: 3596381 - RNA, 18 nt, Human
aggcuggagcuggcgucu

SEQ ID NO: 3596382 - RNA, 13 nt, Human
aggcuggaggcag

SEQ ID NO: 3596383 - RNA, 17 nt, Human
aggcuggaggcagggcc

SEQ ID NO: 3596384 - RNA, 18 nt, Human
aggcuggaggcagggccu

SEQ ID NO: 3596385 - RNA, 20 nt, Human
aggcuggaguggaguggcgu

SEQ ID NO: 3596386 - RNA, 17 nt, Human
aggcuggaguuggggca

SEQ ID NO: 3596387 - RNA, 18 nt, Human
aggcuggaguugucacug

SEQ ID NO: 3596388 - RNA, 18 nt, Human
aggcuggcacaggacaug

SEQ ID NO: 3596389 - RNA, 18 nt, Human
aggcuggcagcucuccag

SEQ ID NO: 3596390 - RNA, 21 nt, Human
aggcuggcagcucuccaguca

SEQ ID NO: 3596391 - RNA, 19 nt, Human
aggcuggccaacgggguga

SEQ ID NO: 3596392 - RNA, 12 nt, Human
aggcuggccagc

SEQ ID NO: 3596393 - RNA, 14 nt, Human
aggcuggccagccc

SEQ ID NO: 3596394 - RNA, 16 nt, Human
aggcuggccagcccca

SEQ ID NO: 3596395 - RNA, 22 nt, Human
aggcuggccagccccacagccc

SEQ ID NO: 3596396 - RNA, 17 nt, Human
aggcuggccagccgcuc

SEQ ID NO: 3596397 - RNA, 21 nt, Human
aggcuggccaguccaggcugc

SEQ ID NO: 3596398 - RNA, 17 nt, Human
aggcuggcccugcccug

SEQ ID NO: 3596399 - RNA, 21 nt, Human
aggcuggccuauguggucuaa

SEQ ID NO: 3596400 - RNA, 16 nt, Human
aggcuggccucagacu

SEQ ID NO: 3596401 - RNA, 19 nt, Human
aggcuggcgagagucuggc

SEQ ID NO: 3596402 - RNA, 15 nt, Human
aggcuggcgcagcca

SEQ ID NO: 3596403 - RNA, 20 nt, Human
aggcuggcgcagccaaggcc

SEQ ID NO: 3596404 - RNA, 19 nt, Human
aggcuggcuccagaugcag

SEQ ID NO: 3596405 - RNA, 22 nt, Human
aggcuggcuggcccgucauguu

SEQ ID NO: 3596406 - RNA, 12 nt, Human
aggcuggcuggg

SEQ ID NO: 3596407 - RNA, 13 nt, Human
aggcuggcugggg

SEQ ID NO: 3596408 - RNA, 17 nt, Human
aggcuggcuggggccua

SEQ ID NO: 3596409 - RNA, 22 nt, Human
aggcuggcuuguccccuccuca

SEQ ID NO: 3596410 - RNA, 19 nt, Human
aggcugggacgcucugcug

SEQ ID NO: 3596411 - RNA, 20 nt, Human
aggcugggagagccuuccag

SEQ ID NO: 3596412 - RNA, 22 nt, Human
aggcugggagagccuuccaggg

SEQ ID NO: 3596413 - RNA, 13 nt, Human
aggcugggcaagg

SEQ ID NO: 3596414 - RNA, 10 nt, Human
aggcugggcc

SEQ ID NO: 3596415 - RNA, 20 nt, Human
aggcugggccauguccaaag

SEQ ID NO: 3596416 - RNA, 13 nt, Human
aggcugggcccag

SEQ ID NO: 3596417 - RNA, 15 nt, Human
aggcugggcccagag

SEQ ID NO: 3596418 - RNA, 16 nt, Human
aggcugggcccagagg

SEQ ID NO: 3596419 - RNA, 17 nt, Human
aggcugggcccagaggc

SEQ ID NO: 3596420 - RNA, 18 nt, Human
aggcugggcccagaggca

SEQ ID NO: 3596421 - RNA, 13 nt, Human
aggcugggcuccc

SEQ ID NO: 3596422 - RNA, 16 nt, Human
aggcugggcugggcac

SEQ ID NO: 3596423 - RNA, 21 nt, Human
aggcugggcugggcacugcuc

SEQ ID NO: 3596424 - RNA, 14 nt, Human
aggcugggcuucag

SEQ ID NO: 3596425 - RNA, 18 nt, Human
aggcugggcuucaguggc

SEQ ID NO: 3596426 - RNA, 19 nt, Human
aggcugggcuucaguggca

SEQ ID NO: 3596427 - RNA, 21 nt, Human
aggcuggggaaguccucuggg

SEQ ID NO: 3596428 - RNA, 17 nt, Human
aggcugggggaagaagc

SEQ ID NO: 3596429 - RNA, 15 nt, Human
aggcugggucgcccu

SEQ ID NO: 3596430 - RNA, 16 nt, Human
aggcugggucgcccug

SEQ ID NO: 3596431 - RNA, 15 nt, Human
aggcugggugcccac

SEQ ID NO: 3596432 - RNA, 18 nt, Human
aggcugggugcccacagc

SEQ ID NO: 3596433 - RNA, 19 nt, Human
aggcugggugcccacagcc

SEQ ID NO: 3596434 - RNA, 23 nt, Human
aggcugguccuauggccucaugu

SEQ ID NO: 3596435 - RNA, 23 nt, Human
aggcuggucucgaacuccugacc

SEQ ID NO: 3596436 - RNA, 19 nt, Human
aggcuggucuugaaguccu

SEQ ID NO: 3596437 - RNA, 23 nt, Human
aggcuggugcuguggccagggug

SEQ ID NO: 3596438 - RNA, 20 nt, Human
aggcugguuuuggcaucucu

SEQ ID NO: 3596439 - RNA, 21 nt, Human
aggcuguaucccaugagccuc

SEQ ID NO: 3596440 - RNA, 12 nt, Human
aggcugucaauu

SEQ ID NO: 3596441 - RNA, 21 nt, Human
aggcugucaauuacaggaagu

SEQ ID NO: 3596442 - RNA, 14 nt, Human
aggcugugcucccu

SEQ ID NO: 3596443 - RNA, 16 nt, Human
aggcugugcugcccug

SEQ ID NO: 3596444 - RNA, 15 nt, Human
aggcugugggccuca

SEQ ID NO: 3596445 - RNA, 20 nt, Human
aggcuguguuuggcuuucag

SEQ ID NO: 3596446 - RNA, 22 nt, Human
aggcuguguuuggcuuucaggg

SEQ ID NO: 3596447 - RNA, 19 nt, Human
aggcuguuaaauacaggaa

SEQ ID NO: 3596448 - RNA, 20 nt, Human
aggcuguuaaauacaggaaa

SEQ ID NO: 3596449 - RNA, 23 nt, Human
aggcuguuaaauacaggaaacag

SEQ ID NO: 3596450 - RNA, 20 nt, Human
aggcuguucccauguagccc

SEQ ID NO: 3596451 - RNA, 19 nt, Human
aggcuguuugcuucaccgu

SEQ ID NO: 3596452 - RNA, 20 nt, Human
aggcuuagcuuugcucugcc

SEQ ID NO: 3596453 - RNA, 17 nt, Human
aggcuuagucacugaga

SEQ ID NO: 3596454 - RNA, 18 nt, Human
aggcuuagucacugagac

SEQ ID NO: 3596455 - RNA, 23 nt, Human
aggcuuagucacugagacagccc

SEQ ID NO: 3596456 - RNA, 17 nt, Human
aggcuuagugauguaau

SEQ ID NO: 3596457 - RNA, 14 nt, Human
aggcuuaguuugug

SEQ ID NO: 3596458 - RNA, 15 nt, Human
aggcuuaguuugugu

SEQ ID NO: 3596459 - RNA, 15 nt, Human
aggcuuauauucaac

SEQ ID NO: 3596460 - RNA, 21 nt, Human
aggcuuauauucaaccaugga

SEQ ID NO: 3596461 - RNA, 22 nt, Human
aggcuucaauuuauugcacaaa

SEQ ID NO: 3596462 - RNA, 20 nt, Human
aggcuucagcauauuuauag

SEQ ID NO: 3596463 - RNA, 23 nt, Human
aggcuuccacguacugcagccuc

SEQ ID NO: 3596464 - RNA, 22 nt, Human
aggcuuccugcguccuccucac

SEQ ID NO: 3596465 - RNA, 15 nt, Human
aggcuucuccgccag

SEQ ID NO: 3596466 - RNA, 17 nt, Human
aggcuucuccgccagcc

SEQ ID NO: 3596467 - RNA, 20 nt, Human
aggcuucuccgccagccucc

SEQ ID NO: 3596468 - RNA, 17 nt, Human
aggcuucugcuggggcc

SEQ ID NO: 3596469 - RNA, 23 nt, Human
aggcuucuucagaucagugcuug

SEQ ID NO: 3596470 - RNA, 12 nt, Human
aggcuugcagaa

SEQ ID NO: 3596471 - RNA, 21 nt, Human
aggcuugcccaguacauuuaa

SEQ ID NO: 3596472 - RNA, 20 nt, Human
aggcuugguuccuucccaau

SEQ ID NO: 3596473 - RNA, 16 nt, Human
aggcuugucagagcug

SEQ ID NO: 3596474 - RNA, 17 nt, Human
aggcuugucagagcugg

SEQ ID NO: 3596475 - RNA, 18 nt, Human
aggcuugucagagcuggg

SEQ ID NO: 3596476 - RNA, 21 nt, Human
aggcuuguuuaccuuucucuc

SEQ ID NO: 3596477 - RNA, 13 nt, Human
aggcuuuacuuag

SEQ ID NO: 3596478 - RNA, 14 nt, Human
aggcuuucagggcc

SEQ ID NO: 3596479 - RNA, 18 nt, Human
aggcuuucccacuuccca

SEQ ID NO: 3596480 - RNA, 22 nt, Human
aggcuuucuguugccaugguga

SEQ ID NO: 3596481 - RNA, 20 nt, Human
aggcuuugcccugcugcccu

SEQ ID NO: 3596482 - RNA, 19 nt, Human
aggcuuuggauuugacauu

SEQ ID NO: 3596483 - RNA, 18 nt, Human
aggcuuuguguuguaauu

SEQ ID NO: 3596484 - RNA, 15 nt, Human
aggcuuuuuuaucau

SEQ ID NO: 3596485 - RNA, 23 nt, Human
agggaaaaaucaaguauuauaaa

SEQ ID NO: 3596486 - RNA, 16 nt, Human
agggaaaaggggcucc

SEQ ID NO: 3596487 - RNA, 17 nt, Human
agggaaaaggggcuccu

SEQ ID NO: 3596488 - RNA, 22 nt, Human
agggaaaauaaaaaaagaaaaa

SEQ ID NO: 3596489 - RNA, 23 nt, Human
agggaaaauaaaaaaagaaaaaa

SEQ ID NO: 3596490 - RNA, 16 nt, Human
agggaaacugccagca

SEQ ID NO: 3596491 - RNA, 19 nt, Human
agggaaagaaaaggaaggc

SEQ ID NO: 3596492 - RNA, 16 nt, Human
agggaaagacuggcaa

SEQ ID NO: 3596493 - RNA, 18 nt, Human
agggaaaggggugcuuuu

SEQ ID NO: 3596494 - RNA, 15 nt, Human
agggaaauagaaaaa

SEQ ID NO: 3596495 - RNA, 20 nt, Human
agggaacaaguugagcuaug

SEQ ID NO: 3596496 - RNA, 21 nt, Human
agggaacaaguugagcuauga

SEQ ID NO: 3596497 - RNA, 23 nt, Human
agggaacaauuuggcaauuuugu

SEQ ID NO: 3596498 - RNA, 17 nt, Human
agggaaccacuuucuua

SEQ ID NO: 3596499 - RNA, 23 nt, Human
agggaacccagcucuaauacauu

SEQ ID NO: 3596500 - RNA, 14 nt, Human
agggaaccuguguc

SEQ ID NO: 3596501 - RNA, 18 nt, Human
agggaacgugauuaguga

SEQ ID NO: 3596502 - RNA, 13 nt, Human
auccucucaccuc

SEQ ID NO: 3596503 - RNA, 16 nt, Human
auccucucaccucagc

SEQ ID NO: 3596504 - RNA, 15 nt, Human
auccucuccuuugaa

SEQ ID NO: 3596505 - RNA, 13 nt, Human
auccucucuuccu

SEQ ID NO: 3596506 - RNA, 10 nt, Human
auccucuggc

SEQ ID NO: 3596507 - RNA, 14 nt, Human
auccucuggcuggc

SEQ ID NO: 3596508 - RNA, 13 nt, Human
auccucuggcuug

SEQ ID NO: 3596509 - RNA, 13 nt, Human
auccucuguugau

SEQ ID NO: 3596510 - RNA, 22 nt, Human
auccucuuccauauggauccac

SEQ ID NO: 3596511 - RNA, 19 nt, Human
auccucuuccucugaggcu

SEQ ID NO: 3596512 - RNA, 21 nt, Human
auccucuuuagaguuagacug

SEQ ID NO: 3596513 - RNA, 20 nt, Human
auccucuuucucuuuucuag

SEQ ID NO: 3596514 - RNA, 15 nt, Human
auccucuuuuuccaa

SEQ ID NO: 3596515 - RNA, 16 nt, Human
auccugaaauuucaga

SEQ ID NO: 3596516 - RNA, 15 nt, Human
auccugaacagcaug

SEQ ID NO: 3596517 - RNA, 13 nt, Human
auccugaggcucc

SEQ ID NO: 3596518 - RNA, 18 nt, Human
auccugaggcuccacuug

SEQ ID NO: 3596519 - RNA, 22 nt, Human
auccugaggcuccacuuggucu

SEQ ID NO: 3596520 - RNA, 15 nt, Human
auccugauuccucuc

SEQ ID NO: 3596521 - RNA, 17 nt, Human
auccugauuccucucua

SEQ ID NO: 3596522 - RNA, 18 nt, Human
auccugauuccucucuaa

SEQ ID NO: 3596523 - RNA, 17 nt, Human
auccugcacugacucug

SEQ ID NO: 3596524 - RNA, 18 nt, Human
auccugcacugacucugg

SEQ ID NO: 3596525 - RNA, 16 nt, Human
auccugcagccuccuc

SEQ ID NO: 3596526 - RNA, 17 nt, Human
auccugcagccuccucc

SEQ ID NO: 3596527 - RNA, 14 nt, Human
auccugccacccug

SEQ ID NO: 3596528 - RNA, 22 nt, Human
auccugccagccccacacagcu

SEQ ID NO: 3596529 - RNA, 20 nt, Human
augaaaaauuuaagcauugu

SEQ ID NO: 3596530 - RNA, 14 nt, Human
augaaaacacauuu

SEQ ID NO: 3596531 - RNA, 15 nt, Human
augaaaacacauuuu

SEQ ID NO: 3596532 - RNA, 17 nt, Human
augaaaacagaaugucu

SEQ ID NO: 3596533 - RNA, 13 nt, Human
augaaaacaugua

SEQ ID NO: 3596534 - RNA, 20 nt, Human
augaaaacguuuuauugugu

SEQ ID NO: 3596535 - RNA, 17 nt, Human
augaaaacuauacaaca

SEQ ID NO: 3596536 - RNA, 17 nt, Human
augaaaagauucuucug

SEQ ID NO: 3596537 - RNA, 13 nt, Human
augaaaagauuua

SEQ ID NO: 3596538 - RNA, 17 nt, Human
augaaaagccucuguuu

SEQ ID NO: 3596539 - RNA, 18 nt, Human
augaaaaggugauuguca

SEQ ID NO: 3596540 - RNA, 16 nt, Human
augaaaaguauauuga

SEQ ID NO: 3596541 - RNA, 22 nt, Human
augaaaauaacugaauuuggag

SEQ ID NO: 3596542 - RNA, 24 nt, Human
augaaaauaccauuuaguaagaau

SEQ ID NO: 3596543 - RNA, 16 nt, Human
augaaaauauuuaaag

SEQ ID NO: 3596544 - RNA, 17 nt, Human
augaaaauccuaccaac

SEQ ID NO: 3596545 - RNA, 20 nt, Human
augaaaaugcaacaacaugu

SEQ ID NO: 3596546 - RNA, 15 nt, Human
augaaaaugucagaa

SEQ ID NO: 3596547 - RNA, 14 nt, Human
augaaaauuguaug

SEQ ID NO: 3596548 - RNA, 19 nt, Human
augaaacaccuucucugga

SEQ ID NO: 3596549 - RNA, 22 nt, Human
augaaacagaaacaaaaacacu

SEQ ID NO: 3596550 - RNA, 23 nt, Human
augaaaccuuauuuuuucccaaa

SEQ ID NO: 3596551 - RNA, 23 nt, Human
augaaacuagaaagcagagauuu

SEQ ID NO: 3596552 - RNA, 16 nt, Human
augaaacucacaaaug

SEQ ID NO: 3596553 - RNA, 15 nt, Human
augaaagaauauauu

SEQ ID NO: 3596554 - RNA, 15 nt, Human
augaaagacucaaaa

SEQ ID NO: 3596555 - RNA, 12 nt, Human
augaaagacugu

SEQ ID NO: 3596556 - RNA, 20 nt, Human
augaaagacuguacaaagua

SEQ ID NO: 3596557 - RNA, 13 nt, Human
augaaagaggagg

SEQ ID NO: 3596558 - RNA, 23 nt, Human
augaaagauggcugugccucugc

SEQ ID NO: 3596559 - RNA, 22 nt, Human
augaaagcugauuacugucaau

SEQ ID NO: 3596560 - RNA, 15 nt, Human
augaaaggagagcau

SEQ ID NO: 3596561 - RNA, 21 nt, Human
augaaaggcaggccuauuuca

SEQ ID NO: 3596562 - RNA, 15 nt, Human
augaaagggcccaga

SEQ ID NO: 3596563 - RNA, 14 nt, Human
augaaagguacuau

SEQ ID NO: 3596564 - RNA, 20 nt, Human
augaaagguacuauauuugc

SEQ ID NO: 3596565 - RNA, 21 nt, Human
augaaagguacuauauuugcu

SEQ ID NO: 3596566 - RNA, 18 nt, Human
augaaagucuugugacua

SEQ ID NO: 3596567 - RNA, 16 nt, Human
augaaagugagacuuu

SEQ ID NO: 3596568 - RNA, 17 nt, Human
augaaauaaaugcccca

SEQ ID NO: 3596569 - RNA, 13 nt, Human
augaaauauuuuu

SEQ ID NO: 3596570 - RNA, 14 nt, Human
augaaaugacuucu

SEQ ID NO: 3596571 - RNA, 18 nt, Human
augaaaugcauauuugca

SEQ ID NO: 3596572 - RNA, 22 nt, Human
augaaaugcuaugucauuucau

SEQ ID NO: 3596573 - RNA, 16 nt, Human
augaaaugguuaagaa

SEQ ID NO: 3596574 - RNA, 13 nt, Human
augaaauguaugu

SEQ ID NO: 3596575 - RNA, 12 nt, Human
augaaaugugaa

SEQ ID NO: 3596576 - RNA, 13 nt, Human
augaaaugugaau

SEQ ID NO: 3596577 - RNA, 18 nt, Human
augaaaugugaauuuuua

SEQ ID NO: 3596578 - RNA, 15 nt, Human
augaaauguuaacaa

SEQ ID NO: 3596579 - RNA, 15 nt, Human
augaaauuuaaacau

SEQ ID NO: 3596580 - RNA, 16 nt, Human
augaaauuuaaacauu

SEQ ID NO: 3596581 - RNA, 18 nt, Human
augaaauuuaaacauuaa

SEQ ID NO: 3596582 - RNA, 14 nt, Human
augaaauuuuacca

SEQ ID NO: 3596583 - RNA, 16 nt, Human
augaaauuuuaccaag

SEQ ID NO: 3596584 - RNA, 20 nt, Human
augaaauuuuaccaaguuau

SEQ ID NO: 3596585 - RNA, 21 nt, Human
augaaauuuucuagacuuucu

SEQ ID NO: 3596586 - RNA, 23 nt, Human
augaaauuuucuagacuuucugu

SEQ ID NO: 3596587 - RNA, 17 nt, Human
augaaauuuuuguaaau

SEQ ID NO: 3596588 - RNA, 16 nt, Human
augaacaaaauuauuu

SEQ ID NO: 3596589 - RNA, 19 nt, Human
augaacaaagaccaauuuu

SEQ ID NO: 3596590 - RNA, 18 nt, Human
augaacaagagaagcauu

SEQ ID NO: 3596591 - RNA, 13 nt, Human
augaacaaguuuu

SEQ ID NO: 3596592 - RNA, 14 nt, Human
augaacaaguuuua

SEQ ID NO: 3596593 - RNA, 15 nt, Human
augaacaaguuuuaa

SEQ ID NO: 3596594 - RNA, 13 nt, Human
augaacacaaauu

SEQ ID NO: 3596595 - RNA, 22 nt, Human
augaacacacuguguccuggug

SEQ ID NO: 3596596 - RNA, 17 nt, Human
augaacacccuuagaaa

SEQ ID NO: 3596597 - RNA, 21 nt, Human
augaacagaacauagacagaa

SEQ ID NO: 3596598 - RNA, 18 nt, Human
augaacauguacuguucu

SEQ ID NO: 3596599 - RNA, 20 nt, Human
augaaccacaucuugcucug

SEQ ID NO: 3596600 - RNA, 15 nt, Human
augaaccauaaauuc

SEQ ID NO: 3596601 - RNA, 21 nt, Human
augaacccaggacgcuucuga

SEQ ID NO: 3596602 - RNA, 21 nt, Human
augaacccuuccugagcuuua

SEQ ID NO: 3596603 - RNA, 20 nt, Human
augaacuauuccccagcagg

SEQ ID NO: 3596604 - RNA, 12 nt, Human
augaacugaaag

SEQ ID NO: 3596605 - RNA, 14 nt, Human
augaacugaaguuu

SEQ ID NO: 3596606 - RNA, 15 nt, Human
augaacugaaguuuc

SEQ ID NO: 3596607 - RNA, 18 nt, Human
augaacuggaggccagga

SEQ ID NO: 3596608 - RNA, 22 nt, Human
augaacuuagauuuuacaugaa

SEQ ID NO: 3596609 - RNA, 15 nt, Human
augaacuuauuaaua

SEQ ID NO: 3596610 - RNA, 16 nt, Human
augaacuuauucugua

SEQ ID NO: 3596611 - RNA, 13 nt, Human
augaacuugagga

SEQ ID NO: 3596612 - RNA, 18 nt, Human
augaacuugaggacacau

SEQ ID NO: 3596613 - RNA, 19 nt, Human
augaacuugaggacacaug

SEQ ID NO: 3596614 - RNA, 17 nt, Human
augaacuuucucuucau

SEQ ID NO: 3596615 - RNA, 15 nt, Human
augaagaaaaaauac

SEQ ID NO: 3596616 - RNA, 20 nt, Human
augaagaaaaaauacauuuu

SEQ ID NO: 3596617 - RNA, 19 nt, Human
augaagaaaagugggccag

SEQ ID NO: 3596618 - RNA, 21 nt, Human
augaagaaaauacuuaaaugu

SEQ ID NO: 3596619 - RNA, 19 nt, Human
augaagaaaaucacuuagg

SEQ ID NO: 3596620 - RNA, 15 nt, Human
augaagaacauaaaa

SEQ ID NO: 3596621 - RNA, 14 nt, Human
augaagaacugagg

SEQ ID NO: 3596622 - RNA, 18 nt, Human
augaagaauagaaacaag

SEQ ID NO: 3596623 - RNA, 20 nt, Human
augaagacaauuuugauuua

SEQ ID NO: 3596624 - RNA, 22 nt, Human
augaagaccuuuuucugcacua

SEQ ID NO: 3596625 - RNA, 15 nt, Human
augaagagaagcaau

SEQ ID NO: 3596626 - RNA, 15 nt, Human
augaagagcaaaaau

SEQ ID NO: 3596627 - RNA, 17 nt, Human
augaagagcuagagaaa

SEQ ID NO: 3596628 - RNA, 19 nt, Human
augaagagugagagggcau

SEQ ID NO: 3596629 - RNA, 16 nt, Human
augaagauacugaaau

SEQ ID NO: 3596630 - RNA, 17 nt, Human
augaagauacugaaaua

SEQ ID NO: 3596631 - RNA, 20 nt, Human
augaagaucauauacgugaa

SEQ ID NO: 3596632 - RNA, 22 nt, Human
augaagauucuccugugcuaga

SEQ ID NO: 3596633 - RNA, 21 nt, Human
augaagauuggugggauuuuu

SEQ ID NO: 3596634 - RNA, 13 nt, Human
augaagcaaggaa

SEQ ID NO: 3596635 - RNA, 15 nt, Human
augaagcaaggaaga

SEQ ID NO: 3596636 - RNA, 13 nt, Human
augaagcagcuuu

SEQ ID NO: 3596637 - RNA, 18 nt, Human
augaagccgaccuuagau

SEQ ID NO: 3596638 - RNA, 22 nt, Human
augaagccuguggaugaucaau

SEQ ID NO: 3596639 - RNA, 14 nt, Human
augaagccuuuuga

SEQ ID NO: 3596640 - RNA, 17 nt, Human
augaagccuuuugaaag

SEQ ID NO: 3596641 - RNA, 20 nt, Human
augaagccuuuugaaaggga

SEQ ID NO: 3596642 - RNA, 14 nt, Human
augaagcuaccuca

SEQ ID NO: 3596643 - RNA, 19 nt, Human
augaagcuuguguauccau

SEQ ID NO: 3596644 - RNA, 15 nt, Human
augaagguaaauaaa

SEQ ID NO: 3596645 - RNA, 18 nt, Human
augaaggugucauacaga

SEQ ID NO: 3596646 - RNA, 22 nt, Human
augaagguuaggauuuaacagu

SEQ ID NO: 3596647 - RNA, 15 nt, Human
aucguuaugugugua

SEQ ID NO: 3596648 - RNA, 14 nt, Human
aucguucucugccu

SEQ ID NO: 3596649 - RNA, 15 nt, Human
aucguuuuuguauuu

SEQ ID NO: 3596650 - RNA, 16 nt, Human
aucuaaaaauaacugu

SEQ ID NO: 3596651 - RNA, 23 nt, Human
aucuaaaaauagacuuaaaucuc

SEQ ID NO: 3596652 - RNA, 23 nt, Human
aucuaaaaauauacauguuuaug

SEQ ID NO: 3596653 - RNA, 15 nt, Human
aucuaaaguguguug

SEQ ID NO: 3596654 - RNA, 13 nt, Human
aucuaaaguuugu

SEQ ID NO: 3596655 - RNA, 17 nt, Human
aucuaaauaaaaugcua

SEQ ID NO: 3596656 - RNA, 18 nt, Human
aucuaaauaccugcccug

SEQ ID NO: 3596657 - RNA, 22 nt, Human
aucuaaauauggacugcucagg

SEQ ID NO: 3596658 - RNA, 16 nt, Human
aucuaaaucuauuuau

SEQ ID NO: 3596659 - RNA, 18 nt, Human
aucuaaaucuauuuauua

SEQ ID NO: 3596660 - RNA, 19 nt, Human
aucuaaauggaaccacucu

SEQ ID NO: 3596661 - RNA, 15 nt, Human
aucuaaauugaauaa

SEQ ID NO: 3596662 - RNA, 16 nt, Human
aucuaaauugaauaau

SEQ ID NO: 3596663 - RNA, 17 nt, Human
aucuaaauuuagaaauc

SEQ ID NO: 3596664 - RNA, 15 nt, Human
aucuaacaauggaag

SEQ ID NO: 3596665 - RNA, 14 nt, Human
aucuaacauuauua

SEQ ID NO: 3596666 - RNA, 16 nt, Human
aucuaacauuauuacu

SEQ ID NO: 3596667 - RNA, 14 nt, Human
aucuaaccacauca

SEQ ID NO: 3596668 - RNA, 13 nt, Human
aucuaaccucauc

SEQ ID NO: 3596669 - RNA, 18 nt, Human
aucuaagaauaauaaaau

SEQ ID NO: 3596670 - RNA, 14 nt, Human
aucuaagcugcagc

SEQ ID NO: 3596671 - RNA, 18 nt, Human
aucuaagcugcagcuucc

SEQ ID NO: 3596672 - RNA, 18 nt, Human
aucuaaggaugucacagg

SEQ ID NO: 3596673 - RNA, 17 nt, Human
aucuaaggcuguuugcu

SEQ ID NO: 3596674 - RNA, 21 nt, Human
aucuaagugccucacauuuuu

SEQ ID NO: 3596675 - RNA, 20 nt, Human
aucuaauauauaugaauaaa

SEQ ID NO: 3596676 - RNA, 15 nt, Human
aucuaauucuuuaau

SEQ ID NO: 3596677 - RNA, 13 nt, Human
aucuaauuuauaa

SEQ ID NO: 3596678 - RNA, 12 nt, Human
aucuaauuucaa

SEQ ID NO: 3596679 - RNA, 14 nt, Human
aucuacaucuuuuu

SEQ ID NO: 3596680 - RNA, 20 nt, Human
aucuacaucuuuuuucacaa

SEQ ID NO: 3596681 - RNA, 21 nt, Human
aucuacaucuuuuuucacaaa

SEQ ID NO: 3596682 - RNA, 12 nt, Human
aucuaccaacuu

SEQ ID NO: 3596683 - RNA, 15 nt, Human
aucuaccaacuuuca

SEQ ID NO: 3596684 - RNA, 17 nt, Human
augaaucugauuuuuau

SEQ ID NO: 3596685 - RNA, 16 nt, Human
augaaucugcucacuu

SEQ ID NO: 3596686 - RNA, 18 nt, Human
augaaucugcucacuuua

SEQ ID NO: 3596687 - RNA, 24 nt, Human
augaaucugucucccaguuaugaa

SEQ ID NO: 3596688 - RNA, 23 nt, Human
augaaucuuuguuucagguucag

SEQ ID NO: 3596689 - RNA, 16 nt, Human
augaaucuuuuccacu

SEQ ID NO: 3596690 - RNA, 14 nt, Human
augaaugaaugaau

SEQ ID NO: 3596691 - RNA, 16 nt, Human
augaaugagaaucuac

SEQ ID NO: 3596692 - RNA, 15 nt, Human
augaaugauuugcau

SEQ ID NO: 3596693 - RNA, 17 nt, Human
augaaugauuugcauau

SEQ ID NO: 3596694 - RNA, 13 nt, Human
augaaugcccagu

SEQ ID NO: 3596695 - RNA, 16 nt, Human
augaaugcuuuuagug

SEQ ID NO: 3596696 - RNA, 23 nt, Human
augaauggcuaagcaaaauguga

SEQ ID NO: 3596697 - RNA, 17 nt, Human
augaaugggcaaaacug

SEQ ID NO: 3596698 - RNA, 18 nt, Human
augaaugggcaaaacuga

SEQ ID NO: 3596699 - RNA, 21 nt, Human
augaaugggcugagcugccug

SEQ ID NO: 3596700 - RNA, 21 nt, Human
augaaugguauggaacucucu

SEQ ID NO: 3596701 - RNA, 15 nt, Human
augaauguaaauuug

SEQ ID NO: 3596702 - RNA, 13 nt, Human
augaauguaucag

SEQ ID NO: 3596703 - RNA, 18 nt, Human
augaaugucagugugacu

SEQ ID NO: 3596704 - RNA, 20 nt, Human
augaaugucagugugacuga

SEQ ID NO: 3596705 - RNA, 21 nt, Human
augaaugugugugguuuuuuu

SEQ ID NO: 3596706 - RNA, 13 nt, Human
augaauguuccug

SEQ ID NO: 3596707 - RNA, 11 nt, Human
augaauguuua

SEQ ID NO: 3596708 - RNA, 14 nt, Human
augaauuaaagugg

SEQ ID NO: 3596709 - RNA, 13 nt, Human
augaauuaaauuu

SEQ ID NO: 3596710 - RNA, 16 nt, Human
augaauuacauuugua

SEQ ID NO: 3596711 - RNA, 17 nt, Human
augaauuacauuuguau

SEQ ID NO: 3596712 - RNA, 19 nt, Human
augaauuacauuuguauaa

SEQ ID NO: 3596713 - RNA, 23 nt, Human
augaauuaguuuuauaugcuucu

SEQ ID NO: 3596714 - RNA, 15 nt, Human
augaauuauuacagu

SEQ ID NO: 3596715 - RNA, 13 nt, Human
augaauuguacag

SEQ ID NO: 3596716 - RNA, 14 nt, Human
augaauuguacaga

SEQ ID NO: 3596717 - RNA, 13 nt, Human
augaauuuaaaua

SEQ ID NO: 3596718 - RNA, 12 nt, Human
augaauuuagug

SEQ ID NO: 3596719 - RNA, 22 nt, Human
augaauuuauugcacauuguuc

SEQ ID NO: 3596720 - RNA, 13 nt, Human
augaauuucucua

SEQ ID NO: 3596721 - RNA, 20 nt, Human
augaauuuggagacucugug

SEQ ID NO: 3596722 - RNA, 15 nt, Human
augaauuuuaaagua

SEQ ID NO: 3596723 - RNA, 16 nt, Human
augaauuuuaaaguau

SEQ ID NO: 3596724 - RNA, 13 nt, Human
augaauuuuacau

SEQ ID NO: 3596725 - RNA, 17 nt, Human
augaauuuuagcuuuug

SEQ ID NO: 3596726 - RNA, 23 nt, Human
augaauuuuguuuggacuucuuu

SEQ ID NO: 3596727 - RNA, 20 nt, Human
augaauuuuuuuauuucugu

SEQ ID NO: 3596728 - RNA, 22 nt, Human
augaauuuuuuucaucuucucu

SEQ ID NO: 3596729 - RNA, 14 nt, Human
augacaaaaaaugu

SEQ ID NO: 3596730 - RNA, 14 nt, Human
augacaacagaagc

SEQ ID NO: 3596731 - RNA, 19 nt, Human
augacaacagaagcuucag

SEQ ID NO: 3596732 - RNA, 14 nt, Human
augacaacuucuaa

SEQ ID NO: 3596733 - RNA, 18 nt, Human
augacaacuucuaauugc

SEQ ID NO: 3596734 - RNA, 18 nt, Human
augacaagccccaggcag

SEQ ID NO: 3596735 - RNA, 17 nt, Human
augacaaucaugugugu

SEQ ID NO: 3596736 - RNA, 15 nt, Human
augacaaugacugug

SEQ ID NO: 3596737 - RNA, 22 nt, Human
augacaccaucuuuuauucuuu

SEQ ID NO: 3596738 - RNA, 22 nt, Human
augacacccgugagcgccugug

SEQ ID NO: 3596739 - RNA, 19 nt, Human
augacacgaauauugcuga

SEQ ID NO: 3596740 - RNA, 14 nt, Human
augacacugaaaug

SEQ ID NO: 3596741 - RNA, 16 nt, Human
augacacugaaaugcc

SEQ ID NO: 3596742 - RNA, 12 nt, Human
augacagagcga

SEQ ID NO: 3596743 - RNA, 21 nt, Human
augacagcugucccugucacc

SEQ ID NO: 3596744 - RNA, 17 nt, Human
augacaggauguuugcu

SEQ ID NO: 3596745 - RNA, 17 nt, Human
augacaggccugaagau

SEQ ID NO: 3596746 - RNA, 19 nt, Human
augacaggccugaagauau

SEQ ID NO: 3596747 - RNA, 23 nt, Human
augacaggccugaagauauuacu

SEQ ID NO: 3596748 - RNA, 24 nt, Human
augacaggccugaagauauuacua

SEQ ID NO: 3596749 - RNA, 21 nt, Human
augacaguaauuguguuuaca

SEQ ID NO: 3596750 - RNA, 13 nt, Human
augacaucuuuuu

SEQ ID NO: 3596751 - RNA, 14 nt, Human
augacaucuuuuua

SEQ ID NO: 3596752 - RNA, 15 nt, Human
augacaucuuuuuaa

SEQ ID NO: 3596753 - RNA, 21 nt, Human
augacaugaauuuuagcuuuu

SEQ ID NO: 3596754 - RNA, 13 nt, Human
augacauugcuaa

SEQ ID NO: 3596755 - RNA, 23 nt, Human
augacauugcuaagaugcucuau

SEQ ID NO: 3596756 - RNA, 19 nt, Human
augacauuguuaaaauaaa

SEQ ID NO: 3596757 - RNA, 22 nt, Human
augacauuuauaucacauguuu

SEQ ID NO: 3596758 - RNA, 21 nt, Human
augacauuucuuugugcuuug

SEQ ID NO: 3596759 - RNA, 14 nt, Human
augacauuuugcca

SEQ ID NO: 3596760 - RNA, 17 nt, Human
augacauuuugccaaaa

SEQ ID NO: 3596761 - RNA, 23 nt, Human
augaccaauauuauacuaagaaa

SEQ ID NO: 3596762 - RNA, 17 nt, Human
augaccaauuuuaacuu

SEQ ID NO: 3596763 - RNA, 14 nt, Human
augaccacaccugc

SEQ ID NO: 3596764 - RNA, 15 nt, Human
augaccacacuccag

SEQ ID NO: 3596765 - RNA, 19 nt, Human
augaccacuuuuuagaaag

SEQ ID NO: 3596766 - RNA, 18 nt, Human
augaccagaugcguccca

SEQ ID NO: 3596767 - RNA, 20 nt, Human
augaccauaaaauuagacau

SEQ ID NO: 3596768 - RNA, 17 nt, Human
augaccauacugaggga

SEQ ID NO: 3596769 - RNA, 12 nt, Human
augacccacccc

SEQ ID NO: 3596770 - RNA, 17 nt, Human
augacccaccccugugc

SEQ ID NO: 3596771 - RNA, 19 nt, Human
augacccaccccugugcuc

SEQ ID NO: 3596772 - RNA, 18 nt, Human
augacccaggcugccuga

SEQ ID NO: 3596773 - RNA, 14 nt, Human
augacccaggcugg

SEQ ID NO: 3596774 - RNA, 16 nt, Human
augacccaggcugggc

SEQ ID NO: 3596775 - RNA, 22 nt, Human
augacccaggcugggcaaggag

SEQ ID NO: 3596776 - RNA, 14 nt, Human
augacccugccucu

SEQ ID NO: 3596777 - RNA, 20 nt, Human
augacccugccucucccagg

SEQ ID NO: 3596778 - RNA, 23 nt, Human
augacccugcgaaggggcccugg

SEQ ID NO: 3596779 - RNA, 14 nt, Human
augacccuuuucau

SEQ ID NO: 3596780 - RNA, 18 nt, Human
augaccuaguuuuccaug

SEQ ID NO: 3596781 - RNA, 16 nt, Human
augaccucaugcaucu

SEQ ID NO: 3596782 - RNA, 13 nt, Human
augaccuccagcu

SEQ ID NO: 3596783 - RNA, 19 nt, Human
augaccuccagcuuuccug

SEQ ID NO: 3596784 - RNA, 18 nt, Human
augaccucuuccuuuagg

SEQ ID NO: 3596785 - RNA, 21 nt, Human
augaccugugaccagcacugu

SEQ ID NO: 3596786 - RNA, 18 nt, Human
augaccuucuaggaagcu

SEQ ID NO: 3596787 - RNA, 21 nt, Human
augaccuuucaauaggaaaaa

SEQ ID NO: 3596788 - RNA, 16 nt, Human
augacgacaaagcugc

SEQ ID NO: 3596789 - RNA, 23 nt, Human
augacgacaaagcugcuaaaucu

SEQ ID NO: 3596790 - RNA, 16 nt, Human
augacggaagaacaua

SEQ ID NO: 3596791 - RNA, 23 nt, Human
augacguacaaguaguucuguau

SEQ ID NO: 3596792 - RNA, 22 nt, Human
aucuucccuagaggguuccugu

SEQ ID NO: 3596793 - RNA, 16 nt, Human
aucuuccucugcuaaa

SEQ ID NO: 3596794 - RNA, 19 nt, Human
aucuuccucugcuaaauug

SEQ ID NO: 3596795 - RNA, 20 nt, Human
aucuuccucugcuaaauuga

SEQ ID NO: 3596796 - RNA, 19 nt, Human
aucuuccuggucgaaaguu

SEQ ID NO: 3596797 - RNA, 22 nt, Human
aucuuccuggucgaaaguuagu

SEQ ID NO: 3596798 - RNA, 13 nt, Human
aucuuccuguguc

SEQ ID NO: 3596799 - RNA, 18 nt, Human
aucuucgggaccaggauu

SEQ ID NO: 3596800 - RNA, 16 nt, Human
aucuucucaaguucua

SEQ ID NO: 3596801 - RNA, 18 nt, Human
aucuucucaaguucuaag

SEQ ID NO: 3596802 - RNA, 20 nt, Human
aucuucucaaguucuaagau

SEQ ID NO: 3596803 - RNA, 16 nt, Human
aucuucucacucccuu

SEQ ID NO: 3596804 - RNA, 24 nt, Human
aucuucucagaaggcaaaugacuu

SEQ ID NO: 3596805 - RNA, 14 nt, Human
aucuucucuggcga

SEQ ID NO: 3596806 - RNA, 17 nt, Human
aucuucugcaauugcuu

SEQ ID NO: 3596807 - RNA, 14 nt, Human
aucuucugccuucu

SEQ ID NO: 3596808 - RNA, 22 nt, Human
aucuucugguuuaaacuuguuu

SEQ ID NO: 3596809 - RNA, 20 nt, Human
aucuucuuaugcaauuuccu

SEQ ID NO: 3596810 - RNA, 14 nt, Human
aucuucuuuauaau

SEQ ID NO: 3596811 - RNA, 14 nt, Human
aucuucuuugcagc

SEQ ID NO: 3596812 - RNA, 12 nt, Human
aucuugaaauua

SEQ ID NO: 3596813 - RNA, 23 nt, Human
aucuugaaauuaagaaggcaaaa

SEQ ID NO: 3596814 - RNA, 18 nt, Human
aucuugaagacuuuucuu

SEQ ID NO: 3596815 - RNA, 14 nt, Human
aucuugaagggccc

SEQ ID NO: 3596816 - RNA, 17 nt, Human
aucuugaagggcccagg

SEQ ID NO: 3596817 - RNA, 18 nt, Human
aucuugaauaauguaaga

SEQ ID NO: 3596818 - RNA, 19 nt, Human
aucuugaauguggucucag

SEQ ID NO: 3596819 - RNA, 20 nt, Human
aucuugaauguggucucagg

SEQ ID NO: 3596820 - RNA, 17 nt, Human
aucuugaauuguaagga

SEQ ID NO: 3596821 - RNA, 22 nt, Human
aucuugaccaagcaggaagcuc

SEQ ID NO: 3596822 - RNA, 16 nt, Human
aucuugacucacugca

SEQ ID NO: 3596823 - RNA, 20 nt, Human
aucuugauacauucaaauuu

SEQ ID NO: 3596824 - RNA, 21 nt, Human
aucuugauacauucaaauuug

SEQ ID NO: 3596825 - RNA, 13 nt, Human
aucuugcauguaa

SEQ ID NO: 3596826 - RNA, 23 nt, Human
aucuugcgaauccaagcucccug

SEQ ID NO: 3596827 - RNA, 20 nt, Human
aucuugcucuaucucacagc

SEQ ID NO: 3596828 - RNA, 21 nt, Human
aucuugcucuaucucacagca

SEQ ID NO: 3596829 - RNA, 23 nt, Human
aucuugcucuaucucacagcaca

SEQ ID NO: 3596830 - RNA, 17 nt, Human
aucuugcucucuuuuau

SEQ ID NO: 3596831 - RNA, 13 nt, Human
aucuugcucugcu

SEQ ID NO: 3596832 - RNA, 16 nt, Human
aucuugcucuguaauc

SEQ ID NO: 3596833 - RNA, 23 nt, Human
aucuugcuuuuuuucaccaauau

SEQ ID NO: 3596834 - RNA, 16 nt, Human
aucuuggacaaaucac

SEQ ID NO: 3596835 - RNA, 17 nt, Human
aucuuggagacccugca

SEQ ID NO: 3596836 - RNA, 21 nt, Human
aucuuggauagcuaauaauga

SEQ ID NO: 3596837 - RNA, 18 nt, Human
aucuuggcagguaggaau

SEQ ID NO: 3596838 - RNA, 21 nt, Human
aucuuggcuauguaauucuug

SEQ ID NO: 3596839 - RNA, 17 nt, Human
aucuugggacuggguuu

SEQ ID NO: 3596840 - RNA, 23 nt, Human
aucuuggggacaucucuuugaau

SEQ ID NO: 3596841 - RNA, 23 nt, Human
aucuuggggggguggccgcugag

SEQ ID NO: 3596842 - RNA, 21 nt, Human
aucuugguuugccuuccagaa

SEQ ID NO: 3596843 - RNA, 18 nt, Human
aucuuguagcuuuaucaa

SEQ ID NO: 3596844 - RNA, 19 nt, Human
aucuuguagcuuuaucaaa

SEQ ID NO: 3596845 - RNA, 16 nt, Human
aucuuguauacacaua

SEQ ID NO: 3596846 - RNA, 11 nt, Human
aucuugucaug

SEQ ID NO: 3596847 - RNA, 15 nt, Human
aucuugucaugugua

SEQ ID NO: 3596848 - RNA, 16 nt, Human
aucuugucauguguau

SEQ ID NO: 3596849 - RNA, 17 nt, Human
aucuugucauguguaua

SEQ ID NO: 3596850 - RNA, 13 nt, Human
aucuugucucaau

SEQ ID NO: 3596851 - RNA, 15 nt, Human
aucuugugaaaauaa

SEQ ID NO: 3596852 - RNA, 14 nt, Human
aucuuguucaggaa

SEQ ID NO: 3596853 - RNA, 16 nt, Human
aucuuguuucugaaaa

SEQ ID NO: 3596854 - RNA, 20 nt, Human
aucuuuaaaagaugcuuuua

SEQ ID NO: 3596855 - RNA, 15 nt, Human
aucuuuaaaauacac

SEQ ID NO: 3596856 - RNA, 14 nt, Human
aucuuuaagaaaaa

SEQ ID NO: 3596857 - RNA, 13 nt, Human
aucuuuaauuaaa

SEQ ID NO: 3596858 - RNA, 17 nt, Human
aucuuuaccuguauaca

SEQ ID NO: 3596859 - RNA, 16 nt, Human
aucuuuagaaaaggca

SEQ ID NO: 3596860 - RNA, 15 nt, Human
aucuuuauaaaugua

SEQ ID NO: 3596861 - RNA, 14 nt, Human
aucuuuauuaauca

SEQ ID NO: 3596862 - RNA, 15 nt, Human
aucuuuauugaaauu

SEQ ID NO: 3596863 - RNA, 19 nt, Human
aucuuucacccacagaaag

SEQ ID NO: 3596864 - RNA, 20 nt, Human
aucuuucacccacagaaaga

SEQ ID NO: 3596865 - RNA, 17 nt, Human
aucuuucagaaauauaa

SEQ ID NO: 3596866 - RNA, 19 nt, Human
aucuuucauuaaaggcuuc

SEQ ID NO: 3596867 - RNA, 20 nt, Human
aucuuucauuaaaggcuucu

SEQ ID NO: 3596868 - RNA, 12 nt, Human
aucuuucccucc

SEQ ID NO: 3596869 - RNA, 16 nt, Human
aucuuucccuccuugg

SEQ ID NO: 3596870 - RNA, 17 nt, Human
aucuuucgcacagcagu

SEQ ID NO: 3596871 - RNA, 14 nt, Human
aucuuucugcacac

SEQ ID NO: 3596872 - RNA, 22 nt, Human
aucuuucuucuauuuuauuccc

SEQ ID NO: 3596873 - RNA, 18 nt, Human
aucuuucuugaucaacau

SEQ ID NO: 3596874 - RNA, 14 nt, Human
aucuuucuuuaccu

SEQ ID NO: 3596875 - RNA, 17 nt, Human
aucuuucuuucuuagaa

SEQ ID NO: 3596876 - RNA, 20 nt, Human
aucuuucuuucuuagaaauu

SEQ ID NO: 3596877 - RNA, 16 nt, Human
aucuuugaaauuaugu

SEQ ID NO: 3596878 - RNA, 21 nt, Human
aucuuugauguguuguucuug

SEQ ID NO: 3596879 - RNA, 19 nt, Human
aucuuugauucuccuucag

SEQ ID NO: 3596880 - RNA, 20 nt, Human
augcacugugaaggacccuu

SEQ ID NO: 3596881 - RNA, 22 nt, Human
augcacuuucuauccucuguaa

SEQ ID NO: 3596882 - RNA, 20 nt, Human
augcacuuugcuuuaauaua

SEQ ID NO: 3596883 - RNA, 22 nt, Human
augcacuuugcuuuaauauaaa

SEQ ID NO: 3596884 - RNA, 17 nt, Human
augcacuuuguucuggc

SEQ ID NO: 3596885 - RNA, 21 nt, Human
augcacuuuguucuggcucuu

SEQ ID NO: 3596886 - RNA, 23 nt, Human
augcacuuuguucuggcucuucc

SEQ ID NO: 3596887 - RNA, 18 nt, Human
augcagaaauagacaaaa

SEQ ID NO: 3596888 - RNA, 15 nt, Human
augcagaacaaauga

SEQ ID NO: 3596889 - RNA, 14 nt, Human
augcagaauacuuu

SEQ ID NO: 3596890 - RNA, 17 nt, Human
augcagaauggcauuug

SEQ ID NO: 3596891 - RNA, 21 nt, Human
augcagaauguugauuacagu

SEQ ID NO: 3596892 - RNA, 13 nt, Human
augcagagagcca

SEQ ID NO: 3596893 - RNA, 14 nt, Human
augcagagagccau

SEQ ID NO: 3596894 - RNA, 16 nt, Human
augcagagagccauuu

SEQ ID NO: 3596895 - RNA, 18 nt, Human
augcagagguccacaaca

SEQ ID NO: 3596896 - RNA, 16 nt, Human
augcagagucagcaga

SEQ ID NO: 3596897 - RNA, 12 nt, Human
augcagaugcca

SEQ ID NO: 3596898 - RNA, 13 nt, Human
augcagcagcuug

SEQ ID NO: 3596899 - RNA, 20 nt, Human
augcagcagggaugcccugg

SEQ ID NO: 3596900 - RNA, 15 nt, Human
augcagcauuugaua

SEQ ID NO: 3596901 - RNA, 16 nt, Human
augcagcauuugauaa

SEQ ID NO: 3596902 - RNA, 11 nt, Human
augcagcccau

SEQ ID NO: 3596903 - RNA, 23 nt, Human
augcagcccaugcccaccugccc

SEQ ID NO: 3596904 - RNA, 16 nt, Human
augcagcccauuucuc

SEQ ID NO: 3596905 - RNA, 19 nt, Human
augcagccgccuuccuuga

SEQ ID NO: 3596906 - RNA, 21 nt, Human
augcagccgugaucaagggaa

SEQ ID NO: 3596907 - RNA, 13 nt, Human
augcagccucaca

SEQ ID NO: 3596908 - RNA, 17 nt, Human
augcagccucacagucc

SEQ ID NO: 3596909 - RNA, 18 nt, Human
augcagccucacaguccu

SEQ ID NO: 3596910 - RNA, 23 nt, Human
augcagcucaacuuucuguugga

SEQ ID NO: 3596911 - RNA, 14 nt, Human
augcagcucuuccu

SEQ ID NO: 3596912 - RNA, 21 nt, Human
augcagcugcacccucccucc

SEQ ID NO: 3596913 - RNA, 16 nt, Human
augcagcuuauacgaa

SEQ ID NO: 3596914 - RNA, 19 nt, Human
augcaggauuuguucucug

SEQ ID NO: 3596915 - RNA, 21 nt, Human
augcaggcacuuauuguaaau

SEQ ID NO: 3596916 - RNA, 22 nt, Human
augcaggcacuuauuguaaauu

SEQ ID NO: 3596917 - RNA, 12 nt, Human
augcaggcccuu

SEQ ID NO: 3596918 - RNA, 22 nt, Human
augcaggcccuuugaagccuca

SEQ ID NO: 3596919 - RNA, 15 nt, Human
augcaggcuccccug

SEQ ID NO: 3596920 - RNA, 20 nt, Human
augcagggauugcugccacu

SEQ ID NO: 3596921 - RNA, 13 nt, Human
augcagggcaguc

SEQ ID NO: 3596922 - RNA, 17 nt, Human
augcaggugaaacccag

SEQ ID NO: 3596923 - RNA, 19 nt, Human
augcaguacaggacauaua

SEQ ID NO: 3596924 - RNA, 20 nt, Human
augcaguacaggacauauau

SEQ ID NO: 3596925 - RNA, 13 nt, Human
augcagucuccuc

SEQ ID NO: 3596926 - RNA, 15 nt, Human
augcagucuccucuu

SEQ ID NO: 3596927 - RNA, 17 nt, Human
augcagucuccucuuua

SEQ ID NO: 3596928 - RNA, 18 nt, Human
augcagucuccucuuuaa

SEQ ID NO: 3596929 - RNA, 20 nt, Human
augcagucuccucuuuaaaa

SEQ ID NO: 3596930 - RNA, 19 nt, Human
augcagucuguccaggcuc

SEQ ID NO: 3596931 - RNA, 21 nt, Human
augcagucuuagaucauaguu

SEQ ID NO: 3596932 - RNA, 19 nt, Human
augcagugauauggcagaa

SEQ ID NO: 3596933 - RNA, 23 nt, Human
augcagugauauggcagaagaca

SEQ ID NO: 3596934 - RNA, 13 nt, Human
augcagugcucgc

SEQ ID NO: 3596935 - RNA, 19 nt, Human
augcagugcucgcuguugc

SEQ ID NO: 3596936 - RNA, 21 nt, Human
augcagugcucgcuguugcug

SEQ ID NO: 3596937 - RNA, 13 nt, Human
augcagugcuucc

SEQ ID NO: 3596938 - RNA, 23 nt, Human
augcagugguaugaucacggcuc

SEQ ID NO: 3596939 - RNA, 17 nt, Human
augcaguucugaagaag

SEQ ID NO: 3596940 - RNA, 16 nt, Human
augcaguugucucugu

SEQ ID NO: 3596941 - RNA, 18 nt, Human
augcaguugucucuguuu

SEQ ID NO: 3596942 - RNA, 23 nt, Human
augcaguuugaaauucugaauuu

SEQ ID NO: 3596943 - RNA, 15 nt, Human
augcauaaagucagu

SEQ ID NO: 3596944 - RNA, 17 nt, Human
augcauaaauaugcagu

SEQ ID NO: 3596945 - RNA, 14 nt, Human
augcauaaaugcau

SEQ ID NO: 3596946 - RNA, 12 nt, Human
augcauaacuga

SEQ ID NO: 3596947 - RNA, 19 nt, Human
augcauaacugacaaauca

SEQ ID NO: 3596948 - RNA, 21 nt, Human
augcauaauaauccugcaaag

SEQ ID NO: 3596949 - RNA, 10 nt, Human
augcauacac

SEQ ID NO: 3596950 - RNA, 11 nt, Human
augcauacaca

SEQ ID NO: 3596951 - RNA, 12 nt, Human
augcauacacac

SEQ ID NO: 3596952 - RNA, 15 nt, Human
augcauacacacaca

SEQ ID NO: 3596953 - RNA, 17 nt, Human
augcauacacacacaca

SEQ ID NO: 3596954 - RNA, 17 nt, Human
augcauacauacacaua

SEQ ID NO: 3596955 - RNA, 22 nt, Human
augcauaguucccauguuaaau

SEQ ID NO: 3596956 - RNA, 16 nt, Human
augcauauauauaugu

SEQ ID NO: 3596957 - RNA, 20 nt, Human
augcauauauauaugugugu

SEQ ID NO: 3596958 - RNA, 22 nt, Human
augcauaugucacuagaaugga

SEQ ID NO: 3596959 - RNA, 24 nt, Human
augcauauuauuuuauguugcaua

SEQ ID NO: 3596960 - RNA, 18 nt, Human
augcaucagaaagggagg

SEQ ID NO: 3596961 - RNA, 22 nt, Human
augcauccauuccucagggaca

SEQ ID NO: 3596962 - RNA, 23 nt, Human
augcauccauuccucagggacag

SEQ ID NO: 3596963 - RNA, 14 nt, Human
augcaucuccaccu

SEQ ID NO: 3596964 - RNA, 18 nt, Human
augcaucuuacugaaggu

SEQ ID NO: 3596965 - RNA, 13 nt, Human
augcaucuuugau

SEQ ID NO: 3596966 - RNA, 13 nt, Human
augcaugaacaag

SEQ ID NO: 3596967 - RNA, 21 nt, Human
augcaugaacaaguuuuaaug

SEQ ID NO: 3596968 - RNA, 15 nt, Human
augcaugcuuuccau

SEQ ID NO: 3596969 - RNA, 19 nt, Human
augcaugcuuuccauauuu

SEQ ID NO: 3596970 - RNA, 21 nt, Human
augcaugcuuuccauauuuuu

SEQ ID NO: 3596971 - RNA, 12 nt, Human
augcauggaaac

SEQ ID NO: 3596972 - RNA, 23 nt, Human
augcauggaaaccugaaaaaaag

SEQ ID NO: 3596973 - RNA, 16 nt, Human
augcauggaaauuccc

SEQ ID NO: 3596974 - RNA, 23 nt, Human
augcauggugcaguugacagcag

SEQ ID NO: 3596975 - RNA, 17 nt, Human
augcaugguuucagcac

SEQ ID NO: 3596976 - RNA, 19 nt, Human
augcaugguuucagcacua

SEQ ID NO: 3596977 - RNA, 19 nt, Human
augcauguaaucaacaugg

SEQ ID NO: 3596978 - RNA, 23 nt, Human
augcaugugguuugguuccucuc

SEQ ID NO: 3596979 - RNA, 20 nt, Human
augcauguuuuccagcuccu

SEQ ID NO: 3596980 - RNA, 14 nt, Human
augcauuaaaccug

SEQ ID NO: 3596981 - RNA, 20 nt, Human
augcauuaaaccugucucca

SEQ ID NO: 3596982 - RNA, 18 nt, Human
augcauuauaucaaaucu

SEQ ID NO: 3596983 - RNA, 13 nt, Human
augcauuauuaaa

SEQ ID NO: 3596984 - RNA, 22 nt, Human
augcauucacauuuagaaaagu

SEQ ID NO: 3596985 - RNA, 17 nt, Human
augcauugauauuguga

SEQ ID NO: 3596986 - RNA, 19 nt, Human
augcauugauauugugaac

SEQ ID NO: 3596987 - RNA, 14 nt, Human
augcauuguccucu

SEQ ID NO: 3596988 - RNA, 16 nt, Human
augcauuguugaggug

SEQ ID NO: 3596989 - RNA, 18 nt, Human
augcauuugaaaauuuug

SEQ ID NO: 3596990 - RNA, 12 nt, Human
augcauuugacu

SEQ ID NO: 3596991 - RNA, 14 nt, Human
augcauuugcauuu

SEQ ID NO: 3596992 - RNA, 17 nt, Human
augcauuuggguccagg

SEQ ID NO: 3596993 - RNA, 19 nt, Human
augcauuuugcagcaguga

SEQ ID NO: 3596994 - RNA, 17 nt, Human
augccaaaaaaaaauac

SEQ ID NO: 3596995 - RNA, 16 nt, Human
augccaaagaucacuu

SEQ ID NO: 3596996 - RNA, 14 nt, Human
augccaaauuaaaa

SEQ ID NO: 3596997 - RNA, 22 nt, Human
augccaaauuaaaaaagauaaa

SEQ ID NO: 3596998 - RNA, 20 nt, Human
augccaaauuguaguucuug

SEQ ID NO: 3596999 - RNA, 19 nt, Human
augccaacaagaaugcauu

SEQ ID NO: 3597000 - RNA, 13 nt, Human
augccaaccagcu

SEQ ID NO: 3597001 - RNA, 16 nt, Human
augccaagcacuucag

SEQ ID NO: 3597002 - RNA, 22 nt, Human
augccaaggaccuuuugcugcc

SEQ ID NO: 3597003 - RNA, 14 nt, Human
augccaaguuguuu

SEQ ID NO: 3597004 - RNA, 16 nt, Human
augccaaguuguuuga

SEQ ID NO: 3597005 - RNA, 17 nt, Human
augccaauauuaaaucu

SEQ ID NO: 3597006 - RNA, 16 nt, Human
augccacaaggacuuc

SEQ ID NO: 3597007 - RNA, 19 nt, Human
augccacaaggacuuccug

SEQ ID NO: 3597008 - RNA, 15 nt, Human
augccacacagagug

SEQ ID NO: 3597009 - RNA, 15 nt, Human
augccacaccaagcu

SEQ ID NO: 3597010 - RNA, 20 nt, Human
augccacaccaagcugugcc

SEQ ID NO: 3597011 - RNA, 23 nt, Human
augccacaccaagcugugccacc

SEQ ID NO: 3597012 - RNA, 14 nt, Human
augccacagcccug

SEQ ID NO: 3597013 - RNA, 19 nt, Human
augccaccaacuuacaaaa

SEQ ID NO: 3597014 - RNA, 20 nt, Human
augccacccccgcuggagga

SEQ ID NO: 3597015 - RNA, 23 nt, Human
augccacgcgguacaaaggaaaa

SEQ ID NO: 3597016 - RNA, 14 nt, Human
augccacguuccac

SEQ ID NO: 3597017 - RNA, 15 nt, Human
augccacuaaauuga

SEQ ID NO: 3597018 - RNA, 16 nt, Human
augccacuccucccuc

SEQ ID NO: 3597019 - RNA, 17 nt, Human
augccacuccucccucc

SEQ ID NO: 3597020 - RNA, 20 nt, Human
augccacuuccuuuuaacug

SEQ ID NO: 3597021 - RNA, 17 nt, Human
augccagccaagcucug

SEQ ID NO: 3597022 - RNA, 21 nt, Human
augccagccaagcucugcagu

SEQ ID NO: 3597023 - RNA, 16 nt, Human
augccagcuacuuccu

SEQ ID NO: 3597024 - RNA, 12 nt, Human
augccaggacac

SEQ ID NO: 3597025 - RNA, 21 nt, Human
augccagguucuauuuggaau

SEQ ID NO: 3597026 - RNA, 22 nt, Human
augccaguaacgcgucuuccug

SEQ ID NO: 3597027 - RNA, 20 nt, Human
augccaguauuuuuaaaggc

SEQ ID NO: 3597028 - RNA, 11 nt, Human
augccauaaua

SEQ ID NO: 3597029 - RNA, 15 nt, Human
aucuuuguaccaaaa

SEQ ID NO: 3597030 - RNA, 19 nt, Human
aucuuuguaccaaaauuuu

SEQ ID NO: 3597031 - RNA, 13 nt, Human
aucuuuguggcca

SEQ ID NO: 3597032 - RNA, 14 nt, Human
aucuuuguggccaa

SEQ ID NO: 3597033 - RNA, 23 nt, Human
aucuuuguggccaaggagcugcu

SEQ ID NO: 3597034 - RNA, 21 nt, Human
aucuuuguuaagguccugaaa

SEQ ID NO: 3597035 - RNA, 14 nt, Human
aucuuuuaaagaaa

SEQ ID NO: 3597036 - RNA, 14 nt, Human
aucuuuuauuuugc

SEQ ID NO: 3597037 - RNA, 12 nt, Human
aucuuuucuaca

SEQ ID NO: 3597038 - RNA, 22 nt, Human
aucuuuucuacagcaaauuuau

SEQ ID NO: 3597039 - RNA, 16 nt, Human
aucuuuucugaaucuu

SEQ ID NO: 3597040 - RNA, 14 nt, Human
aucuuuucuugccu

SEQ ID NO: 3597041 - RNA, 16 nt, Human
aucuuuugaagcauag

SEQ ID NO: 3597042 - RNA, 19 nt, Human
aucuuuugaccuguggugc

SEQ ID NO: 3597043 - RNA, 13 nt, Human
aucuuuuguauua

SEQ ID NO: 3597044 - RNA, 22 nt, Human
aucuuuuguauuaagaaaggaa

SEQ ID NO: 3597045 - RNA, 22 nt, Human
aucuuuuguucccauccucuuc

SEQ ID NO: 3597046 - RNA, 16 nt, Human
aucuuuuguuuccuuu

SEQ ID NO: 3597047 - RNA, 21 nt, Human
aucuuuuuaaccucuguucag

SEQ ID NO: 3597048 - RNA, 19 nt, Human
aucuuuuuaccuuucauac

SEQ ID NO: 3597049 - RNA, 13 nt, Human
aucuuuuuauuca

SEQ ID NO: 3597050 - RNA, 14 nt, Human
aucuuuuuucacaa

SEQ ID NO: 3597051 - RNA, 17 nt, Human
aucuuuuuucacaaauu

SEQ ID NO: 3597052 - RNA, 20 nt, Human
aucuuuuuuuuauuccacau

SEQ ID NO: 3597053 - RNA, 21 nt, Human
augaaaaaaggacaauuucaa

SEQ ID NO: 3597054 - RNA, 23 nt, Human
augaaaaaauauauaucaaauau

SEQ ID NO: 3597055 - RNA, 20 nt, Human
augaaaaacaaaaauaacau

SEQ ID NO: 3597056 - RNA, 13 nt, Human
augaaaaacaacc

SEQ ID NO: 3597057 - RNA, 17 nt, Human
augaaaaagaagaaucu

SEQ ID NO: 3597058 - RNA, 19 nt, Human
augaaaaagcauguacagu

SEQ ID NO: 3597059 - RNA, 15 nt, Human
augaaaaaugaaaga

SEQ ID NO: 3597060 - RNA, 19 nt, Human
augaaaaaugaaagaugau

SEQ ID NO: 3597061 - RNA, 18 nt, Human
augaaaaauugcugacug

SEQ ID NO: 3597062 - RNA, 21 nt, Human
augaaaaauuuaagcauuguu

SEQ ID NO: 3597063 - RNA, 22 nt, Human
augaaaaauuuaagcauuguuu

SEQ ID NO: 3597064 - RNA, 15 nt, Human
augaaaacagaaugu

SEQ ID NO: 3597065 - RNA, 19 nt, Human
augaaaacagaaugucucu

SEQ ID NO: 3597066 - RNA, 20 nt, Human
augaaaacaguguguaaaca

SEQ ID NO: 3597067 - RNA, 17 nt, Human
augaaaacauggaacag

SEQ ID NO: 3597068 - RNA, 16 nt, Human
augaaaacucuuugcu

SEQ ID NO: 3597069 - RNA, 13 nt, Human
augaaaagcuaga

SEQ ID NO: 3597070 - RNA, 18 nt, Human
augaaaagcuagaauuga

SEQ ID NO: 3597071 - RNA, 18 nt, Human
augaaaagcuuuguuugu

SEQ ID NO: 3597072 - RNA, 15 nt, Human
augaaaauaaagaau

SEQ ID NO: 3597073 - RNA, 18 nt, Human
augaaaauaacugaauuu

SEQ ID NO: 3597074 - RNA, 19 nt, Human
augaaaauaacugaauuug

SEQ ID NO: 3597075 - RNA, 19 nt, Human
augaaaauaaucucugauu

SEQ ID NO: 3597076 - RNA, 22 nt, Human
augaaaauacaacuuaaauaau

SEQ ID NO: 3597077 - RNA, 14 nt, Human
augaaaauauuuaa

SEQ ID NO: 3597078 - RNA, 18 nt, Human
augaaaauauuuuuuaca

SEQ ID NO: 3597079 - RNA, 19 nt, Human
augaaaauccuaccaaccu

SEQ ID NO: 3597080 - RNA, 22 nt, Human
agggggaggggguuacaaacug

SEQ ID NO: 3597081 - RNA, 19 nt, Human
agggggauccgacugcuuu

SEQ ID NO: 3597082 - RNA, 16 nt, Human
agggggaugccacucc

SEQ ID NO: 3597083 - RNA, 16 nt, Human
agggggcaagaggaau

SEQ ID NO: 3597084 - RNA, 15 nt, Human
agggggccuggaugc

SEQ ID NO: 3597085 - RNA, 15 nt, Human
agggggcggccuaug

SEQ ID NO: 3597086 - RNA, 14 nt, Human
agggggcugcuccc

SEQ ID NO: 3597087 - RNA, 15 nt, Human
agggggcugcuccca

SEQ ID NO: 3597088 - RNA, 16 nt, Human
agggggcugcucccac

SEQ ID NO: 3597089 - RNA, 19 nt, Human
agggggcugcucccaccug

SEQ ID NO: 3597090 - RNA, 13 nt, Human
agggggcugcugc

SEQ ID NO: 3597091 - RNA, 20 nt, Human
agggggcugcugcugggcuc

SEQ ID NO: 3597092 - RNA, 13 nt, Human
agggggcuggagg

SEQ ID NO: 3597093 - RNA, 12 nt, Human
agggggcuuccu

SEQ ID NO: 3597094 - RNA, 18 nt, Human
agggggcuugaagccaaa

SEQ ID NO: 3597095 - RNA, 13 nt, Human
aggggggagcugg

SEQ ID NO: 3597096 - RNA, 17 nt, Human
aggggggagggggaggg

SEQ ID NO: 3597097 - RNA, 21 nt, Human
agggggguugugaggccuggc

SEQ ID NO: 3597098 - RNA, 16 nt, Human
agggggucccaguggg

SEQ ID NO: 3597099 - RNA, 19 nt, Human
agggggucccagugggagg

SEQ ID NO: 3597100 - RNA, 24 nt, Human
agggggucccagugggaggggcag

SEQ ID NO: 3597101 - RNA, 15 nt, Human
agggggucguggaga

SEQ ID NO: 3597102 - RNA, 16 nt, Human
agggggucguggagag

SEQ ID NO: 3597103 - RNA, 15 nt, Human
aggggguggaggggu

SEQ ID NO: 3597104 - RNA, 18 nt, Human
aggggguggccucccaac

SEQ ID NO: 3597105 - RNA, 20 nt, Human
agggggugucucaggccaca

SEQ ID NO: 3597106 - RNA, 14 nt, Human
aggggguuacaaac

SEQ ID NO: 3597107 - RNA, 18 nt, Human
agggguaggggcugggaa

SEQ ID NO: 3597108 - RNA, 16 nt, Human
aggggucaaagaaaug

SEQ ID NO: 3597109 - RNA, 15 nt, Human
aggggucaaguuauu

SEQ ID NO: 3597110 - RNA, 20 nt, Human
aggggucagggaccaaggac

SEQ ID NO: 3597111 - RNA, 24 nt, Human
aggggucagggaccaaggaccccu

SEQ ID NO: 3597112 - RNA, 15 nt, Human
aggggucccagccac

SEQ ID NO: 3597113 - RNA, 19 nt, Human
aggggucccagccaccccg

SEQ ID NO: 3597114 - RNA, 16 nt, Human
agggguccuuggugug

SEQ ID NO: 3597115 - RNA, 19 nt, Human
aggggucgacuucgggcug

SEQ ID NO: 3597116 - RNA, 21 nt, Human
aggggucggcugaccaugcuc

SEQ ID NO: 3597117 - RNA, 19 nt, Human
aggggucuccaggaggaga

SEQ ID NO: 3597118 - RNA, 13 nt, Human
aggggucucccug

SEQ ID NO: 3597119 - RNA, 15 nt, Human
aggggugacacagac

SEQ ID NO: 3597120 - RNA, 16 nt, Human
aggggugacacagacu

SEQ ID NO: 3597121 - RNA, 23 nt, Human
aggggugacacagacucauccug

SEQ ID NO: 3597122 - RNA, 16 nt, Human
aggggugacggcccuc

SEQ ID NO: 3597123 - RNA, 13 nt, Human
aggggugauuuca

SEQ ID NO: 3597124 - RNA, 22 nt, Human
aggggugauuucagagagggca

SEQ ID NO: 3597125 - RNA, 16 nt, Human
aggggugcagaggcug

SEQ ID NO: 3597126 - RNA, 17 nt, Human
aggggugcagaggcugu

SEQ ID NO: 3597127 - RNA, 21 nt, Human
aggggugcccccuccucuccc

SEQ ID NO: 3597128 - RNA, 23 nt, Human
aggggugcccccuccucucccau

SEQ ID NO: 3597129 - RNA, 20 nt, Human
aggggugcggcggucccagc

SEQ ID NO: 3597130 - RNA, 21 nt, Human
aggggugcggcggucccagcu

SEQ ID NO: 3597131 - RNA, 22 nt, Human
aggggugcggcggucccagcuc

SEQ ID NO: 3597132 - RNA, 23 nt, Human
aggggugcggcggucccagcucc

SEQ ID NO: 3597133 - RNA, 15 nt, Human
agggguggagacugc

SEQ ID NO: 3597134 - RNA, 13 nt, Human
aggggugggcugg

SEQ ID NO: 3597135 - RNA, 16 nt, Human
agggguguggcagugg

SEQ ID NO: 3597136 - RNA, 18 nt, Human
agggguguggcagugguu

SEQ ID NO: 3597137 - RNA, 20 nt, Human
agggguuccucaaauuuuuu

SEQ ID NO: 3597138 - RNA, 19 nt, Human
agggguuccuucugggcau

SEQ ID NO: 3597139 - RNA, 19 nt, Human
agggguugccacaggccuc

SEQ ID NO: 3597140 - RNA, 22 nt, Human
agggguugccacaggccucccu

SEQ ID NO: 3597141 - RNA, 19 nt, Human
agggguugguugaggugga

SEQ ID NO: 3597142 - RNA, 20 nt, Human
agggguugguugagguggaa

SEQ ID NO: 3597143 - RNA, 14 nt, Human
agggguuuacagug

SEQ ID NO: 3597144 - RNA, 20 nt, Human
agggguuuuaggucucuucc

SEQ ID NO: 3597145 - RNA, 22 nt, Human
agggguuuuaggucucuucccc

SEQ ID NO: 3597146 - RNA, 22 nt, Human
agggguuuucgaagcucagccc

SEQ ID NO: 3597147 - RNA, 23 nt, Human
aggguaaaucaguaagagguguu

SEQ ID NO: 3597148 - RNA, 15 nt, Human
aggguaaggugccuu

SEQ ID NO: 3597149 - RNA, 14 nt, Human
aggguaccagcaga

SEQ ID NO: 3597150 - RNA, 15 nt, Human
aggguaccagcagaa

SEQ ID NO: 3597151 - RNA, 23 nt, Human
aggguaccuugaacacuggggga

SEQ ID NO: 3597152 - RNA, 20 nt, Human
aggguacuuccacugaugga

SEQ ID NO: 3597153 - RNA, 16 nt, Human
aggguagcccgccugc

SEQ ID NO: 3597154 - RNA, 20 nt, Human
aggguaggagggugggaagg

SEQ ID NO: 3597155 - RNA, 18 nt, Human
aggguaggcaggauuggg

SEQ ID NO: 3597156 - RNA, 16 nt, Human
aggguaggcuggaguu

SEQ ID NO: 3597157 - RNA, 12 nt, Human
aggguagggugg

SEQ ID NO: 3597158 - RNA, 18 nt, Human
aggguaucaaauaaaauu

SEQ ID NO: 3597159 - RNA, 22 nt, Human
aggguauccaaguuggacuggg

SEQ ID NO: 3597160 - RNA, 21 nt, Human
aggguauggacuaucugucug

SEQ ID NO: 3597161 - RNA, 18 nt, Human
aggguauugcuugccacu

SEQ ID NO: 3597162 - RNA, 19 nt, Human
agggucacuggggcccaag

SEQ ID NO: 3597163 - RNA, 13 nt, Human
agggucagagagg

SEQ ID NO: 3597164 - RNA, 21 nt, Human
agggucagagaggagucagag

SEQ ID NO: 3597165 - RNA, 20 nt, Human
agggucagaggaccuguauu

SEQ ID NO: 3597166 - RNA, 14 nt, Human
agggucaggagagg

SEQ ID NO: 3597167 - RNA, 15 nt, Human
agggucaggagaggg

SEQ ID NO: 3597168 - RNA, 12 nt, Human
agggucaggccu

SEQ ID NO: 3597169 - RNA, 14 nt, Human
agggucaggccuuu

SEQ ID NO: 3597170 - RNA, 21 nt, Human
aggguccagaaggagacaggc

SEQ ID NO: 3597171 - RNA, 20 nt, Human
aggguccauuuuucuuccag

SEQ ID NO: 3597172 - RNA, 17 nt, Human
agggucccaagcugggc

SEQ ID NO: 3597173 - RNA, 12 nt, Human
agggucccucug

SEQ ID NO: 3597174 - RNA, 12 nt, Human
agggucccuggg

SEQ ID NO: 3597175 - RNA, 20 nt, Human
agggucccugguggcagcuc

SEQ ID NO: 3597176 - RNA, 21 nt, Human
aggguccugcagccugcagga

SEQ ID NO: 3597177 - RNA, 17 nt, Human
aggguccuggcuccuga

SEQ ID NO: 3597178 - RNA, 19 nt, Human
aggguccuggcuccugagg

SEQ ID NO: 3597179 - RNA, 21 nt, Human
aggguccuggcuccugagggg

SEQ ID NO: 3597180 - RNA, 14 nt, Human
aggguccuucccuc

SEQ ID NO: 3597181 - RNA, 16 nt, Human
aggguccuucccucuc

SEQ ID NO: 3597182 - RNA, 22 nt, Human
aggguccuucccucuccccaag

SEQ ID NO: 3597183 - RNA, 22 nt, Human
aggguccuuuugacacugcucu

SEQ ID NO: 3597184 - RNA, 20 nt, Human
augaagauuauuuuuuauga

SEQ ID NO: 3597185 - RNA, 15 nt, Human
augaagcaaacacau

SEQ ID NO: 3597186 - RNA, 21 nt, Human
augaagcaaaugucaugcugc

SEQ ID NO: 3597187 - RNA, 22 nt, Human
augaagcaaaugucaugcugcc

SEQ ID NO: 3597188 - RNA, 14 nt, Human
augaagcaaggaag

SEQ ID NO: 3597189 - RNA, 22 nt, Human
augaagcagcuuuaaacaaauu

SEQ ID NO: 3597190 - RNA, 12 nt, Human
augaagcccaag

SEQ ID NO: 3597191 - RNA, 19 nt, Human
augaagcgaaacacagaga

SEQ ID NO: 3597192 - RNA, 15 nt, Human
augaagcuaccucaa

SEQ ID NO: 3597193 - RNA, 13 nt, Human
augaagcuguugu

SEQ ID NO: 3597194 - RNA, 18 nt, Human
augaagcuuguguaucca

SEQ ID NO: 3597195 - RNA, 19 nt, Human
augaagcuuuuaugugaaa

SEQ ID NO: 3597196 - RNA, 21 nt, Human
augaagcuuuuaugugaaaca

SEQ ID NO: 3597197 - RNA, 22 nt, Human
augaagcuuuuaugugaaacau

SEQ ID NO: 3597198 - RNA, 22 nt, Human
augaaggcagaaaaaugucauu

SEQ ID NO: 3597199 - RNA, 17 nt, Human
augaagguaaauaaaaa

SEQ ID NO: 3597200 - RNA, 16 nt, Human
augaagguuaggauuu

SEQ ID NO: 3597201 - RNA, 20 nt, Human
augaagguuaggauuuaaca

SEQ ID NO: 3597202 - RNA, 21 nt, Human
augaagguuaggauuuaacag

SEQ ID NO: 3597203 - RNA, 22 nt, Human
augaaguaaagccauuaaauga

SEQ ID NO: 3597204 - RNA, 19 nt, Human
augaaguaacuugucuuaa

SEQ ID NO: 3597205 - RNA, 14 nt, Human
augaaguauauaau

SEQ ID NO: 3597206 - RNA, 16 nt, Human
augaaguauauaaugg

SEQ ID NO: 3597207 - RNA, 21 nt, Human
augaaguaucuaaaaguguca

SEQ ID NO: 3597208 - RNA, 12 nt, Human
augaaguauuuu

SEQ ID NO: 3597209 - RNA, 20 nt, Human
augaaguuacuuucuuaaug

SEQ ID NO: 3597210 - RNA, 20 nt, Human
augaaguuuaaaacaguauu

SEQ ID NO: 3597211 - RNA, 21 nt, Human
augaaguuuaaaacaguauuu

SEQ ID NO: 3597212 - RNA, 15 nt, Human
augaaguuuauacag

SEQ ID NO: 3597213 - RNA, 16 nt, Human
augaaguuuauacagu

SEQ ID NO: 3597214 - RNA, 18 nt, Human
augaaguuugaacuucau

SEQ ID NO: 3597215 - RNA, 13 nt, Human
augaaguuugaau

SEQ ID NO: 3597216 - RNA, 14 nt, Human
augaaguuugaaug

SEQ ID NO: 3597217 - RNA, 15 nt, Human
augaaguuugaaugu

SEQ ID NO: 3597218 - RNA, 16 nt, Human
augaaguuugaauguu

SEQ ID NO: 3597219 - RNA, 19 nt, Human
augaaguuugaauguuaaa

SEQ ID NO: 3597220 - RNA, 20 nt, Human
augaaguuugaauguuaaau

SEQ ID NO: 3597221 - RNA, 22 nt, Human
augaaguuuguaguuguuuuaa

SEQ ID NO: 3597222 - RNA, 16 nt, Human
augaaguuuuacauug

SEQ ID NO: 3597223 - RNA, 20 nt, Human
augaauaaugccuuuguaac

SEQ ID NO: 3597224 - RNA, 17 nt, Human
augccuaccaauauuua

SEQ ID NO: 3597225 - RNA, 20 nt, Human
augccucagcccugacccug

SEQ ID NO: 3597226 - RNA, 14 nt, Human
augccucaguguau

SEQ ID NO: 3597227 - RNA, 12 nt, Human
augccuccaccg

SEQ ID NO: 3597228 - RNA, 13 nt, Human
augccuccaccgc

SEQ ID NO: 3597229 - RNA, 22 nt, Human
augccucccugacccugcagag

SEQ ID NO: 3597230 - RNA, 17 nt, Human
augccucuccuuuguau

SEQ ID NO: 3597231 - RNA, 21 nt, Human
augccucuccuuuguauauua

SEQ ID NO: 3597232 - RNA, 12 nt, Human
augccucugagg

SEQ ID NO: 3597233 - RNA, 19 nt, Human
augccucugaggccagccu

SEQ ID NO: 3597234 - RNA, 21 nt, Human
augccucugauaugggacuga

SEQ ID NO: 3597235 - RNA, 13 nt, Human
augccucugucua

SEQ ID NO: 3597236 - RNA, 17 nt, Human
augccucugucuagcau

SEQ ID NO: 3597237 - RNA, 22 nt, Human
augccucugucuagcaugccaa

SEQ ID NO: 3597238 - RNA, 21 nt, Human
augccugauugccaagcucag

SEQ ID NO: 3597239 - RNA, 12 nt, Human
augccugcucuu

SEQ ID NO: 3597240 - RNA, 23 nt, Human
augccugcuuugaauaaaugugu

SEQ ID NO: 3597241 - RNA, 18 nt, Human
augccuggaagcuuuguc

SEQ ID NO: 3597242 - RNA, 12 nt, Human
augccugguggc

SEQ ID NO: 3597243 - RNA, 14 nt, Human
augccugguggcag

SEQ ID NO: 3597244 - RNA, 16 nt, Human
augccugguggcagcu

SEQ ID NO: 3597245 - RNA, 18 nt, Human
augccugguggcagcugc

SEQ ID NO: 3597246 - RNA, 18 nt, Human
augccuguaauucagugu

SEQ ID NO: 3597247 - RNA, 16 nt, Human
augccuguccagccug

SEQ ID NO: 3597248 - RNA, 17 nt, Human
augccuguccagccugg

SEQ ID NO: 3597249 - RNA, 22 nt, Human
augccuguggaagagugugugu

SEQ ID NO: 3597250 - RNA, 12 nt, Human
augccuguggcu

SEQ ID NO: 3597251 - RNA, 15 nt, Human
augccuuaaaaugga

SEQ ID NO: 3597252 - RNA, 18 nt, Human
augccuuaaaauggaauu

SEQ ID NO: 3597253 - RNA, 22 nt, Human
augccuuaaaauggaauugaaa

SEQ ID NO: 3597254 - RNA, 18 nt, Human
augccuuacucuucuuga

SEQ ID NO: 3597255 - RNA, 18 nt, Human
augccuuacuuuguauga

SEQ ID NO: 3597256 - RNA, 15 nt, Human
augccuucuccagac

SEQ ID NO: 3597257 - RNA, 20 nt, Human
augccuuggggaggacaaaa

SEQ ID NO: 3597258 - RNA, 21 nt, Human
augccuuguauaauauugaaa

SEQ ID NO: 3597259 - RNA, 13 nt, Human
augccuuucuagu

SEQ ID NO: 3597260 - RNA, 12 nt, Human
augccuuugaga

SEQ ID NO: 3597261 - RNA, 14 nt, Human
augccuuugagaca

SEQ ID NO: 3597262 - RNA, 16 nt, Human
augccuuugagacagu

SEQ ID NO: 3597263 - RNA, 19 nt, Human
augccuuugagacaguuuc

SEQ ID NO: 3597264 - RNA, 21 nt, Human
augccuuugagacaguuucuu

SEQ ID NO: 3597265 - RNA, 13 nt, Human
augccuuuguaac

SEQ ID NO: 3597266 - RNA, 21 nt, Human
augccuuuucccaaaauguug

SEQ ID NO: 3597267 - RNA, 20 nt, Human
augccuuuucccaacuccag

SEQ ID NO: 3597268 - RNA, 22 nt, Human
augccuuuucccaacuccagaa

SEQ ID NO: 3597269 - RNA, 20 nt, Human
augcgacacugggaggccag

SEQ ID NO: 3597270 - RNA, 20 nt, Human
augcgcacaaggcugaccaa

SEQ ID NO: 3597271 - RNA, 12 nt, Human
augcgcagcccc

SEQ ID NO: 3597272 - RNA, 20 nt, Human
augcgcaggcuggcccugcc

SEQ ID NO: 3597273 - RNA, 15 nt, Human
augcgccaauaaacc

SEQ ID NO: 3597274 - RNA, 16 nt, Human
augcgccaauaaacca

SEQ ID NO: 3597275 - RNA, 22 nt, Human
augcgcccccuccgcccugcca

SEQ ID NO: 3597276 - RNA, 23 nt, Human
augcgcucagggccaugcugagg

SEQ ID NO: 3597277 - RNA, 12 nt, Human
augcggcccagc

SEQ ID NO: 3597278 - RNA, 14 nt, Human
augcggcccagccc

SEQ ID NO: 3597279 - RNA, 15 nt, Human
augcggcccagcccg

SEQ ID NO: 3597280 - RNA, 21 nt, Human
augcgggccagugcuccagcc

SEQ ID NO: 3597281 - RNA, 17 nt, Human
augcgggcugggcagcu

SEQ ID NO: 3597282 - RNA, 19 nt, Human
augcgggcugggcagcugu

SEQ ID NO: 3597283 - RNA, 18 nt, Human
augcgguagccagcacac

SEQ ID NO: 3597284 - RNA, 20 nt, Human
augcgguagccagcacacag

SEQ ID NO: 3597285 - RNA, 15 nt, Human
augcggucuagggaa

SEQ ID NO: 3597286 - RNA, 21 nt, Human
augcgguguuugguuuuuugu

SEQ ID NO: 3597287 - RNA, 22 nt, Human
augcgugcauaccacuuuuguu

SEQ ID NO: 3597288 - RNA, 16 nt, Human
augcguguuucugacu

SEQ ID NO: 3597289 - RNA, 17 nt, Human
augcguguuucugacuc

SEQ ID NO: 3597290 - RNA, 22 nt, Human
augcuaaaccuuaguacugagu

SEQ ID NO: 3597291 - RNA, 23 nt, Human
augcuaaagguuguauugcauau

SEQ ID NO: 3597292 - RNA, 15 nt, Human
augcuaacaaagaca

SEQ ID NO: 3597293 - RNA, 16 nt, Human
augcuaacaucuaaaa

SEQ ID NO: 3597294 - RNA, 17 nt, Human
augcuaacaucuaaaaa

SEQ ID NO: 3597295 - RNA, 19 nt, Human
augcuaacaucuaaaaaua

SEQ ID NO: 3597296 - RNA, 13 nt, Human
augcuaagaauuu

SEQ ID NO: 3597297 - RNA, 16 nt, Human
augcuaagacucagug

SEQ ID NO: 3597298 - RNA, 20 nt, Human
augcuaagggcaggcccaaa

SEQ ID NO: 3597299 - RNA, 16 nt, Human
augcuaauuuaaagag

SEQ ID NO: 3597300 - RNA, 18 nt, Human
augcuaauuuaaagagac

SEQ ID NO: 3597301 - RNA, 18 nt, Human
augcuacaggauuugaaa

SEQ ID NO: 3597302 - RNA, 17 nt, Human
augcuacaguaauaaau

SEQ ID NO: 3597303 - RNA, 13 nt, Human
augcuaccaccag

SEQ ID NO: 3597304 - RNA, 17 nt, Human
augcuaccaccagcugu

SEQ ID NO: 3597305 - RNA, 16 nt, Human
augcuacccagccauu

SEQ ID NO: 3597306 - RNA, 16 nt, Human
augcuacgugugauuu

SEQ ID NO: 3597307 - RNA, 21 nt, Human
augcuacuacaaaaaaguugu

SEQ ID NO: 3597308 - RNA, 14 nt, Human
augcuacugucuca

SEQ ID NO: 3597309 - RNA, 21 nt, Human
augcuagaacucccuuucaac

SEQ ID NO: 3597310 - RNA, 16 nt, Human
augcuagaagaaaaca

SEQ ID NO: 3597311 - RNA, 16 nt, Human
augcuagcucugagcc

SEQ ID NO: 3597312 - RNA, 17 nt, Human
augcuaugucauuucau

SEQ ID NO: 3597313 - RNA, 13 nt, Human
augcuauuaaagu

SEQ ID NO: 3597314 - RNA, 15 nt, Human
augcuauugaaaaug

SEQ ID NO: 3597315 - RNA, 13 nt, Human
augcuauuucuau

SEQ ID NO: 3597316 - RNA, 15 nt, Human
augcuauuucuauau

SEQ ID NO: 3597317 - RNA, 18 nt, Human
augcuauuuuuguuuuua

SEQ ID NO: 3597318 - RNA, 16 nt, Human
augcucaaagaaaucu

SEQ ID NO: 3597319 - RNA, 17 nt, Human
augcucaaagaaaucua

SEQ ID NO: 3597320 - RNA, 15 nt, Human
augcucaaguuuuuc

SEQ ID NO: 3597321 - RNA, 14 nt, Human
augcucagaccagc

SEQ ID NO: 3597322 - RNA, 13 nt, Human
augcucagcccug

SEQ ID NO: 3597323 - RNA, 19 nt, Human
augcucagguacagagaag

SEQ ID NO: 3597324 - RNA, 19 nt, Human
augcucaggugcuggggcc

SEQ ID NO: 3597325 - RNA, 14 nt, Human
augcucaucugcug

SEQ ID NO: 3597326 - RNA, 15 nt, Human
augcuccaaaugcug

SEQ ID NO: 3597327 - RNA, 16 nt, Human
augcuccaagauucua

SEQ ID NO: 3597328 - RNA, 19 nt, Human
augcuccagccaaccccug

SEQ ID NO: 3597329 - RNA, 13 nt, Human
augcuccccacag

SEQ ID NO: 3597330 - RNA, 14 nt, Human
augcuccccacagc

SEQ ID NO: 3597331 - RNA, 21 nt, Human
augcucccccauccuccccuu

SEQ ID NO: 3597332 - RNA, 13 nt, Human
augcuccuaguuu

SEQ ID NO: 3597333 - RNA, 22 nt, Human
augcuccuaguuugaccucaca

SEQ ID NO: 3597334 - RNA, 15 nt, Human
augcuccuuguuccu

SEQ ID NO: 3597335 - RNA, 18 nt, Human
augcuccuuguuccuaga

SEQ ID NO: 3597336 - RNA, 17 nt, Human
augcucuagugccuucu

SEQ ID NO: 3597337 - RNA, 19 nt, Human
augcucuaucuugcucugu

SEQ ID NO: 3597338 - RNA, 13 nt, Human
augcucucugcag

SEQ ID NO: 3597339 - RNA, 15 nt, Human
agggucgaaagcucu

SEQ ID NO: 3597340 - RNA, 17 nt, Human
agggucggaacccaagc

SEQ ID NO: 3597341 - RNA, 16 nt, Human
agggucggugccuuca

SEQ ID NO: 3597342 - RNA, 23 nt, Human
agggucuagggagagacccuugu

SEQ ID NO: 3597343 - RNA, 22 nt, Human
agggucucacuauguugcccag

SEQ ID NO: 3597344 - RNA, 14 nt, Human
agggucucacucug

SEQ ID NO: 3597345 - RNA, 15 nt, Human
agggucucacucugu

SEQ ID NO: 3597346 - RNA, 20 nt, Human
agggucucuagugcugugaa

SEQ ID NO: 3597347 - RNA, 12 nt, Human
agggucucuccc

SEQ ID NO: 3597348 - RNA, 13 nt, Human
agggucucugcug

SEQ ID NO: 3597349 - RNA, 14 nt, Human
agggucucugcugc

SEQ ID NO: 3597350 - RNA, 15 nt, Human
agggucucugcugcc

SEQ ID NO: 3597351 - RNA, 21 nt, Human
agggucugcucuuucucugcc

SEQ ID NO: 3597352 - RNA, 13 nt, Human
agggucuggagaa

SEQ ID NO: 3597353 - RNA, 20 nt, Human
agggucuguagguugcacac

SEQ ID NO: 3597354 - RNA, 21 nt, Human
agggucuguagguugcacacu

SEQ ID NO: 3597355 - RNA, 15 nt, Human
agggucugugugaau

SEQ ID NO: 3597356 - RNA, 18 nt, Human
agggucugugugaaugug

SEQ ID NO: 3597357 - RNA, 13 nt, Human
agggucuuuucau

SEQ ID NO: 3597358 - RNA, 18 nt, Human
agggucuuuucaucuggg

SEQ ID NO: 3597359 - RNA, 15 nt, Human
agggugccguguccc

SEQ ID NO: 3597360 - RNA, 19 nt, Human
agggugcuaguggugggca

SEQ ID NO: 3597361 - RNA, 21 nt, Human
aggguggacuuagaaagcagg

SEQ ID NO: 3597362 - RNA, 12 nt, Human
aggguggagacu

SEQ ID NO: 3597363 - RNA, 15 nt, Human
aggguggcagcaaca

SEQ ID NO: 3597364 - RNA, 16 nt, Human
aggguggcagcaacaa

SEQ ID NO: 3597365 - RNA, 11 nt, Human
aggguggcccu

SEQ ID NO: 3597366 - RNA, 17 nt, Human
agggugggagagcccag

SEQ ID NO: 3597367 - RNA, 18 nt, Human
agggugggagagcccagc

SEQ ID NO: 3597368 - RNA, 18 nt, Human
agggugggggagggaggu

SEQ ID NO: 3597369 - RNA, 20 nt, Human
agggugggggccaccugccu

SEQ ID NO: 3597370 - RNA, 20 nt, Human
aaugcaugcuuuccauauuu

SEQ ID NO: 3597371 - RNA, 18 nt, Human
aaugcauguuaggaaaau

SEQ ID NO: 3597372 - RNA, 22 nt, Human
aaugcauuauaggaucauuugu

SEQ ID NO: 3597373 - RNA, 18 nt, Human
aauuucauagcuguacuu

SEQ ID NO: 3597374 - RNA, 21 nt, Human
aauuuccacucaggucuguuu

SEQ ID NO: 3597375 - RNA, 20 nt, Human
aauuuccaguaccuuuguca

SEQ ID NO: 3597376 - RNA, 15 nt, Human
aauuucccaaagcag

SEQ ID NO: 3597377 - RNA, 17 nt, Human
aauuucccaaagcagug

SEQ ID NO: 3597378 - RNA, 22 nt, Human
aauuucccacaccguguaaacc

SEQ ID NO: 3597379 - RNA, 18 nt, Human
aauuucccacccccaccc

SEQ ID NO: 3597380 - RNA, 21 nt, Human
aauuucccaggacccugaagg

SEQ ID NO: 3597381 - RNA, 14 nt, Human
aauuuccccaacag

SEQ ID NO: 3597382 - RNA, 22 nt, Human
aauuuccccaacagugugaagu

SEQ ID NO: 3597383 - RNA, 17 nt, Human
aauuuccccuaaucuuu

SEQ ID NO: 3597384 - RNA, 18 nt, Human
aauuuccccuaaucuuuu

SEQ ID NO: 3597385 - RNA, 18 nt, Human
aauuuccuggugugaagg

SEQ ID NO: 3597386 - RNA, 14 nt, Human
aauuuccuuuuuga

SEQ ID NO: 3597387 - RNA, 17 nt, Human
aauuuccuuuuugacac

SEQ ID NO: 3597388 - RNA, 19 nt, Human
aauuuccuuuuugacacug

SEQ ID NO: 3597389 - RNA, 18 nt, Human
aauuucgccguugaagag

SEQ ID NO: 3597390 - RNA, 18 nt, Human
aauuucggauuuuuucca

SEQ ID NO: 3597391 - RNA, 20 nt, Human
aauuucggauuuuuuccaaa

SEQ ID NO: 3597392 - RNA, 21 nt, Human
aauuucggauuuuuuccaaaa

SEQ ID NO: 3597393 - RNA, 22 nt, Human
aauuucuaaaaagauuagcaag

SEQ ID NO: 3597394 - RNA, 13 nt, Human
aauuucuaaagau

SEQ ID NO: 3597395 - RNA, 23 nt, Human
aauuucuaaagauaauauuacug

SEQ ID NO: 3597396 - RNA, 16 nt, Human
aauuucuacuuugaag

SEQ ID NO: 3597397 - RNA, 22 nt, Human
aauuucuaggacugaauuauga

SEQ ID NO: 3597398 - RNA, 13 nt, Human
aauuucuccccag

SEQ ID NO: 3597399 - RNA, 20 nt, Human
aauuucuccucccuuccuuu

SEQ ID NO: 3597400 - RNA, 14 nt, Human
aauuucucuacaga

SEQ ID NO: 3597401 - RNA, 23 nt, Human
aauuucucuacagaugucccauu

SEQ ID NO: 3597402 - RNA, 17 nt, Human
aauuucugccauuucau

SEQ ID NO: 3597403 - RNA, 18 nt, Human
aauuucugccauuucaug

SEQ ID NO: 3597404 - RNA, 20 nt, Human
aauuucugccauuucauguc

SEQ ID NO: 3597405 - RNA, 19 nt, Human
aauuucugugcccuccuga

SEQ ID NO: 3597406 - RNA, 20 nt, Human
aauuucugugcccuccugac

SEQ ID NO: 3597407 - RNA, 20 nt, Human
aauuucuuacuaaacauuuu

SEQ ID NO: 3597408 - RNA, 17 nt, Human
aauuucuugguaagaag

SEQ ID NO: 3597409 - RNA, 20 nt, Human
aauuucuugguaagaagccg

SEQ ID NO: 3597410 - RNA, 15 nt, Human
aauuucuuguuucuc

SEQ ID NO: 3597411 - RNA, 16 nt, Human
aauuucuuuauaaaau

SEQ ID NO: 3597412 - RNA, 22 nt, Human
aauuucuuuauaaaauuuacug

SEQ ID NO: 3597413 - RNA, 11 nt, Human
aauuucuuuug

SEQ ID NO: 3597414 - RNA, 22 nt, Human
aauuucuuuuuuuccuuuuuaa

SEQ ID NO: 3597415 - RNA, 18 nt, Human
aauuugaaaauaauuguu

SEQ ID NO: 3597416 - RNA, 13 nt, Human
aauuugaaacauu

SEQ ID NO: 3597417 - RNA, 15 nt, Human
aauuugaaacauugc

SEQ ID NO: 3597418 - RNA, 14 nt, Human
aauuugaaauuuag

SEQ ID NO: 3597419 - RNA, 16 nt, Human
aauuugaaccaaaaca

SEQ ID NO: 3597420 - RNA, 12 nt, Human
aauuugaaugaa

SEQ ID NO: 3597421 - RNA, 16 nt, Human
aauuugacuaauuuua

SEQ ID NO: 3597422 - RNA, 16 nt, Human
aauuugacuuuucugu

SEQ ID NO: 3597423 - RNA, 18 nt, Human
aauuugagagaaauauga

SEQ ID NO: 3597424 - RNA, 17 nt, Human
aauuugagauacaaaca

SEQ ID NO: 3597425 - RNA, 13 nt, Human
aauuugagugcuc

SEQ ID NO: 3597426 - RNA, 14 nt, Human
aauuugauacauaa

SEQ ID NO: 3597427 - RNA, 17 nt, Human
aauuugauacauaauaa

SEQ ID NO: 3597428 - RNA, 16 nt, Human
aauuugauacuuauau

SEQ ID NO: 3597429 - RNA, 18 nt, Human
aauuugauacuuauauuu

SEQ ID NO: 3597430 - RNA, 20 nt, Human
aauuugauacuuauauuuuc

SEQ ID NO: 3597431 - RNA, 16 nt, Human
aauuugauugauuuga

SEQ ID NO: 3597432 - RNA, 20 nt, Human
aauuugauugauuugaagaa

SEQ ID NO: 3597433 - RNA, 15 nt, Human
aauuugauuucuauu

SEQ ID NO: 3597434 - RNA, 15 nt, Human
aauuugcaaaguacu

SEQ ID NO: 3597435 - RNA, 16 nt, Human
aauuugcaaaguacug

SEQ ID NO: 3597436 - RNA, 17 nt, Human
aauuugcaaaguacugu

SEQ ID NO: 3597437 - RNA, 16 nt, Human
aauuugcacuguuuaa

SEQ ID NO: 3597438 - RNA, 20 nt, Human
aauuugcacuuucaggaaca

SEQ ID NO: 3597439 - RNA, 15 nt, Human
aauuugcagcuucca

SEQ ID NO: 3597440 - RNA, 23 nt, Human
aauuugcauuaaauucacaaacu

SEQ ID NO: 3597441 - RNA, 18 nt, Human
aauuugccaaaauaaugu

SEQ ID NO: 3597442 - RNA, 21 nt, Human
aauuugccaaaauaaugucuu

SEQ ID NO: 3597443 - RNA, 13 nt, Human
aauuugccugcug

SEQ ID NO: 3597444 - RNA, 12 nt, Human
aauuugcugcug

SEQ ID NO: 3597445 - RNA, 18 nt, Human
aauuuggaaacuaauaaa

SEQ ID NO: 3597446 - RNA, 12 nt, Human
aauuuggauuua

SEQ ID NO: 3597447 - RNA, 23 nt, Human
aauuuggauuuaaaagccugcuc

SEQ ID NO: 3597448 - RNA, 15 nt, Human
aauuuggcaauuuug

SEQ ID NO: 3597449 - RNA, 18 nt, Human
aauuuggcuucuguuguc

SEQ ID NO: 3597450 - RNA, 22 nt, Human
aauuugggaagguuuguguuuu

SEQ ID NO: 3597451 - RNA, 21 nt, Human
aauuugggacccugcuuuaga

SEQ ID NO: 3597452 - RNA, 20 nt, Human
aauuuggggacagauucagu

SEQ ID NO: 3597453 - RNA, 16 nt, Human
aauuugguucuaauag

SEQ ID NO: 3597454 - RNA, 17 nt, Human
aauuugguucuaggccg

SEQ ID NO: 3597455 - RNA, 21 nt, Human
aauuugguuuucacauuggaa

SEQ ID NO: 3597456 - RNA, 24 nt, Human
aauuuguaaaaacagcauugcuuu

SEQ ID NO: 3597457 - RNA, 22 nt, Human
aauuuguaaaguugguuggaua

SEQ ID NO: 3597458 - RNA, 15 nt, Human
aauuuguaaccucag

SEQ ID NO: 3597459 - RNA, 14 nt, Human
aauuuguaaguuua

SEQ ID NO: 3597460 - RNA, 18 nt, Human
aauuuguaaugucuugag

SEQ ID NO: 3597461 - RNA, 15 nt, Human
aauuuguaauugcuu

SEQ ID NO: 3597462 - RNA, 20 nt, Human
aauuuguacauauguaaaau

SEQ ID NO: 3597463 - RNA, 17 nt, Human
aauuuguaccauuucag

SEQ ID NO: 3597464 - RNA, 19 nt, Human
aauuuguacuauuuaacug

SEQ ID NO: 3597465 - RNA, 20 nt, Human
aauuuguaucugaaggagau

SEQ ID NO: 3597466 - RNA, 14 nt, Human
aauuugucauuuug

SEQ ID NO: 3597467 - RNA, 17 nt, Human
aauuugucauuuugaag

SEQ ID NO: 3597468 - RNA, 16 nt, Human
aauuugucuugccuua

SEQ ID NO: 3597469 - RNA, 17 nt, Human
aauuugugauacaaugc

SEQ ID NO: 3597470 - RNA, 14 nt, Human
aauuuguggugauu

SEQ ID NO: 3597471 - RNA, 22 nt, Human
aauuuguguaauaaaguguuuu

SEQ ID NO: 3597472 - RNA, 21 nt, Human
aauuuguguguuuuuagcugu

SEQ ID NO: 3597473 - RNA, 18 nt, Human
aauuuguuauuuugcaac

SEQ ID NO: 3597474 - RNA, 16 nt, Human
aauuuguuugugcuuc

SEQ ID NO: 3597475 - RNA, 12 nt, Human
aauuuuaaaaaa

SEQ ID NO: 3597476 - RNA, 23 nt, Human
aauuuuaaaaaagggaguuuuug

SEQ ID NO: 3597477 - RNA, 14 nt, Human
aauuuuaaaaauac

SEQ ID NO: 3597478 - RNA, 18 nt, Human
aauuuuaaaaauacauau

SEQ ID NO: 3597479 - RNA, 15 nt, Human
aauuuuaaaaaucua

SEQ ID NO: 3597480 - RNA, 15 nt, Human
aauuuuaaaaucuga

SEQ ID NO: 3597481 - RNA, 14 nt, Human
aauuuuaaacaaag

SEQ ID NO: 3597482 - RNA, 14 nt, Human
aauuuuaaacauau

SEQ ID NO: 3597483 - RNA, 19 nt, Human
aauuuuaagauuccuuuuc

SEQ ID NO: 3597484 - RNA, 14 nt, Human
aauuuuaauuuagu

SEQ ID NO: 3597485 - RNA, 13 nt, Human
aauuuuacacauu

SEQ ID NO: 3597486 - RNA, 19 nt, Human
aauuuuacacgcuuuugug

SEQ ID NO: 3597487 - RNA, 20 nt, Human
aauuuuacacgcuuuuguga

SEQ ID NO: 3597488 - RNA, 18 nt, Human
aauuuuacccuuuagacu

SEQ ID NO: 3597489 - RNA, 23 nt, Human
aauuuuacuccauaaacagacug

SEQ ID NO: 3597490 - RNA, 13 nt, Human
aauuuuagaaaua

SEQ ID NO: 3597491 - RNA, 16 nt, Human
aauuuuagaaauauuc

SEQ ID NO: 3597492 - RNA, 17 nt, Human
aauuuuagaaauauuca

SEQ ID NO: 3597493 - RNA, 15 nt, Human
aauuuuagcuuuugu

SEQ ID NO: 3597494 - RNA, 17 nt, Human
aauuuuaguccaaauaa

SEQ ID NO: 3597495 - RNA, 14 nt, Human
aauuuuaguuuuuc

SEQ ID NO: 3597496 - RNA, 15 nt, Human
aauuuuaguuuuuca

SEQ ID NO: 3597497 - RNA, 20 nt, Human
aauuuuauacuuucccuacc

SEQ ID NO: 3597498 - RNA, 21 nt, Human
aauuuuauacuuucccuaccc

SEQ ID NO: 3597499 - RNA, 13 nt, Human
aauuuuaucugcc

SEQ ID NO: 3597500 - RNA, 22 nt, Human
aauuuuaugaacugcauguaua

SEQ ID NO: 3597501 - RNA, 20 nt, Human
aauuuuauuuugugcucauu

SEQ ID NO: 3597502 - RNA, 15 nt, Human
aauuuucaaguaauu

SEQ ID NO: 3597503 - RNA, 19 nt, Human
aauuuucacacacgugaga

SEQ ID NO: 3597504 - RNA, 14 nt, Human
aauuuucacaugaa

SEQ ID NO: 3597505 - RNA, 17 nt, Human
aauuuucacaugaacau

SEQ ID NO: 3597506 - RNA, 14 nt, Human
aauuuucacugugu

SEQ ID NO: 3597507 - RNA, 21 nt, Human
aauuuucacuuuuggcaauga

SEQ ID NO: 3597508 - RNA, 17 nt, Human
aauuuucagaccccagc

SEQ ID NO: 3597509 - RNA, 18 nt, Human
aauuuucagauuugcaca

SEQ ID NO: 3597510 - RNA, 12 nt, Human
aauuuucagcau

SEQ ID NO: 3597511 - RNA, 23 nt, Human
aauuuuccuguccucuuucagcu

SEQ ID NO: 3597512 - RNA, 20 nt, Human
aauuuuccuucagauauuuu

SEQ ID NO: 3597513 - RNA, 14 nt, Human
aauuuuccuugaag

SEQ ID NO: 3597514 - RNA, 23 nt, Human
aaguggcaaagcuguucuuccug

SEQ ID NO: 3597515 - RNA, 13 nt, Human
aaguggcaccugu

SEQ ID NO: 3597516 - RNA, 17 nt, Human
aaguggcaccugucugc

SEQ ID NO: 3597517 - RNA, 21 nt, Human
aaguggcaccugucugcucca

SEQ ID NO: 3597518 - RNA, 16 nt, Human
aaguggcauguuuugu

SEQ ID NO: 3597519 - RNA, 19 nt, Human
aaguggccaagaagcagug

SEQ ID NO: 3597520 - RNA, 22 nt, Human
aaguggccucuuugucuaaaac

SEQ ID NO: 3597521 - RNA, 20 nt, Human
aaguggcgugggagccagcc

SEQ ID NO: 3597522 - RNA, 14 nt, Human
aaguggcugcugac

SEQ ID NO: 3597523 - RNA, 11 nt, Human
aagugggacag

SEQ ID NO: 3597524 - RNA, 21 nt, Human
aagugggccaggacaggcccg

SEQ ID NO: 3597525 - RNA, 11 nt, Human
aagugggccca

SEQ ID NO: 3597526 - RNA, 22 nt, Human
aagugggcuugauucugcagua

SEQ ID NO: 3597527 - RNA, 17 nt, Human
aaguggggcagagccuc

SEQ ID NO: 3597528 - RNA, 20 nt, Human
aaguggguuauucuggaguu

SEQ ID NO: 3597529 - RNA, 19 nt, Human
aaguggucuuaagaaaugu

SEQ ID NO: 3597530 - RNA, 13 nt, Human
aaguggugcucag

SEQ ID NO: 3597531 - RNA, 17 nt, Human
aaguggugcucaguugu

SEQ ID NO: 3597532 - RNA, 18 nt, Human
aagugguucccucucuua

SEQ ID NO: 3597533 - RNA, 21 nt, Human
aauuuugaauaaauaaaugua

SEQ ID NO: 3597534 - RNA, 12 nt, Human
aauuuugacacu

SEQ ID NO: 3597535 - RNA, 17 nt, Human
aauuuugacuuaaugug

SEQ ID NO: 3597536 - RNA, 14 nt, Human
aauuuugaugaaca

SEQ ID NO: 3597537 - RNA, 14 nt, Human
aauuuugauguuuu

SEQ ID NO: 3597538 - RNA, 18 nt, Human
aauuuugccuaauacauu

SEQ ID NO: 3597539 - RNA, 20 nt, Human
aauuuugcuggaauuccuaa

SEQ ID NO: 3597540 - RNA, 18 nt, Human
aauuuugcuuuuaauuaa

SEQ ID NO: 3597541 - RNA, 18 nt, Human
aauuuuggaagauuuuca

SEQ ID NO: 3597542 - RNA, 12 nt, Human
aauuuuggaauu

SEQ ID NO: 3597543 - RNA, 17 nt, Human
aauuuuggccaaagugu

SEQ ID NO: 3597544 - RNA, 22 nt, Human
aauuuuggggauuuucaaaaga

SEQ ID NO: 3597545 - RNA, 21 nt, Human
aauuuugggguaagacuuuuu

SEQ ID NO: 3597546 - RNA, 20 nt, Human
aauuuuggucauagcauuca

SEQ ID NO: 3597547 - RNA, 15 nt, Human
aauuuugguuguauu

SEQ ID NO: 3597548 - RNA, 17 nt, Human
aauuuuguaaaggugaa

SEQ ID NO: 3597549 - RNA, 20 nt, Human
aauuuuguauguuaaagaga

SEQ ID NO: 3597550 - RNA, 13 nt, Human
aauuuuguauuuu

SEQ ID NO: 3597551 - RNA, 15 nt, Human
aauuuuguauuuucc

SEQ ID NO: 3597552 - RNA, 17 nt, Human
aauuuuguauuuuccaa

SEQ ID NO: 3597553 - RNA, 17 nt, Human
aauuuugugaagcaaaa

SEQ ID NO: 3597554 - RNA, 18 nt, Human
aauuuugugguuuucgag

SEQ ID NO: 3597555 - RNA, 14 nt, Human
aauuuuguucucug

SEQ ID NO: 3597556 - RNA, 15 nt, Human
aauuuuguucucugg

SEQ ID NO: 3597557 - RNA, 18 nt, Human
aauuuuguucucugggag

SEQ ID NO: 3597558 - RNA, 21 nt, Human
aauuuuguucucugggagaaa

SEQ ID NO: 3597559 - RNA, 24 nt, Human
aauuuuguucucugggagaaaauc

SEQ ID NO: 3597560 - RNA, 13 nt, Human
aauuuuguuucug

SEQ ID NO: 3597561 - RNA, 15 nt, Human
aauuuuuaaacaagu

SEQ ID NO: 3597562 - RNA, 19 nt, Human
aauuuuuaaacaaguauuu

SEQ ID NO: 3597563 - RNA, 22 nt, Human
aauuuuuaaaguauauauuuau

SEQ ID NO: 3597564 - RNA, 11 nt, Human
aauuuuuaagc

SEQ ID NO: 3597565 - RNA, 14 nt, Human
aauuuuuaaugaug

SEQ ID NO: 3597566 - RNA, 22 nt, Human
aauuuuuacccuaaugucuuca

SEQ ID NO: 3597567 - RNA, 22 nt, Human
aauuuuuaggaaguuuucugua

SEQ ID NO: 3597568 - RNA, 15 nt, Human
aauuuuuauucauaa

SEQ ID NO: 3597569 - RNA, 15 nt, Human
aauuuuuauuucuuc

SEQ ID NO: 3597570 - RNA, 15 nt, Human
aauuuuuauuucuuu

SEQ ID NO: 3597571 - RNA, 15 nt, Human
aauuuuuauuuuucu

SEQ ID NO: 3597572 - RNA, 15 nt, Human
aauuuuucagaugcu

SEQ ID NO: 3597573 - RNA, 20 nt, Human
aauuuuucagcucucuguau

SEQ ID NO: 3597574 - RNA, 14 nt, Human
aauuuuucauauuu

SEQ ID NO: 3597575 - RNA, 14 nt, Human
aauuuuucuguaua

SEQ ID NO: 3597576 - RNA, 14 nt, Human
aauuuuucuucuug

SEQ ID NO: 3597577 - RNA, 20 nt, Human
aauuuuugccuucauuaccu

SEQ ID NO: 3597578 - RNA, 18 nt, Human
aauuuuugcuuuuagaaa

SEQ ID NO: 3597579 - RNA, 19 nt, Human
aauuuuugcuuuuagaaaa

SEQ ID NO: 3597580 - RNA, 18 nt, Human
aauuuuuggauugacagu

SEQ ID NO: 3597581 - RNA, 19 nt, Human
aauuuuuggauugacagua

SEQ ID NO: 3597582 - RNA, 21 nt, Human
aauuuuuggauugacaguaac

SEQ ID NO: 3597583 - RNA, 18 nt, Human
aauuuuugguugaauaaa

SEQ ID NO: 3597584 - RNA, 12 nt, Human
aauuuuuguauu

SEQ ID NO: 3597585 - RNA, 17 nt, Human
aauuuuugucucagaag

SEQ ID NO: 3597586 - RNA, 18 nt, Human
aauuuuuuaucaugcaug

SEQ ID NO: 3597587 - RNA, 20 nt, Human
aauuuuuuaucaugcauguc

SEQ ID NO: 3597588 - RNA, 21 nt, Human
aauuuuuugguacaaaaauaa

SEQ ID NO: 3597589 - RNA, 17 nt, Human
aauuuuuuguugacauu

SEQ ID NO: 3597590 - RNA, 16 nt, Human
aauuuuuuuaauuuug

SEQ ID NO: 3597591 - RNA, 17 nt, Human
aauuuuuuuaauuuugu

SEQ ID NO: 3597592 - RNA, 15 nt, Human
aauuuuuuuagaaag

SEQ ID NO: 3597593 - RNA, 23 nt, Human
aauuuuuuuauguuuuguuucug

SEQ ID NO: 3597594 - RNA, 20 nt, Human
aauuuuuuucaccuagauuu

SEQ ID NO: 3597595 - RNA, 15 nt, Human
aauuuuuuuguaaua

SEQ ID NO: 3597596 - RNA, 17 nt, Human
aauuuuuuuguaugaaa

SEQ ID NO: 3597597 - RNA, 18 nt, Human
aauuuuuuuguauuuuag

SEQ ID NO: 3597598 - RNA, 19 nt, Human
aauuuuuuuuaaaauagaa

SEQ ID NO: 3597599 - RNA, 20 nt, Human
aauuuuuuuuaaaauagaaa

SEQ ID NO: 3597600 - RNA, 15 nt, Human
aauuuuuuuuaacau

SEQ ID NO: 3597601 - RNA, 17 nt, Human
aauuuuuuuuaacauuc

SEQ ID NO: 3597602 - RNA, 18 nt, Human
aauuuuuuuuaacauucc

SEQ ID NO: 3597603 - RNA, 19 nt, Human
aauuuuuuuuaacauuccu

SEQ ID NO: 3597604 - RNA, 23 nt, Human
aauuuuuuuuauuaguauuguug

SEQ ID NO: 3597605 - RNA, 14 nt, Human
aauuuuuuuucaug

SEQ ID NO: 3597606 - RNA, 15 nt, Human
aauuuuuuuucaugu

SEQ ID NO: 3597607 - RNA, 21 nt, Human
aauuuuuuuuguuguuucagu

SEQ ID NO: 3597608 - RNA, 19 nt, Human
aauuuuuuuuuccuagccc

SEQ ID NO: 3597609 - RNA, 15 nt, Human
aauuuuuuuuuccuu

SEQ ID NO: 3597610 - RNA, 20 nt, Human
aauuuuuuuuuuuuaacuuu

SEQ ID NO: 3597611 - RNA, 19 nt, Human
acaaaaaaaaaguuuuauu

SEQ ID NO: 3597612 - RNA, 14 nt, Human
acaaaaaaaaauuu

SEQ ID NO: 3597613 - RNA, 19 nt, Human
acaaaaaaaguugaaggcc

SEQ ID NO: 3597614 - RNA, 23 nt, Human
acaaaaaaauaccucaggaaaga

SEQ ID NO: 3597615 - RNA, 19 nt, Human
acaaaaaaaucuuccaauu

SEQ ID NO: 3597616 - RNA, 17 nt, Human
acaaaaaacaauauuua

SEQ ID NO: 3597617 - RNA, 11 nt, Human
acaaaaaagug

SEQ ID NO: 3597618 - RNA, 14 nt, Human
acaaaaaauguuuu

SEQ ID NO: 3597619 - RNA, 15 nt, Human
acaaaaacacagcaa

SEQ ID NO: 3597620 - RNA, 16 nt, Human
acaaaaacacagcaag

SEQ ID NO: 3597621 - RNA, 16 nt, Human
acaaaaagaacaaaaa

SEQ ID NO: 3597622 - RNA, 20 nt, Human
acaaaaagauaccuuaaaau

SEQ ID NO: 3597623 - RNA, 16 nt, Human
acaaaaagcuacuuau

SEQ ID NO: 3597624 - RNA, 14 nt, Human
acaaaaagcuuccc

SEQ ID NO: 3597625 - RNA, 20 nt, Human
acaaaaagguucucaggugu

SEQ ID NO: 3597626 - RNA, 12 nt, Human
acaaaaauaaaa

SEQ ID NO: 3597627 - RNA, 20 nt, Human
acaaaaauaaauuuauauga

SEQ ID NO: 3597628 - RNA, 15 nt, Human
acaaaaaucagccag

SEQ ID NO: 3597629 - RNA, 23 nt, Human
acaaaaaugaacugaaguuucac

SEQ ID NO: 3597630 - RNA, 12 nt, Human
acaaaaauuauc

SEQ ID NO: 3597631 - RNA, 11 nt, Human
acaaaacaaaa

SEQ ID NO: 3597632 - RNA, 15 nt, Human
acaaaacaaaacaaa

SEQ ID NO: 3597633 - RNA, 18 nt, Human
acaaaacaaaacaaaacu

SEQ ID NO: 3597634 - RNA, 15 nt, Human
acaaaacaaauccug

SEQ ID NO: 3597635 - RNA, 23 nt, Human
acaaaacacucggcauuucaaau

SEQ ID NO: 3597636 - RNA, 16 nt, Human
acaaaaccaaaaguua

SEQ ID NO: 3597637 - RNA, 15 nt, Human
acaaaaccacagugu

SEQ ID NO: 3597638 - RNA, 16 nt, Human
acaaaacuagagacuc

SEQ ID NO: 3597639 - RNA, 17 nt, Human
acaaaacuucuugucag

SEQ ID NO: 3597640 - RNA, 19 nt, Human
acaaaacuucuugucagac

SEQ ID NO: 3597641 - RNA, 18 nt, Human
acaaaagaaauaccuuga

SEQ ID NO: 3597642 - RNA, 22 nt, Human
acaaaagcugaacacauuucuu

SEQ ID NO: 3597643 - RNA, 18 nt, Human
acaaaaggauaaugaaua

SEQ ID NO: 3597644 - RNA, 21 nt, Human
acaaaaggguuuaaacugauu

SEQ ID NO: 3597645 - RNA, 21 nt, Human
acaaaagucugucuuuccuga

SEQ ID NO: 3597646 - RNA, 22 nt, Human
acaaaaguuucauccuuuucau

SEQ ID NO: 3597647 - RNA, 10 nt, Human
acaaaauaaa

SEQ ID NO: 3597648 - RNA, 14 nt, Human
acaaaauaaacaaa

SEQ ID NO: 3597649 - RNA, 14 nt, Human
acaaaauacauucu

SEQ ID NO: 3597650 - RNA, 16 nt, Human
acaaaauacauucuuu

SEQ ID NO: 3597651 - RNA, 14 nt, Human
acaaaauagaaagu

SEQ ID NO: 3597652 - RNA, 12 nt, Human
acaaaauauaca

SEQ ID NO: 3597653 - RNA, 17 nt, Human
acaaaaucacuuccaua

SEQ ID NO: 3597654 - RNA, 20 nt, Human
acaaaauccagcuaugaaua

SEQ ID NO: 3597655 - RNA, 14 nt, Human
acaaaaucuguuua

SEQ ID NO: 3597656 - RNA, 13 nt, Human
acaaaaugaaacg

SEQ ID NO: 3597657 - RNA, 22 nt, Human
acaaaaugaaacgcaaccacca

SEQ ID NO: 3597658 - RNA, 13 nt, Human
acaaaaugaagcu

SEQ ID NO: 3597659 - RNA, 20 nt, Human
aauguauguguaaguauucu

SEQ ID NO: 3597660 - RNA, 17 nt, Human
aauguauguuaccaaaa

SEQ ID NO: 3597661 - RNA, 21 nt, Human
aauguauguuaccaaaaauaa

SEQ ID NO: 3597662 - RNA, 16 nt, Human
aauguauuauucugca

SEQ ID NO: 3597663 - RNA, 22 nt, Human
aauguauuauucugcagcauga

SEQ ID NO: 3597664 - RNA, 15 nt, Human
aauguauucauauuu

SEQ ID NO: 3597665 - RNA, 17 nt, Human
aauguauucauauuugu

SEQ ID NO: 3597666 - RNA, 20 nt, Human
aauguauucauauuuguacu

SEQ ID NO: 3597667 - RNA, 16 nt, Human
aauguauucuaucucu

SEQ ID NO: 3597668 - RNA, 21 nt, Human
aauguauucuaucucucuuua

SEQ ID NO: 3597669 - RNA, 13 nt, Human
aauguauuguacc

SEQ ID NO: 3597670 - RNA, 19 nt, Human
aauguauuguugguaauua

SEQ ID NO: 3597671 - RNA, 18 nt, Human
aauguauuuuauguuaua

SEQ ID NO: 3597672 - RNA, 20 nt, Human
aauguauuuuauguuauaua

SEQ ID NO: 3597673 - RNA, 15 nt, Human
aauguauuuuauugu

SEQ ID NO: 3597674 - RNA, 14 nt, Human
aaugucaaaaguag

SEQ ID NO: 3597675 - RNA, 15 nt, Human
aaugucaaaauuguu

SEQ ID NO: 3597676 - RNA, 16 nt, Human
aaugucaaggugcugu

SEQ ID NO: 3597677 - RNA, 14 nt, Human
aaugucacaggcag

SEQ ID NO: 3597678 - RNA, 16 nt, Human
aaugucacaggcaggu

SEQ ID NO: 3597679 - RNA, 18 nt, Human
aaugucaccaccuuccca

SEQ ID NO: 3597680 - RNA, 19 nt, Human
aaugucaccaccuucccag

SEQ ID NO: 3597681 - RNA, 20 nt, Human
aaugucaccaccuucccagc

SEQ ID NO: 3597682 - RNA, 23 nt, Human
aaugucaccaccuucccagcucu

SEQ ID NO: 3597683 - RNA, 22 nt, Human
aaugucacguuuuguuuugugc

SEQ ID NO: 3597684 - RNA, 17 nt, Human
aaugucagaaaaacaau

SEQ ID NO: 3597685 - RNA, 21 nt, Human
aaugucagaaaaacaauaaga

SEQ ID NO: 3597686 - RNA, 15 nt, Human
aaugucagauacaau

SEQ ID NO: 3597687 - RNA, 17 nt, Human
aaugucagauacaaugu

SEQ ID NO: 3597688 - RNA, 13 nt, Human
aaugucaguaugu

SEQ ID NO: 3597689 - RNA, 15 nt, Human
aaugucagugugacu

SEQ ID NO: 3597690 - RNA, 17 nt, Human
aaugucagugugacuga

SEQ ID NO: 3597691 - RNA, 21 nt, Human
aaugucauaaagugagaaaac

SEQ ID NO: 3597692 - RNA, 23 nt, Human
aaugucauaaagugagaaaacug

SEQ ID NO: 3597693 - RNA, 15 nt, Human
aaugucauauacugc

SEQ ID NO: 3597694 - RNA, 22 nt, Human
acaaacaucuaauaaguauaua

SEQ ID NO: 3597695 - RNA, 16 nt, Human
acaaacauuguguuga

SEQ ID NO: 3597696 - RNA, 15 nt, Human
acaaacauuuuucaa

SEQ ID NO: 3597697 - RNA, 12 nt, Human
acaaaccaaguc

SEQ ID NO: 3597698 - RNA, 15 nt, Human
acaaaccacaacuga

SEQ ID NO: 3597699 - RNA, 21 nt, Human
acaaaccacaacugacacagg

SEQ ID NO: 3597700 - RNA, 21 nt, Human
acaaacucguuuuuuacaaag

SEQ ID NO: 3597701 - RNA, 13 nt, Human
acaaacucuugaa

SEQ ID NO: 3597702 - RNA, 11 nt, Human
acaaacugaag

SEQ ID NO: 3597703 - RNA, 10 nt, Human
acaaacugca

SEQ ID NO: 3597704 - RNA, 13 nt, Human
acaaacugcaaua

SEQ ID NO: 3597705 - RNA, 16 nt, Human
acaaacugcacaugau

SEQ ID NO: 3597706 - RNA, 22 nt, Human
acaaacugcaccaguugcugcu

SEQ ID NO: 3597707 - RNA, 13 nt, Human
acaaacuuugcau

SEQ ID NO: 3597708 - RNA, 13 nt, Human
acaaacuuuuaua

SEQ ID NO: 3597709 - RNA, 12 nt, Human
acaaagaaaauu

SEQ ID NO: 3597710 - RNA, 18 nt, Human
acaaagaaacaaagaugu

SEQ ID NO: 3597711 - RNA, 13 nt, Human
acaaagaagacau

SEQ ID NO: 3597712 - RNA, 16 nt, Human
acaaagaagacauguu

SEQ ID NO: 3597713 - RNA, 14 nt, Human
acaaagaauuccaa

SEQ ID NO: 3597714 - RNA, 19 nt, Human
acaaagacaaauucuguuu

SEQ ID NO: 3597715 - RNA, 21 nt, Human
acaaagagaaaaagaaaugca

SEQ ID NO: 3597716 - RNA, 22 nt, Human
acaaagaguucaagaaauaagu

SEQ ID NO: 3597717 - RNA, 20 nt, Human
acaaagauaucuuuucuuua

SEQ ID NO: 3597718 - RNA, 20 nt, Human
acaaagauggcucagagggg

SEQ ID NO: 3597719 - RNA, 23 nt, Human
acaaagauguuugucagauauga

SEQ ID NO: 3597720 - RNA, 12 nt, Human
acaaagcagcca

SEQ ID NO: 3597721 - RNA, 19 nt, Human
acaaagccaaacucugcca

SEQ ID NO: 3597722 - RNA, 11 nt, Human
acaaagccaga

SEQ ID NO: 3597723 - RNA, 20 nt, Human
acaaagcccaagggaucugg

SEQ ID NO: 3597724 - RNA, 16 nt, Human
acaaagcccuuuuaua

SEQ ID NO: 3597725 - RNA, 13 nt, Human
acaaagcugcuaa

SEQ ID NO: 3597726 - RNA, 17 nt, Human
acaaagcugcuaaaucu

SEQ ID NO: 3597727 - RNA, 23 nt, Human
acaaagcugcuaaaucuccuauu

SEQ ID NO: 3597728 - RNA, 20 nt, Human
acaaagcuguuaaacuguua

SEQ ID NO: 3597729 - RNA, 21 nt, Human
acaaagcuuagcaggagagga

SEQ ID NO: 3597730 - RNA, 15 nt, Human
acaaagcuuuugcau

SEQ ID NO: 3597731 - RNA, 15 nt, Human
acaaaggagccugug

SEQ ID NO: 3597732 - RNA, 23 nt, Human
acaaaggagccugugaacccagg

SEQ ID NO: 3597733 - RNA, 23 nt, Human
acaaaggauacuuauuuaaauag

SEQ ID NO: 3597734 - RNA, 24 nt, Human
acaaaggauacuuauuuaaauaga

SEQ ID NO: 3597735 - RNA, 11 nt, Human
acaaaggcaag

SEQ ID NO: 3597736 - RNA, 23 nt, Human
acaaaggcaaguuaagagaaacu

SEQ ID NO: 3597737 - RNA, 18 nt, Human
acaaaggcuuauuaauuu

SEQ ID NO: 3597738 - RNA, 20 nt, Human
acaaagggcacagcaucugu

SEQ ID NO: 3597739 - RNA, 21 nt, Human
acaaaggggaucauaaaguua

SEQ ID NO: 3597740 - RNA, 19 nt, Human
acaaagguauaauuuuaug

SEQ ID NO: 3597741 - RNA, 17 nt, Human
acaaagguuuaaaugaa

SEQ ID NO: 3597742 - RNA, 18 nt, Human
acaaagguuuaaaugaac

SEQ ID NO: 3597743 - RNA, 19 nt, Human
acaaagguuuaaaugaaca

SEQ ID NO: 3597744 - RNA, 23 nt, Human
acaaagguuuaaaugaacaagag

SEQ ID NO: 3597745 - RNA, 13 nt, Human
acaaaguauuaag

SEQ ID NO: 3597746 - RNA, 14 nt, Human
acaaagucuccagc

SEQ ID NO: 3597747 - RNA, 15 nt, Human
acaaagugccaaaga

SEQ ID NO: 3597748 - RNA, 18 nt, Human
acaaagugccaaagaaag

SEQ ID NO: 3597749 - RNA, 14 nt, Human
acaaaguggaagga

SEQ ID NO: 3597750 - RNA, 16 nt, Human
acaaaguggaaggaaa

SEQ ID NO: 3597751 - RNA, 17 nt, Human
acaaaguggaaggaaag

SEQ ID NO: 3597752 - RNA, 19 nt, Human
acaaaguggcauaaaaaac

SEQ ID NO: 3597753 - RNA, 15 nt, Human
acaaaguguguauua

SEQ ID NO: 3597754 - RNA, 19 nt, Human
acaaaguguguauuaaaaa

SEQ ID NO: 3597755 - RNA, 21 nt, Human
acaaaguuacuagguaacuuc

SEQ ID NO: 3597756 - RNA, 18 nt, Human
acaaaguuuaucuuggcc

SEQ ID NO: 3597757 - RNA, 14 nt, Human
acaaaguuucagag

SEQ ID NO: 3597758 - RNA, 18 nt, Human
acaaaguuucagaguaua

SEQ ID NO: 3597759 - RNA, 22 nt, Human
acaaaguuucagaguauauugu

SEQ ID NO: 3597760 - RNA, 23 nt, Human
acaaauaacaacuuuuuuuucuu

SEQ ID NO: 3597761 - RNA, 13 nt, Human
acaaauaaucaca

SEQ ID NO: 3597762 - RNA, 15 nt, Human
acaaauacucuuagg

SEQ ID NO: 3597763 - RNA, 18 nt, Human
acaaauacuuauucauug

SEQ ID NO: 3597764 - RNA, 19 nt, Human
acaaauaggaugcuuggga

SEQ ID NO: 3597765 - RNA, 22 nt, Human
acaaauaguaggcaagauggca

SEQ ID NO: 3597766 - RNA, 23 nt, Human
acaaauaguaggcaagauggcac

SEQ ID NO: 3597767 - RNA, 20 nt, Human
acaaauagugcaacuaugaa

SEQ ID NO: 3597768 - RNA, 19 nt, Human
acaaauauaagaauaaaau

SEQ ID NO: 3597769 - RNA, 12 nt, Human
acaaauauauug

SEQ ID NO: 3597770 - RNA, 19 nt, Human
acaaauaugcaaaagguuc

SEQ ID NO: 3597771 - RNA, 16 nt, Human
acaaauaugcuaauuu

SEQ ID NO: 3597772 - RNA, 12 nt, Human
acaaauauuaaa

SEQ ID NO: 3597773 - RNA, 20 nt, Human
acaaauauuaaaaagucuuu

SEQ ID NO: 3597774 - RNA, 12 nt, Human
acaaauauuuau

SEQ ID NO: 3597775 - RNA, 19 nt, Human
acaaaucaacagaagcauu

SEQ ID NO: 3597776 - RNA, 23 nt, Human
acaaaucaacagaagcauuugua

SEQ ID NO: 3597777 - RNA, 22 nt, Human
acaaaucaagcuucaguuuccu

SEQ ID NO: 3597778 - RNA, 14 nt, Human
acaaaucagaaguc

SEQ ID NO: 3597779 - RNA, 20 nt, Human
acaaaucagaagucaucuug

SEQ ID NO: 3597780 - RNA, 23 nt, Human
acaaaucagaagucaucuugcua

SEQ ID NO: 3597781 - RNA, 15 nt, Human
acaaaucaguaauuu

SEQ ID NO: 3597782 - RNA, 21 nt, Human
acaaauccaaaggaaagaaua

SEQ ID NO: 3597783 - RNA, 18 nt, Human
acaaaucuaggaaaauau

SEQ ID NO: 3597784 - RNA, 20 nt, Human
acaaaucuauuuaauuagga

SEQ ID NO: 3597785 - RNA, 17 nt, Human
acaaaucuguguauauu

SEQ ID NO: 3597786 - RNA, 11 nt, Human
acaaaugaaaa

SEQ ID NO: 3597787 - RNA, 17 nt, Human
acaaaugacugucucuu

SEQ ID NO: 3597788 - RNA, 12 nt, Human
acaaaugacuuu

SEQ ID NO: 3597789 - RNA, 18 nt, Human
acaaaugacuuuauuauu

SEQ ID NO: 3597790 - RNA, 17 nt, Human
acaaaugcaugaacaag

SEQ ID NO: 3597791 - RNA, 23 nt, Human
acaaaugcauuucuaaagccauu

SEQ ID NO: 3597792 - RNA, 18 nt, Human
acaaaugccaaauuaaaa

SEQ ID NO: 3597793 - RNA, 16 nt, Human
acaaaugccacacauc

SEQ ID NO: 3597794 - RNA, 20 nt, Human
acaaaugccacacaucaccc

SEQ ID NO: 3597795 - RNA, 21 nt, Human
acaaaugcucaaagaaaucua

SEQ ID NO: 3597796 - RNA, 14 nt, Human
acaaauggccuuua

SEQ ID NO: 3597797 - RNA, 14 nt, Human
acaaauguaaacau

SEQ ID NO: 3597798 - RNA, 18 nt, Human
acaaauguaaacauuuuc

SEQ ID NO: 3597799 - RNA, 13 nt, Human
acaaauguaugau

SEQ ID NO: 3597800 - RNA, 13 nt, Human
acaaaugugaaga

SEQ ID NO: 3597801 - RNA, 23 nt, Human
acaaaugugaagaugcauuguag

SEQ ID NO: 3597802 - RNA, 22 nt, Human
acaaauguguaucggaugcuuu

SEQ ID NO: 3597803 - RNA, 13 nt, Human
aauacauucuuuu

SEQ ID NO: 3597804 - RNA, 18 nt, Human
aauacauugaauuagaaa

SEQ ID NO: 3597805 - RNA, 20 nt, Human
aauacauuuaaaacauuaaa

SEQ ID NO: 3597806 - RNA, 23 nt, Human
aauacauuuaaaacauuaaaaua

SEQ ID NO: 3597807 - RNA, 16 nt, Human
aauaccaaguauuuau

SEQ ID NO: 3597808 - RNA, 23 nt, Human
aauaccacaggaaccacaagacu

SEQ ID NO: 3597809 - RNA, 21 nt, Human
aauaccacaucaaauaagaaa

SEQ ID NO: 3597810 - RNA, 17 nt, Human
aauaccagccaguaaau

SEQ ID NO: 3597811 - RNA, 19 nt, Human
aauaccagccaguaaaugg

SEQ ID NO: 3597812 - RNA, 13 nt, Human
aauaccaggauuu

SEQ ID NO: 3597813 - RNA, 15 nt, Human
aauaccauuaaaacu

SEQ ID NO: 3597814 - RNA, 21 nt, Human
aauaccauuaaaacugcuuuu

SEQ ID NO: 3597815 - RNA, 16 nt, Human
aauaccauugacacau

SEQ ID NO: 3597816 - RNA, 20 nt, Human
aauaccauuuuuuaaggaaa

SEQ ID NO: 3597817 - RNA, 16 nt, Human
aauaccucaggaaaga

SEQ ID NO: 3597818 - RNA, 22 nt, Human
aauaccucauguuuaugaaaau

SEQ ID NO: 3597819 - RNA, 13 nt, Human
aauaccucugugu

SEQ ID NO: 3597820 - RNA, 15 nt, Human
aauaccucugugugc

SEQ ID NO: 3597821 - RNA, 21 nt, Human
aauaccucuuagcugagugga

SEQ ID NO: 3597822 - RNA, 12 nt, Human
aauaccugcccu

SEQ ID NO: 3597823 - RNA, 20 nt, Human
aauacgacacugaaauaugu

SEQ ID NO: 3597824 - RNA, 15 nt, Human
aauacuaccuugaaa

SEQ ID NO: 3597825 - RNA, 21 nt, Human
aauacuaccuugaaaauaaga

SEQ ID NO: 3597826 - RNA, 13 nt, Human
aauacuagccaga

SEQ ID NO: 3597827 - RNA, 19 nt, Human
aauacuagggagaagguuu

SEQ ID NO: 3597828 - RNA, 17 nt, Human
aauacuagucaccccaa

SEQ ID NO: 3597829 - RNA, 14 nt, Human
aauacuaguuguga

SEQ ID NO: 3597830 - RNA, 21 nt, Human
aauacuauuuaagaugugaaa

SEQ ID NO: 3597831 - RNA, 16 nt, Human
aauacuauuuuuacug

SEQ ID NO: 3597832 - RNA, 21 nt, Human
aauacuauuuuuacugccacu

SEQ ID NO: 3597833 - RNA, 13 nt, Human
aauacucaaauga

SEQ ID NO: 3597834 - RNA, 21 nt, Human
aauacucagggaaagcauuua

SEQ ID NO: 3597835 - RNA, 19 nt, Human
aauacucauaaugugaagu

SEQ ID NO: 3597836 - RNA, 12 nt, Human
aauacucaugug

SEQ ID NO: 3597837 - RNA, 14 nt, Human
aauacucaugugua

SEQ ID NO: 3597838 - RNA, 13 nt, Human
aauacucuaauuc

SEQ ID NO: 3597839 - RNA, 18 nt, Human
aauacucuauuuuuacau

SEQ ID NO: 3597840 - RNA, 13 nt, Human
aauacucugcccu

SEQ ID NO: 3597841 - RNA, 22 nt, Human
aauacucuguuguacuauggaa

SEQ ID NO: 3597842 - RNA, 23 nt, Human
aauacucuuaggaagagaaacca

SEQ ID NO: 3597843 - RNA, 15 nt, Human
aauacugaacaucug

SEQ ID NO: 3597844 - RNA, 14 nt, Human
aauacugaaccacu

SEQ ID NO: 3597845 - RNA, 14 nt, Human
aauacugcaaauca

SEQ ID NO: 3597846 - RNA, 18 nt, Human
aauacugccagaugcuga

SEQ ID NO: 3597847 - RNA, 19 nt, Human
aauacugccagaugcugau

SEQ ID NO: 3597848 - RNA, 23 nt, Human
aauacugccagaugcugauguuc

SEQ ID NO: 3597849 - RNA, 21 nt, Human
aauacugcugagauacauaca

SEQ ID NO: 3597850 - RNA, 22 nt, Human
aauacuguacaaugacuuuauu

SEQ ID NO: 3597851 - RNA, 15 nt, Human
aauacuguacagggg

SEQ ID NO: 3597852 - RNA, 14 nt, Human
aauacuguguggaa

SEQ ID NO: 3597853 - RNA, 12 nt, Human
aauacuguuuga

SEQ ID NO: 3597854 - RNA, 17 nt, Human
aauacuuauucauugug

SEQ ID NO: 3597855 - RNA, 15 nt, Human
aauacuuccagaagu

SEQ ID NO: 3597856 - RNA, 14 nt, Human
aauacuucucauuu

SEQ ID NO: 3597857 - RNA, 22 nt, Human
aauacuucucauuuuuuaaaaa

SEQ ID NO: 3597858 - RNA, 14 nt, Human
aauacuucuugugu

SEQ ID NO: 3597859 - RNA, 19 nt, Human
aauacuucuuguguguaug

SEQ ID NO: 3597860 - RNA, 19 nt, Human
aauacuugaaccauaaaau

SEQ ID NO: 3597861 - RNA, 15 nt, Human
aauacuugaacuugu

SEQ ID NO: 3597862 - RNA, 14 nt, Human
aauacuuugaaugu

SEQ ID NO: 3597863 - RNA, 17 nt, Human
aauacuuugaauguguu

SEQ ID NO: 3597864 - RNA, 17 nt, Human
aauacuuuguauacaag

SEQ ID NO: 3597865 - RNA, 15 nt, Human
aauacuuuuacucug

SEQ ID NO: 3597866 - RNA, 18 nt, Human
aauacuuuuacucugccu

SEQ ID NO: 3597867 - RNA, 20 nt, Human
aauacuuuuacucugccuac

SEQ ID NO: 3597868 - RNA, 10 nt, Human
aauacuuuuu

SEQ ID NO: 3597869 - RNA, 15 nt, Human
aauacuuuuuacaau

SEQ ID NO: 3597870 - RNA, 19 nt, Human
aauagaaaacugaaaaucu

SEQ ID NO: 3597871 - RNA, 15 nt, Human
aauagaaaaguuauu

SEQ ID NO: 3597872 - RNA, 13 nt, Human
aauagaaaauggu

SEQ ID NO: 3597873 - RNA, 22 nt, Human
aauagaaauaaaggaugugauu

SEQ ID NO: 3597874 - RNA, 17 nt, Human
aauagaaauuuuguaag

SEQ ID NO: 3597875 - RNA, 18 nt, Human
aauagaaauuuuguaaga

SEQ ID NO: 3597876 - RNA, 19 nt, Human
aauagaaauuuuguaagaa

SEQ ID NO: 3597877 - RNA, 15 nt, Human
aauagaagaacaucc

SEQ ID NO: 3597878 - RNA, 19 nt, Human
aauagaaggauguacauuu

SEQ ID NO: 3597879 - RNA, 20 nt, Human
aauagaaggauguacauuuc

SEQ ID NO: 3597880 - RNA, 19 nt, Human
aauagaagugcuccccucu

SEQ ID NO: 3597881 - RNA, 16 nt, Human
aauagaauaaaggcag

SEQ ID NO: 3597882 - RNA, 19 nt, Human
aauagacaaauagaaaaug

SEQ ID NO: 3597883 - RNA, 18 nt, Human
aauagacaauuuauuaug

SEQ ID NO: 3597884 - RNA, 23 nt, Human
aauagacaauuuauuauggcaca

SEQ ID NO: 3597885 - RNA, 16 nt, Human
aauagacagcaugaga

SEQ ID NO: 3597886 - RNA, 15 nt, Human
aauagacaguauauu

SEQ ID NO: 3597887 - RNA, 20 nt, Human
aauagacaguauauuuauag

SEQ ID NO: 3597888 - RNA, 15 nt, Human
aauagacaucaaacu

SEQ ID NO: 3597889 - RNA, 15 nt, Human
aauagacuaaaugaa

SEQ ID NO: 3597890 - RNA, 16 nt, Human
aauagacuaaaugaaa

SEQ ID NO: 3597891 - RNA, 14 nt, Human
aauagagacuguag

SEQ ID NO: 3597892 - RNA, 18 nt, Human
aauagagacuguagauug

SEQ ID NO: 3597893 - RNA, 19 nt, Human
aauagagaugagcuuucuu

SEQ ID NO: 3597894 - RNA, 20 nt, Human
aauagagcaaaauugaugug

SEQ ID NO: 3597895 - RNA, 22 nt, Human
aauagagcaaaauugauguguu

SEQ ID NO: 3597896 - RNA, 18 nt, Human
aauagaguauaugcacuu

SEQ ID NO: 3597897 - RNA, 21 nt, Human
aauuguaaaauuguauagaga

SEQ ID NO: 3597898 - RNA, 14 nt, Human
aauuguaaacugua

SEQ ID NO: 3597899 - RNA, 24 nt, Human
aauuguaaauugaaucaguauaaa

SEQ ID NO: 3597900 - RNA, 12 nt, Human
aauuguaaggaa

SEQ ID NO: 3597901 - RNA, 22 nt, Human
aauuguaaggaaugauuaauua

SEQ ID NO: 3597902 - RNA, 14 nt, Human
aauuguaauuauau

SEQ ID NO: 3597903 - RNA, 17 nt, Human
aauuguaauuauaucug

SEQ ID NO: 3597904 - RNA, 14 nt, Human
aauuguacauauuu

SEQ ID NO: 3597905 - RNA, 16 nt, Human
aauuguacuaaagcca

SEQ ID NO: 3597906 - RNA, 18 nt, Human
aauuguaggggugugugu

SEQ ID NO: 3597907 - RNA, 17 nt, Human
aauuguauaacagguua

SEQ ID NO: 3597908 - RNA, 13 nt, Human
aauuguauauuca

SEQ ID NO: 3597909 - RNA, 17 nt, Human
aauuguauauucacuuu

SEQ ID NO: 3597910 - RNA, 21 nt, Human
aauuguaucagaggccuauaa

SEQ ID NO: 3597911 - RNA, 22 nt, Human
aauuguaucagaggccuauaau

SEQ ID NO: 3597912 - RNA, 18 nt, Human
aauuguaucauuugaaca

SEQ ID NO: 3597913 - RNA, 20 nt, Human
aauuguaucguauagcugua

SEQ ID NO: 3597914 - RNA, 21 nt, Human
aauuguaucguauagcuguau

SEQ ID NO: 3597915 - RNA, 20 nt, Human
aauuguaucuagugcagcug

SEQ ID NO: 3597916 - RNA, 23 nt, Human
aauuguaucuagugcagcugauu

SEQ ID NO: 3597917 - RNA, 16 nt, Human
aauuguauuuuaguaa

SEQ ID NO: 3597918 - RNA, 18 nt, Human
aauugucagcaauuuaac

SEQ ID NO: 3597919 - RNA, 12 nt, Human
aauugucuauuu

SEQ ID NO: 3597920 - RNA, 18 nt, Human
aauugucuauuuaucuuu

SEQ ID NO: 3597921 - RNA, 18 nt, Human
aauugugaauugauaaua

SEQ ID NO: 3597922 - RNA, 18 nt, Human
aauugugauuagacagaa

SEQ ID NO: 3597923 - RNA, 20 nt, Human
aauugugauuagacagaaca

SEQ ID NO: 3597924 - RNA, 21 nt, Human
aauugugauuagacagaacac

SEQ ID NO: 3597925 - RNA, 14 nt, Human
aauugugcugccau

SEQ ID NO: 3597926 - RNA, 15 nt, Human
aauugugcugccauu

SEQ ID NO: 3597927 - RNA, 16 nt, Human
aauugugcugccauuu

SEQ ID NO: 3597928 - RNA, 19 nt, Human
aauugugcugccauuugau

SEQ ID NO: 3597929 - RNA, 20 nt, Human
aauugugcuucuccccagaa

SEQ ID NO: 3597930 - RNA, 21 nt, Human
aauugugcuucuccccagaau

SEQ ID NO: 3597931 - RNA, 17 nt, Human
aauugugggucuauuuc

SEQ ID NO: 3597932 - RNA, 22 nt, Human
aauuguguacucggaaauuaaa

SEQ ID NO: 3597933 - RNA, 15 nt, Human
aauuguguagccuuu

SEQ ID NO: 3597934 - RNA, 14 nt, Human
aauugugucugcag

SEQ ID NO: 3597935 - RNA, 18 nt, Human
aauugugugaacuuggaa

SEQ ID NO: 3597936 - RNA, 15 nt, Human
aauugugugauauuu

SEQ ID NO: 3597937 - RNA, 21 nt, Human
aauugugugauauuucagaaa

SEQ ID NO: 3597938 - RNA, 14 nt, Human
aauuguguuuacau

SEQ ID NO: 3597939 - RNA, 19 nt, Human
aauuguguuuacauuuuau

SEQ ID NO: 3597940 - RNA, 20 nt, Human
aauuguguuuauaauuuuaa

SEQ ID NO: 3597941 - RNA, 15 nt, Human
aauuguuaagauaug

SEQ ID NO: 3597942 - RNA, 13 nt, Human
aauuguucucaga

SEQ ID NO: 3597943 - RNA, 18 nt, Human
aauuguugaaauuuugca

SEQ ID NO: 3597944 - RNA, 14 nt, Human
aauuguugacaaau

SEQ ID NO: 3597945 - RNA, 20 nt, Human
aauuguugacaguucugaag

SEQ ID NO: 3597946 - RNA, 20 nt, Human
aauuguuguccgguuuacuu

SEQ ID NO: 3597947 - RNA, 22 nt, Human
aauuguuguccgguuuacuuua

SEQ ID NO: 3597948 - RNA, 23 nt, Human
aauuguuguccgguuuacuuuaa

SEQ ID NO: 3597949 - RNA, 15 nt, Human
aauuguuguucuguu

SEQ ID NO: 3597950 - RNA, 17 nt, Human
aauuguuguucuguuaa

SEQ ID NO: 3597951 - RNA, 22 nt, Human
aauuguuguucuguuaacugaa

SEQ ID NO: 3597952 - RNA, 12 nt, Human
aauuguuguuuc

SEQ ID NO: 3597953 - RNA, 21 nt, Human
aauuguuguuucuuucuagug

SEQ ID NO: 3597954 - RNA, 23 nt, Human
aauuguuguuucuuucuaguggu

SEQ ID NO: 3597955 - RNA, 19 nt, Human
aauuguuguuuguauguau

SEQ ID NO: 3597956 - RNA, 22 nt, Human
aauuguuguuuguauguauaau

SEQ ID NO: 3597957 - RNA, 14 nt, Human
aauuguuuagauuu

SEQ ID NO: 3597958 - RNA, 22 nt, Human
aauuguuuagauuuuguguuua

SEQ ID NO: 3597959 - RNA, 20 nt, Human
aauuguuucaaaauaaaaac

SEQ ID NO: 3597960 - RNA, 14 nt, Human
aauuguuucagaau

SEQ ID NO: 3597961 - RNA, 21 nt, Human
aauuguuugacggcaagguuu

SEQ ID NO: 3597962 - RNA, 18 nt, Human
aauuguuuuaaucugaaa

SEQ ID NO: 3597963 - RNA, 19 nt, Human
aauuguuuuaaucugaaau

SEQ ID NO: 3597964 - RNA, 14 nt, Human
aauuguuuucuuua

SEQ ID NO: 3597965 - RNA, 15 nt, Human
aauuguuuucuuuaa

SEQ ID NO: 3597966 - RNA, 19 nt, Human
aauuguuuucuuuaaagau

SEQ ID NO: 3597967 - RNA, 17 nt, Human
aauuuaaaaagcccaac

SEQ ID NO: 3597968 - RNA, 22 nt, Human
aauuuaaaaaugagugugaagg

SEQ ID NO: 3597969 - RNA, 12 nt, Human
aauuuaaaacaa

SEQ ID NO: 3597970 - RNA, 16 nt, Human
aauuuaaaaguaaaau

SEQ ID NO: 3597971 - RNA, 19 nt, Human
aauuuaaaauaauuauaua

SEQ ID NO: 3597972 - RNA, 20 nt, Human
aauuuaaacaggcccagcau

SEQ ID NO: 3597973 - RNA, 19 nt, Human
aauuuaaacccauuuuagu

SEQ ID NO: 3597974 - RNA, 22 nt, Human
aauuuaaacuauaagcaagaag

SEQ ID NO: 3597975 - RNA, 19 nt, Human
aauuuaaagcagguucuug

SEQ ID NO: 3597976 - RNA, 21 nt, Human
aauuuaaaggguguacuuaua

SEQ ID NO: 3597977 - RNA, 15 nt, Human
aauuuaaauagcuuu

SEQ ID NO: 3597978 - RNA, 16 nt, Human
aauuuaaauauaauuc

SEQ ID NO: 3597979 - RNA, 19 nt, Human
aauuuaaauauaauucugu

SEQ ID NO: 3597980 - RNA, 15 nt, Human
aauuuaacaaugcga

SEQ ID NO: 3597981 - RNA, 23 nt, Human
aauuuaacuacccuuaauuacuu

SEQ ID NO: 3597982 - RNA, 21 nt, Human
aauuuaacuagacacagauaa

SEQ ID NO: 3597983 - RNA, 12 nt, Human
aauuuaagcauu

SEQ ID NO: 3597984 - RNA, 14 nt, Human
aauuuaaguaucuu

SEQ ID NO: 3597985 - RNA, 16 nt, Human
aauuuaagugcgugug

SEQ ID NO: 3597986 - RNA, 20 nt, Human
aauuuaagugcguguguaga

SEQ ID NO: 3597987 - RNA, 20 nt, Human
aauuuaauaccagauaccuu

SEQ ID NO: 3597988 - RNA, 14 nt, Human
aauuuaaugcaugu

SEQ ID NO: 3597989 - RNA, 15 nt, Human
aauuuaaugcugccu

SEQ ID NO: 3597990 - RNA, 18 nt, Human
aauuuaauucauguuucu

SEQ ID NO: 3597991 - RNA, 17 nt, Human
aauuuacagagacagaa

SEQ ID NO: 3597992 - RNA, 23 nt, Human
aauuuacuacaauauguacauuu

SEQ ID NO: 3597993 - RNA, 19 nt, Human
aauuuacuggacaaagaau

SEQ ID NO: 3597994 - RNA, 14 nt, Human
aauuuacuugccau

SEQ ID NO: 3597995 - RNA, 15 nt, Human
aauuuacuuguuuug

SEQ ID NO: 3597996 - RNA, 18 nt, Human
aauuuacuuuaaacuaca

SEQ ID NO: 3597997 - RNA, 15 nt, Human
aauuuagaaaaagaa

SEQ ID NO: 3597998 - RNA, 21 nt, Human
aauuuagaaaaagaacaugca

SEQ ID NO: 3597999 - RNA, 13 nt, Human
aauuuagaaacua

SEQ ID NO: 3598000 - RNA, 18 nt, Human
aauuuagaaacuaauuga

SEQ ID NO: 3598001 - RNA, 21 nt, Human
aauuuagaaacuaauugacuu

SEQ ID NO: 3598002 - RNA, 17 nt, Human
aauuuagacuucaagca

SEQ ID NO: 3598003 - RNA, 20 nt, Human
aauuuagacuuggauucuuu

SEQ ID NO: 3598004 - RNA, 13 nt, Human
aauuuagcauugu

SEQ ID NO: 3598005 - RNA, 18 nt, Human
aauuuaggguacuaaauu

SEQ ID NO: 3598006 - RNA, 21 nt, Human
aauuuaggguacuaaauuuaa

SEQ ID NO: 3598007 - RNA, 15 nt, Human
aauuuaguaaaccaa

SEQ ID NO: 3598008 - RNA, 20 nt, Human
aauuuaguaaaccaauccua

SEQ ID NO: 3598009 - RNA, 12 nt, Human
aauuuaguauua

SEQ ID NO: 3598010 - RNA, 13 nt, Human
aauuuaguguuuu

SEQ ID NO: 3598011 - RNA, 16 nt, Human
aauuuaguuguuguag

SEQ ID NO: 3598012 - RNA, 22 nt, Human
aauuuauaaaaagguguuuuga

SEQ ID NO: 3598013 - RNA, 18 nt, Human
aauuuauaaaauuagaaa

SEQ ID NO: 3598014 - RNA, 15 nt, Human
aauuuauaaugauua

SEQ ID NO: 3598015 - RNA, 13 nt, Human
aauuuauaauuca

SEQ ID NO: 3598016 - RNA, 13 nt, Human
aauuuauaauuuu

SEQ ID NO: 3598017 - RNA, 20 nt, Human
aauuuauaccucaauuuuca

SEQ ID NO: 3598018 - RNA, 15 nt, Human
aauuuauaguaauga

SEQ ID NO: 3598019 - RNA, 20 nt, Human
aauuuauaguaaugaguuua

SEQ ID NO: 3598020 - RNA, 16 nt, Human
aauuuauauguaucca

SEQ ID NO: 3598021 - RNA, 17 nt, Human
aauuuaucacacuucug

SEQ ID NO: 3598022 - RNA, 18 nt, Human
aauuuauccugaaauuuc

SEQ ID NO: 3598023 - RNA, 23 nt, Human
aauuuauccugaaauuucagauu

SEQ ID NO: 3598024 - RNA, 18 nt, Human
aauuuaucuugucucugg

SEQ ID NO: 3598025 - RNA, 19 nt, Human
aauuuaucuugucucuggg

SEQ ID NO: 3598026 - RNA, 20 nt, Human
aauuuaucuugucucugggc

SEQ ID NO: 3598027 - RNA, 16 nt, Human
aauuuaucuuugauaa

SEQ ID NO: 3598028 - RNA, 12 nt, Human
aauuuauuaaau

SEQ ID NO: 3598029 - RNA, 19 nt, Human
aauuuauuacuuguugcaa

SEQ ID NO: 3598030 - RNA, 14 nt, Human
aauuuauucaagaa

SEQ ID NO: 3598031 - RNA, 12 nt, Human
aauuuauucaau

SEQ ID NO: 3598032 - RNA, 22 nt, Human
aauuuauugaggaaaaauaugu

SEQ ID NO: 3598033 - RNA, 20 nt, Human
aauuuauuuauacuauuuag

SEQ ID NO: 3598034 - RNA, 20 nt, Human
aauuuauuuaugggauccug

SEQ ID NO: 3598035 - RNA, 22 nt, Human
aauuuauuuauuaagauggauu

SEQ ID NO: 3598036 - RNA, 12 nt, Human
aauuuauuucca

SEQ ID NO: 3598037 - RNA, 14 nt, Human
aauuuauuuccacu

SEQ ID NO: 3598038 - RNA, 20 nt, Human
aauuuauuuccacuaaaaau

SEQ ID NO: 3598039 - RNA, 16 nt, Human
aauuuauuuuauaaga

SEQ ID NO: 3598040 - RNA, 17 nt, Human
aauuuauuuuauaagaa

SEQ ID NO: 3598041 - RNA, 22 nt, Human
aauuuauuuuauuuuagcaguu

SEQ ID NO: 3598042 - RNA, 17 nt, Human
aauuuauuuugucgaau

SEQ ID NO: 3598043 - RNA, 15 nt, Human
aauuuauuuuugcau

SEQ ID NO: 3598044 - RNA, 19 nt, Human
aauuucaaaaauauaacuu

SEQ ID NO: 3598045 - RNA, 15 nt, Human
aauuucaaaagacau

SEQ ID NO: 3598046 - RNA, 23 nt, Human
acacauccgccuuuuguauacau

SEQ ID NO: 3598047 - RNA, 15 nt, Human
acacaucuucaacag

SEQ ID NO: 3598048 - RNA, 13 nt, Human
acacaucuuccac

SEQ ID NO: 3598049 - RNA, 13 nt, Human
acacaucuuuccu

SEQ ID NO: 3598050 - RNA, 21 nt, Human
acacaugagcaucaggccagg

SEQ ID NO: 3598051 - RNA, 19 nt, Human
acacaugcaaggucauuuu

SEQ ID NO: 3598052 - RNA, 12 nt, Human
acacaugcacac

SEQ ID NO: 3598053 - RNA, 13 nt, Human
acacaugcauaca

SEQ ID NO: 3598054 - RNA, 15 nt, Human
acacaugcauacaca

SEQ ID NO: 3598055 - RNA, 13 nt, Human
acacauguccaag

SEQ ID NO: 3598056 - RNA, 18 nt, Human
acacauguccaagaagcc

SEQ ID NO: 3598057 - RNA, 14 nt, Human
acacauuacaaagu

SEQ ID NO: 3598058 - RNA, 23 nt, Human
acacauuacaaaguuaaaauugu

SEQ ID NO: 3598059 - RNA, 22 nt, Human
acacauugaguuggaaucacug

SEQ ID NO: 3598060 - RNA, 21 nt, Human
acacauugugucacaucauga

SEQ ID NO: 3598061 - RNA, 13 nt, Human
acacauuguuauu

SEQ ID NO: 3598062 - RNA, 18 nt, Human
acacauuucacugucugu

SEQ ID NO: 3598063 - RNA, 17 nt, Human
acacauuugcuacuguu

SEQ ID NO: 3598064 - RNA, 18 nt, Human
acacauuuguacagaauu

SEQ ID NO: 3598065 - RNA, 14 nt, Human
acacauuuuauuuu

SEQ ID NO: 3598066 - RNA, 21 nt, Human
acacauuuuauuuuauuaugc

SEQ ID NO: 3598067 - RNA, 12 nt, Human
acacauuuugua

SEQ ID NO: 3598068 - RNA, 14 nt, Human
acacauuuuguaua

SEQ ID NO: 3598069 - RNA, 16 nt, Human
acacauuuuguauaau

SEQ ID NO: 3598070 - RNA, 15 nt, Human
acacauuuuuaaauu

SEQ ID NO: 3598071 - RNA, 12 nt, Human
acacauuuuucu

SEQ ID NO: 3598072 - RNA, 16 nt, Human
acacauuuuuuaaaug

SEQ ID NO: 3598073 - RNA, 20 nt, Human
acacauuuuuuaaaugcacc

SEQ ID NO: 3598074 - RNA, 15 nt, Human
acacauuuuuuagga

SEQ ID NO: 3598075 - RNA, 19 nt, Human
acacauuuuuuaggaaaug

SEQ ID NO: 3598076 - RNA, 14 nt, Human
acaccaaaguucua

SEQ ID NO: 3598077 - RNA, 14 nt, Human
acaccaaauaaaua

SEQ ID NO: 3598078 - RNA, 16 nt, Human
acaccaagcagcaaca

SEQ ID NO: 3598079 - RNA, 17 nt, Human
acaccaagcugugccac

SEQ ID NO: 3598080 - RNA, 22 nt, Human
acaccaagcugugccacccugg

SEQ ID NO: 3598081 - RNA, 20 nt, Human
acaccaaucuuacuuuguaa

SEQ ID NO: 3598082 - RNA, 12 nt, Human
acaccacacaca

SEQ ID NO: 3598083 - RNA, 16 nt, Human
acaccacacacaacag

SEQ ID NO: 3598084 - RNA, 13 nt, Human
acaccacacccag

SEQ ID NO: 3598085 - RNA, 16 nt, Human
acaccacagacacaca

SEQ ID NO: 3598086 - RNA, 14 nt, Human
acaccacuacauuc

SEQ ID NO: 3598087 - RNA, 20 nt, Human
acaccacuacauucuguuaa

SEQ ID NO: 3598088 - RNA, 21 nt, Human
acaccacuacauucuguuaau

SEQ ID NO: 3598089 - RNA, 13 nt, Human
acaccacuagccu

SEQ ID NO: 3598090 - RNA, 16 nt, Human
acaccacucuggcagc

SEQ ID NO: 3598091 - RNA, 19 nt, Human
acaccagagcagaugcaga

SEQ ID NO: 3598092 - RNA, 18 nt, Human
aauuucuuaugugacauu

SEQ ID NO: 3598093 - RNA, 16 nt, Human
aauuucuucaaaaugu

SEQ ID NO: 3598094 - RNA, 19 nt, Human
aauuucuucaaaauguaua

SEQ ID NO: 3598095 - RNA, 18 nt, Human
aauuucuucucaaagggu

SEQ ID NO: 3598096 - RNA, 23 nt, Human
aauuucuucuccuggaguugcau

SEQ ID NO: 3598097 - RNA, 22 nt, Human
aauuucuuuauguaaucuaugu

SEQ ID NO: 3598098 - RNA, 16 nt, Human
aauuugaaaaugauaa

SEQ ID NO: 3598099 - RNA, 15 nt, Human
aauuugaaacacuuu

SEQ ID NO: 3598100 - RNA, 12 nt, Human
aauuugaaacau

SEQ ID NO: 3598101 - RNA, 21 nt, Human
aauuugaaacauugcuuuuaa

SEQ ID NO: 3598102 - RNA, 14 nt, Human
aauuugaaguaaug

SEQ ID NO: 3598103 - RNA, 14 nt, Human
aauuugaaugaaaa

SEQ ID NO: 3598104 - RNA, 15 nt, Human
aauuugaaugaaaaa

SEQ ID NO: 3598105 - RNA, 16 nt, Human
aauuugaaugaaaaau

SEQ ID NO: 3598106 - RNA, 17 nt, Human
aauuugacuuuucugua

SEQ ID NO: 3598107 - RNA, 19 nt, Human
aauuugacuuuucuguaau

SEQ ID NO: 3598108 - RNA, 13 nt, Human
aauuugaggacaa

SEQ ID NO: 3598109 - RNA, 14 nt, Human
aauuugaggacaac

SEQ ID NO: 3598110 - RNA, 13 nt, Human
aauuugauacaua

SEQ ID NO: 3598111 - RNA, 12 nt, Human
aauuugauacuu

SEQ ID NO: 3598112 - RNA, 14 nt, Human
aauuugauaucaca

SEQ ID NO: 3598113 - RNA, 16 nt, Human
aauuugauaucacagu

SEQ ID NO: 3598114 - RNA, 18 nt, Human
aauuugauaucacagucu

SEQ ID NO: 3598115 - RNA, 19 nt, Human
aauuugauaugugaacagu

SEQ ID NO: 3598116 - RNA, 22 nt, Human
aauuugauguggugaaaagcag

SEQ ID NO: 3598117 - RNA, 15 nt, Human
aauuugauuaacaaa

SEQ ID NO: 3598118 - RNA, 17 nt, Human
aauuugauuauuaacau

SEQ ID NO: 3598119 - RNA, 15 nt, Human
aauuugauugauuug

SEQ ID NO: 3598120 - RNA, 19 nt, Human
aauuugcaaaguacuguaa

SEQ ID NO: 3598121 - RNA, 16 nt, Human
aauuugcacauuaaau

SEQ ID NO: 3598122 - RNA, 14 nt, Human
aauuugcauacuua

SEQ ID NO: 3598123 - RNA, 20 nt, Human
aauuugcauuaaauuacaga

SEQ ID NO: 3598124 - RNA, 17 nt, Human
aauuugcauuaaauuca

SEQ ID NO: 3598125 - RNA, 18 nt, Human
aauuugcauuaaauucac

SEQ ID NO: 3598126 - RNA, 21 nt, Human
aauuugcauuaaauucacaaa

SEQ ID NO: 3598127 - RNA, 16 nt, Human
aauuugccaaaauaau

SEQ ID NO: 3598128 - RNA, 20 nt, Human
aauuugccaaaauaaugucu

SEQ ID NO: 3598129 - RNA, 20 nt, Human
aauuugcccugggaaacccc

SEQ ID NO: 3598130 - RNA, 15 nt, Human
aauuugccugcuggg

SEQ ID NO: 3598131 - RNA, 20 nt, Human
aauuugcugccaaaugcgua

SEQ ID NO: 3598132 - RNA, 13 nt, Human
aauuugcugcuga

SEQ ID NO: 3598133 - RNA, 16 nt, Human
aauuuggaaacuaaua

SEQ ID NO: 3598134 - RNA, 17 nt, Human
aauuuggaaacuaauaa

SEQ ID NO: 3598135 - RNA, 20 nt, Human
aauuuggaaacuaauaaaau

SEQ ID NO: 3598136 - RNA, 14 nt, Human
aauuuggaaauccu

SEQ ID NO: 3598137 - RNA, 18 nt, Human
aauuuggagcacaaaauu

SEQ ID NO: 3598138 - RNA, 19 nt, Human
aauuuggagcacaaaauuc

SEQ ID NO: 3598139 - RNA, 21 nt, Human
aauuuggagcacaaaauucaa

SEQ ID NO: 3598140 - RNA, 22 nt, Human
aauuuggaucucuucuuaaugu

SEQ ID NO: 3598141 - RNA, 23 nt, Human
aauuuggaucucuucuuaaugua

SEQ ID NO: 3598142 - RNA, 18 nt, Human
aauuuggcaauuuugugg

SEQ ID NO: 3598143 - RNA, 18 nt, Human
aauuuggccugcacuaau

SEQ ID NO: 3598144 - RNA, 12 nt, Human
aauuuggcuucu

SEQ ID NO: 3598145 - RNA, 17 nt, Human
aauuugggacccugcuu

SEQ ID NO: 3598146 - RNA, 11 nt, Human
aauuuggggac

SEQ ID NO: 3598147 - RNA, 22 nt, Human
aauuuggggacagauucagucu

SEQ ID NO: 3598148 - RNA, 23 nt, Human
aauuuggggacagauucagucuu

SEQ ID NO: 3598149 - RNA, 18 nt, Human
aauuugggggacuuacau

SEQ ID NO: 3598150 - RNA, 22 nt, Human
aauuugguucuaauagaacuca

SEQ ID NO: 3598151 - RNA, 20 nt, Human
aauuuguaaaauguucucuu

SEQ ID NO: 3598152 - RNA, 16 nt, Human
aauuuguaaguuucag

SEQ ID NO: 3598153 - RNA, 18 nt, Human
aauuuguaaguuucaggu

SEQ ID NO: 3598154 - RNA, 20 nt, Human
aauuuguaaugucuugagcu

SEQ ID NO: 3598155 - RNA, 19 nt, Human
aauuuguaauugcuuacau

SEQ ID NO: 3598156 - RNA, 12 nt, Human
aauuuguaucug

SEQ ID NO: 3598157 - RNA, 14 nt, Human
aauuuguaucugaa

SEQ ID NO: 3598158 - RNA, 18 nt, Human
aauuugucauuuugaagc

SEQ ID NO: 3598159 - RNA, 20 nt, Human
aauuugucugaaacauuuca

SEQ ID NO: 3598160 - RNA, 22 nt, Human
aauuugucugaaacauuucaua

SEQ ID NO: 3598161 - RNA, 18 nt, Human
aauuugugauacaaugcu

SEQ ID NO: 3598162 - RNA, 20 nt, Human
aauuugugauacaaugcugu

SEQ ID NO: 3598163 - RNA, 16 nt, Human
aauuuguggugauuug

SEQ ID NO: 3598164 - RNA, 19 nt, Human
aauuuguguaaauuauuga

SEQ ID NO: 3598165 - RNA, 19 nt, Human
aauuuguguaauaaagugu

SEQ ID NO: 3598166 - RNA, 19 nt, Human
aauuuguguugaaggaacu

SEQ ID NO: 3598167 - RNA, 15 nt, Human
aauuuguucuuguau

SEQ ID NO: 3598168 - RNA, 16 nt, Human
aauuuguucuuguauu

SEQ ID NO: 3598169 - RNA, 18 nt, Human
aauuuguugaaauuaugu

SEQ ID NO: 3598170 - RNA, 15 nt, Human
aauuuguuugugcuu

SEQ ID NO: 3598171 - RNA, 17 nt, Human
aauuuguuugugcuucu

SEQ ID NO: 3598172 - RNA, 18 nt, Human
aauuuguuugugcuucua

SEQ ID NO: 3598173 - RNA, 17 nt, Human
aauuuuaaaaaugaauc

SEQ ID NO: 3598174 - RNA, 21 nt, Human
aauuuuaaaaaugaauccuac

SEQ ID NO: 3598175 - RNA, 14 nt, Human
aauuuuaaaaaugg

SEQ ID NO: 3598176 - RNA, 20 nt, Human
aauuuuaaaaaugguggcuu

SEQ ID NO: 3598177 - RNA, 12 nt, Human
aauuuuaaagcc

SEQ ID NO: 3598178 - RNA, 13 nt, Human
aauuuuaaagcca

SEQ ID NO: 3598179 - RNA, 12 nt, Human
aauuuuaaagua

SEQ ID NO: 3598180 - RNA, 14 nt, Human
aauuuuaaaguaug

SEQ ID NO: 3598181 - RNA, 18 nt, Human
aauuuuaaaguaugcauu

SEQ ID NO: 3598182 - RNA, 17 nt, Human
aauuuuaaagugcaaaa

SEQ ID NO: 3598183 - RNA, 20 nt, Human
aauuuuaagccuuuguugaa

SEQ ID NO: 3598184 - RNA, 23 nt, Human
aauuuuaagccuuuguugaacug

SEQ ID NO: 3598185 - RNA, 16 nt, Human
aauuuuaaugaagaaa

SEQ ID NO: 3598186 - RNA, 12 nt, Human
aauuuuaauuua

SEQ ID NO: 3598187 - RNA, 13 nt, Human
aauuuuaauuuau

SEQ ID NO: 3598188 - RNA, 20 nt, Human
aauuuuacauggcuggagcu

SEQ ID NO: 3598189 - RNA, 14 nt, Human
aauuuuaccaaguu

SEQ ID NO: 3598190 - RNA, 23 nt, Human
aauuuuaggcacucuuaaaugau

SEQ ID NO: 3598191 - RNA, 23 nt, Human
aauuuuagugacagcucugccug

SEQ ID NO: 3598192 - RNA, 16 nt, Human
aauuuuaguuuuucau

SEQ ID NO: 3598193 - RNA, 15 nt, Human
aauuuuauaaacaaa

SEQ ID NO: 3598194 - RNA, 21 nt, Human
aauuuuauaagcaaauuucaa

SEQ ID NO: 3598195 - RNA, 15 nt, Human
aauuuuauaaucugc

SEQ ID NO: 3598196 - RNA, 20 nt, Human
aauuuuaucccucaccugua

SEQ ID NO: 3598197 - RNA, 19 nt, Human
aauuuuaugagggccacgg

SEQ ID NO: 3598198 - RNA, 23 nt, Human
aauuuuauuuugugcucauuuaa

SEQ ID NO: 3598199 - RNA, 22 nt, Human
aauuuucaacugucuuccucaa

SEQ ID NO: 3598200 - RNA, 18 nt, Human
aauuuucacuuuuggcaa

SEQ ID NO: 3598201 - RNA, 10 nt, Human
aauuuucauu

SEQ ID NO: 3598202 - RNA, 19 nt, Human
aauuuuccuaauaaaguuc

SEQ ID NO: 3598203 - RNA, 17 nt, Human
aauuuucuagacuuucu

SEQ ID NO: 3598204 - RNA, 13 nt, Human
aauuuucuucaug

SEQ ID NO: 3598205 - RNA, 19 nt, Human
aauuuucuucaugcaauga

SEQ ID NO: 3598206 - RNA, 22 nt, Human
aauuuucuucaugcaaugacau

SEQ ID NO: 3598207 - RNA, 12 nt, Human
aauuuucuugau

SEQ ID NO: 3598208 - RNA, 21 nt, Human
aauuuucuuuuuaauaaaaag

SEQ ID NO: 3598209 - RNA, 20 nt, Human
aauuuugaaaaguaauauuu

SEQ ID NO: 3598210 - RNA, 21 nt, Human
aauuuugaaaaguaauauuua

SEQ ID NO: 3598211 - RNA, 19 nt, Human
aauuuugacacuauaucug

SEQ ID NO: 3598212 - RNA, 16 nt, Human
aauuuugagauuaaga

SEQ ID NO: 3598213 - RNA, 17 nt, Human
aauuuugaguugccaca

SEQ ID NO: 3598214 - RNA, 23 nt, Human
aauuuugauaaaaauuuagaaca

SEQ ID NO: 3598215 - RNA, 16 nt, Human
aauuuugcaaauauaa

SEQ ID NO: 3598216 - RNA, 18 nt, Human
aauuuugcaaauauaaac

SEQ ID NO: 3598217 - RNA, 12 nt, Human
aauuuugcaaug

SEQ ID NO: 3598218 - RNA, 17 nt, Human
aauuuugcuuuuaauua

SEQ ID NO: 3598219 - RNA, 11 nt, Human
aauuuuggaau

SEQ ID NO: 3598220 - RNA, 12 nt, Human
aauuuuggauuu

SEQ ID NO: 3598221 - RNA, 18 nt, Human
aauuuugguuguauucuu

SEQ ID NO: 3598222 - RNA, 13 nt, Human
aauuuuguaagaa

SEQ ID NO: 3598223 - RNA, 18 nt, Human
aauuuuguaauguaucaa

SEQ ID NO: 3598224 - RNA, 14 nt, Human
aauuuuguauuuuc

SEQ ID NO: 3598225 - RNA, 21 nt, Human
aauuuuguauuuuccaagugu

SEQ ID NO: 3598226 - RNA, 23 nt, Human
aauuuuguauuuuccaagugugc

SEQ ID NO: 3598227 - RNA, 17 nt, Human
aauuuuguucucuggga

SEQ ID NO: 3598228 - RNA, 19 nt, Human
aauuuuguucucugggaga

SEQ ID NO: 3598229 - RNA, 23 nt, Human
aauuuuguucucugggagaaaau

SEQ ID NO: 3598230 - RNA, 15 nt, Human
aauuuuguuucugua

SEQ ID NO: 3598231 - RNA, 19 nt, Human
aauuuuuaaaguauauauu

SEQ ID NO: 3598232 - RNA, 19 nt, Human
aauuuuuauauuugaaaua

SEQ ID NO: 3598233 - RNA, 18 nt, Human
aauuuuuauuaaauuaug

SEQ ID NO: 3598234 - RNA, 16 nt, Human
aauuuuuauuaugcau

SEQ ID NO: 3598235 - RNA, 19 nt, Human
aauuuuuauuaugcauaac

SEQ ID NO: 3598236 - RNA, 21 nt, Human
aauuuuuauuauuuguuuucc

SEQ ID NO: 3598237 - RNA, 13 nt, Human
aauuuuuauucau

SEQ ID NO: 3598238 - RNA, 16 nt, Human
aauuuuuauucauaag

SEQ ID NO: 3598239 - RNA, 13 nt, Human
aauuuuuauuguu

SEQ ID NO: 3598240 - RNA, 23 nt, Human
aauuuuucauugauaugaaaaau

SEQ ID NO: 3598241 - RNA, 20 nt, Human
aauuuuuccaacuacuaaua

SEQ ID NO: 3598242 - RNA, 13 nt, Human
aauuuuuccuaug

SEQ ID NO: 3598243 - RNA, 22 nt, Human
aauuuuucucuaacucagaaac

SEQ ID NO: 3598244 - RNA, 16 nt, Human
aauuuuucuucuugag

SEQ ID NO: 3598245 - RNA, 13 nt, Human
aauuuuugaaaag

SEQ ID NO: 3598246 - RNA, 15 nt, Human
aauuuuugcaauaau

SEQ ID NO: 3598247 - RNA, 18 nt, Human
aauuuuugcaauaaugca

SEQ ID NO: 3598248 - RNA, 16 nt, Human
aauuuuugccuucauu

SEQ ID NO: 3598249 - RNA, 17 nt, Human
aauuuuuguauuauuuu

SEQ ID NO: 3598250 - RNA, 15 nt, Human
aauuuuugucucaga

SEQ ID NO: 3598251 - RNA, 15 nt, Human
aauuuuuuaaaaagc

SEQ ID NO: 3598252 - RNA, 21 nt, Human
aauuuuuuaagugaaaauaua

SEQ ID NO: 3598253 - RNA, 17 nt, Human
aauuuuuuauaaaagug

SEQ ID NO: 3598254 - RNA, 21 nt, Human
aauuuuuuauucuugugaaua

SEQ ID NO: 3598255 - RNA, 11 nt, Human
aauuuuuuccu

SEQ ID NO: 3598256 - RNA, 13 nt, Human
aauuuuuugacuu

SEQ ID NO: 3598257 - RNA, 20 nt, Human
aauuuuuuggcacuugccau

SEQ ID NO: 3598258 - RNA, 15 nt, Human
aauuuuuugguacaa

SEQ ID NO: 3598259 - RNA, 20 nt, Human
aauuuuuugguacaaaaaua

SEQ ID NO: 3598260 - RNA, 19 nt, Human
aauuuuuuuaaccaaaggu

SEQ ID NO: 3598261 - RNA, 20 nt, Human
aauuuuuuuaauuuuguauu

SEQ ID NO: 3598262 - RNA, 18 nt, Human
aauuuuuuuauguuuugu

SEQ ID NO: 3598263 - RNA, 17 nt, Human
aauuuuuuuauuacuga

SEQ ID NO: 3598264 - RNA, 18 nt, Human
aauuuuuuuauuguuuaa

SEQ ID NO: 3598265 - RNA, 17 nt, Human
aauuuuuuugagacaga

SEQ ID NO: 3598266 - RNA, 18 nt, Human
aauuuuuuuguaugaaaa

SEQ ID NO: 3598267 - RNA, 23 nt, Human
aauuuuuuuuaguauuuauuuau

SEQ ID NO: 3598268 - RNA, 22 nt, Human
aauuuuuuuuauuaguauuguu

SEQ ID NO: 3598269 - RNA, 20 nt, Human
aauuuuuuuucaugcuuuau

SEQ ID NO: 3598270 - RNA, 20 nt, Human
aauuuuuuuuguuguuucag

SEQ ID NO: 3598271 - RNA, 22 nt, Human
aauuuuuuuuguuguuucagug

SEQ ID NO: 3598272 - RNA, 23 nt, Human
aauuuuuuuuguuguuucaguga

SEQ ID NO: 3598273 - RNA, 19 nt, Human
acaaaaaaaaaauuugcca

SEQ ID NO: 3598274 - RNA, 20 nt, Human
acaaaaaaauauauuuaaug

SEQ ID NO: 3598275 - RNA, 18 nt, Human
acaaaaaaaucugcagaa

SEQ ID NO: 3598276 - RNA, 13 nt, Human
acaaaaaacaaua

SEQ ID NO: 3598277 - RNA, 15 nt, Human
acaaaaaacaauauu

SEQ ID NO: 3598278 - RNA, 21 nt, Human
acaaaaacagccucacagaag

SEQ ID NO: 3598279 - RNA, 22 nt, Human
acaaaaacagguauauacuuug

SEQ ID NO: 3598280 - RNA, 11 nt, Human
acaaaaaccaa

SEQ ID NO: 3598281 - RNA, 20 nt, Human
acaaaaagccacaaugaaca

SEQ ID NO: 3598282 - RNA, 15 nt, Human
acaaaaagugcuuca

SEQ ID NO: 3598283 - RNA, 23 nt, Human
acaaaaagugcuucauucuuugc

SEQ ID NO: 3598284 - RNA, 12 nt, Human
acaaaaauaaau

SEQ ID NO: 3598285 - RNA, 12 nt, Human
acaaaaauaaca

SEQ ID NO: 3598286 - RNA, 21 nt, Human
acaaaaauacucuaauucuaa

SEQ ID NO: 3598287 - RNA, 18 nt, Human
acaaaaaucagccagaca

SEQ ID NO: 3598288 - RNA, 22 nt, Human
acaaaaaugaaagcaugucuca

SEQ ID NO: 3598289 - RNA, 21 nt, Human
acaaaaauguaaugaucauaa

SEQ ID NO: 3598290 - RNA, 19 nt, Human
acaaaaauucucaguucuc

SEQ ID NO: 3598291 - RNA, 12 nt, Human
acaaaacaaaac

SEQ ID NO: 3598292 - RNA, 16 nt, Human
acaaaacaaaacaaaa

SEQ ID NO: 3598293 - RNA, 14 nt, Human
acaaaacaaaacua

SEQ ID NO: 3598294 - RNA, 13 nt, Human
acaaaacaaacuc

SEQ ID NO: 3598295 - RNA, 14 nt, Human
acaaaaccaaaagu

SEQ ID NO: 3598296 - RNA, 22 nt, Human
acaaaaccacaguguaccauua

SEQ ID NO: 3598297 - RNA, 20 nt, Human
acaaaaccccccagauauca

SEQ ID NO: 3598298 - RNA, 16 nt, Human
acaaaaccuaacuugc

SEQ ID NO: 3598299 - RNA, 23 nt, Human
acaaaacuacaugagaacaaaca

SEQ ID NO: 3598300 - RNA, 14 nt, Human
acaaaacuauacuu

SEQ ID NO: 3598301 - RNA, 15 nt, Human
acaaaacuauacuug

SEQ ID NO: 3598302 - RNA, 21 nt, Human
acaaaacuuagcaucuaauuu

SEQ ID NO: 3598303 - RNA, 13 nt, Human
acaaaacuucuug

SEQ ID NO: 3598304 - RNA, 18 nt, Human
acaaaacuucuugucaga

SEQ ID NO: 3598305 - RNA, 15 nt, Human
acaaaagaaauaccu

SEQ ID NO: 3598306 - RNA, 23 nt, Human
acaaaagaagcccggcuccuggu

SEQ ID NO: 3598307 - RNA, 23 nt, Human
acaaaagaggagcacuuccaaaa

SEQ ID NO: 3598308 - RNA, 13 nt, Human
acaaaagaugaaa

SEQ ID NO: 3598309 - RNA, 11 nt, Human
acaaaagaugu

SEQ ID NO: 3598310 - RNA, 21 nt, Human
acaaaagauguauccuuccaa

SEQ ID NO: 3598311 - RNA, 21 nt, Human
acaaaagcugaacacauuucu

SEQ ID NO: 3598312 - RNA, 19 nt, Human
acaaaaggcuccauauaua

SEQ ID NO: 3598313 - RNA, 11 nt, Human
acaaaaggguc

SEQ ID NO: 3598314 - RNA, 13 nt, Human
acaaaagggucag

SEQ ID NO: 3598315 - RNA, 16 nt, Human
acaaaauaaaauaaua

SEQ ID NO: 3598316 - RNA, 23 nt, Human
acaaaauauaaagcaucuaaacu

SEQ ID NO: 3598317 - RNA, 16 nt, Human
acaaaauauuucccau

SEQ ID NO: 3598318 - RNA, 13 nt, Human
acaaaaucaaaua

SEQ ID NO: 3598319 - RNA, 14 nt, Human
acaaaaucuccucu

SEQ ID NO: 3598320 - RNA, 10 nt, Human
acaaaaugga

SEQ ID NO: 3598321 - RNA, 22 nt, Human
acaaaauggaauucauucuggu

SEQ ID NO: 3598322 - RNA, 11 nt, Human
acaaaauggac

SEQ ID NO: 3598323 - RNA, 22 nt, Human
acaaaauggauacauaaagacu

SEQ ID NO: 3598324 - RNA, 16 nt, Human
acaaaauguaacuguu

SEQ ID NO: 3598325 - RNA, 17 nt, Human
acaaaauguagaauauu

SEQ ID NO: 3598326 - RNA, 21 nt, Human
acaaaauguagaauauucaga

SEQ ID NO: 3598327 - RNA, 11 nt, Human
acaaaauguua

SEQ ID NO: 3598328 - RNA, 16 nt, Human
acaaaauuauuuguaa

SEQ ID NO: 3598329 - RNA, 14 nt, Human
acaaacaaacaagc

SEQ ID NO: 3598330 - RNA, 13 nt, Human
acaaacaaauuuu

SEQ ID NO: 3598331 - RNA, 16 nt, Human
acaaacaaucucuuaa

SEQ ID NO: 3598332 - RNA, 19 nt, Human
acaaacauauuuguuaaau

SEQ ID NO: 3598333 - RNA, 14 nt, Human
acaaacaucacucu

SEQ ID NO: 3598334 - RNA, 20 nt, Human
acaaacauuguguugacauu

SEQ ID NO: 3598335 - RNA, 19 nt, Human
acaaaccacaacugacaca

SEQ ID NO: 3598336 - RNA, 23 nt, Human
acaaaccacaacugacacaggaa

SEQ ID NO: 3598337 - RNA, 14 nt, Human
acaaaccaugcaaa

SEQ ID NO: 3598338 - RNA, 21 nt, Human
acaaaccgagugcaaugaaug

SEQ ID NO: 3598339 - RNA, 14 nt, Human
acaaaccugccugg

SEQ ID NO: 3598340 - RNA, 21 nt, Human
acaaaccuguuucugcagcca

SEQ ID NO: 3598341 - RNA, 15 nt, Human
acaaacgggcucagc

SEQ ID NO: 3598342 - RNA, 23 nt, Human
acaaacuacuugauuuuauugua

SEQ ID NO: 3598343 - RNA, 20 nt, Human
acaaacucaccaucugugca

SEQ ID NO: 3598344 - RNA, 22 nt, Human
acaaacucucugaaccccuccc

SEQ ID NO: 3598345 - RNA, 16 nt, Human
acaaacugcaauagag

SEQ ID NO: 3598346 - RNA, 21 nt, Human
acaaacugcacaugauuucac

SEQ ID NO: 3598347 - RNA, 22 nt, Human
acaaacugcuucccuuacuuug

SEQ ID NO: 3598348 - RNA, 21 nt, Human
acaaacugcuuccuuucuuga

SEQ ID NO: 3598349 - RNA, 13 nt, Human
acaaacuguaaau

SEQ ID NO: 3598350 - RNA, 16 nt, Human
acaaacuguaauacaa

SEQ ID NO: 3598351 - RNA, 15 nt, Human
acaaacuuugcaucu

SEQ ID NO: 3598352 - RNA, 12 nt, Human
acaaagaaauua

SEQ ID NO: 3598353 - RNA, 20 nt, Human
acaaagaaccuaacauuuau

SEQ ID NO: 3598354 - RNA, 12 nt, Human
acaaagaaccuu

SEQ ID NO: 3598355 - RNA, 18 nt, Human
acaaagacaaaagucugu

SEQ ID NO: 3598356 - RNA, 13 nt, Human
aauauauauuaua

SEQ ID NO: 3598357 - RNA, 14 nt, Human
aauauauauuauac

SEQ ID NO: 3598358 - RNA, 16 nt, Human
aauauauauuauacuu

SEQ ID NO: 3598359 - RNA, 16 nt, Human
aauauauauuaucuuu

SEQ ID NO: 3598360 - RNA, 19 nt, Human
aauauauauuaucuuuuca

SEQ ID NO: 3598361 - RNA, 16 nt, Human
aauauaucccagaaau

SEQ ID NO: 3598362 - RNA, 18 nt, Human
aauauaucuaaauugaau

SEQ ID NO: 3598363 - RNA, 20 nt, Human
aauauaucuaaauugaauaa

SEQ ID NO: 3598364 - RNA, 19 nt, Human
aauauauggcagaguugua

SEQ ID NO: 3598365 - RNA, 20 nt, Human
aauauauggcagaguuguaa

SEQ ID NO: 3598366 - RNA, 21 nt, Human
aauauauggcagaguuguaaa

SEQ ID NO: 3598367 - RNA, 16 nt, Human
aauauauggcauuugc

SEQ ID NO: 3598368 - RNA, 18 nt, Human
aauauauggucuaauguu

SEQ ID NO: 3598369 - RNA, 19 nt, Human
aauauauggucuaauguuu

SEQ ID NO: 3598370 - RNA, 20 nt, Human
aauauauggucuaauguuua

SEQ ID NO: 3598371 - RNA, 14 nt, Human
aauauauguaugua

SEQ ID NO: 3598372 - RNA, 19 nt, Human
aauauauguauguaaaaau

SEQ ID NO: 3598373 - RNA, 14 nt, Human
aauauauguauuau

SEQ ID NO: 3598374 - RNA, 18 nt, Human
aauauauguauuauuuau

SEQ ID NO: 3598375 - RNA, 23 nt, Human
aauauauuaccagcaagaauaaa

SEQ ID NO: 3598376 - RNA, 23 nt, Human
aauauauuccugagauuuccucc

SEQ ID NO: 3598377 - RNA, 20 nt, Human
aauauauugaacuuuuguac

SEQ ID NO: 3598378 - RNA, 13 nt, Human
aauauauuguuaa

SEQ ID NO: 3598379 - RNA, 22 nt, Human
aauauauuuaaagggaaauuga

SEQ ID NO: 3598380 - RNA, 15 nt, Human
acacacacacacagg

SEQ ID NO: 3598381 - RNA, 14 nt, Human
acacacacacacau

SEQ ID NO: 3598382 - RNA, 14 nt, Human
acacacacacagcc

SEQ ID NO: 3598383 - RNA, 15 nt, Human
acacacacacauaca

SEQ ID NO: 3598384 - RNA, 13 nt, Human
acacacacacauc

SEQ ID NO: 3598385 - RNA, 14 nt, Human
acacacacacaugc

SEQ ID NO: 3598386 - RNA, 15 nt, Human
acacacacacaugca

SEQ ID NO: 3598387 - RNA, 12 nt, Human
acacacacagcc

SEQ ID NO: 3598388 - RNA, 14 nt, Human
acacacacagccac

SEQ ID NO: 3598389 - RNA, 14 nt, Human
acacacacaggagg

SEQ ID NO: 3598390 - RNA, 14 nt, Human
acacacacauccac

SEQ ID NO: 3598391 - RNA, 11 nt, Human
acacacacaug

SEQ ID NO: 3598392 - RNA, 12 nt, Human
acacacacaugc

SEQ ID NO: 3598393 - RNA, 15 nt, Human
acacacacaugcaua

SEQ ID NO: 3598394 - RNA, 16 nt, Human
acacacacaugcauac

SEQ ID NO: 3598395 - RNA, 14 nt, Human
acacacacgcacgc

SEQ ID NO: 3598396 - RNA, 22 nt, Human
acacacacgcgugcacacacca

SEQ ID NO: 3598397 - RNA, 15 nt, Human
acacacagaaaauau

SEQ ID NO: 3598398 - RNA, 18 nt, Human
acacacagaaaauauacu

SEQ ID NO: 3598399 - RNA, 19 nt, Human
acacacagaaaauauacug

SEQ ID NO: 3598400 - RNA, 21 nt, Human
acacacagaaaauauacugua

SEQ ID NO: 3598401 - RNA, 22 nt, Human
acacacagaggaagagcaggca

SEQ ID NO: 3598402 - RNA, 21 nt, Human
acacacagccacacacacaga

SEQ ID NO: 3598403 - RNA, 11 nt, Human
acacacagcuc

SEQ ID NO: 3598404 - RNA, 14 nt, Human
acacacagcucugu

SEQ ID NO: 3598405 - RNA, 18 nt, Human
acacacauaaaggauaaa

SEQ ID NO: 3598406 - RNA, 12 nt, Human
acacacauacac

SEQ ID NO: 3598407 - RNA, 12 nt, Human
acacacauagau

SEQ ID NO: 3598408 - RNA, 16 nt, Human
acacacauauacacga

SEQ ID NO: 3598409 - RNA, 13 nt, Human
acacacaugcaca

SEQ ID NO: 3598410 - RNA, 17 nt, Human
acacacaugcacacaca

SEQ ID NO: 3598411 - RNA, 21 nt, Human
acacacaugcauacacacaca

SEQ ID NO: 3598412 - RNA, 15 nt, Human
acacaccacacauac

SEQ ID NO: 3598413 - RNA, 20 nt, Human
acacaccagagcccaccuug

SEQ ID NO: 3598414 - RNA, 14 nt, Human
acacaccaggcgcu

SEQ ID NO: 3598415 - RNA, 14 nt, Human
acacacccugaggu

SEQ ID NO: 3598416 - RNA, 22 nt, Human
acacaccuaagggacauguuuu

SEQ ID NO: 3598417 - RNA, 20 nt, Human
acacaccuguagcacuuacu

SEQ ID NO: 3598418 - RNA, 24 nt, Human
acacaccuguagucccagcuacuc

SEQ ID NO: 3598419 - RNA, 14 nt, Human
acacacgcaggaac

SEQ ID NO: 3598420 - RNA, 21 nt, Human
acacacgcaggaacucccagc

SEQ ID NO: 3598421 - RNA, 19 nt, Human
acacacgugcaauuuguuu

SEQ ID NO: 3598422 - RNA, 13 nt, Human
acacacuaaucga

SEQ ID NO: 3598423 - RNA, 16 nt, Human
acacacuacaccacac

SEQ ID NO: 3598424 - RNA, 18 nt, Human
acacacuacaccacacac

SEQ ID NO: 3598425 - RNA, 22 nt, Human
acacacuaccgaaugugucuuu

SEQ ID NO: 3598426 - RNA, 12 nt, Human
acacacugaaag

SEQ ID NO: 3598427 - RNA, 14 nt, Human
acacacugaagaag

SEQ ID NO: 3598428 - RNA, 22 nt, Human
acacacugucaugcuucaucau

SEQ ID NO: 3598429 - RNA, 21 nt, Human
acacacugugcuuucuauugu

SEQ ID NO: 3598430 - RNA, 13 nt, Human
acacacuguuguu

SEQ ID NO: 3598431 - RNA, 19 nt, Human
acacacuuuuuaagaaaua

SEQ ID NO: 3598432 - RNA, 17 nt, Human
acacagaaaauauacug

SEQ ID NO: 3598433 - RNA, 18 nt, Human
acacagaaaauauacugu

SEQ ID NO: 3598434 - RNA, 19 nt, Human
acacagaaaauguugagaa

SEQ ID NO: 3598435 - RNA, 16 nt, Human
acacagaaacacugcc

SEQ ID NO: 3598436 - RNA, 17 nt, Human
acacagaaacacugccu

SEQ ID NO: 3598437 - RNA, 23 nt, Human
acacagacauucugccaggcccc

SEQ ID NO: 3598438 - RNA, 14 nt, Human
acacagacuauuuu

SEQ ID NO: 3598439 - RNA, 21 nt, Human
acacagaggaagagcaggcac

SEQ ID NO: 3598440 - RNA, 23 nt, Human
acacagaguggucuuucuggaga

SEQ ID NO: 3598441 - RNA, 17 nt, Human
acacagauuugagcuca

SEQ ID NO: 3598442 - RNA, 22 nt, Human
acacagcagcuucaccagagca

SEQ ID NO: 3598443 - RNA, 14 nt, Human
acacagcaugugua

SEQ ID NO: 3598444 - RNA, 18 nt, Human
acacagcauuguauaugu

SEQ ID NO: 3598445 - RNA, 12 nt, Human
acacagccacac

SEQ ID NO: 3598446 - RNA, 18 nt, Human
acacagccacacacacag

SEQ ID NO: 3598447 - RNA, 21 nt, Human
acacagccacacacacagaaa

SEQ ID NO: 3598448 - RNA, 22 nt, Human
acacagccacacacacagaaaa

SEQ ID NO: 3598449 - RNA, 23 nt, Human
acacagccacacacacagaaaau

SEQ ID NO: 3598450 - RNA, 13 nt, Human
acacagccugggc

SEQ ID NO: 3598451 - RNA, 18 nt, Human
acacagccugggccccag

SEQ ID NO: 3598452 - RNA, 20 nt, Human
acacagccugggccccagcu

SEQ ID NO: 3598453 - RNA, 17 nt, Human
acacagcgucccuagca

SEQ ID NO: 3598454 - RNA, 20 nt, Human
acacagcuaacacacagcuc

SEQ ID NO: 3598455 - RNA, 14 nt, Human
acacagcucugucc

SEQ ID NO: 3598456 - RNA, 20 nt, Human
acacagcucuguccugggag

SEQ ID NO: 3598457 - RNA, 12 nt, Human
acacagcugccg

SEQ ID NO: 3598458 - RNA, 12 nt, Human
acacagcugggc

SEQ ID NO: 3598459 - RNA, 21 nt, Human
acacagcuuuaucaccagaga

SEQ ID NO: 3598460 - RNA, 23 nt, Human
acacagcuuuuaguacccaccug

SEQ ID NO: 3598461 - RNA, 21 nt, Human
acacaggcaacugaggcagac

SEQ ID NO: 3598462 - RNA, 11 nt, Human
acacaggcagc

SEQ ID NO: 3598463 - RNA, 16 nt, Human
acacaggcauuuccug

SEQ ID NO: 3598464 - RNA, 20 nt, Human
acacaggcauuuccugggug

SEQ ID NO: 3598465 - RNA, 23 nt, Human
acacaggcauuuccuggguggcu

SEQ ID NO: 3598466 - RNA, 23 nt, Human
acacaggcccggcuccaggcucc

SEQ ID NO: 3598467 - RNA, 13 nt, Human
acacaggcccucc

SEQ ID NO: 3598468 - RNA, 16 nt, Human
acacaggccugcucuc

SEQ ID NO: 3598469 - RNA, 12 nt, Human
acacaggccugu

SEQ ID NO: 3598470 - RNA, 14 nt, Human
acacagggacuuga

SEQ ID NO: 3598471 - RNA, 21 nt, Human
acacaggggacacccagaaac

SEQ ID NO: 3598472 - RNA, 23 nt, Human
acacagggugacggugacaaaga

SEQ ID NO: 3598473 - RNA, 16 nt, Human
acacaguauuacuucu

SEQ ID NO: 3598474 - RNA, 22 nt, Human
acacaguauuacuucugcuaca

SEQ ID NO: 3598475 - RNA, 23 nt, Human
acacagucaaaauaauucuaaau

SEQ ID NO: 3598476 - RNA, 19 nt, Human
acacagugggaacucugac

SEQ ID NO: 3598477 - RNA, 18 nt, Human
acacaguuacacuugugc

SEQ ID NO: 3598478 - RNA, 15 nt, Human
acacaguuccuggga

SEQ ID NO: 3598479 - RNA, 13 nt, Human
acacauaaaggau

SEQ ID NO: 3598480 - RNA, 18 nt, Human
acacauaaaggauaaacu

SEQ ID NO: 3598481 - RNA, 12 nt, Human
acacauaaauau

SEQ ID NO: 3598482 - RNA, 15 nt, Human
acacauaauuaaagu

SEQ ID NO: 3598483 - RNA, 19 nt, Human
acacauaauuaaagugucc

SEQ ID NO: 3598484 - RNA, 16 nt, Human
acacauacaugucaca

SEQ ID NO: 3598485 - RNA, 14 nt, Human
acacauaccuuugg

SEQ ID NO: 3598486 - RNA, 19 nt, Human
acacauacucauuuuucau

SEQ ID NO: 3598487 - RNA, 20 nt, Human
acacauagauuaauggcacu

SEQ ID NO: 3598488 - RNA, 23 nt, Human
acacauagauuaauggcacugau

SEQ ID NO: 3598489 - RNA, 17 nt, Human
acacauagcauguaaug

SEQ ID NO: 3598490 - RNA, 22 nt, Human
acacauauaaacaucacacaca

SEQ ID NO: 3598491 - RNA, 15 nt, Human
acacauauacacgaa

SEQ ID NO: 3598492 - RNA, 13 nt, Human
acacauaugaggg

SEQ ID NO: 3598493 - RNA, 15 nt, Human
acacaucacagauga

SEQ ID NO: 3598494 - RNA, 14 nt, Human
acacauccacccca

SEQ ID NO: 3598495 - RNA, 15 nt, Human
acacaucccagccca

SEQ ID NO: 3598496 - RNA, 19 nt, Human
acacauccgccuuuuguau

SEQ ID NO: 3598497 - RNA, 22 nt, Human
acacauccgccuuuuguauaca

SEQ ID NO: 3598498 - RNA, 14 nt, Human
acacaucuccucca

SEQ ID NO: 3598499 - RNA, 13 nt, Human
acacaucuucccu

SEQ ID NO: 3598500 - RNA, 21 nt, Human
acacaugcaaggucauuuuuu

SEQ ID NO: 3598501 - RNA, 13 nt, Human
acacaugcacaca

SEQ ID NO: 3598502 - RNA, 18 nt, Human
acacauggaaacccauag

SEQ ID NO: 3598503 - RNA, 22 nt, Human
acacauguccaagaagcccagg

SEQ ID NO: 3598504 - RNA, 14 nt, Human
acacauuaucuucu

SEQ ID NO: 3598505 - RNA, 16 nt, Human
acacauucaauaagca

SEQ ID NO: 3598506 - RNA, 17 nt, Human
acacauucaauaagcau

SEQ ID NO: 3598507 - RNA, 11 nt, Human
acacauuucuu

SEQ ID NO: 3598508 - RNA, 19 nt, Human
acacauuugcuacuguugu

SEQ ID NO: 3598509 - RNA, 20 nt, Human
acacauuugcuacuguugua

SEQ ID NO: 3598510 - RNA, 12 nt, Human
acacauuuguac

SEQ ID NO: 3598511 - RNA, 23 nt, Human
acacauuuguugccagauuucag

SEQ ID NO: 3598512 - RNA, 19 nt, Human
acacauuuuauuuuauuau

SEQ ID NO: 3598513 - RNA, 22 nt, Human
acacauuuuauuuuauuaugca

SEQ ID NO: 3598514 - RNA, 15 nt, Human
acacauuuuguauaa

SEQ ID NO: 3598515 - RNA, 21 nt, Human
acacauuuuguauaauuguau

SEQ ID NO: 3598516 - RNA, 19 nt, Human
acacauuuuuuaaaugcac

SEQ ID NO: 3598517 - RNA, 22 nt, Human
acacauuuuuuaaaugcaccug

SEQ ID NO: 3598518 - RNA, 16 nt, Human
acacauuuuuuaggaa

SEQ ID NO: 3598519 - RNA, 19 nt, Human
acaccaaaaaaauccagaa

SEQ ID NO: 3598520 - RNA, 14 nt, Human
acaccaaaaaauau

SEQ ID NO: 3598521 - RNA, 15 nt, Human
acaccaaaguucuaa

SEQ ID NO: 3598522 - RNA, 16 nt, Human
acaccaagcacagcag

SEQ ID NO: 3598523 - RNA, 20 nt, Human
acaccaagcacagcagccug

SEQ ID NO: 3598524 - RNA, 20 nt, Human
acaccaagcugugccacccu

SEQ ID NO: 3598525 - RNA, 17 nt, Human
acagcuguauugucuga

SEQ ID NO: 3598526 - RNA, 14 nt, Human
acagcugucccugu

SEQ ID NO: 3598527 - RNA, 13 nt, Human
acagcugugccuc

SEQ ID NO: 3598528 - RNA, 21 nt, Human
acagcuguucuucuguucugc

SEQ ID NO: 3598529 - RNA, 14 nt, Human
acagcuguuuaaga

SEQ ID NO: 3598530 - RNA, 19 nt, Human
acagcuguuuaagaugggc

SEQ ID NO: 3598531 - RNA, 12 nt, Human
acagcuuagaau

SEQ ID NO: 3598532 - RNA, 15 nt, Human
acagcuucagccagg

SEQ ID NO: 3598533 - RNA, 22 nt, Human
acagcuucagccaggagcuggg

SEQ ID NO: 3598534 - RNA, 22 nt, Human
acagcuucagguuaucgaaaua

SEQ ID NO: 3598535 - RNA, 19 nt, Human
acagcuucaugccuuugua

SEQ ID NO: 3598536 - RNA, 20 nt, Human
acagcuuccccucucuccuc

SEQ ID NO: 3598537 - RNA, 22 nt, Human
acagcuuccccucucuccuccu

SEQ ID NO: 3598538 - RNA, 21 nt, Human
acagcuucucauccugcaggc

SEQ ID NO: 3598539 - RNA, 23 nt, Human
acagcuugaccgugaggccagag

SEQ ID NO: 3598540 - RNA, 15 nt, Human
acagcuuuacacaca

SEQ ID NO: 3598541 - RNA, 20 nt, Human
acagcuuuccccucauuuuu

SEQ ID NO: 3598542 - RNA, 12 nt, Human
acagcuuucuga

SEQ ID NO: 3598543 - RNA, 14 nt, Human
acagcuuucugacc

SEQ ID NO: 3598544 - RNA, 17 nt, Human
acagcuuucuugcuccc

SEQ ID NO: 3598545 - RNA, 12 nt, Human
acagcuuugacu

SEQ ID NO: 3598546 - RNA, 22 nt, Human
acagcuuuggggugucuuuuuu

SEQ ID NO: 3598547 - RNA, 15 nt, Human
acagcuuugugacug

SEQ ID NO: 3598548 - RNA, 19 nt, Human
acagcuuugugacuguaua

SEQ ID NO: 3598549 - RNA, 23 nt, Human
acagcuuuuaguacccaccugag

SEQ ID NO: 3598550 - RNA, 17 nt, Human
acaggaaaagcugcuga

SEQ ID NO: 3598551 - RNA, 18 nt, Human
acaggaaaagcugcugac

SEQ ID NO: 3598552 - RNA, 17 nt, Human
acaggaaaauccucugg

SEQ ID NO: 3598553 - RNA, 18 nt, Human
acaggaaaauccucuggc

SEQ ID NO: 3598554 - RNA, 23 nt, Human
acaggaaaauccucuggcuggcu

SEQ ID NO: 3598555 - RNA, 14 nt, Human
acaggaaccuuaag

SEQ ID NO: 3598556 - RNA, 20 nt, Human
acaggaagcaccccaugcca

SEQ ID NO: 3598557 - RNA, 17 nt, Human
acaggaaguagaggagg

SEQ ID NO: 3598558 - RNA, 20 nt, Human
acaggacagugcuucagccu

SEQ ID NO: 3598559 - RNA, 14 nt, Human
acaggaccagauuu

SEQ ID NO: 3598560 - RNA, 15 nt, Human
acaggaccccugcag

SEQ ID NO: 3598561 - RNA, 21 nt, Human
acaggacgcugaccguggagc

SEQ ID NO: 3598562 - RNA, 16 nt, Human
acaggacuaacacuca

SEQ ID NO: 3598563 - RNA, 18 nt, Human
acaggacuaacacucaga

SEQ ID NO: 3598564 - RNA, 15 nt, Human
acaggacucugccuc

SEQ ID NO: 3598565 - RNA, 23 nt, Human
acaggacugauucugggaugcuc

SEQ ID NO: 3598566 - RNA, 22 nt, Human
acacccaaagcauggacuaacc

SEQ ID NO: 3598567 - RNA, 13 nt, Human
acacccaaagcug

SEQ ID NO: 3598568 - RNA, 21 nt, Human
acacccaccguccgcccugcu

SEQ ID NO: 3598569 - RNA, 23 nt, Human
acacccaccguccgcccugcucc

SEQ ID NO: 3598570 - RNA, 15 nt, Human
acacccacucagcuc

SEQ ID NO: 3598571 - RNA, 12 nt, Human
acacccagccca

SEQ ID NO: 3598572 - RNA, 17 nt, Human
acacccagcccccacau

SEQ ID NO: 3598573 - RNA, 16 nt, Human
acacccagccucaguc

SEQ ID NO: 3598574 - RNA, 17 nt, Human
acacccagccucagucc

SEQ ID NO: 3598575 - RNA, 13 nt, Human
acacccauguuuc

SEQ ID NO: 3598576 - RNA, 16 nt, Human
acacccauuuuuccuu

SEQ ID NO: 3598577 - RNA, 14 nt, Human
acaccccaccugcg

SEQ ID NO: 3598578 - RNA, 17 nt, Human
acacccucaaccucuuc

SEQ ID NO: 3598579 - RNA, 18 nt, Human
acacccucaaccucuucu

SEQ ID NO: 3598580 - RNA, 17 nt, Human
acacccucacucugcca

SEQ ID NO: 3598581 - RNA, 13 nt, Human
acacccucuccca

SEQ ID NO: 3598582 - RNA, 11 nt, Human
acacccugcaa

SEQ ID NO: 3598583 - RNA, 23 nt, Human
acacccugcaaggcccacaggag

SEQ ID NO: 3598584 - RNA, 13 nt, Human
acacccuguacug

SEQ ID NO: 3598585 - RNA, 11 nt, Human
acacccuguga

SEQ ID NO: 3598586 - RNA, 18 nt, Human
acacccugugauggggcc

SEQ ID NO: 3598587 - RNA, 19 nt, Human
acacccugugauggggccc

SEQ ID NO: 3598588 - RNA, 17 nt, Human
acacccuucucccacuc

SEQ ID NO: 3598589 - RNA, 14 nt, Human
acacccuuggagcu

SEQ ID NO: 3598590 - RNA, 18 nt, Human
acacccuuggagcucuga

SEQ ID NO: 3598591 - RNA, 17 nt, Human
acaccguguaaaccaaa

SEQ ID NO: 3598592 - RNA, 20 nt, Human
acaccguguaaaccaaagcc

SEQ ID NO: 3598593 - RNA, 18 nt, Human
acaccguucauucaggca

SEQ ID NO: 3598594 - RNA, 21 nt, Human
acaccuaaagguguauuuaaa

SEQ ID NO: 3598595 - RNA, 17 nt, Human
acaccuacccuccuuuu

SEQ ID NO: 3598596 - RNA, 21 nt, Human
acaccuacuagucaccagaga

SEQ ID NO: 3598597 - RNA, 18 nt, Human
acaccuagcuuuauucuu

SEQ ID NO: 3598598 - RNA, 20 nt, Human
acaccuaggcuagggugggg

SEQ ID NO: 3598599 - RNA, 19 nt, Human
acaccucacaccucacucu

SEQ ID NO: 3598600 - RNA, 16 nt, Human
acaccucacucuuuau

SEQ ID NO: 3598601 - RNA, 18 nt, Human
acaccucacucuuuauag

SEQ ID NO: 3598602 - RNA, 12 nt, Human
acaccucagagc

SEQ ID NO: 3598603 - RNA, 18 nt, Human
acaccucagagccccgca

SEQ ID NO: 3598604 - RNA, 12 nt, Human
acaccucccagg

SEQ ID NO: 3598605 - RNA, 19 nt, Human
acaccucccaggagacagu

SEQ ID NO: 3598606 - RNA, 16 nt, Human
acaccucccugaacca

SEQ ID NO: 3598607 - RNA, 22 nt, Human
acaccucccugaaccaucccug

SEQ ID NO: 3598608 - RNA, 22 nt, Human
acaccuccucccacugcccacu

SEQ ID NO: 3598609 - RNA, 14 nt, Human
acaccuccuggggc

SEQ ID NO: 3598610 - RNA, 18 nt, Human
acaccuccuucccucucu

SEQ ID NO: 3598611 - RNA, 19 nt, Human
acaccuccuucccucucug

SEQ ID NO: 3598612 - RNA, 21 nt, Human
acaccucguuagggaagagaa

SEQ ID NO: 3598613 - RNA, 19 nt, Human
acaccucugcacaagcugc

SEQ ID NO: 3598614 - RNA, 21 nt, Human
acaccucugcacaagcugcac

SEQ ID NO: 3598615 - RNA, 14 nt, Human
acaccucugccaga

SEQ ID NO: 3598616 - RNA, 16 nt, Human
acaccugacagccccu

SEQ ID NO: 3598617 - RNA, 14 nt, Human
acaccugacucuga

SEQ ID NO: 3598618 - RNA, 18 nt, Human
acaccugacucugaaauc

SEQ ID NO: 3598619 - RNA, 19 nt, Human
acaccugagaaacaucuag

SEQ ID NO: 3598620 - RNA, 15 nt, Human
acaccugauguguac

SEQ ID NO: 3598621 - RNA, 18 nt, Human
acaccugauguguacauc

SEQ ID NO: 3598622 - RNA, 11 nt, Human
acaccugcacc

SEQ ID NO: 3598623 - RNA, 14 nt, Human
acaccugcaccucc

SEQ ID NO: 3598624 - RNA, 15 nt, Human
acaccugcaccuccc

SEQ ID NO: 3598625 - RNA, 14 nt, Human
acaccugcccuaaa

SEQ ID NO: 3598626 - RNA, 13 nt, Human
acaccugcccugc

SEQ ID NO: 3598627 - RNA, 20 nt, Human
acaccugcccugcccugcca

SEQ ID NO: 3598628 - RNA, 18 nt, Human
acaccuggcccuggggcc

SEQ ID NO: 3598629 - RNA, 17 nt, Human
acaccugggcuuaagaa

SEQ ID NO: 3598630 - RNA, 15 nt, Human
acaccuguacuggag

SEQ ID NO: 3598631 - RNA, 14 nt, Human
acaccuucauuuug

SEQ ID NO: 3598632 - RNA, 16 nt, Human
acaccuuccagcuccu

SEQ ID NO: 3598633 - RNA, 20 nt, Human
acaccuuccagcuccuguaa

SEQ ID NO: 3598634 - RNA, 19 nt, Human
acaccuucuuauuauauau

SEQ ID NO: 3598635 - RNA, 16 nt, Human
acaccuugacagggca

SEQ ID NO: 3598636 - RNA, 21 nt, Human
acaccuugugaccuucucuau

SEQ ID NO: 3598637 - RNA, 23 nt, Human
acaccuugugaccuucucuauau

SEQ ID NO: 3598638 - RNA, 16 nt, Human
acaccuuuagguucuu

SEQ ID NO: 3598639 - RNA, 14 nt, Human
acaccuuucuccuu

SEQ ID NO: 3598640 - RNA, 22 nt, Human
acaccuuucuccuuuguacuuu

SEQ ID NO: 3598641 - RNA, 16 nt, Human
acaccuuugcaggcau

SEQ ID NO: 3598642 - RNA, 22 nt, Human
acaccuuugcaggcaugcaugu

SEQ ID NO: 3598643 - RNA, 21 nt, Human
acaccuuuuauugacacagaa

SEQ ID NO: 3598644 - RNA, 14 nt, Human
acacgaaacuuguu

SEQ ID NO: 3598645 - RNA, 17 nt, Human
acacgaaacuuguuauu

SEQ ID NO: 3598646 - RNA, 15 nt, Human
acacgaaagaaaugu

SEQ ID NO: 3598647 - RNA, 22 nt, Human
acacgagguaugaggucuagga

SEQ ID NO: 3598648 - RNA, 20 nt, Human
acacgcacacacacacacag

SEQ ID NO: 3598649 - RNA, 21 nt, Human
acacgcacauauacacacaca

SEQ ID NO: 3598650 - RNA, 14 nt, Human
acacgcaccugccu

SEQ ID NO: 3598651 - RNA, 16 nt, Human
acacgcaccugccuca

SEQ ID NO: 3598652 - RNA, 14 nt, Human
acacgcacgcacac

SEQ ID NO: 3598653 - RNA, 15 nt, Human
acacgcacgcacaca

SEQ ID NO: 3598654 - RNA, 20 nt, Human
acacgcauggucaacccuca

SEQ ID NO: 3598655 - RNA, 21 nt, Human
acacgccccaauuuucaggua

SEQ ID NO: 3598656 - RNA, 16 nt, Human
acacgccuuccccuca

SEQ ID NO: 3598657 - RNA, 22 nt, Human
acacgcgcgcacacacacacau

SEQ ID NO: 3598658 - RNA, 22 nt, Human
acacgcgguuugguuugcagcg

SEQ ID NO: 3598659 - RNA, 20 nt, Human
acacgcucccucccccugcc

SEQ ID NO: 3598660 - RNA, 14 nt, Human
acacgcuccucccu

SEQ ID NO: 3598661 - RNA, 23 nt, Human
acacgcugcucugccccagcuug

SEQ ID NO: 3598662 - RNA, 15 nt, Human
acacggaucugagaa

SEQ ID NO: 3598663 - RNA, 17 nt, Human
acacggaucugagaauc

SEQ ID NO: 3598664 - RNA, 21 nt, Human
acacggaucugagaaucuuua

SEQ ID NO: 3598665 - RNA, 12 nt, Human
acacggccacau

SEQ ID NO: 3598666 - RNA, 23 nt, Human
acacgggggcagcugauacaaau

SEQ ID NO: 3598667 - RNA, 17 nt, Human
acacgggguauuuuagg

SEQ ID NO: 3598668 - RNA, 19 nt, Human
acacgguuugaagccugga

SEQ ID NO: 3598669 - RNA, 18 nt, Human
acauggagguucuaaggc

SEQ ID NO: 3598670 - RNA, 18 nt, Human
acauggccuaugcacaua

SEQ ID NO: 3598671 - RNA, 20 nt, Human
acauggccuaugcacauaug

SEQ ID NO: 3598672 - RNA, 14 nt, Human
acauggccuuugcu

SEQ ID NO: 3598673 - RNA, 22 nt, Human
acauggcuccggccucugccuu

SEQ ID NO: 3598674 - RNA, 20 nt, Human
acauggcucuaaaaaguuuu

SEQ ID NO: 3598675 - RNA, 16 nt, Human
acauggcuuccuccug

SEQ ID NO: 3598676 - RNA, 13 nt, Human
acaugggagcagu

SEQ ID NO: 3598677 - RNA, 23 nt, Human
acaugggagcaguccaugcauga

SEQ ID NO: 3598678 - RNA, 23 nt, Human
acaugggagccgggucugccucu

SEQ ID NO: 3598679 - RNA, 18 nt, Human
acauggggaaaaaaauca

SEQ ID NO: 3598680 - RNA, 16 nt, Human
acaugggguuuucaau

SEQ ID NO: 3598681 - RNA, 14 nt, Human
acauggguuuaguu

SEQ ID NO: 3598682 - RNA, 20 nt, Human
acaugguacucuuguugagu

SEQ ID NO: 3598683 - RNA, 19 nt, Human
acauggugccugagaggca

SEQ ID NO: 3598684 - RNA, 23 nt, Human
acauggugcuacgccugcaugua

SEQ ID NO: 3598685 - RNA, 16 nt, Human
acauggugcugggaga

SEQ ID NO: 3598686 - RNA, 23 nt, Human
acauggugcugggagaggcagcc

SEQ ID NO: 3598687 - RNA, 21 nt, Human
acaugguggcaugcaccugca

SEQ ID NO: 3598688 - RNA, 19 nt, Human
acaugguggggucuccuca

SEQ ID NO: 3598689 - RNA, 18 nt, Human
acaugguuaccaugucuu

SEQ ID NO: 3598690 - RNA, 15 nt, Human
acaugguuugacucu

SEQ ID NO: 3598691 - RNA, 19 nt, Human
acauguaauaaaaaguaua

SEQ ID NO: 3598692 - RNA, 20 nt, Human
acauguaauaaaaaguauau

SEQ ID NO: 3598693 - RNA, 18 nt, Human
acauguaauauaaagaug

SEQ ID NO: 3598694 - RNA, 19 nt, Human
acauguaauuaaguacuau

SEQ ID NO: 3598695 - RNA, 21 nt, Human
acauguaauuaaguacuaugu

SEQ ID NO: 3598696 - RNA, 13 nt, Human
acauguacagaga

SEQ ID NO: 3598697 - RNA, 20 nt, Human
acauguacuguucucuucuu

SEQ ID NO: 3598698 - RNA, 18 nt, Human
acauguagaaaacaaaau

SEQ ID NO: 3598699 - RNA, 21 nt, Human
acauguauuaaauuacauuug

SEQ ID NO: 3598700 - RNA, 19 nt, Human
acauguauugcacauugua

SEQ ID NO: 3598701 - RNA, 21 nt, Human
acauguauugcacauuguaaa

SEQ ID NO: 3598702 - RNA, 21 nt, Human
acauguccaagaagcccagga

SEQ ID NO: 3598703 - RNA, 22 nt, Human
acauguccuaauucuucugucc

SEQ ID NO: 3598704 - RNA, 19 nt, Human
acauguccuucugagcccg

SEQ ID NO: 3598705 - RNA, 19 nt, Human
acaugucuccuacugagga

SEQ ID NO: 3598706 - RNA, 16 nt, Human
acaugucuuaaugaag

SEQ ID NO: 3598707 - RNA, 18 nt, Human
acaugucuuaaugaaguu

SEQ ID NO: 3598708 - RNA, 20 nt, Human
acaugucuuccauguaucuu

SEQ ID NO: 3598709 - RNA, 16 nt, Human
acaugucuuguacaug

SEQ ID NO: 3598710 - RNA, 19 nt, Human
acaugucuuguacaugugu

SEQ ID NO: 3598711 - RNA, 12 nt, Human
acaugugaaacc

SEQ ID NO: 3598712 - RNA, 13 nt, Human
acaugugaaaccu

SEQ ID NO: 3598713 - RNA, 14 nt, Human
acaugugaaaccuu

SEQ ID NO: 3598714 - RNA, 15 nt, Human
acaugugaaaccuuu

SEQ ID NO: 3598715 - RNA, 15 nt, Human
acaugugacauuuau

SEQ ID NO: 3598716 - RNA, 14 nt, Human
acaugugauacauu

SEQ ID NO: 3598717 - RNA, 16 nt, Human
acaugugcacaugcac

SEQ ID NO: 3598718 - RNA, 18 nt, Human
acaugugcugcccuacag

SEQ ID NO: 3598719 - RNA, 18 nt, Human
acauguggcuugaauuaa

SEQ ID NO: 3598720 - RNA, 18 nt, Human
acauguggggccagguca

SEQ ID NO: 3598721 - RNA, 15 nt, Human
acauguggugggaca

SEQ ID NO: 3598722 - RNA, 16 nt, Human
acaugugguuuauaga

SEQ ID NO: 3598723 - RNA, 20 nt, Human
acauguguagccuauguugu

SEQ ID NO: 3598724 - RNA, 23 nt, Human
acaugugucaacaccccugugug

SEQ ID NO: 3598725 - RNA, 20 nt, Human
acaugugucaagcugcuugg

SEQ ID NO: 3598726 - RNA, 12 nt, Human
acauguguguau

SEQ ID NO: 3598727 - RNA, 15 nt, Human
acauguguguauaua

SEQ ID NO: 3598728 - RNA, 12 nt, Human
acauguguuuua

SEQ ID NO: 3598729 - RNA, 21 nt, Human
acauguguuuuaauuccaaua

SEQ ID NO: 3598730 - RNA, 13 nt, Human
acauguuacaaca

SEQ ID NO: 3598731 - RNA, 16 nt, Human
acauguuacugaccag

SEQ ID NO: 3598732 - RNA, 15 nt, Human
acauguucccuucuc

SEQ ID NO: 3598733 - RNA, 18 nt, Human
acauguugguauuuaucu

SEQ ID NO: 3598734 - RNA, 20 nt, Human
acauguugguauuuaucuau

SEQ ID NO: 3598735 - RNA, 21 nt, Human
acauguuguaaauuaggaggc

SEQ ID NO: 3598736 - RNA, 20 nt, Human
acauguuuagaguugcaauc

SEQ ID NO: 3598737 - RNA, 21 nt, Human
acauguuuauguaaacaaauc

SEQ ID NO: 3598738 - RNA, 23 nt, Human
acauguuuauuuauucugcauuu

SEQ ID NO: 3598739 - RNA, 16 nt, Human
acauguuuccucuagu

SEQ ID NO: 3598740 - RNA, 21 nt, Human
acauguuugcaccuuucuagu

SEQ ID NO: 3598741 - RNA, 16 nt, Human
acauguuuuaaagaaa

SEQ ID NO: 3598742 - RNA, 21 nt, Human
acauguuuuagacaaauacuc

SEQ ID NO: 3598743 - RNA, 23 nt, Human
acauguuuuagacaaauacucau

SEQ ID NO: 3598744 - RNA, 14 nt, Human
acauguuuucaaau

SEQ ID NO: 3598745 - RNA, 20 nt, Human
acauguuuugauaaaguagu

SEQ ID NO: 3598746 - RNA, 14 nt, Human
acauuaaaaaugga

SEQ ID NO: 3598747 - RNA, 16 nt, Human
acauuaaaaauggaac

SEQ ID NO: 3598748 - RNA, 22 nt, Human
acauuaaaacaauauuguuucu

SEQ ID NO: 3598749 - RNA, 12 nt, Human
acauuaaauaau

SEQ ID NO: 3598750 - RNA, 12 nt, Human
acauuaaaugac

SEQ ID NO: 3598751 - RNA, 12 nt, Human
acauuaaauguc

SEQ ID NO: 3598752 - RNA, 17 nt, Human
acauuaaaugucuuaua

SEQ ID NO: 3598753 - RNA, 22 nt, Human
acauuaaauuuuuuuuacauuu

SEQ ID NO: 3598754 - RNA, 16 nt, Human
acauuaacaguuuucc

SEQ ID NO: 3598755 - RNA, 17 nt, Human
acauuaacaguuuucca

SEQ ID NO: 3598756 - RNA, 22 nt, Human
acauuaacaguuuuccaugaaa

SEQ ID NO: 3598757 - RNA, 14 nt, Human
acauuaacucauua

SEQ ID NO: 3598758 - RNA, 13 nt, Human
acauuaagaaaau

SEQ ID NO: 3598759 - RNA, 13 nt, Human
acauuaagaaugu

SEQ ID NO: 3598760 - RNA, 14 nt, Human
acauuaagaauguu

SEQ ID NO: 3598761 - RNA, 19 nt, Human
acauuaagaauguugguuu

SEQ ID NO: 3598762 - RNA, 18 nt, Human
acauuaauagcagccuuu

SEQ ID NO: 3598763 - RNA, 19 nt, Human
acauuaauccacauguuuc

SEQ ID NO: 3598764 - RNA, 13 nt, Human
acauuaauguuga

SEQ ID NO: 3598765 - RNA, 14 nt, Human
acauuaauguugau

SEQ ID NO: 3598766 - RNA, 21 nt, Human
acauuaauguugauuucuagu

SEQ ID NO: 3598767 - RNA, 15 nt, Human
acauuaccuuacugu

SEQ ID NO: 3598768 - RNA, 11 nt, Human
acauuagaacu

SEQ ID NO: 3598769 - RNA, 14 nt, Human
acauuagaacuucu

SEQ ID NO: 3598770 - RNA, 22 nt, Human
acauuagaacuucuccguccuc

SEQ ID NO: 3598771 - RNA, 17 nt, Human
acauuagguugugaaug

SEQ ID NO: 3598772 - RNA, 18 nt, Human
acauuaguaaaugucuuu

SEQ ID NO: 3598773 - RNA, 19 nt, Human
acagccgcuccugucugcc

SEQ ID NO: 3598774 - RNA, 24 nt, Human
acagccgcuccugucugccagcca

SEQ ID NO: 3598775 - RNA, 16 nt, Human
acagccggggccugcc

SEQ ID NO: 3598776 - RNA, 20 nt, Human
acagccgucagccaaaugua

SEQ ID NO: 3598777 - RNA, 18 nt, Human
acagccguuuguucccca

SEQ ID NO: 3598778 - RNA, 17 nt, Human
acagccuauuccugaac

SEQ ID NO: 3598779 - RNA, 14 nt, Human
acagccucacuugg

SEQ ID NO: 3598780 - RNA, 22 nt, Human
acagccucacuuggucugccag

SEQ ID NO: 3598781 - RNA, 12 nt, Human
acagccucagaa

SEQ ID NO: 3598782 - RNA, 18 nt, Human
acagccuccccugccagg

SEQ ID NO: 3598783 - RNA, 15 nt, Human
acagccuccucuguc

SEQ ID NO: 3598784 - RNA, 19 nt, Human
acagccuccucugucugcc

SEQ ID NO: 3598785 - RNA, 20 nt, Human
acagccuccucugucugccc

SEQ ID NO: 3598786 - RNA, 12 nt, Human
acagccucuauc

SEQ ID NO: 3598787 - RNA, 16 nt, Human
acagccucugaccccu

SEQ ID NO: 3598788 - RNA, 20 nt, Human
acagccucugaccccuccuc

SEQ ID NO: 3598789 - RNA, 16 nt, Human
acagccucuuagaugc

SEQ ID NO: 3598790 - RNA, 17 nt, Human
acagccugacaacauuu

SEQ ID NO: 3598791 - RNA, 12 nt, Human
acagccuggcug

SEQ ID NO: 3598792 - RNA, 15 nt, Human
acagccugggcccca

SEQ ID NO: 3598793 - RNA, 14 nt, Human
acagccugugucuu

SEQ ID NO: 3598794 - RNA, 16 nt, Human
acagccuugucccccu

SEQ ID NO: 3598795 - RNA, 14 nt, Human
acagcgagggcagc

SEQ ID NO: 3598796 - RNA, 16 nt, Human
acagcgagggcagcug

SEQ ID NO: 3598797 - RNA, 21 nt, Human
acagcgcccaaaggacgcacu

SEQ ID NO: 3598798 - RNA, 13 nt, Human
acagcgcuaugca

SEQ ID NO: 3598799 - RNA, 15 nt, Human
acagcggaggugugg

SEQ ID NO: 3598800 - RNA, 16 nt, Human
acagcggaggugugga

SEQ ID NO: 3598801 - RNA, 22 nt, Human
acagcggcuggacuuggaggua

SEQ ID NO: 3598802 - RNA, 16 nt, Human
acagcggggccccagg

SEQ ID NO: 3598803 - RNA, 21 nt, Human
acagcgucccuagcagugaac

SEQ ID NO: 3598804 - RNA, 23 nt, Human
acagcgucccuagcagugaacua

SEQ ID NO: 3598805 - RNA, 22 nt, Human
acagcguuccuagagaagacag

SEQ ID NO: 3598806 - RNA, 17 nt, Human
acagcguuuaagacugu

SEQ ID NO: 3598807 - RNA, 19 nt, Human
acagcuaacaauugugaag

SEQ ID NO: 3598808 - RNA, 15 nt, Human
acagcuaacacacag

SEQ ID NO: 3598809 - RNA, 19 nt, Human
acagcuaacacacagcucc

SEQ ID NO: 3598810 - RNA, 13 nt, Human
acagcuaacaugg

SEQ ID NO: 3598811 - RNA, 22 nt, Human
acagcuaaucagcauucucacu

SEQ ID NO: 3598812 - RNA, 21 nt, Human
acagcuaauucuacucacagu

SEQ ID NO: 3598813 - RNA, 13 nt, Human
acauucaggagcu

SEQ ID NO: 3598814 - RNA, 15 nt, Human
acauucaugccuggc

SEQ ID NO: 3598815 - RNA, 17 nt, Human
acauuccaaagaacagc

SEQ ID NO: 3598816 - RNA, 15 nt, Human
acauuccaacucgua

SEQ ID NO: 3598817 - RNA, 17 nt, Human
acauucccaucugucac

SEQ ID NO: 3598818 - RNA, 17 nt, Human
acauuccccuggggacc

SEQ ID NO: 3598819 - RNA, 23 nt, Human
acauuccgacaaccgaugcucca

SEQ ID NO: 3598820 - RNA, 16 nt, Human
acauuccguuuacauu

SEQ ID NO: 3598821 - RNA, 20 nt, Human
acauuccucaugaauguaaa

SEQ ID NO: 3598822 - RNA, 14 nt, Human
acauuccugaugcu

SEQ ID NO: 3598823 - RNA, 23 nt, Human
acauuccuucucccaucucuucc

SEQ ID NO: 3598824 - RNA, 23 nt, Human
acauucgaucucauucaguauua

SEQ ID NO: 3598825 - RNA, 14 nt, Human
acauucuaucuacu

SEQ ID NO: 3598826 - RNA, 18 nt, Human
acauucuaucuacugauu

SEQ ID NO: 3598827 - RNA, 13 nt, Human
acauucucaguuu

SEQ ID NO: 3598828 - RNA, 15 nt, Human
acauucucaguuuuu

SEQ ID NO: 3598829 - RNA, 15 nt, Human
acauucugaaugcuu

SEQ ID NO: 3598830 - RNA, 20 nt, Human
acauucugaaugcuucuaag

SEQ ID NO: 3598831 - RNA, 21 nt, Human
acauucugaaugcuucuaagu

SEQ ID NO: 3598832 - RNA, 15 nt, Human
acauucugaugagca

SEQ ID NO: 3598833 - RNA, 17 nt, Human
acauucuguaaaauguc

SEQ ID NO: 3598834 - RNA, 10 nt, Human
acauucuuau

SEQ ID NO: 3598835 - RNA, 15 nt, Human
acauucuuauaaaua

SEQ ID NO: 3598836 - RNA, 16 nt, Human
acauucuuauaaauau

SEQ ID NO: 3598837 - RNA, 23 nt, Human
acauucuuauaaauaugaagcuc

SEQ ID NO: 3598838 - RNA, 21 nt, Human
acauucuucaagaucccauuu

SEQ ID NO: 3598839 - RNA, 11 nt, Human
acauucuugua

SEQ ID NO: 3598840 - RNA, 19 nt, Human
acauucuuuuugcucuaaa

SEQ ID NO: 3598841 - RNA, 12 nt, Human
acauugaaagag

SEQ ID NO: 3598842 - RNA, 13 nt, Human
acauugaaaucua

SEQ ID NO: 3598843 - RNA, 19 nt, Human
acauugaaaucuaggaaaa

SEQ ID NO: 3598844 - RNA, 23 nt, Human
acauugaaaucuaggaaaauuau

SEQ ID NO: 3598845 - RNA, 18 nt, Human
acauugaaguaaugaauu

SEQ ID NO: 3598846 - RNA, 22 nt, Human
acauugaauuagaaacauaaau

SEQ ID NO: 3598847 - RNA, 19 nt, Human
acauugaccaagaacugca

SEQ ID NO: 3598848 - RNA, 22 nt, Human
acauugacgauuccuucucuga

SEQ ID NO: 3598849 - RNA, 14 nt, Human
acauugaguagaca

SEQ ID NO: 3598850 - RNA, 16 nt, Human
acauugcaauagaaau

SEQ ID NO: 3598851 - RNA, 17 nt, Human
acauugcaucaaagcau

SEQ ID NO: 3598852 - RNA, 16 nt, Human
acauugcauucuauug

SEQ ID NO: 3598853 - RNA, 22 nt, Human
acauugcauucuauugccuucu

SEQ ID NO: 3598854 - RNA, 19 nt, Human
acauugccguggcaucuua

SEQ ID NO: 3598855 - RNA, 17 nt, Human
acauugccuuugaaugu

SEQ ID NO: 3598856 - RNA, 23 nt, Human
acauugccuuugaauguuaauuu

SEQ ID NO: 3598857 - RNA, 22 nt, Human
acauugccuuuucuagcccgaa

SEQ ID NO: 3598858 - RNA, 20 nt, Human
acauugcuugugccacaccc

SEQ ID NO: 3598859 - RNA, 21 nt, Human
acauuggaagcagguuaaaug

SEQ ID NO: 3598860 - RNA, 17 nt, Human
acauuggaauguucuca

SEQ ID NO: 3598861 - RNA, 16 nt, Human
acauuggauuauccug

SEQ ID NO: 3598862 - RNA, 18 nt, Human
acauuggauuauccugag

SEQ ID NO: 3598863 - RNA, 21 nt, Human
acauugggcagcgcccuuccu

SEQ ID NO: 3598864 - RNA, 18 nt, Human
acauugggucuauuccag

SEQ ID NO: 3598865 - RNA, 21 nt, Human
acauugggucuauuccagcuc

SEQ ID NO: 3598866 - RNA, 23 nt, Human
acauugguucuuguauuaagaau

SEQ ID NO: 3598867 - RNA, 21 nt, Human
acauuguaaauaguauuugag

SEQ ID NO: 3598868 - RNA, 15 nt, Human
acauugucauuuaua

SEQ ID NO: 3598869 - RNA, 24 nt, Human
acauuguccccaaugaauauacuc

SEQ ID NO: 3598870 - RNA, 19 nt, Human
acauugucucccgcccccc

SEQ ID NO: 3598871 - RNA, 16 nt, Human
acauuguuaaaauaaa

SEQ ID NO: 3598872 - RNA, 20 nt, Human
acauuguucaauuagaauag

SEQ ID NO: 3598873 - RNA, 17 nt, Human
acauuguucuuauucug

SEQ ID NO: 3598874 - RNA, 17 nt, Human
acauuguugagcuauug

SEQ ID NO: 3598875 - RNA, 15 nt, Human
acauuguugcucccu

SEQ ID NO: 3598876 - RNA, 14 nt, Human
acauuguuguuuuu

SEQ ID NO: 3598877 - RNA, 13 nt, Human
acauuguuuuaaa

SEQ ID NO: 3598878 - RNA, 17 nt, Human
acauuguuuuaaaaaga

SEQ ID NO: 3598879 - RNA, 16 nt, Human
acauuuaaaccuuuua

SEQ ID NO: 3598880 - RNA, 17 nt, Human
acauuuaaacuugucag

SEQ ID NO: 3598881 - RNA, 23 nt, Human
acauuuaaauuuuacccuuuaga

SEQ ID NO: 3598882 - RNA, 21 nt, Human
acauuuaaggaugggguuaug

SEQ ID NO: 3598883 - RNA, 15 nt, Human
acauuuaauuuagug

SEQ ID NO: 3598884 - RNA, 21 nt, Human
acauuuacauguauuauuuca

SEQ ID NO: 3598885 - RNA, 15 nt, Human
acauuuaccaaucau

SEQ ID NO: 3598886 - RNA, 16 nt, Human
acauuuagaaaaguga

SEQ ID NO: 3598887 - RNA, 15 nt, Human
acauuuagaagaaag

SEQ ID NO: 3598888 - RNA, 18 nt, Human
acauuuagaagaaagaug

SEQ ID NO: 3598889 - RNA, 13 nt, Human
acauuuagauccu

SEQ ID NO: 3598890 - RNA, 15 nt, Human
acauuuauaauguuu

SEQ ID NO: 3598891 - RNA, 18 nt, Human
acauuuauaauguuugcu

SEQ ID NO: 3598892 - RNA, 22 nt, Human
acauuuaucaaucaguauaauu

SEQ ID NO: 3598893 - RNA, 18 nt, Human
acauuuaugaguaacuau

SEQ ID NO: 3598894 - RNA, 20 nt, Human
acauuuaugauuuaauaaaa

SEQ ID NO: 3598895 - RNA, 22 nt, Human
acauuuaugauuuaauaaaaua

SEQ ID NO: 3598896 - RNA, 15 nt, Human
acauuuauucugcuc

SEQ ID NO: 3598897 - RNA, 18 nt, Human
acauuuauuuauccagaa

SEQ ID NO: 3598898 - RNA, 13 nt, Human
acauuuauuuccu

SEQ ID NO: 3598899 - RNA, 14 nt, Human
acauuuauuuuaug

SEQ ID NO: 3598900 - RNA, 17 nt, Human
acauuuauuuuaugaga

SEQ ID NO: 3598901 - RNA, 20 nt, Human
acauuuauuuuaugagaaau

SEQ ID NO: 3598902 - RNA, 22 nt, Human
acauuuauuuuaugagaaaugu

SEQ ID NO: 3598903 - RNA, 14 nt, Human
acauuucaaaguuu

SEQ ID NO: 3598904 - RNA, 22 nt, Human
acauuucacugucugucugguc

SEQ ID NO: 3598905 - RNA, 13 nt, Human
acauuucccaggg

SEQ ID NO: 3598906 - RNA, 21 nt, Human
acauuuccccagaccugagcu

SEQ ID NO: 3598907 - RNA, 16 nt, Human
acauuuccuaaauaua

SEQ ID NO: 3598908 - RNA, 18 nt, Human
acauuuccuuacagaacu

SEQ ID NO: 3598909 - RNA, 20 nt, Human
acauuucuaacucugaugua

SEQ ID NO: 3598910 - RNA, 12 nt, Human
acauuucucaau

SEQ ID NO: 3598911 - RNA, 17 nt, Human
acauuucucauguugaa

SEQ ID NO: 3598912 - RNA, 19 nt, Human
acauuucuguaaauaccau

SEQ ID NO: 3598913 - RNA, 21 nt, Human
acauuucuuuucuuuuuacau

SEQ ID NO: 3598914 - RNA, 22 nt, Human
acauuucuuuucuuuuuacaua

SEQ ID NO: 3598915 - RNA, 17 nt, Human
acauuugaugcaugucu

SEQ ID NO: 3598916 - RNA, 13 nt, Human
acauuugccuugc

SEQ ID NO: 3598917 - RNA, 14 nt, Human
acauuugccuugca

SEQ ID NO: 3598918 - RNA, 19 nt, Human
acauuugcuacuguuguaa

SEQ ID NO: 3598919 - RNA, 15 nt, Human
acauuugcucaugga

SEQ ID NO: 3598920 - RNA, 23 nt, Human
acauuugcuguuuuaaacauuaa

SEQ ID NO: 3598921 - RNA, 14 nt, Human
acauuuggagaggg

SEQ ID NO: 3598922 - RNA, 15 nt, Human
acauuuggaguguuc

SEQ ID NO: 3598923 - RNA, 20 nt, Human
acauuugggagacaugugac

SEQ ID NO: 3598924 - RNA, 20 nt, Human
acauuugggaguuuuuauga

SEQ ID NO: 3598925 - RNA, 15 nt, Human
acauuuguacagaau

SEQ ID NO: 3598926 - RNA, 21 nt, Human
acauuuguagcauccucuuua

SEQ ID NO: 3598927 - RNA, 18 nt, Human
acauuugucauuuucauu

SEQ ID NO: 3598928 - RNA, 19 nt, Human
acauuugucauuuucauua

SEQ ID NO: 3598929 - RNA, 22 nt, Human
acauuugucauuuucauuagca

SEQ ID NO: 3598930 - RNA, 12 nt, Human
acauuugugaga

SEQ ID NO: 3598931 - RNA, 21 nt, Human
acauuugugauauauguauua

SEQ ID NO: 3598932 - RNA, 14 nt, Human
acaggaugcugugu

SEQ ID NO: 3598933 - RNA, 15 nt, Human
acaggaugcuuuggu

SEQ ID NO: 3598934 - RNA, 24 nt, Human
acaggaugguucccuugaugaaga

SEQ ID NO: 3598935 - RNA, 16 nt, Human
acaggauguguuugcu

SEQ ID NO: 3598936 - RNA, 20 nt, Human
acaggauguguuugcuuucu

SEQ ID NO: 3598937 - RNA, 21 nt, Human
acaggauguguuugcuuucug

SEQ ID NO: 3598938 - RNA, 22 nt, Human
acaggauguuugcucagcuucu

SEQ ID NO: 3598939 - RNA, 14 nt, Human
acaggauuauuuug

SEQ ID NO: 3598940 - RNA, 14 nt, Human
acaggcaaacauuu

SEQ ID NO: 3598941 - RNA, 15 nt, Human
acaggcaaacauuuu

SEQ ID NO: 3598942 - RNA, 23 nt, Human
acaggcaaauccgaaaucagcag

SEQ ID NO: 3598943 - RNA, 14 nt, Human
acaggcaaaugcau

SEQ ID NO: 3598944 - RNA, 18 nt, Human
acaggcaacugaggcaga

SEQ ID NO: 3598945 - RNA, 16 nt, Human
acaggcaagcaccucc

SEQ ID NO: 3598946 - RNA, 17 nt, Human
acaggcacacaccacca

SEQ ID NO: 3598947 - RNA, 16 nt, Human
acaggcacugcccugg

SEQ ID NO: 3598948 - RNA, 23 nt, Human
acaggcacugcccugguggcccu

SEQ ID NO: 3598949 - RNA, 13 nt, Human
acaggcagaaaga

SEQ ID NO: 3598950 - RNA, 13 nt, Human
acaggcagagcug

SEQ ID NO: 3598951 - RNA, 15 nt, Human
acaggcagauacagg

SEQ ID NO: 3598952 - RNA, 13 nt, Human
acaggcagcacag

SEQ ID NO: 3598953 - RNA, 12 nt, Human
acaggcagcaga

SEQ ID NO: 3598954 - RNA, 14 nt, Human
acaggcagcauuua

SEQ ID NO: 3598955 - RNA, 22 nt, Human
acaggcagccagugcccugagc

SEQ ID NO: 3598956 - RNA, 16 nt, Human
acaggcagccuggaca

SEQ ID NO: 3598957 - RNA, 12 nt, Human
aauuaaacuuag

SEQ ID NO: 3598958 - RNA, 16 nt, Human
aauuaaacuuccaaag

SEQ ID NO: 3598959 - RNA, 22 nt, Human
aauuaaacuuccaaagaaaguu

SEQ ID NO: 3598960 - RNA, 12 nt, Human
aauuaaaguguc

SEQ ID NO: 3598961 - RNA, 14 nt, Human
aauuaaauaaaaua

SEQ ID NO: 3598962 - RNA, 19 nt, Human
aauuaaauauauguaugua

SEQ ID NO: 3598963 - RNA, 11 nt, Human
aauuaaaugua

SEQ ID NO: 3598964 - RNA, 14 nt, Human
aauuaaauuaggaa

SEQ ID NO: 3598965 - RNA, 14 nt, Human
aauuaaauuuugag

SEQ ID NO: 3598966 - RNA, 22 nt, Human
aauuaaauuuugaguucuacau

SEQ ID NO: 3598967 - RNA, 17 nt, Human
aauuaaauuuugugucu

SEQ ID NO: 3598968 - RNA, 14 nt, Human
aauuaacagaaaaa

SEQ ID NO: 3598969 - RNA, 17 nt, Human
aauuaacauauaauaua

SEQ ID NO: 3598970 - RNA, 18 nt, Human
aauuaacauauaauauau

SEQ ID NO: 3598971 - RNA, 19 nt, Human
aauuaacauauaauauaug

SEQ ID NO: 3598972 - RNA, 19 nt, Human
aauuaacauguuaaaccau

SEQ ID NO: 3598973 - RNA, 20 nt, Human
aauuaacauugggaaaucuu

SEQ ID NO: 3598974 - RNA, 20 nt, Human
aauuaaccaagguagaauga

SEQ ID NO: 3598975 - RNA, 12 nt, Human
aauuaaccuggu

SEQ ID NO: 3598976 - RNA, 13 nt, Human
aauuaaccuggug

SEQ ID NO: 3598977 - RNA, 18 nt, Human
aauuaaccuggugcugga

SEQ ID NO: 3598978 - RNA, 20 nt, Human
aauuaacuuuuauaaacuuu

SEQ ID NO: 3598979 - RNA, 16 nt, Human
aauuaagaagaaacua

SEQ ID NO: 3598980 - RNA, 13 nt, Human
aauuaagaaggca

SEQ ID NO: 3598981 - RNA, 12 nt, Human
aauuaagacaag

SEQ ID NO: 3598982 - RNA, 19 nt, Human
aauuaagaggauacacacg

SEQ ID NO: 3598983 - RNA, 22 nt, Human
aauuaagcaaauguuaaaaguu

SEQ ID NO: 3598984 - RNA, 16 nt, Human
aauuaaggcauaagaa

SEQ ID NO: 3598985 - RNA, 12 nt, Human
aauuaaguaaac

SEQ ID NO: 3598986 - RNA, 13 nt, Human
aauuaaguaucug

SEQ ID NO: 3598987 - RNA, 23 nt, Human
aauuaauaaaaaauggaaagaau

SEQ ID NO: 3598988 - RNA, 11 nt, Human
aauuaauaaau

SEQ ID NO: 3598989 - RNA, 13 nt, Human
aauuaauagcuuu

SEQ ID NO: 3598990 - RNA, 14 nt, Human
aauuaauaguuugu

SEQ ID NO: 3598991 - RNA, 22 nt, Human
aauuaauaguuugucuauuuua

SEQ ID NO: 3598992 - RNA, 19 nt, Human
aauuaauauauuaaaauuc

SEQ ID NO: 3598993 - RNA, 16 nt, Human
aauuaaucaugaaugu

SEQ ID NO: 3598994 - RNA, 19 nt, Human
aauuaaugaaauaucugua

SEQ ID NO: 3598995 - RNA, 13 nt, Human
aauuaaugacaga

SEQ ID NO: 3598996 - RNA, 16 nt, Human
aauuaauugcuauugu

SEQ ID NO: 3598997 - RNA, 13 nt, Human
aauuaauuggcag

SEQ ID NO: 3598998 - RNA, 18 nt, Human
aauuaauuggcagcagau

SEQ ID NO: 3598999 - RNA, 15 nt, Human
aauuaauuguaaucu

SEQ ID NO: 3599000 - RNA, 15 nt, Human
aauuaauugugugaa

SEQ ID NO: 3599001 - RNA, 16 nt, Human
aauuaauuugauuaac

SEQ ID NO: 3599002 - RNA, 12 nt, Human
aauuaauuuuac

SEQ ID NO: 3599003 - RNA, 23 nt, Human
aauuaauuuuuuuauuguuuaaa

SEQ ID NO: 3599004 - RNA, 15 nt, Human
aauuacaauuuuauc

SEQ ID NO: 3599005 - RNA, 20 nt, Human
aauuacacucuuccuccauu

SEQ ID NO: 3599006 - RNA, 17 nt, Human
aauuacagaaauuuaau

SEQ ID NO: 3599007 - RNA, 11 nt, Human
aauuacaggaa

SEQ ID NO: 3599008 - RNA, 20 nt, Human
aauuacaggaaguacuggag

SEQ ID NO: 3599009 - RNA, 19 nt, Human
aauuacaguggauugcuca

SEQ ID NO: 3599010 - RNA, 15 nt, Human
aauuaccauuuguua

SEQ ID NO: 3599011 - RNA, 16 nt, Human
aauuaccauuuguuaa

SEQ ID NO: 3599012 - RNA, 14 nt, Human
aauuaccuacucug

SEQ ID NO: 3599013 - RNA, 23 nt, Human
aauuaccuuagauuagcucugga

SEQ ID NO: 3599014 - RNA, 21 nt, Human
aauuaccuugagccaguaauu

SEQ ID NO: 3599015 - RNA, 20 nt, Human
aauuacgauaaggaagaaac

SEQ ID NO: 3599016 - RNA, 14 nt, Human
aauuacgugcucug

SEQ ID NO: 3599017 - RNA, 20 nt, Human
aauuacuaaauuacaaaugc

SEQ ID NO: 3599018 - RNA, 16 nt, Human
aauuacuaacuucuaa

SEQ ID NO: 3599019 - RNA, 23 nt, Human
aauuacuaacuucuaaaacugua

SEQ ID NO: 3599020 - RNA, 17 nt, Human
aauuacuacaaaauuug

SEQ ID NO: 3599021 - RNA, 16 nt, Human
aauuacugccuugaaa

SEQ ID NO: 3599022 - RNA, 15 nt, Human
aauuacuuaaaaaaa

SEQ ID NO: 3599023 - RNA, 17 nt, Human
aauuacuuaguauugca

SEQ ID NO: 3599024 - RNA, 23 nt, Human
aauuacuuuggggcuaauuuaac

SEQ ID NO: 3599025 - RNA, 14 nt, Human
aauuacuuugguag

SEQ ID NO: 3599026 - RNA, 19 nt, Human
aauuagacugugauucaga

SEQ ID NO: 3599027 - RNA, 22 nt, Human
aauuagagcagaugaccccucc

SEQ ID NO: 3599028 - RNA, 21 nt, Human
aauuagaugcauguugaccau

SEQ ID NO: 3599029 - RNA, 13 nt, Human
aauuagauuucuc

SEQ ID NO: 3599030 - RNA, 15 nt, Human
aauuagccaagugug

SEQ ID NO: 3599031 - RNA, 17 nt, Human
aauuagccaguaauccu

SEQ ID NO: 3599032 - RNA, 15 nt, Human
aauuagccuaagaua

SEQ ID NO: 3599033 - RNA, 16 nt, Human
aauuagcugugugaaa

SEQ ID NO: 3599034 - RNA, 16 nt, Human
aauuagcuuauguuaa

SEQ ID NO: 3599035 - RNA, 17 nt, Human
aauuagcuuggggccag

SEQ ID NO: 3599036 - RNA, 21 nt, Human
aauuaggaaguguaacagcug

SEQ ID NO: 3599037 - RNA, 18 nt, Human
aauuaggcuguaacuacu

SEQ ID NO: 3599038 - RNA, 17 nt, Human
aauuagggguugcuaag

SEQ ID NO: 3599039 - RNA, 16 nt, Human
aauuaggguacauuua

SEQ ID NO: 3599040 - RNA, 20 nt, Human
aauuaggguacauuuauaau

SEQ ID NO: 3599041 - RNA, 14 nt, Human
aauuagguuaacua

SEQ ID NO: 3599042 - RNA, 22 nt, Human
aauuagguuaacuauguacaau

SEQ ID NO: 3599043 - RNA, 17 nt, Human
aauuagguugaaacaua

SEQ ID NO: 3599044 - RNA, 18 nt, Human
aauuagguuuuuccuuau

SEQ ID NO: 3599045 - RNA, 17 nt, Human
aauuaguaacauguguu

SEQ ID NO: 3599046 - RNA, 22 nt, Human
aauuaguaggcucauuuacugu

SEQ ID NO: 3599047 - RNA, 22 nt, Human
aauuagugcuaagugugaacug

SEQ ID NO: 3599048 - RNA, 12 nt, Human
aauuaguuuccu

SEQ ID NO: 3599049 - RNA, 17 nt, Human
aauuaguuuuauaugcu

SEQ ID NO: 3599050 - RNA, 14 nt, Human
aauuauaaaagcca

SEQ ID NO: 3599051 - RNA, 20 nt, Human
aauuauaagaggcugauaau

SEQ ID NO: 3599052 - RNA, 18 nt, Human
aauuauaaggacugcaug

SEQ ID NO: 3599053 - RNA, 16 nt, Human
aauuauaagucacaaa

SEQ ID NO: 3599054 - RNA, 16 nt, Human
aauuauaauguauuca

SEQ ID NO: 3599055 - RNA, 13 nt, Human
aauuauacaaauu

SEQ ID NO: 3599056 - RNA, 12 nt, Human
aauuauacuaac

SEQ ID NO: 3599057 - RNA, 20 nt, Human
aauuauagcucuaauguuug

SEQ ID NO: 3599058 - RNA, 23 nt, Human
aauuauagcucuaauguuugcau

SEQ ID NO: 3599059 - RNA, 14 nt, Human
aauuauaguuucug

SEQ ID NO: 3599060 - RNA, 16 nt, Human
aauuauaguuucugag

SEQ ID NO: 3599061 - RNA, 17 nt, Human
aauuauaguuucugagg

SEQ ID NO: 3599062 - RNA, 14 nt, Human
aauuauauaacugu

SEQ ID NO: 3599063 - RNA, 22 nt, Human
aauuauaucaguccucuuucaa

SEQ ID NO: 3599064 - RNA, 14 nt, Human
aauuauauguugua

SEQ ID NO: 3599065 - RNA, 13 nt, Human
aauuauauuugug

SEQ ID NO: 3599066 - RNA, 16 nt, Human
aauuaucagcaaagaa

SEQ ID NO: 3599067 - RNA, 19 nt, Human
aauuaucagcaaagaaaaa

SEQ ID NO: 3599068 - RNA, 21 nt, Human
aauuaucagcaaagaaaaaaa

SEQ ID NO: 3599069 - RNA, 22 nt, Human
aauuaucaggcaaauuugcauu

SEQ ID NO: 3599070 - RNA, 15 nt, Human
aauuauccagaguuu

SEQ ID NO: 3599071 - RNA, 21 nt, Human
aauuaucccuuuucuugacua

SEQ ID NO: 3599072 - RNA, 16 nt, Human
aauuauccuauuucag

SEQ ID NO: 3599073 - RNA, 21 nt, Human
aauuaucggaagcagugccuu

SEQ ID NO: 3599074 - RNA, 23 nt, Human
aauuaucgggaacaguguuuccc

SEQ ID NO: 3599075 - RNA, 15 nt, Human
aauuaucuaauuuau

SEQ ID NO: 3599076 - RNA, 18 nt, Human
aauuaucuaauuuauaaa

SEQ ID NO: 3599077 - RNA, 14 nt, Human
aauuaucuauacau

SEQ ID NO: 3599078 - RNA, 16 nt, Human
aauuaucuauacauau

SEQ ID NO: 3599079 - RNA, 15 nt, Human
aauuaucuauagcua

SEQ ID NO: 3599080 - RNA, 22 nt, Human
aauuaucuauagcuaaguacac

SEQ ID NO: 3599081 - RNA, 23 nt, Human
aauuaucuauagcuaaguacaca

SEQ ID NO: 3599082 - RNA, 13 nt, Human
aauuaucuauuug

SEQ ID NO: 3599083 - RNA, 18 nt, Human
aauuaucuugauacauuc

SEQ ID NO: 3599084 - RNA, 12 nt, Human
aauuaugaaacu

SEQ ID NO: 3599085 - RNA, 15 nt, Human
aauuaugaagauuua

SEQ ID NO: 3599086 - RNA, 21 nt, Human
aauuaugaaucugauuuuuau

SEQ ID NO: 3599087 - RNA, 13 nt, Human
aauuaugacaguu

SEQ ID NO: 3599088 - RNA, 15 nt, Human
aauuaugacaguuau

SEQ ID NO: 3599089 - RNA, 16 nt, Human
aauuaugcuaagaauu

SEQ ID NO: 3599090 - RNA, 18 nt, Human
aauuaugcuaagaauuuu

SEQ ID NO: 3599091 - RNA, 21 nt, Human
aauuauggaaaaaaaauauuc

SEQ ID NO: 3599092 - RNA, 21 nt, Human
aauuauggcccagggggcuaa

SEQ ID NO: 3599093 - RNA, 17 nt, Human
aauuaugguaaaauuuu

SEQ ID NO: 3599094 - RNA, 22 nt, Human
acaguauaucccaagugcacuu

SEQ ID NO: 3599095 - RNA, 18 nt, Human
acaguauauuuuauuuca

SEQ ID NO: 3599096 - RNA, 15 nt, Human
acaguaucccacauc

SEQ ID NO: 3599097 - RNA, 21 nt, Human
acaguaucccacauccaacuc

SEQ ID NO: 3599098 - RNA, 21 nt, Human
acaguauggcagcuuuccuca

SEQ ID NO: 3599099 - RNA, 19 nt, Human
acaguauggggguuguaaa

SEQ ID NO: 3599100 - RNA, 22 nt, Human
acaguauggggguuguaaauug

SEQ ID NO: 3599101 - RNA, 17 nt, Human
acaguaugucccauagg

SEQ ID NO: 3599102 - RNA, 15 nt, Human
aaaguguuuucagag

SEQ ID NO: 3599103 - RNA, 17 nt, Human
aaaguguuuuguaccag

SEQ ID NO: 3599104 - RNA, 15 nt, Human
aaaguuaaaaaaaau

SEQ ID NO: 3599105 - RNA, 17 nt, Human
aaaguuaaaauuguuau

SEQ ID NO: 3599106 - RNA, 16 nt, Human
aaaguuaaacauugaa

SEQ ID NO: 3599107 - RNA, 20 nt, Human
aaaguuaaccuaccuguaac

SEQ ID NO: 3599108 - RNA, 22 nt, Human
aaaguuaaugcuuaagagggaa

SEQ ID NO: 3599109 - RNA, 14 nt, Human
aaaguuacagaaau

SEQ ID NO: 3599110 - RNA, 19 nt, Human
aaaguuacuaccugucaag

SEQ ID NO: 3599111 - RNA, 20 nt, Human
aaaguuacuuugucagaggc

SEQ ID NO: 3599112 - RNA, 13 nt, Human
aaaguuagaaucu

SEQ ID NO: 3599113 - RNA, 18 nt, Human
aaaguuagaaucuauuuu

SEQ ID NO: 3599114 - RNA, 20 nt, Human
aaaguuaguaucuuuugaua

SEQ ID NO: 3599115 - RNA, 16 nt, Human
aaaguuauauagguuu

SEQ ID NO: 3599116 - RNA, 24 nt, Human
aaaguuauauuucagauguaaugu

SEQ ID NO: 3599117 - RNA, 20 nt, Human
aaaguuauugauaaguucau

SEQ ID NO: 3599118 - RNA, 23 nt, Human
aaaguuauugauaaguucauaca

SEQ ID NO: 3599119 - RNA, 18 nt, Human
aaaguuauuuuuaaaaac

SEQ ID NO: 3599120 - RNA, 18 nt, Human
aaaguucacaauguggcc

SEQ ID NO: 3599121 - RNA, 15 nt, Human
aaaguucagaguuuu

SEQ ID NO: 3599122 - RNA, 22 nt, Human
aaaguucauaacagugccauug

SEQ ID NO: 3599123 - RNA, 16 nt, Human
aaaguuccaagagucu

SEQ ID NO: 3599124 - RNA, 11 nt, Human
aaaguucuaag

SEQ ID NO: 3599125 - RNA, 19 nt, Human
aaaguucuaauaauuucua

SEQ ID NO: 3599126 - RNA, 21 nt, Human
aaaguucuaauaauuucuaau

SEQ ID NO: 3599127 - RNA, 23 nt, Human
aaaguucugcagauaaacaguag

SEQ ID NO: 3599128 - RNA, 17 nt, Human
aaaguucuguaaaauau

SEQ ID NO: 3599129 - RNA, 12 nt, Human
aaaguucugugu

SEQ ID NO: 3599130 - RNA, 13 nt, Human
aaaguucugugua

SEQ ID NO: 3599131 - RNA, 15 nt, Human
aaaguugcaaggcaa

SEQ ID NO: 3599132 - RNA, 18 nt, Human
aaaguugcagcuguuuug

SEQ ID NO: 3599133 - RNA, 13 nt, Human
aaaguugccuaaa

SEQ ID NO: 3599134 - RNA, 14 nt, Human
aaaguugccuaaau

SEQ ID NO: 3599135 - RNA, 13 nt, Human
aaaguuggacuaa

SEQ ID NO: 3599136 - RNA, 15 nt, Human
aaaguuggacuaaau

SEQ ID NO: 3599137 - RNA, 13 nt, Human
aaaguuguacaug

SEQ ID NO: 3599138 - RNA, 16 nt, Human
aaaguuguacuuuaaa

SEQ ID NO: 3599139 - RNA, 16 nt, Human
aaaguuguucaacuau

SEQ ID NO: 3599140 - RNA, 19 nt, Human
aaaguuguucaacuauuuu

SEQ ID NO: 3599141 - RNA, 20 nt, Human
aaaguuuaaaacagaagccu

SEQ ID NO: 3599142 - RNA, 12 nt, Human
aaaguuuaaaau

SEQ ID NO: 3599143 - RNA, 21 nt, Human
aaaguuuaauauuaaagccau

SEQ ID NO: 3599144 - RNA, 18 nt, Human
aaaguuuacaguaaauaa

SEQ ID NO: 3599145 - RNA, 19 nt, Human
aaaguuuagccccugaaag

SEQ ID NO: 3599146 - RNA, 19 nt, Human
aaaguuucaaaaaucugaa

SEQ ID NO: 3599147 - RNA, 21 nt, Human
aaaguuucaaaaaucugaaga

SEQ ID NO: 3599148 - RNA, 12 nt, Human
aaaguuucaaug

SEQ ID NO: 3599149 - RNA, 22 nt, Human
aaaguuuccccaccagugaaug

SEQ ID NO: 3599150 - RNA, 14 nt, Human
aaaguuugaucuuc

SEQ ID NO: 3599151 - RNA, 22 nt, Human
aaaguuugaucuuccucugcua

SEQ ID NO: 3599152 - RNA, 15 nt, Human
aaaguuugccagaag

SEQ ID NO: 3599153 - RNA, 15 nt, Human
aaaguuugcuuagaa

SEQ ID NO: 3599154 - RNA, 16 nt, Human
aaaguuugcuuagaaa

SEQ ID NO: 3599155 - RNA, 14 nt, Human
aaaguuuuauauau

SEQ ID NO: 3599156 - RNA, 17 nt, Human
aaaguuuuauauauuau

SEQ ID NO: 3599157 - RNA, 18 nt, Human
aaaguuuuauauauuaua

SEQ ID NO: 3599158 - RNA, 20 nt, Human
aaaguuuuauauauuauaug

SEQ ID NO: 3599159 - RNA, 21 nt, Human
aaaguuuuauauauuauaugg

SEQ ID NO: 3599160 - RNA, 22 nt, Human
aaaguuuuauauauuauaugga

SEQ ID NO: 3599161 - RNA, 16 nt, Human
aaaguuuuauuuuucu

SEQ ID NO: 3599162 - RNA, 16 nt, Human
aaaguuuugaaaagcu

SEQ ID NO: 3599163 - RNA, 19 nt, Human
aaaguuuugaaaagcuauu

SEQ ID NO: 3599164 - RNA, 23 nt, Human
aaaguuuugaguagauauuacuu

SEQ ID NO: 3599165 - RNA, 23 nt, Human
aaaguuuuguuguacuuaaaugg

SEQ ID NO: 3599166 - RNA, 22 nt, Human
aaauaaaaaaaagaaaaaagag

SEQ ID NO: 3599167 - RNA, 16 nt, Human
aaauaaaaaagauccc

SEQ ID NO: 3599168 - RNA, 10 nt, Human
aaauaaaaag

SEQ ID NO: 3599169 - RNA, 19 nt, Human
aaauaaaaagaaaggcugu

SEQ ID NO: 3599170 - RNA, 15 nt, Human
aaauaaaaagugaca

SEQ ID NO: 3599171 - RNA, 14 nt, Human
aaauaaaaaguuaa

SEQ ID NO: 3599172 - RNA, 14 nt, Human
aaauaaaaauauug

SEQ ID NO: 3599173 - RNA, 20 nt, Human
aaauaaaaauauuguguugu

SEQ ID NO: 3599174 - RNA, 23 nt, Human
aaauaaaaauuauuauugauuuu

SEQ ID NO: 3599175 - RNA, 13 nt, Human
aaauaaaaauucu

SEQ ID NO: 3599176 - RNA, 20 nt, Human
aaauaaaacaaagggcacag

SEQ ID NO: 3599177 - RNA, 13 nt, Human
aaauaaaacauuu

SEQ ID NO: 3599178 - RNA, 22 nt, Human
aaauaaaacauuuucacacaau

SEQ ID NO: 3599179 - RNA, 15 nt, Human
aaauaaaaccuuuca

SEQ ID NO: 3599180 - RNA, 17 nt, Human
aaauaaaaccuuucaaa

SEQ ID NO: 3599181 - RNA, 19 nt, Human
aaauaaaacuuuuuaaaau

SEQ ID NO: 3599182 - RNA, 20 nt, Human
aaauaaaagaaaugcacaau

SEQ ID NO: 3599183 - RNA, 19 nt, Human
aaauaaaagcagcaucugc

SEQ ID NO: 3599184 - RNA, 16 nt, Human
aaauaaaagugaucaa

SEQ ID NO: 3599185 - RNA, 13 nt, Human
aaauaaaauauaa

SEQ ID NO: 3599186 - RNA, 15 nt, Human
aaauaaaauauaauu

SEQ ID NO: 3599187 - RNA, 17 nt, Human
aaauaaaaugcuagguu

SEQ ID NO: 3599188 - RNA, 21 nt, Human
aaauaaacacauagauucacc

SEQ ID NO: 3599189 - RNA, 23 nt, Human
aaauaaacacauagauucaccug

SEQ ID NO: 3599190 - RNA, 16 nt, Human
aaauaaacacuacaga

SEQ ID NO: 3599191 - RNA, 17 nt, Human
aaacuacauuuuaacau

SEQ ID NO: 3599192 - RNA, 17 nt, Human
aaacuacucuuugauuu

SEQ ID NO: 3599193 - RNA, 21 nt, Human
aaacuacugccuuuagaaaau

SEQ ID NO: 3599194 - RNA, 23 nt, Human
aaacuagacuugaggaaaccagg

SEQ ID NO: 3599195 - RNA, 22 nt, Human
aaacuagaggugagaaauuuaa

SEQ ID NO: 3599196 - RNA, 12 nt, Human
aaacuagaugac

SEQ ID NO: 3599197 - RNA, 13 nt, Human
aaacuagaugacc

SEQ ID NO: 3599198 - RNA, 17 nt, Human
aaacuagaugaccucau

SEQ ID NO: 3599199 - RNA, 19 nt, Human
aaacuagcauaucugccuu

SEQ ID NO: 3599200 - RNA, 21 nt, Human
aaacuagcauaucugccuuua

SEQ ID NO: 3599201 - RNA, 13 nt, Human
aaacuaggaaaau

SEQ ID NO: 3599202 - RNA, 17 nt, Human
aaacuaggaaaauugga

SEQ ID NO: 3599203 - RNA, 15 nt, Human
aaacuaggcuccuuc

SEQ ID NO: 3599204 - RNA, 20 nt, Human
aaacuaggggacaaagcaaa

SEQ ID NO: 3599205 - RNA, 18 nt, Human
aaacuaggugcauauuua

SEQ ID NO: 3599206 - RNA, 19 nt, Human
aaacuauacuugaacaaaa

SEQ ID NO: 3599207 - RNA, 17 nt, Human
aaacuauauuuugucau

SEQ ID NO: 3599208 - RNA, 14 nt, Human
aaacuaucuugugu

SEQ ID NO: 3599209 - RNA, 19 nt, Human
aaacuaugaaaccuuuuuc

SEQ ID NO: 3599210 - RNA, 13 nt, Human
aaacuauguguuu

SEQ ID NO: 3599211 - RNA, 17 nt, Human
aaacuauguguuuuucu

SEQ ID NO: 3599212 - RNA, 18 nt, Human
aaacuauuuaaagaaaua

SEQ ID NO: 3599213 - RNA, 18 nt, Human
aaacucaaaacuuaacau

SEQ ID NO: 3599214 - RNA, 15 nt, Human
aaacucaaacuuuuc

SEQ ID NO: 3599215 - RNA, 20 nt, Human
aaacucaaccaaaugguaca

SEQ ID NO: 3599216 - RNA, 22 nt, Human
aaacucaaccaaaugguacaaa

SEQ ID NO: 3599217 - RNA, 13 nt, Human
aaacucaaugcuu

SEQ ID NO: 3599218 - RNA, 18 nt, Human
aaacucaaugcuuuauuu

SEQ ID NO: 3599219 - RNA, 15 nt, Human
aaacucacaaaugau

SEQ ID NO: 3599220 - RNA, 15 nt, Human
aaacucacugcucaa

SEQ ID NO: 3599221 - RNA, 23 nt, Human
aaacucagccucaauaagccuug

SEQ ID NO: 3599222 - RNA, 19 nt, Human
aaacucaggcaaagaaaau

SEQ ID NO: 3599223 - RNA, 17 nt, Human
aaacucagggacagagc

SEQ ID NO: 3599224 - RNA, 21 nt, Human
aaacucauucauuagucaugu

SEQ ID NO: 3599225 - RNA, 15 nt, Human
aaacucauuuauaaa

SEQ ID NO: 3599226 - RNA, 24 nt, Human
aaacucauuuauaaagcuaaaaua

SEQ ID NO: 3599227 - RNA, 15 nt, Human
aaacucauuuccuau

SEQ ID NO: 3599228 - RNA, 18 nt, Human
aaacuccacaucugccuu

SEQ ID NO: 3599229 - RNA, 19 nt, Human
aaacuccacaucugccuua

SEQ ID NO: 3599230 - RNA, 15 nt, Human
aaacuccaccuuccc

SEQ ID NO: 3599231 - RNA, 22 nt, Human
aaacuccgagugaacuggucuu

SEQ ID NO: 3599232 - RNA, 17 nt, Human
aaacuccggauugcguu

SEQ ID NO: 3599233 - RNA, 14 nt, Human
aaacuccugccccu

SEQ ID NO: 3599234 - RNA, 16 nt, Human
aaacucgaggacugua

SEQ ID NO: 3599235 - RNA, 17 nt, Human
aaacucgaggacuguau

SEQ ID NO: 3599236 - RNA, 19 nt, Human
aaacucgaggacuguauuu

SEQ ID NO: 3599237 - RNA, 22 nt, Human
aaacucgaggacuguauuugug

SEQ ID NO: 3599238 - RNA, 15 nt, Human
aaacucguuaauuug

SEQ ID NO: 3599239 - RNA, 20 nt, Human
aaacucuaaacauuaaucaa

SEQ ID NO: 3599240 - RNA, 22 nt, Human
aaacucuaucggagaacaugaa

SEQ ID NO: 3599241 - RNA, 23 nt, Human
aaacucucuuugggaauguuugu

SEQ ID NO: 3599242 - RNA, 23 nt, Human
aaacucugcauccagagauucau

SEQ ID NO: 3599243 - RNA, 14 nt, Human
aaacucugggaaau

SEQ ID NO: 3599244 - RNA, 22 nt, Human
aaacucugggaaauaagagaga

SEQ ID NO: 3599245 - RNA, 18 nt, Human
aaacucuguuacacuuuu

SEQ ID NO: 3599246 - RNA, 15 nt, Human
aaauaagcaggugga

SEQ ID NO: 3599247 - RNA, 22 nt, Human
aaauaagcagguggaucuauuu

SEQ ID NO: 3599248 - RNA, 12 nt, Human
aaauaagcuauu

SEQ ID NO: 3599249 - RNA, 18 nt, Human
aaauaagcuauuugaugu

SEQ ID NO: 3599250 - RNA, 22 nt, Human
aaauaagcuauuugauguaaua

SEQ ID NO: 3599251 - RNA, 22 nt, Human
aaauaaggcacccaucugucug

SEQ ID NO: 3599252 - RNA, 12 nt, Human
aaauaaguauuu

SEQ ID NO: 3599253 - RNA, 17 nt, Human
aaauaaguauuuauaau

SEQ ID NO: 3599254 - RNA, 22 nt, Human
aaauaaguauuuauaauagcaa

SEQ ID NO: 3599255 - RNA, 13 nt, Human
aaauaagucaaca

SEQ ID NO: 3599256 - RNA, 12 nt, Human
aaauaagucuga

SEQ ID NO: 3599257 - RNA, 14 nt, Human
aaauaagucugauu

SEQ ID NO: 3599258 - RNA, 17 nt, Human
aaauaagucugauuuaa

SEQ ID NO: 3599259 - RNA, 14 nt, Human
aaauaaguguauuu

SEQ ID NO: 3599260 - RNA, 16 nt, Human
aaauaaguuuuuguuu

SEQ ID NO: 3599261 - RNA, 11 nt, Human
aaauaauaaag

SEQ ID NO: 3599262 - RNA, 16 nt, Human
aaauaauaaauugcau

SEQ ID NO: 3599263 - RNA, 15 nt, Human
aaauaauaauaaugu

SEQ ID NO: 3599264 - RNA, 13 nt, Human
aaauaauaauuuu

SEQ ID NO: 3599265 - RNA, 14 nt, Human
aaauaauaugcauu

SEQ ID NO: 3599266 - RNA, 14 nt, Human
aaauaaucauucuu

SEQ ID NO: 3599267 - RNA, 13 nt, Human
aaauaaucucuga

SEQ ID NO: 3599268 - RNA, 19 nt, Human
aaauaaugcuacaauuuua

SEQ ID NO: 3599269 - RNA, 18 nt, Human
aaauaauguaauuguaau

SEQ ID NO: 3599270 - RNA, 12 nt, Human
aaauaaugucuc

SEQ ID NO: 3599271 - RNA, 21 nt, Human
aaauaaugucuuguuaauauu

SEQ ID NO: 3599272 - RNA, 12 nt, Human
aaauaaugugaa

SEQ ID NO: 3599273 - RNA, 14 nt, Human
aaauaaugugaaac

SEQ ID NO: 3599274 - RNA, 13 nt, Human
aaauaauucuuuu

SEQ ID NO: 3599275 - RNA, 14 nt, Human
aaauaauucuuuuu

SEQ ID NO: 3599276 - RNA, 21 nt, Human
aaauaauucuuuuuuauuaau

SEQ ID NO: 3599277 - RNA, 17 nt, Human
aaauaauugauuucaag

SEQ ID NO: 3599278 - RNA, 13 nt, Human
aaauaauuguugu

SEQ ID NO: 3599279 - RNA, 19 nt, Human
aaauaauuuaacuacccuu

SEQ ID NO: 3599280 - RNA, 12 nt, Human
aaauaauuuuaa

SEQ ID NO: 3599281 - RNA, 20 nt, Human
aaauaauuuuaaacaaaggu

SEQ ID NO: 3599282 - RNA, 13 nt, Human
aaauaauuuuagu

SEQ ID NO: 3599283 - RNA, 19 nt, Human
aaauaauuuuaucucuuuc

SEQ ID NO: 3599284 - RNA, 14 nt, Human
aaauaauuuuauga

SEQ ID NO: 3599285 - RNA, 23 nt, Human
aaauaauuuuaugaacugcaugu

SEQ ID NO: 3599286 - RNA, 13 nt, Human
aaauaauuuugua

SEQ ID NO: 3599287 - RNA, 18 nt, Human
aaauaauuuuuauauuug

SEQ ID NO: 3599288 - RNA, 20 nt, Human
aaauaauuuuuauauuugaa

SEQ ID NO: 3599289 - RNA, 11 nt, Human
aaauacaaaaa

SEQ ID NO: 3599290 - RNA, 17 nt, Human
aaauacaaguucuauuu

SEQ ID NO: 3599291 - RNA, 13 nt, Human
aaauacaauaaac

SEQ ID NO: 3599292 - RNA, 17 nt, Human
aaauacaauuuuguuuc

SEQ ID NO: 3599293 - RNA, 18 nt, Human
aaauacaauuuuguuucu

SEQ ID NO: 3599294 - RNA, 20 nt, Human
aaauacaauuuuguuucugu

SEQ ID NO: 3599295 - RNA, 21 nt, Human
aaauacaccaccucacuccug

SEQ ID NO: 3599296 - RNA, 14 nt, Human
aaauacagacacua

SEQ ID NO: 3599297 - RNA, 16 nt, Human
aaauacagacacuaag

SEQ ID NO: 3599298 - RNA, 22 nt, Human
aaauacagacacuaaguuauag

SEQ ID NO: 3599299 - RNA, 16 nt, Human
aaauacagauaaauga

SEQ ID NO: 3599300 - RNA, 20 nt, Human
aaauacagauaaaugauuca

SEQ ID NO: 3599301 - RNA, 22 nt, Human
aaauacagauaaaugauucaaa

SEQ ID NO: 3599302 - RNA, 17 nt, Human
aaauacagcuggauugg

SEQ ID NO: 3599303 - RNA, 16 nt, Human
aaauacaggaaacagu

SEQ ID NO: 3599304 - RNA, 16 nt, Human
aaauacaguauucugu

SEQ ID NO: 3599305 - RNA, 22 nt, Human
aaauacaguuugucacaugaaa

SEQ ID NO: 3599306 - RNA, 16 nt, Human
aaauacauacggucag

SEQ ID NO: 3599307 - RNA, 19 nt, Human
aaauacaugcauauaauga

SEQ ID NO: 3599308 - RNA, 18 nt, Human
aaauacaugcuaagagaa

SEQ ID NO: 3599309 - RNA, 13 nt, Human
aaauacauucuuu

SEQ ID NO: 3599310 - RNA, 19 nt, Human
aaauacauucuuuuugcuc

SEQ ID NO: 3599311 - RNA, 23 nt, Human
aaauaccaaaauuauuucagaaa

SEQ ID NO: 3599312 - RNA, 23 nt, Human
aaauaccaaaccuucugacuuug

SEQ ID NO: 3599313 - RNA, 18 nt, Human
aaauaccagugaaccaaa

SEQ ID NO: 3599314 - RNA, 21 nt, Human
aaauaccagugaaccaaagag

SEQ ID NO: 3599315 - RNA, 12 nt, Human
aaauaccauuua

SEQ ID NO: 3599316 - RNA, 14 nt, Human
aaauaccucaggaa

SEQ ID NO: 3599317 - RNA, 15 nt, Human
aaauaccucauguuu

SEQ ID NO: 3599318 - RNA, 14 nt, Human
aaauacuacuccug

SEQ ID NO: 3599319 - RNA, 22 nt, Human
aaauacuauuuuuacugccacu

SEQ ID NO: 3599320 - RNA, 16 nt, Human
aaauacucauguguau

SEQ ID NO: 3599321 - RNA, 15 nt, Human
aaauacugcaaauca

SEQ ID NO: 3599322 - RNA, 18 nt, Human
aaauacugccagaugcug

SEQ ID NO: 3599323 - RNA, 20 nt, Human
aaauacugccagaugcugau

SEQ ID NO: 3599324 - RNA, 18 nt, Human
aaauacuguagauaauua

SEQ ID NO: 3599325 - RNA, 23 nt, Human
aaauacuguagauaauuaaccaa

SEQ ID NO: 3599326 - RNA, 22 nt, Human
aaauacuguuuuuaacaacuau

SEQ ID NO: 3599327 - RNA, 19 nt, Human
aaauacuuaaauguuaugu

SEQ ID NO: 3599328 - RNA, 17 nt, Human
aaauacuuauucauugu

SEQ ID NO: 3599329 - RNA, 20 nt, Human
aaauacuugucaauauuuaa

SEQ ID NO: 3599330 - RNA, 21 nt, Human
aaauacuugucaauauuuaaa

SEQ ID NO: 3599331 - RNA, 14 nt, Human
aaauacuugucugu

SEQ ID NO: 3599332 - RNA, 16 nt, Human
aaauacuuuaaaggaa

SEQ ID NO: 3599333 - RNA, 19 nt, Human
aaauacuuuuacucugccu

SEQ ID NO: 3599334 - RNA, 19 nt, Human
aaauacuuuuccuuaccuu

SEQ ID NO: 3599335 - RNA, 16 nt, Human
aaauacuuuuucuaau

SEQ ID NO: 3599336 - RNA, 18 nt, Human
aaauacuuuuucuaauga

SEQ ID NO: 3599337 - RNA, 16 nt, Human
aaauagaaaaguuauu

SEQ ID NO: 3599338 - RNA, 12 nt, Human
aaauagaaauaa

SEQ ID NO: 3599339 - RNA, 14 nt, Human
aaauagaaauuuug

SEQ ID NO: 3599340 - RNA, 16 nt, Human
aaauagaagagagagg

SEQ ID NO: 3599341 - RNA, 19 nt, Human
aaauagacaaaaaguauau

SEQ ID NO: 3599342 - RNA, 15 nt, Human
aaauagacaguauau

SEQ ID NO: 3599343 - RNA, 17 nt, Human
aaauagaguauaugcac

SEQ ID NO: 3599344 - RNA, 14 nt, Human
aaauagaguguagu

SEQ ID NO: 3599345 - RNA, 14 nt, Human
aaauagauacaaau

SEQ ID NO: 3599346 - RNA, 14 nt, Human
aaauagauauaaau

SEQ ID NO: 3599347 - RNA, 21 nt, Human
aaauagaugacauugacuauu

SEQ ID NO: 3599348 - RNA, 20 nt, Human
aaauagauggauuuguauca

SEQ ID NO: 3599349 - RNA, 16 nt, Human
aaauagaugucuuuua

SEQ ID NO: 3599350 - RNA, 17 nt, Human
aaauagcaaaagaagaa

SEQ ID NO: 3599351 - RNA, 16 nt, Human
aaauagcaauccuaaa

SEQ ID NO: 3599352 - RNA, 22 nt, Human
aaauagcagcccucaauuguga

SEQ ID NO: 3599353 - RNA, 16 nt, Human
aaauagcauguauugu

SEQ ID NO: 3599354 - RNA, 23 nt, Human
aaauagccaacacccaucuguuu

SEQ ID NO: 3599355 - RNA, 16 nt, Human
aaauagcuauauccau

SEQ ID NO: 3599356 - RNA, 15 nt, Human
aaauagcuuguauag

SEQ ID NO: 3599357 - RNA, 21 nt, Human
aaaguguuucagcuaagggaa

SEQ ID NO: 3599358 - RNA, 15 nt, Human
aaaguguuucuguua

SEQ ID NO: 3599359 - RNA, 14 nt, Human
aaaguguuuucucu

SEQ ID NO: 3599360 - RNA, 17 nt, Human
aaaguguuuucucugaa

SEQ ID NO: 3599361 - RNA, 16 nt, Human
aaaguuaacagauuuu

SEQ ID NO: 3599362 - RNA, 17 nt, Human
aaaguuacaaauugcuu

SEQ ID NO: 3599363 - RNA, 12 nt, Human
aaaguuacuagg

SEQ ID NO: 3599364 - RNA, 15 nt, Human
aaaguuagaaucuau

SEQ ID NO: 3599365 - RNA, 19 nt, Human
aaaguuagaaucuauuuuc

SEQ ID NO: 3599366 - RNA, 14 nt, Human
aaaguuagucuacu

SEQ ID NO: 3599367 - RNA, 13 nt, Human
aaaguuauauuuc

SEQ ID NO: 3599368 - RNA, 14 nt, Human
aaaguuauauuuca

SEQ ID NO: 3599369 - RNA, 16 nt, Human
aaaguuauuaaaauug

SEQ ID NO: 3599370 - RNA, 16 nt, Human
aaaguucagaguuuuc

SEQ ID NO: 3599371 - RNA, 18 nt, Human
aaaguuccaagagucuaa

SEQ ID NO: 3599372 - RNA, 20 nt, Human
aaaguuccaagagucuaaag

SEQ ID NO: 3599373 - RNA, 22 nt, Human
aaaguuccaagagucuaaagau

SEQ ID NO: 3599374 - RNA, 16 nt, Human
aaaguucuaagauucu

SEQ ID NO: 3599375 - RNA, 18 nt, Human
aaaguucuaauaauuucu

SEQ ID NO: 3599376 - RNA, 20 nt, Human
aaaguucuaauaauuucuaa

SEQ ID NO: 3599377 - RNA, 16 nt, Human
aaaguucuagugaccg

SEQ ID NO: 3599378 - RNA, 18 nt, Human
aaaguucuguguauuuaa

SEQ ID NO: 3599379 - RNA, 16 nt, Human
aaaguugaauuuuaca

SEQ ID NO: 3599380 - RNA, 16 nt, Human
aaaguugccuaaaucc

SEQ ID NO: 3599381 - RNA, 22 nt, Human
aaaguugcuauuugaacuuuuu

SEQ ID NO: 3599382 - RNA, 19 nt, Human
aaaguuggacuaaaugccu

SEQ ID NO: 3599383 - RNA, 12 nt, Human
aaaguuguacau

SEQ ID NO: 3599384 - RNA, 17 nt, Human
aaaguuguacaugaaau

SEQ ID NO: 3599385 - RNA, 15 nt, Human
aaaguuguacuuuaa

SEQ ID NO: 3599386 - RNA, 18 nt, Human
aaaguugugauuccagau

SEQ ID NO: 3599387 - RNA, 18 nt, Human
aaaguuguucaacuauuu

SEQ ID NO: 3599388 - RNA, 14 nt, Human
aaaguuuaaaaugu

SEQ ID NO: 3599389 - RNA, 15 nt, Human
aaaguuuaauaaauu

SEQ ID NO: 3599390 - RNA, 12 nt, Human
aaaguuuaauau

SEQ ID NO: 3599391 - RNA, 14 nt, Human
aaaguuuaauauua

SEQ ID NO: 3599392 - RNA, 19 nt, Human
aaauauacauguuuaugua

SEQ ID NO: 3599393 - RNA, 21 nt, Human
aaauauacauguuuauguaaa

SEQ ID NO: 3599394 - RNA, 14 nt, Human
aaauauacuguaaa

SEQ ID NO: 3599395 - RNA, 15 nt, Human
aaauauacuguaaag

SEQ ID NO: 3599396 - RNA, 16 nt, Human
aaauauacuguaaaga

SEQ ID NO: 3599397 - RNA, 14 nt, Human
aaauauacuuaaau

SEQ ID NO: 3599398 - RNA, 23 nt, Human
aaauauacuuuuacaaguaacaa

SEQ ID NO: 3599399 - RNA, 13 nt, Human
aaauauagauuag

SEQ ID NO: 3599400 - RNA, 16 nt, Human
aaauauagauuagaaa

SEQ ID NO: 3599401 - RNA, 10 nt, Human
aaauauagcg

SEQ ID NO: 3599402 - RNA, 12 nt, Human
aaauauauaaau

SEQ ID NO: 3599403 - RNA, 13 nt, Human
aaauauauauaaa

SEQ ID NO: 3599404 - RNA, 21 nt, Human
aaauauauauaaagaauauau

SEQ ID NO: 3599405 - RNA, 17 nt, Human
aaauauauauaaauaua

SEQ ID NO: 3599406 - RNA, 20 nt, Human
aaauauauauaaauauauau

SEQ ID NO: 3599407 - RNA, 14 nt, Human
aaauauauauacau

SEQ ID NO: 3599408 - RNA, 13 nt, Human
aaauauauauagu

SEQ ID NO: 3599409 - RNA, 22 nt, Human
aaauauauaucuaaauuuagaa

SEQ ID NO: 3599410 - RNA, 13 nt, Human
aaauauauauuau

SEQ ID NO: 3599411 - RNA, 15 nt, Human
aaauauaugaacauu

SEQ ID NO: 3599412 - RNA, 21 nt, Human
aaauauauggucuaauguuua

SEQ ID NO: 3599413 - RNA, 19 nt, Human
aaauauauguauguaaaaa

SEQ ID NO: 3599414 - RNA, 12 nt, Human
aaauauauuauu

SEQ ID NO: 3599415 - RNA, 17 nt, Human
aaauauauucucuuugg

SEQ ID NO: 3599416 - RNA, 20 nt, Human
aaauauauucuuucaaagga

SEQ ID NO: 3599417 - RNA, 21 nt, Human
aaauauauuuaagauaauuau

SEQ ID NO: 3599418 - RNA, 14 nt, Human
aaauauauuuaaug

SEQ ID NO: 3599419 - RNA, 16 nt, Human
aaauauauuuuaagac

SEQ ID NO: 3599420 - RNA, 12 nt, Human
aaauaucaaagu

SEQ ID NO: 3599421 - RNA, 14 nt, Human
aaauaucaaaguca

SEQ ID NO: 3599422 - RNA, 18 nt, Human
aaauaucaaucauuuucc

SEQ ID NO: 3599423 - RNA, 23 nt, Human
aaauaucaugcuccauuguucag

SEQ ID NO: 3599424 - RNA, 16 nt, Human
aaauaucauucagcaa

SEQ ID NO: 3599425 - RNA, 20 nt, Human
aaauaucccaaacugugaug

SEQ ID NO: 3599426 - RNA, 23 nt, Human
aaauaucccuccuguugggagag

SEQ ID NO: 3599427 - RNA, 23 nt, Human
aaauaucccuuggacauuuuaug

SEQ ID NO: 3599428 - RNA, 17 nt, Human
aaauaucucuauuuaau

SEQ ID NO: 3599429 - RNA, 15 nt, Human
aaauaucucugaguu

SEQ ID NO: 3599430 - RNA, 12 nt, Human
aaauaucugaaa

SEQ ID NO: 3599431 - RNA, 18 nt, Human
aaauaucugaaaauguau

SEQ ID NO: 3599432 - RNA, 19 nt, Human
aaauaucugaaaauguaug

SEQ ID NO: 3599433 - RNA, 19 nt, Human
aaauaucugaacauuuacu

SEQ ID NO: 3599434 - RNA, 14 nt, Human
aaauaucugcucaa

SEQ ID NO: 3599435 - RNA, 15 nt, Human
aaauaucuguauuua

SEQ ID NO: 3599436 - RNA, 22 nt, Human
aaauaucuguauuuaauuuuga

SEQ ID NO: 3599437 - RNA, 19 nt, Human
aaauaucuuuuauguuuga

SEQ ID NO: 3599438 - RNA, 16 nt, Human
aaauaucuuuugaccu

SEQ ID NO: 3599439 - RNA, 23 nt, Human
aaauaugagugguuauugaaaau

SEQ ID NO: 3599440 - RNA, 16 nt, Human
aaauaugcacuaaguc

SEQ ID NO: 3599441 - RNA, 22 nt, Human
aaauaugcagugauauggcaga

SEQ ID NO: 3599442 - RNA, 20 nt, Human
aaauaugccucuccuuugua

SEQ ID NO: 3599443 - RNA, 13 nt, Human
aaauauggaacuu

SEQ ID NO: 3599444 - RNA, 17 nt, Human
aaauauggaacuuacau

SEQ ID NO: 3599445 - RNA, 19 nt, Human
aaauauggaacuucuaaua

SEQ ID NO: 3599446 - RNA, 15 nt, Human
aaauauggacacuua

SEQ ID NO: 3599447 - RNA, 19 nt, Human
aaauauggucuuuugguua

SEQ ID NO: 3599448 - RNA, 12 nt, Human
aaauauguacaa

SEQ ID NO: 3599449 - RNA, 13 nt, Human
aaauauguaccaa

SEQ ID NO: 3599450 - RNA, 17 nt, Human
aaauauguauaacuuua

SEQ ID NO: 3599451 - RNA, 13 nt, Human
aaauauguauuaa

SEQ ID NO: 3599452 - RNA, 21 nt, Human
aaauauguauuuaccaaaaau

SEQ ID NO: 3599453 - RNA, 16 nt, Human
aaauauguccuggggu

SEQ ID NO: 3599454 - RNA, 21 nt, Human
aaauaugugagauuuuuuauu

SEQ ID NO: 3599455 - RNA, 20 nt, Human
aaauauguuagcaaagaguu

SEQ ID NO: 3599456 - RNA, 22 nt, Human
aaauauguucuuuaaaaauaua

SEQ ID NO: 3599457 - RNA, 14 nt, Human
aaauauguuucaca

SEQ ID NO: 3599458 - RNA, 19 nt, Human
aaauauguuuuuuagauca

SEQ ID NO: 3599459 - RNA, 14 nt, Human
aaauauuaaaaagu

SEQ ID NO: 3599460 - RNA, 17 nt, Human
aaauauuaaaaagucuu

SEQ ID NO: 3599461 - RNA, 12 nt, Human
aaauauuaagac

SEQ ID NO: 3599462 - RNA, 14 nt, Human
aaauauuaagcaug

SEQ ID NO: 3599463 - RNA, 17 nt, Human
aaauauuagaaacagcu

SEQ ID NO: 3599464 - RNA, 14 nt, Human
aaauauuagaugug

SEQ ID NO: 3599465 - RNA, 18 nt, Human
aaauauuagaugugauuu

SEQ ID NO: 3599466 - RNA, 20 nt, Human
aaauauuauaacuuaaaaaa

SEQ ID NO: 3599467 - RNA, 17 nt, Human
aaauauuaugagaugcu

SEQ ID NO: 3599468 - RNA, 12 nt, Human
aaauauuaugca

SEQ ID NO: 3599469 - RNA, 17 nt, Human
aaauauuaugcaaauuc

SEQ ID NO: 3599470 - RNA, 17 nt, Human
aaauauuauguuaaaac

SEQ ID NO: 3599471 - RNA, 16 nt, Human
aaauauuauuuguguu

SEQ ID NO: 3599472 - RNA, 17 nt, Human
aaauauucacuggcccc

SEQ ID NO: 3599473 - RNA, 17 nt, Human
aaauauucagaaucuuu

SEQ ID NO: 3599474 - RNA, 15 nt, Human
aaauauuccugcauu

SEQ ID NO: 3599475 - RNA, 18 nt, Human
aaauauucuauaugaauu

SEQ ID NO: 3599476 - RNA, 21 nt, Human
aaauauugagcagaauucauu

SEQ ID NO: 3599477 - RNA, 17 nt, Human
aaauauugaggcuuugu

SEQ ID NO: 3599478 - RNA, 19 nt, Human
aaauauugaggcuuugugu

SEQ ID NO: 3599479 - RNA, 13 nt, Human
aaauauugcuggg

SEQ ID NO: 3599480 - RNA, 15 nt, Human
aaauauugcuguaua

SEQ ID NO: 3599481 - RNA, 20 nt, Human
aaauauuguguugugaaugu

SEQ ID NO: 3599482 - RNA, 12 nt, Human
aaauauuguuaa

SEQ ID NO: 3599483 - RNA, 15 nt, Human
aaauauuguuucugc

SEQ ID NO: 3599484 - RNA, 22 nt, Human
aaauauuguuucugcauucauu

SEQ ID NO: 3599485 - RNA, 22 nt, Human
aaauauuguuuuacaauaguuc

SEQ ID NO: 3599486 - RNA, 12 nt, Human
aaauauuuaaga

SEQ ID NO: 3599487 - RNA, 19 nt, Human
aaauauuuacauaugaaau

SEQ ID NO: 3599488 - RNA, 12 nt, Human
aaauauuuaucu

SEQ ID NO: 3599489 - RNA, 13 nt, Human
aaauauuuaugaa

SEQ ID NO: 3599490 - RNA, 16 nt, Human
aaauauuuaugaagaa

SEQ ID NO: 3599491 - RNA, 16 nt, Human
aaauauuuauuaaaua

SEQ ID NO: 3599492 - RNA, 18 nt, Human
aaauauuuauuaaauaaa

SEQ ID NO: 3599493 - RNA, 18 nt, Human
aaauauuugacuugcaug

SEQ ID NO: 3599494 - RNA, 21 nt, Human
aaauauuuggucucuauuuca

SEQ ID NO: 3599495 - RNA, 22 nt, Human
aaauauuuguacauaguuauuu

SEQ ID NO: 3599496 - RNA, 19 nt, Human
aaauauuuuaaaaucagcu

SEQ ID NO: 3599497 - RNA, 14 nt, Human
aaauauuuuaaaga

SEQ ID NO: 3599498 - RNA, 15 nt, Human
aaauauuuuaaagaa

SEQ ID NO: 3599499 - RNA, 17 nt, Human
aaauauuuuaaagaauu

SEQ ID NO: 3599500 - RNA, 19 nt, Human
aaauauuuuaaagaauugu

SEQ ID NO: 3599501 - RNA, 21 nt, Human
aaauauuuuaauuuuuaaaug

SEQ ID NO: 3599502 - RNA, 22 nt, Human
aaauauuuuaauuuuuaaaugc

SEQ ID NO: 3599503 - RNA, 18 nt, Human
aaauauuuuaugauccag

SEQ ID NO: 3599504 - RNA, 19 nt, Human
aaauauuuuaugauccagc

SEQ ID NO: 3599505 - RNA, 20 nt, Human
aaauauuuucauacagcauu

SEQ ID NO: 3599506 - RNA, 11 nt, Human
aaauauuuucu

SEQ ID NO: 3599507 - RNA, 17 nt, Human
aaauauuuucuauuuua

SEQ ID NO: 3599508 - RNA, 15 nt, Human
aaauauuuucucugu

SEQ ID NO: 3599509 - RNA, 21 nt, Human
aaauauuuucucuguacuuuu

SEQ ID NO: 3599510 - RNA, 19 nt, Human
aaauauuuucuguguguuc

SEQ ID NO: 3599511 - RNA, 20 nt, Human
aaauauuuucuguguguucc

SEQ ID NO: 3599512 - RNA, 23 nt, Human
aaauauuuucuguguguuccugg

SEQ ID NO: 3599513 - RNA, 21 nt, Human
aaauauuuugaaucaauaaua

SEQ ID NO: 3599514 - RNA, 22 nt, Human
aaauauuuugaaucaauaauau

SEQ ID NO: 3599515 - RNA, 19 nt, Human
aaauauuuugauaauaaau

SEQ ID NO: 3599516 - RNA, 16 nt, Human
aaauauuuugucuaaa

SEQ ID NO: 3599517 - RNA, 15 nt, Human
aaauauuuuuauaga

SEQ ID NO: 3599518 - RNA, 22 nt, Human
aaauauuuuuggucauuguaau

SEQ ID NO: 3599519 - RNA, 20 nt, Human
aaagaggcaguugcccagcc

SEQ ID NO: 3599520 - RNA, 21 nt, Human
aaagaggccaaacaggcccuc

SEQ ID NO: 3599521 - RNA, 18 nt, Human
aaagaggcgucuguauau

SEQ ID NO: 3599522 - RNA, 19 nt, Human
aaagaggcguugcuuucac

SEQ ID NO: 3599523 - RNA, 12 nt, Human
aaagaggcugag

SEQ ID NO: 3599524 - RNA, 22 nt, Human
aaagaggcugccccucucacca

SEQ ID NO: 3599525 - RNA, 20 nt, Human
aaagaggugaccccagggca

SEQ ID NO: 3599526 - RNA, 22 nt, Human
aaagagugggcugcaucuggga

SEQ ID NO: 3599527 - RNA, 19 nt, Human
aaagaguguggcaaaauaa

SEQ ID NO: 3599528 - RNA, 16 nt, Human
aaagaguucuuaagga

SEQ ID NO: 3599529 - RNA, 18 nt, Human
aaagaguuugagaccuga

SEQ ID NO: 3599530 - RNA, 15 nt, Human
aaagauaaaauagug

SEQ ID NO: 3599531 - RNA, 21 nt, Human
aaagauaauauuuuacauaca

SEQ ID NO: 3599532 - RNA, 19 nt, Human
aaagauaaucucucagcuu

SEQ ID NO: 3599533 - RNA, 15 nt, Human
aaagauacauuugua

SEQ ID NO: 3599534 - RNA, 16 nt, Human
aaagauaccuuaaaau

SEQ ID NO: 3599535 - RNA, 22 nt, Human
aaagauaccuuaaaauuugaaa

SEQ ID NO: 3599536 - RNA, 20 nt, Human
aaagauauaagugcuguaua

SEQ ID NO: 3599537 - RNA, 14 nt, Human
aaauguuuuugguc

SEQ ID NO: 3599538 - RNA, 17 nt, Human
aaauuaaaaaaaaauug

SEQ ID NO: 3599539 - RNA, 22 nt, Human
aaauuaaaaaaaaauuguaucu

SEQ ID NO: 3599540 - RNA, 12 nt, Human
aaauuaaaaaag

SEQ ID NO: 3599541 - RNA, 15 nt, Human
aaauuaaaaaagaua

SEQ ID NO: 3599542 - RNA, 16 nt, Human
aaauuaaaaaagauaa

SEQ ID NO: 3599543 - RNA, 23 nt, Human
aaauuaaaaagauucuuuuucug

SEQ ID NO: 3599544 - RNA, 21 nt, Human
aaauuaaaaguuugaaaagca

SEQ ID NO: 3599545 - RNA, 19 nt, Human
aaauuaaaccggaccaucu

SEQ ID NO: 3599546 - RNA, 17 nt, Human
aaauuaaagcugaaaac

SEQ ID NO: 3599547 - RNA, 12 nt, Human
aaauuaaauaua

SEQ ID NO: 3599548 - RNA, 21 nt, Human
aaauuaacacugcuuguguuu

SEQ ID NO: 3599549 - RNA, 18 nt, Human
aaauuaacagaaaaacag

SEQ ID NO: 3599550 - RNA, 17 nt, Human
aaauuaacaguccuaac

SEQ ID NO: 3599551 - RNA, 14 nt, Human
aaauuaacuuuuau

SEQ ID NO: 3599552 - RNA, 15 nt, Human
aaauuaagaagaaac

SEQ ID NO: 3599553 - RNA, 16 nt, Human
aaauuaagaauguucu

SEQ ID NO: 3599554 - RNA, 12 nt, Human
aaauuaagacau

SEQ ID NO: 3599555 - RNA, 13 nt, Human
aaauuaagacuuu

SEQ ID NO: 3599556 - RNA, 17 nt, Human
aaauuaagauguucaga

SEQ ID NO: 3599557 - RNA, 17 nt, Human
aaauuaagcaaauguua

SEQ ID NO: 3599558 - RNA, 14 nt, Human
aaauuaaggcauaa

SEQ ID NO: 3599559 - RNA, 14 nt, Human
aaauuaauaucuuu

SEQ ID NO: 3599560 - RNA, 16 nt, Human
aaauuaauuggcagca

SEQ ID NO: 3599561 - RNA, 21 nt, Human
aaauuaauuggcagcagauuu

SEQ ID NO: 3599562 - RNA, 13 nt, Human
aaauuaauugugu

SEQ ID NO: 3599563 - RNA, 15 nt, Human
aaauuaauuguguga

SEQ ID NO: 3599564 - RNA, 13 nt, Human
aaauuacaacuaa

SEQ ID NO: 3599565 - RNA, 13 nt, Human
aaauuacaauuuu

SEQ ID NO: 3599566 - RNA, 13 nt, Human
aaauuacauuugu

SEQ ID NO: 3599567 - RNA, 15 nt, Human
aaauuacauuuguaa

SEQ ID NO: 3599568 - RNA, 16 nt, Human
aaauuaccaguaaagu

SEQ ID NO: 3599569 - RNA, 13 nt, Human
aaauugcuauguu

SEQ ID NO: 3599570 - RNA, 17 nt, Human
aaauugcuauguuacua

SEQ ID NO: 3599571 - RNA, 15 nt, Human
aaauugcucacaguu

SEQ ID NO: 3599572 - RNA, 22 nt, Human
aaauugcuccuaagcuucaaau

SEQ ID NO: 3599573 - RNA, 23 nt, Human
aaauugcugacuguagcuuugga

SEQ ID NO: 3599574 - RNA, 13 nt, Human
aaauugcuuuuga

SEQ ID NO: 3599575 - RNA, 12 nt, Human
aaauugcuuuuu

SEQ ID NO: 3599576 - RNA, 16 nt, Human
aaauuggaacagaaug

SEQ ID NO: 3599577 - RNA, 23 nt, Human
aaauuggacuuucaaaauuaaau

SEQ ID NO: 3599578 - RNA, 12 nt, Human
aaauuggagaaa

SEQ ID NO: 3599579 - RNA, 18 nt, Human
aaauuggcauuaaaacuu

SEQ ID NO: 3599580 - RNA, 16 nt, Human
aaauuggcuaguugaa

SEQ ID NO: 3599581 - RNA, 17 nt, Human
aaauuggggauucuuaa

SEQ ID NO: 3599582 - RNA, 18 nt, Human
aaauuggggauucuuaaa

SEQ ID NO: 3599583 - RNA, 19 nt, Human
aaauuggggauucuuaaag

SEQ ID NO: 3599584 - RNA, 23 nt, Human
aaauuggggauucuuaaaguuga

SEQ ID NO: 3599585 - RNA, 16 nt, Human
aaauuggguucaugau

SEQ ID NO: 3599586 - RNA, 20 nt, Human
aaauuguaagcaugcacaaa

SEQ ID NO: 3599587 - RNA, 12 nt, Human
aaauuguacaua

SEQ ID NO: 3599588 - RNA, 15 nt, Human
aaauuguacauauuu

SEQ ID NO: 3599589 - RNA, 15 nt, Human
aaauuguauauucac

SEQ ID NO: 3599590 - RNA, 15 nt, Human
aaauuguauauugua

SEQ ID NO: 3599591 - RNA, 22 nt, Human
aaauuguaucuagugcagcuga

SEQ ID NO: 3599592 - RNA, 18 nt, Human
aaauugucagaugcugug

SEQ ID NO: 3599593 - RNA, 21 nt, Human
aaauugucccuuaaacaaaaa

SEQ ID NO: 3599594 - RNA, 14 nt, Human
aaauugucuucaug

SEQ ID NO: 3599595 - RNA, 22 nt, Human
aaauugugcuucuccccagaau

SEQ ID NO: 3599596 - RNA, 11 nt, Human
aaauuguguua

SEQ ID NO: 3599597 - RNA, 23 nt, Human
aaauuguuugacggcaagguuua

SEQ ID NO: 3599598 - RNA, 22 nt, Human
aaauuguuuggcuuccuccuga

SEQ ID NO: 3599599 - RNA, 13 nt, Human
aaauuuaaaaaau

SEQ ID NO: 3599600 - RNA, 13 nt, Human
aaauuuaaaacaa

SEQ ID NO: 3599601 - RNA, 14 nt, Human
aaauuuaaaacaaa

SEQ ID NO: 3599602 - RNA, 16 nt, Human
aaauuuaaaacaaaca

SEQ ID NO: 3599603 - RNA, 22 nt, Human
aaauuuaaaaguaaaaugucuu

SEQ ID NO: 3599604 - RNA, 14 nt, Human
aaauuuaaacuaua

SEQ ID NO: 3599605 - RNA, 16 nt, Human
aaauuuaagugcgugu

SEQ ID NO: 3599606 - RNA, 20 nt, Human
aaauuuaauauagcuauuuu

SEQ ID NO: 3599607 - RNA, 17 nt, Human
aaauuuaaugcugccuu

SEQ ID NO: 3599608 - RNA, 17 nt, Human
aaauuuaauucauguuu

SEQ ID NO: 3599609 - RNA, 21 nt, Human
aaauuuacuacaauauguaca

SEQ ID NO: 3599610 - RNA, 13 nt, Human
aaauuuagcauug

SEQ ID NO: 3599611 - RNA, 16 nt, Human
aaauuuagcauuguag

SEQ ID NO: 3599612 - RNA, 12 nt, Human
aaauuuaguguu

SEQ ID NO: 3599613 - RNA, 15 nt, Human
aaauuuaguuuuugu

SEQ ID NO: 3599614 - RNA, 18 nt, Human
aaauuuaguuuuuguucu

SEQ ID NO: 3599615 - RNA, 17 nt, Human
aaauuuaucaaagcaua

SEQ ID NO: 3599616 - RNA, 12 nt, Human
aaauuuauguga

SEQ ID NO: 3599617 - RNA, 15 nt, Human
aaauuuaugugaugg

SEQ ID NO: 3599618 - RNA, 16 nt, Human
aaauuuauugaggaaa

SEQ ID NO: 3599619 - RNA, 19 nt, Human
aaauuuauugaggaaaaau

SEQ ID NO: 3599620 - RNA, 23 nt, Human
aaauuuauugaggaaaaauaugu

SEQ ID NO: 3599621 - RNA, 14 nt, Human
aaauuuauuuacug

SEQ ID NO: 3599622 - RNA, 21 nt, Human
aaauuuauuuacugcuagucu

SEQ ID NO: 3599623 - RNA, 22 nt, Human
aaauuuauuucaauauuagcaa

SEQ ID NO: 3599624 - RNA, 22 nt, Human
aaauuuauuuuauaagaaaaac

SEQ ID NO: 3599625 - RNA, 17 nt, Human
aaauuucacgauucauu

SEQ ID NO: 3599626 - RNA, 21 nt, Human
aaauuucacgauucauuuuug

SEQ ID NO: 3599627 - RNA, 18 nt, Human
aaauuucagcagcugcag

SEQ ID NO: 3599628 - RNA, 14 nt, Human
aaauuuccacucag

SEQ ID NO: 3599629 - RNA, 22 nt, Human
aaauuuccacucaggucuguuu

SEQ ID NO: 3599630 - RNA, 16 nt, Human
aaauuuccccaacagu

SEQ ID NO: 3599631 - RNA, 17 nt, Human
aaauuuccccaacagug

SEQ ID NO: 3599632 - RNA, 19 nt, Human
aaauuuccccaacagugug

SEQ ID NO: 3599633 - RNA, 20 nt, Human
aaauuuccccaacaguguga

SEQ ID NO: 3599634 - RNA, 20 nt, Human
aaauuucgcuucuuagaaca

SEQ ID NO: 3599635 - RNA, 12 nt, Human
aaauuucuaaau

SEQ ID NO: 3599636 - RNA, 15 nt, Human
aaauuucuaaaucuc

SEQ ID NO: 3599637 - RNA, 19 nt, Human
aaauuucuaaaucuccaaa

SEQ ID NO: 3599638 - RNA, 16 nt, Human
aaauuucuaagagagc

SEQ ID NO: 3599639 - RNA, 12 nt, Human
aaauuucucugu

SEQ ID NO: 3599640 - RNA, 18 nt, Human
aaauuucuguaaaacagg

SEQ ID NO: 3599641 - RNA, 15 nt, Human
aaauuugaaacauug

SEQ ID NO: 3599642 - RNA, 10 nt, Human
aaauuugaau

SEQ ID NO: 3599643 - RNA, 15 nt, Human
aaauuugauacuuau

SEQ ID NO: 3599644 - RNA, 14 nt, Human
aaauuugauugauu

SEQ ID NO: 3599645 - RNA, 15 nt, Human
aaauuugauugauuu

SEQ ID NO: 3599646 - RNA, 22 nt, Human
aaauuugauuuacauauauuau

SEQ ID NO: 3599647 - RNA, 17 nt, Human
aaauuugcauuaaauua

SEQ ID NO: 3599648 - RNA, 12 nt, Human
aaauuugccaag

SEQ ID NO: 3599649 - RNA, 17 nt, Human
aaauuuggaauucuguu

SEQ ID NO: 3599650 - RNA, 20 nt, Human
aaauuuggggacagauucag

SEQ ID NO: 3599651 - RNA, 15 nt, Human
aaauuuguaaguuuc

SEQ ID NO: 3599652 - RNA, 16 nt, Human
aaauuuguaaguuuca

SEQ ID NO: 3599653 - RNA, 19 nt, Human
aaauuuguaaguuucaggu

SEQ ID NO: 3599654 - RNA, 12 nt, Human
aaauuuguacua

SEQ ID NO: 3599655 - RNA, 20 nt, Human
aaauuuguacuauuuaacug

SEQ ID NO: 3599656 - RNA, 19 nt, Human
aaauuugucugaaacauuu

SEQ ID NO: 3599657 - RNA, 15 nt, Human
aaauuuguguaauau

SEQ ID NO: 3599658 - RNA, 18 nt, Human
aaauuuguucuuguauuu

SEQ ID NO: 3599659 - RNA, 14 nt, Human
aaauuuguuugaaa

SEQ ID NO: 3599660 - RNA, 22 nt, Human
aaauuuuaaagccauucugauu

SEQ ID NO: 3599661 - RNA, 14 nt, Human
aaauuuuagaaaua

SEQ ID NO: 3599662 - RNA, 15 nt, Human
aaauuuuagaaauau

SEQ ID NO: 3599663 - RNA, 21 nt, Human
aaauuuuauaaaauuaagcaa

SEQ ID NO: 3599664 - RNA, 12 nt, Human
aaauuuuauaug

SEQ ID NO: 3599665 - RNA, 23 nt, Human
aaauuuuaucugccucucuugua

SEQ ID NO: 3599666 - RNA, 11 nt, Human
aaauuuuaugu

SEQ ID NO: 3599667 - RNA, 18 nt, Human
aaauuuucacauaaaaua

SEQ ID NO: 3599668 - RNA, 16 nt, Human
aaauuuugcaaauaua

SEQ ID NO: 3599669 - RNA, 23 nt, Human
aaauuuugccuaauacauuaaag

SEQ ID NO: 3599670 - RNA, 18 nt, Human
aaauuuuggccaaagugu

SEQ ID NO: 3599671 - RNA, 14 nt, Human
aaauuuuguaagaa

SEQ ID NO: 3599672 - RNA, 12 nt, Human
aaauuuuguaau

SEQ ID NO: 3599673 - RNA, 17 nt, Human
aaauuuuguaauuuucu

SEQ ID NO: 3599674 - RNA, 15 nt, Human
aaauuuuuauuuuuc

SEQ ID NO: 3599675 - RNA, 21 nt, Human
aaauuuuucaaccccacccug

SEQ ID NO: 3599676 - RNA, 17 nt, Human
aaauuuuucagaugcuu

SEQ ID NO: 3599677 - RNA, 15 nt, Human
aaauuuuucauauuu

SEQ ID NO: 3599678 - RNA, 17 nt, Human
aaauuuuuccuuagcau

SEQ ID NO: 3599679 - RNA, 21 nt, Human
aaauuuuucucaguuuguaua

SEQ ID NO: 3599680 - RNA, 17 nt, Human
aaauuuuucuucuugag

SEQ ID NO: 3599681 - RNA, 13 nt, Human
aaauuuuuggauu

SEQ ID NO: 3599682 - RNA, 17 nt, Human
aaauuuuuguaguagcg

SEQ ID NO: 3599683 - RNA, 16 nt, Human
aacaauuuucagauuu

SEQ ID NO: 3599684 - RNA, 22 nt, Human
aacaauuuucagauuugcacaa

SEQ ID NO: 3599685 - RNA, 18 nt, Human
aacacaaagcuuuugcau

SEQ ID NO: 3599686 - RNA, 19 nt, Human
aacacaaagcuuuugcaua

SEQ ID NO: 3599687 - RNA, 17 nt, Human
aacacaacuauauuguu

SEQ ID NO: 3599688 - RNA, 21 nt, Human
aacacaagauugguguuuuuu

SEQ ID NO: 3599689 - RNA, 15 nt, Human
aacacaagcuggaag

SEQ ID NO: 3599690 - RNA, 17 nt, Human
aacacaaggucauggcc

SEQ ID NO: 3599691 - RNA, 13 nt, Human
aacacaauguuau

SEQ ID NO: 3599692 - RNA, 15 nt, Human
aacacacacauauac

SEQ ID NO: 3599693 - RNA, 20 nt, Human
aacacacagauacacacaca

SEQ ID NO: 3599694 - RNA, 15 nt, Human
aacacaccaggcugu

SEQ ID NO: 3599695 - RNA, 16 nt, Human
aacacaccaggcugug

SEQ ID NO: 3599696 - RNA, 23 nt, Human
aacacaccaggcugugggccuca

SEQ ID NO: 3599697 - RNA, 12 nt, Human
aacacacugaaa

SEQ ID NO: 3599698 - RNA, 20 nt, Human
aacacacugaggcagggaag

SEQ ID NO: 3599699 - RNA, 16 nt, Human
aacacacuguguccug

SEQ ID NO: 3599700 - RNA, 21 nt, Human
aacacacuguguccuggugcu

SEQ ID NO: 3599701 - RNA, 20 nt, Human
aacacagacauucugccagg

SEQ ID NO: 3599702 - RNA, 22 nt, Human
aacacagaggaauuuauaccuc

SEQ ID NO: 3599703 - RNA, 15 nt, Human
aacacagcaagggug

SEQ ID NO: 3599704 - RNA, 20 nt, Human
aacacagcaagggugauggg

SEQ ID NO: 3599705 - RNA, 17 nt, Human
aacacagcuguucuucu

SEQ ID NO: 3599706 - RNA, 18 nt, Human
aacacagcuguucuucug

SEQ ID NO: 3599707 - RNA, 13 nt, Human
aacacaggcagcu

SEQ ID NO: 3599708 - RNA, 17 nt, Human
aacacaggcagcuuucu

SEQ ID NO: 3599709 - RNA, 13 nt, Human
aacacaguauuuu

SEQ ID NO: 3599710 - RNA, 19 nt, Human
aacacagucaaaauaauuc

SEQ ID NO: 3599711 - RNA, 22 nt, Human
aacacaguguuuuuguaaagug

SEQ ID NO: 3599712 - RNA, 18 nt, Human
aacacauagauucaccug

SEQ ID NO: 3599713 - RNA, 12 nt, Human
aacacaucagcu

SEQ ID NO: 3599714 - RNA, 22 nt, Human
aacacaucagcuagcaaaagaa

SEQ ID NO: 3599715 - RNA, 16 nt, Human
aacacaucagcuugcc

SEQ ID NO: 3599716 - RNA, 21 nt, Human
aacacauuaagccuuccacac

SEQ ID NO: 3599717 - RNA, 21 nt, Human
aacacauuaucgggagcagug

SEQ ID NO: 3599718 - RNA, 17 nt, Human
aacacauuguuauuuuc

SEQ ID NO: 3599719 - RNA, 14 nt, Human
aacacauuucaaau

SEQ ID NO: 3599720 - RNA, 16 nt, Human
aacacauuucaaauga

SEQ ID NO: 3599721 - RNA, 12 nt, Human
aacacauuucuu

SEQ ID NO: 3599722 - RNA, 15 nt, Human
aacacauuucuuuuu

SEQ ID NO: 3599723 - RNA, 18 nt, Human
aacacauuugauucugug

SEQ ID NO: 3599724 - RNA, 21 nt, Human
aacacauuugcuuuuugugau

SEQ ID NO: 3599725 - RNA, 21 nt, Human
aacacauuuuguauaauugua

SEQ ID NO: 3599726 - RNA, 22 nt, Human
aacacauuuuguauaauuguau

SEQ ID NO: 3599727 - RNA, 20 nt, Human
aacacauuuuuuugcaugca

SEQ ID NO: 3599728 - RNA, 22 nt, Human
aacaccaaaaaaauccagaaac

SEQ ID NO: 3599729 - RNA, 15 nt, Human
aacaccaaaaaauau

SEQ ID NO: 3599730 - RNA, 17 nt, Human
aacaccaagcacagcag

SEQ ID NO: 3599731 - RNA, 14 nt, Human
aacaccacagaaau

SEQ ID NO: 3599732 - RNA, 16 nt, Human
aacaccacagacacac

SEQ ID NO: 3599733 - RNA, 18 nt, Human
aacaccacagacacacac

SEQ ID NO: 3599734 - RNA, 23 nt, Human
aacaccacagacacacacacgca

SEQ ID NO: 3599735 - RNA, 17 nt, Human
aaauaacuaguguugcu

SEQ ID NO: 3599736 - RNA, 19 nt, Human
aaauaacuggaaaacagaa

SEQ ID NO: 3599737 - RNA, 21 nt, Human
aaauaacuggaaaacagaaca

SEQ ID NO: 3599738 - RNA, 20 nt, Human
aaauaacuggaacaaauuau

SEQ ID NO: 3599739 - RNA, 16 nt, Human
aaauaacuguaauuau

SEQ ID NO: 3599740 - RNA, 22 nt, Human
aaauaacuguaauuauuugaau

SEQ ID NO: 3599741 - RNA, 14 nt, Human
aaauaacuucaguc

SEQ ID NO: 3599742 - RNA, 15 nt, Human
aaauaagaaaaauca

SEQ ID NO: 3599743 - RNA, 12 nt, Human
aaauaagaaaag

SEQ ID NO: 3599744 - RNA, 21 nt, Human
aaauaagaaacuuuuuuauuu

SEQ ID NO: 3599745 - RNA, 17 nt, Human
aaauaagaauagaaaua

SEQ ID NO: 3599746 - RNA, 23 nt, Human
aaauaagacggauuuauuuuucc

SEQ ID NO: 3599747 - RNA, 14 nt, Human
aaauaagagauuug

SEQ ID NO: 3599748 - RNA, 17 nt, Human
aaauaagagcucaggau

SEQ ID NO: 3599749 - RNA, 12 nt, Human
aaauaagauucu

SEQ ID NO: 3599750 - RNA, 13 nt, Human
aaauaagauucua

SEQ ID NO: 3599751 - RNA, 13 nt, Human
aaauaagcaggug

SEQ ID NO: 3599752 - RNA, 20 nt, Human
aaauaagcccccucaacuac

SEQ ID NO: 3599753 - RNA, 17 nt, Human
aaauaagcuauuugaug

SEQ ID NO: 3599754 - RNA, 14 nt, Human
aaauaagucaacag

SEQ ID NO: 3599755 - RNA, 16 nt, Human
aaauaagucugauuua

SEQ ID NO: 3599756 - RNA, 19 nt, Human
aaauaaguguauuuugaaa

SEQ ID NO: 3599757 - RNA, 13 nt, Human
aaauaaguuuuug

SEQ ID NO: 3599758 - RNA, 14 nt, Human
aaauaauaaaagau

SEQ ID NO: 3599759 - RNA, 12 nt, Human
aaauaauaaauc

SEQ ID NO: 3599760 - RNA, 13 nt, Human
aaauaauacauua

SEQ ID NO: 3599761 - RNA, 19 nt, Human
aaauaauaccuuagaaggu

SEQ ID NO: 3599762 - RNA, 18 nt, Human
aaauaauaucucuaauau

SEQ ID NO: 3599763 - RNA, 15 nt, Human
aaauaaucggcccac

SEQ ID NO: 3599764 - RNA, 23 nt, Human
aaauaaucuauuucuaugagaaa

SEQ ID NO: 3599765 - RNA, 13 nt, Human
aaauaaugcuguu

SEQ ID NO: 3599766 - RNA, 21 nt, Human
aaauaauguguaguucaugua

SEQ ID NO: 3599767 - RNA, 21 nt, Human
aaauaauuauauaacuguauu

SEQ ID NO: 3599768 - RNA, 22 nt, Human
aaauaauuauauaacuguauuu

SEQ ID NO: 3599769 - RNA, 20 nt, Human
aaauaauuauuuauuacaua

SEQ ID NO: 3599770 - RNA, 14 nt, Human
aaauaauucuaaag

SEQ ID NO: 3599771 - RNA, 14 nt, Human
aaauaauuuuaaac

SEQ ID NO: 3599772 - RNA, 15 nt, Human
aaauaauuuuaugaa

SEQ ID NO: 3599773 - RNA, 12 nt, Human
aaauaauuuugu

SEQ ID NO: 3599774 - RNA, 21 nt, Human
aaauaauuuuuauauuugaaa

SEQ ID NO: 3599775 - RNA, 13 nt, Human
aaauacaaaguua

SEQ ID NO: 3599776 - RNA, 13 nt, Human
aaauacaagacug

SEQ ID NO: 3599777 - RNA, 12 nt, Human
aaauacaauaaa

SEQ ID NO: 3599778 - RNA, 22 nt, Human
aaauacaauaaacuauuggaaa

SEQ ID NO: 3599779 - RNA, 13 nt, Human
aaauacaauuuuu

SEQ ID NO: 3599780 - RNA, 21 nt, Human
aaauacaauuuuuauuucuuu

SEQ ID NO: 3599781 - RNA, 18 nt, Human
aaauacacauagcaugua

SEQ ID NO: 3599782 - RNA, 14 nt, Human
aaauacacauuugc

SEQ ID NO: 3599783 - RNA, 23 nt, Human
aaauacaccaccucacuccuguu

SEQ ID NO: 3599784 - RNA, 15 nt, Human
aaauacagacuggau

SEQ ID NO: 3599785 - RNA, 15 nt, Human
aaauacaguacuguu

SEQ ID NO: 3599786 - RNA, 23 nt, Human
aaauacagucuuccauuugcaag

SEQ ID NO: 3599787 - RNA, 20 nt, Human
aaauacaguuugucacauga

SEQ ID NO: 3599788 - RNA, 16 nt, Human
aaauacauauuuccaa

SEQ ID NO: 3599789 - RNA, 20 nt, Human
aaauacaugaagcuucaugc

SEQ ID NO: 3599790 - RNA, 18 nt, Human
aaauacauuguauauaug

SEQ ID NO: 3599791 - RNA, 21 nt, Human
aaauaccaaaauuauuucaga

SEQ ID NO: 3599792 - RNA, 16 nt, Human
aaauaccaggauuuuu

SEQ ID NO: 3599793 - RNA, 21 nt, Human
aaauaccaugccauuuaaagc

SEQ ID NO: 3599794 - RNA, 19 nt, Human
aaauaccccaucauucaug

SEQ ID NO: 3599795 - RNA, 21 nt, Human
aaauacccuucuuuuaugagc

SEQ ID NO: 3599796 - RNA, 17 nt, Human
aaauaccucaggaaaga

SEQ ID NO: 3599797 - RNA, 14 nt, Human
aaauaccucauguu

SEQ ID NO: 3599798 - RNA, 15 nt, Human
aaauacggugggggu

SEQ ID NO: 3599799 - RNA, 23 nt, Human
aaauacuaaugaaaacagaaugu

SEQ ID NO: 3599800 - RNA, 20 nt, Human
aaauacuauuuaaagccucc

SEQ ID NO: 3599801 - RNA, 16 nt, Human
aaauacuauuuaagau

SEQ ID NO: 3599802 - RNA, 21 nt, Human
aaauacuauuuuuacugccac

SEQ ID NO: 3599803 - RNA, 14 nt, Human
aaauacucaugugu

SEQ ID NO: 3599804 - RNA, 17 nt, Human
aaauacucauguguaug

SEQ ID NO: 3599805 - RNA, 15 nt, Human
aaauacucuaauucu

SEQ ID NO: 3599806 - RNA, 17 nt, Human
aaauacucuaauucuaa

SEQ ID NO: 3599807 - RNA, 13 nt, Human
aaauacugccaga

SEQ ID NO: 3599808 - RNA, 14 nt, Human
aaauacuguacaau

SEQ ID NO: 3599809 - RNA, 14 nt, Human
aaauacuguagaua

SEQ ID NO: 3599810 - RNA, 15 nt, Human
aaauacuguagauaa

SEQ ID NO: 3599811 - RNA, 20 nt, Human
aaauacuguagauaauuaac

SEQ ID NO: 3599812 - RNA, 14 nt, Human
aaauacugugugga

SEQ ID NO: 3599813 - RNA, 13 nt, Human
aaauacuguuggu

SEQ ID NO: 3599814 - RNA, 14 nt, Human
aaauacuguuggug

SEQ ID NO: 3599815 - RNA, 13 nt, Human
aaauacuuaaaug

SEQ ID NO: 3599816 - RNA, 16 nt, Human
aaauacuuaaauguua

SEQ ID NO: 3599817 - RNA, 18 nt, Human
aaauacuuaaauguuaug

SEQ ID NO: 3599818 - RNA, 19 nt, Human
aaauacuuaacuacuguuu

SEQ ID NO: 3599819 - RNA, 16 nt, Human
aaauacuuagcaaaaa

SEQ ID NO: 3599820 - RNA, 14 nt, Human
aaauacuuauucau

SEQ ID NO: 3599821 - RNA, 11 nt, Human
aaauacuuguc

SEQ ID NO: 3599822 - RNA, 15 nt, Human
aaauacuuuaaagga

SEQ ID NO: 3599823 - RNA, 17 nt, Human
aaauacuuuaaaggaaa

SEQ ID NO: 3599824 - RNA, 14 nt, Human
aaauacuuuuccuu

SEQ ID NO: 3599825 - RNA, 15 nt, Human
aaauacuuuuccuua

SEQ ID NO: 3599826 - RNA, 14 nt, Human
aaauagaaaaguua

SEQ ID NO: 3599827 - RNA, 15 nt, Human
aaauagaaaaguuau

SEQ ID NO: 3599828 - RNA, 16 nt, Human
aaauagaaaguugcaa

SEQ ID NO: 3599829 - RNA, 21 nt, Human
aaaugcaugauuuuguaaccc

SEQ ID NO: 3599830 - RNA, 13 nt, Human
aaaugcauggagg

SEQ ID NO: 3599831 - RNA, 13 nt, Human
aaaugcauguugc

SEQ ID NO: 3599832 - RNA, 22 nt, Human
aaaugccaaauuaaaaaagaua

SEQ ID NO: 3599833 - RNA, 14 nt, Human
aaaugccaaucucu

SEQ ID NO: 3599834 - RNA, 17 nt, Human
aaaugccauaauacaaa

SEQ ID NO: 3599835 - RNA, 19 nt, Human
aaaugccauaauacaaaag

SEQ ID NO: 3599836 - RNA, 18 nt, Human
aaaugccauagaaaugua

SEQ ID NO: 3599837 - RNA, 19 nt, Human
aaaugccauuuauuuauug

SEQ ID NO: 3599838 - RNA, 20 nt, Human
aaaugccauuuauuuauuga

SEQ ID NO: 3599839 - RNA, 15 nt, Human
aaaugccuaguuuuu

SEQ ID NO: 3599840 - RNA, 16 nt, Human
aaaugccuaguuuuua

SEQ ID NO: 3599841 - RNA, 19 nt, Human
aaaugccuaguuuuuagua

SEQ ID NO: 3599842 - RNA, 22 nt, Human
aaaugccucaguguauuuguau

SEQ ID NO: 3599843 - RNA, 23 nt, Human
aaaugccucaguguauuuguauu

SEQ ID NO: 3599844 - RNA, 23 nt, Human
aaaugccuuacccucauguucuu

SEQ ID NO: 3599845 - RNA, 19 nt, Human
aaaugccuuacuuuguaug

SEQ ID NO: 3599846 - RNA, 22 nt, Human
aaaugccuuagaaauguaaacu

SEQ ID NO: 3599847 - RNA, 13 nt, Human
aaaugccuuugag

SEQ ID NO: 3599848 - RNA, 19 nt, Human
aaaugccuuugagacaguu

SEQ ID NO: 3599849 - RNA, 20 nt, Human
aaaugccuuugagacaguuu

SEQ ID NO: 3599850 - RNA, 16 nt, Human
aaaugcgggguggggg

SEQ ID NO: 3599851 - RNA, 16 nt, Human
aaaugcuagguucuac

SEQ ID NO: 3599852 - RNA, 18 nt, Human
aaaugcucaaagaaaucu

SEQ ID NO: 3599853 - RNA, 12 nt, Human
aaaugcugaaca

SEQ ID NO: 3599854 - RNA, 10 nt, Human
aaaugcugcu

SEQ ID NO: 3599855 - RNA, 22 nt, Human
aaaugcugguuuuucaguuuuc

SEQ ID NO: 3599856 - RNA, 23 nt, Human
aaaugcugucuuucuugcucccu

SEQ ID NO: 3599857 - RNA, 21 nt, Human
aaaugcuuuaaaaacuauuua

SEQ ID NO: 3599858 - RNA, 18 nt, Human
aaaugcuuuaugcaaacc

SEQ ID NO: 3599859 - RNA, 21 nt, Human
aaauggaaagcagaguuuuca

SEQ ID NO: 3599860 - RNA, 20 nt, Human
aaauggaaaguaacucauuu

SEQ ID NO: 3599861 - RNA, 12 nt, Human
aaauggaaauuu

SEQ ID NO: 3599862 - RNA, 15 nt, Human
aaauggaagacacau

SEQ ID NO: 3599863 - RNA, 18 nt, Human
aaauggaagacacauuga

SEQ ID NO: 3599864 - RNA, 18 nt, Human
aaauggaagacagcucuu

SEQ ID NO: 3599865 - RNA, 19 nt, Human
aaauggacauaggacucaa

SEQ ID NO: 3599866 - RNA, 15 nt, Human
aaauggacguguuau

SEQ ID NO: 3599867 - RNA, 18 nt, Human
aaauggagaagcugcagg

SEQ ID NO: 3599868 - RNA, 22 nt, Human
aaauggaggaucucuaaagagc

SEQ ID NO: 3599869 - RNA, 22 nt, Human
aaauggaguuggaguucauuca

SEQ ID NO: 3599870 - RNA, 16 nt, Human
aaauggauacauaaag

SEQ ID NO: 3599871 - RNA, 23 nt, Human
aaauggaugccuugaauaauaag

SEQ ID NO: 3599872 - RNA, 17 nt, Human
aaauggcaaguuuugau

SEQ ID NO: 3599873 - RNA, 13 nt, Human
aaauggccauuug

SEQ ID NO: 3599874 - RNA, 19 nt, Human
aaauggccauuugcuuuuu

SEQ ID NO: 3599875 - RNA, 22 nt, Human
aaauggccucauguggcuggaa

SEQ ID NO: 3599876 - RNA, 18 nt, Human
aaauggcuuccuggcaau

SEQ ID NO: 3599877 - RNA, 16 nt, Human
aaaugggacuucuuuu

SEQ ID NO: 3599878 - RNA, 20 nt, Human
aaaugggacuucuuuucaca

SEQ ID NO: 3599879 - RNA, 21 nt, Human
aaaugggacuucuuuucacau

SEQ ID NO: 3599880 - RNA, 20 nt, Human
aaaugggcagagcagagacc

SEQ ID NO: 3599881 - RNA, 20 nt, Human
aaaugggcgccccccccucc

SEQ ID NO: 3599882 - RNA, 16 nt, Human
aaauggggccagaucc

SEQ ID NO: 3599883 - RNA, 17 nt, Human
aaaugggggugcauuug

SEQ ID NO: 3599884 - RNA, 19 nt, Human
aaauggguagagaaacacu

SEQ ID NO: 3599885 - RNA, 18 nt, Human
aaaugguaaaauugcaug

SEQ ID NO: 3599886 - RNA, 18 nt, Human
aaaugguacuguacagcu

SEQ ID NO: 3599887 - RNA, 22 nt, Human
aaaugguagcauuuuaaacaaa

SEQ ID NO: 3599888 - RNA, 19 nt, Human
aaaugguaggcauuuccua

SEQ ID NO: 3599889 - RNA, 17 nt, Human
aaaugguaucaaaauua

SEQ ID NO: 3599890 - RNA, 21 nt, Human
aaaugguaucaaaauuacaua

SEQ ID NO: 3599891 - RNA, 17 nt, Human
aaauggucgcccaggag

SEQ ID NO: 3599892 - RNA, 22 nt, Human
aaaugguggcuucagcuccagc

SEQ ID NO: 3599893 - RNA, 14 nt, Human
aaaugguguacaua

SEQ ID NO: 3599894 - RNA, 16 nt, Human
aaaugguguacauaau

SEQ ID NO: 3599895 - RNA, 19 nt, Human
aaaugguguuuucauguaa

SEQ ID NO: 3599896 - RNA, 19 nt, Human
aaaugguuaaaagagguuu

SEQ ID NO: 3599897 - RNA, 14 nt, Human
aaaugguucagaau

SEQ ID NO: 3599898 - RNA, 15 nt, Human
aaaugguucagaauu

SEQ ID NO: 3599899 - RNA, 16 nt, Human
aaaugguuguauuaga

SEQ ID NO: 3599900 - RNA, 19 nt, Human
aaaugguuguauuagaugu

SEQ ID NO: 3599901 - RNA, 23 nt, Human
aaaugguuuauuuuguauugugg

SEQ ID NO: 3599902 - RNA, 11 nt, Human
aaauguaaacu

SEQ ID NO: 3599903 - RNA, 16 nt, Human
aaauguaaacugccau

SEQ ID NO: 3599904 - RNA, 22 nt, Human
aaauguaaagauauuuuuaucu

SEQ ID NO: 3599905 - RNA, 15 nt, Human
aaauguaaauauucu

SEQ ID NO: 3599906 - RNA, 16 nt, Human
aaauguaacagucuga

SEQ ID NO: 3599907 - RNA, 13 nt, Human
aaauguaacuguc

SEQ ID NO: 3599908 - RNA, 18 nt, Human
aaauguaacugugccagu

SEQ ID NO: 3599909 - RNA, 18 nt, Human
aaauguaacuguuaccau

SEQ ID NO: 3599910 - RNA, 17 nt, Human
aaauguaacuuuuguaa

SEQ ID NO: 3599911 - RNA, 13 nt, Human
aaauguaaggcug

SEQ ID NO: 3599912 - RNA, 17 nt, Human
aaauguaaggcugugua

SEQ ID NO: 3599913 - RNA, 18 nt, Human
aaauguaaggcuguguaa

SEQ ID NO: 3599914 - RNA, 20 nt, Human
aaauguaaggcuguguaaga

SEQ ID NO: 3599915 - RNA, 18 nt, Human
aaauguaaugcgauuuua

SEQ ID NO: 3599916 - RNA, 12 nt, Human
aaauguacaaaa

SEQ ID NO: 3599917 - RNA, 12 nt, Human
aaauguacaugu

SEQ ID NO: 3599918 - RNA, 13 nt, Human
aaauguacaugua

SEQ ID NO: 3599919 - RNA, 23 nt, Human
aaauguacauguauuaaauuaca

SEQ ID NO: 3599920 - RNA, 17 nt, Human
aaauguagcuucaguca

SEQ ID NO: 3599921 - RNA, 20 nt, Human
aaauguaggcuuaguuugug

SEQ ID NO: 3599922 - RNA, 13 nt, Human
aaauguagguccu

SEQ ID NO: 3599923 - RNA, 17 nt, Human
aaauguagguccucaga

SEQ ID NO: 3599924 - RNA, 22 nt, Human
aaauguaguauggccuguguca

SEQ ID NO: 3599925 - RNA, 13 nt, Human
aaauguaguucau

SEQ ID NO: 3599926 - RNA, 20 nt, Human
aaauguaguucugcuccaga

SEQ ID NO: 3599927 - RNA, 19 nt, Human
aaauguaguugauguaucc

SEQ ID NO: 3599928 - RNA, 16 nt, Human
aaauguauaaauauac

SEQ ID NO: 3599929 - RNA, 21 nt, Human
aaauguauaaauauacaguau

SEQ ID NO: 3599930 - RNA, 11 nt, Human
aaauguauacu

SEQ ID NO: 3599931 - RNA, 14 nt, Human
aaauguauauacac

SEQ ID NO: 3599932 - RNA, 16 nt, Human
aaauguauauacacau

SEQ ID NO: 3599933 - RNA, 14 nt, Human
aaauguauaugcac

SEQ ID NO: 3599934 - RNA, 15 nt, Human
aaauguauaugcacu

SEQ ID NO: 3599935 - RNA, 17 nt, Human
aaauguaucauagaaau

SEQ ID NO: 3599936 - RNA, 20 nt, Human
aaauguaucauagaaaugua

SEQ ID NO: 3599937 - RNA, 14 nt, Human
aaauguaucuucca

SEQ ID NO: 3599938 - RNA, 18 nt, Human
aaauguaugauuacauca

SEQ ID NO: 3599939 - RNA, 19 nt, Human
aaauguaugcauguugucu

SEQ ID NO: 3599940 - RNA, 14 nt, Human
aaauguauuauguc

SEQ ID NO: 3599941 - RNA, 23 nt, Human
aaauguauuauguccugugagau

SEQ ID NO: 3599942 - RNA, 21 nt, Human
aaccaaaaugacaucuuuuua

SEQ ID NO: 3599943 - RNA, 13 nt, Human
aaccaaacaauua

SEQ ID NO: 3599944 - RNA, 16 nt, Human
aaccaaaggacauuau

SEQ ID NO: 3599945 - RNA, 10 nt, Human
aaccaaaggu

SEQ ID NO: 3599946 - RNA, 14 nt, Human
aaccaaaggugaag

SEQ ID NO: 3599947 - RNA, 16 nt, Human
aaccaaaggugaagga

SEQ ID NO: 3599948 - RNA, 12 nt, Human
aaccaaaugcau

SEQ ID NO: 3599949 - RNA, 14 nt, Human
aaccaagaagggcu

SEQ ID NO: 3599950 - RNA, 15 nt, Human
aaccaagagauugcu

SEQ ID NO: 3599951 - RNA, 18 nt, Human
aaccaagagauugcuaau

SEQ ID NO: 3599952 - RNA, 19 nt, Human
aaccaagcaggagacgaca

SEQ ID NO: 3599953 - RNA, 18 nt, Human
aaccaagccguggcuucc

SEQ ID NO: 3599954 - RNA, 15 nt, Human
aaccaagcucucugc

SEQ ID NO: 3599955 - RNA, 17 nt, Human
aaccaagcucucugcau

SEQ ID NO: 3599956 - RNA, 18 nt, Human
aaccaagcugaguuuccu

SEQ ID NO: 3599957 - RNA, 19 nt, Human
aaccaagcugaguuuccua

SEQ ID NO: 3599958 - RNA, 21 nt, Human
aaccaaggaaauauauuuuac

SEQ ID NO: 3599959 - RNA, 20 nt, Human
aaccaagguagaaugaccuu

SEQ ID NO: 3599960 - RNA, 22 nt, Human
aaccaagguagaaugaccuugu

SEQ ID NO: 3599961 - RNA, 23 nt, Human
aaccaagguagaaugaccuugua

SEQ ID NO: 3599962 - RNA, 20 nt, Human
aaccaagugaucaaacuaca

SEQ ID NO: 3599963 - RNA, 15 nt, Human
aaccaauauuuguag

SEQ ID NO: 3599964 - RNA, 22 nt, Human
aaccaauguuuaaaaaaguuua

SEQ ID NO: 3599965 - RNA, 21 nt, Human
aaccaauuuuuuguucuucag

SEQ ID NO: 3599966 - RNA, 23 nt, Human
aaccacaccacaucuaagccuga

SEQ ID NO: 3599967 - RNA, 17 nt, Human
aaccacacccacacuca

SEQ ID NO: 3599968 - RNA, 12 nt, Human
aaccacagcagu

SEQ ID NO: 3599969 - RNA, 13 nt, Human
aaccacagcccug

SEQ ID NO: 3599970 - RNA, 14 nt, Human
aaccacagcccugu

SEQ ID NO: 3599971 - RNA, 13 nt, Human
aaccacaucuugc

SEQ ID NO: 3599972 - RNA, 20 nt, Human
aaccacaucuugcucugcug

SEQ ID NO: 3599973 - RNA, 19 nt, Human
aaaugucuaauguauuuua

SEQ ID NO: 3599974 - RNA, 19 nt, Human
aaaugucuaguuguaacac

SEQ ID NO: 3599975 - RNA, 16 nt, Human
aaaugucucacugagc

SEQ ID NO: 3599976 - RNA, 21 nt, Human
aaaugucucuuuaaugucaca

SEQ ID NO: 3599977 - RNA, 16 nt, Human
aaaugucuguggccuu

SEQ ID NO: 3599978 - RNA, 23 nt, Human
aaaugucuguggccuuguucucu

SEQ ID NO: 3599979 - RNA, 16 nt, Human
aaaugucuuauauagc

SEQ ID NO: 3599980 - RNA, 23 nt, Human
aaaugucuugcuguugacauauu

SEQ ID NO: 3599981 - RNA, 18 nt, Human
aaaugucuuuaaugcaau

SEQ ID NO: 3599982 - RNA, 13 nt, Human
aaaugucuuugua

SEQ ID NO: 3599983 - RNA, 20 nt, Human
aaaugucuuuuuuuuaaugu

SEQ ID NO: 3599984 - RNA, 21 nt, Human
aaaugugaauaaaauuauuuu

SEQ ID NO: 3599985 - RNA, 13 nt, Human
aaaugugaugaau

SEQ ID NO: 3599986 - RNA, 20 nt, Human
aaaugugauguucuaaggcu

SEQ ID NO: 3599987 - RNA, 16 nt, Human
aaaugugauuuuucug

SEQ ID NO: 3599988 - RNA, 22 nt, Human
aaaugugcauucuuuuaaaaga

SEQ ID NO: 3599989 - RNA, 23 nt, Human
aaaugugcauucuuuuaaaagac

SEQ ID NO: 3599990 - RNA, 23 nt, Human
aaauguguacaauguacacacug

SEQ ID NO: 3599991 - RNA, 20 nt, Human
aaauguguaucggaugcuuu

SEQ ID NO: 3599992 - RNA, 18 nt, Human
aaauguguguauucuuaa

SEQ ID NO: 3599993 - RNA, 12 nt, Human
aaaugugugugu

SEQ ID NO: 3599994 - RNA, 19 nt, Human
aaauguguuggacaaaugu

SEQ ID NO: 3599995 - RNA, 21 nt, Human
aaauguguuggacaaauguga

SEQ ID NO: 3599996 - RNA, 13 nt, Human
aaauguguuucug

SEQ ID NO: 3599997 - RNA, 14 nt, Human
aaauguguuucugu

SEQ ID NO: 3599998 - RNA, 15 nt, Human
aaauguguuuugguc

SEQ ID NO: 3599999 - RNA, 16 nt, Human
aaauguguuuuggucc

SEQ ID NO: 3600000 - RNA, 16 nt, Human
aaauguuaaaaguuuu

SEQ ID NO: 3600001 - RNA, 14 nt, Human
aaauguuaaaaugu

SEQ ID NO: 3600002 - RNA, 16 nt, Human
aaauguuaaaauguau

SEQ ID NO: 3600003 - RNA, 12 nt, Human
aaauguuaaaga

SEQ ID NO: 3600004 - RNA, 15 nt, Human
aaauguuaaagaugu

SEQ ID NO: 3600005 - RNA, 23 nt, Human
aaauguuaacaaugccuauugua

SEQ ID NO: 3600006 - RNA, 20 nt, Human
aaauguuaaguugaugguga

SEQ ID NO: 3600007 - RNA, 18 nt, Human
aaauguuagucauuguua

SEQ ID NO: 3600008 - RNA, 22 nt, Human
aaauguuaugacuauguaaacu

SEQ ID NO: 3600009 - RNA, 17 nt, Human
aaauguuauuucugcaa

SEQ ID NO: 3600010 - RNA, 20 nt, Human
aaauguucaucaaugaauga

SEQ ID NO: 3600011 - RNA, 13 nt, Human
aaauguucuugca

SEQ ID NO: 3600012 - RNA, 22 nt, Human
aaauguugacaugggacauuug

SEQ ID NO: 3600013 - RNA, 18 nt, Human
aaauguuggauuuauaaa

SEQ ID NO: 3600014 - RNA, 21 nt, Human
aaauguuggauuuauaaaugc

SEQ ID NO: 3600015 - RNA, 17 nt, Human
aaauguuggucauuuua

SEQ ID NO: 3600016 - RNA, 22 nt, Human
aaauguuguucucuucuuuaaa

SEQ ID NO: 3600017 - RNA, 17 nt, Human
aaauguuuaaucauaua

SEQ ID NO: 3600018 - RNA, 18 nt, Human
aaauguuuaaucauauaa

SEQ ID NO: 3600019 - RNA, 20 nt, Human
aaauguuuacagggagccuc

SEQ ID NO: 3600020 - RNA, 21 nt, Human
aaauguuuacagggagccucc

SEQ ID NO: 3600021 - RNA, 14 nt, Human
aaauguuuauuuaa

SEQ ID NO: 3600022 - RNA, 12 nt, Human
aaauguuucuaa

SEQ ID NO: 3600023 - RNA, 13 nt, Human
aaauguuucugca

SEQ ID NO: 3600024 - RNA, 23 nt, Human
aaauguuucugcaguagucucug

SEQ ID NO: 3600025 - RNA, 15 nt, Human
aaauguuucuuuuaa

SEQ ID NO: 3600026 - RNA, 18 nt, Human
aaauguuucuuuuaaaga

SEQ ID NO: 3600027 - RNA, 10 nt, Human
aaauguuugg

SEQ ID NO: 3600028 - RNA, 19 nt, Human
aaauguuuggcauguaaau

SEQ ID NO: 3600029 - RNA, 22 nt, Human
aaauguuuggcauguaaaugua

SEQ ID NO: 3600030 - RNA, 21 nt, Human
aaauguuugucucaguuggaa

SEQ ID NO: 3600031 - RNA, 20 nt, Human
aaauguuuguuaaaaauaaa

SEQ ID NO: 3600032 - RNA, 14 nt, Human
aaauguuuucagcu

SEQ ID NO: 3600033 - RNA, 15 nt, Human
aaauguuuucagcua

SEQ ID NO: 3600034 - RNA, 14 nt, Human
aaauguuuuguaaa

SEQ ID NO: 3600035 - RNA, 19 nt, Human
aaauguuuuguaaacuuug

SEQ ID NO: 3600036 - RNA, 21 nt, Human
aaauguuuuguaaacuuugaa

SEQ ID NO: 3600037 - RNA, 22 nt, Human
aaauguuuuguaaacuuugaaa

SEQ ID NO: 3600038 - RNA, 22 nt, Human
aaauguuuuuaauaaaagaaaa

SEQ ID NO: 3600039 - RNA, 18 nt, Human
aaauguuuuuuuuuaaag

SEQ ID NO: 3600040 - RNA, 18 nt, Human
aaauuaaaaagauucuuu

SEQ ID NO: 3600041 - RNA, 14 nt, Human
aaauuaaaauggau

SEQ ID NO: 3600042 - RNA, 12 nt, Human
aaauuaaacaau

SEQ ID NO: 3600043 - RNA, 15 nt, Human
aaauuaaacaauuua

SEQ ID NO: 3600044 - RNA, 16 nt, Human
aaauuaaacacaaagu

SEQ ID NO: 3600045 - RNA, 13 nt, Human
aaauuaaagcauu

SEQ ID NO: 3600046 - RNA, 13 nt, Human
aaauuaaagcuga

SEQ ID NO: 3600047 - RNA, 14 nt, Human
aaauuaaagcugaa

SEQ ID NO: 3600048 - RNA, 13 nt, Human
aaauuaaaucugu

SEQ ID NO: 3600049 - RNA, 23 nt, Human
aaauuaaaucugucccugagagu

SEQ ID NO: 3600050 - RNA, 12 nt, Human
aaauuaacacug

SEQ ID NO: 3600051 - RNA, 20 nt, Human
aaauuaaccauagauguaga

SEQ ID NO: 3600052 - RNA, 12 nt, Human
aaauuaacuuuu

SEQ ID NO: 3600053 - RNA, 19 nt, Human
aaauuaacuuuuauaaacu

SEQ ID NO: 3600054 - RNA, 21 nt, Human
aaauuaacuuuuauaaacuuu

SEQ ID NO: 3600055 - RNA, 22 nt, Human
aaauuaacuuuuauaaacuuua

SEQ ID NO: 3600056 - RNA, 14 nt, Human
aaauuaagaaagga

SEQ ID NO: 3600057 - RNA, 13 nt, Human
aaauuaagaagaa

SEQ ID NO: 3600058 - RNA, 16 nt, Human
aaauuaagaagaaacu

SEQ ID NO: 3600059 - RNA, 14 nt, Human
aaauuaagaaggca

SEQ ID NO: 3600060 - RNA, 13 nt, Human
aaauuaagaaugu

SEQ ID NO: 3600061 - RNA, 13 nt, Human
aaauuaagcaaau

SEQ ID NO: 3600062 - RNA, 23 nt, Human
aaauuaaggcaacugaacaaaaa

SEQ ID NO: 3600063 - RNA, 17 nt, Human
aaauuaaggguuaagaa

SEQ ID NO: 3600064 - RNA, 19 nt, Human
aaauuaagguguuugaaaa

SEQ ID NO: 3600065 - RNA, 18 nt, Human
aaauuaauuggcagcaga

SEQ ID NO: 3600066 - RNA, 18 nt, Human
aaauuaauugugugaacu

SEQ ID NO: 3600067 - RNA, 14 nt, Human
aaauuaauuuuacu

SEQ ID NO: 3600068 - RNA, 15 nt, Human
aaauuacaauuuuau

SEQ ID NO: 3600069 - RNA, 23 nt, Human
aaauuacauuacugaaaacuuca

SEQ ID NO: 3600070 - RNA, 18 nt, Human
aaauuaccaguaaagugu

SEQ ID NO: 3600071 - RNA, 20 nt, Human
aaauuaccaguaaaguguaa

SEQ ID NO: 3600072 - RNA, 18 nt, Human
aaauuaccuguggauauu

SEQ ID NO: 3600073 - RNA, 20 nt, Human
aaauuacguacuaaggauac

SEQ ID NO: 3600074 - RNA, 22 nt, Human
aaauuacuaauuuuacacauua

SEQ ID NO: 3600075 - RNA, 15 nt, Human
aaauuacucuuucuc

SEQ ID NO: 3600076 - RNA, 21 nt, Human
aaauuacuuaucauccacauu

SEQ ID NO: 3600077 - RNA, 19 nt, Human
aaauuagaaaaaaauuacu

SEQ ID NO: 3600078 - RNA, 19 nt, Human
aaauuagaaaauauucucu

SEQ ID NO: 3600079 - RNA, 14 nt, Human
aaauuagaugaacu

SEQ ID NO: 3600080 - RNA, 16 nt, Human
aaauuagaugcauguu

SEQ ID NO: 3600081 - RNA, 18 nt, Human
aaauuagccaguaauccu

SEQ ID NO: 3600082 - RNA, 22 nt, Human
aaauuagccaguaauccuguag

SEQ ID NO: 3600083 - RNA, 14 nt, Human
aaauuaggaauaaa

SEQ ID NO: 3600084 - RNA, 19 nt, Human
aaauuaggauuucaugauu

SEQ ID NO: 3600085 - RNA, 21 nt, Human
aaauuagggcucuaauuuccu

SEQ ID NO: 3600086 - RNA, 23 nt, Human
aaauuagggcucuaauuuccuua

SEQ ID NO: 3600087 - RNA, 14 nt, Human
aaauuagguugaaa

SEQ ID NO: 3600088 - RNA, 23 nt, Human
aaauuagguuuuguacaauugaa

SEQ ID NO: 3600089 - RNA, 21 nt, Human
aaauuaguuagccaauauuuu

SEQ ID NO: 3600090 - RNA, 16 nt, Human
aaauuauaacuuaaaa

SEQ ID NO: 3600091 - RNA, 22 nt, Human
aaauuauaacuuaaaauauuuu

SEQ ID NO: 3600092 - RNA, 20 nt, Human
aaauuauaaggacugcaugg

SEQ ID NO: 3600093 - RNA, 12 nt, Human
aaauuauaaugu

SEQ ID NO: 3600094 - RNA, 14 nt, Human
aaauuauaauguau

SEQ ID NO: 3600095 - RNA, 16 nt, Human
aaauuauauaaguauu

SEQ ID NO: 3600096 - RNA, 22 nt, Human
aaauuauauaaguauucuaaau

SEQ ID NO: 3600097 - RNA, 15 nt, Human
aaauuauaucaauuu

SEQ ID NO: 3600098 - RNA, 16 nt, Human
aaauuaucaagcuaau

SEQ ID NO: 3600099 - RNA, 16 nt, Human
aaauuaucaauaucua

SEQ ID NO: 3600100 - RNA, 13 nt, Human
aaauuaucuauuu

SEQ ID NO: 3600101 - RNA, 17 nt, Human
aaauuaucuugauacau

SEQ ID NO: 3600102 - RNA, 21 nt, Human
aaauuaugcuaagaauuuuuu

SEQ ID NO: 3600103 - RNA, 21 nt, Human
aaauuauggaaacagaugaaa

SEQ ID NO: 3600104 - RNA, 22 nt, Human
aaauuaugugacauuuuacauu

SEQ ID NO: 3600105 - RNA, 21 nt, Human
aaauuaugugaccauaaugua

SEQ ID NO: 3600106 - RNA, 14 nt, Human
aaauuauguuuaua

SEQ ID NO: 3600107 - RNA, 17 nt, Human
aacgaucagacagaucu

SEQ ID NO: 3600108 - RNA, 17 nt, Human
aacgaugaugcuuguaa

SEQ ID NO: 3600109 - RNA, 20 nt, Human
aacgauuuaauucucuugaa

SEQ ID NO: 3600110 - RNA, 11 nt, Human
aacgcagcccu

SEQ ID NO: 3600111 - RNA, 12 nt, Human
aacgcagcccug

SEQ ID NO: 3600112 - RNA, 20 nt, Human
aacgcaggcccccaggugcc

SEQ ID NO: 3600113 - RNA, 22 nt, Human
aacgcaucuaguuccccuguuu

SEQ ID NO: 3600114 - RNA, 23 nt, Human
aacgcauggaguguguauuguuc

SEQ ID NO: 3600115 - RNA, 13 nt, Human
aacgccugagccc

SEQ ID NO: 3600116 - RNA, 18 nt, Human
aacgccugagcccaggga

SEQ ID NO: 3600117 - RNA, 20 nt, Human
aacuuuacccaaaaacuaaa

SEQ ID NO: 3600118 - RNA, 15 nt, Human
aacuuuagaaauaaa

SEQ ID NO: 3600119 - RNA, 19 nt, Human
aacuuuauaaauccaguga

SEQ ID NO: 3600120 - RNA, 15 nt, Human
aacuuuauacauuag

SEQ ID NO: 3600121 - RNA, 22 nt, Human
aacuuuauacccagaaaguuau

SEQ ID NO: 3600122 - RNA, 14 nt, Human
aacuuuaucacuua

SEQ ID NO: 3600123 - RNA, 21 nt, Human
aacuuuaugcuaagugaaaua

SEQ ID NO: 3600124 - RNA, 13 nt, Human
aacuuuaugugua

SEQ ID NO: 3600125 - RNA, 17 nt, Human
aacuuuauguguaaaua

SEQ ID NO: 3600126 - RNA, 21 nt, Human
aacuuuauuaaauacaaaacu

SEQ ID NO: 3600127 - RNA, 22 nt, Human
aacuuucacuauaaugugaaau

SEQ ID NO: 3600128 - RNA, 14 nt, Human
aacuuucauuuuuu

SEQ ID NO: 3600129 - RNA, 23 nt, Human
aacuuucccagguucuguuuaug

SEQ ID NO: 3600130 - RNA, 14 nt, Human
aacuuuccucgccu

SEQ ID NO: 3600131 - RNA, 19 nt, Human
aacuuuccucuuccugccu

SEQ ID NO: 3600132 - RNA, 18 nt, Human
aacuuucucuucauacuu

SEQ ID NO: 3600133 - RNA, 23 nt, Human
aacuuucuguuggauuccaugcu

SEQ ID NO: 3600134 - RNA, 15 nt, Human
aacuuucuuauccua

SEQ ID NO: 3600135 - RNA, 12 nt, Human
aacuuugaauaa

SEQ ID NO: 3600136 - RNA, 17 nt, Human
aacuuugaauaaagaau

SEQ ID NO: 3600137 - RNA, 14 nt, Human
aacuuugaccucug

SEQ ID NO: 3600138 - RNA, 17 nt, Human
aacuuugaccucugcag

SEQ ID NO: 3600139 - RNA, 16 nt, Human
aacuuuggaacaagau

SEQ ID NO: 3600140 - RNA, 11 nt, Human
aacuuuuaugc

SEQ ID NO: 3600141 - RNA, 16 nt, Human
aacuuuucuaacagaa

SEQ ID NO: 3600142 - RNA, 18 nt, Human
aacuuuucuauuaaaagu

SEQ ID NO: 3600143 - RNA, 22 nt, Human
aacuuuuugguuugcagaugac

SEQ ID NO: 3600144 - RNA, 19 nt, Human
aacuuuuuuaaauaaacuu

SEQ ID NO: 3600145 - RNA, 13 nt, Human
aacuuuuuuucaa

SEQ ID NO: 3600146 - RNA, 14 nt, Human
aacuuuuuuucaau

SEQ ID NO: 3600147 - RNA, 22 nt, Human
aacuuuuuuucuguaccaguua

SEQ ID NO: 3600148 - RNA, 16 nt, Human
aacuuuuuuuucuuuu

SEQ ID NO: 3600149 - RNA, 17 nt, Human
aacuuuuuuuugagaau

SEQ ID NO: 3600150 - RNA, 18 nt, Human
aagaaaaaaaaaaaagcc

SEQ ID NO: 3600151 - RNA, 15 nt, Human
aagaaaaaaaaagaa

SEQ ID NO: 3600152 - RNA, 17 nt, Human
aagaaaaaaaagaaagc

SEQ ID NO: 3600153 - RNA, 16 nt, Human
aagaaaaaaaauaaca

SEQ ID NO: 3600154 - RNA, 18 nt, Human
aagaaaaaaaauaacaca

SEQ ID NO: 3600155 - RNA, 14 nt, Human
aagaaaaaaauaau

SEQ ID NO: 3600156 - RNA, 24 nt, Human
aagaaaaaaauaauuuuaugaacu

SEQ ID NO: 3600157 - RNA, 15 nt, Human
aagaaaaaaauacua

SEQ ID NO: 3600158 - RNA, 15 nt, Human
aagaaaaaaaucuuc

SEQ ID NO: 3600159 - RNA, 13 nt, Human
aagaaaaaaaugu

SEQ ID NO: 3600160 - RNA, 21 nt, Human
aagaaaaaaauguauuuuaug

SEQ ID NO: 3600161 - RNA, 17 nt, Human
aagaaaaaaauugaaau

SEQ ID NO: 3600162 - RNA, 21 nt, Human
aagaaaaaaauugaaauguaa

SEQ ID NO: 3600163 - RNA, 19 nt, Human
aagaaaaaauauuuucccu

SEQ ID NO: 3600164 - RNA, 14 nt, Human
aagaaaaauaaaga

SEQ ID NO: 3600165 - RNA, 15 nt, Human
aagaaaaauaaagaa

SEQ ID NO: 3600166 - RNA, 12 nt, Human
aagaaaaauauu

SEQ ID NO: 3600167 - RNA, 12 nt, Human
aagaaaaaucag

SEQ ID NO: 3600168 - RNA, 13 nt, Human
aagaaaaaucaug

SEQ ID NO: 3600169 - RNA, 17 nt, Human
aagaaaaaucauguuug

SEQ ID NO: 3600170 - RNA, 18 nt, Human
aagaaaaaugagccuggc

SEQ ID NO: 3600171 - RNA, 13 nt, Human
aagaaaaccaaac

SEQ ID NO: 3600172 - RNA, 14 nt, Human
aagaaaacccaccc

SEQ ID NO: 3600173 - RNA, 20 nt, Human
aagaaaagaaucccuguuca

SEQ ID NO: 3600174 - RNA, 18 nt, Human
aagaaaagacuuguaaua

SEQ ID NO: 3600175 - RNA, 16 nt, Human
aagaaaagagcuuucu

SEQ ID NO: 3600176 - RNA, 11 nt, Human
aagaaaagaua

SEQ ID NO: 3600177 - RNA, 23 nt, Human
aagaaaagaugcacuuugcuuua

SEQ ID NO: 3600178 - RNA, 17 nt, Human
aagaaaaguauuuugaa

SEQ ID NO: 3600179 - RNA, 16 nt, Human
aagaaaagugguuguu

SEQ ID NO: 3600180 - RNA, 18 nt, Human
aagaaaaguuuauaaaag

SEQ ID NO: 3600181 - RNA, 21 nt, Human
aagaaaaguuuuguaaauuuc

SEQ ID NO: 3600182 - RNA, 22 nt, Human
aagaaaauaaaaaaaagaaaaa

SEQ ID NO: 3600183 - RNA, 23 nt, Human
aagaaaauaaaaaaaagaaaaaa

SEQ ID NO: 3600184 - RNA, 22 nt, Human
aagaaaauaaaauuaagaaugu

SEQ ID NO: 3600185 - RNA, 13 nt, Human
aagaaaauacuua

SEQ ID NO: 3600186 - RNA, 20 nt, Human
aagaaaauacuuaaauguua

SEQ ID NO: 3600187 - RNA, 21 nt, Human
aagaaaauaguggugugauuu

SEQ ID NO: 3600188 - RNA, 23 nt, Human
aagaaaaucagauggagcaugaa

SEQ ID NO: 3600189 - RNA, 15 nt, Human
aagaaaaucauauug

SEQ ID NO: 3600190 - RNA, 22 nt, Human
aagaaaaucuauuuuguaacuu

SEQ ID NO: 3600191 - RNA, 15 nt, Human
aagaaaaucuuuaua

SEQ ID NO: 3600192 - RNA, 12 nt, Human
aagaaaaugguu

SEQ ID NO: 3600193 - RNA, 16 nt, Human
aagaaaauuacaaaaa

SEQ ID NO: 3600194 - RNA, 19 nt, Human
aagaaaauuuuuguaguag

SEQ ID NO: 3600195 - RNA, 13 nt, Human
aagaaacaaaccc

SEQ ID NO: 3600196 - RNA, 15 nt, Human
aagaaacaaagaugu

SEQ ID NO: 3600197 - RNA, 22 nt, Human
aagaaacacacugaggcaggga

SEQ ID NO: 3600198 - RNA, 16 nt, Human
aagaaacagauaccau

SEQ ID NO: 3600199 - RNA, 11 nt, Human
aagaaacauug

SEQ ID NO: 3600200 - RNA, 21 nt, Human
aagaaaccuacugcccaggca

SEQ ID NO: 3600201 - RNA, 21 nt, Human
aagaaacugacaugcccuccc

SEQ ID NO: 3600202 - RNA, 22 nt, Human
aagaaacugacaugcccucccu

SEQ ID NO: 3600203 - RNA, 23 nt, Human
aagaaacuuucuuucucacuaaa

SEQ ID NO: 3600204 - RNA, 12 nt, Human
aagaaacuuuug

SEQ ID NO: 3600205 - RNA, 13 nt, Human
aagaaacuuuugu

SEQ ID NO: 3600206 - RNA, 15 nt, Human
aagaaacuuuuguaa

SEQ ID NO: 3600207 - RNA, 13 nt, Human
aagaaagaaaauc

SEQ ID NO: 3600208 - RNA, 12 nt, Human
aagaaagaaaga

SEQ ID NO: 3600209 - RNA, 12 nt, Human
aagaaagaaaua

SEQ ID NO: 3600210 - RNA, 15 nt, Human
aagaaagaaggaagu

SEQ ID NO: 3600211 - RNA, 12 nt, Human
aagaaagaaugu

SEQ ID NO: 3600212 - RNA, 13 nt, Human
aagaaagagagaa

SEQ ID NO: 3600213 - RNA, 23 nt, Human
aagaaagaggugaccccagggca

SEQ ID NO: 3600214 - RNA, 14 nt, Human
aagaaagauguuug

SEQ ID NO: 3600215 - RNA, 12 nt, Human
aagaaagcaacu

SEQ ID NO: 3600216 - RNA, 16 nt, Human
aagaaagccagucuua

SEQ ID NO: 3600217 - RNA, 12 nt, Human
aagaaagccuga

SEQ ID NO: 3600218 - RNA, 22 nt, Human
aagaaagccugaguacuccaca

SEQ ID NO: 3600219 - RNA, 16 nt, Human
aagaaaggaaaccuuu

SEQ ID NO: 3600220 - RNA, 23 nt, Human
aagaaaggaagcauuguaaaaua

SEQ ID NO: 3600221 - RNA, 18 nt, Human
aagaaaggggcaggagcu

SEQ ID NO: 3600222 - RNA, 16 nt, Human
aagaaagucagccaua

SEQ ID NO: 3600223 - RNA, 17 nt, Human
aagaaagugggagguca

SEQ ID NO: 3600224 - RNA, 23 nt, Human
aagaaagugggaggucaggaaac

SEQ ID NO: 3600225 - RNA, 22 nt, Human
aagaaaguggucuuaagaaaug

SEQ ID NO: 3600226 - RNA, 18 nt, Human
aagaaaguguauuuggaa

SEQ ID NO: 3600227 - RNA, 16 nt, Human
aagaaaguucuacagu

SEQ ID NO: 3600228 - RNA, 23 nt, Human
aagaaauaaaaggaagccaaaga

SEQ ID NO: 3600229 - RNA, 13 nt, Human
aagaaauaauaau

SEQ ID NO: 3600230 - RNA, 15 nt, Human
aagaaauaauaauau

SEQ ID NO: 3600231 - RNA, 12 nt, Human
aagaaauaauuu

SEQ ID NO: 3600232 - RNA, 15 nt, Human
aagaaauaguucugu

SEQ ID NO: 3600233 - RNA, 19 nt, Human
aagaaauaucugugaaaua

SEQ ID NO: 3600234 - RNA, 20 nt, Human
aagaaauauguauucuguaa

SEQ ID NO: 3600235 - RNA, 12 nt, Human
aagaaaucaugu

SEQ ID NO: 3600236 - RNA, 21 nt, Human
aagaaaucauguuaugauaaa

SEQ ID NO: 3600237 - RNA, 20 nt, Human
aagaaaucuauagaaagugu

SEQ ID NO: 3600238 - RNA, 20 nt, Human
aagaaaugaaauuuuaccaa

SEQ ID NO: 3600239 - RNA, 14 nt, Human
aagaaaugaacauu

SEQ ID NO: 3600240 - RNA, 16 nt, Human
aagaaaugaacauucc

SEQ ID NO: 3600241 - RNA, 13 nt, Human
aagaaaugcacaa

SEQ ID NO: 3600242 - RNA, 13 nt, Human
aagaaauguaagg

SEQ ID NO: 3600243 - RNA, 14 nt, Human
aagaaauguaaggg

SEQ ID NO: 3600244 - RNA, 12 nt, Human
aagaaauguacc

SEQ ID NO: 3600245 - RNA, 14 nt, Human
aagaaauguauaaa

SEQ ID NO: 3600246 - RNA, 15 nt, Human
aagaaauuauaaaga

SEQ ID NO: 3600247 - RNA, 22 nt, Human
aagaaauuaugugccagauuua

SEQ ID NO: 3600248 - RNA, 15 nt, Human
aagaaauucccugga

SEQ ID NO: 3600249 - RNA, 19 nt, Human
aagaaauugaauacuuuga

SEQ ID NO: 3600250 - RNA, 22 nt, Human
aagaaauugaauacuuugaaug

SEQ ID NO: 3600251 - RNA, 17 nt, Human
aagaaauuuaaaagaca

SEQ ID NO: 3600252 - RNA, 15 nt, Human
aagaaauuuauuacu

SEQ ID NO: 3600253 - RNA, 13 nt, Human
aagaaauuugugg

SEQ ID NO: 3600254 - RNA, 21 nt, Human
aagaacaaaaaaaucugcaga

SEQ ID NO: 3600255 - RNA, 14 nt, Human
aagaacaacggcaa

SEQ ID NO: 3600256 - RNA, 15 nt, Human
aagaacaauauugac

SEQ ID NO: 3600257 - RNA, 15 nt, Human
aagaacacacacaua

SEQ ID NO: 3600258 - RNA, 21 nt, Human
aagaacacccuauauuuugca

SEQ ID NO: 3600259 - RNA, 20 nt, Human
aagaacacuuuuaauaaacu

SEQ ID NO: 3600260 - RNA, 12 nt, Human
aagaacaggccu

SEQ ID NO: 3600261 - RNA, 16 nt, Human
aagaacauagaacucu

SEQ ID NO: 3600262 - RNA, 14 nt, Human
aagaacaugcaguu

SEQ ID NO: 3600263 - RNA, 21 nt, Human
aagacaaaacauacauuuugu

SEQ ID NO: 3600264 - RNA, 13 nt, Human
aagacaaauauuc

SEQ ID NO: 3600265 - RNA, 17 nt, Human
aagacaaaucaaagcag

SEQ ID NO: 3600266 - RNA, 17 nt, Human
aagacaaccauauuuag

SEQ ID NO: 3600267 - RNA, 14 nt, Human
aagacaagaaaauc

SEQ ID NO: 3600268 - RNA, 22 nt, Human
aagacaagaacuccccuuuuuu

SEQ ID NO: 3600269 - RNA, 15 nt, Human
aagacaagacuucag

SEQ ID NO: 3600270 - RNA, 13 nt, Human
aagacaagcugca

SEQ ID NO: 3600271 - RNA, 15 nt, Human
aagacaauucuuuau

SEQ ID NO: 3600272 - RNA, 19 nt, Human
aagacaauucuuuauacaa

SEQ ID NO: 3600273 - RNA, 16 nt, Human
aagacaauuugauaca

SEQ ID NO: 3600274 - RNA, 13 nt, Human
aagacaccagagc

SEQ ID NO: 3600275 - RNA, 17 nt, Human
aagacacucaaauauga

SEQ ID NO: 3600276 - RNA, 14 nt, Human
aagacacugccugg

SEQ ID NO: 3600277 - RNA, 15 nt, Human
aagacagagcuggga

SEQ ID NO: 3600278 - RNA, 12 nt, Human
aagacagagucu

SEQ ID NO: 3600279 - RNA, 23 nt, Human
aagacagauacuccuccaagguu

SEQ ID NO: 3600280 - RNA, 17 nt, Human
aagacagaugccccaga

SEQ ID NO: 3600281 - RNA, 22 nt, Human
aagacagaugccccagagcugu

SEQ ID NO: 3600282 - RNA, 18 nt, Human
aagacaggagacaaaaga

SEQ ID NO: 3600283 - RNA, 21 nt, Human
aagacagggcugauaagcuaa

SEQ ID NO: 3600284 - RNA, 18 nt, Human
aagacaguguauguagaa

SEQ ID NO: 3600285 - RNA, 18 nt, Human
aagacauaacguuuuucc

SEQ ID NO: 3600286 - RNA, 16 nt, Human
aagacauaucucuaau

SEQ ID NO: 3600287 - RNA, 18 nt, Human
aagacaugaaugcacacu

SEQ ID NO: 3600288 - RNA, 21 nt, Human
aagacaugauuuccuugaaug

SEQ ID NO: 3600289 - RNA, 18 nt, Human
aagacauggagacuccug

SEQ ID NO: 3600290 - RNA, 19 nt, Human
aagacauggagacuccugc

SEQ ID NO: 3600291 - RNA, 19 nt, Human
aagacauggggaggaagga

SEQ ID NO: 3600292 - RNA, 16 nt, Human
aagacauguagguguu

SEQ ID NO: 3600293 - RNA, 15 nt, Human
aagacauuaaaucua

SEQ ID NO: 3600294 - RNA, 22 nt, Human
aagacauucuuauauuucauau

SEQ ID NO: 3600295 - RNA, 17 nt, Human
aagacauugucaauaaa

SEQ ID NO: 3600296 - RNA, 12 nt, Human
aagacauuucuu

SEQ ID NO: 3600297 - RNA, 22 nt, Human
aagacauuucuuuucuuuuuac

SEQ ID NO: 3600298 - RNA, 23 nt, Human
aagacauuucuuuucuuuuuaca

SEQ ID NO: 3600299 - RNA, 13 nt, Human
aagaccaaacuuc

SEQ ID NO: 3600300 - RNA, 17 nt, Human
aagaccacaaaaauuga

SEQ ID NO: 3600301 - RNA, 12 nt, Human
aagaccagacua

SEQ ID NO: 3600302 - RNA, 23 nt, Human
aagaccagagauaguggggagac

SEQ ID NO: 3600303 - RNA, 13 nt, Human
aagaccagccugg

SEQ ID NO: 3600304 - RNA, 12 nt, Human
aagaccagucca

SEQ ID NO: 3600305 - RNA, 16 nt, Human
aagaccccacccaagc

SEQ ID NO: 3600306 - RNA, 23 nt, Human
aagaccccuuaccacugcucuga

SEQ ID NO: 3600307 - RNA, 17 nt, Human
aagacccucucaaacua

SEQ ID NO: 3600308 - RNA, 21 nt, Human
aagacccucuugcccauccug

SEQ ID NO: 3600309 - RNA, 13 nt, Human
aagacccuucucg

SEQ ID NO: 3600310 - RNA, 18 nt, Human
aagacccuugugguccca

SEQ ID NO: 3600311 - RNA, 21 nt, Human
aagacccuuguggucccaccc

SEQ ID NO: 3600312 - RNA, 20 nt, Human
aagacccuuuuggguuucug

SEQ ID NO: 3600313 - RNA, 15 nt, Human
aagaccgccccccgc

SEQ ID NO: 3600314 - RNA, 22 nt, Human
aagaccuaaccagggccagaag

SEQ ID NO: 3600315 - RNA, 22 nt, Human
aagaccuacuguucuaaagcuc

SEQ ID NO: 3600316 - RNA, 23 nt, Human
aagaccuaggcucauggacgaga

SEQ ID NO: 3600317 - RNA, 17 nt, Human
aagaccucaccuagaaa

SEQ ID NO: 3600318 - RNA, 15 nt, Human
aagaccugagaaugu

SEQ ID NO: 3600319 - RNA, 21 nt, Human
aagaccuggcaaggacacaga

SEQ ID NO: 3600320 - RNA, 23 nt, Human
aagaccuggggcugcugugaagc

SEQ ID NO: 3600321 - RNA, 18 nt, Human
aagaccuuguguguaugu

SEQ ID NO: 3600322 - RNA, 13 nt, Human
aagaccuuucaaa

SEQ ID NO: 3600323 - RNA, 18 nt, Human
aagaccuuuuucugcacu

SEQ ID NO: 3600324 - RNA, 22 nt, Human
aagacgcacuuuggcuuauaau

SEQ ID NO: 3600325 - RNA, 13 nt, Human
aagacgcugugcu

SEQ ID NO: 3600326 - RNA, 22 nt, Human
aagacgcugugcugcccugccc

SEQ ID NO: 3600327 - RNA, 21 nt, Human
aagacggcacggucuucccuc

SEQ ID NO: 3600328 - RNA, 20 nt, Human
aagacgugaugccaggacca

SEQ ID NO: 3600329 - RNA, 20 nt, Human
aagaaguauuuuuagaauaa

SEQ ID NO: 3600330 - RNA, 22 nt, Human
aagaagugaaaaucuacacucc

SEQ ID NO: 3600331 - RNA, 19 nt, Human
aagaagugaccaaggagga

SEQ ID NO: 3600332 - RNA, 20 nt, Human
aagaagugaccaaggaggag

SEQ ID NO: 3600333 - RNA, 20 nt, Human
aagaagugaguguuucuaug

SEQ ID NO: 3600334 - RNA, 16 nt, Human
aagaaguguccgagaa

SEQ ID NO: 3600335 - RNA, 17 nt, Human
aagaaguucauguccaa

SEQ ID NO: 3600336 - RNA, 14 nt, Human
aagaaguucuuuga

SEQ ID NO: 3600337 - RNA, 12 nt, Human
aagaaguuuauu

SEQ ID NO: 3600338 - RNA, 18 nt, Human
aagaaguuucaucauuuu

SEQ ID NO: 3600339 - RNA, 23 nt, Human
aagaauaaaauguugaaaaguca

SEQ ID NO: 3600340 - RNA, 16 nt, Human
aagaauaauaaaauca

SEQ ID NO: 3600341 - RNA, 21 nt, Human
aagaauaauaugcugccaaau

SEQ ID NO: 3600342 - RNA, 18 nt, Human
aagaauacaaacauauuu

SEQ ID NO: 3600343 - RNA, 14 nt, Human
aagaauacagaaag

SEQ ID NO: 3600344 - RNA, 23 nt, Human
aagaauacaguuaggcaccagaa

SEQ ID NO: 3600345 - RNA, 12 nt, Human
aagaauacuucu

SEQ ID NO: 3600346 - RNA, 17 nt, Human
aagaauacuucucauuu

SEQ ID NO: 3600347 - RNA, 15 nt, Human
aagaauagcaucugu

SEQ ID NO: 3600348 - RNA, 21 nt, Human
aagaauagcaucuguacaaag

SEQ ID NO: 3600349 - RNA, 23 nt, Human
aagaauagcaucuguacaaaggg

SEQ ID NO: 3600350 - RNA, 23 nt, Human
aagaauagcauuguaaaagcauu

SEQ ID NO: 3600351 - RNA, 19 nt, Human
aagaauaggcauuaacaca

SEQ ID NO: 3600352 - RNA, 15 nt, Human
aagaauagggcccau

SEQ ID NO: 3600353 - RNA, 21 nt, Human
aagaauauccuuuaaaauuua

SEQ ID NO: 3600354 - RNA, 16 nt, Human
aagaauaucuggcaaa

SEQ ID NO: 3600355 - RNA, 20 nt, Human
aagaauaucuguaaugguac

SEQ ID NO: 3600356 - RNA, 21 nt, Human
aagaauauucagagaauauca

SEQ ID NO: 3600357 - RNA, 13 nt, Human
aagaauauucagg

SEQ ID NO: 3600358 - RNA, 17 nt, Human
aagaauauugcaaaaua

SEQ ID NO: 3600359 - RNA, 19 nt, Human
aagaauauugcaaaauaca

SEQ ID NO: 3600360 - RNA, 13 nt, Human
aagaauauuguau

SEQ ID NO: 3600361 - RNA, 21 nt, Human
aagaauauuguuccuaaguuc

SEQ ID NO: 3600362 - RNA, 11 nt, Human
aagaauauuug

SEQ ID NO: 3600363 - RNA, 21 nt, Human
aagaaucacaauaauuuucua

SEQ ID NO: 3600364 - RNA, 22 nt, Human
aagaaucauuauuuauuaaauu

SEQ ID NO: 3600365 - RNA, 19 nt, Human
aagaauccacauuucuaaa

SEQ ID NO: 3600366 - RNA, 21 nt, Human
aagaauccacauuucuaaaau

SEQ ID NO: 3600367 - RNA, 21 nt, Human
aagaauccuuuuguagaauga

SEQ ID NO: 3600368 - RNA, 13 nt, Human
aagaaucuacuua

SEQ ID NO: 3600369 - RNA, 17 nt, Human
aagaaucuaucugcuua

SEQ ID NO: 3600370 - RNA, 20 nt, Human
aagaaucuucuguuccacau

SEQ ID NO: 3600371 - RNA, 13 nt, Human
aagaaugaaagcu

SEQ ID NO: 3600372 - RNA, 17 nt, Human
aagaaugaaagcuguuc

SEQ ID NO: 3600373 - RNA, 22 nt, Human
aagaaugaagguuuuuguaaag

SEQ ID NO: 3600374 - RNA, 21 nt, Human
aagaaugagaaggagucagaa

SEQ ID NO: 3600375 - RNA, 21 nt, Human
aagaaugaguuucuuagacuu

SEQ ID NO: 3600376 - RNA, 24 nt, Human
aagaaugcaguacuaacauuuauu

SEQ ID NO: 3600377 - RNA, 20 nt, Human
aagaaugcaugcuuuccaua

SEQ ID NO: 3600378 - RNA, 13 nt, Human
aagaaugcauuga

SEQ ID NO: 3600379 - RNA, 9 nt, Human
aagaaugcu

SEQ ID NO: 3600380 - RNA, 13 nt, Human
aagaaugcugaaa

SEQ ID NO: 3600381 - RNA, 16 nt, Human
aagaaugcugaaacca

SEQ ID NO: 3600382 - RNA, 13 nt, Human
aagaaugcuuaau

SEQ ID NO: 3600383 - RNA, 13 nt, Human
aagaauggaaaag

SEQ ID NO: 3600384 - RNA, 15 nt, Human
aagaauggaaaagag

SEQ ID NO: 3600385 - RNA, 20 nt, Human
aagaauggcagaaaaguuua

SEQ ID NO: 3600386 - RNA, 17 nt, Human
aagaaugggcaguuaca

SEQ ID NO: 3600387 - RNA, 20 nt, Human
aagaaugggcaguuacaugc

SEQ ID NO: 3600388 - RNA, 22 nt, Human
aagaaugguccgugcuaaggac

SEQ ID NO: 3600389 - RNA, 19 nt, Human
aagaaugguggcuucuuuu

SEQ ID NO: 3600390 - RNA, 13 nt, Human
aagaauguaaagc

SEQ ID NO: 3600391 - RNA, 23 nt, Human
aagaaugucagaaaaacaauaag

SEQ ID NO: 3600392 - RNA, 14 nt, Human
aagaauguguuuca

SEQ ID NO: 3600393 - RNA, 12 nt, Human
aagaauguuaag

SEQ ID NO: 3600394 - RNA, 17 nt, Human
aagaauguuacugccuu

SEQ ID NO: 3600395 - RNA, 20 nt, Human
aagaauguuagaguaaugaa

SEQ ID NO: 3600396 - RNA, 17 nt, Human
aagaauguugguuuacu

SEQ ID NO: 3600397 - RNA, 16 nt, Human
aagaauuauuuugaug

SEQ ID NO: 3600398 - RNA, 17 nt, Human
aagaauucaaauuuuau

SEQ ID NO: 3600399 - RNA, 13 nt, Human
aagaauuccaaag

SEQ ID NO: 3600400 - RNA, 17 nt, Human
aagaauuccuacaauau

SEQ ID NO: 3600401 - RNA, 23 nt, Human
aagaauuccuacaauauauauuc

SEQ ID NO: 3600402 - RNA, 12 nt, Human
aagaauucuuau

SEQ ID NO: 3600403 - RNA, 19 nt, Human
aagaauugaaaaguuuuug

SEQ ID NO: 3600404 - RNA, 18 nt, Human
aagaauugaacccaggag

SEQ ID NO: 3600405 - RNA, 19 nt, Human
aagaauugaacccaggagg

SEQ ID NO: 3600406 - RNA, 17 nt, Human
aagaauugaguaauggu

SEQ ID NO: 3600407 - RNA, 21 nt, Human
aacccucucaggugaccaaaa

SEQ ID NO: 3600408 - RNA, 11 nt, Human
aacccugcccc

SEQ ID NO: 3600409 - RNA, 21 nt, Human
aacccugccgucaccaccacc

SEQ ID NO: 3600410 - RNA, 16 nt, Human
aacccugcguggggac

SEQ ID NO: 3600411 - RNA, 19 nt, Human
aacccugcguggggacagg

SEQ ID NO: 3600412 - RNA, 12 nt, Human
aacccuggagag

SEQ ID NO: 3600413 - RNA, 19 nt, Human
aacccugucaaacauuagu

SEQ ID NO: 3600414 - RNA, 14 nt, Human
aacccugugcuggu

SEQ ID NO: 3600415 - RNA, 23 nt, Human
aacccuuaccccuuagccucccu

SEQ ID NO: 3600416 - RNA, 23 nt, Human
aacccuuaggacagggucccugc

SEQ ID NO: 3600417 - RNA, 19 nt, Human
aacccuucaacguuucuuc

SEQ ID NO: 3600418 - RNA, 22 nt, Human
aacccuucaacguuucuucacu

SEQ ID NO: 3600419 - RNA, 13 nt, Human
aacccuucagugc

SEQ ID NO: 3600420 - RNA, 22 nt, Human
aacccuucaucuuccugugucc

SEQ ID NO: 3600421 - RNA, 20 nt, Human
aacccuuccugagcuuuaug

SEQ ID NO: 3600422 - RNA, 18 nt, Human
aacccuucuccucuugua

SEQ ID NO: 3600423 - RNA, 20 nt, Human
aacccuucuccucuuguaaa

SEQ ID NO: 3600424 - RNA, 21 nt, Human
aacccuucuccucuuguaaau

SEQ ID NO: 3600425 - RNA, 15 nt, Human
aacccuugaaaagac

SEQ ID NO: 3600426 - RNA, 16 nt, Human
aacccuugccaggucc

SEQ ID NO: 3600427 - RNA, 14 nt, Human
aacccuugggccag

SEQ ID NO: 3600428 - RNA, 15 nt, Human
aacccuugggccaga

SEQ ID NO: 3600429 - RNA, 13 nt, Human
aacccuugucagu

SEQ ID NO: 3600430 - RNA, 18 nt, Human
aacccuuuuaaaguugau

SEQ ID NO: 3600431 - RNA, 21 nt, Human
aacccuuuucauccuggcugg

SEQ ID NO: 3600432 - RNA, 22 nt, Human
aacccuuuuggcccccgagcug

SEQ ID NO: 3600433 - RNA, 21 nt, Human
aaccgaaaggccaaauucccu

SEQ ID NO: 3600434 - RNA, 21 nt, Human
aaccgaacugauguaaguaaa

SEQ ID NO: 3600435 - RNA, 21 nt, Human
aaccgagagaaugcugaccug

SEQ ID NO: 3600436 - RNA, 15 nt, Human
aaccgagcaaagauc

SEQ ID NO: 3600437 - RNA, 22 nt, Human
aaccgagcaaagaucaaaauaa

SEQ ID NO: 3600438 - RNA, 20 nt, Human
aaccgaggggcucaggaaaa

SEQ ID NO: 3600439 - RNA, 20 nt, Human
aaccgagggggcugcuccca

SEQ ID NO: 3600440 - RNA, 23 nt, Human
aaccgaguagaaaaugugacccu

SEQ ID NO: 3600441 - RNA, 17 nt, Human
aaccgaugcuccagcca

SEQ ID NO: 3600442 - RNA, 18 nt, Human
aaccgaugcuuuaccaaa

SEQ ID NO: 3600443 - RNA, 12 nt, Human
aaccgcacagcu

SEQ ID NO: 3600444 - RNA, 14 nt, Human
aaccgcacagcuca

SEQ ID NO: 3600445 - RNA, 21 nt, Human
aaccgcaggaagcugcuccgu

SEQ ID NO: 3600446 - RNA, 16 nt, Human
aaccgccucaaaaugu

SEQ ID NO: 3600447 - RNA, 12 nt, Human
aaccgcucaccu

SEQ ID NO: 3600448 - RNA, 17 nt, Human
aaccgcuuuggccugag

SEQ ID NO: 3600449 - RNA, 18 nt, Human
aaccgcuuuggccugagu

SEQ ID NO: 3600450 - RNA, 21 nt, Human
aaccguggcccuuccuggaca

SEQ ID NO: 3600451 - RNA, 22 nt, Human
aaccguuauuauaauuguauca

SEQ ID NO: 3600452 - RNA, 17 nt, Human
aaccguuuugaagcuac

SEQ ID NO: 3600453 - RNA, 21 nt, Human
aaccuaaaauaauugguucuu

SEQ ID NO: 3600454 - RNA, 20 nt, Human
aaccuaccaccccuuccugu

SEQ ID NO: 3600455 - RNA, 21 nt, Human
aaccuaccuucauuucaggag

SEQ ID NO: 3600456 - RNA, 14 nt, Human
aaccuagagaagau

SEQ ID NO: 3600457 - RNA, 16 nt, Human
aaccuauaugauuuau

SEQ ID NO: 3600458 - RNA, 22 nt, Human
aaccuaugauauuuucugugcc

SEQ ID NO: 3600459 - RNA, 18 nt, Human
aaccuauuucucuuucuu

SEQ ID NO: 3600460 - RNA, 22 nt, Human
aaccuauuuugaaaaauuccua

SEQ ID NO: 3600461 - RNA, 15 nt, Human
aaccuauuuugaagu

SEQ ID NO: 3600462 - RNA, 17 nt, Human
aaccucaaaaugucuaa

SEQ ID NO: 3600463 - RNA, 21 nt, Human
aaccucaccccgaggcccugc

SEQ ID NO: 3600464 - RNA, 22 nt, Human
aaccucaccccgaggcccugca

SEQ ID NO: 3600465 - RNA, 19 nt, Human
aaccucacgcaccucccau

SEQ ID NO: 3600466 - RNA, 12 nt, Human
aaccucacucuu

SEQ ID NO: 3600467 - RNA, 15 nt, Human
aaccucacucuugcc

SEQ ID NO: 3600468 - RNA, 16 nt, Human
aaccucacucuugcca

SEQ ID NO: 3600469 - RNA, 17 nt, Human
aaccucacucuugccaa

SEQ ID NO: 3600470 - RNA, 12 nt, Human
aaccucagccug

SEQ ID NO: 3600471 - RNA, 16 nt, Human
aaccucagccuggcca

SEQ ID NO: 3600472 - RNA, 20 nt, Human
aaccucagccuggccagaca

SEQ ID NO: 3600473 - RNA, 14 nt, Human
aaccucagcucugg

SEQ ID NO: 3600474 - RNA, 18 nt, Human
aaccucaggcuuccuugg

SEQ ID NO: 3600475 - RNA, 17 nt, Human
aaccucagggcucccag

SEQ ID NO: 3600476 - RNA, 19 nt, Human
aaccucagggcucccaggg

SEQ ID NO: 3600477 - RNA, 21 nt, Human
aaccucauugacaagaacuga

SEQ ID NO: 3600478 - RNA, 13 nt, Human
aaccuccaccucc

SEQ ID NO: 3600479 - RNA, 11 nt, Human
aaccucccaga

SEQ ID NO: 3600480 - RNA, 13 nt, Human
aaccucccagagg

SEQ ID NO: 3600481 - RNA, 14 nt, Human
aaccuccccagccu

SEQ ID NO: 3600482 - RNA, 16 nt, Human
aaccuccccagccugc

SEQ ID NO: 3600483 - RNA, 17 nt, Human
aaccuccccagccugcg

SEQ ID NO: 3600484 - RNA, 13 nt, Human
aaccuccucugug

SEQ ID NO: 3600485 - RNA, 15 nt, Human
aaccuccucugugaa

SEQ ID NO: 3600486 - RNA, 19 nt, Human
aaccuccuuuacccucauc

SEQ ID NO: 3600487 - RNA, 18 nt, Human
aaccuccuuucucuucuc

SEQ ID NO: 3600488 - RNA, 21 nt, Human
aaccucgagguuucucaaaga

SEQ ID NO: 3600489 - RNA, 16 nt, Human
aaccucgaguacugug

SEQ ID NO: 3600490 - RNA, 17 nt, Human
aaccucgcccucuccuu

SEQ ID NO: 3600491 - RNA, 17 nt, Human
aaccucgcuccaacucc

SEQ ID NO: 3600492 - RNA, 14 nt, Human
aaccucgcuggacu

SEQ ID NO: 3600493 - RNA, 12 nt, Human
aaccucuaaauu

SEQ ID NO: 3600494 - RNA, 21 nt, Human
aaccucuaauuuauuuugucg

SEQ ID NO: 3600495 - RNA, 13 nt, Human
aaccucugucuca

SEQ ID NO: 3600496 - RNA, 15 nt, Human
aaccucuguucagug

SEQ ID NO: 3600497 - RNA, 14 nt, Human
aaccucuuccccag

SEQ ID NO: 3600498 - RNA, 21 nt, Human
aaccugaaaagauguuguguc

SEQ ID NO: 3600499 - RNA, 15 nt, Human
aaccugaaguuuuuu

SEQ ID NO: 3600500 - RNA, 11 nt, Human
aaccugacccc

SEQ ID NO: 3600501 - RNA, 19 nt, Human
aaccugaccccugcucagu

SEQ ID NO: 3600502 - RNA, 20 nt, Human
aaccugagauggcccucugg

SEQ ID NO: 3600503 - RNA, 21 nt, Human
aaccugagauggcccucuggu

SEQ ID NO: 3600504 - RNA, 20 nt, Human
aaccugagauuuauuaaaga

SEQ ID NO: 3600505 - RNA, 21 nt, Human
aaccugagauuuauuaaagaa

SEQ ID NO: 3600506 - RNA, 19 nt, Human
aaccugaugaaaauaaaga

SEQ ID NO: 3600507 - RNA, 23 nt, Human
aaccugaugaaaauaaagaaugg

SEQ ID NO: 3600508 - RNA, 17 nt, Human
aaccugauguuaaaauu

SEQ ID NO: 3600509 - RNA, 12 nt, Human
aaccugauugua

SEQ ID NO: 3600510 - RNA, 18 nt, Human
aaccugauuguaaacuuc

SEQ ID NO: 3600511 - RNA, 18 nt, Human
aaccugauugugucucuu

SEQ ID NO: 3600512 - RNA, 14 nt, Human
aaccugcaaaaaau

SEQ ID NO: 3600513 - RNA, 15 nt, Human
aaccugcucuccucu

SEQ ID NO: 3600514 - RNA, 16 nt, Human
aaccugcucuccucuu

SEQ ID NO: 3600515 - RNA, 17 nt, Human
aaccugcucuccucuuc

SEQ ID NO: 3600516 - RNA, 22 nt, Human
aaccugcuuggguggagaagcc

SEQ ID NO: 3600517 - RNA, 22 nt, Human
aaccugcuuucaagaccccugu

SEQ ID NO: 3600518 - RNA, 11 nt, Human
aaccuggagau

SEQ ID NO: 3600519 - RNA, 17 nt, Human
aaccuggagauggggag

SEQ ID NO: 3600520 - RNA, 10 nt, Human
aaccuggagg

SEQ ID NO: 3600521 - RNA, 19 nt, Human
aaccuggagggcuagaacc

SEQ ID NO: 3600522 - RNA, 22 nt, Human
aaccuggagggcuagaaucugg

SEQ ID NO: 3600523 - RNA, 11 nt, Human
aaccuggaggu

SEQ ID NO: 3600524 - RNA, 23 nt, Human
aaccuggccgcguuuagaccaag

SEQ ID NO: 3600525 - RNA, 22 nt, Human
aaccugggaggcggagaguaca

SEQ ID NO: 3600526 - RNA, 22 nt, Human
aagcagaauaaagcaauuuucc

SEQ ID NO: 3600527 - RNA, 23 nt, Human
aagcagaauaaagcaauuuuccu

SEQ ID NO: 3600528 - RNA, 12 nt, Human
aagcagacagcu

SEQ ID NO: 3600529 - RNA, 14 nt, Human
aagcagacagcucc

SEQ ID NO: 3600530 - RNA, 21 nt, Human
aagcagaccacugauaaaacc

SEQ ID NO: 3600531 - RNA, 23 nt, Human
aagcagaccauuggggcucccag

SEQ ID NO: 3600532 - RNA, 16 nt, Human
aagcagagaagcucuc

SEQ ID NO: 3600533 - RNA, 19 nt, Human
aagcagagauuuucaacau

SEQ ID NO: 3600534 - RNA, 15 nt, Human
aagcagaggaccagg

SEQ ID NO: 3600535 - RNA, 15 nt, Human
aagcagaggaggggc

SEQ ID NO: 3600536 - RNA, 18 nt, Human
aagcagaggcuggccuca

SEQ ID NO: 3600537 - RNA, 20 nt, Human
aagcagaggcuggccucaga

SEQ ID NO: 3600538 - RNA, 10 nt, Human
aagcagagug

SEQ ID NO: 3600539 - RNA, 19 nt, Human
aagcagagugcacagcugu

SEQ ID NO: 3600540 - RNA, 20 nt, Human
aagcagaguggcagucuuca

SEQ ID NO: 3600541 - RNA, 23 nt, Human
aagcagaugcaaagaggcaagag

SEQ ID NO: 3600542 - RNA, 19 nt, Human
aagcagcaacuuguccuag

SEQ ID NO: 3600543 - RNA, 22 nt, Human
aagcagcggucagcagacaagg

SEQ ID NO: 3600544 - RNA, 22 nt, Human
aagcagcguuucuaugacacau

SEQ ID NO: 3600545 - RNA, 11 nt, Human
aagcagcucuu

SEQ ID NO: 3600546 - RNA, 15 nt, Human
aagcagcuuagaguu

SEQ ID NO: 3600547 - RNA, 16 nt, Human
aagcagcuuauuguuu

SEQ ID NO: 3600548 - RNA, 16 nt, Human
aagcagcuuuaaacaa

SEQ ID NO: 3600549 - RNA, 17 nt, Human
aagcagcuuuaaacaaa

SEQ ID NO: 3600550 - RNA, 21 nt, Human
aagcagcuuuaaacaaauuca

SEQ ID NO: 3600551 - RNA, 16 nt, Human
aaccuuauccugcauu

SEQ ID NO: 3600552 - RNA, 18 nt, Human
aaccuuauccugcauugu

SEQ ID NO: 3600553 - RNA, 19 nt, Human
aaccuuauccugcauuguu

SEQ ID NO: 3600554 - RNA, 22 nt, Human
aaccuuauccugcauuguuagc

SEQ ID NO: 3600555 - RNA, 22 nt, Human
aaccuuccauacauuuuuuucu

SEQ ID NO: 3600556 - RNA, 13 nt, Human
aaccuuccaucuc

SEQ ID NO: 3600557 - RNA, 13 nt, Human
aaccuuccugucu

SEQ ID NO: 3600558 - RNA, 21 nt, Human
aaccuuccugucuucauccuu

SEQ ID NO: 3600559 - RNA, 19 nt, Human
aaccuuccuuccugcuuga

SEQ ID NO: 3600560 - RNA, 23 nt, Human
aaccuucugcccauccugucugu

SEQ ID NO: 3600561 - RNA, 13 nt, Human
aaccuugaaugcu

SEQ ID NO: 3600562 - RNA, 16 nt, Human
aaccuugaaugcugcc

SEQ ID NO: 3600563 - RNA, 17 nt, Human
aaccuugaaugcugcca

SEQ ID NO: 3600564 - RNA, 18 nt, Human
aaccuugaaugcugccag

SEQ ID NO: 3600565 - RNA, 13 nt, Human
aaccuugccuggu

SEQ ID NO: 3600566 - RNA, 13 nt, Human
aaccuugccuuuc

SEQ ID NO: 3600567 - RNA, 17 nt, Human
aaccuuggccugggccg

SEQ ID NO: 3600568 - RNA, 14 nt, Human
aaccuuguauaaau

SEQ ID NO: 3600569 - RNA, 19 nt, Human
aaccuugucucuaugccag

SEQ ID NO: 3600570 - RNA, 17 nt, Human
aaccuuguuauuucuca

SEQ ID NO: 3600571 - RNA, 15 nt, Human
aaccuuguuuuggac

SEQ ID NO: 3600572 - RNA, 23 nt, Human
aaccuuguuuuggacaguuuacc

SEQ ID NO: 3600573 - RNA, 14 nt, Human
aaccuuuagggcag

SEQ ID NO: 3600574 - RNA, 11 nt, Human
aaccuuucccc

SEQ ID NO: 3600575 - RNA, 11 nt, Human
aaccuuucccu

SEQ ID NO: 3600576 - RNA, 22 nt, Human
aaccuuucccucacccccuccc

SEQ ID NO: 3600577 - RNA, 16 nt, Human
aaccuuucuucaccaa

SEQ ID NO: 3600578 - RNA, 18 nt, Human
aaccuuucuucaccaaau

SEQ ID NO: 3600579 - RNA, 21 nt, Human
aaccuuugaguagauccauuu

SEQ ID NO: 3600580 - RNA, 18 nt, Human
aaccuuuguuugcaucug

SEQ ID NO: 3600581 - RNA, 23 nt, Human
aaccuuuugagugccuuacacaa

SEQ ID NO: 3600582 - RNA, 12 nt, Human
aaccuuuuuaaa

SEQ ID NO: 3600583 - RNA, 22 nt, Human
aaccuuuuuuaagauuuuucuc

SEQ ID NO: 3600584 - RNA, 12 nt, Human
aacgaaaagcac

SEQ ID NO: 3600585 - RNA, 16 nt, Human
aacgaaaaugaaagcu

SEQ ID NO: 3600586 - RNA, 14 nt, Human
aacgaaacacuuca

SEQ ID NO: 3600587 - RNA, 14 nt, Human
aacgaaacccacuc

SEQ ID NO: 3600588 - RNA, 14 nt, Human
aacgaaagaaggca

SEQ ID NO: 3600589 - RNA, 18 nt, Human
aacgaaccuuggccuggg

SEQ ID NO: 3600590 - RNA, 11 nt, Human
aacgaaugaag

SEQ ID NO: 3600591 - RNA, 21 nt, Human
aacgagacuuuccauuacaag

SEQ ID NO: 3600592 - RNA, 21 nt, Human
aacgagccuuuucacccuucu

SEQ ID NO: 3600593 - RNA, 15 nt, Human
aacgauccuucaaag

SEQ ID NO: 3600594 - RNA, 17 nt, Human
aacgauuuaauucucuu

SEQ ID NO: 3600595 - RNA, 18 nt, Human
aacgauuuaauucucuug

SEQ ID NO: 3600596 - RNA, 15 nt, Human
aacgauuuaauuuau

SEQ ID NO: 3600597 - RNA, 18 nt, Human
aacgcaaagggcugaaag

SEQ ID NO: 3600598 - RNA, 22 nt, Human
aacgcaaguucccaguuggagc

SEQ ID NO: 3600599 - RNA, 18 nt, Human
aacgcagaugauccauga

SEQ ID NO: 3600600 - RNA, 21 nt, Human
aacgcauggaguguguauugu

SEQ ID NO: 3600601 - RNA, 17 nt, Human
aacgcccacuucccugg

SEQ ID NO: 3600602 - RNA, 11 nt, Human
aacgccugagc

SEQ ID NO: 3600603 - RNA, 21 nt, Human
aacgccugcuugucccugccc

SEQ ID NO: 3600604 - RNA, 14 nt, Human
aacgcgcagaugug

SEQ ID NO: 3600605 - RNA, 23 nt, Human
aacgcgcagaugugcagcagauu

SEQ ID NO: 3600606 - RNA, 17 nt, Human
aacgcguugaaauugua

SEQ ID NO: 3600607 - RNA, 17 nt, Human
aacgcuaaagagcccuu

SEQ ID NO: 3600608 - RNA, 15 nt, Human
aacgcuaccucucug

SEQ ID NO: 3600609 - RNA, 14 nt, Human
aacgcuccuuugug

SEQ ID NO: 3600610 - RNA, 17 nt, Human
aacgcugagccaccugc

SEQ ID NO: 3600611 - RNA, 13 nt, Human
aacgcugccugcc

SEQ ID NO: 3600612 - RNA, 15 nt, Human
aacgcugccugcccg

SEQ ID NO: 3600613 - RNA, 14 nt, Human
aacggaccaaagca

SEQ ID NO: 3600614 - RNA, 21 nt, Human
aacggaccaaagcaagacccu

SEQ ID NO: 3600615 - RNA, 14 nt, Human
aacggagaaaggug

SEQ ID NO: 3600616 - RNA, 20 nt, Human
aacggagccccaggccucug

SEQ ID NO: 3600617 - RNA, 12 nt, Human
aacggagucaaa

SEQ ID NO: 3600618 - RNA, 18 nt, Human
aacggaucagaaauacag

SEQ ID NO: 3600619 - RNA, 16 nt, Human
aacggaugauuucuau

SEQ ID NO: 3600620 - RNA, 16 nt, Human
aacggauuauuuuuuc

SEQ ID NO: 3600621 - RNA, 17 nt, Human
aacggauuauuuuuuca

SEQ ID NO: 3600622 - RNA, 19 nt, Human
aacggauuauuuuuucaga

SEQ ID NO: 3600623 - RNA, 17 nt, Human
aacgggaacaugccccc

SEQ ID NO: 3600624 - RNA, 18 nt, Human
aacggggcucuucucauu

SEQ ID NO: 3600625 - RNA, 17 nt, Human
aacgguaaauuucugug

SEQ ID NO: 3600626 - RNA, 20 nt, Human
aacggugcugugagggaggg

SEQ ID NO: 3600627 - RNA, 14 nt, Human
aacgguucaguuuc

SEQ ID NO: 3600628 - RNA, 17 nt, Human
aacguaaccacggaaaa

SEQ ID NO: 3600629 - RNA, 15 nt, Human
aacguauaaaagccu

SEQ ID NO: 3600630 - RNA, 21 nt, Human
aacguaugcaugugaagaaag

SEQ ID NO: 3600631 - RNA, 12 nt, Human
aacgucuuaaau

SEQ ID NO: 3600632 - RNA, 15 nt, Human
aacgugauacauuug

SEQ ID NO: 3600633 - RNA, 11 nt, Human
aacgugcaacu

SEQ ID NO: 3600634 - RNA, 23 nt, Human
aacgugcauugugcuucuuucuu

SEQ ID NO: 3600635 - RNA, 20 nt, Human
aacguggagaaucacaggcu

SEQ ID NO: 3600636 - RNA, 17 nt, Human
aacguggcucugcuggc

SEQ ID NO: 3600637 - RNA, 12 nt, Human
aacguggcugcu

SEQ ID NO: 3600638 - RNA, 23 nt, Human
aacguggcugcuucaaggauccu

SEQ ID NO: 3600639 - RNA, 22 nt, Human
aacguggggcagcacagagagg

SEQ ID NO: 3600640 - RNA, 18 nt, Human
aacguuaagaauuguuaa

SEQ ID NO: 3600641 - RNA, 17 nt, Human
aacguuacucagggcuc

SEQ ID NO: 3600642 - RNA, 14 nt, Human
aacguugcuguggg

SEQ ID NO: 3600643 - RNA, 21 nt, Human
aacguuuucuaauugcuuauu

SEQ ID NO: 3600644 - RNA, 17 nt, Human
aacguuuuuccuguucu

SEQ ID NO: 3600645 - RNA, 23 nt, Human
aacguuuuuccuuuaaaaaaauu

SEQ ID NO: 3600646 - RNA, 17 nt, Human
aacuaaaacaaagccac

SEQ ID NO: 3600647 - RNA, 17 nt, Human
aacuaaaauaauuuugu

SEQ ID NO: 3600648 - RNA, 19 nt, Human
aacuaaacuaguuuuuccu

SEQ ID NO: 3600649 - RNA, 18 nt, Human
aacuaaacucauuuauaa

SEQ ID NO: 3600650 - RNA, 16 nt, Human
aacuaaacucucuuug

SEQ ID NO: 3600651 - RNA, 13 nt, Human
aacuaaacuuuca

SEQ ID NO: 3600652 - RNA, 15 nt, Human
aacuaaacuuucaca

SEQ ID NO: 3600653 - RNA, 19 nt, Human
aacuaaagaagaucuguaa

SEQ ID NO: 3600654 - RNA, 15 nt, Human
aacuaaaguuguacu

SEQ ID NO: 3600655 - RNA, 17 nt, Human
aacuaaaguuguacuuu

SEQ ID NO: 3600656 - RNA, 21 nt, Human
aacuaaaugugcaauagaagg

SEQ ID NO: 3600657 - RNA, 13 nt, Human
aacuaaauuucac

SEQ ID NO: 3600658 - RNA, 22 nt, Human
aacuaaauuucacuacuagauu

SEQ ID NO: 3600659 - RNA, 17 nt, Human
aacuaaauuugauacuu

SEQ ID NO: 3600660 - RNA, 19 nt, Human
aacuaaauuugauacuuau

SEQ ID NO: 3600661 - RNA, 18 nt, Human
aacuaacaggcuuaguga

SEQ ID NO: 3600662 - RNA, 18 nt, Human
aacuaagaaacuuuugua

SEQ ID NO: 3600663 - RNA, 23 nt, Human
aacuaagcagucccugagaccau

SEQ ID NO: 3600664 - RNA, 15 nt, Human
aacuaaggugcuaaa

SEQ ID NO: 3600665 - RNA, 10 nt, Human
aacuaauaaa

SEQ ID NO: 3600666 - RNA, 11 nt, Human
aacuaauaaaa

SEQ ID NO: 3600667 - RNA, 18 nt, Human
aacuaauugacuuuagaa

SEQ ID NO: 3600668 - RNA, 20 nt, Human
aacuaauugacuuuagaaag

SEQ ID NO: 3600669 - RNA, 15 nt, Human
aacuaauuuaguaau

SEQ ID NO: 3600670 - RNA, 23 nt, Human
aacuaauuuuuauuuuugcugag

SEQ ID NO: 3600671 - RNA, 18 nt, Human
aacuacaaagguuuaaau

SEQ ID NO: 3600672 - RNA, 20 nt, Human
aacuacaaagguuuaaauga

SEQ ID NO: 3600673 - RNA, 20 nt, Human
aacuacaaccaauggaaugu

SEQ ID NO: 3600674 - RNA, 13 nt, Human
aacuacaugagaa

SEQ ID NO: 3600675 - RNA, 12 nt, Human
aacuacauuuua

SEQ ID NO: 3600676 - RNA, 17 nt, Human
aacuaccaccugacauu

SEQ ID NO: 3600677 - RNA, 21 nt, Human
aacuacccaaaacaagccugg

SEQ ID NO: 3600678 - RNA, 21 nt, Human
aacuaccuguauuuaaaaaua

SEQ ID NO: 3600679 - RNA, 23 nt, Human
aacuaccuguauuuaaaaauaga

SEQ ID NO: 3600680 - RNA, 15 nt, Human
aacuacuauucaaaa

SEQ ID NO: 3600681 - RNA, 21 nt, Human
aagcacugaccugucaugccc

SEQ ID NO: 3600682 - RNA, 19 nt, Human
aagcacugacuucuaagua

SEQ ID NO: 3600683 - RNA, 19 nt, Human
aagcacugcuaggcgagug

SEQ ID NO: 3600684 - RNA, 23 nt, Human
aagcacugcuaggcgagugccag

SEQ ID NO: 3600685 - RNA, 15 nt, Human
aagcacugugcucag

SEQ ID NO: 3600686 - RNA, 18 nt, Human
aagcacuuugggauucuu

SEQ ID NO: 3600687 - RNA, 13 nt, Human
aagcagaaaauac

SEQ ID NO: 3600688 - RNA, 18 nt, Human
aagcagaaagugccuuuc

SEQ ID NO: 3600689 - RNA, 14 nt, Human
aagcagaauaaagc

SEQ ID NO: 3600690 - RNA, 15 nt, Human
aagcagaauaaagca

SEQ ID NO: 3600691 - RNA, 18 nt, Human
aagcagaauaaagcaauu

SEQ ID NO: 3600692 - RNA, 21 nt, Human
aagcagaauaguauuuuuaua

SEQ ID NO: 3600693 - RNA, 19 nt, Human
aagcagaauuggaaaagac

SEQ ID NO: 3600694 - RNA, 21 nt, Human
aagcagaauuggaaaagacua

SEQ ID NO: 3600695 - RNA, 21 nt, Human
aagcagaggaaggagaggaga

SEQ ID NO: 3600696 - RNA, 18 nt, Human
aagcagaggaccagggcc

SEQ ID NO: 3600697 - RNA, 13 nt, Human
aagcagaggcugg

SEQ ID NO: 3600698 - RNA, 18 nt, Human
aagcagagugcacagcug

SEQ ID NO: 3600699 - RNA, 21 nt, Human
aagcagagugcacagcugucc

SEQ ID NO: 3600700 - RNA, 17 nt, Human
aagcagauggaaugcug

SEQ ID NO: 3600701 - RNA, 19 nt, Human
aagcagauggaaugcugug

SEQ ID NO: 3600702 - RNA, 21 nt, Human
aagcagcagccucgccccugg

SEQ ID NO: 3600703 - RNA, 14 nt, Human
aagcagccaagcuc

SEQ ID NO: 3600704 - RNA, 16 nt, Human
aagcagccagccguga

SEQ ID NO: 3600705 - RNA, 16 nt, Human
aagcagccucucccca

SEQ ID NO: 3600706 - RNA, 17 nt, Human
aagcagccucuccccag

SEQ ID NO: 3600707 - RNA, 20 nt, Human
aagcagcgaccgcccccucc

SEQ ID NO: 3600708 - RNA, 14 nt, Human
aagcagcguuucua

SEQ ID NO: 3600709 - RNA, 17 nt, Human
aagcagcguuucuauga

SEQ ID NO: 3600710 - RNA, 16 nt, Human
aagcagcuaaauuuuc

SEQ ID NO: 3600711 - RNA, 16 nt, Human
aagcagcucaaaggca

SEQ ID NO: 3600712 - RNA, 18 nt, Human
aagcagcucaaaggcaca

SEQ ID NO: 3600713 - RNA, 17 nt, Human
aagcagcucuccccuca

SEQ ID NO: 3600714 - RNA, 22 nt, Human
aagcaggaaaugaaaaugucuu

SEQ ID NO: 3600715 - RNA, 12 nt, Human
aagcaggaagcu

SEQ ID NO: 3600716 - RNA, 11 nt, Human
aagcaggaggc

SEQ ID NO: 3600717 - RNA, 23 nt, Human
aagcaggcgcaagggaggcccag

SEQ ID NO: 3600718 - RNA, 18 nt, Human
aagcaggcgcugugcuau

SEQ ID NO: 3600719 - RNA, 16 nt, Human
aagcaggcuacacuga

SEQ ID NO: 3600720 - RNA, 15 nt, Human
aagcaggcuggaggu

SEQ ID NO: 3600721 - RNA, 18 nt, Human
aagcaggcuucuaugaaa

SEQ ID NO: 3600722 - RNA, 16 nt, Human
aagcagggaauuucua

SEQ ID NO: 3600723 - RNA, 18 nt, Human
aagcaggggaguaugcaa

SEQ ID NO: 3600724 - RNA, 22 nt, Human
aagcagguggaucuauuucaug

SEQ ID NO: 3600725 - RNA, 21 nt, Human
aagcagguuaaauguuuugua

SEQ ID NO: 3600726 - RNA, 18 nt, Human
aagcagguucccaagcuc

SEQ ID NO: 3600727 - RNA, 16 nt, Human
aagcagguuuuucucc

SEQ ID NO: 3600728 - RNA, 22 nt, Human
aagcaguaaaaacuguucucua

SEQ ID NO: 3600729 - RNA, 22 nt, Human
aagcaguagaaauaauaugcau

SEQ ID NO: 3600730 - RNA, 14 nt, Human
aagcaguagacaag

SEQ ID NO: 3600731 - RNA, 17 nt, Human
aagcaguauuuuucuug

SEQ ID NO: 3600732 - RNA, 18 nt, Human
aagcaguauuuuucuuga

SEQ ID NO: 3600733 - RNA, 16 nt, Human
aagcagucacuuuucc

SEQ ID NO: 3600734 - RNA, 13 nt, Human
aagcagugcccag

SEQ ID NO: 3600735 - RNA, 15 nt, Human
aagcagugcccaggu

SEQ ID NO: 3600736 - RNA, 18 nt, Human
aagcagugccuuccauaa

SEQ ID NO: 3600737 - RNA, 17 nt, Human
aagcaguggacaccagg

SEQ ID NO: 3600738 - RNA, 18 nt, Human
aagcaguggagcccagga

SEQ ID NO: 3600739 - RNA, 12 nt, Human
aagcaguuucaa

SEQ ID NO: 3600740 - RNA, 19 nt, Human
aagcaguuucaauaaaguu

SEQ ID NO: 3600741 - RNA, 22 nt, Human
aagcauaaaugcaaacacacaa

SEQ ID NO: 3600742 - RNA, 22 nt, Human
aagcauacaugcaaaaagaaau

SEQ ID NO: 3600743 - RNA, 17 nt, Human
aagcauacuuuguaaau

SEQ ID NO: 3600744 - RNA, 20 nt, Human
aagcauagauaauauuguuu

SEQ ID NO: 3600745 - RNA, 15 nt, Human
aagcauagauguuuu

SEQ ID NO: 3600746 - RNA, 15 nt, Human
aagcauauagagaug

SEQ ID NO: 3600747 - RNA, 21 nt, Human
aagcauauggguuagauguug

SEQ ID NO: 3600748 - RNA, 14 nt, Human
aagcaucaaacucu

SEQ ID NO: 3600749 - RNA, 15 nt, Human
aagcaucaaacucuu

SEQ ID NO: 3600750 - RNA, 14 nt, Human
aagcaucacaaaug

SEQ ID NO: 3600751 - RNA, 15 nt, Human
aagcaucacaaauga

SEQ ID NO: 3600752 - RNA, 18 nt, Human
aagcaucaccucaggcca

SEQ ID NO: 3600753 - RNA, 19 nt, Human
aagcaucaccucaggccag

SEQ ID NO: 3600754 - RNA, 13 nt, Human
aagcaucagaaag

SEQ ID NO: 3600755 - RNA, 19 nt, Human
aagcaucaguucuacggau

SEQ ID NO: 3600756 - RNA, 14 nt, Human
aagcaucauuauuu

SEQ ID NO: 3600757 - RNA, 12 nt, Human
aagcauccaugu

SEQ ID NO: 3600758 - RNA, 20 nt, Human
aagcauccauguguggacuc

SEQ ID NO: 3600759 - RNA, 13 nt, Human
aagcaucccucac

SEQ ID NO: 3600760 - RNA, 17 nt, Human
aagcaucuaaacuuuaa

SEQ ID NO: 3600761 - RNA, 17 nt, Human
aagcaucuaaggacaag

SEQ ID NO: 3600762 - RNA, 13 nt, Human
aagcaucuaaguu

SEQ ID NO: 3600763 - RNA, 12 nt, Human
aagcaucuacuu

SEQ ID NO: 3600764 - RNA, 14 nt, Human
aagcaucuugcauu

SEQ ID NO: 3600765 - RNA, 16 nt, Human
aagcaugaaaugugaa

SEQ ID NO: 3600766 - RNA, 17 nt, Human
aagcaugaaaugugaau

SEQ ID NO: 3600767 - RNA, 12 nt, Human
aagcaugaacag

SEQ ID NO: 3600768 - RNA, 13 nt, Human
aagcaugcauucu

SEQ ID NO: 3600769 - RNA, 16 nt, Human
aagcaugccaauuucu

SEQ ID NO: 3600770 - RNA, 11 nt, Human
aagcauggacu

SEQ ID NO: 3600771 - RNA, 23 nt, Human
aagcauggcuugaauaaggaaau

SEQ ID NO: 3600772 - RNA, 17 nt, Human
aagcauggucccacauc

SEQ ID NO: 3600773 - RNA, 22 nt, Human
aagcauggucccacaucccugg

SEQ ID NO: 3600774 - RNA, 16 nt, Human
aagcauguacaguguu

SEQ ID NO: 3600775 - RNA, 12 nt, Human
aagcaugugaga

SEQ ID NO: 3600776 - RNA, 13 nt, Human
aagcauguggcau

SEQ ID NO: 3600777 - RNA, 12 nt, Human
aagcauguuuca

SEQ ID NO: 3600778 - RNA, 15 nt, Human
aagcauguuucaugu

SEQ ID NO: 3600779 - RNA, 14 nt, Human
aagcauguuuugca

SEQ ID NO: 3600780 - RNA, 18 nt, Human
aagcauuaacuucucugg

SEQ ID NO: 3600781 - RNA, 18 nt, Human
aagcauuaagaacacuuu

SEQ ID NO: 3600782 - RNA, 19 nt, Human
aagcauuaccacucaggca

SEQ ID NO: 3600783 - RNA, 21 nt, Human
aagcauuacucuuguaagauu

SEQ ID NO: 3600784 - RNA, 12 nt, Human
aagcauucacaa

SEQ ID NO: 3600785 - RNA, 13 nt, Human
aagcauucacaac

SEQ ID NO: 3600786 - RNA, 20 nt, Human
aagcauuccuucuuugauaa

SEQ ID NO: 3600787 - RNA, 22 nt, Human
aagcauuccuucuuugauaaug

SEQ ID NO: 3600788 - RNA, 23 nt, Human
aagcauuccuucuuugauaaugu

SEQ ID NO: 3600789 - RNA, 23 nt, Human
aagcauucuccccaguguauguc

SEQ ID NO: 3600790 - RNA, 13 nt, Human
aagcauucugucu

SEQ ID NO: 3600791 - RNA, 14 nt, Human
aagcauugaaauua

SEQ ID NO: 3600792 - RNA, 17 nt, Human
aagcauugaaauuauag

SEQ ID NO: 3600793 - RNA, 21 nt, Human
aagcauugcuguuaugucugu

SEQ ID NO: 3600794 - RNA, 22 nt, Human
aagcauugcuuuuauuuugaaa

SEQ ID NO: 3600795 - RNA, 15 nt, Human
aagcauuguaaaaua

SEQ ID NO: 3600796 - RNA, 17 nt, Human
aagcauuguaaaauaau

SEQ ID NO: 3600797 - RNA, 13 nt, Human
aagcauugugagu

SEQ ID NO: 3600798 - RNA, 20 nt, Human
aagcauuguuugcuuauugu

SEQ ID NO: 3600799 - RNA, 22 nt, Human
aagcauuuaaccccccuguaca

SEQ ID NO: 3600800 - RNA, 23 nt, Human
aagcauuuaaccccccuguacac

SEQ ID NO: 3600801 - RNA, 14 nt, Human
aagcauuuaggaau

SEQ ID NO: 3600802 - RNA, 12 nt, Human
aagcauuugaau

SEQ ID NO: 3600803 - RNA, 14 nt, Human
aagcauuuguauuu

SEQ ID NO: 3600804 - RNA, 19 nt, Human
aagcauuuguauuuugugu

SEQ ID NO: 3600805 - RNA, 19 nt, Human
aagcauuuguuucuacuuu

SEQ ID NO: 3600806 - RNA, 12 nt, Human
aagcauuuuaua

SEQ ID NO: 3600807 - RNA, 15 nt, Human
aagcauuuuauaaau

SEQ ID NO: 3600808 - RNA, 13 nt, Human
aagcauuuuguaa

SEQ ID NO: 3600809 - RNA, 23 nt, Human
aagcauuuuguaaguugaagcaa

SEQ ID NO: 3600810 - RNA, 22 nt, Human
aagccaaaaaccuuagcucccu

SEQ ID NO: 3600811 - RNA, 16 nt, Human
aagccaaaacugagca

SEQ ID NO: 3600812 - RNA, 17 nt, Human
aagccaaaauuaaggug

SEQ ID NO: 3600813 - RNA, 14 nt, Human
aagccaaacucugc

SEQ ID NO: 3600814 - RNA, 16 nt, Human
aagccaaacucugcca

SEQ ID NO: 3600815 - RNA, 20 nt, Human
aagccaaacucugccagcca

SEQ ID NO: 3600816 - RNA, 13 nt, Human
aagccaaagaaaa

SEQ ID NO: 3600817 - RNA, 17 nt, Human
aagccaaagcuaggccu

SEQ ID NO: 3600818 - RNA, 18 nt, Human
aagccaaagcuaggccug

SEQ ID NO: 3600819 - RNA, 17 nt, Human
aagccaaaucaaaauau

SEQ ID NO: 3600820 - RNA, 14 nt, Human
aagccaaauuuauc

SEQ ID NO: 3600821 - RNA, 16 nt, Human
aagccaaauuuaucaa

SEQ ID NO: 3600822 - RNA, 16 nt, Human
aagccaacgacaaagc

SEQ ID NO: 3600823 - RNA, 19 nt, Human
aagccaacuuguaaauaca

SEQ ID NO: 3600824 - RNA, 14 nt, Human
aagccaagaaagau

SEQ ID NO: 3600825 - RNA, 22 nt, Human
aagccaagaggcugcagccagg

SEQ ID NO: 3600826 - RNA, 16 nt, Human
aagccaagcagccaag

SEQ ID NO: 3600827 - RNA, 13 nt, Human
aagccaagggccu

SEQ ID NO: 3600828 - RNA, 19 nt, Human
aagccaaguggggugcugg

SEQ ID NO: 3600829 - RNA, 20 nt, Human
aagccaauaacacacagcua

SEQ ID NO: 3600830 - RNA, 14 nt, Human
aagccaauccccuc

SEQ ID NO: 3600831 - RNA, 15 nt, Human
aagccaauccccucc

SEQ ID NO: 3600832 - RNA, 23 nt, Human
aagccagcaccggaccagccugg

SEQ ID NO: 3600833 - RNA, 23 nt, Human
aagccagcaggcucucaggccag

SEQ ID NO: 3600834 - RNA, 20 nt, Human
aagccagccaagcuuuaaau

SEQ ID NO: 3600835 - RNA, 19 nt, Human
aagccagccugaccuuccu

SEQ ID NO: 3600836 - RNA, 19 nt, Human
aagccagcguccuccucug

SEQ ID NO: 3600837 - RNA, 21 nt, Human
aagccagcugcccccagagcc

SEQ ID NO: 3600838 - RNA, 15 nt, Human
aagccagcugcccua

SEQ ID NO: 3600839 - RNA, 16 nt, Human
aagccagcugcccuau

SEQ ID NO: 3600840 - RNA, 15 nt, Human
aagccagcugccgac

SEQ ID NO: 3600841 - RNA, 23 nt, Human
aagccagcuuguuuacaugcuua

SEQ ID NO: 3600842 - RNA, 19 nt, Human
aacuacugaaugaagcagu

SEQ ID NO: 3600843 - RNA, 20 nt, Human
aacuacugcaccauuuaaaa

SEQ ID NO: 3600844 - RNA, 20 nt, Human
aacuacugccuuuagaaaau

SEQ ID NO: 3600845 - RNA, 14 nt, Human
aacuacuguguuau

SEQ ID NO: 3600846 - RNA, 14 nt, Human
aacuacuguguucc

SEQ ID NO: 3600847 - RNA, 15 nt, Human
aacuacuguguuccu

SEQ ID NO: 3600848 - RNA, 19 nt, Human
aacuacuuugcugcuaaua

SEQ ID NO: 3600849 - RNA, 22 nt, Human
aacuagaauuuauucaauuccu

SEQ ID NO: 3600850 - RNA, 16 nt, Human
aacuagaauuugauua

SEQ ID NO: 3600851 - RNA, 20 nt, Human
aacuagacaccaaaguucua

SEQ ID NO: 3600852 - RNA, 16 nt, Human
aacuagagcagcccug

SEQ ID NO: 3600853 - RNA, 23 nt, Human
aacuagagcagcccuggagucau

SEQ ID NO: 3600854 - RNA, 22 nt, Human
aacuagaggugagaaauuuaaa

SEQ ID NO: 3600855 - RNA, 18 nt, Human
aacuagagguuuuaugau

SEQ ID NO: 3600856 - RNA, 20 nt, Human
aacuagagguuuuaugauau

SEQ ID NO: 3600857 - RNA, 22 nt, Human
aacuagagguuuuaugauauuu

SEQ ID NO: 3600858 - RNA, 17 nt, Human
aacuagaugaccucauu

SEQ ID NO: 3600859 - RNA, 20 nt, Human
aacuagauuacauucaguug

SEQ ID NO: 3600860 - RNA, 21 nt, Human
aacuagccaaaccaggacccu

SEQ ID NO: 3600861 - RNA, 12 nt, Human
aacuagcuggaa

SEQ ID NO: 3600862 - RNA, 22 nt, Human
aacuaggagcuuugacucagga

SEQ ID NO: 3600863 - RNA, 23 nt, Human
aacuaggagcuuugacucaggag

SEQ ID NO: 3600864 - RNA, 17 nt, Human
aacuaggcauuuguaaa

SEQ ID NO: 3600865 - RNA, 18 nt, Human
aacuaggcauuuguaaau

SEQ ID NO: 3600866 - RNA, 15 nt, Human
aacuaggcuccuuca

SEQ ID NO: 3600867 - RNA, 17 nt, Human
aacuagggccaagccca

SEQ ID NO: 3600868 - RNA, 21 nt, Human
aacuaggugcauauuuauaaa

SEQ ID NO: 3600869 - RNA, 16 nt, Human
aacuauaaauauguac

SEQ ID NO: 3600870 - RNA, 16 nt, Human
aacuauacuugaacaa

SEQ ID NO: 3600871 - RNA, 18 nt, Human
aacuauacuugaacaaaa

SEQ ID NO: 3600872 - RNA, 13 nt, Human
aacuauauuguuu

SEQ ID NO: 3600873 - RNA, 13 nt, Human
aacuauauuuucu

SEQ ID NO: 3600874 - RNA, 17 nt, Human
aacuauauuuugucaua

SEQ ID NO: 3600875 - RNA, 13 nt, Human
aacuaucuucauc

SEQ ID NO: 3600876 - RNA, 23 nt, Human
aacuaugagcuugcucauuaauu

SEQ ID NO: 3600877 - RNA, 18 nt, Human
aacuaugauaugguaaaa

SEQ ID NO: 3600878 - RNA, 16 nt, Human
aacuaugauuauuaac

SEQ ID NO: 3600879 - RNA, 16 nt, Human
aacuaugauuuggaaa

SEQ ID NO: 3600880 - RNA, 19 nt, Human
aacuauguacaauauuuua

SEQ ID NO: 3600881 - RNA, 20 nt, Human
aacuauguacaauauuuuaa

SEQ ID NO: 3600882 - RNA, 13 nt, Human
aacuauguugaua

SEQ ID NO: 3600883 - RNA, 18 nt, Human
aacuauguuuaaaguaau

SEQ ID NO: 3600884 - RNA, 16 nt, Human
aacuauucaguugugu

SEQ ID NO: 3600885 - RNA, 21 nt, Human
aacuauucaguuguguuuguu

SEQ ID NO: 3600886 - RNA, 21 nt, Human
aacuauugcauuuauauguac

SEQ ID NO: 3600887 - RNA, 15 nt, Human
aacuauuggaaagua

SEQ ID NO: 3600888 - RNA, 21 nt, Human
aacuauugugcucagagacac

SEQ ID NO: 3600889 - RNA, 16 nt, Human
aacuauuuaacuugag

SEQ ID NO: 3600890 - RNA, 21 nt, Human
aacuauuuauugacucugggu

SEQ ID NO: 3600891 - RNA, 18 nt, Human
aacuauuuucaaagacuu

SEQ ID NO: 3600892 - RNA, 12 nt, Human
aacuauuuucag

SEQ ID NO: 3600893 - RNA, 13 nt, Human
aacuauuuucaga

SEQ ID NO: 3600894 - RNA, 16 nt, Human
aacuauuuucagaugu

SEQ ID NO: 3600895 - RNA, 19 nt, Human
aacucaaaacuuaacauau

SEQ ID NO: 3600896 - RNA, 18 nt, Human
aacucaaauggggccaga

SEQ ID NO: 3600897 - RNA, 19 nt, Human
aacucaaccaaaugguaca

SEQ ID NO: 3600898 - RNA, 21 nt, Human
aacucaacugggcucuguccc

SEQ ID NO: 3600899 - RNA, 14 nt, Human
aacucaauauuuuc

SEQ ID NO: 3600900 - RNA, 21 nt, Human
aacucaauauuuuccaugaaa

SEQ ID NO: 3600901 - RNA, 15 nt, Human
aacucaccauguaaa

SEQ ID NO: 3600902 - RNA, 15 nt, Human
aacucaccccagccc

SEQ ID NO: 3600903 - RNA, 16 nt, Human
aacucaccccagcccc

SEQ ID NO: 3600904 - RNA, 18 nt, Human
aacucaccccagccccaa

SEQ ID NO: 3600905 - RNA, 14 nt, Human
aacucaccuaacuc

SEQ ID NO: 3600906 - RNA, 16 nt, Human
aacucaccugccccuc

SEQ ID NO: 3600907 - RNA, 21 nt, Human
aacucaccugcuggccccuca

SEQ ID NO: 3600908 - RNA, 22 nt, Human
aacucacucaguuuaugcugug

SEQ ID NO: 3600909 - RNA, 16 nt, Human
aacucacuccuuuuaa

SEQ ID NO: 3600910 - RNA, 12 nt, Human
aacucacucugg

SEQ ID NO: 3600911 - RNA, 18 nt, Human
aacucagaauuauuuuua

SEQ ID NO: 3600912 - RNA, 14 nt, Human
aacucagagccucc

SEQ ID NO: 3600913 - RNA, 18 nt, Human
aacucagaucacuacugc

SEQ ID NO: 3600914 - RNA, 13 nt, Human
aacucagauccag

SEQ ID NO: 3600915 - RNA, 14 nt, Human
aacucagauccagg

SEQ ID NO: 3600916 - RNA, 15 nt, Human
aacucagauccaggg

SEQ ID NO: 3600917 - RNA, 13 nt, Human
aacucagaucugu

SEQ ID NO: 3600918 - RNA, 12 nt, Human
aacucagccaag

SEQ ID NO: 3600919 - RNA, 15 nt, Human
aacucagccaagcac

SEQ ID NO: 3600920 - RNA, 18 nt, Human
aacucagccaagcacagu

SEQ ID NO: 3600921 - RNA, 20 nt, Human
aacucagccaagcacagugg

SEQ ID NO: 3600922 - RNA, 16 nt, Human
aacucagccugggaca

SEQ ID NO: 3600923 - RNA, 16 nt, Human
aacucaggacuccagc

SEQ ID NO: 3600924 - RNA, 14 nt, Human
aacucaggcaaaga

SEQ ID NO: 3600925 - RNA, 15 nt, Human
aacucaggcaaagaa

SEQ ID NO: 3600926 - RNA, 17 nt, Human
aacucagggacagagcc

SEQ ID NO: 3600927 - RNA, 20 nt, Human
aacucaguccuguacucugg

SEQ ID NO: 3600928 - RNA, 15 nt, Human
aacucaguuuuaacu

SEQ ID NO: 3600929 - RNA, 23 nt, Human
aacucauacugugcuggagccac

SEQ ID NO: 3600930 - RNA, 15 nt, Human
aacucaucauaaaau

SEQ ID NO: 3600931 - RNA, 21 nt, Human
aacucaucccuaaugcugcag

SEQ ID NO: 3600932 - RNA, 22 nt, Human
aacucaucccuaaugcugcaga

SEQ ID NO: 3600933 - RNA, 17 nt, Human
aacucaucugucaccaa

SEQ ID NO: 3600934 - RNA, 21 nt, Human
aacucauuccagaucccaggc

SEQ ID NO: 3600935 - RNA, 15 nt, Human
aacucauuccugccu

SEQ ID NO: 3600936 - RNA, 21 nt, Human
aacucauuccugccugucucc

SEQ ID NO: 3600937 - RNA, 22 nt, Human
aacucauuccugccugucuccu

SEQ ID NO: 3600938 - RNA, 17 nt, Human
aacucauuuuugccaua

SEQ ID NO: 3600939 - RNA, 19 nt, Human
aacucauuuuugccauaca

SEQ ID NO: 3600940 - RNA, 21 nt, Human
aacucauuuuuguuuucauua

SEQ ID NO: 3600941 - RNA, 16 nt, Human
aacuccaacauccacu

SEQ ID NO: 3600942 - RNA, 14 nt, Human
aacuccacaucugc

SEQ ID NO: 3600943 - RNA, 12 nt, Human
aacuccaugaug

SEQ ID NO: 3600944 - RNA, 19 nt, Human
aacucccugccccccagcc

SEQ ID NO: 3600945 - RNA, 14 nt, Human
aacucccuuucaac

SEQ ID NO: 3600946 - RNA, 17 nt, Human
aacuccgagugaacugg

SEQ ID NO: 3600947 - RNA, 15 nt, Human
aacuccgcccccagc

SEQ ID NO: 3600948 - RNA, 19 nt, Human
aacuccuaguucuagaaaa

SEQ ID NO: 3600949 - RNA, 21 nt, Human
aacuccuaguucuagaaaaac

SEQ ID NO: 3600950 - RNA, 12 nt, Human
aacuccucccau

SEQ ID NO: 3600951 - RNA, 23 nt, Human
aacuccugacgucugaagcuuga

SEQ ID NO: 3600952 - RNA, 18 nt, Human
aacuccugagaaauguua

SEQ ID NO: 3600953 - RNA, 18 nt, Human
aacuccugccccuguucu

SEQ ID NO: 3600954 - RNA, 18 nt, Human
aacuccuggaaauaucag

SEQ ID NO: 3600955 - RNA, 12 nt, Human
aacuccuggccu

SEQ ID NO: 3600956 - RNA, 17 nt, Human
aacuccuuccuggccug

SEQ ID NO: 3600957 - RNA, 20 nt, Human
aacuccuuccuggccugaga

SEQ ID NO: 3600958 - RNA, 12 nt, Human
aacuccuuggcc

SEQ ID NO: 3600959 - RNA, 15 nt, Human
aacucgaaucugugu

SEQ ID NO: 3600960 - RNA, 16 nt, Human
aacucgaaucugugug

SEQ ID NO: 3600961 - RNA, 16 nt, Human
aacucgguguccccac

SEQ ID NO: 3600962 - RNA, 18 nt, Human
aacucgguguccccacca

SEQ ID NO: 3600963 - RNA, 21 nt, Human
aacucguauagcaugcaucug

SEQ ID NO: 3600964 - RNA, 18 nt, Human
aacucguuaauuuguagu

SEQ ID NO: 3600965 - RNA, 15 nt, Human
aacucguuuuuuaca

SEQ ID NO: 3600966 - RNA, 19 nt, Human
aacucuaaaagauccuuuu

SEQ ID NO: 3600967 - RNA, 22 nt, Human
aacucuaauucccauuuugcaa

SEQ ID NO: 3600968 - RNA, 19 nt, Human
aacucuagcuggggguggg

SEQ ID NO: 3600969 - RNA, 15 nt, Human
aacucuccagugccu

SEQ ID NO: 3600970 - RNA, 17 nt, Human
aacucuccucugcugcu

SEQ ID NO: 3600971 - RNA, 12 nt, Human
aacucucuccac

SEQ ID NO: 3600972 - RNA, 16 nt, Human
aacucugaacuuugga

SEQ ID NO: 3600973 - RNA, 16 nt, Human
aacucugaauuuaucu

SEQ ID NO: 3600974 - RNA, 16 nt, Human
aacucugacaacagac

SEQ ID NO: 3600975 - RNA, 20 nt, Human
aacucugacaacagacuucu

SEQ ID NO: 3600976 - RNA, 12 nt, Human
aacucugagccc

SEQ ID NO: 3600977 - RNA, 14 nt, Human
aacucugagcccau

SEQ ID NO: 3600978 - RNA, 22 nt, Human
aacucugauguaaaugaaguaa

SEQ ID NO: 3600979 - RNA, 18 nt, Human
aacucugcaugguccccu

SEQ ID NO: 3600980 - RNA, 14 nt, Human
aacucugccagcca

SEQ ID NO: 3600981 - RNA, 22 nt, Human
aacucugcugucuaaccuguga

SEQ ID NO: 3600982 - RNA, 16 nt, Human
aacucugcuugauuuu

SEQ ID NO: 3600983 - RNA, 22 nt, Human
aacucugggcugcuacccagaa

SEQ ID NO: 3600984 - RNA, 13 nt, Human
aacucuguaauuc

SEQ ID NO: 3600985 - RNA, 22 nt, Human
aacucuguuacacuuuuuggaa

SEQ ID NO: 3600986 - RNA, 17 nt, Human
aacucuuagaaaugaag

SEQ ID NO: 3600987 - RNA, 11 nt, Human
aagucaugagc

SEQ ID NO: 3600988 - RNA, 13 nt, Human
aagucaugauguu

SEQ ID NO: 3600989 - RNA, 18 nt, Human
aagucaugauguuuuuaa

SEQ ID NO: 3600990 - RNA, 23 nt, Human
aagucaugauguuuuuaaaaucu

SEQ ID NO: 3600991 - RNA, 19 nt, Human
aagucaugcuccccugugc

SEQ ID NO: 3600992 - RNA, 14 nt, Human
aagucaugugcauu

SEQ ID NO: 3600993 - RNA, 14 nt, Human
aagucauuaaacug

SEQ ID NO: 3600994 - RNA, 16 nt, Human
aagucauuaaacuggu

SEQ ID NO: 3600995 - RNA, 17 nt, Human
aagucauuaaacugguu

SEQ ID NO: 3600996 - RNA, 13 nt, Human
aagucauuggcuu

SEQ ID NO: 3600997 - RNA, 20 nt, Human
aagucauuggcuuuauccuc

SEQ ID NO: 3600998 - RNA, 17 nt, Human
aaguccaagcauaccaa

SEQ ID NO: 3600999 - RNA, 14 nt, Human
aaguccaauaagac

SEQ ID NO: 3601000 - RNA, 19 nt, Human
aaguccagauuuacacugg

SEQ ID NO: 3601001 - RNA, 22 nt, Human
aaguccagauuuacacugggag

SEQ ID NO: 3601002 - RNA, 15 nt, Human
aaguccagguccugg

SEQ ID NO: 3601003 - RNA, 23 nt, Human
aagucccaccgguugcuucuggg

SEQ ID NO: 3601004 - RNA, 22 nt, Human
aagucccccaagaccuaagggu

SEQ ID NO: 3601005 - RNA, 21 nt, Human
aaguccccgaguuuccccaga

SEQ ID NO: 3601006 - RNA, 14 nt, Human
aagucccugccccc

SEQ ID NO: 3601007 - RNA, 17 nt, Human
aagucccugcccccucc

SEQ ID NO: 3601008 - RNA, 19 nt, Human
aaguccuacuuuuaaagaa

SEQ ID NO: 3601009 - RNA, 15 nt, Human
aaguccuauggaaac

SEQ ID NO: 3601010 - RNA, 16 nt, Human
aaguccuauggaaacc

SEQ ID NO: 3601011 - RNA, 23 nt, Human
aaguccucccugacuuuucugug

SEQ ID NO: 3601012 - RNA, 22 nt, Human
aaguccucuuuucugagaggac

SEQ ID NO: 3601013 - RNA, 18 nt, Human
aaguccuuaccucuuccg

SEQ ID NO: 3601014 - RNA, 16 nt, Human
aaguccuuuaugugga

SEQ ID NO: 3601015 - RNA, 15 nt, Human
aaguccuuuuguaaa

SEQ ID NO: 3601016 - RNA, 15 nt, Human
aagucgaauuaauag

SEQ ID NO: 3601017 - RNA, 14 nt, Human
aagucgguuagugg

SEQ ID NO: 3601018 - RNA, 22 nt, Human
aagucguccuuacuccuguggg

SEQ ID NO: 3601019 - RNA, 17 nt, Human
aagucuaaauauuuccu

SEQ ID NO: 3601020 - RNA, 18 nt, Human
aagucuaucugguauuaa

SEQ ID NO: 3601021 - RNA, 17 nt, Human
aagucucaaugaaauag

SEQ ID NO: 3601022 - RNA, 19 nt, Human
aagucucagcuaagcucac

SEQ ID NO: 3601023 - RNA, 14 nt, Human
aagucuccaaaguc

SEQ ID NO: 3601024 - RNA, 15 nt, Human
aagucuccagcccac

SEQ ID NO: 3601025 - RNA, 14 nt, Human
aagucuccuucccc

SEQ ID NO: 3601026 - RNA, 15 nt, Human
aagucucuaauucua

SEQ ID NO: 3601027 - RNA, 18 nt, Human
aagucucuaauucuauua

SEQ ID NO: 3601028 - RNA, 14 nt, Human
aagucucuauuuaa

SEQ ID NO: 3601029 - RNA, 19 nt, Human
aagucucuauuuaaauucu

SEQ ID NO: 3601030 - RNA, 20 nt, Human
aagucucuauuuaaauucuu

SEQ ID NO: 3601031 - RNA, 23 nt, Human
aagucucuauuuaaauucuuuuu

SEQ ID NO: 3601032 - RNA, 22 nt, Human
aagucucugaagugaaacugcu

SEQ ID NO: 3601033 - RNA, 11 nt, Human
aagucucugug

SEQ ID NO: 3601034 - RNA, 14 nt, Human
aagucucugugaau

SEQ ID NO: 3601035 - RNA, 16 nt, Human
aagucucuuuuuuaca

SEQ ID NO: 3601036 - RNA, 18 nt, Human
aagucucuuuuuuacaaa

SEQ ID NO: 3601037 - RNA, 22 nt, Human
aagucucuuuuuuuggcccagg

SEQ ID NO: 3601038 - RNA, 22 nt, Human
aagucugcucucauauaagaca

SEQ ID NO: 3601039 - RNA, 15 nt, Human
aagucugucuuuccu

SEQ ID NO: 3601040 - RNA, 22 nt, Human
aagucugugagauucauucaug

SEQ ID NO: 3601041 - RNA, 18 nt, Human
aagucugugccuggagcu

SEQ ID NO: 3601042 - RNA, 20 nt, Human
aagucuguugauuaaagaug

SEQ ID NO: 3601043 - RNA, 20 nt, Human
aaggauuuuaugcuuuaaac

SEQ ID NO: 3601044 - RNA, 22 nt, Human
aaggauuuuaugcuuuaaacau

SEQ ID NO: 3601045 - RNA, 23 nt, Human
aaggauuuuaugcuuuaaacauu

SEQ ID NO: 3601046 - RNA, 15 nt, Human
aaggauuuuuuaaag

SEQ ID NO: 3601047 - RNA, 21 nt, Human
aaggauuuuuuaaaguuuuuu

SEQ ID NO: 3601048 - RNA, 19 nt, Human
aaggcaaaauugcaaaucu

SEQ ID NO: 3601049 - RNA, 20 nt, Human
aaggcaaagcacgaaauguu

SEQ ID NO: 3601050 - RNA, 14 nt, Human
aaggcaaaugacuu

SEQ ID NO: 3601051 - RNA, 17 nt, Human
aaggcaaaugcccaagg

SEQ ID NO: 3601052 - RNA, 21 nt, Human
aaggcaagaggggguggaggg

SEQ ID NO: 3601053 - RNA, 18 nt, Human
aaggcaagcacuuguggg

SEQ ID NO: 3601054 - RNA, 15 nt, Human
aaggcaagccaggcu

SEQ ID NO: 3601055 - RNA, 23 nt, Human
aaggcaagccaggcucacucaca

SEQ ID NO: 3601056 - RNA, 18 nt, Human
aaggcaaggcugucaauu

SEQ ID NO: 3601057 - RNA, 17 nt, Human
aaggcaaguuaagagaa

SEQ ID NO: 3601058 - RNA, 19 nt, Human
aaggcaaguuaagagaaac

SEQ ID NO: 3601059 - RNA, 22 nt, Human
aaggcaaugccauccucaaaca

SEQ ID NO: 3601060 - RNA, 22 nt, Human
aaggcacccaucugucugccaa

SEQ ID NO: 3601061 - RNA, 16 nt, Human
aaggcacuugaggggg

SEQ ID NO: 3601062 - RNA, 15 nt, Human
aaggcagaaagcaaa

SEQ ID NO: 3601063 - RNA, 16 nt, Human
aaggcagaaagcaaaa

SEQ ID NO: 3601064 - RNA, 14 nt, Human
aaggcagaagcagc

SEQ ID NO: 3601065 - RNA, 14 nt, Human
aaggcagacagcag

SEQ ID NO: 3601066 - RNA, 13 nt, Human
aaggcagagaaau

SEQ ID NO: 3601067 - RNA, 18 nt, Human
aaggcagaggccugggcu

SEQ ID NO: 3601068 - RNA, 19 nt, Human
aaggcagaggccugggcug

SEQ ID NO: 3601069 - RNA, 16 nt, Human
aaggcagcaaggcccg

SEQ ID NO: 3601070 - RNA, 16 nt, Human
aaggcagcauguauag

SEQ ID NO: 3601071 - RNA, 14 nt, Human
aaggcagccaccag

SEQ ID NO: 3601072 - RNA, 12 nt, Human
aaggcaggaaga

SEQ ID NO: 3601073 - RNA, 14 nt, Human
aaggcaggaagaga

SEQ ID NO: 3601074 - RNA, 15 nt, Human
aaggcaggccuauuu

SEQ ID NO: 3601075 - RNA, 17 nt, Human
aaggcaggccuauuuca

SEQ ID NO: 3601076 - RNA, 18 nt, Human
aaggcagggaaaggcucu

SEQ ID NO: 3601077 - RNA, 14 nt, Human
aaggcagggaggag

SEQ ID NO: 3601078 - RNA, 19 nt, Human
aaggcagggaggaggcaga

SEQ ID NO: 3601079 - RNA, 20 nt, Human
aaggcaggggaauguaugug

SEQ ID NO: 3601080 - RNA, 22 nt, Human
aaggcaguuaccauuaaaccau

SEQ ID NO: 3601081 - RNA, 19 nt, Human
aaggcaguuugcaaaaaau

SEQ ID NO: 3601082 - RNA, 22 nt, Human
aaggcauacgagagcagagguc

SEQ ID NO: 3601083 - RNA, 20 nt, Human
aaggcaucagucccuaugua

SEQ ID NO: 3601084 - RNA, 17 nt, Human
aaggcaucugacaugca

SEQ ID NO: 3601085 - RNA, 17 nt, Human
aaggcauggacuucugg

SEQ ID NO: 3601086 - RNA, 19 nt, Human
aaggcauuauaaaaagaau

SEQ ID NO: 3601087 - RNA, 14 nt, Human
aaggcauucucuga

SEQ ID NO: 3601088 - RNA, 21 nt, Human
aaggccaauaaagaguuagaa

SEQ ID NO: 3601089 - RNA, 21 nt, Human
aaggccaccucuuccuggccg

SEQ ID NO: 3601090 - RNA, 22 nt, Human
aaggccaccucuuccuggccgg

SEQ ID NO: 3601091 - RNA, 20 nt, Human
aaggccagaccugcagacgc

SEQ ID NO: 3601092 - RNA, 17 nt, Human
aaggccagaguggccug

SEQ ID NO: 3601093 - RNA, 21 nt, Human
aaggccagaguggccuggcca

SEQ ID NO: 3601094 - RNA, 13 nt, Human
aaggccagcacuc

SEQ ID NO: 3601095 - RNA, 17 nt, Human
aaggccagcuggcagca

SEQ ID NO: 3601096 - RNA, 19 nt, Human
aaggccagcuggcagcaga

SEQ ID NO: 3601097 - RNA, 18 nt, Human
aaggccaggggcuuuugc

SEQ ID NO: 3601098 - RNA, 17 nt, Human
aaggccauaaaacaggu

SEQ ID NO: 3601099 - RNA, 22 nt, Human
aaggccauccuucccugucugc

SEQ ID NO: 3601100 - RNA, 21 nt, Human
aaggcccagagagaagagccc

SEQ ID NO: 3601101 - RNA, 15 nt, Human
aaggcccagccccua

SEQ ID NO: 3601102 - RNA, 16 nt, Human
aaggcccagccccuag

SEQ ID NO: 3601103 - RNA, 18 nt, Human
aaggccccaagguuuaca

SEQ ID NO: 3601104 - RNA, 14 nt, Human
aaggcccgagcagc

SEQ ID NO: 3601105 - RNA, 13 nt, Human
aaggcccugcuga

SEQ ID NO: 3601106 - RNA, 19 nt, Human
aaggccgaagcucuggcug

SEQ ID NO: 3601107 - RNA, 14 nt, Human
aaggccgagaagca

SEQ ID NO: 3601108 - RNA, 18 nt, Human
aaggccgagaagcaagaa

SEQ ID NO: 3601109 - RNA, 13 nt, Human
aaggccucccaca

SEQ ID NO: 3601110 - RNA, 15 nt, Human
aaggccucccacagu

SEQ ID NO: 3601111 - RNA, 17 nt, Human
aaggccucccacaguga

SEQ ID NO: 3601112 - RNA, 17 nt, Human
aaggccucgcaggaaga

SEQ ID NO: 3601113 - RNA, 15 nt, Human
aaggccugcacacaa

SEQ ID NO: 3601114 - RNA, 15 nt, Human
aaggccuggggugac

SEQ ID NO: 3601115 - RNA, 20 nt, Human
aaggccugguguuucuugau

SEQ ID NO: 3601116 - RNA, 15 nt, Human
aaggccuuaauaugu

SEQ ID NO: 3601117 - RNA, 12 nt, Human
aaggccuucucc

SEQ ID NO: 3601118 - RNA, 11 nt, Human
aaggccuuuaa

SEQ ID NO: 3601119 - RNA, 22 nt, Human
aaggcgcuaacuugcuuaaaug

SEQ ID NO: 3601120 - RNA, 12 nt, Human
aaggcgcugaga

SEQ ID NO: 3601121 - RNA, 22 nt, Human
aaggcgguggacuugaacuuuc

SEQ ID NO: 3601122 - RNA, 16 nt, Human
aaggcguggagcugcc

SEQ ID NO: 3601123 - RNA, 18 nt, Human
aaggcguggagcugccug

SEQ ID NO: 3601124 - RNA, 17 nt, Human
aaggcuaaaaagcaaca

SEQ ID NO: 3601125 - RNA, 13 nt, Human
aaggcuaccuuug

SEQ ID NO: 3601126 - RNA, 14 nt, Human
aaggcuagaaccac

SEQ ID NO: 3601127 - RNA, 15 nt, Human
aaggcuaugugauua

SEQ ID NO: 3601128 - RNA, 15 nt, Human
aaggcuccaggagca

SEQ ID NO: 3601129 - RNA, 18 nt, Human
aaggcuccugaucauucu

SEQ ID NO: 3601130 - RNA, 18 nt, Human
aaggcucgagcaugccug

SEQ ID NO: 3601131 - RNA, 23 nt, Human
aaggcucgauuuuguaucugcag

SEQ ID NO: 3601132 - RNA, 22 nt, Human
aagaauauucagagaauaucaa

SEQ ID NO: 3601133 - RNA, 23 nt, Human
aagaauauugcaaaauacaugaa

SEQ ID NO: 3601134 - RNA, 18 nt, Human
aagaauauuguauuguua

SEQ ID NO: 3601135 - RNA, 15 nt, Human
aagaauauuugaaug

SEQ ID NO: 3601136 - RNA, 23 nt, Human
aagaaucagagaaggaacauacc

SEQ ID NO: 3601137 - RNA, 22 nt, Human
aagaaucagaguagaaauaaaa

SEQ ID NO: 3601138 - RNA, 17 nt, Human
aagaauccacauuucua

SEQ ID NO: 3601139 - RNA, 13 nt, Human
aagaauccuuuug

SEQ ID NO: 3601140 - RNA, 19 nt, Human
aagaaucuaucugcuuaug

SEQ ID NO: 3601141 - RNA, 20 nt, Human
aagaaucuugguuugccuuc

SEQ ID NO: 3601142 - RNA, 18 nt, Human
aagaaugaagguuuuugu

SEQ ID NO: 3601143 - RNA, 23 nt, Human
aagaaugaagguuuuuguaaaga

SEQ ID NO: 3601144 - RNA, 16 nt, Human
aagaaugacuauauaa

SEQ ID NO: 3601145 - RNA, 22 nt, Human
aagaaugagccuacgcugaaga

SEQ ID NO: 3601146 - RNA, 14 nt, Human
aagaaugaguuucu

SEQ ID NO: 3601147 - RNA, 19 nt, Human
aagaaugaucugauugacc

SEQ ID NO: 3601148 - RNA, 16 nt, Human
aagaaugauuaugaau

SEQ ID NO: 3601149 - RNA, 17 nt, Human
aagaaugcacaagaaug

SEQ ID NO: 3601150 - RNA, 19 nt, Human
aagaaugcacaagaaugga

SEQ ID NO: 3601151 - RNA, 15 nt, Human
aagaaugcaugcuuu

SEQ ID NO: 3601152 - RNA, 20 nt, Human
aagaaugcauugauauugug

SEQ ID NO: 3601153 - RNA, 23 nt, Human
aagaaugcauugauauugugaac

SEQ ID NO: 3601154 - RNA, 18 nt, Human
aagaaugcugguuuuccu

SEQ ID NO: 3601155 - RNA, 22 nt, Human
aagaaugcugguuuuccuaaau

SEQ ID NO: 3601156 - RNA, 17 nt, Human
aagaauggcagaaaagu

SEQ ID NO: 3601157 - RNA, 21 nt, Human
aagaaugggcaguuacaugca

SEQ ID NO: 3601158 - RNA, 20 nt, Human
aagaauggggaucacagaga

SEQ ID NO: 3601159 - RNA, 12 nt, Human
aagaauguaaag

SEQ ID NO: 3601160 - RNA, 21 nt, Human
aagaauguguuuaaacuuggu

SEQ ID NO: 3601161 - RNA, 19 nt, Human
aagaauguuacugccuuaa

SEQ ID NO: 3601162 - RNA, 15 nt, Human
aagaauguuagagua

SEQ ID NO: 3601163 - RNA, 19 nt, Human
aagaauguugguuuacuuu

SEQ ID NO: 3601164 - RNA, 15 nt, Human
aagaauguuuauagc

SEQ ID NO: 3601165 - RNA, 11 nt, Human
aagaauuauuu

SEQ ID NO: 3601166 - RNA, 14 nt, Human
aagaauuauuuugu

SEQ ID NO: 3601167 - RNA, 19 nt, Human
aagaauucaaacuggggcc

SEQ ID NO: 3601168 - RNA, 14 nt, Human
aagaauucagauug

SEQ ID NO: 3601169 - RNA, 19 nt, Human
aagaauucugauugauuug

SEQ ID NO: 3601170 - RNA, 19 nt, Human
aagaauucuuauacacauu

SEQ ID NO: 3601171 - RNA, 20 nt, Human
aagaauugaccaucugcuuu

SEQ ID NO: 3601172 - RNA, 22 nt, Human
aagaauugaccaucugcuuuua

SEQ ID NO: 3601173 - RNA, 16 nt, Human
aagaauugaguaaugg

SEQ ID NO: 3601174 - RNA, 22 nt, Human
aagaauugugguuuauauauuu

SEQ ID NO: 3601175 - RNA, 23 nt, Human
aagaauugugguuuauauauuua

SEQ ID NO: 3601176 - RNA, 14 nt, Human
aagaauuuaaagaa

SEQ ID NO: 3601177 - RNA, 16 nt, Human
aagaauuuaguauuau

SEQ ID NO: 3601178 - RNA, 15 nt, Human
aagaauuucaauuug

SEQ ID NO: 3601179 - RNA, 24 nt, Human
aagaauuucuaggacugaauuaug

SEQ ID NO: 3601180 - RNA, 20 nt, Human
aagaauuucuugguaagaag

SEQ ID NO: 3601181 - RNA, 16 nt, Human
aagaauuuuaaaaaug

SEQ ID NO: 3601182 - RNA, 19 nt, Human
aagaauuuuaaaaaugaau

SEQ ID NO: 3601183 - RNA, 20 nt, Human
aagaauuuucagaccccagc

SEQ ID NO: 3601184 - RNA, 16 nt, Human
aagaauuuuuuauuuu

SEQ ID NO: 3601185 - RNA, 14 nt, Human
aagaauuuuuuugu

SEQ ID NO: 3601186 - RNA, 15 nt, Human
aagaauuuuuuuguc

SEQ ID NO: 3601187 - RNA, 15 nt, Human
aagaauuuuuuuuaa

SEQ ID NO: 3601188 - RNA, 15 nt, Human
aagacaaaaauacuc

SEQ ID NO: 3601189 - RNA, 21 nt, Human
aagacaaaaauacucuaauuc

SEQ ID NO: 3601190 - RNA, 22 nt, Human
aagacaaaagucugucuuuccu

SEQ ID NO: 3601191 - RNA, 18 nt, Human
aagacaaacuuugcaucu

SEQ ID NO: 3601192 - RNA, 22 nt, Human
aagacaaaucaacagaagcauu

SEQ ID NO: 3601193 - RNA, 16 nt, Human
aagacaaauucuguuu

SEQ ID NO: 3601194 - RNA, 18 nt, Human
aagacaaauucuguuucu

SEQ ID NO: 3601195 - RNA, 13 nt, Human
aagacaagaaaau

SEQ ID NO: 3601196 - RNA, 16 nt, Human
aagacaauccauguaa

SEQ ID NO: 3601197 - RNA, 15 nt, Human
aagacaaugacauac

SEQ ID NO: 3601198 - RNA, 20 nt, Human
aagacaaugugaaaagaaaa

SEQ ID NO: 3601199 - RNA, 11 nt, Human
aagacaauucu

SEQ ID NO: 3601200 - RNA, 23 nt, Human
aagacacaggggacacccagaaa

SEQ ID NO: 3601201 - RNA, 15 nt, Human
aagacaccagagcag

SEQ ID NO: 3601202 - RNA, 22 nt, Human
aagacaccagagcagaugcaga

SEQ ID NO: 3601203 - RNA, 18 nt, Human
aagacaccguucauucag

SEQ ID NO: 3601204 - RNA, 21 nt, Human
aagacacugaaauauacacac

SEQ ID NO: 3601205 - RNA, 22 nt, Human
aagacacugaaauauacacaca

SEQ ID NO: 3601206 - RNA, 11 nt, Human
aagacacugcc

SEQ ID NO: 3601207 - RNA, 17 nt, Human
aagacacugccugggcu

SEQ ID NO: 3601208 - RNA, 18 nt, Human
aagacagaaguuugcacu

SEQ ID NO: 3601209 - RNA, 16 nt, Human
aagacagaugccccag

SEQ ID NO: 3601210 - RNA, 16 nt, Human
aagacagcauuugugu

SEQ ID NO: 3601211 - RNA, 14 nt, Human
aagacaguggcccc

SEQ ID NO: 3601212 - RNA, 14 nt, Human
aagacauaacguuu

SEQ ID NO: 3601213 - RNA, 20 nt, Human
aaguguauuuuauaaaauua

SEQ ID NO: 3601214 - RNA, 22 nt, Human
aaguguauuuuauaaaauuaaa

SEQ ID NO: 3601215 - RNA, 21 nt, Human
aaguguauuuugaaauuguuu

SEQ ID NO: 3601216 - RNA, 13 nt, Human
aaguguauuuuuc

SEQ ID NO: 3601217 - RNA, 17 nt, Human
aagugucaacucuuugu

SEQ ID NO: 3601218 - RNA, 13 nt, Human
aagugucauguuu

SEQ ID NO: 3601219 - RNA, 18 nt, Human
aaguguccauugacaugu

SEQ ID NO: 3601220 - RNA, 14 nt, Human
aaguguccuucuug

SEQ ID NO: 3601221 - RNA, 19 nt, Human
aagugucucacuaaagcau

SEQ ID NO: 3601222 - RNA, 19 nt, Human
aagugucucaguccaccug

SEQ ID NO: 3601223 - RNA, 21 nt, Human
aagugugaacuggacccuguu

SEQ ID NO: 3601224 - RNA, 14 nt, Human
aagugugaauacug

SEQ ID NO: 3601225 - RNA, 15 nt, Human
aagugugaauacugc

SEQ ID NO: 3601226 - RNA, 16 nt, Human
aagugugaauacugcu

SEQ ID NO: 3601227 - RNA, 20 nt, Human
aagugugaauacugcuugaa

SEQ ID NO: 3601228 - RNA, 18 nt, Human
aagugugaguaagagcug

SEQ ID NO: 3601229 - RNA, 21 nt, Human
aagugugaguaagagcuggug

SEQ ID NO: 3601230 - RNA, 18 nt, Human
aagugugcauauuguaca

SEQ ID NO: 3601231 - RNA, 22 nt, Human
aagugugcauauuguacacuuu

SEQ ID NO: 3601232 - RNA, 20 nt, Human
aaguguggggauuuucacug

SEQ ID NO: 3601233 - RNA, 17 nt, Human
aagugugggucugugug

SEQ ID NO: 3601234 - RNA, 19 nt, Human
aaguguguauauauuuugu

SEQ ID NO: 3601235 - RNA, 22 nt, Human
aaguguguaugugcgugugugc

SEQ ID NO: 3601236 - RNA, 16 nt, Human
aaguguguauuaaaaa

SEQ ID NO: 3601237 - RNA, 18 nt, Human
aagugugugauugaaggu

SEQ ID NO: 3601238 - RNA, 18 nt, Human
aagugugugguagaaaca

SEQ ID NO: 3601239 - RNA, 16 nt, Human
aaguguguguuuuuca

SEQ ID NO: 3601240 - RNA, 16 nt, Human
aaguguguuguugcuu

SEQ ID NO: 3601241 - RNA, 21 nt, Human
aaguguguuuccuucagugca

SEQ ID NO: 3601242 - RNA, 14 nt, Human
aaguguucauuguu

SEQ ID NO: 3601243 - RNA, 16 nt, Human
aaguguucuguuacaa

SEQ ID NO: 3601244 - RNA, 19 nt, Human
aaguguucuguuacaaaau

SEQ ID NO: 3601245 - RNA, 21 nt, Human
aaguguucuguuacaaaaugu

SEQ ID NO: 3601246 - RNA, 23 nt, Human
aaguguucuguuacaaaauguaa

SEQ ID NO: 3601247 - RNA, 16 nt, Human
aaguguuggaaaaaau

SEQ ID NO: 3601248 - RNA, 23 nt, Human
aaguguuggcuaaugaagggaaa

SEQ ID NO: 3601249 - RNA, 22 nt, Human
aaguguuguaaauauuuaugua

SEQ ID NO: 3601250 - RNA, 19 nt, Human
aaguguuuauuuuucauau

SEQ ID NO: 3601251 - RNA, 23 nt, Human
aaguguuucauaaauuugagagu

SEQ ID NO: 3601252 - RNA, 21 nt, Human
aaguguuucuguuauuaacaa

SEQ ID NO: 3601253 - RNA, 13 nt, Human
aaguguuuucaga

SEQ ID NO: 3601254 - RNA, 14 nt, Human
aaguguuuucagag

SEQ ID NO: 3601255 - RNA, 18 nt, Human
aaguguuuuguaccagug

SEQ ID NO: 3601256 - RNA, 21 nt, Human
aaguuaaaaaaaauaauaaau

SEQ ID NO: 3601257 - RNA, 17 nt, Human
aaguuaaagugaauaac

SEQ ID NO: 3601258 - RNA, 13 nt, Human
aaguuaaauguag

SEQ ID NO: 3601259 - RNA, 18 nt, Human
aaguuaagagaaacuuua

SEQ ID NO: 3601260 - RNA, 16 nt, Human
aaguuaagauucuugg

SEQ ID NO: 3601261 - RNA, 14 nt, Human
aaguuaauaagcaa

SEQ ID NO: 3601262 - RNA, 12 nt, Human
aaguuaauagau

SEQ ID NO: 3601263 - RNA, 19 nt, Human
aaguuaauccacugugacu

SEQ ID NO: 3601264 - RNA, 16 nt, Human
aaguuaaugcuuaaga

SEQ ID NO: 3601265 - RNA, 16 nt, Human
aaguuaauuuaaaguu

SEQ ID NO: 3601266 - RNA, 18 nt, Human
aaguuacaacuuccuaau

SEQ ID NO: 3601267 - RNA, 19 nt, Human
aaguuacagaaauacuaua

SEQ ID NO: 3601268 - RNA, 16 nt, Human
aaguuacuauccuggc

SEQ ID NO: 3601269 - RNA, 19 nt, Human
aaguuagaacauuugcugu

SEQ ID NO: 3601270 - RNA, 15 nt, Human
aaguuagaaucuauu

SEQ ID NO: 3601271 - RNA, 17 nt, Human
aaguuagaauuccuuca

SEQ ID NO: 3601272 - RNA, 14 nt, Human
aaguuagcucagga

SEQ ID NO: 3601273 - RNA, 16 nt, Human
aaguuagcuuuaacuu

SEQ ID NO: 3601274 - RNA, 16 nt, Human
aaguuaguaggauaug

SEQ ID NO: 3601275 - RNA, 23 nt, Human
aaguuagucuacucuuaagccau

SEQ ID NO: 3601276 - RNA, 23 nt, Human
aaguuaguggaaaucugaacauu

SEQ ID NO: 3601277 - RNA, 19 nt, Human
aaguuauaaaucaauguca

SEQ ID NO: 3601278 - RNA, 13 nt, Human
aaguuauaguacu

SEQ ID NO: 3601279 - RNA, 17 nt, Human
aaguuauagugaauacu

SEQ ID NO: 3601280 - RNA, 23 nt, Human
aaguuauauaaagagaaaauuga

SEQ ID NO: 3601281 - RNA, 12 nt, Human
aaguuauauuuc

SEQ ID NO: 3601282 - RNA, 23 nt, Human
aaguuauauuucagauguaaugu

SEQ ID NO: 3601283 - RNA, 14 nt, Human
aaguuauauuuccu

SEQ ID NO: 3601284 - RNA, 22 nt, Human
aaguuaucagacacucuggcug

SEQ ID NO: 3601285 - RNA, 17 nt, Human
aaguuauuaacuuuaau

SEQ ID NO: 3601286 - RNA, 21 nt, Human
aaguuauuaagagguaagacu

SEQ ID NO: 3601287 - RNA, 19 nt, Human
aaguuauuaauauuuuaau

SEQ ID NO: 3601288 - RNA, 18 nt, Human
aaguuauugacaaacucu

SEQ ID NO: 3601289 - RNA, 15 nt, Human
aaguuauugcaguuu

SEQ ID NO: 3601290 - RNA, 23 nt, Human
aaguuauugcaguuuaucauuca

SEQ ID NO: 3601291 - RNA, 11 nt, Human
aaguuauugua

SEQ ID NO: 3601292 - RNA, 20 nt, Human
aaguuauuguacagcuguuu

SEQ ID NO: 3601293 - RNA, 10 nt, Human
aaguuauuuu

SEQ ID NO: 3601294 - RNA, 14 nt, Human
aaguuauuuuaccu

SEQ ID NO: 3601295 - RNA, 16 nt, Human
aaguuauuuuuguaca

SEQ ID NO: 3601296 - RNA, 17 nt, Human
aaguuauuuuuguacau

SEQ ID NO: 3601297 - RNA, 19 nt, Human
aaguucaaucuguuuuuca

SEQ ID NO: 3601298 - RNA, 11 nt, Human
aaguucacaaa

SEQ ID NO: 3601299 - RNA, 19 nt, Human
aaguucagaguuuucuggg

SEQ ID NO: 3601300 - RNA, 22 nt, Human
aaguucagcacuugucucauuu

SEQ ID NO: 3601301 - RNA, 15 nt, Human
aaguucauacauugu

SEQ ID NO: 3601302 - RNA, 22 nt, Human
aaguucauaccuaaguacugua

SEQ ID NO: 3601303 - RNA, 14 nt, Human
aaguucauaggguc

SEQ ID NO: 3601304 - RNA, 15 nt, Human
aaguucauauuccau

SEQ ID NO: 3601305 - RNA, 22 nt, Human
aaguucauauuccauauuuauu

SEQ ID NO: 3601306 - RNA, 18 nt, Human
aaguucccaguuggagcu

SEQ ID NO: 3601307 - RNA, 20 nt, Human
aaguuccuuauguauauuua

SEQ ID NO: 3601308 - RNA, 12 nt, Human
aaguucgucugu

SEQ ID NO: 3601309 - RNA, 11 nt, Human
aaguucuaaga

SEQ ID NO: 3601310 - RNA, 21 nt, Human
aaguucuaagauucuaaugau

SEQ ID NO: 3601311 - RNA, 21 nt, Human
aaguucuaguguuuucaauuu

SEQ ID NO: 3601312 - RNA, 22 nt, Human
aaguucuaguguuuucaauuuu

SEQ ID NO: 3601313 - RNA, 21 nt, Human
aaguucuauuggaaaaaccac

SEQ ID NO: 3601314 - RNA, 12 nt, Human
aaguucuauuua

SEQ ID NO: 3601315 - RNA, 15 nt, Human
aaguucugacuugac

SEQ ID NO: 3601316 - RNA, 15 nt, Human
aaguucugaguguuu

SEQ ID NO: 3601317 - RNA, 17 nt, Human
aaguucugcagauaaac

SEQ ID NO: 3601318 - RNA, 22 nt, Human
aaguucugccucugauguauuu

SEQ ID NO: 3601319 - RNA, 19 nt, Human
aaguucuguacucaaaugu

SEQ ID NO: 3601320 - RNA, 16 nt, Human
aaguucuguguauuua

SEQ ID NO: 3601321 - RNA, 20 nt, Human
aaguucuguguuuaauuucu

SEQ ID NO: 3601322 - RNA, 14 nt, Human
aaguucuuagauau

SEQ ID NO: 3601323 - RNA, 15 nt, Human
aaguucuuagauauc

SEQ ID NO: 3601324 - RNA, 17 nt, Human
aaguucuuagauaucuu

SEQ ID NO: 3601325 - RNA, 22 nt, Human
aaguucuuaguugcuguauguc

SEQ ID NO: 3601326 - RNA, 15 nt, Human
aaguugaaaaucaua

SEQ ID NO: 3601327 - RNA, 21 nt, Human
aaguugaaaaucauaggcacc

SEQ ID NO: 3601328 - RNA, 23 nt, Human
aaguugaauugaggggauuaaua

SEQ ID NO: 3601329 - RNA, 14 nt, Human
aaguugaauuuauu

SEQ ID NO: 3601330 - RNA, 15 nt, Human
aaguugaauuuauug

SEQ ID NO: 3601331 - RNA, 17 nt, Human
aaguugaauuuauuggc

SEQ ID NO: 3601332 - RNA, 16 nt, Human
aaguugacuuauagua

SEQ ID NO: 3601333 - RNA, 23 nt, Human
aaguugacuuauaguacaugaua

SEQ ID NO: 3601334 - RNA, 16 nt, Human
aaguugagauaguuuu

SEQ ID NO: 3601335 - RNA, 18 nt, Human
aaguugagauaguuuuca

SEQ ID NO: 3601336 - RNA, 16 nt, Human
aaguugagcaaacauu

SEQ ID NO: 3601337 - RNA, 16 nt, Human
aaguugagcuaugacu

SEQ ID NO: 3601338 - RNA, 17 nt, Human
aaguugaggauuguuga

SEQ ID NO: 3601339 - RNA, 14 nt, Human
aaguugaggcauuu

SEQ ID NO: 3601340 - RNA, 16 nt, Human
aaguugaguauauuau

SEQ ID NO: 3601341 - RNA, 17 nt, Human
aaguugauauagaacag

SEQ ID NO: 3601342 - RNA, 22 nt, Human
aaguugauaugccuuuucccaa

SEQ ID NO: 3601343 - RNA, 14 nt, Human
aaguugauuagaaa

SEQ ID NO: 3601344 - RNA, 16 nt, Human
aaguugcacggcugcu

SEQ ID NO: 3601345 - RNA, 18 nt, Human
aaguugcacugauauuuu

SEQ ID NO: 3601346 - RNA, 19 nt, Human
aaguugcauuccuuugucu

SEQ ID NO: 3601347 - RNA, 16 nt, Human
aaguugccuaaaucca

SEQ ID NO: 3601348 - RNA, 17 nt, Human
aaguugccuaaauccau

SEQ ID NO: 3601349 - RNA, 16 nt, Human
aaguugcugaugaacu

SEQ ID NO: 3601350 - RNA, 23 nt, Human
aaguugcugcuucucccaggcaa

SEQ ID NO: 3601351 - RNA, 21 nt, Human
aaguuggaaacacuaaauguu

SEQ ID NO: 3601352 - RNA, 22 nt, Human
aaguuggaaacacuaaauguua

SEQ ID NO: 3601353 - RNA, 22 nt, Human
aaguuggacuaaaugccuaguu

SEQ ID NO: 3601354 - RNA, 19 nt, Human
aaguuggcuucuguuucua

SEQ ID NO: 3601355 - RNA, 19 nt, Human
aaguugggaucuaggagag

SEQ ID NO: 3601356 - RNA, 19 nt, Human
aaguugggcaauauaacca

SEQ ID NO: 3601357 - RNA, 17 nt, Human
aaguugggcuugcuauu

SEQ ID NO: 3601358 - RNA, 21 nt, Human
aaguuggguuaauaccagcuu

SEQ ID NO: 3601359 - RNA, 19 nt, Human
aaguuguaacuuauauuga

SEQ ID NO: 3601360 - RNA, 22 nt, Human
aaguuguaugaucugugccuuu

SEQ ID NO: 3601361 - RNA, 19 nt, Human
aaguugugccuuuuauagc

SEQ ID NO: 3601362 - RNA, 20 nt, Human
aaguugugcuugagccagga

SEQ ID NO: 3601363 - RNA, 15 nt, Human
aaguugugcuuguuu

SEQ ID NO: 3601364 - RNA, 19 nt, Human
aaguuguggauuucaguuu

SEQ ID NO: 3601365 - RNA, 20 nt, Human
aaguuguuacuaacuaaacu

SEQ ID NO: 3601366 - RNA, 23 nt, Human
aaguuguuacuaacuaaacucuc

SEQ ID NO: 3601367 - RNA, 12 nt, Human
aaguuguuugag

SEQ ID NO: 3601368 - RNA, 13 nt, Human
aaguuguuugcau

SEQ ID NO: 3601369 - RNA, 12 nt, Human
aaguuuaaaaca

SEQ ID NO: 3601370 - RNA, 17 nt, Human
aaguuuaauaaauuuau

SEQ ID NO: 3601371 - RNA, 18 nt, Human
aaguuuaauauuaaagcc

SEQ ID NO: 3601372 - RNA, 19 nt, Human
aaguuuaauauuaaagcca

SEQ ID NO: 3601373 - RNA, 21 nt, Human
aaguuuaauauuaaagccaug

SEQ ID NO: 3601374 - RNA, 23 nt, Human
aaguuuacaaguguauaucagaa

SEQ ID NO: 3601375 - RNA, 12 nt, Human
aaguuuacagua

SEQ ID NO: 3601376 - RNA, 19 nt, Human
aaguuuacaguaaauaaau

SEQ ID NO: 3601377 - RNA, 20 nt, Human
aaguuuacaguaaauaaauu

SEQ ID NO: 3601378 - RNA, 12 nt, Human
aaguuuacauuu

SEQ ID NO: 3601379 - RNA, 22 nt, Human
aaguuuacauuuuuauuuauga

SEQ ID NO: 3601380 - RNA, 19 nt, Human
aaguuuacucaacccucuc

SEQ ID NO: 3601381 - RNA, 13 nt, Human
aaguuuagcucug

SEQ ID NO: 3601382 - RNA, 18 nt, Human
aaguuuauacaguacagu

SEQ ID NO: 3601383 - RNA, 18 nt, Human
aaguuuaucaguaaauaa

SEQ ID NO: 3601384 - RNA, 17 nt, Human
aaguuuaugucuaaaga

SEQ ID NO: 3601385 - RNA, 14 nt, Human
aaguuuaugucuca

SEQ ID NO: 3601386 - RNA, 16 nt, Human
aaguuuauucucauuu

SEQ ID NO: 3601387 - RNA, 22 nt, Human
aaguuucaaugugauucuaaug

SEQ ID NO: 3601388 - RNA, 20 nt, Human
aaguuucacugacuuagaac

SEQ ID NO: 3601389 - RNA, 21 nt, Human
aaguuucagagaccauugcaa

SEQ ID NO: 3601390 - RNA, 16 nt, Human
aaguuucagaguauau

SEQ ID NO: 3601391 - RNA, 12 nt, Human
aaguuucauuua

SEQ ID NO: 3601392 - RNA, 14 nt, Human
aaguuucccuuccu

SEQ ID NO: 3601393 - RNA, 18 nt, Human
aaguuuccuuccagccca

SEQ ID NO: 3601394 - RNA, 11 nt, Human
aaguuucuaag

SEQ ID NO: 3601395 - RNA, 17 nt, Human
aaguuucuaagauucua

SEQ ID NO: 3601396 - RNA, 20 nt, Human
aaguuucuaagauucuaaag

SEQ ID NO: 3601397 - RNA, 19 nt, Human
aaguuucuagcuagaaaua

SEQ ID NO: 3601398 - RNA, 14 nt, Human
aaguuucucagcuc

SEQ ID NO: 3601399 - RNA, 18 nt, Human
aaguuucucagcucccau

SEQ ID NO: 3601400 - RNA, 13 nt, Human
aaguuucucuucu

SEQ ID NO: 3601401 - RNA, 19 nt, Human
aaguuucugccgcagcccu

SEQ ID NO: 3601402 - RNA, 21 nt, Human
aaguuucugccgcagcccugc

SEQ ID NO: 3601403 - RNA, 16 nt, Human
aaguuucuuugcuuca

SEQ ID NO: 3601404 - RNA, 17 nt, Human
aaguuugaaggaaacag

SEQ ID NO: 3601405 - RNA, 14 nt, Human
aaguuugaauguua

SEQ ID NO: 3601406 - RNA, 15 nt, Human
aaguuugaauguuaa

SEQ ID NO: 3601407 - RNA, 20 nt, Human
aaguuugagaucagccuggg

SEQ ID NO: 3601408 - RNA, 17 nt, Human
aaguuugauaaauagug

SEQ ID NO: 3601409 - RNA, 19 nt, Human
aaguuugcacuaucuuuca

SEQ ID NO: 3601410 - RNA, 13 nt, Human
aaguuugcuuaga

SEQ ID NO: 3601411 - RNA, 19 nt, Human
aaguuugcuuguuucuugg

SEQ ID NO: 3601412 - RNA, 22 nt, Human
aaguuuguguucuguuuguuaa

SEQ ID NO: 3601413 - RNA, 14 nt, Human
aaguuuguuuuuaa

SEQ ID NO: 3601414 - RNA, 17 nt, Human
aaguuuuaaaaagccag

SEQ ID NO: 3601415 - RNA, 14 nt, Human
aaguuuuaggacaa

SEQ ID NO: 3601416 - RNA, 19 nt, Human
aaguuuuaggguacaugug

SEQ ID NO: 3601417 - RNA, 21 nt, Human
aaguuuuauauauuauaugga

SEQ ID NO: 3601418 - RNA, 15 nt, Human
aaguuuucaaugaug

SEQ ID NO: 3601419 - RNA, 16 nt, Human
aauauccuaaacauca

SEQ ID NO: 3601420 - RNA, 21 nt, Human
aauauccuaauaaaaagguga

SEQ ID NO: 3601421 - RNA, 13 nt, Human
aauauccugcuug

SEQ ID NO: 3601422 - RNA, 20 nt, Human
aauaucuaaaguuauauuuc

SEQ ID NO: 3601423 - RNA, 13 nt, Human
aauaucugaaaug

SEQ ID NO: 3601424 - RNA, 19 nt, Human
aauaucugaacauuuacua

SEQ ID NO: 3601425 - RNA, 16 nt, Human
aauaucugcuguaugu

SEQ ID NO: 3601426 - RNA, 13 nt, Human
aauaucugggauu

SEQ ID NO: 3601427 - RNA, 21 nt, Human
aauaucugggauucuacuuua

SEQ ID NO: 3601428 - RNA, 17 nt, Human
aauaucuguaaugguac

SEQ ID NO: 3601429 - RNA, 13 nt, Human
aauaucuguauuu

SEQ ID NO: 3601430 - RNA, 14 nt, Human
aauaucuguauuua

SEQ ID NO: 3601431 - RNA, 20 nt, Human
aauaucuguauuuaauuuug

SEQ ID NO: 3601432 - RNA, 19 nt, Human
aauaucugugaaauaucau

SEQ ID NO: 3601433 - RNA, 17 nt, Human
aauaucuugcuugaacu

SEQ ID NO: 3601434 - RNA, 20 nt, Human
aauaucuuugugauaauuua

SEQ ID NO: 3601435 - RNA, 21 nt, Human
aauaucuuugugauaauuuaa

SEQ ID NO: 3601436 - RNA, 15 nt, Human
aauaucuuuuauguu

SEQ ID NO: 3601437 - RNA, 20 nt, Human
aauaucuuuuauguuugaau

SEQ ID NO: 3601438 - RNA, 15 nt, Human
aauaucuuuugaccu

SEQ ID NO: 3601439 - RNA, 23 nt, Human
aauaugaaauuuuuuuucaugcu

SEQ ID NO: 3601440 - RNA, 18 nt, Human
aauaugaagcucaccugu

SEQ ID NO: 3601441 - RNA, 12 nt, Human
aauaugaaguua

SEQ ID NO: 3601442 - RNA, 19 nt, Human
aauaugaaguuacuuucuu

SEQ ID NO: 3601443 - RNA, 20 nt, Human
aauaugaaucugcucacuuu

SEQ ID NO: 3601444 - RNA, 16 nt, Human
aauaugacagcugucc

SEQ ID NO: 3601445 - RNA, 17 nt, Human
aauaugacggaagaaca

SEQ ID NO: 3601446 - RNA, 19 nt, Human
aauaugacggaagaacaua

SEQ ID NO: 3601447 - RNA, 19 nt, Human
aauaugaguacaaaugccu

SEQ ID NO: 3601448 - RNA, 21 nt, Human
aauaugaguacaaaugccuua

SEQ ID NO: 3601449 - RNA, 17 nt, Human
aauaugauauugcauau

SEQ ID NO: 3601450 - RNA, 16 nt, Human
aauaugaugacaauca

SEQ ID NO: 3601451 - RNA, 16 nt, Human
aauaugaugacuguuu

SEQ ID NO: 3601452 - RNA, 19 nt, Human
aauaugauuaguaaagaaa

SEQ ID NO: 3601453 - RNA, 22 nt, Human
aauaugauuaguaaagaaauga

SEQ ID NO: 3601454 - RNA, 21 nt, Human
aauaugauuuuuuaaaagaaa

SEQ ID NO: 3601455 - RNA, 23 nt, Human
aauaugauuuuuuaaaagaaauu

SEQ ID NO: 3601456 - RNA, 15 nt, Human
aauaugcacacauuu

SEQ ID NO: 3601457 - RNA, 22 nt, Human
aauaugcacacauuuuuuaaau

SEQ ID NO: 3601458 - RNA, 17 nt, Human
aauaugcacuaagucuc

SEQ ID NO: 3601459 - RNA, 22 nt, Human
aauaugcacuaagucucuuuuu

SEQ ID NO: 3601460 - RNA, 22 nt, Human
aauaugcagugauauggcagaa

SEQ ID NO: 3601461 - RNA, 23 nt, Human
aauaugccucuccuuuguauauu

SEQ ID NO: 3601462 - RNA, 10 nt, Human
aauaugcuua

SEQ ID NO: 3601463 - RNA, 22 nt, Human
aauaugcuuaaaauaagcaggu

SEQ ID NO: 3601464 - RNA, 17 nt, Human
aauauggaacuuacauu

SEQ ID NO: 3601465 - RNA, 17 nt, Human
aauauggaacuucuaau

SEQ ID NO: 3601466 - RNA, 14 nt, Human
aauauggacaagag

SEQ ID NO: 3601467 - RNA, 15 nt, Human
aauauggacaagagg

SEQ ID NO: 3601468 - RNA, 17 nt, Human
aauauggacacuuaaua

SEQ ID NO: 3601469 - RNA, 21 nt, Human
aauauggacacuuaauacuac

SEQ ID NO: 3601470 - RNA, 14 nt, Human
aauauggauuuguu

SEQ ID NO: 3601471 - RNA, 13 nt, Human
aauaugggagaaa

SEQ ID NO: 3601472 - RNA, 18 nt, Human
aauauggucuuuugguua

SEQ ID NO: 3601473 - RNA, 14 nt, Human
aauauguacauuuc

SEQ ID NO: 3601474 - RNA, 15 nt, Human
aauauguacauuucu

SEQ ID NO: 3601475 - RNA, 18 nt, Human
aauauguacauuucuaag

SEQ ID NO: 3601476 - RNA, 19 nt, Human
aauauguacauuucuaagu

SEQ ID NO: 3601477 - RNA, 23 nt, Human
aauauguauaacuuuaacuucug

SEQ ID NO: 3601478 - RNA, 16 nt, Human
aauauguauuaacacu

SEQ ID NO: 3601479 - RNA, 21 nt, Human
aauauguauuuaccaaaaauu

SEQ ID NO: 3601480 - RNA, 16 nt, Human
aauauguauuuuaugu

SEQ ID NO: 3601481 - RNA, 11 nt, Human
aauaugucugc

SEQ ID NO: 3601482 - RNA, 11 nt, Human
aauaugugaag

SEQ ID NO: 3601483 - RNA, 16 nt, Human
aauaugugagauuuuu

SEQ ID NO: 3601484 - RNA, 22 nt, Human
aauaugugagauuuuuuauugc

SEQ ID NO: 3601485 - RNA, 12 nt, Human
aauaugugauuu

SEQ ID NO: 3601486 - RNA, 19 nt, Human
aauauguggaagcaaccaa

SEQ ID NO: 3601487 - RNA, 20 nt, Human
aauauguucuuuaaaaauau

SEQ ID NO: 3601488 - RNA, 20 nt, Human
aauauguuuaaaauaaaaug

SEQ ID NO: 3601489 - RNA, 22 nt, Human
aauauguuuuuuagaucaaaua

SEQ ID NO: 3601490 - RNA, 13 nt, Human
aauauuaaaaaac

SEQ ID NO: 3601491 - RNA, 16 nt, Human
aauauuaaaaagucuu

SEQ ID NO: 3601492 - RNA, 19 nt, Human
aauauuaaaaagucuuuua

SEQ ID NO: 3601493 - RNA, 13 nt, Human
aauauuaaaagaa

SEQ ID NO: 3601494 - RNA, 22 nt, Human
aauauuaaccuaaucaccaugu

SEQ ID NO: 3601495 - RNA, 18 nt, Human
aauauuaccuaaugaaag

SEQ ID NO: 3601496 - RNA, 22 nt, Human
aauauuacucaguuuauguugu

SEQ ID NO: 3601497 - RNA, 19 nt, Human
aauauuacuuuaacaugcc

SEQ ID NO: 3601498 - RNA, 18 nt, Human
aauauuagcuuuacuguu

SEQ ID NO: 3601499 - RNA, 19 nt, Human
aauauuagcuuuacuguuu

SEQ ID NO: 3601500 - RNA, 21 nt, Human
aauauuagcuuuacuguuugu

SEQ ID NO: 3601501 - RNA, 20 nt, Human
aauauuaucuuuguaauuau

SEQ ID NO: 3601502 - RNA, 14 nt, Human
aauauuaugagaug

SEQ ID NO: 3601503 - RNA, 22 nt, Human
aauauuaugagaugcuggcuug

SEQ ID NO: 3601504 - RNA, 12 nt, Human
aauauuaugcaa

SEQ ID NO: 3601505 - RNA, 17 nt, Human
aauauuaugcaaauucc

SEQ ID NO: 3601506 - RNA, 19 nt, Human
aauauuaugcaaauuccca

SEQ ID NO: 3601507 - RNA, 20 nt, Human
aauauuaugcaaauucccag

SEQ ID NO: 3601508 - RNA, 16 nt, Human
aauauuauguuaaaac

SEQ ID NO: 3601509 - RNA, 14 nt, Human
aauauuauugaacu

SEQ ID NO: 3601510 - RNA, 19 nt, Human
aauauuauuuguguuuccu

SEQ ID NO: 3601511 - RNA, 21 nt, Human
aauauucagaaucuuuguuaa

SEQ ID NO: 3601512 - RNA, 21 nt, Human
aauauucagacaaaauggaua

SEQ ID NO: 3601513 - RNA, 23 nt, Human
aauauucagacaaaauggauaca

SEQ ID NO: 3601514 - RNA, 16 nt, Human
aauauuccagaucuuu

SEQ ID NO: 3601515 - RNA, 23 nt, Human
aauauuccagaucuuucagaaau

SEQ ID NO: 3601516 - RNA, 12 nt, Human
aauauuccugaa

SEQ ID NO: 3601517 - RNA, 16 nt, Human
aauauucuauaugaau

SEQ ID NO: 3601518 - RNA, 23 nt, Human
aauauucuauuuucauuuucugc

SEQ ID NO: 3601519 - RNA, 14 nt, Human
aauauucucuguac

SEQ ID NO: 3601520 - RNA, 21 nt, Human
aauauucucuguacauauuag

SEQ ID NO: 3601521 - RNA, 18 nt, Human
aauauugaauuuuuccua

SEQ ID NO: 3601522 - RNA, 15 nt, Human
aauauugacauuugu

SEQ ID NO: 3601523 - RNA, 17 nt, Human
aauauugacuuguauau

SEQ ID NO: 3601524 - RNA, 15 nt, Human
aauauugacuuuguc

SEQ ID NO: 3601525 - RNA, 19 nt, Human
aauauugagaaagaaacua

SEQ ID NO: 3601526 - RNA, 20 nt, Human
aauauugagaaagaaacuaa

SEQ ID NO: 3601527 - RNA, 14 nt, Human
aauauugaggcuuu

SEQ ID NO: 3601528 - RNA, 18 nt, Human
aauauugaggcuuugugu

SEQ ID NO: 3601529 - RNA, 20 nt, Human
aauauugaggcuuuguguug

SEQ ID NO: 3601530 - RNA, 17 nt, Human
aauauugauaugcuuau

SEQ ID NO: 3601531 - RNA, 22 nt, Human
aauauugauugggaaaacauuu

SEQ ID NO: 3601532 - RNA, 20 nt, Human
aauauugauuucugccuucc

SEQ ID NO: 3601533 - RNA, 16 nt, Human
aauauugcaaaauaca

SEQ ID NO: 3601534 - RNA, 17 nt, Human
aauauugcaaaauacau

SEQ ID NO: 3601535 - RNA, 15 nt, Human
aauauugguugggau

SEQ ID NO: 3601536 - RNA, 14 nt, Human
aauauuguauauuu

SEQ ID NO: 3601537 - RNA, 16 nt, Human
aauauuguguuccuuu

SEQ ID NO: 3601538 - RNA, 18 nt, Human
aauauuguguugugaaug

SEQ ID NO: 3601539 - RNA, 18 nt, Human
aauauuguuccuaaguuc

SEQ ID NO: 3601540 - RNA, 20 nt, Human
aauauuguuccuaaguucuu

SEQ ID NO: 3601541 - RNA, 13 nt, Human
aauauuguucucu

SEQ ID NO: 3601542 - RNA, 22 nt, Human
aauauuguugacaacugugacu

SEQ ID NO: 3601543 - RNA, 19 nt, Human
aauauuguuguauaauuuc

SEQ ID NO: 3601544 - RNA, 23 nt, Human
aauauuguuguauaauuucgaga

SEQ ID NO: 3601545 - RNA, 12 nt, Human
aauauuguuucu

SEQ ID NO: 3601546 - RNA, 18 nt, Human
aauauuguuuuucuuucu

SEQ ID NO: 3601547 - RNA, 14 nt, Human
aauauuuaaacagc

SEQ ID NO: 3601548 - RNA, 17 nt, Human
aauauuuaaacagcagu

SEQ ID NO: 3601549 - RNA, 19 nt, Human
aauauuuaaacagcagugu

SEQ ID NO: 3601550 - RNA, 22 nt, Human
aauauuuaaacaugguuacaau

SEQ ID NO: 3601551 - RNA, 13 nt, Human
aauauuuaauguu

SEQ ID NO: 3601552 - RNA, 14 nt, Human
aauauuuaauguug

SEQ ID NO: 3601553 - RNA, 11 nt, Human
aauauuuauaa

SEQ ID NO: 3601554 - RNA, 17 nt, Human
aauauuuauaacagcau

SEQ ID NO: 3601555 - RNA, 17 nt, Human
aauauuuauauauuuau

SEQ ID NO: 3601556 - RNA, 15 nt, Human
aauauuuaugaagaa

SEQ ID NO: 3601557 - RNA, 22 nt, Human
aauauuuaugaagaaaauacuu

SEQ ID NO: 3601558 - RNA, 17 nt, Human
aauauuuauuaaauaaa

SEQ ID NO: 3601559 - RNA, 18 nt, Human
aauauuuauuaaauaaaa

SEQ ID NO: 3601560 - RNA, 16 nt, Human
aauauuuauuaccucu

SEQ ID NO: 3601561 - RNA, 14 nt, Human
aauauuuauugcuu

SEQ ID NO: 3601562 - RNA, 18 nt, Human
aaguuauuuuuguacaug

SEQ ID NO: 3601563 - RNA, 13 nt, Human
aagcauugaaauu

SEQ ID NO: 3601564 - RNA, 22 nt, Human
aagcauuggguggguaaauuca

SEQ ID NO: 3601565 - RNA, 14 nt, Human
aagcauuguaaaau

SEQ ID NO: 3601566 - RNA, 13 nt, Human
aagcauuuaaagg

SEQ ID NO: 3601567 - RNA, 20 nt, Human
aagcauuuaauguagccaug

SEQ ID NO: 3601568 - RNA, 16 nt, Human
aagcauuuacuuugug

SEQ ID NO: 3601569 - RNA, 13 nt, Human
aagcauuucaaag

SEQ ID NO: 3601570 - RNA, 13 nt, Human
aagcauuugaaug

SEQ ID NO: 3601571 - RNA, 14 nt, Human
aagcauuugaaugc

SEQ ID NO: 3601572 - RNA, 16 nt, Human
aagcauuugaaugcau

SEQ ID NO: 3601573 - RNA, 20 nt, Human
aagcauuugguuuuucacau

SEQ ID NO: 3601574 - RNA, 18 nt, Human
aagcauuuguauuuugug

SEQ ID NO: 3601575 - RNA, 21 nt, Human
aagcauuuguauuuuguguga

SEQ ID NO: 3601576 - RNA, 14 nt, Human
aagcauuuuauaaa

SEQ ID NO: 3601577 - RNA, 13 nt, Human
aauaaaaaggcac

SEQ ID NO: 3601578 - RNA, 12 nt, Human
aauaaaaaggug

SEQ ID NO: 3601579 - RNA, 13 nt, Human
aauaaaaagguga

SEQ ID NO: 3601580 - RNA, 16 nt, Human
aauaaaaaggugacca

SEQ ID NO: 3601581 - RNA, 15 nt, Human
aauaaaaauaaauuc

SEQ ID NO: 3601582 - RNA, 14 nt, Human
aauaaaaauauauu

SEQ ID NO: 3601583 - RNA, 13 nt, Human
aauaaaaaugaua

SEQ ID NO: 3601584 - RNA, 14 nt, Human
aauaaaaauguuua

SEQ ID NO: 3601585 - RNA, 15 nt, Human
aauaaaaauguuuaa

SEQ ID NO: 3601586 - RNA, 19 nt, Human
aauaaaaauuaaggcaacu

SEQ ID NO: 3601587 - RNA, 13 nt, Human
aauaaaacaaagg

SEQ ID NO: 3601588 - RNA, 15 nt, Human
aauaaaacauagcaa

SEQ ID NO: 3601589 - RNA, 11 nt, Human
aauaaaacauu

SEQ ID NO: 3601590 - RNA, 12 nt, Human
aauaaaaccuuu

SEQ ID NO: 3601591 - RNA, 16 nt, Human
aauaaaaccuuucaaa

SEQ ID NO: 3601592 - RNA, 21 nt, Human
aauaaaaccuuucaaauuuca

SEQ ID NO: 3601593 - RNA, 23 nt, Human
aauaaaaccuuucaaauuucaca

SEQ ID NO: 3601594 - RNA, 15 nt, Human
aauaaaacuggcuuu

SEQ ID NO: 3601595 - RNA, 18 nt, Human
aauaaaacuuuuuaaaau

SEQ ID NO: 3601596 - RNA, 16 nt, Human
aauaaaagaaaauuac

SEQ ID NO: 3601597 - RNA, 14 nt, Human
aauaaaagcccagg

SEQ ID NO: 3601598 - RNA, 17 nt, Human
aauaaaaggaaaagcaa

SEQ ID NO: 3601599 - RNA, 16 nt, Human
aauaaaagugaccuuu

SEQ ID NO: 3601600 - RNA, 19 nt, Human
aauaaaaguuuuacaaagg

SEQ ID NO: 3601601 - RNA, 12 nt, Human
aauaaaauaacc

SEQ ID NO: 3601602 - RNA, 15 nt, Human
aauaaaauaauucua

SEQ ID NO: 3601603 - RNA, 21 nt, Human
aauaaaauauaauuguuuuuu

SEQ ID NO: 3601604 - RNA, 15 nt, Human
aauaaaauauaucuu

SEQ ID NO: 3601605 - RNA, 15 nt, Human
aauaaaauaucauuc

SEQ ID NO: 3601606 - RNA, 19 nt, Human
aauaaaauaucauucagca

SEQ ID NO: 3601607 - RNA, 21 nt, Human
aauaaaauaucauucagcaac

SEQ ID NO: 3601608 - RNA, 11 nt, Human
aauaaaauauu

SEQ ID NO: 3601609 - RNA, 12 nt, Human
aauaaaauauuu

SEQ ID NO: 3601610 - RNA, 20 nt, Human
aauaaaauauuuucugugug

SEQ ID NO: 3601611 - RNA, 11 nt, Human
aauaaaaucau

SEQ ID NO: 3601612 - RNA, 14 nt, Human
aauaaaaugaaaau

SEQ ID NO: 3601613 - RNA, 12 nt, Human
aauaaaauuaag

SEQ ID NO: 3601614 - RNA, 15 nt, Human
aauaaaauuauuuug

SEQ ID NO: 3601615 - RNA, 19 nt, Human
aauaaaauucaacaaacau

SEQ ID NO: 3601616 - RNA, 18 nt, Human
aauaaaauucccuaaagc

SEQ ID NO: 3601617 - RNA, 13 nt, Human
aauaaaauuuaaa

SEQ ID NO: 3601618 - RNA, 12 nt, Human
aauaaaauuuuu

SEQ ID NO: 3601619 - RNA, 13 nt, Human
aauaaacauccuu

SEQ ID NO: 3601620 - RNA, 18 nt, Human
aauaaaccaaaggaaaau

SEQ ID NO: 3601621 - RNA, 15 nt, Human
aauaaacgauuuaau

SEQ ID NO: 3601622 - RNA, 21 nt, Human
aauaaacgauuuaauucucuu

SEQ ID NO: 3601623 - RNA, 16 nt, Human
aauaaacgucuuaaau

SEQ ID NO: 3601624 - RNA, 13 nt, Human
aauaaacuaaaga

SEQ ID NO: 3601625 - RNA, 18 nt, Human
aauaaacuaauaauugca

SEQ ID NO: 3601626 - RNA, 19 nt, Human
aauaaacuauuuguaaagu

SEQ ID NO: 3601627 - RNA, 15 nt, Human
aauaaacucuaaaca

SEQ ID NO: 3601628 - RNA, 22 nt, Human
aauaaacuguccucuuucagaa

SEQ ID NO: 3601629 - RNA, 14 nt, Human
aauaaacuucagca

SEQ ID NO: 3601630 - RNA, 21 nt, Human
aauaaacuuggauucucuaac

SEQ ID NO: 3601631 - RNA, 12 nt, Human
aauaaacuuuuu

SEQ ID NO: 3601632 - RNA, 16 nt, Human
aauaaacuuuuuuuca

SEQ ID NO: 3601633 - RNA, 19 nt, Human
aauaaacuuuuuuucaaug

SEQ ID NO: 3601634 - RNA, 21 nt, Human
aauaaacuuuuuuucaaugug

SEQ ID NO: 3601635 - RNA, 14 nt, Human
aauaaagaaaagau

SEQ ID NO: 3601636 - RNA, 20 nt, Human
aauaaagaaguaugguaauc

SEQ ID NO: 3601637 - RNA, 12 nt, Human
aauaaagaaugg

SEQ ID NO: 3601638 - RNA, 11 nt, Human
aauaaagacag

SEQ ID NO: 3601639 - RNA, 15 nt, Human
aauaaagaguuagaa

SEQ ID NO: 3601640 - RNA, 20 nt, Human
aauaaagaucauguaaaagu

SEQ ID NO: 3601641 - RNA, 16 nt, Human
aauaaagcaauaagaa

SEQ ID NO: 3601642 - RNA, 16 nt, Human
aauaaagcaauuuucc

SEQ ID NO: 3601643 - RNA, 17 nt, Human
aauaaagcaauuuuccu

SEQ ID NO: 3601644 - RNA, 15 nt, Human
aauaaagccugcuuu

SEQ ID NO: 3601645 - RNA, 11 nt, Human
aauaaagcugu

SEQ ID NO: 3601646 - RNA, 12 nt, Human
aauaaagcuugu

SEQ ID NO: 3601647 - RNA, 12 nt, Human
aauaaaguauaa

SEQ ID NO: 3601648 - RNA, 15 nt, Human
aauaaaguauaaugu

SEQ ID NO: 3601649 - RNA, 16 nt, Human
aauaaaguaucuacau

SEQ ID NO: 3601650 - RNA, 11 nt, Human
aauaaaguauu

SEQ ID NO: 3601651 - RNA, 19 nt, Human
aauaaaguauuccaccuua

SEQ ID NO: 3601652 - RNA, 16 nt, Human
aauaaaguauuuaauu

SEQ ID NO: 3601653 - RNA, 21 nt, Human
aauaaaguauuuaauuagugc

SEQ ID NO: 3601654 - RNA, 22 nt, Human
aauaaaguauuuaauuagugcu

SEQ ID NO: 3601655 - RNA, 17 nt, Human
aauaaagucagauggaa

SEQ ID NO: 3601656 - RNA, 12 nt, Human
aauaaagugacc

SEQ ID NO: 3601657 - RNA, 17 nt, Human
aauaaaguguuuucaga

SEQ ID NO: 3601658 - RNA, 15 nt, Human
aauaaaguuaaaagu

SEQ ID NO: 3601659 - RNA, 12 nt, Human
aauaaaguuuga

SEQ ID NO: 3601660 - RNA, 18 nt, Human
aauaaaguuugaucuucc

SEQ ID NO: 3601661 - RNA, 14 nt, Human
aauaaauaaaagcc

SEQ ID NO: 3601662 - RNA, 16 nt, Human
aauaaauaauuuucau

SEQ ID NO: 3601663 - RNA, 14 nt, Human
aauaaauagagcaa

SEQ ID NO: 3601664 - RNA, 19 nt, Human
aauaaauagcuauauccau

SEQ ID NO: 3601665 - RNA, 15 nt, Human
aauaaauauauacau

SEQ ID NO: 3601666 - RNA, 13 nt, Human
aauaaauaugagu

SEQ ID NO: 3601667 - RNA, 13 nt, Human
aauaaauaugccu

SEQ ID NO: 3601668 - RNA, 16 nt, Human
aauaaauaugccucuc

SEQ ID NO: 3601669 - RNA, 16 nt, Human
aauaaauauugucuuu

SEQ ID NO: 3601670 - RNA, 23 nt, Human
aauaaauauugucuuuuuguaug

SEQ ID NO: 3601671 - RNA, 14 nt, Human
aauaaauauuuaug

SEQ ID NO: 3601672 - RNA, 15 nt, Human
aauaaaucauguuaa

SEQ ID NO: 3601673 - RNA, 19 nt, Human
aauaaauccacccauguua

SEQ ID NO: 3601674 - RNA, 20 nt, Human
aauaaaucugacccagugcc

SEQ ID NO: 3601675 - RNA, 11 nt, Human
aauaaaucuuu

SEQ ID NO: 3601676 - RNA, 16 nt, Human
aauaaaucuuuggaaa

SEQ ID NO: 3601677 - RNA, 18 nt, Human
aauaaaugagcuauguau

SEQ ID NO: 3601678 - RNA, 19 nt, Human
aauaaaugcaauauguauu

SEQ ID NO: 3601679 - RNA, 23 nt, Human
aauaaaugguauagcaaauguuu

SEQ ID NO: 3601680 - RNA, 21 nt, Human
aauaaaugucaccagguacuu

SEQ ID NO: 3601681 - RNA, 15 nt, Human
aauaaaugucacuuu

SEQ ID NO: 3601682 - RNA, 14 nt, Human
aauaaaugucuugc

SEQ ID NO: 3601683 - RNA, 20 nt, Human
aauaaaugugaaauucuguc

SEQ ID NO: 3601684 - RNA, 11 nt, Human
aauaaaugugu

SEQ ID NO: 3601685 - RNA, 12 nt, Human
aauaaauguguu

SEQ ID NO: 3601686 - RNA, 16 nt, Human
aauaaauuaguuguua

SEQ ID NO: 3601687 - RNA, 12 nt, Human
aauaaauuauuu

SEQ ID NO: 3601688 - RNA, 17 nt, Human
aauaaauuauuuauuau

SEQ ID NO: 3601689 - RNA, 21 nt, Human
aauaaauugcaugcugcuuua

SEQ ID NO: 3601690 - RNA, 16 nt, Human
aauaaauugcuccuug

SEQ ID NO: 3601691 - RNA, 20 nt, Human
aauaaauugcuccuugacau

SEQ ID NO: 3601692 - RNA, 18 nt, Human
aauaaauuguacagccgg

SEQ ID NO: 3601693 - RNA, 13 nt, Human
aauaaauuguaua

SEQ ID NO: 3601694 - RNA, 18 nt, Human
aauaaauuuauaugaaaa

SEQ ID NO: 3601695 - RNA, 15 nt, Human
aauaaauuuugaaaa

SEQ ID NO: 3601696 - RNA, 18 nt, Human
aauaacaaaugccaaauu

SEQ ID NO: 3601697 - RNA, 21 nt, Human
aauaacaaugaaaguugauaa

SEQ ID NO: 3601698 - RNA, 13 nt, Human
aauaacaauguua

SEQ ID NO: 3601699 - RNA, 14 nt, Human
aauaacaauguuaa

SEQ ID NO: 3601700 - RNA, 15 nt, Human
aauaacaauguuaag

SEQ ID NO: 3601701 - RNA, 20 nt, Human
aauaacaauguuaaggaaac

SEQ ID NO: 3601702 - RNA, 24 nt, Human
aauaacaauguuaaggaaacucuu

SEQ ID NO: 3601703 - RNA, 15 nt, Human
aauaacacacagcua

SEQ ID NO: 3601704 - RNA, 23 nt, Human
aauaacacagagagacagacuug

SEQ ID NO: 3601705 - RNA, 20 nt, Human
aauaacagccgcuccagagu

SEQ ID NO: 3601706 - RNA, 12 nt, Human
aauaacagcugc

SEQ ID NO: 3601707 - RNA, 14 nt, Human
aauaacagcugcaa

SEQ ID NO: 3601708 - RNA, 19 nt, Human
aauaacauguaauuaagua

SEQ ID NO: 3601709 - RNA, 13 nt, Human
aauaacauuaccu

SEQ ID NO: 3601710 - RNA, 13 nt, Human
aauaacauuugug

SEQ ID NO: 3601711 - RNA, 12 nt, Human
aaggaagaaaaa

SEQ ID NO: 3601712 - RNA, 11 nt, Human
aaggaagaaau

SEQ ID NO: 3601713 - RNA, 21 nt, Human
aaggaagacuucaucccucug

SEQ ID NO: 3601714 - RNA, 18 nt, Human
aaggaagauauacaugaa

SEQ ID NO: 3601715 - RNA, 16 nt, Human
aaggaagcacaugccu

SEQ ID NO: 3601716 - RNA, 18 nt, Human
aaggaagccaaauuuauc

SEQ ID NO: 3601717 - RNA, 19 nt, Human
aaggaagccaaauuuauca

SEQ ID NO: 3601718 - RNA, 19 nt, Human
aaggaagccggggaagaga

SEQ ID NO: 3601719 - RNA, 18 nt, Human
aaggaagcuccacuguca

SEQ ID NO: 3601720 - RNA, 17 nt, Human
aaggaaggcuccaucuc

SEQ ID NO: 3601721 - RNA, 14 nt, Human
aaggaagucuagga

SEQ ID NO: 3601722 - RNA, 14 nt, Human
aaggaagugaagag

SEQ ID NO: 3601723 - RNA, 20 nt, Human
aaggaauacaauauauagcu

SEQ ID NO: 3601724 - RNA, 18 nt, Human
aaggaauaccuguccccc

SEQ ID NO: 3601725 - RNA, 13 nt, Human
aaggaauauaugg

SEQ ID NO: 3601726 - RNA, 18 nt, Human
aaggaauauauggcagag

SEQ ID NO: 3601727 - RNA, 21 nt, Human
aaggaauaugggagaaauagu

SEQ ID NO: 3601728 - RNA, 20 nt, Human
aaggaauccacucccaggca

SEQ ID NO: 3601729 - RNA, 22 nt, Human
aaggaauccacucccaggcagc

SEQ ID NO: 3601730 - RNA, 18 nt, Human
aaggaaucuagccaguga

SEQ ID NO: 3601731 - RNA, 23 nt, Human
aaggaaucuagccagugaacaua

SEQ ID NO: 3601732 - RNA, 17 nt, Human
aaggaaucuccaguuuu

SEQ ID NO: 3601733 - RNA, 14 nt, Human
aaggaaucuuuaag

SEQ ID NO: 3601734 - RNA, 16 nt, Human
aaggaaugucuuuggu

SEQ ID NO: 3601735 - RNA, 21 nt, Human
aaggaauuaccaagaauaucc

SEQ ID NO: 3601736 - RNA, 18 nt, Human
aaggaauuauagaccucu

SEQ ID NO: 3601737 - RNA, 17 nt, Human
aaggaauuucuuaacuu

SEQ ID NO: 3601738 - RNA, 20 nt, Human
aaggaauuucuuaacuucuu

SEQ ID NO: 3601739 - RNA, 12 nt, Human
aaggaauuuuau

SEQ ID NO: 3601740 - RNA, 17 nt, Human
aaggacaaaaaugaacu

SEQ ID NO: 3601741 - RNA, 21 nt, Human
aaggacaaagucuccagccca

SEQ ID NO: 3601742 - RNA, 16 nt, Human
aaggacacuuccugcc

SEQ ID NO: 3601743 - RNA, 18 nt, Human
aaggacacuuccugccua

SEQ ID NO: 3601744 - RNA, 17 nt, Human
aaggacaggcagaaaga

SEQ ID NO: 3601745 - RNA, 13 nt, Human
aaggacaggcagg

SEQ ID NO: 3601746 - RNA, 18 nt, Human
aaggacaugaugcuuuua

SEQ ID NO: 3601747 - RNA, 17 nt, Human
aaggacauuaugugugc

SEQ ID NO: 3601748 - RNA, 14 nt, Human
aaggaccagcccuu

SEQ ID NO: 3601749 - RNA, 13 nt, Human
aaggaccccucac

SEQ ID NO: 3601750 - RNA, 15 nt, Human
aaggaccccucaccu

SEQ ID NO: 3601751 - RNA, 21 nt, Human
aaggacccggaggggccuggc

SEQ ID NO: 3601752 - RNA, 14 nt, Human
aaggacccugugag

SEQ ID NO: 3601753 - RNA, 16 nt, Human
aaggaccuauguuugc

SEQ ID NO: 3601754 - RNA, 18 nt, Human
aaggaccugaaauuccaa

SEQ ID NO: 3601755 - RNA, 20 nt, Human
aaggaccuucacucuaagau

SEQ ID NO: 3601756 - RNA, 23 nt, Human
aaggaccuucacucuaagauguu

SEQ ID NO: 3601757 - RNA, 24 nt, Human
aaggaccuucacucuaagauguua

SEQ ID NO: 3601758 - RNA, 21 nt, Human
aaggacggccuucaacugaaa

SEQ ID NO: 3601759 - RNA, 17 nt, Human
aaggacggguuggggcc

SEQ ID NO: 3601760 - RNA, 15 nt, Human
aaggacuaauagaaa

SEQ ID NO: 3601761 - RNA, 18 nt, Human
aaggacuaauagaaaagu

SEQ ID NO: 3601762 - RNA, 21 nt, Human
aaggacuaugaaaagcuagaa

SEQ ID NO: 3601763 - RNA, 15 nt, Human
aaggacuccugaaaa

SEQ ID NO: 3601764 - RNA, 23 nt, Human
aaggacucugguuucucauucuu

SEQ ID NO: 3601765 - RNA, 21 nt, Human
aaggacugagcacccucugga

SEQ ID NO: 3601766 - RNA, 17 nt, Human
aaggacugagggacucu

SEQ ID NO: 3601767 - RNA, 22 nt, Human
aaggacugcaugguaauuuaua

SEQ ID NO: 3601768 - RNA, 22 nt, Human
aaggacugccgaccgaggcugg

SEQ ID NO: 3601769 - RNA, 23 nt, Human
aaggacugcgggacuugggucuc

SEQ ID NO: 3601770 - RNA, 20 nt, Human
aaggacuuccuguccagcuc

SEQ ID NO: 3601771 - RNA, 21 nt, Human
aaggacuuccuguccagcucc

SEQ ID NO: 3601772 - RNA, 22 nt, Human
aaggacuuccuguccagcucca

SEQ ID NO: 3601773 - RNA, 23 nt, Human
aaggacuuccuguccagcuccaa

SEQ ID NO: 3601774 - RNA, 20 nt, Human
aaggacuucuuuaauuuugg

SEQ ID NO: 3601775 - RNA, 15 nt, Human
aaggacuuguuagau

SEQ ID NO: 3601776 - RNA, 14 nt, Human
aaggagaacaaaua

SEQ ID NO: 3601777 - RNA, 15 nt, Human
aaggagaacaaauau

SEQ ID NO: 3601778 - RNA, 16 nt, Human
aaggagaaucaucagg

SEQ ID NO: 3601779 - RNA, 23 nt, Human
aaggagaaucaucaggacccugg

SEQ ID NO: 3601780 - RNA, 19 nt, Human
aaggagaaucauguuucuu

SEQ ID NO: 3601781 - RNA, 19 nt, Human
aauggauauuauuagaaau

SEQ ID NO: 3601782 - RNA, 13 nt, Human
aauggaucacaag

SEQ ID NO: 3601783 - RNA, 22 nt, Human
aauggaugccuugaauaauaag

SEQ ID NO: 3601784 - RNA, 16 nt, Human
aauggauuggauuauu

SEQ ID NO: 3601785 - RNA, 20 nt, Human
aauggauuggauuauuuaau

SEQ ID NO: 3601786 - RNA, 23 nt, Human
aauggauuggauuauuuaauaac

SEQ ID NO: 3601787 - RNA, 12 nt, Human
aauggauuguua

SEQ ID NO: 3601788 - RNA, 14 nt, Human
aauggcaacaaacu

SEQ ID NO: 3601789 - RNA, 14 nt, Human
aauggcaaguuuuc

SEQ ID NO: 3601790 - RNA, 17 nt, Human
aauggcacagcccaaag

SEQ ID NO: 3601791 - RNA, 12 nt, Human
aauggcacugau

SEQ ID NO: 3601792 - RNA, 13 nt, Human
aauggcagcaggg

SEQ ID NO: 3601793 - RNA, 19 nt, Human
aauggcagcagggguuggg

SEQ ID NO: 3601794 - RNA, 16 nt, Human
aauggcagccuuggca

SEQ ID NO: 3601795 - RNA, 17 nt, Human
aauggcaguuauauuuu

SEQ ID NO: 3601796 - RNA, 20 nt, Human
aauggcaguuauauuuugca

SEQ ID NO: 3601797 - RNA, 15 nt, Human
aauggcauuugcaau

SEQ ID NO: 3601798 - RNA, 15 nt, Human
aauggccucaugugg

SEQ ID NO: 3601799 - RNA, 14 nt, Human
aauggccugccuug

SEQ ID NO: 3601800 - RNA, 17 nt, Human
aauggccuucauaucau

SEQ ID NO: 3601801 - RNA, 18 nt, Human
aauggcgugaucucggcu

SEQ ID NO: 3601802 - RNA, 16 nt, Human
aauggcuauguuuuua

SEQ ID NO: 3601803 - RNA, 12 nt, Human
aauggcucagau

SEQ ID NO: 3601804 - RNA, 15 nt, Human
aauggcucagaugcc

SEQ ID NO: 3601805 - RNA, 14 nt, Human
aauggcugaagcca

SEQ ID NO: 3601806 - RNA, 19 nt, Human
aauggcugauaauuuuaaa

SEQ ID NO: 3601807 - RNA, 17 nt, Human
aauggcuguaaucauuu

SEQ ID NO: 3601808 - RNA, 21 nt, Human
aauggcuuauccagcugguga

SEQ ID NO: 3601809 - RNA, 14 nt, Human
aauggcuuguucau

SEQ ID NO: 3601810 - RNA, 15 nt, Human
aauggcuuuguauag

SEQ ID NO: 3601811 - RNA, 14 nt, Human
aaugggaacauuua

SEQ ID NO: 3601812 - RNA, 16 nt, Human
aaugggaauauuuuau

SEQ ID NO: 3601813 - RNA, 18 nt, Human
aaugggacuucuuuucac

SEQ ID NO: 3601814 - RNA, 20 nt, Human
aaugggacuucuuuucacau

SEQ ID NO: 3601815 - RNA, 21 nt, Human
aaugggacuucuuuucacauu

SEQ ID NO: 3601816 - RNA, 14 nt, Human
aaugggagcucaug

SEQ ID NO: 3601817 - RNA, 21 nt, Human
aaugggaggggaaaugggaau

SEQ ID NO: 3601818 - RNA, 12 nt, Human
aaugggcacagc

SEQ ID NO: 3601819 - RNA, 14 nt, Human
aaugggcacuuaaa

SEQ ID NO: 3601820 - RNA, 17 nt, Human
aaugggcaguuacaugc

SEQ ID NO: 3601821 - RNA, 22 nt, Human
aaugggcaguuacaugcauacu

SEQ ID NO: 3601822 - RNA, 14 nt, Human
aaugggcucaaacu

SEQ ID NO: 3601823 - RNA, 19 nt, Human
aaugggcucuccggggcca

SEQ ID NO: 3601824 - RNA, 12 nt, Human
aauggggccaga

SEQ ID NO: 3601825 - RNA, 14 nt, Human
aauggggccagauc

SEQ ID NO: 3601826 - RNA, 19 nt, Human
aauggggguagcagcugga

SEQ ID NO: 3601827 - RNA, 12 nt, Human
aauggguaauau

SEQ ID NO: 3601828 - RNA, 15 nt, Human
aauggguuacuugau

SEQ ID NO: 3601829 - RNA, 20 nt, Human
aaugguaacauuuuucaaua

SEQ ID NO: 3601830 - RNA, 22 nt, Human
aaugguacaaaaccacagugua

SEQ ID NO: 3601831 - RNA, 16 nt, Human
aaugguaccagauaaa

SEQ ID NO: 3601832 - RNA, 18 nt, Human
aaugguaggcauuuccua

SEQ ID NO: 3601833 - RNA, 24 nt, Human
aaugguagucuaaccaaaugcauc

SEQ ID NO: 3601834 - RNA, 13 nt, Human
aaugguaguuucu

SEQ ID NO: 3601835 - RNA, 15 nt, Human
aaugguauagcaaau

SEQ ID NO: 3601836 - RNA, 16 nt, Human
aaugguaucaaaauua

SEQ ID NO: 3601837 - RNA, 18 nt, Human
aaugguaucaaaauuaca

SEQ ID NO: 3601838 - RNA, 12 nt, Human
aaugguaucuuu

SEQ ID NO: 3601839 - RNA, 18 nt, Human
aaugguaugagcugaggg

SEQ ID NO: 3601840 - RNA, 23 nt, Human
aauggucacguuuggugcuucuc

SEQ ID NO: 3601841 - RNA, 18 nt, Human
aauggucagcguugcaug

SEQ ID NO: 3601842 - RNA, 17 nt, Human
aauggucccauccaggc

SEQ ID NO: 3601843 - RNA, 12 nt, Human
aauggugauuuu

SEQ ID NO: 3601844 - RNA, 19 nt, Human
aauggugcauuguauagau

SEQ ID NO: 3601845 - RNA, 18 nt, Human
aauggugcucauuucaug

SEQ ID NO: 3601846 - RNA, 16 nt, Human
aaugguggcuucagcu

SEQ ID NO: 3601847 - RNA, 23 nt, Human
aaugguggcuucuuuucuuugua

SEQ ID NO: 3601848 - RNA, 19 nt, Human
aaugguguagaacacuaau

SEQ ID NO: 3601849 - RNA, 19 nt, Human
aaugguguuuuucuuguaa

SEQ ID NO: 3601850 - RNA, 17 nt, Human
aaugguguuuuuuuaau

SEQ ID NO: 3601851 - RNA, 16 nt, Human
aaugguuauaaaagug

SEQ ID NO: 3601852 - RNA, 22 nt, Human
aaugguucagaauuaaacuuuu

SEQ ID NO: 3601853 - RNA, 19 nt, Human
aaugguuccaugccugagg

SEQ ID NO: 3601854 - RNA, 21 nt, Human
aaugguuccaugccugagggu

SEQ ID NO: 3601855 - RNA, 17 nt, Human
aaugucuugcuguugac

SEQ ID NO: 3601856 - RNA, 17 nt, Human
aaugucuuugguccucu

SEQ ID NO: 3601857 - RNA, 13 nt, Human
aaugucuuuguaa

SEQ ID NO: 3601858 - RNA, 19 nt, Human
aaugucuuuguaagucagu

SEQ ID NO: 3601859 - RNA, 18 nt, Human
aaugucuuuguuggaaaa

SEQ ID NO: 3601860 - RNA, 20 nt, Human
aaugucuuuuuucaaacuuu

SEQ ID NO: 3601861 - RNA, 15 nt, Human
aaugugaaaaaucug

SEQ ID NO: 3601862 - RNA, 22 nt, Human
aaugugaaacuggauuaaacuu

SEQ ID NO: 3601863 - RNA, 16 nt, Human
aaugugaaauguaacu

SEQ ID NO: 3601864 - RNA, 19 nt, Human
aaugugaacagcggcugga

SEQ ID NO: 3601865 - RNA, 19 nt, Human
aaugugaacuagcuggaau

SEQ ID NO: 3601866 - RNA, 20 nt, Human
aaugugaacuuuauuaaaua

SEQ ID NO: 3601867 - RNA, 15 nt, Human
aaugugaagaugcau

SEQ ID NO: 3601868 - RNA, 13 nt, Human
aaugugaagccuu

SEQ ID NO: 3601869 - RNA, 14 nt, Human
aaugugaagccuuc

SEQ ID NO: 3601870 - RNA, 15 nt, Human
aaugugaagccuucc

SEQ ID NO: 3601871 - RNA, 17 nt, Human
aaugugaaguguuaaua

SEQ ID NO: 3601872 - RNA, 18 nt, Human
aaugugaauuuuuauugu

SEQ ID NO: 3601873 - RNA, 17 nt, Human
aaugugaccagggguga

SEQ ID NO: 3601874 - RNA, 15 nt, Human
aaugugacccuccaa

SEQ ID NO: 3601875 - RNA, 21 nt, Human
aaugugagaagccagccagag

SEQ ID NO: 3601876 - RNA, 21 nt, Human
aaugugaguuuggucuggacu

SEQ ID NO: 3601877 - RNA, 23 nt, Human
aaugugaguuuggucuggacuga

SEQ ID NO: 3601878 - RNA, 19 nt, Human
aaugugauauaaacagcuu

SEQ ID NO: 3601879 - RNA, 11 nt, Human
aaugugauaug

SEQ ID NO: 3601880 - RNA, 12 nt, Human
aaugugaugaau

SEQ ID NO: 3601881 - RNA, 16 nt, Human
aaugugaugaauacug

SEQ ID NO: 3601882 - RNA, 14 nt, Human
aaugugauguucua

SEQ ID NO: 3601883 - RNA, 17 nt, Human
aaugugauuacugcucu

SEQ ID NO: 3601884 - RNA, 22 nt, Human
aaugugauuccuuugaagagga

SEQ ID NO: 3601885 - RNA, 14 nt, Human
aaugugauucuaau

SEQ ID NO: 3601886 - RNA, 17 nt, Human
aaugugcaauagaaggu

SEQ ID NO: 3601887 - RNA, 17 nt, Human
aaugugcacuuuauccu

SEQ ID NO: 3601888 - RNA, 20 nt, Human
aaugugcagguuuguuacau

SEQ ID NO: 3601889 - RNA, 23 nt, Human
aaugugcauucuuuuaaaagaca

SEQ ID NO: 3601890 - RNA, 17 nt, Human
aaugugccuaguucuuu

SEQ ID NO: 3601891 - RNA, 12 nt, Human
aaugugccuauu

SEQ ID NO: 3601892 - RNA, 12 nt, Human
aaugugcugugu

SEQ ID NO: 3601893 - RNA, 17 nt, Human
aaugugcuguguaaagu

SEQ ID NO: 3601894 - RNA, 19 nt, Human
aauguggagaacuaaaggu

SEQ ID NO: 3601895 - RNA, 16 nt, Human
aauguggcagcugucu

SEQ ID NO: 3601896 - RNA, 12 nt, Human
aauguggcuuga

SEQ ID NO: 3601897 - RNA, 14 nt, Human
aaugugggauuaug

SEQ ID NO: 3601898 - RNA, 13 nt, Human
aaugugggcacug

SEQ ID NO: 3601899 - RNA, 23 nt, Human
aauguguaaagaucuacaugaau

SEQ ID NO: 3601900 - RNA, 21 nt, Human
aauguguaagaacaacuaccu

SEQ ID NO: 3601901 - RNA, 16 nt, Human
aauguguacaacuuaa

SEQ ID NO: 3601902 - RNA, 19 nt, Human
aauguguacaauguacaca

SEQ ID NO: 3601903 - RNA, 18 nt, Human
aauguguauaaauugucu

SEQ ID NO: 3601904 - RNA, 19 nt, Human
aauguguccuaucuaucuu

SEQ ID NO: 3601905 - RNA, 14 nt, Human
aaugugucuuuaga

SEQ ID NO: 3601906 - RNA, 15 nt, Human
aaugugucuuuagau

SEQ ID NO: 3601907 - RNA, 18 nt, Human
aaugugucuuucuaagaa

SEQ ID NO: 3601908 - RNA, 16 nt, Human
aaugugugcccagcuu

SEQ ID NO: 3601909 - RNA, 16 nt, Human
aauguguguauaugga

SEQ ID NO: 3601910 - RNA, 18 nt, Human
aauguguguauguguauu

SEQ ID NO: 3601911 - RNA, 23 nt, Human
aauguguguauucuuaaaaugca

SEQ ID NO: 3601912 - RNA, 12 nt, Human
aauguguucucg

SEQ ID NO: 3601913 - RNA, 19 nt, Human
aauguguucucggagugug

SEQ ID NO: 3601914 - RNA, 15 nt, Human
aauguguugaaacug

SEQ ID NO: 3601915 - RNA, 19 nt, Human
aauguguuggacaaaugug

SEQ ID NO: 3601916 - RNA, 21 nt, Human
aauguguuggacaaaugugaa

SEQ ID NO: 3601917 - RNA, 23 nt, Human
aauguguuucacaguuugaaaua

SEQ ID NO: 3601918 - RNA, 15 nt, Human
aauguguuuuggucc

SEQ ID NO: 3601919 - RNA, 22 nt, Human
aauguguuuuucuccagugcug

SEQ ID NO: 3601920 - RNA, 12 nt, Human
aauguuaaaaug

SEQ ID NO: 3601921 - RNA, 15 nt, Human
aauguuaaaauguau

SEQ ID NO: 3601922 - RNA, 16 nt, Human
aauguuaaaauguauu

SEQ ID NO: 3601923 - RNA, 13 nt, Human
aauguuaaagaug

SEQ ID NO: 3601924 - RNA, 19 nt, Human
aauguuaaagauguagcaa

SEQ ID NO: 3601925 - RNA, 20 nt, Human
aauguuaaagauguagcaaa

SEQ ID NO: 3601926 - RNA, 13 nt, Human
aauguuaaaggga

SEQ ID NO: 3601927 - RNA, 18 nt, Human
aauguuaaauaaauugua

SEQ ID NO: 3601928 - RNA, 12 nt, Human
aauguuaagaau

SEQ ID NO: 3601929 - RNA, 15 nt, Human
aauguuaagaauuga

SEQ ID NO: 3601930 - RNA, 22 nt, Human
aauguuaagcaucuaaggacaa

SEQ ID NO: 3601931 - RNA, 18 nt, Human
aauguuaaggaaacucuu

SEQ ID NO: 3601932 - RNA, 23 nt, Human
aauguuaauucagcacugauuuc

SEQ ID NO: 3601933 - RNA, 22 nt, Human
aauguuaauuuuuugguacaaa

SEQ ID NO: 3601934 - RNA, 16 nt, Human
aauguuacauagugua

SEQ ID NO: 3601935 - RNA, 17 nt, Human
aauguuacauaguguag

SEQ ID NO: 3601936 - RNA, 15 nt, Human
aauguuacauuauua

SEQ ID NO: 3601937 - RNA, 15 nt, Human
aauguuacauuguuu

SEQ ID NO: 3601938 - RNA, 20 nt, Human
aauguuacugaucaugcauu

SEQ ID NO: 3601939 - RNA, 13 nt, Human
aauguuacugccu

SEQ ID NO: 3601940 - RNA, 17 nt, Human
aauguuaguuaguguag

SEQ ID NO: 3601941 - RNA, 19 nt, Human
aauguuaucuuauacugua

SEQ ID NO: 3601942 - RNA, 16 nt, Human
aauguuaucuucucaa

SEQ ID NO: 3601943 - RNA, 17 nt, Human
aauguuaucuucucaag

SEQ ID NO: 3601944 - RNA, 22 nt, Human
aauguuaucuucucaaguucua

SEQ ID NO: 3601945 - RNA, 22 nt, Human
aauguuaugacuauguaaacua

SEQ ID NO: 3601946 - RNA, 21 nt, Human
aauguuauuuucuucuaagug

SEQ ID NO: 3601947 - RNA, 19 nt, Human
aauguuauuuuuuaauuau

SEQ ID NO: 3601948 - RNA, 20 nt, Human
aauguuauuuuuuaauuauu

SEQ ID NO: 3601949 - RNA, 21 nt, Human
aauguuauuuuuuaauuauua

SEQ ID NO: 3601950 - RNA, 19 nt, Human
aauguucacgcaacuugaa

SEQ ID NO: 3601951 - RNA, 16 nt, Human
aauguucaucaaugaa

SEQ ID NO: 3601952 - RNA, 20 nt, Human
aauguucaucaaugaaugaa

SEQ ID NO: 3601953 - RNA, 21 nt, Human
aauguucaucccaugauguag

SEQ ID NO: 3601954 - RNA, 22 nt, Human
aauguucauuguaauguuacug

SEQ ID NO: 3601955 - RNA, 24 nt, Human
aauguucauuguaauguuacugau

SEQ ID NO: 3601956 - RNA, 15 nt, Human
aauguuccuuuugcu

SEQ ID NO: 3601957 - RNA, 14 nt, Human
aauguucuaaguuu

SEQ ID NO: 3601958 - RNA, 20 nt, Human
aauguucuaaguuucuaaga

SEQ ID NO: 3601959 - RNA, 21 nt, Human
aauguucucucuucuccaccu

SEQ ID NO: 3601960 - RNA, 14 nt, Human
aauguucugacauu

SEQ ID NO: 3601961 - RNA, 20 nt, Human
aauguucugacauuaacagu

SEQ ID NO: 3601962 - RNA, 21 nt, Human
aauguucugugauacagaacu

SEQ ID NO: 3601963 - RNA, 22 nt, Human
aauguucuuaugcaaaauggaa

SEQ ID NO: 3601964 - RNA, 10 nt, Human
aauguucuuu

SEQ ID NO: 3601965 - RNA, 12 nt, Human
aauguucuuuau

SEQ ID NO: 3601966 - RNA, 16 nt, Human
aauguucuuuauauac

SEQ ID NO: 3601967 - RNA, 13 nt, Human
aauguugaaaagu

SEQ ID NO: 3601968 - RNA, 22 nt, Human
aauguugaaauaugauguuaaa

SEQ ID NO: 3601969 - RNA, 15 nt, Human
aauguugaacaaaau

SEQ ID NO: 3601970 - RNA, 19 nt, Human
aauguugaaccaaaccucc

SEQ ID NO: 3601971 - RNA, 19 nt, Human
aauguugauuacagugcag

SEQ ID NO: 3601972 - RNA, 13 nt, Human
aauguugauuucu

SEQ ID NO: 3601973 - RNA, 16 nt, Human
aauguugauuucuagu

SEQ ID NO: 3601974 - RNA, 22 nt, Human
aauguugauuucuaguuauuua

SEQ ID NO: 3601975 - RNA, 20 nt, Human
aauguugcuuaggaugugug

SEQ ID NO: 3601976 - RNA, 16 nt, Human
aauguuggauaaggaa

SEQ ID NO: 3601977 - RNA, 17 nt, Human
aauguuggauaaggaau

SEQ ID NO: 3601978 - RNA, 20 nt, Human
aauguuggcagaugcagcuc

SEQ ID NO: 3601979 - RNA, 23 nt, Human
aauguuggucauuuuauguuaag

SEQ ID NO: 3601980 - RNA, 15 nt, Human
aauguugguuuacuu

SEQ ID NO: 3601981 - RNA, 15 nt, Human
aauguuguuauuuaa

SEQ ID NO: 3601982 - RNA, 15 nt, Human
aauguuuaagcagaa

SEQ ID NO: 3601983 - RNA, 14 nt, Human
aauguuuaaugcug

SEQ ID NO: 3601984 - RNA, 22 nt, Human
aauguuuacagggagccuccug

SEQ ID NO: 3601985 - RNA, 22 nt, Human
aauguuuaugcaaggaaggaaa

SEQ ID NO: 3601986 - RNA, 12 nt, Human
aauguuuccuuu

SEQ ID NO: 3601987 - RNA, 20 nt, Human
aauguuuccuuuaauuuuuu

SEQ ID NO: 3601988 - RNA, 12 nt, Human
aauguuucuaag

SEQ ID NO: 3601989 - RNA, 16 nt, Human
aauguuucuggauuuc

SEQ ID NO: 3601990 - RNA, 20 nt, Human
aauguuugacacaauuggaa

SEQ ID NO: 3601991 - RNA, 18 nt, Human
aauguuugccucugccuc

SEQ ID NO: 3601992 - RNA, 18 nt, Human
aauguuugggcagaaggg

SEQ ID NO: 3601993 - RNA, 19 nt, Human
aauguuuguuaaaaauaaa

SEQ ID NO: 3601994 - RNA, 20 nt, Human
aauguuuuacugugaaacug

SEQ ID NO: 3601995 - RNA, 13 nt, Human
aauguuuucuuug

SEQ ID NO: 3601996 - RNA, 16 nt, Human
aauguuuucuuugcaa

SEQ ID NO: 3601997 - RNA, 17 nt, Human
aauguuuucuuugcaaa

SEQ ID NO: 3601998 - RNA, 12 nt, Human
aauguuuuguaa

SEQ ID NO: 3601999 - RNA, 18 nt, Human
aauguuuuguaaacauuu

SEQ ID NO: 3602000 - RNA, 23 nt, Human
augcgcaggcuggcccugcccug

SEQ ID NO: 3602001 - RNA, 15 nt, Human
augcgcaguugcugu

SEQ ID NO: 3602002 - RNA, 13 nt, Human
augcgcccccucc

SEQ ID NO: 3602003 - RNA, 18 nt, Human
augcggcaagaaggaauu

SEQ ID NO: 3602004 - RNA, 19 nt, Human
augcggccgcauucccuga

SEQ ID NO: 3602005 - RNA, 16 nt, Human
augcgggccagugcuc

SEQ ID NO: 3602006 - RNA, 16 nt, Human
augcguaaacgacacu

SEQ ID NO: 3602007 - RNA, 21 nt, Human
augcguauuauaccaaaaugu

SEQ ID NO: 3602008 - RNA, 13 nt, Human
augcgucccaaga

SEQ ID NO: 3602009 - RNA, 15 nt, Human
augcguucacuccaa

SEQ ID NO: 3602010 - RNA, 14 nt, Human
augcuaaaaccuga

SEQ ID NO: 3602011 - RNA, 23 nt, Human
augcuaaaccuuaguacugaguu

SEQ ID NO: 3602012 - RNA, 22 nt, Human
augcuaaagaaaaagucaucca

SEQ ID NO: 3602013 - RNA, 19 nt, Human
augcuaacaguucacuugc

SEQ ID NO: 3602014 - RNA, 14 nt, Human
augcuaacaucuaa

SEQ ID NO: 3602015 - RNA, 17 nt, Human
augcuaagagaaguaga

SEQ ID NO: 3602016 - RNA, 13 nt, Human
caccccuucccca

SEQ ID NO: 3602017 - RNA, 15 nt, Human
caccccuuccccacu

SEQ ID NO: 3602018 - RNA, 15 nt, Human
caccccuuccugggc

SEQ ID NO: 3602019 - RNA, 13 nt, Human
caccccuuccugu

SEQ ID NO: 3602020 - RNA, 16 nt, Human
caccccuuccuguccc

SEQ ID NO: 3602021 - RNA, 18 nt, Human
caccccuucucuccuccc

SEQ ID NO: 3602022 - RNA, 13 nt, Human
cacccgaccacac

SEQ ID NO: 3602023 - RNA, 15 nt, Human
cacccgacuccucaa

SEQ ID NO: 3602024 - RNA, 17 nt, Human
cacccgaggcugcccac

SEQ ID NO: 3602025 - RNA, 23 nt, Human
cacccgaugcugcuuuccccugu

SEQ ID NO: 3602026 - RNA, 15 nt, Human
cacccggcugcagag

SEQ ID NO: 3602027 - RNA, 13 nt, Human
cacccgggcucag

SEQ ID NO: 3602028 - RNA, 23 nt, Human
cacccgguccccacuuuauugcc

SEQ ID NO: 3602029 - RNA, 19 nt, Human
cacccggugaccucuagcc

SEQ ID NO: 3602030 - RNA, 21 nt, Human
cacccggugggacccccgugg

SEQ ID NO: 3602031 - RNA, 17 nt, Human
cacccgugagcgccugu

SEQ ID NO: 3602032 - RNA, 16 nt, Human
cacccguggagauggg

SEQ ID NO: 3602033 - RNA, 17 nt, Human
cacccgugguggcucaa

SEQ ID NO: 3602034 - RNA, 21 nt, Human
cacccguucugcuggccugga

SEQ ID NO: 3602035 - RNA, 20 nt, Human
cacccuaauguggcagcugu

SEQ ID NO: 3602036 - RNA, 16 nt, Human
cacccuaccugugccu

SEQ ID NO: 3602037 - RNA, 16 nt, Human
cacccuaccuguucag

SEQ ID NO: 3602038 - RNA, 16 nt, Human
cacccuagucccuucc

SEQ ID NO: 3602039 - RNA, 18 nt, Human
cacccuagucccuucccc

SEQ ID NO: 3602040 - RNA, 20 nt, Human
cacccuagucccuuccccuc

SEQ ID NO: 3602041 - RNA, 17 nt, Human
cacccuaguuucccuga

SEQ ID NO: 3602042 - RNA, 12 nt, Human
cacccucacacu

SEQ ID NO: 3602043 - RNA, 16 nt, Human
cacccucacucugcca

SEQ ID NO: 3602044 - RNA, 20 nt, Human
cacccucacuggcucuccug

SEQ ID NO: 3602045 - RNA, 21 nt, Human
cacccucacuggcucuccugg

SEQ ID NO: 3602046 - RNA, 19 nt, Human
cacccucagcaccccuucc

SEQ ID NO: 3602047 - RNA, 22 nt, Human
cacccucagcaccccuuccaug

SEQ ID NO: 3602048 - RNA, 14 nt, Human
cacccucaggcagg

SEQ ID NO: 3602049 - RNA, 17 nt, Human
cacccucauucuacuga

SEQ ID NO: 3602050 - RNA, 16 nt, Human
cacccuccacccuguc

SEQ ID NO: 3602051 - RNA, 17 nt, Human
cacccuccacccugucc

SEQ ID NO: 3602052 - RNA, 19 nt, Human
cacccucccagaccugccu

SEQ ID NO: 3602053 - RNA, 20 nt, Human
cacccucccccgccacuccu

SEQ ID NO: 3602054 - RNA, 11 nt, Human
cacccuccccu

SEQ ID NO: 3602055 - RNA, 19 nt, Human
cacccuccccucucuugca

SEQ ID NO: 3602056 - RNA, 23 nt, Human
cacccuccccucucuugcacccg

SEQ ID NO: 3602057 - RNA, 16 nt, Human
cacccuccccuuccca

SEQ ID NO: 3602058 - RNA, 20 nt, Human
cacccuccccuucccagggc

SEQ ID NO: 3602059 - RNA, 13 nt, Human
cacccucccugga

SEQ ID NO: 3602060 - RNA, 14 nt, Human
cacccucccuggag

SEQ ID NO: 3602061 - RNA, 12 nt, Human
cacccuccuggc

SEQ ID NO: 3602062 - RNA, 18 nt, Human
cacccuccuggccucaga

SEQ ID NO: 3602063 - RNA, 22 nt, Human
cacccuccuggccucagacugc

SEQ ID NO: 3602064 - RNA, 19 nt, Human
cacccuccugucuucccag

SEQ ID NO: 3602065 - RNA, 20 nt, Human
cacccuccugucuucccagg

SEQ ID NO: 3602066 - RNA, 21 nt, Human
cacccuccugucuucccaggg

SEQ ID NO: 3602067 - RNA, 22 nt, Human
cacccuccuucccacucuucuc

SEQ ID NO: 3602068 - RNA, 16 nt, Human
cacccucgaagcgcgc

SEQ ID NO: 3602069 - RNA, 23 nt, Human
cacccucgaagcgcgccacucgc

SEQ ID NO: 3602070 - RNA, 24 nt, Human
cacccucgaagcgcgccacucgcu

SEQ ID NO: 3602071 - RNA, 22 nt, Human
cacccucggggauguguccuga

SEQ ID NO: 3602072 - RNA, 15 nt, Human
cacccucucccagga

SEQ ID NO: 3602073 - RNA, 13 nt, Human
cacccucugagcu

SEQ ID NO: 3602074 - RNA, 22 nt, Human
cacccucugagcuuugcauguu

SEQ ID NO: 3602075 - RNA, 22 nt, Human
cacccucuggcugaggagcugu

SEQ ID NO: 3602076 - RNA, 11 nt, Human
cacccucuucc

SEQ ID NO: 3602077 - RNA, 14 nt, Human
cacccucuuccuac

SEQ ID NO: 3602078 - RNA, 16 nt, Human
cacccucuuccuacug

SEQ ID NO: 3602079 - RNA, 17 nt, Human
cacccucuuccuacugg

SEQ ID NO: 3602080 - RNA, 17 nt, Human
cacccugaaagcccuga

SEQ ID NO: 3602081 - RNA, 12 nt, Human
cacccugagccc

SEQ ID NO: 3602082 - RNA, 21 nt, Human
cacccugaggagucugagguc

SEQ ID NO: 3602083 - RNA, 17 nt, Human
cacccugaggucaggga

SEQ ID NO: 3602084 - RNA, 17 nt, Human
cacccugauaggaagag

SEQ ID NO: 3602085 - RNA, 17 nt, Human
cacccugccccucagag

SEQ ID NO: 3602086 - RNA, 12 nt, Human
cacccugccuua

SEQ ID NO: 3602087 - RNA, 13 nt, Human
cacccugccuuau

SEQ ID NO: 3602088 - RNA, 15 nt, Human
cacccugcugccuuc

SEQ ID NO: 3602089 - RNA, 17 nt, Human
cacccugcuuggcccag

SEQ ID NO: 3602090 - RNA, 21 nt, Human
cacccuggaggauuucaucuc

SEQ ID NO: 3602091 - RNA, 21 nt, Human
cacccuggauugaucggagcc

SEQ ID NO: 3602092 - RNA, 19 nt, Human
cacccuggccuagaccagc

SEQ ID NO: 3602093 - RNA, 23 nt, Human
cacccuggccuagaccagcagac

SEQ ID NO: 3602094 - RNA, 16 nt, Human
cacccugggcucugug

SEQ ID NO: 3602095 - RNA, 17 nt, Human
cacccugggcucugugg

SEQ ID NO: 3602096 - RNA, 17 nt, Human
cacccuguacuguucug

SEQ ID NO: 3602097 - RNA, 21 nt, Human
cacccuguacuguucuguguc

SEQ ID NO: 3602098 - RNA, 20 nt, Human
cacccuguccaaacugccua

SEQ ID NO: 3602099 - RNA, 23 nt, Human
cacccuguccaaacugccuaagc

SEQ ID NO: 3602100 - RNA, 16 nt, Human
cacccugucccccagc

SEQ ID NO: 3602101 - RNA, 20 nt, Human
cacccugucccccagcucug

SEQ ID NO: 3602102 - RNA, 19 nt, Human
cacccugucugccccgccc

SEQ ID NO: 3602103 - RNA, 11 nt, Human
cacccugugau

SEQ ID NO: 3602104 - RNA, 12 nt, Human
cacccugugaug

SEQ ID NO: 3602105 - RNA, 20 nt, Human
cacccugugauggggcccug

SEQ ID NO: 3602106 - RNA, 16 nt, Human
cacccuguggcccugg

SEQ ID NO: 3602107 - RNA, 14 nt, Human
cacccuguuccugc

SEQ ID NO: 3602108 - RNA, 20 nt, Human
cacccuguuuggauuuuuaa

SEQ ID NO: 3602109 - RNA, 22 nt, Human
cacccuguuuggauuuuuaauu

SEQ ID NO: 3602110 - RNA, 17 nt, Human
cacccuuaacccaagga

SEQ ID NO: 3602111 - RNA, 20 nt, Human
cacccuucacauacccuccc

SEQ ID NO: 3602112 - RNA, 19 nt, Human
cacccuuccaucugauucc

SEQ ID NO: 3602113 - RNA, 13 nt, Human
cacccuuccccuc

SEQ ID NO: 3602114 - RNA, 14 nt, Human
cacccuuccccucc

SEQ ID NO: 3602115 - RNA, 23 nt, Human
cacccuuccccuccuucucccuu

SEQ ID NO: 3602116 - RNA, 18 nt, Human
cacccuucucccacucuc

SEQ ID NO: 3602117 - RNA, 16 nt, Human
cacccuucuuuccucu

SEQ ID NO: 3602118 - RNA, 20 nt, Human
cacccuucuuuccucuuccc

SEQ ID NO: 3602119 - RNA, 14 nt, Human
cacccuucuuuucu

SEQ ID NO: 3602120 - RNA, 16 nt, Human
cacccuucuuuucuca

SEQ ID NO: 3602121 - RNA, 23 nt, Human
cacccuugcccaccccaccccca

SEQ ID NO: 3602122 - RNA, 13 nt, Human
cacccuuggacuu

SEQ ID NO: 3602123 - RNA, 16 nt, Human
cacccuuggacuugag

SEQ ID NO: 3602124 - RNA, 15 nt, Human
cacccuuggagcucu

SEQ ID NO: 3602125 - RNA, 23 nt, Human
cacccuuggccugucucaucccc

SEQ ID NO: 3602126 - RNA, 13 nt, Human
cacccuuguucca

SEQ ID NO: 3602127 - RNA, 20 nt, Human
cacccuuugcugugaggcug

SEQ ID NO: 3602128 - RNA, 17 nt, Human
cacccuuuuccagcugg

SEQ ID NO: 3602129 - RNA, 23 nt, Human
caccgaaguggacuggccccugg

SEQ ID NO: 3602130 - RNA, 17 nt, Human
caccgacgcgucuccug

SEQ ID NO: 3602131 - RNA, 19 nt, Human
caccgacgcgucuccuguu

SEQ ID NO: 3602132 - RNA, 13 nt, Human
caccgagaauguu

SEQ ID NO: 3602133 - RNA, 14 nt, Human
caccgaggggccuu

SEQ ID NO: 3602134 - RNA, 13 nt, Human
caccgcagacagg

SEQ ID NO: 3602135 - RNA, 15 nt, Human
caccgcagacaggac

SEQ ID NO: 3602136 - RNA, 13 nt, Human
caccgcagucguc

SEQ ID NO: 3602137 - RNA, 18 nt, Human
caccgcaugcccccucgu

SEQ ID NO: 3602138 - RNA, 23 nt, Human
caccgccauggcuuccaaggugg

SEQ ID NO: 3602139 - RNA, 19 nt, Human
caccgccgacuuuguaccc

SEQ ID NO: 3602140 - RNA, 19 nt, Human
caccgccggccagcuggga

SEQ ID NO: 3602141 - RNA, 19 nt, Human
caccgccuccccaccucca

SEQ ID NO: 3602142 - RNA, 22 nt, Human
caccgccuccccaccuccaggc

SEQ ID NO: 3602143 - RNA, 15 nt, Human
caccgccucuucccg

SEQ ID NO: 3602144 - RNA, 16 nt, Human
caccuaguggcugucc

SEQ ID NO: 3602145 - RNA, 18 nt, Human
caccuaguggcuguccag

SEQ ID NO: 3602146 - RNA, 22 nt, Human
caccuaguggcuguccagugcc

SEQ ID NO: 3602147 - RNA, 23 nt, Human
caccuaguggcuguccagugccc

SEQ ID NO: 3602148 - RNA, 16 nt, Human
caccuauaaaacaggu

SEQ ID NO: 3602149 - RNA, 20 nt, Human
caccuauaauaccagcuacu

SEQ ID NO: 3602150 - RNA, 16 nt, Human
caccuauagucccagc

SEQ ID NO: 3602151 - RNA, 18 nt, Human
caccuaucucgugggaga

SEQ ID NO: 3602152 - RNA, 19 nt, Human
caccuaugucauuucauuu

SEQ ID NO: 3602153 - RNA, 18 nt, Human
caccuauuaucccagcug

SEQ ID NO: 3602154 - RNA, 17 nt, Human
caccucacacuccuuua

SEQ ID NO: 3602155 - RNA, 11 nt, Human
caccucacccc

SEQ ID NO: 3602156 - RNA, 13 nt, Human
caccucacuccug

SEQ ID NO: 3602157 - RNA, 15 nt, Human
caccucacuccuguu

SEQ ID NO: 3602158 - RNA, 16 nt, Human
caccucacucugcuac

SEQ ID NO: 3602159 - RNA, 12 nt, Human
caccucagaugg

SEQ ID NO: 3602160 - RNA, 19 nt, Human
caccucagauggcagcuuu

SEQ ID NO: 3602161 - RNA, 11 nt, Human
caccucagccu

SEQ ID NO: 3602162 - RNA, 18 nt, Human
caccucagccuccugugu

SEQ ID NO: 3602163 - RNA, 12 nt, Human
caccucagccug

SEQ ID NO: 3602164 - RNA, 14 nt, Human
caccucagccugca

SEQ ID NO: 3602165 - RNA, 15 nt, Human
caccucagccuugga

SEQ ID NO: 3602166 - RNA, 15 nt, Human
caccucaggccaggu

SEQ ID NO: 3602167 - RNA, 23 nt, Human
caccucaggccaggugcaguggc

SEQ ID NO: 3602168 - RNA, 22 nt, Human
caccucaguucccuuggccuca

SEQ ID NO: 3602169 - RNA, 15 nt, Human
caccucaugcccacc

SEQ ID NO: 3602170 - RNA, 19 nt, Human
caccucaugcccacccccu

SEQ ID NO: 3602171 - RNA, 11 nt, Human
caccucaugga

SEQ ID NO: 3602172 - RNA, 12 nt, Human
caccucauggaa

SEQ ID NO: 3602173 - RNA, 14 nt, Human
caccuccagcccgg

SEQ ID NO: 3602174 - RNA, 16 nt, Human
caccuccagcccggga

SEQ ID NO: 3602175 - RNA, 21 nt, Human
caccuccagcccgggagccua

SEQ ID NO: 3602176 - RNA, 18 nt, Human
caccuccaggccuguugc

SEQ ID NO: 3602177 - RNA, 12 nt, Human
caccuccaggcu

SEQ ID NO: 3602178 - RNA, 22 nt, Human
caccuccagucccccuauccuu

SEQ ID NO: 3602179 - RNA, 15 nt, Human
caccuccaucccaga

SEQ ID NO: 3602180 - RNA, 13 nt, Human
caccuccccacgc

SEQ ID NO: 3602181 - RNA, 17 nt, Human
caccuccccacgcccuc

SEQ ID NO: 3602182 - RNA, 19 nt, Human
caccuccccacgcccuccc

SEQ ID NO: 3602183 - RNA, 21 nt, Human
caccucccccacucccaacca

SEQ ID NO: 3602184 - RNA, 14 nt, Human
caccuccccuugcc

SEQ ID NO: 3602185 - RNA, 15 nt, Human
caccuccccuugcca

SEQ ID NO: 3602186 - RNA, 16 nt, Human
caccuccccuugccag

SEQ ID NO: 3602187 - RNA, 22 nt, Human
caccuccccuugccagcugcug

SEQ ID NO: 3602188 - RNA, 15 nt, Human
caccucccucaaccu

SEQ ID NO: 3602189 - RNA, 19 nt, Human
caccucccugaaccauccc

SEQ ID NO: 3602190 - RNA, 17 nt, Human
caccucccugccuccag

SEQ ID NO: 3602191 - RNA, 18 nt, Human
caccuccuaaaaggccca

SEQ ID NO: 3602192 - RNA, 16 nt, Human
caccuccucccacugc

SEQ ID NO: 3602193 - RNA, 22 nt, Human
caccuccucggcuggcugucca

SEQ ID NO: 3602194 - RNA, 11 nt, Human
caccuccugcc

SEQ ID NO: 3602195 - RNA, 14 nt, Human
caccuccugccucg

SEQ ID NO: 3602196 - RNA, 22 nt, Human
caccuccuugucacuuuauuac

SEQ ID NO: 3602197 - RNA, 15 nt, Human
caccucgaauuuugu

SEQ ID NO: 3602198 - RNA, 21 nt, Human
caccucguuagggaagagaaa

SEQ ID NO: 3602199 - RNA, 16 nt, Human
caccucuaacagcacc

SEQ ID NO: 3602200 - RNA, 22 nt, Human
caccucuacccaaacccuaggu

SEQ ID NO: 3602201 - RNA, 13 nt, Human
caccucuccaagg

SEQ ID NO: 3602202 - RNA, 12 nt, Human
caccucucccuc

SEQ ID NO: 3602203 - RNA, 14 nt, Human
caccucucccucaa

SEQ ID NO: 3602204 - RNA, 19 nt, Human
caccucucccucaacaagg

SEQ ID NO: 3602205 - RNA, 16 nt, Human
caccucucuccuuugc

SEQ ID NO: 3602206 - RNA, 19 nt, Human
caccucugcacaagcugca

SEQ ID NO: 3602207 - RNA, 12 nt, Human
caccucugccag

SEQ ID NO: 3602208 - RNA, 13 nt, Human
caccucugccaga

SEQ ID NO: 3602209 - RNA, 13 nt, Human
caccucugccuca

SEQ ID NO: 3602210 - RNA, 19 nt, Human
caccucugcggaccccagc

SEQ ID NO: 3602211 - RNA, 22 nt, Human
caccucugcuacucaaguagca

SEQ ID NO: 3602212 - RNA, 12 nt, Human
caccucugcugc

SEQ ID NO: 3602213 - RNA, 19 nt, Human
caccucugucauuuguugu

SEQ ID NO: 3602214 - RNA, 18 nt, Human
caccucugugaccucagg

SEQ ID NO: 3602215 - RNA, 13 nt, Human
caccucuguggca

SEQ ID NO: 3602216 - RNA, 22 nt, Human
caccucuuaaagaaaacccacc

SEQ ID NO: 3602217 - RNA, 20 nt, Human
caccucuucaccccccacuc

SEQ ID NO: 3602218 - RNA, 15 nt, Human
caccucuuccuggcc

SEQ ID NO: 3602219 - RNA, 16 nt, Human
caccucuuccuggccg

SEQ ID NO: 3602220 - RNA, 17 nt, Human
caccucuucucuuccug

SEQ ID NO: 3602221 - RNA, 14 nt, Human
caccugaagacuca

SEQ ID NO: 3602222 - RNA, 23 nt, Human
caccugaagacucauucuucugu

SEQ ID NO: 3602223 - RNA, 16 nt, Human
caccugacacaccagg

SEQ ID NO: 3602224 - RNA, 23 nt, Human
caccugacucugaaaucugaaga

SEQ ID NO: 3602225 - RNA, 21 nt, Human
caccugagcccggaugcuucu

SEQ ID NO: 3602226 - RNA, 17 nt, Human
caccugaggugggccca

SEQ ID NO: 3602227 - RNA, 23 nt, Human
caccugagucacccuaccugugc

SEQ ID NO: 3602228 - RNA, 16 nt, Human
caccugauguguacau

SEQ ID NO: 3602229 - RNA, 19 nt, Human
caccugauucaacuaaaaa

SEQ ID NO: 3602230 - RNA, 20 nt, Human
caccugcaaagcucuguggc

SEQ ID NO: 3602231 - RNA, 13 nt, Human
caccugcaccucc

SEQ ID NO: 3602232 - RNA, 23 nt, Human
caccugcagauucuaggaccugu

SEQ ID NO: 3602233 - RNA, 15 nt, Human
cacuaccuccucagg

SEQ ID NO: 3602234 - RNA, 16 nt, Human
cacuaccuccucaggg

SEQ ID NO: 3602235 - RNA, 14 nt, Human
cacuacuccucugc

SEQ ID NO: 3602236 - RNA, 18 nt, Human
cacuacuccucugcagug

SEQ ID NO: 3602237 - RNA, 13 nt, Human
cacuacucugugc

SEQ ID NO: 3602238 - RNA, 13 nt, Human
cacuacugacaug

SEQ ID NO: 3602239 - RNA, 15 nt, Human
cacuacugacaugug

SEQ ID NO: 3602240 - RNA, 13 nt, Human
cacuacugcagca

SEQ ID NO: 3602241 - RNA, 16 nt, Human
cacuacugcagcaccu

SEQ ID NO: 3602242 - RNA, 15 nt, Human
cacuacuggguguca

SEQ ID NO: 3602243 - RNA, 12 nt, Human
cacuagaaaacu

SEQ ID NO: 3602244 - RNA, 17 nt, Human
cacuagaacucuccauc

SEQ ID NO: 3602245 - RNA, 13 nt, Human
cacuagaauggau

SEQ ID NO: 3602246 - RNA, 18 nt, Human
cacuagaauggauaaaau

SEQ ID NO: 3602247 - RNA, 21 nt, Human
cacuagacaagccagaacuug

SEQ ID NO: 3602248 - RNA, 22 nt, Human
cacuagccaaaccucaccaacu

SEQ ID NO: 3602249 - RNA, 18 nt, Human
cacuagccuuuggcucug

SEQ ID NO: 3602250 - RNA, 18 nt, Human
cacuaggacucugaggcu

SEQ ID NO: 3602251 - RNA, 20 nt, Human
cacuaggcacccagcugcca

SEQ ID NO: 3602252 - RNA, 17 nt, Human
cacuaggcccccacuug

SEQ ID NO: 3602253 - RNA, 21 nt, Human
cacuaggcccccacuugccuc

SEQ ID NO: 3602254 - RNA, 23 nt, Human
cacuaggcccccacuugccucuu

SEQ ID NO: 3602255 - RNA, 18 nt, Human
cacuaggcugggugccca

SEQ ID NO: 3602256 - RNA, 17 nt, Human
cacuagggccuuggaaa

SEQ ID NO: 3602257 - RNA, 21 nt, Human
cacuaguaaguaauuaugcac

SEQ ID NO: 3602258 - RNA, 19 nt, Human
cacuaguauuucuaugaaa

SEQ ID NO: 3602259 - RNA, 20 nt, Human
cacuagucugugugcugugg

SEQ ID NO: 3602260 - RNA, 21 nt, Human
cacuagucugugugcuguggu

SEQ ID NO: 3602261 - RNA, 21 nt, Human
cacuagugaccccuucccugu

SEQ ID NO: 3602262 - RNA, 19 nt, Human
cacuauaaaugguguuuuu

SEQ ID NO: 3602263 - RNA, 14 nt, Human
cacuauaauguaag

SEQ ID NO: 3602264 - RNA, 14 nt, Human
cacuauacagauuc

SEQ ID NO: 3602265 - RNA, 21 nt, Human
cacuauagccuaggugacaga

SEQ ID NO: 3602266 - RNA, 17 nt, Human
cacuauaguuuaaaaca

SEQ ID NO: 3602267 - RNA, 19 nt, Human
cacuaucauaguuaacaua

SEQ ID NO: 3602268 - RNA, 11 nt, Human
cacuaucuggg

SEQ ID NO: 3602269 - RNA, 17 nt, Human
cacuaucugggugcaug

SEQ ID NO: 3602270 - RNA, 18 nt, Human
cacuaucugggugcauga

SEQ ID NO: 3602271 - RNA, 14 nt, Human
cacuaugaagaugu

SEQ ID NO: 3602272 - RNA, 17 nt, Human
cacuaugguauuugagu

SEQ ID NO: 3602273 - RNA, 13 nt, Human
cacuauggugcca

SEQ ID NO: 3602274 - RNA, 15 nt, Human
cacuauggugccaau

SEQ ID NO: 3602275 - RNA, 17 nt, Human
cacuauguugcccaggc

SEQ ID NO: 3602276 - RNA, 18 nt, Human
cacuauuuauuuacaaau

SEQ ID NO: 3602277 - RNA, 14 nt, Human
cacuauuuccuuua

SEQ ID NO: 3602278 - RNA, 13 nt, Human
cacuauuuuaugc

SEQ ID NO: 3602279 - RNA, 13 nt, Human
cacuauuuucaga

SEQ ID NO: 3602280 - RNA, 20 nt, Human
cacuauuuucagaaucugaa

SEQ ID NO: 3602281 - RNA, 21 nt, Human
cacuauuuucagaaucugaau

SEQ ID NO: 3602282 - RNA, 19 nt, Human
cacucaaaagcugggcagg

SEQ ID NO: 3602283 - RNA, 12 nt, Human
cacucaaaggcc

SEQ ID NO: 3602284 - RNA, 15 nt, Human
cacucaaaggccaga

SEQ ID NO: 3602285 - RNA, 16 nt, Human
cacucaaaucaagaaa

SEQ ID NO: 3602286 - RNA, 17 nt, Human
cacucaaaucuuaagaa

SEQ ID NO: 3602287 - RNA, 19 nt, Human
cacucaaauuaaucuuucu

SEQ ID NO: 3602288 - RNA, 22 nt, Human
cacucaacaaaagugcuuugga

SEQ ID NO: 3602289 - RNA, 19 nt, Human
cacucaagaagcaggcuac

SEQ ID NO: 3602290 - RNA, 11 nt, Human
cacuccuugca

SEQ ID NO: 3602291 - RNA, 18 nt, Human
augugacauucuuaaaaa

SEQ ID NO: 3602292 - RNA, 13 nt, Human
augugacauuuau

SEQ ID NO: 3602293 - RNA, 14 nt, Human
augugacauuuaua

SEQ ID NO: 3602294 - RNA, 13 nt, Human
augugacauuugu

SEQ ID NO: 3602295 - RNA, 16 nt, Human
augugacauuuuacau

SEQ ID NO: 3602296 - RNA, 15 nt, Human
augugaccauaaugu

SEQ ID NO: 3602297 - RNA, 17 nt, Human
augugagagguuugacu

SEQ ID NO: 3602298 - RNA, 21 nt, Human
augugagauuuuuuauugcua

SEQ ID NO: 3602299 - RNA, 15 nt, Human
augugagcucuuccu

SEQ ID NO: 3602300 - RNA, 12 nt, Human
augugaggaugu

SEQ ID NO: 3602301 - RNA, 17 nt, Human
augugaguauucucauu

SEQ ID NO: 3602302 - RNA, 20 nt, Human
augugagugccuuuugcaga

SEQ ID NO: 3602303 - RNA, 22 nt, Human
augugagugguugaauaugauu

SEQ ID NO: 3602304 - RNA, 20 nt, Human
augugauaaggaucagaaca

SEQ ID NO: 3602305 - RNA, 21 nt, Human
augugauaaguucuuaugcca

SEQ ID NO: 3602306 - RNA, 21 nt, Human
augugauacauuuuuuaagcu

SEQ ID NO: 3602307 - RNA, 22 nt, Human
augugauacauuuuuuaagcuu

SEQ ID NO: 3602308 - RNA, 21 nt, Human
augugauacccauagcuucca

SEQ ID NO: 3602309 - RNA, 16 nt, Human
augugauauauaagug

SEQ ID NO: 3602310 - RNA, 19 nt, Human
augugaucauguguggaag

SEQ ID NO: 3602311 - RNA, 20 nt, Human
augugaucauguguggaagu

SEQ ID NO: 3602312 - RNA, 16 nt, Human
augugauccuuuuaug

SEQ ID NO: 3602313 - RNA, 18 nt, Human
augugauccuuuuauguu

SEQ ID NO: 3602314 - RNA, 18 nt, Human
augugauccuuuuggagu

SEQ ID NO: 3602315 - RNA, 21 nt, Human
augugaucuauguuucaucuu

SEQ ID NO: 3602316 - RNA, 16 nt, Human
augugaucucauuguu

SEQ ID NO: 3602317 - RNA, 19 nt, Human
augugaucugucuuguaau

SEQ ID NO: 3602318 - RNA, 17 nt, Human
augugaugaauacugua

SEQ ID NO: 3602319 - RNA, 17 nt, Human
augugaugauguaauug

SEQ ID NO: 3602320 - RNA, 18 nt, Human
augugauggacacuccag

SEQ ID NO: 3602321 - RNA, 17 nt, Human
augugauguucuaaggc

SEQ ID NO: 3602322 - RNA, 20 nt, Human
augugauguucuaaggcucu

SEQ ID NO: 3602323 - RNA, 21 nt, Human
augugauguucuaaggcucug

SEQ ID NO: 3602324 - RNA, 15 nt, Human
augugauucaaaaga

SEQ ID NO: 3602325 - RNA, 17 nt, Human
augugauuguggaaugg

SEQ ID NO: 3602326 - RNA, 22 nt, Human
augugauuguggaauggagauu

SEQ ID NO: 3602327 - RNA, 15 nt, Human
augugauuuaaacaa

SEQ ID NO: 3602328 - RNA, 13 nt, Human
augugauuuaaua

SEQ ID NO: 3602329 - RNA, 15 nt, Human
augugauuuuaacuc

SEQ ID NO: 3602330 - RNA, 14 nt, Human
augugauuuuucug

SEQ ID NO: 3602331 - RNA, 21 nt, Human
augugcaaacccacucagaga

SEQ ID NO: 3602332 - RNA, 16 nt, Human
augugcacccaugggc

SEQ ID NO: 3602333 - RNA, 22 nt, Human
augugcacccaugggcucugac

SEQ ID NO: 3602334 - RNA, 15 nt, Human
augugcacugucacu

SEQ ID NO: 3602335 - RNA, 17 nt, Human
augugcagcauuucacu

SEQ ID NO: 3602336 - RNA, 23 nt, Human
augugcaguguagcccacacuug

SEQ ID NO: 3602337 - RNA, 13 nt, Human
augugccaaggug

SEQ ID NO: 3602338 - RNA, 20 nt, Human
augugccagggcaaugauga

SEQ ID NO: 3602339 - RNA, 21 nt, Human
augugccagguuuuuggucug

SEQ ID NO: 3602340 - RNA, 22 nt, Human
augugccauuuuaaaaaaaaag

SEQ ID NO: 3602341 - RNA, 16 nt, Human
augugcccuccugagg

SEQ ID NO: 3602342 - RNA, 17 nt, Human
augugcccuccugaggg

SEQ ID NO: 3602343 - RNA, 18 nt, Human
augugccuaaauaaguua

SEQ ID NO: 3602344 - RNA, 11 nt, Human
augugccuauu

SEQ ID NO: 3602345 - RNA, 23 nt, Human
augugccuauugcuagagcuccu

SEQ ID NO: 3602346 - RNA, 17 nt, Human
augugccugcaccagga

SEQ ID NO: 3602347 - RNA, 14 nt, Human
augugcgugugugc

SEQ ID NO: 3602348 - RNA, 18 nt, Human
augugcgugugugcaagu

SEQ ID NO: 3602349 - RNA, 15 nt, Human
augugcuacaggggc

SEQ ID NO: 3602350 - RNA, 19 nt, Human
augugcuacaggggccaga

SEQ ID NO: 3602351 - RNA, 23 nt, Human
augugcuacaggggccagaagau

SEQ ID NO: 3602352 - RNA, 20 nt, Human
augugcuacugauuguuuca

SEQ ID NO: 3602353 - RNA, 20 nt, Human
augugcuaguaauuggaaag

SEQ ID NO: 3602354 - RNA, 21 nt, Human
augugcuaguaauuggaaagg

SEQ ID NO: 3602355 - RNA, 18 nt, Human
augugcuauacugcauac

SEQ ID NO: 3602356 - RNA, 19 nt, Human
augugcuauacugcauacu

SEQ ID NO: 3602357 - RNA, 16 nt, Human
augugcuauuaauauu

SEQ ID NO: 3602358 - RNA, 17 nt, Human
augugcuauuaauauuu

SEQ ID NO: 3602359 - RNA, 14 nt, Human
augugcugcuuuga

SEQ ID NO: 3602360 - RNA, 16 nt, Human
augugcugcuuugaua

SEQ ID NO: 3602361 - RNA, 20 nt, Human
augugcugcuuugauauaua

SEQ ID NO: 3602362 - RNA, 15 nt, Human
augugcuguguaaag

SEQ ID NO: 3602363 - RNA, 18 nt, Human
augugcuguguaaaguua

SEQ ID NO: 3602364 - RNA, 15 nt, Human
augugcuuuucucca

SEQ ID NO: 3602365 - RNA, 16 nt, Human
augugcuuuucuccaa

SEQ ID NO: 3602366 - RNA, 13 nt, Human
auguggaaaacag

SEQ ID NO: 3602367 - RNA, 15 nt, Human
auguggaaagugaau

SEQ ID NO: 3602368 - RNA, 17 nt, Human
auguggaacugcugcca

SEQ ID NO: 3602369 - RNA, 19 nt, Human
auguggaacugcugccacu

SEQ ID NO: 3602370 - RNA, 15 nt, Human
auguggaaguguggg

SEQ ID NO: 3602371 - RNA, 18 nt, Human
auguggaccuuagaauac

SEQ ID NO: 3602372 - RNA, 16 nt, Human
auguggacuuaggaag

SEQ ID NO: 3602373 - RNA, 17 nt, Human
auguggacuuaggaagg

SEQ ID NO: 3602374 - RNA, 12 nt, Human
auguggagccag

SEQ ID NO: 3602375 - RNA, 14 nt, Human
auguggagccaggc

SEQ ID NO: 3602376 - RNA, 20 nt, Human
auguggaguucaucuugaau

SEQ ID NO: 3602377 - RNA, 13 nt, Human
auguggcaggggu

SEQ ID NO: 3602378 - RNA, 18 nt, Human
auguggccccugaacaag

SEQ ID NO: 3602379 - RNA, 22 nt, Human
auguggccccugaacaagaauu

SEQ ID NO: 3602380 - RNA, 16 nt, Human
auguggcccuggccug

SEQ ID NO: 3602381 - RNA, 16 nt, Human
auguggccuuugaauu

SEQ ID NO: 3602382 - RNA, 14 nt, Human
auguggcuggaaga

SEQ ID NO: 3602383 - RNA, 21 nt, Human
auguggcuugagaaauaugga

SEQ ID NO: 3602384 - RNA, 22 nt, Human
auguggcuuuuuuaaaaaagca

SEQ ID NO: 3602385 - RNA, 18 nt, Human
augugggaagaaacaaac

SEQ ID NO: 3602386 - RNA, 20 nt, Human
augugggaauuaagcaaaau

SEQ ID NO: 3602387 - RNA, 11 nt, Human
augugggaggg

SEQ ID NO: 3602388 - RNA, 17 nt, Human
augugggauauugaaug

SEQ ID NO: 3602389 - RNA, 19 nt, Human
augugggauauugaauguu

SEQ ID NO: 3602390 - RNA, 13 nt, Human
augugggauuaug

SEQ ID NO: 3602391 - RNA, 14 nt, Human
augugggauuaugg

SEQ ID NO: 3602392 - RNA, 18 nt, Human
augugggauuauggguca

SEQ ID NO: 3602393 - RNA, 18 nt, Human
augugggcacuggcccag

SEQ ID NO: 3602394 - RNA, 16 nt, Human
auguggguuccacaga

SEQ ID NO: 3602395 - RNA, 19 nt, Human
auguggucguuagagacag

SEQ ID NO: 3602396 - RNA, 23 nt, Human
auguggucguuagagacagagcg

SEQ ID NO: 3602397 - RNA, 13 nt, Human
auguggucucagg

SEQ ID NO: 3602398 - RNA, 22 nt, Human
augugguggcacaggcccccuu

SEQ ID NO: 3602399 - RNA, 21 nt, Human
augugguuacacagugugaau

SEQ ID NO: 3602400 - RNA, 19 nt, Human
augugguuugguuccucuc

SEQ ID NO: 3602401 - RNA, 21 nt, Human
augugguuugguuccucucug

SEQ ID NO: 3602402 - RNA, 22 nt, Human
augugguuugguuccucucugg

SEQ ID NO: 3602403 - RNA, 13 nt, Human
auguguaauaaau

SEQ ID NO: 3602404 - RNA, 17 nt, Human
auguguaauaaauaugu

SEQ ID NO: 3602405 - RNA, 21 nt, Human
auguguaaucaauaaacgauu

SEQ ID NO: 3602406 - RNA, 12 nt, Human
auguguaauuuu

SEQ ID NO: 3602407 - RNA, 15 nt, Human
auguguaauuuuucu

SEQ ID NO: 3602408 - RNA, 19 nt, Human
auguguaauuuuucuguau

SEQ ID NO: 3602409 - RNA, 18 nt, Human
auguguacaauguacaca

SEQ ID NO: 3602410 - RNA, 20 nt, Human
auguguacaauguacacacu

SEQ ID NO: 3602411 - RNA, 16 nt, Human
auguguacgugugugu

SEQ ID NO: 3602412 - RNA, 15 nt, Human
auguguagccugugc

SEQ ID NO: 3602413 - RNA, 22 nt, Human
auguguaggcaguuuagugcau

SEQ ID NO: 3602414 - RNA, 16 nt, Human
auguguaguucaugua

SEQ ID NO: 3602415 - RNA, 19 nt, Human
auguguaguucauguaaau

SEQ ID NO: 3602416 - RNA, 20 nt, Human
auguguaguucauguaaaua

SEQ ID NO: 3602417 - RNA, 22 nt, Human
auguguaguugucucucuucag

SEQ ID NO: 3602418 - RNA, 13 nt, Human
auguguauaaaca

SEQ ID NO: 3602419 - RNA, 19 nt, Human
auguguauaaauugucuuu

SEQ ID NO: 3602420 - RNA, 22 nt, Human
auguguauauauaugugaggau

SEQ ID NO: 3602421 - RNA, 21 nt, Human
auguguaucaguguuuaugug

SEQ ID NO: 3602422 - RNA, 20 nt, Human
auguguaugcacaguaaaaa

SEQ ID NO: 3602423 - RNA, 20 nt, Human
auguguauguacguuuguau

SEQ ID NO: 3602424 - RNA, 12 nt, Human
auguguauguga

SEQ ID NO: 3602425 - RNA, 19 nt, Human
auguguaugugaguauucu

SEQ ID NO: 3602426 - RNA, 15 nt, Human
augugucaugcauga

SEQ ID NO: 3602427 - RNA, 15 nt, Human
auguguccauuuccu

SEQ ID NO: 3602428 - RNA, 18 nt, Human
auguguccuaucuaucuu

SEQ ID NO: 3602429 - RNA, 19 nt, Human
auguguccuaucuaucuuc

SEQ ID NO: 3602430 - RNA, 19 nt, Human
augugucugccacauuaac

SEQ ID NO: 3602431 - RNA, 13 nt, Human
augugucuucaau

SEQ ID NO: 3602432 - RNA, 14 nt, Human
augugucuuucuaa

SEQ ID NO: 3602433 - RNA, 19 nt, Human
augugucuuucuaagaaau

SEQ ID NO: 3602434 - RNA, 15 nt, Human
cagaaggucuguuuu

SEQ ID NO: 3602435 - RNA, 22 nt, Human
cagaaggugccacuuuacccac

SEQ ID NO: 3602436 - RNA, 23 nt, Human
cagaagguugcucuagauugaga

SEQ ID NO: 3602437 - RNA, 13 nt, Human
cagaaguaagccu

SEQ ID NO: 3602438 - RNA, 16 nt, Human
cagaaguaagccucau

SEQ ID NO: 3602439 - RNA, 20 nt, Human
cagaaguaccagacuagaug

SEQ ID NO: 3602440 - RNA, 13 nt, Human
cagaaguagggga

SEQ ID NO: 3602441 - RNA, 18 nt, Human
cagaaguaggggaagaau

SEQ ID NO: 3602442 - RNA, 20 nt, Human
cagaagucacacauuacaaa

SEQ ID NO: 3602443 - RNA, 22 nt, Human
cagaagucacacauuacaaagu

SEQ ID NO: 3602444 - RNA, 20 nt, Human
cagaagucaucuugcuacca

SEQ ID NO: 3602445 - RNA, 17 nt, Human
cagaagucaugaagccc

SEQ ID NO: 3602446 - RNA, 18 nt, Human
cagaagucaugaagccca

SEQ ID NO: 3602447 - RNA, 16 nt, Human
cagaaguccagagucu

SEQ ID NO: 3602448 - RNA, 21 nt, Human
cagaaguccuguaugucuguc

SEQ ID NO: 3602449 - RNA, 22 nt, Human
cagaaguccuguaugucuguca

SEQ ID NO: 3602450 - RNA, 13 nt, Human
cagaagugacuga

SEQ ID NO: 3602451 - RNA, 18 nt, Human
cagaagugagcuuugcug

SEQ ID NO: 3602452 - RNA, 22 nt, Human
cagaagugagcuuugcugcuac

SEQ ID NO: 3602453 - RNA, 11 nt, Human
cagaaguguga

SEQ ID NO: 3602454 - RNA, 13 nt, Human
cagaagugugacu

SEQ ID NO: 3602455 - RNA, 19 nt, Human
cacucgaggucgggcagca

SEQ ID NO: 3602456 - RNA, 16 nt, Human
cacucgcuagcagugg

SEQ ID NO: 3602457 - RNA, 22 nt, Human
cacucggcauuucaaaugugcu

SEQ ID NO: 3602458 - RNA, 14 nt, Human
cacucggcuuugga

SEQ ID NO: 3602459 - RNA, 18 nt, Human
cacucgggaggcugagac

SEQ ID NO: 3602460 - RNA, 21 nt, Human
cacucggguuucucuguggcu

SEQ ID NO: 3602461 - RNA, 12 nt, Human
cacucgguccca

SEQ ID NO: 3602462 - RNA, 20 nt, Human
cacucggucccaguuuuguu

SEQ ID NO: 3602463 - RNA, 14 nt, Human
cacucgucuccccc

SEQ ID NO: 3602464 - RNA, 16 nt, Human
cacucgucucccccaa

SEQ ID NO: 3602465 - RNA, 16 nt, Human
cacucguguguuucua

SEQ ID NO: 3602466 - RNA, 19 nt, Human
cacucuaaaagguucaggg

SEQ ID NO: 3602467 - RNA, 21 nt, Human
cacucuaaaggcgcugagacu

SEQ ID NO: 3602468 - RNA, 15 nt, Human
cacucuaagucaugu

SEQ ID NO: 3602469 - RNA, 16 nt, Human
cacucuaagucaugua

SEQ ID NO: 3602470 - RNA, 18 nt, Human
cacucuaccagugcaggc

SEQ ID NO: 3602471 - RNA, 16 nt, Human
cacucuacccucccac

SEQ ID NO: 3602472 - RNA, 17 nt, Human
cacucuacccucccacc

SEQ ID NO: 3602473 - RNA, 21 nt, Human
cacucuacccucccacccccu

SEQ ID NO: 3602474 - RNA, 14 nt, Human
cacucuagauucca

SEQ ID NO: 3602475 - RNA, 19 nt, Human
cacucuaggggucaggcuc

SEQ ID NO: 3602476 - RNA, 20 nt, Human
cacucuagucaaugacauga

SEQ ID NO: 3602477 - RNA, 13 nt, Human
cacucuauaacaa

SEQ ID NO: 3602478 - RNA, 13 nt, Human
cacucucagaggc

SEQ ID NO: 3602479 - RNA, 16 nt, Human
cacucucagaggcccc

SEQ ID NO: 3602480 - RNA, 17 nt, Human
cacucucauuccccagg

SEQ ID NO: 3602481 - RNA, 18 nt, Human
cacucucauuccccaggu

SEQ ID NO: 3602482 - RNA, 15 nt, Human
cacucuccauuuaau

SEQ ID NO: 3602483 - RNA, 15 nt, Human
cacucuccccacacu

SEQ ID NO: 3602484 - RNA, 16 nt, Human
cacucucccccacccc

SEQ ID NO: 3602485 - RNA, 18 nt, Human
cacucucccccacccccu

SEQ ID NO: 3602486 - RNA, 14 nt, Human
cacucuccugggcc

SEQ ID NO: 3602487 - RNA, 13 nt, Human
cacucuccuugca

SEQ ID NO: 3602488 - RNA, 17 nt, Human
cacucuccuugcaguuc

SEQ ID NO: 3602489 - RNA, 17 nt, Human
cacucuccuugcuaccc

SEQ ID NO: 3602490 - RNA, 19 nt, Human
cacucugacuggcacaguc

SEQ ID NO: 3602491 - RNA, 12 nt, Human
cacucugagacu

SEQ ID NO: 3602492 - RNA, 16 nt, Human
cacucugaguguuuua

SEQ ID NO: 3602493 - RNA, 18 nt, Human
cacucugcagacugcuag

SEQ ID NO: 3602494 - RNA, 16 nt, Human
cacucugccagcaaag

SEQ ID NO: 3602495 - RNA, 12 nt, Human
cacucugccagg

SEQ ID NO: 3602496 - RNA, 19 nt, Human
cacucugccagggcagugc

SEQ ID NO: 3602497 - RNA, 17 nt, Human
cacucugcucugaugca

SEQ ID NO: 3602498 - RNA, 16 nt, Human
cacucugcucugcccu

SEQ ID NO: 3602499 - RNA, 12 nt, Human
cacucugcuucu

SEQ ID NO: 3602500 - RNA, 14 nt, Human
cacucugcuucucu

SEQ ID NO: 3602501 - RNA, 18 nt, Human
cacucugcuucucugacu

SEQ ID NO: 3602502 - RNA, 18 nt, Human
cacucuggcagccacacu

SEQ ID NO: 3602503 - RNA, 13 nt, Human
cacucuggcagcu

SEQ ID NO: 3602504 - RNA, 14 nt, Human
cacucuggcagcuc

SEQ ID NO: 3602505 - RNA, 16 nt, Human
cacucuggcagcucag

SEQ ID NO: 3602506 - RNA, 20 nt, Human
cacucuggcagcucagagag

SEQ ID NO: 3602507 - RNA, 23 nt, Human
cacucuggcagcucagagagggu

SEQ ID NO: 3602508 - RNA, 13 nt, Human
cacucuggccuca

SEQ ID NO: 3602509 - RNA, 16 nt, Human
cacucugggcuccaga

SEQ ID NO: 3602510 - RNA, 15 nt, Human
cacucugucgcccag

SEQ ID NO: 3602511 - RNA, 20 nt, Human
cacucugucgcccagucugg

SEQ ID NO: 3602512 - RNA, 16 nt, Human
cacucugugcccaugg

SEQ ID NO: 3602513 - RNA, 21 nt, Human
cacucugugcccaugggcacu

SEQ ID NO: 3602514 - RNA, 17 nt, Human
cacucugugucugagug

SEQ ID NO: 3602515 - RNA, 13 nt, Human
cacucuguuauuu

SEQ ID NO: 3602516 - RNA, 19 nt, Human
cacucuguucauuccucca

SEQ ID NO: 3602517 - RNA, 21 nt, Human
cacucuguucauuccuccagg

SEQ ID NO: 3602518 - RNA, 14 nt, Human
cacucuuaaaugau

SEQ ID NO: 3602519 - RNA, 18 nt, Human
cacucuuaugcuguaccc

SEQ ID NO: 3602520 - RNA, 18 nt, Human
cacucuuauugcccacgc

SEQ ID NO: 3602521 - RNA, 22 nt, Human
cacucuuauugcccacgcugga

SEQ ID NO: 3602522 - RNA, 11 nt, Human
cacucuuccaa

SEQ ID NO: 3602523 - RNA, 14 nt, Human
cacucuucucagcc

SEQ ID NO: 3602524 - RNA, 17 nt, Human
cacucuucucagccacu

SEQ ID NO: 3602525 - RNA, 15 nt, Human
cacucuuggagccug

SEQ ID NO: 3602526 - RNA, 16 nt, Human
cacucuuggagccugc

SEQ ID NO: 3602527 - RNA, 17 nt, Human
cacucuuggagccugca

SEQ ID NO: 3602528 - RNA, 21 nt, Human
cacucuuggagccugcagagc

SEQ ID NO: 3602529 - RNA, 22 nt, Human
cacucuuggagccugcagagcu

SEQ ID NO: 3602530 - RNA, 23 nt, Human
cacucuuggagccugcagagcug

SEQ ID NO: 3602531 - RNA, 15 nt, Human
cacucuuuguaagag

SEQ ID NO: 3602532 - RNA, 15 nt, Human
cacucuuuugcuuua

SEQ ID NO: 3602533 - RNA, 23 nt, Human
cacucuuuugcuuuauuccagaa

SEQ ID NO: 3602534 - RNA, 14 nt, Human
cacugaaaaaauau

SEQ ID NO: 3602535 - RNA, 20 nt, Human
cacugaaaaaucuaagugau

SEQ ID NO: 3602536 - RNA, 18 nt, Human
cacugaaaacaucuggaa

SEQ ID NO: 3602537 - RNA, 22 nt, Human
cacugaaaugccuuacuuugua

SEQ ID NO: 3602538 - RNA, 19 nt, Human
cacugaagaaaccuucaga

SEQ ID NO: 3602539 - RNA, 15 nt, Human
cacugaagaggagga

SEQ ID NO: 3602540 - RNA, 16 nt, Human
cacugaagauagaaga

SEQ ID NO: 3602541 - RNA, 21 nt, Human
cacugaaggcuuucagggccu

SEQ ID NO: 3602542 - RNA, 17 nt, Human
cacugaagucaguucuc

SEQ ID NO: 3602543 - RNA, 19 nt, Human
cacugaaguuaacagagac

SEQ ID NO: 3602544 - RNA, 22 nt, Human
cacugaaguuaacagagacaga

SEQ ID NO: 3602545 - RNA, 15 nt, Human
cacugaaucccugua

SEQ ID NO: 3602546 - RNA, 13 nt, Human
cacugaaucugua

SEQ ID NO: 3602547 - RNA, 14 nt, Human
cacugaaucuguac

SEQ ID NO: 3602548 - RNA, 17 nt, Human
cacugaaucuguacaga

SEQ ID NO: 3602549 - RNA, 17 nt, Human
cacugaauuccauuuuu

SEQ ID NO: 3602550 - RNA, 13 nt, Human
cacugaauuuaua

SEQ ID NO: 3602551 - RNA, 14 nt, Human
cacugaauuuauaa

SEQ ID NO: 3602552 - RNA, 19 nt, Human
cacugaauuuauaaaguac

SEQ ID NO: 3602553 - RNA, 19 nt, Human
cacugacacaaaaaguaga

SEQ ID NO: 3602554 - RNA, 14 nt, Human
cacugacacaaagg

SEQ ID NO: 3602555 - RNA, 14 nt, Human
cacugacaccuuug

SEQ ID NO: 3602556 - RNA, 16 nt, Human
cacugacaccuuugca

SEQ ID NO: 3602557 - RNA, 13 nt, Human
cacugacacuggu

SEQ ID NO: 3602558 - RNA, 13 nt, Human
cacugacagauuu

SEQ ID NO: 3602559 - RNA, 16 nt, Human
cacugacagccuccca

SEQ ID NO: 3602560 - RNA, 17 nt, Human
cacugaccauccacucu

SEQ ID NO: 3602561 - RNA, 15 nt, Human
cacugacccuuccag

SEQ ID NO: 3602562 - RNA, 18 nt, Human
cacugaccugucaugccc

SEQ ID NO: 3602563 - RNA, 22 nt, Human
cacugaccugucaugccccccu

SEQ ID NO: 3602564 - RNA, 23 nt, Human
cacugaccugucaugccccccuc

SEQ ID NO: 3602565 - RNA, 20 nt, Human
cacugaccuuggagagacac

SEQ ID NO: 3602566 - RNA, 20 nt, Human
cacugacugaacuguaaugu

SEQ ID NO: 3602567 - RNA, 14 nt, Human
cacugacuucuaag

SEQ ID NO: 3602568 - RNA, 17 nt, Human
cacugagaagauuguga

SEQ ID NO: 3602569 - RNA, 21 nt, Human
cacugagaauguaagaacuac

SEQ ID NO: 3602570 - RNA, 12 nt, Human
cacugagacagc

SEQ ID NO: 3602571 - RNA, 13 nt, Human
cacugagacagcc

SEQ ID NO: 3602572 - RNA, 15 nt, Human
cacugagaccaaggc

SEQ ID NO: 3602573 - RNA, 17 nt, Human
cacugagaccaaggcuu

SEQ ID NO: 3602574 - RNA, 18 nt, Human
cacugagagagcgcagcc

SEQ ID NO: 3602575 - RNA, 21 nt, Human
cacugagagccuuuuugaaag

SEQ ID NO: 3602576 - RNA, 18 nt, Human
cacugagauaccagcgag

SEQ ID NO: 3602577 - RNA, 17 nt, Human
cacugagaucuguuuga

SEQ ID NO: 3602578 - RNA, 20 nt, Human
cacugagcaacgcuauucca

SEQ ID NO: 3602579 - RNA, 15 nt, Human
cacugagcacuguuu

SEQ ID NO: 3602580 - RNA, 23 nt, Human
auuggcuagagguucaaagauau

SEQ ID NO: 3602581 - RNA, 13 nt, Human
auuggcucacacu

SEQ ID NO: 3602582 - RNA, 17 nt, Human
auuggcuuguagaauug

SEQ ID NO: 3602583 - RNA, 19 nt, Human
auuggcuuguagaauuguu

SEQ ID NO: 3602584 - RNA, 22 nt, Human
auuggcuuguguguuucacuuu

SEQ ID NO: 3602585 - RNA, 14 nt, Human
auuggcuuuauccu

SEQ ID NO: 3602586 - RNA, 23 nt, Human
auuggcuuuggguugcaggaccu

SEQ ID NO: 3602587 - RNA, 20 nt, Human
auuggcuuuucugauccagu

SEQ ID NO: 3602588 - RNA, 17 nt, Human
auugggacuggggcuga

SEQ ID NO: 3602589 - RNA, 18 nt, Human
auugggagcuugggaaug

SEQ ID NO: 3602590 - RNA, 14 nt, Human
auugggcagcgccc

SEQ ID NO: 3602591 - RNA, 22 nt, Human
auugggcagcgcccuuccucuc

SEQ ID NO: 3602592 - RNA, 15 nt, Human
auugggccccugcca

SEQ ID NO: 3602593 - RNA, 18 nt, Human
auugggcggcucugaagc

SEQ ID NO: 3602594 - RNA, 16 nt, Human
auuggggaagagagcc

SEQ ID NO: 3602595 - RNA, 22 nt, Human
auuggggaagagagccugcagg

SEQ ID NO: 3602596 - RNA, 23 nt, Human
auuggggaagagagccugcagga

SEQ ID NO: 3602597 - RNA, 21 nt, Human
auuggggaggagggggccggg

SEQ ID NO: 3602598 - RNA, 14 nt, Human
auuggggauucuua

SEQ ID NO: 3602599 - RNA, 15 nt, Human
auuggggauucuuaa

SEQ ID NO: 3602600 - RNA, 21 nt, Human
auuggggauucuuaaaguuga

SEQ ID NO: 3602601 - RNA, 21 nt, Human
auuggggcucccagccaggcc

SEQ ID NO: 3602602 - RNA, 23 nt, Human
auugggggggccaaaaggaaaaa

SEQ ID NO: 3602603 - RNA, 21 nt, Human
auuggguaucaagacauagca

SEQ ID NO: 3602604 - RNA, 18 nt, Human
auugggucauagaaauuc

SEQ ID NO: 3602605 - RNA, 17 nt, Human
auugggucuauuccagc

SEQ ID NO: 3602606 - RNA, 14 nt, Human
auuggguucaugau

SEQ ID NO: 3602607 - RNA, 18 nt, Human
auuggguuccauucucac

SEQ ID NO: 3602608 - RNA, 22 nt, Human
auuggguuuuuggacuucuggg

SEQ ID NO: 3602609 - RNA, 16 nt, Human
auugguaacauccuuu

SEQ ID NO: 3602610 - RNA, 17 nt, Human
auugguaccuugcacac

SEQ ID NO: 3602611 - RNA, 18 nt, Human
auugguaucaagaaaguc

SEQ ID NO: 3602612 - RNA, 14 nt, Human
auuggucuaauuua

SEQ ID NO: 3602613 - RNA, 18 nt, Human
auuggucuaucuacuggc

SEQ ID NO: 3602614 - RNA, 14 nt, Human
auuggucuccucuc

SEQ ID NO: 3602615 - RNA, 17 nt, Human
auuggugaguuaggaac

SEQ ID NO: 3602616 - RNA, 18 nt, Human
auuggugggauuuuuugu

SEQ ID NO: 3602617 - RNA, 14 nt, Human
auugguguuguacu

SEQ ID NO: 3602618 - RNA, 22 nt, Human
auugguguuguacucaauuuua

SEQ ID NO: 3602619 - RNA, 17 nt, Human
auugguucccuuugcuc

SEQ ID NO: 3602620 - RNA, 16 nt, Human
auugguuucucuucuc

SEQ ID NO: 3602621 - RNA, 22 nt, Human
auugguuuuaauugaaggaaag

SEQ ID NO: 3602622 - RNA, 14 nt, Human
auugguuuuaugau

SEQ ID NO: 3602623 - RNA, 18 nt, Human
auugguuuuaugaugacg

SEQ ID NO: 3602624 - RNA, 17 nt, Human
auuguaaaaaaaaaugc

SEQ ID NO: 3602625 - RNA, 22 nt, Human
auuguaaaaaaaaaugccuuug

SEQ ID NO: 3602626 - RNA, 22 nt, Human
auuguaaaaaagguuuucuaua

SEQ ID NO: 3602627 - RNA, 13 nt, Human
auuguaaaagcau

SEQ ID NO: 3602628 - RNA, 13 nt, Human
auuguaaaauaau

SEQ ID NO: 3602629 - RNA, 15 nt, Human
auuguaaaauagcuu

SEQ ID NO: 3602630 - RNA, 21 nt, Human
auuguaaaauagcuuguauag

SEQ ID NO: 3602631 - RNA, 22 nt, Human
auuguaaaauagcuuguauagu

SEQ ID NO: 3602632 - RNA, 14 nt, Human
auuguaaacaaacu

SEQ ID NO: 3602633 - RNA, 15 nt, Human
auuguaaacaugugu

SEQ ID NO: 3602634 - RNA, 12 nt, Human
auuguaaacugu

SEQ ID NO: 3602635 - RNA, 15 nt, Human
auuguaaacuguacu

SEQ ID NO: 3602636 - RNA, 23 nt, Human
auacugcaauuaaagugauacug

SEQ ID NO: 3602637 - RNA, 19 nt, Human
auacugcagggccaggacu

SEQ ID NO: 3602638 - RNA, 21 nt, Human
auacugcauacuuuuuaaaug

SEQ ID NO: 3602639 - RNA, 17 nt, Human
auacugccacuaaccuu

SEQ ID NO: 3602640 - RNA, 16 nt, Human
auacugccagaugcug

SEQ ID NO: 3602641 - RNA, 19 nt, Human
auacugccagaugcugaug

SEQ ID NO: 3602642 - RNA, 20 nt, Human
auacugcgacuuucugccug

SEQ ID NO: 3602643 - RNA, 15 nt, Human
auacugcuacuguaa

SEQ ID NO: 3602644 - RNA, 22 nt, Human
auacugcuacuguaauuuuaua

SEQ ID NO: 3602645 - RNA, 12 nt, Human
auacugcugaga

SEQ ID NO: 3602646 - RNA, 22 nt, Human
auacugcugagauacauacaga

SEQ ID NO: 3602647 - RNA, 10 nt, Human
auacugcuug

SEQ ID NO: 3602648 - RNA, 13 nt, Human
auacuggaaguuu

SEQ ID NO: 3602649 - RNA, 15 nt, Human
auacuggaggaacac

SEQ ID NO: 3602650 - RNA, 15 nt, Human
auacuggcacagagg

SEQ ID NO: 3602651 - RNA, 22 nt, Human
auacuggccucgccuggccuga

SEQ ID NO: 3602652 - RNA, 23 nt, Human
auacuggcuucaccaucaauccu

SEQ ID NO: 3602653 - RNA, 12 nt, Human
auacuguaaaga

SEQ ID NO: 3602654 - RNA, 21 nt, Human
auacuguaaagaaagagagaa

SEQ ID NO: 3602655 - RNA, 20 nt, Human
auacuguacaauaaaaacau

SEQ ID NO: 3602656 - RNA, 17 nt, Human
auacuguacuuaauaaa

SEQ ID NO: 3602657 - RNA, 18 nt, Human
auacuguagauaauuaac

SEQ ID NO: 3602658 - RNA, 15 nt, Human
auacuguauuaagag

SEQ ID NO: 3602659 - RNA, 17 nt, Human
auacugugcuggagcca

SEQ ID NO: 3602660 - RNA, 20 nt, Human
auacugugcuggagccacua

SEQ ID NO: 3602661 - RNA, 13 nt, Human
auacuguguguga

SEQ ID NO: 3602662 - RNA, 21 nt, Human
auacugugugugagugugaau

SEQ ID NO: 3602663 - RNA, 16 nt, Human
auacuguuauucuuug

SEQ ID NO: 3602664 - RNA, 13 nt, Human
auacuguugcacg

SEQ ID NO: 3602665 - RNA, 15 nt, Human
auacuguugcacgug

SEQ ID NO: 3602666 - RNA, 15 nt, Human
auacuguugugcgca

SEQ ID NO: 3602667 - RNA, 20 nt, Human
auacuguuugagguuuuuaa

SEQ ID NO: 3602668 - RNA, 21 nt, Human
auacuguuuuucgucauucca

SEQ ID NO: 3602669 - RNA, 16 nt, Human
auacuuaagcaaaagu

SEQ ID NO: 3602670 - RNA, 13 nt, Human
auacuuacauucu

SEQ ID NO: 3602671 - RNA, 19 nt, Human
auacuuaccuagugaaacu

SEQ ID NO: 3602672 - RNA, 19 nt, Human
auacuuagcaaaaaguggg

SEQ ID NO: 3602673 - RNA, 15 nt, Human
auacuuauauuuccc

SEQ ID NO: 3602674 - RNA, 22 nt, Human
auacuuauauuuucguaugaaa

SEQ ID NO: 3602675 - RNA, 23 nt, Human
auacuuauauuuucguaugaaaa

SEQ ID NO: 3602676 - RNA, 21 nt, Human
auacuuauauuuuuaauaaaa

SEQ ID NO: 3602677 - RNA, 16 nt, Human
auacuuaucucucugu

SEQ ID NO: 3602678 - RNA, 15 nt, Human
auacuuauucauugu

SEQ ID NO: 3602679 - RNA, 16 nt, Human
auacuucacuacuuua

SEQ ID NO: 3602680 - RNA, 21 nt, Human
auacuuccuuaugcuucuuuc

SEQ ID NO: 3602681 - RNA, 16 nt, Human
auacuucuugugugua

SEQ ID NO: 3602682 - RNA, 13 nt, Human
auacuugaacaaa

SEQ ID NO: 3602683 - RNA, 15 nt, Human
auacuugaacaaaag

SEQ ID NO: 3602684 - RNA, 22 nt, Human
auacuugaacaaaagggucaga

SEQ ID NO: 3602685 - RNA, 18 nt, Human
auacuugaaccauaaaau

SEQ ID NO: 3602686 - RNA, 22 nt, Human
auacuugaaccauaaaaugucc

SEQ ID NO: 3602687 - RNA, 19 nt, Human
auacuugaacguuuucuaa

SEQ ID NO: 3602688 - RNA, 12 nt, Human
auacuugaacuu

SEQ ID NO: 3602689 - RNA, 13 nt, Human
auacuugaacuug

SEQ ID NO: 3602690 - RNA, 18 nt, Human
auacuugaagggccagag

SEQ ID NO: 3602691 - RNA, 23 nt, Human
auacuugaagggccagagccagg

SEQ ID NO: 3602692 - RNA, 13 nt, Human
auacuugagacug

SEQ ID NO: 3602693 - RNA, 13 nt, Human
auacuuggauuua

SEQ ID NO: 3602694 - RNA, 13 nt, Human
auacuuguggacu

SEQ ID NO: 3602695 - RNA, 20 nt, Human
auacuuguggacuaaaagau

SEQ ID NO: 3602696 - RNA, 21 nt, Human
auacuuguggacuaaaagaua

SEQ ID NO: 3602697 - RNA, 17 nt, Human
auacuugugguuuucaa

SEQ ID NO: 3602698 - RNA, 19 nt, Human
auacuugugguuuucaaau

SEQ ID NO: 3602699 - RNA, 15 nt, Human
auacuuuaaaggaaa

SEQ ID NO: 3602700 - RNA, 18 nt, Human
auacuuuaguagacauuu

SEQ ID NO: 3602701 - RNA, 15 nt, Human
auacuuuagugaacg

SEQ ID NO: 3602702 - RNA, 22 nt, Human
auacuuugaaaggagaugucuu

SEQ ID NO: 3602703 - RNA, 12 nt, Human
auacuuugaaug

SEQ ID NO: 3602704 - RNA, 17 nt, Human
auacuuugaauguguuu

SEQ ID NO: 3602705 - RNA, 19 nt, Human
auacuuugaauguguuuca

SEQ ID NO: 3602706 - RNA, 20 nt, Human
auacuuugaauguguuucac

SEQ ID NO: 3602707 - RNA, 23 nt, Human
auacuuugaauguguuucacagu

SEQ ID NO: 3602708 - RNA, 16 nt, Human
auacuuugaguuuuga

SEQ ID NO: 3602709 - RNA, 13 nt, Human
auacuuuguauuu

SEQ ID NO: 3602710 - RNA, 24 nt, Human
auacuuuguggaccaauuauugau

SEQ ID NO: 3602711 - RNA, 17 nt, Human
auacuuuuacucugccu

SEQ ID NO: 3602712 - RNA, 13 nt, Human
auacuuuuccuua

SEQ ID NO: 3602713 - RNA, 17 nt, Human
auacuuuuucuuuugua

SEQ ID NO: 3602714 - RNA, 21 nt, Human
auacuuuuucuuuuguaagug

SEQ ID NO: 3602715 - RNA, 14 nt, Human
auacuuuuuugaaa

SEQ ID NO: 3602716 - RNA, 21 nt, Human
auagaaaacaggaaaaaaacu

SEQ ID NO: 3602717 - RNA, 22 nt, Human
auagaaaacaggaaaaaaacuu

SEQ ID NO: 3602718 - RNA, 22 nt, Human
auagaaaaguauguucuaaccu

SEQ ID NO: 3602719 - RNA, 15 nt, Human
auagaaaaguuauua

SEQ ID NO: 3602720 - RNA, 13 nt, Human
auagaaacaugac

SEQ ID NO: 3602721 - RNA, 14 nt, Human
auagaaacaugaca

SEQ ID NO: 3602722 - RNA, 15 nt, Human
auagaaacaugacac

SEQ ID NO: 3602723 - RNA, 22 nt, Human
auagaaagccaaaucaaaauau

SEQ ID NO: 3602724 - RNA, 14 nt, Human
auagcccuguccug

SEQ ID NO: 3602725 - RNA, 18 nt, Human
auagcccuguccuggugg

SEQ ID NO: 3602726 - RNA, 15 nt, Human
auagccuaggugaca

SEQ ID NO: 3602727 - RNA, 11 nt, Human
auagccuggac

SEQ ID NO: 3602728 - RNA, 21 nt, Human
auagcgcuguuuuuguugugu

SEQ ID NO: 3602729 - RNA, 14 nt, Human
auagcguucuugua

SEQ ID NO: 3602730 - RNA, 13 nt, Human
auagcguuggaau

SEQ ID NO: 3602731 - RNA, 21 nt, Human
auagcguuggaauuaaaacaa

SEQ ID NO: 3602732 - RNA, 23 nt, Human
auagcuaacauuuuaaauaaaag

SEQ ID NO: 3602733 - RNA, 14 nt, Human
auagcuaacuguaa

SEQ ID NO: 3602734 - RNA, 15 nt, Human
auagcuaaguacaca

SEQ ID NO: 3602735 - RNA, 16 nt, Human
auagcuacaggaagca

SEQ ID NO: 3602736 - RNA, 14 nt, Human
auagcuacccaaaa

SEQ ID NO: 3602737 - RNA, 18 nt, Human
auagcuacuaauuuuaaa

SEQ ID NO: 3602738 - RNA, 14 nt, Human
auagcuagacuggu

SEQ ID NO: 3602739 - RNA, 23 nt, Human
auagcuagacuggugacugauuc

SEQ ID NO: 3602740 - RNA, 22 nt, Human
auagcuaggugacauauacaua

SEQ ID NO: 3602741 - RNA, 19 nt, Human
auagcuauauccauguacu

SEQ ID NO: 3602742 - RNA, 14 nt, Human
auagcuauuacugu

SEQ ID NO: 3602743 - RNA, 22 nt, Human
auagcuauuacugucugguuuu

SEQ ID NO: 3602744 - RNA, 15 nt, Human
auagcucaugugcau

SEQ ID NO: 3602745 - RNA, 16 nt, Human
auagcucuaauguuug

SEQ ID NO: 3602746 - RNA, 18 nt, Human
auagcucuaauguuugca

SEQ ID NO: 3602747 - RNA, 19 nt, Human
auagcucuaauguuugcau

SEQ ID NO: 3602748 - RNA, 15 nt, Human
auagcucuuucaggg

SEQ ID NO: 3602749 - RNA, 15 nt, Human
auagcugcuuccagu

SEQ ID NO: 3602750 - RNA, 12 nt, Human
auagcugggacu

SEQ ID NO: 3602751 - RNA, 17 nt, Human
auagcugggacuacagg

SEQ ID NO: 3602752 - RNA, 23 nt, Human
auagcuggucuuauuuguaaagc

SEQ ID NO: 3602753 - RNA, 17 nt, Human
auagcuguacaaauaua

SEQ ID NO: 3602754 - RNA, 18 nt, Human
auagcuguacaaauauaa

SEQ ID NO: 3602755 - RNA, 17 nt, Human
auagcuguauugaauca

SEQ ID NO: 3602756 - RNA, 22 nt, Human
auagcuguauugaaucauguag

SEQ ID NO: 3602757 - RNA, 18 nt, Human
auagcuguucuaauggau

SEQ ID NO: 3602758 - RNA, 18 nt, Human
auagcuuaugaaaagaau

SEQ ID NO: 3602759 - RNA, 17 nt, Human
auagcuugcagaacugu

SEQ ID NO: 3602760 - RNA, 23 nt, Human
auagcuugcgcauucucauggag

SEQ ID NO: 3602761 - RNA, 19 nt, Human
auagcuuuauuuuuuaagu

SEQ ID NO: 3602762 - RNA, 21 nt, Human
auagcuuuauuuuuuaaguau

SEQ ID NO: 3602763 - RNA, 14 nt, Human
auagcuuuuauugu

SEQ ID NO: 3602764 - RNA, 15 nt, Human
auagcuuuuauugua

SEQ ID NO: 3602765 - RNA, 18 nt, Human
auagcuuuuauuguauaa

SEQ ID NO: 3602766 - RNA, 22 nt, Human
auagcuuuucccuuuuuuuaag

SEQ ID NO: 3602767 - RNA, 17 nt, Human
auagcuuuugugucuua

SEQ ID NO: 3602768 - RNA, 16 nt, Human
auaggaaaaacugauu

SEQ ID NO: 3602769 - RNA, 16 nt, Human
auaggaacauaugaaa

SEQ ID NO: 3602770 - RNA, 18 nt, Human
auaggaaucauucagaaa

SEQ ID NO: 3602771 - RNA, 16 nt, Human
auaggaauugacccac

SEQ ID NO: 3602772 - RNA, 21 nt, Human
auaggaccaggauccagccuc

SEQ ID NO: 3602773 - RNA, 14 nt, Human
auaggaccuuucca

SEQ ID NO: 3602774 - RNA, 13 nt, Human
auaggacuuguuu

SEQ ID NO: 3602775 - RNA, 16 nt, Human
auaggacuuguuuuug

SEQ ID NO: 3602776 - RNA, 24 nt, Human
auaggagaggaugagagcccagag

SEQ ID NO: 3602777 - RNA, 12 nt, Human
auaggagccugc

SEQ ID NO: 3602778 - RNA, 13 nt, Human
auaggagccugcu

SEQ ID NO: 3602779 - RNA, 22 nt, Human
auaggauuuauuuaaaauagca

SEQ ID NO: 3602780 - RNA, 21 nt, Human
auaggcaccuaccaccacgcc

SEQ ID NO: 3602781 - RNA, 20 nt, Human
auaggcaccuuuuacuguga

SEQ ID NO: 3602782 - RNA, 13 nt, Human
auaggcaggaagc

SEQ ID NO: 3602783 - RNA, 17 nt, Human
auaggccuucuugugau

SEQ ID NO: 3602784 - RNA, 20 nt, Human
auaggcggggcuugccuucu

SEQ ID NO: 3602785 - RNA, 17 nt, Human
auaggcuauuuucuaaa

SEQ ID NO: 3602786 - RNA, 16 nt, Human
auaggcuggagaagcu

SEQ ID NO: 3602787 - RNA, 20 nt, Human
auagggcugggcaaggaaaa

SEQ ID NO: 3602788 - RNA, 18 nt, Human
auaggggauauuuaaggu

SEQ ID NO: 3602789 - RNA, 16 nt, Human
auagguaaucaaugaa

SEQ ID NO: 3602790 - RNA, 19 nt, Human
auagguagggagauauuua

SEQ ID NO: 3602791 - RNA, 21 nt, Human
auagguauaaguggugugugu

SEQ ID NO: 3602792 - RNA, 16 nt, Human
auaggucacuccuggg

SEQ ID NO: 3602793 - RNA, 15 nt, Human
auaggucacuggcuc

SEQ ID NO: 3602794 - RNA, 21 nt, Human
auaggucacuggcucuccaag

SEQ ID NO: 3602795 - RNA, 23 nt, Human
auaggucagugaggcccagggag

SEQ ID NO: 3602796 - RNA, 17 nt, Human
auuguaaacuguacuag

SEQ ID NO: 3602797 - RNA, 10 nt, Human
auuguaaaua

SEQ ID NO: 3602798 - RNA, 15 nt, Human
auuguaaauacaagu

SEQ ID NO: 3602799 - RNA, 14 nt, Human
auuguaaauaguau

SEQ ID NO: 3602800 - RNA, 21 nt, Human
auuguaaauuauauuugugcu

SEQ ID NO: 3602801 - RNA, 17 nt, Human
auuguaaauugaaucag

SEQ ID NO: 3602802 - RNA, 16 nt, Human
auuguaacagacauug

SEQ ID NO: 3602803 - RNA, 19 nt, Human
auuguaacagacauuguuu

SEQ ID NO: 3602804 - RNA, 18 nt, Human
auuguaacccugucugga

SEQ ID NO: 3602805 - RNA, 17 nt, Human
auuguaacguugcugug

SEQ ID NO: 3602806 - RNA, 21 nt, Human
auuguaacguugcugugggaa

SEQ ID NO: 3602807 - RNA, 13 nt, Human
auuguaacuguuc

SEQ ID NO: 3602808 - RNA, 19 nt, Human
auuguaacuguucuugaau

SEQ ID NO: 3602809 - RNA, 15 nt, Human
auuguaacuuggaug

SEQ ID NO: 3602810 - RNA, 23 nt, Human
auuguaacuuggauguagccaug

SEQ ID NO: 3602811 - RNA, 14 nt, Human
auuguaagaaauac

SEQ ID NO: 3602812 - RNA, 20 nt, Human
auuguaagaaauacuguaca

SEQ ID NO: 3602813 - RNA, 13 nt, Human
auuguaagauaaa

SEQ ID NO: 3602814 - RNA, 14 nt, Human
auuguaagauaaaa

SEQ ID NO: 3602815 - RNA, 18 nt, Human
auuguaagcaugcacaaa

SEQ ID NO: 3602816 - RNA, 17 nt, Human
auuguaagcguauggcu

SEQ ID NO: 3602817 - RNA, 18 nt, Human
auuguaagcguauggcuu

SEQ ID NO: 3602818 - RNA, 24 nt, Human
auuguaauguuacugaucaugcau

SEQ ID NO: 3602819 - RNA, 20 nt, Human
auuguaauguugugaauaau

SEQ ID NO: 3602820 - RNA, 18 nt, Human
auuguaauuaauaauaga

SEQ ID NO: 3602821 - RNA, 14 nt, Human
auuguaauuauauc

SEQ ID NO: 3602822 - RNA, 22 nt, Human
auuguacaaaauuaagcaaaug

SEQ ID NO: 3602823 - RNA, 19 nt, Human
auuguacaaaguauuaagc

SEQ ID NO: 3602824 - RNA, 16 nt, Human
auuguacagcuguuua

SEQ ID NO: 3602825 - RNA, 18 nt, Human
auuguacaguuuguuuac

SEQ ID NO: 3602826 - RNA, 14 nt, Human
auuguacaguuuuu

SEQ ID NO: 3602827 - RNA, 19 nt, Human
auuguacauagcauguuua

SEQ ID NO: 3602828 - RNA, 16 nt, Human
auuguaccuuuuaaca

SEQ ID NO: 3602829 - RNA, 17 nt, Human
auuguacgaagaguauu

SEQ ID NO: 3602830 - RNA, 22 nt, Human
auuguacucaauggauuugaug

SEQ ID NO: 3602831 - RNA, 15 nt, Human
auuguaggugcaagc

SEQ ID NO: 3602832 - RNA, 21 nt, Human
auuguauaaaaauagaagaau

SEQ ID NO: 3602833 - RNA, 13 nt, Human
auuguauaaacua

SEQ ID NO: 3602834 - RNA, 17 nt, Human
auuguauaaacuaucag

SEQ ID NO: 3602835 - RNA, 15 nt, Human
auuguauaacagguu

SEQ ID NO: 3602836 - RNA, 21 nt, Human
auuguauagagauaugcagaa

SEQ ID NO: 3602837 - RNA, 11 nt, Human
auuguauauau

SEQ ID NO: 3602838 - RNA, 15 nt, Human
auuguauauaugugu

SEQ ID NO: 3602839 - RNA, 20 nt, Human
auuguauauuacaaugauca

SEQ ID NO: 3602840 - RNA, 15 nt, Human
auuguauauucacuu

SEQ ID NO: 3602841 - RNA, 17 nt, Human
auuguaucagaggccua

SEQ ID NO: 3602842 - RNA, 19 nt, Human
auuguaucagaggccuaua

SEQ ID NO: 3602843 - RNA, 14 nt, Human
auuguauccugagg

SEQ ID NO: 3602844 - RNA, 16 nt, Human
auuguaucguauagcu

SEQ ID NO: 3602845 - RNA, 16 nt, Human
auuguaucugucuuuc

SEQ ID NO: 3602846 - RNA, 12 nt, Human
auuguaugaugu

SEQ ID NO: 3602847 - RNA, 21 nt, Human
auuguaugauguguugugaua

SEQ ID NO: 3602848 - RNA, 14 nt, Human
auuguauuacaaau

SEQ ID NO: 3602849 - RNA, 15 nt, Human
auuguauuacaaauc

SEQ ID NO: 3602850 - RNA, 23 nt, Human
auuguauuaggugucauuuccau

SEQ ID NO: 3602851 - RNA, 13 nt, Human
auuguauucagag

SEQ ID NO: 3602852 - RNA, 16 nt, Human
auugucaaagugguga

SEQ ID NO: 3602853 - RNA, 23 nt, Human
auugucaaaguggugagaggcau

SEQ ID NO: 3602854 - RNA, 16 nt, Human
auugucaccugcuucu

SEQ ID NO: 3602855 - RNA, 23 nt, Human
auugucauuccuguauucacccg

SEQ ID NO: 3602856 - RNA, 18 nt, Human
auuguccaauccuauguu

SEQ ID NO: 3602857 - RNA, 23 nt, Human
auuguccagagcugcuuccccgu

SEQ ID NO: 3602858 - RNA, 18 nt, Human
auuguccuauuaguguua

SEQ ID NO: 3602859 - RNA, 20 nt, Human
auuguccuauuaguguuaua

SEQ ID NO: 3602860 - RNA, 14 nt, Human
auugucuauuuauc

SEQ ID NO: 3602861 - RNA, 20 nt, Human
auugucuccuauauauuucu

SEQ ID NO: 3602862 - RNA, 18 nt, Human
auugucucguuugugauu

SEQ ID NO: 3602863 - RNA, 18 nt, Human
auugucucuaaauugugg

SEQ ID NO: 3602864 - RNA, 12 nt, Human
auugucuguaaa

SEQ ID NO: 3602865 - RNA, 13 nt, Human
auugucuguaaau

SEQ ID NO: 3602866 - RNA, 14 nt, Human
auugucuuaaugga

SEQ ID NO: 3602867 - RNA, 14 nt, Human
auugucuucaugua

SEQ ID NO: 3602868 - RNA, 19 nt, Human
auugucuuuaaaaacuguu

SEQ ID NO: 3602869 - RNA, 17 nt, Human
auauauuauacuuguaa

SEQ ID NO: 3602870 - RNA, 14 nt, Human
auauauuauaugga

SEQ ID NO: 3602871 - RNA, 15 nt, Human
auauauuauauggaa

SEQ ID NO: 3602872 - RNA, 13 nt, Human
auauauuaucuuu

SEQ ID NO: 3602873 - RNA, 21 nt, Human
auauauucugaagcaacauuu

SEQ ID NO: 3602874 - RNA, 14 nt, Human
auauauucuuauaa

SEQ ID NO: 3602875 - RNA, 18 nt, Human
auauauucuuucaaagga

SEQ ID NO: 3602876 - RNA, 13 nt, Human
auauauugaacuu

SEQ ID NO: 3602877 - RNA, 15 nt, Human
auauauugaacuuuu

SEQ ID NO: 3602878 - RNA, 17 nt, Human
auauauuggguuccauu

SEQ ID NO: 3602879 - RNA, 23 nt, Human
auauauuguguugacuuuauaaa

SEQ ID NO: 3602880 - RNA, 14 nt, Human
auauauuguuaauc

SEQ ID NO: 3602881 - RNA, 18 nt, Human
auauauuuaaaauauauu

SEQ ID NO: 3602882 - RNA, 14 nt, Human
auauauuuaaaggg

SEQ ID NO: 3602883 - RNA, 13 nt, Human
auauauuuaagca

SEQ ID NO: 3602884 - RNA, 20 nt, Human
auauauuuaagcaacaucuu

SEQ ID NO: 3602885 - RNA, 16 nt, Human
auauauuuaaugauaa

SEQ ID NO: 3602886 - RNA, 16 nt, Human
auauauuuauaacuca

SEQ ID NO: 3602887 - RNA, 21 nt, Human
auauauuuauaacucaucaua

SEQ ID NO: 3602888 - RNA, 23 nt, Human
auauauuuauggccgggcagggu

SEQ ID NO: 3602889 - RNA, 14 nt, Human
auauauuuauuuaa

SEQ ID NO: 3602890 - RNA, 13 nt, Human
auauauuucuauu

SEQ ID NO: 3602891 - RNA, 23 nt, Human
auauauuucuauuauuaauugca

SEQ ID NO: 3602892 - RNA, 13 nt, Human
auauauuuuaaga

SEQ ID NO: 3602893 - RNA, 14 nt, Human
auauauuuuaagac

SEQ ID NO: 3602894 - RNA, 13 nt, Human
auauauuuuaauu

SEQ ID NO: 3602895 - RNA, 21 nt, Human
auauauuuuaccauacauuua

SEQ ID NO: 3602896 - RNA, 11 nt, Human
auauauuuuag

SEQ ID NO: 3602897 - RNA, 13 nt, Human
auauauuuuguau

SEQ ID NO: 3602898 - RNA, 23 nt, Human
auauauuuuguaugcaagcaguu

SEQ ID NO: 3602899 - RNA, 22 nt, Human
auauauuuugugugaaauugca

SEQ ID NO: 3602900 - RNA, 22 nt, Human
auauauuuuuaaaaaaugaaau

SEQ ID NO: 3602901 - RNA, 13 nt, Human
auauauuuuuaua

SEQ ID NO: 3602902 - RNA, 15 nt, Human
auauauuuuucacag

SEQ ID NO: 3602903 - RNA, 18 nt, Human
auauauuuuuuaaaauaa

SEQ ID NO: 3602904 - RNA, 22 nt, Human
auauauuuuuuaaaauaagucu

SEQ ID NO: 3602905 - RNA, 23 nt, Human
auauauuuuuuaauuugaugaaa

SEQ ID NO: 3602906 - RNA, 18 nt, Human
auauauuuuuuucugaaa

SEQ ID NO: 3602907 - RNA, 23 nt, Human
auauauuuuuuuuuaagcucuga

SEQ ID NO: 3602908 - RNA, 14 nt, Human
auaucaaaaagacu

SEQ ID NO: 3602909 - RNA, 13 nt, Human
auaucaaaguauu

SEQ ID NO: 3602910 - RNA, 13 nt, Human
auaucaaauuaau

SEQ ID NO: 3602911 - RNA, 21 nt, Human
auaucaacagauaguuguguu

SEQ ID NO: 3602912 - RNA, 21 nt, Human
auaucaaucaagccauguaua

SEQ ID NO: 3602913 - RNA, 17 nt, Human
auaucaaucauuuuccu

SEQ ID NO: 3602914 - RNA, 22 nt, Human
auaucaccaaaaaccuauucca

SEQ ID NO: 3602915 - RNA, 14 nt, Human
auaucacccagaca

SEQ ID NO: 3602916 - RNA, 20 nt, Human
auaucacccagacauaaagg

SEQ ID NO: 3602917 - RNA, 21 nt, Human
auaucacccagacauaaagga

SEQ ID NO: 3602918 - RNA, 16 nt, Human
auaucacucauuaauu

SEQ ID NO: 3602919 - RNA, 17 nt, Human
auaucacucauuaauua

SEQ ID NO: 3602920 - RNA, 16 nt, Human
auaucagcacauauuu

SEQ ID NO: 3602921 - RNA, 12 nt, Human
auaucagccuga

SEQ ID NO: 3602922 - RNA, 22 nt, Human
auaucaguuacucagcccuggg

SEQ ID NO: 3602923 - RNA, 23 nt, Human
auaucaguuacucagcccugggc

SEQ ID NO: 3602924 - RNA, 21 nt, Human
auaucauaauggggguaaagu

SEQ ID NO: 3602925 - RNA, 13 nt, Human
auaucauacaaau

SEQ ID NO: 3602926 - RNA, 18 nt, Human
auaucaucacguauguua

SEQ ID NO: 3602927 - RNA, 20 nt, Human
auaucaucacguauguuaua

SEQ ID NO: 3602928 - RNA, 13 nt, Human
auaucaucaguau

SEQ ID NO: 3602929 - RNA, 22 nt, Human
auaucaucaguauugaagcauu

SEQ ID NO: 3602930 - RNA, 18 nt, Human
auaucauccacacaugaa

SEQ ID NO: 3602931 - RNA, 20 nt, Human
auaucaugcuuuaaagugua

SEQ ID NO: 3602932 - RNA, 13 nt, Human
auaucauguaaag

SEQ ID NO: 3602933 - RNA, 12 nt, Human
auauccauguac

SEQ ID NO: 3602934 - RNA, 14 nt, Human
auaucccaaacugu

SEQ ID NO: 3602935 - RNA, 16 nt, Human
auaucccaagugcacu

SEQ ID NO: 3602936 - RNA, 17 nt, Human
auaucccuacauguauu

SEQ ID NO: 3602937 - RNA, 23 nt, Human
auaucccuuggacauuuuauguc

SEQ ID NO: 3602938 - RNA, 15 nt, Human
auauccuaaacauca

SEQ ID NO: 3602939 - RNA, 18 nt, Human
auauccuaauaaaaaggu

SEQ ID NO: 3602940 - RNA, 16 nt, Human
auauccuacuucucca

SEQ ID NO: 3602941 - RNA, 14 nt, Human
auauccugagccau

SEQ ID NO: 3602942 - RNA, 11 nt, Human
auauccugccu

SEQ ID NO: 3602943 - RNA, 20 nt, Human
auauccugugacugucucac

SEQ ID NO: 3602944 - RNA, 17 nt, Human
auauccuuaucagagcu

SEQ ID NO: 3602945 - RNA, 16 nt, Human
auauccuuucuaacaa

SEQ ID NO: 3602946 - RNA, 14 nt, Human
auauccuuugccuc

SEQ ID NO: 3602947 - RNA, 19 nt, Human
auaucggcucacaaagaga

SEQ ID NO: 3602948 - RNA, 16 nt, Human
auaucuaaaguuauau

SEQ ID NO: 3602949 - RNA, 21 nt, Human
auaucuaaaguuauauuucag

SEQ ID NO: 3602950 - RNA, 22 nt, Human
auaucuaaauugaauaauggua

SEQ ID NO: 3602951 - RNA, 18 nt, Human
auaucuagguuuaugaca

SEQ ID NO: 3602952 - RNA, 21 nt, Human
auaucuagguuuaugacagua

SEQ ID NO: 3602953 - RNA, 22 nt, Human
auaucuaguaauauauuuaaag

SEQ ID NO: 3602954 - RNA, 15 nt, Human
auaucuaguaugaaa

SEQ ID NO: 3602955 - RNA, 14 nt, Human
auaucuauaaaaua

SEQ ID NO: 3602956 - RNA, 17 nt, Human
auaucuauaaaauagau

SEQ ID NO: 3602957 - RNA, 22 nt, Human
auaucuauaaaauagauauaaa

SEQ ID NO: 3602958 - RNA, 23 nt, Human
auaucuauaaaauagauauaaau

SEQ ID NO: 3602959 - RNA, 17 nt, Human
auaucuauauauauaau

SEQ ID NO: 3602960 - RNA, 17 nt, Human
auaucuauauguacuug

SEQ ID NO: 3602961 - RNA, 20 nt, Human
auaucuauauuuuacauaaa

SEQ ID NO: 3602962 - RNA, 17 nt, Human
auaucuaucuauuugag

SEQ ID NO: 3602963 - RNA, 16 nt, Human
auaucuauguuuuacc

SEQ ID NO: 3602964 - RNA, 19 nt, Human
auaucuccgucaacucaua

SEQ ID NO: 3602965 - RNA, 15 nt, Human
auaucuccugaaaag

SEQ ID NO: 3602966 - RNA, 11 nt, Human
auaucugaaaa

SEQ ID NO: 3602967 - RNA, 16 nt, Human
auaucugaaaacugga

SEQ ID NO: 3602968 - RNA, 16 nt, Human
auaucugaaaauguau

SEQ ID NO: 3602969 - RNA, 22 nt, Human
auaucugaaaauguauguguaa

SEQ ID NO: 3602970 - RNA, 20 nt, Human
auaucugaggaauucuguau

SEQ ID NO: 3602971 - RNA, 21 nt, Human
auaucugaggaauucuguaua

SEQ ID NO: 3602972 - RNA, 22 nt, Human
auaucugauuguugucaggcca

SEQ ID NO: 3602973 - RNA, 18 nt, Human
auaucugccuuuauugug

SEQ ID NO: 3602974 - RNA, 20 nt, Human
auaucugccuuuauuguguu

SEQ ID NO: 3602975 - RNA, 15 nt, Human
auaucugcuguaugu

SEQ ID NO: 3602976 - RNA, 16 nt, Human
auaucugcuguauguc

SEQ ID NO: 3602977 - RNA, 12 nt, Human
auaucugcuguc

SEQ ID NO: 3602978 - RNA, 21 nt, Human
auaucuggccuaaaaucuugg

SEQ ID NO: 3602979 - RNA, 21 nt, Human
auaucugggauucuacuuuaa

SEQ ID NO: 3602980 - RNA, 18 nt, Human
auaucuguauuuaauuuu

SEQ ID NO: 3602981 - RNA, 15 nt, Human
auaucugugaaauau

SEQ ID NO: 3602982 - RNA, 17 nt, Human
auaucugugaaauauca

SEQ ID NO: 3602983 - RNA, 15 nt, Human
auaucuguuagaugc

SEQ ID NO: 3602984 - RNA, 20 nt, Human
auaucuguuuuacugcuuuu

SEQ ID NO: 3602985 - RNA, 14 nt, Human
auaucuuaaagaaa

SEQ ID NO: 3602986 - RNA, 16 nt, Human
auaucuuaaagaaaca

SEQ ID NO: 3602987 - RNA, 20 nt, Human
auaucuucagcucuuuuugu

SEQ ID NO: 3602988 - RNA, 15 nt, Human
auaucuugaaaugaa

SEQ ID NO: 3602989 - RNA, 14 nt, Human
auaucuugcuugaa

SEQ ID NO: 3602990 - RNA, 22 nt, Human
auaucuuggcagguaggaauau

SEQ ID NO: 3602991 - RNA, 13 nt, Human
auaucuuguagcu

SEQ ID NO: 3602992 - RNA, 21 nt, Human
auaucuuugugauaauuuaag

SEQ ID NO: 3602993 - RNA, 17 nt, Human
auaucuuuuauguuuga

SEQ ID NO: 3602994 - RNA, 19 nt, Human
auaucuuuuauguuugaau

SEQ ID NO: 3602995 - RNA, 20 nt, Human
auaucuuuuauguuugaaua

SEQ ID NO: 3602996 - RNA, 14 nt, Human
auuucaguaagucu

SEQ ID NO: 3602997 - RNA, 17 nt, Human
auuucaguccuguaguu

SEQ ID NO: 3602998 - RNA, 21 nt, Human
auuucaguguaguuaauuuau

SEQ ID NO: 3602999 - RNA, 21 nt, Human
auuucaguuauugucccuggc

SEQ ID NO: 3603000 - RNA, 22 nt, Human
auuucaguuccgucagaaagug

SEQ ID NO: 3603001 - RNA, 16 nt, Human
auuucaguucuaggaa

SEQ ID NO: 3603002 - RNA, 17 nt, Human
auuucaguucuaggaaa

SEQ ID NO: 3603003 - RNA, 18 nt, Human
auuucauaaacaacuuaa

SEQ ID NO: 3603004 - RNA, 20 nt, Human
auuucauaauuuguuuccag

SEQ ID NO: 3603005 - RNA, 14 nt, Human
auuucauaguucag

SEQ ID NO: 3603006 - RNA, 15 nt, Human
auuucauaguucaga

SEQ ID NO: 3603007 - RNA, 17 nt, Human
auuucauaguucagaau

SEQ ID NO: 3603008 - RNA, 19 nt, Human
auuucauaguucagaauuu

SEQ ID NO: 3603009 - RNA, 14 nt, Human
auuucauaucuaca

SEQ ID NO: 3603010 - RNA, 20 nt, Human
auuucauaucuacagauaga

SEQ ID NO: 3603011 - RNA, 22 nt, Human
auuucauaucuacagauagaga

SEQ ID NO: 3603012 - RNA, 16 nt, Human
auuucauaugcuguau

SEQ ID NO: 3603013 - RNA, 20 nt, Human
auuuuuauacaaaccuacca

SEQ ID NO: 3603014 - RNA, 12 nt, Human
auuuuuauacag

SEQ ID NO: 3603015 - RNA, 16 nt, Human
auuuuuauaccuguuu

SEQ ID NO: 3603016 - RNA, 17 nt, Human
auuuuuauauaauaucu

SEQ ID NO: 3603017 - RNA, 19 nt, Human
auuuuuauaucaugcaaaa

SEQ ID NO: 3603018 - RNA, 22 nt, Human
auuuuuauaucuauauguacuu

SEQ ID NO: 3603019 - RNA, 23 nt, Human
auuuuuauauuaaccagauauau

SEQ ID NO: 3603020 - RNA, 16 nt, Human
auuuuuauauuuccuu

SEQ ID NO: 3603021 - RNA, 17 nt, Human
auuuuuauauuuccuuu

SEQ ID NO: 3603022 - RNA, 11 nt, Human
auuuuuaucag

SEQ ID NO: 3603023 - RNA, 12 nt, Human
auuuuuauccaa

SEQ ID NO: 3603024 - RNA, 15 nt, Human
auuuuuaucuauaua

SEQ ID NO: 3603025 - RNA, 12 nt, Human
auuuuuauggaa

SEQ ID NO: 3603026 - RNA, 17 nt, Human
auuuuuauuaauuuuag

SEQ ID NO: 3603027 - RNA, 17 nt, Human
auuuuuauuaugcauaa

SEQ ID NO: 3603028 - RNA, 13 nt, Human
auuuuuauucaua

SEQ ID NO: 3603029 - RNA, 14 nt, Human
auuuuuauuuauga

SEQ ID NO: 3603030 - RNA, 14 nt, Human
auuuuuauuucaaa

SEQ ID NO: 3603031 - RNA, 14 nt, Human
auuuuuauuucaga

SEQ ID NO: 3603032 - RNA, 16 nt, Human
auuuuuauuucagauu

SEQ ID NO: 3603033 - RNA, 17 nt, Human
auuuuuauuucagauuu

SEQ ID NO: 3603034 - RNA, 20 nt, Human
auuuuuauuucagauuuuga

SEQ ID NO: 3603035 - RNA, 21 nt, Human
auuuuuauuucagauuuugau

SEQ ID NO: 3603036 - RNA, 12 nt, Human
auuuuuauuucu

SEQ ID NO: 3603037 - RNA, 17 nt, Human
auuuuuauuucuuccua

SEQ ID NO: 3603038 - RNA, 21 nt, Human
auuuuucaacaaauaucuugu

SEQ ID NO: 3603039 - RNA, 18 nt, Human
auuuuucaacuuugaaua

SEQ ID NO: 3603040 - RNA, 17 nt, Human
auuuuucaauaauaaaa

SEQ ID NO: 3603041 - RNA, 12 nt, Human
auuuuucaauag

SEQ ID NO: 3603042 - RNA, 19 nt, Human
auuuuucaauagcgugugu

SEQ ID NO: 3603043 - RNA, 18 nt, Human
auuuuucaauauauugaa

SEQ ID NO: 3603044 - RNA, 16 nt, Human
auuuuucagauauaaa

SEQ ID NO: 3603045 - RNA, 15 nt, Human
auuuuucaguuccaa

SEQ ID NO: 3603046 - RNA, 18 nt, Human
auuuuucaguuccaagaa

SEQ ID NO: 3603047 - RNA, 22 nt, Human
auuuuucaguuccaagaaagau

SEQ ID NO: 3603048 - RNA, 13 nt, Human
auuuuucauauug

SEQ ID NO: 3603049 - RNA, 18 nt, Human
auuuuucauauugugcca

SEQ ID NO: 3603050 - RNA, 18 nt, Human
auuuuucaugauaaugaa

SEQ ID NO: 3603051 - RNA, 19 nt, Human
auuuuucuaacuacaaagg

SEQ ID NO: 3603052 - RNA, 17 nt, Human
auuuuucucaaaguuuu

SEQ ID NO: 3603053 - RNA, 21 nt, Human
auuuuucucaaaguuuugaaa

SEQ ID NO: 3603054 - RNA, 10 nt, Human
auuuuucucu

SEQ ID NO: 3603055 - RNA, 12 nt, Human
auuuuucucuuc

SEQ ID NO: 3603056 - RNA, 12 nt, Human
auuuuucugcac

SEQ ID NO: 3603057 - RNA, 14 nt, Human
auuuuucugcacug

SEQ ID NO: 3603058 - RNA, 22 nt, Human
auuuuucuggagguugauaacu

SEQ ID NO: 3603059 - RNA, 21 nt, Human
auuuuucuuagggaaggauac

SEQ ID NO: 3603060 - RNA, 16 nt, Human
auuuuucuuuaacugc

SEQ ID NO: 3603061 - RNA, 17 nt, Human
auuuuugaaaaaaguac

SEQ ID NO: 3603062 - RNA, 22 nt, Human
auuuuugaauguaguaaguaaa

SEQ ID NO: 3603063 - RNA, 15 nt, Human
auuuuugacagaaua

SEQ ID NO: 3603064 - RNA, 18 nt, Human
auuuuugacauggaaaug

SEQ ID NO: 3603065 - RNA, 23 nt, Human
auuuuugauacaguuuucagaaa

SEQ ID NO: 3603066 - RNA, 13 nt, Human
auuuuugauuuau

SEQ ID NO: 3603067 - RNA, 17 nt, Human
auuuuugcaauaaugca

SEQ ID NO: 3603068 - RNA, 22 nt, Human
auuuuugcccugaguccaagag

SEQ ID NO: 3603069 - RNA, 18 nt, Human
auuuuugccucuuccagu

SEQ ID NO: 3603070 - RNA, 10 nt, Human
auuuuugcuu

SEQ ID NO: 3603071 - RNA, 20 nt, Human
auuuuugcuuuuagaaaagg

SEQ ID NO: 3603072 - RNA, 15 nt, Human
auuuuugcuuuugau

SEQ ID NO: 3603073 - RNA, 18 nt, Human
auuuuuggauugacagua

SEQ ID NO: 3603074 - RNA, 19 nt, Human
auuuuuggauugacaguaa

SEQ ID NO: 3603075 - RNA, 14 nt, Human
auuuuuguaaaguu

SEQ ID NO: 3603076 - RNA, 17 nt, Human
auuuuuguaaaguuucc

SEQ ID NO: 3603077 - RNA, 13 nt, Human
auuuuuguaaaug

SEQ ID NO: 3603078 - RNA, 11 nt, Human
auuuuuguaca

SEQ ID NO: 3603079 - RNA, 12 nt, Human
auuuuuguacag

SEQ ID NO: 3603080 - RNA, 12 nt, Human
auuuuuguacau

SEQ ID NO: 3603081 - RNA, 21 nt, Human
auuuuuguagcacugacagau

SEQ ID NO: 3603082 - RNA, 21 nt, Human
auuuuuguaucuacaucuuuu

SEQ ID NO: 3603083 - RNA, 12 nt, Human
auuuuuguuguu

SEQ ID NO: 3603084 - RNA, 18 nt, Human
auuuuuuaaaaaagcuua

SEQ ID NO: 3603085 - RNA, 20 nt, Human
auuuuuuaaaaaagcuuaaa

SEQ ID NO: 3603086 - RNA, 23 nt, Human
auuuuuuaaaaaucuauauuuug

SEQ ID NO: 3603087 - RNA, 22 nt, Human
auuuuuuaaaacaagccaagaa

SEQ ID NO: 3603088 - RNA, 14 nt, Human
auuuuuuaaaagaa

SEQ ID NO: 3603089 - RNA, 17 nt, Human
auuuuuuaaaagaaauu

SEQ ID NO: 3603090 - RNA, 14 nt, Human
auuuuuuaaaauaa

SEQ ID NO: 3603091 - RNA, 13 nt, Human
auuuuuuaaauuc

SEQ ID NO: 3603092 - RNA, 21 nt, Human
auuuuuuaaccccgucaacaa

SEQ ID NO: 3603093 - RNA, 23 nt, Human
auuuuuuaaccuccuaaguauca

SEQ ID NO: 3603094 - RNA, 21 nt, Human
auuuuuuaagcuucaguugcu

SEQ ID NO: 3603095 - RNA, 16 nt, Human
auuuuuuaaggaaaca

SEQ ID NO: 3603096 - RNA, 11 nt, Human
auuuuuuaagu

SEQ ID NO: 3603097 - RNA, 16 nt, Human
auuuuuuaaguauuua

SEQ ID NO: 3603098 - RNA, 20 nt, Human
auuuuuuaaguauuuauaua

SEQ ID NO: 3603099 - RNA, 21 nt, Human
auuuuuuaagugaaaauauag

SEQ ID NO: 3603100 - RNA, 13 nt, Human
auuuuuuaauugu

SEQ ID NO: 3603101 - RNA, 21 nt, Human
auuuuuuaauuugaugaaagc

SEQ ID NO: 3603102 - RNA, 19 nt, Human
auuuuuuacagcugccugc

SEQ ID NO: 3603103 - RNA, 18 nt, Human
auuuuuuauauuucaagu

SEQ ID NO: 3603104 - RNA, 16 nt, Human
auuuuuuaucaugcau

SEQ ID NO: 3603105 - RNA, 15 nt, Human
auuuuuuauuuuacu

SEQ ID NO: 3603106 - RNA, 13 nt, Human
auuuuuucagaaa

SEQ ID NO: 3603107 - RNA, 13 nt, Human
auuuuuucagacc

SEQ ID NO: 3603108 - RNA, 16 nt, Human
auuuuuucagaccgaa

SEQ ID NO: 3603109 - RNA, 22 nt, Human
auuuuuucaguauuauauguac

SEQ ID NO: 3603110 - RNA, 14 nt, Human
auuuuuucauuuca

SEQ ID NO: 3603111 - RNA, 12 nt, Human
auuuuuuccaaa

SEQ ID NO: 3603112 - RNA, 23 nt, Human
auuuuuuccaaaaucucccauuu

SEQ ID NO: 3603113 - RNA, 11 nt, Human
auuuuuuccuu

SEQ ID NO: 3603114 - RNA, 21 nt, Human
auuuuuuccuucaaaguuuaa

SEQ ID NO: 3603115 - RNA, 23 nt, Human
auuuuuucucuaggaaauauuua

SEQ ID NO: 3603116 - RNA, 13 nt, Human
auuuuuucugaau

SEQ ID NO: 3603117 - RNA, 17 nt, Human
auuuuuucuugcauuga

SEQ ID NO: 3603118 - RNA, 16 nt, Human
auuuuuugaaaugcug

SEQ ID NO: 3603119 - RNA, 19 nt, Human
auuuuuugaaaugcugaaa

SEQ ID NO: 3603120 - RNA, 21 nt, Human
auuuuuugaaaugcugaaaau

SEQ ID NO: 3603121 - RNA, 22 nt, Human
auuuuuugggcagcaauuuaaa

SEQ ID NO: 3603122 - RNA, 17 nt, Human
auuuuuugguacaaaaa

SEQ ID NO: 3603123 - RNA, 16 nt, Human
auuuuuuguauaauug

SEQ ID NO: 3603124 - RNA, 18 nt, Human
auuuuuuguuaaaugauu

SEQ ID NO: 3603125 - RNA, 16 nt, Human
auuuuuuguugacauu

SEQ ID NO: 3603126 - RNA, 18 nt, Human
auuuuuuuaaaaucacua

SEQ ID NO: 3603127 - RNA, 15 nt, Human
auuuuuuuaaaauuu

SEQ ID NO: 3603128 - RNA, 21 nt, Human
auuuuuuuaaccaaaggugaa

SEQ ID NO: 3603129 - RNA, 15 nt, Human
auuuuuuuaagucuu

SEQ ID NO: 3603130 - RNA, 18 nt, Human
auuuuuuuaauuuacaaa

SEQ ID NO: 3603131 - RNA, 22 nt, Human
auuuuuuuauuguuuaaagcaa

SEQ ID NO: 3603132 - RNA, 21 nt, Human
auuuuuuucacuggaguuaca

SEQ ID NO: 3603133 - RNA, 12 nt, Human
auuuuuuuccuu

SEQ ID NO: 3603134 - RNA, 22 nt, Human
auuuuuuuccuuacauaaacau

SEQ ID NO: 3603135 - RNA, 15 nt, Human
auuuuuuucuaccua

SEQ ID NO: 3603136 - RNA, 13 nt, Human
auuuuuuucuauu

SEQ ID NO: 3603137 - RNA, 14 nt, Human
auuuuuuucugauu

SEQ ID NO: 3603138 - RNA, 22 nt, Human
auuuuuuugaacucuucucauu

SEQ ID NO: 3603139 - RNA, 14 nt, Human
auuuuuuugcaagu

SEQ ID NO: 3603140 - RNA, 22 nt, Human
auuuuuuugcaugcaugcaaau

SEQ ID NO: 3603141 - RNA, 14 nt, Human
auuuuuuuguaaua

SEQ ID NO: 3603142 - RNA, 15 nt, Human
auuuuuuuguaauug

SEQ ID NO: 3603143 - RNA, 13 nt, Human
auuuuuuuguaug

SEQ ID NO: 3603144 - RNA, 22 nt, Human
auuuuuuuuaauugaaaagaag

SEQ ID NO: 3603145 - RNA, 17 nt, Human
auuuuuuuuaauuguau

SEQ ID NO: 3603146 - RNA, 20 nt, Human
auuuuuuuuaauuguauuuu

SEQ ID NO: 3603147 - RNA, 14 nt, Human
auuuuuuuuaguau

SEQ ID NO: 3603148 - RNA, 18 nt, Human
auuuuuuuuaguauuuau

SEQ ID NO: 3603149 - RNA, 15 nt, Human
auuuuuuuuguuuca

SEQ ID NO: 3603150 - RNA, 23 nt, Human
auuuuuuuuuaaagaagaaaaaa

SEQ ID NO: 3603151 - RNA, 22 nt, Human
auaucuuuuauguuugaauaug

SEQ ID NO: 3603152 - RNA, 13 nt, Human
auaugaaaaauau

SEQ ID NO: 3603153 - RNA, 19 nt, Human
auaugaaaaauaugauauu

SEQ ID NO: 3603154 - RNA, 23 nt, Human
auaugaaaauacaacuuaaauaa

SEQ ID NO: 3603155 - RNA, 17 nt, Human
auaugaaagcugauuuu

SEQ ID NO: 3603156 - RNA, 12 nt, Human
auaugaacauag

SEQ ID NO: 3603157 - RNA, 15 nt, Human
auaugaacauauugu

SEQ ID NO: 3603158 - RNA, 19 nt, Human
auaugaacauauuguugaa

SEQ ID NO: 3603159 - RNA, 14 nt, Human
caaaagggucagag

SEQ ID NO: 3603160 - RNA, 13 nt, Human
caaaaggugccug

SEQ ID NO: 3603161 - RNA, 14 nt, Human
auuucuguuucuca

SEQ ID NO: 3603162 - RNA, 21 nt, Human
auuucuuaaacaaauguauga

SEQ ID NO: 3603163 - RNA, 14 nt, Human
auuucuuaaacacu

SEQ ID NO: 3603164 - RNA, 14 nt, Human
auuucuuaacuucu

SEQ ID NO: 3603165 - RNA, 17 nt, Human
auuucuuaacuucuugc

SEQ ID NO: 3603166 - RNA, 18 nt, Human
auuucuuaauuauuauaa

SEQ ID NO: 3603167 - RNA, 23 nt, Human
auuucuuaauuauuauaaaaaua

SEQ ID NO: 3603168 - RNA, 20 nt, Human
auuucuuacuaaacauuuug

SEQ ID NO: 3603169 - RNA, 11 nt, Human
auuucuuaggg

SEQ ID NO: 3603170 - RNA, 11 nt, Human
auuucuuauag

SEQ ID NO: 3603171 - RNA, 18 nt, Human
auuucuuaucaccacagu

SEQ ID NO: 3603172 - RNA, 13 nt, Human
auuucuuauguga

SEQ ID NO: 3603173 - RNA, 16 nt, Human
auuucuucaccagauu

SEQ ID NO: 3603174 - RNA, 13 nt, Human
auuucuucacugu

SEQ ID NO: 3603175 - RNA, 15 nt, Human
auuucuucagggcug

SEQ ID NO: 3603176 - RNA, 17 nt, Human
auuucuucagucagaaa

SEQ ID NO: 3603177 - RNA, 20 nt, Human
auuucuucagucagaaaacu

SEQ ID NO: 3603178 - RNA, 23 nt, Human
auuucuucagucagaaaacuuua

SEQ ID NO: 3603179 - RNA, 19 nt, Human
auuucuuccuaccaaguca

SEQ ID NO: 3603180 - RNA, 23 nt, Human
auuucuuccuaccaagucaaacu

SEQ ID NO: 3603181 - RNA, 14 nt, Human
auuucuucuuacca

SEQ ID NO: 3603182 - RNA, 20 nt, Human
auuucuugagguaaaagcau

SEQ ID NO: 3603183 - RNA, 14 nt, Human
auuucuugcgagcc

SEQ ID NO: 3603184 - RNA, 14 nt, Human
auuucuuguuuguu

SEQ ID NO: 3603185 - RNA, 15 nt, Human
auuucuuuauaaaau

SEQ ID NO: 3603186 - RNA, 21 nt, Human
auuucuuuauauuuauccacu

SEQ ID NO: 3603187 - RNA, 12 nt, Human
auuucuuugaaa

SEQ ID NO: 3603188 - RNA, 15 nt, Human
auuucuuugaaaaaa

SEQ ID NO: 3603189 - RNA, 20 nt, Human
auuucuuugccuguucaguu

SEQ ID NO: 3603190 - RNA, 19 nt, Human
auuucuuugugcuuuggcu

SEQ ID NO: 3603191 - RNA, 23 nt, Human
auuucuuuguuaucaaacuucag

SEQ ID NO: 3603192 - RNA, 20 nt, Human
auuucuuuucaccauucgua

SEQ ID NO: 3603193 - RNA, 16 nt, Human
auuucuuuucuuccug

SEQ ID NO: 3603194 - RNA, 20 nt, Human
auuucuuuugccguuauuaa

SEQ ID NO: 3603195 - RNA, 22 nt, Human
auuucuuuuguaauaaacuauu

SEQ ID NO: 3603196 - RNA, 20 nt, Human
auuucuuuuugggagagacu

SEQ ID NO: 3603197 - RNA, 21 nt, Human
auuucuuuuugggagagacuu

SEQ ID NO: 3603198 - RNA, 22 nt, Human
auuugaaaacauaaucugcaaa

SEQ ID NO: 3603199 - RNA, 18 nt, Human
auuugaaaauaauuguuc

SEQ ID NO: 3603200 - RNA, 14 nt, Human
auuugaaaauuuug

SEQ ID NO: 3603201 - RNA, 17 nt, Human
auuugaaacauugcuuu

SEQ ID NO: 3603202 - RNA, 14 nt, Human
auuugaaagugccu

SEQ ID NO: 3603203 - RNA, 16 nt, Human
auuugaaauaagaauu

SEQ ID NO: 3603204 - RNA, 16 nt, Human
auuugaagaacaugug

SEQ ID NO: 3603205 - RNA, 23 nt, Human
auuugaagcugcagugagcugug

SEQ ID NO: 3603206 - RNA, 23 nt, Human
auuugaagguagaauguuuucaa

SEQ ID NO: 3603207 - RNA, 13 nt, Human
auuugaaguguaa

SEQ ID NO: 3603208 - RNA, 16 nt, Human
auuugaaucucaauuu

SEQ ID NO: 3603209 - RNA, 18 nt, Human
auuugaaucucaauuuga

SEQ ID NO: 3603210 - RNA, 14 nt, Human
auuugaaucuuguc

SEQ ID NO: 3603211 - RNA, 18 nt, Human
auuugaaucuugucucaa

SEQ ID NO: 3603212 - RNA, 22 nt, Human
auuugaaucuugucucaaugcu

SEQ ID NO: 3603213 - RNA, 14 nt, Human
auuugaaugcauuu

SEQ ID NO: 3603214 - RNA, 21 nt, Human
auuugaauguaugcuucauac

SEQ ID NO: 3603215 - RNA, 20 nt, Human
auuugaauuaaaacuucuua

SEQ ID NO: 3603216 - RNA, 18 nt, Human
auuugaauuaucagcaaa

SEQ ID NO: 3603217 - RNA, 17 nt, Human
auuugaauuauuucugu

SEQ ID NO: 3603218 - RNA, 18 nt, Human
auuugaauuuuaaaucua

SEQ ID NO: 3603219 - RNA, 20 nt, Human
auuugaauuuuaaaucuaaa

SEQ ID NO: 3603220 - RNA, 13 nt, Human
auuugaauuuugu

SEQ ID NO: 3603221 - RNA, 15 nt, Human
auuugaauuuugugu

SEQ ID NO: 3603222 - RNA, 13 nt, Human
auuugaccuacaa

SEQ ID NO: 3603223 - RNA, 21 nt, Human
auuugaccuccucccuguuau

SEQ ID NO: 3603224 - RNA, 12 nt, Human
auuugacuaauu

SEQ ID NO: 3603225 - RNA, 14 nt, Human
auuugacugaagau

SEQ ID NO: 3603226 - RNA, 15 nt, Human
auuugacuguuauuu

SEQ ID NO: 3603227 - RNA, 15 nt, Human
auuugacuugugguu

SEQ ID NO: 3603228 - RNA, 16 nt, Human
auuugacuugugguug

SEQ ID NO: 3603229 - RNA, 14 nt, Human
auuugagaaaugca

SEQ ID NO: 3603230 - RNA, 16 nt, Human
auuugagaaaugcaua

SEQ ID NO: 3603231 - RNA, 15 nt, Human
auuugagacauucca

SEQ ID NO: 3603232 - RNA, 18 nt, Human
auuugagagaaauaugaa

SEQ ID NO: 3603233 - RNA, 15 nt, Human
auuugagcagggcuc

SEQ ID NO: 3603234 - RNA, 16 nt, Human
auuugagcagggcuca

SEQ ID NO: 3603235 - RNA, 17 nt, Human
auuugagcagggcucag

SEQ ID NO: 3603236 - RNA, 19 nt, Human
auuugaggagcagcuucag

SEQ ID NO: 3603237 - RNA, 23 nt, Human
auuugaggagcagcuucaguugu

SEQ ID NO: 3603238 - RNA, 20 nt, Human
auuugaggaguguuaagauu

SEQ ID NO: 3603239 - RNA, 14 nt, Human
auuugaggcucaga

SEQ ID NO: 3603240 - RNA, 18 nt, Human
auuugaggucuguucuuu

SEQ ID NO: 3603241 - RNA, 21 nt, Human
auuugaggucuguucuuucca

SEQ ID NO: 3603242 - RNA, 22 nt, Human
auuugaggucuguucuuuccaa

SEQ ID NO: 3603243 - RNA, 18 nt, Human
auuugagguuaagacaaa

SEQ ID NO: 3603244 - RNA, 21 nt, Human
auuugagucucuuaauagcca

SEQ ID NO: 3603245 - RNA, 16 nt, Human
auuugagugcucugau

SEQ ID NO: 3603246 - RNA, 16 nt, Human
auuugauaaugauaaa

SEQ ID NO: 3603247 - RNA, 19 nt, Human
auuugauaaugauaaaaca

SEQ ID NO: 3603248 - RNA, 14 nt, Human
auuugauacauaau

SEQ ID NO: 3603249 - RNA, 19 nt, Human
auuugauacauaauaaaaa

SEQ ID NO: 3603250 - RNA, 16 nt, Human
auuugauaccccuggg

SEQ ID NO: 3603251 - RNA, 14 nt, Human
auuugauacuuaua

SEQ ID NO: 3603252 - RNA, 17 nt, Human
auuugauauuuuuuaaa

SEQ ID NO: 3603253 - RNA, 23 nt, Human
auuugaucguuccaguucccacu

SEQ ID NO: 3603254 - RNA, 11 nt, Human
auuugaugaaa

SEQ ID NO: 3603255 - RNA, 16 nt, Human
auuugaugaaagcuga

SEQ ID NO: 3603256 - RNA, 19 nt, Human
auuugauuauuuaagacua

SEQ ID NO: 3603257 - RNA, 14 nt, Human
auuugauuuauuaa

SEQ ID NO: 3603258 - RNA, 15 nt, Human
auuugauuuauuaac

SEQ ID NO: 3603259 - RNA, 17 nt, Human
auuugauuucuauucaa

SEQ ID NO: 3603260 - RNA, 18 nt, Human
auuugauuuuugucucaa

SEQ ID NO: 3603261 - RNA, 11 nt, Human
auuugcaaagu

SEQ ID NO: 3603262 - RNA, 13 nt, Human
auuugcaaaguac

SEQ ID NO: 3603263 - RNA, 17 nt, Human
auuugcaaaguacugua

SEQ ID NO: 3603264 - RNA, 19 nt, Human
auuugcaagucauggcugu

SEQ ID NO: 3603265 - RNA, 15 nt, Human
auuugcacaaguuuu

SEQ ID NO: 3603266 - RNA, 17 nt, Human
auuugcacauuaaauga

SEQ ID NO: 3603267 - RNA, 20 nt, Human
auuugcacauuaaaugacuc

SEQ ID NO: 3603268 - RNA, 16 nt, Human
auuugcacccuccgcc

SEQ ID NO: 3603269 - RNA, 21 nt, Human
auuugcacuggaguucuaugc

SEQ ID NO: 3603270 - RNA, 15 nt, Human
auuugcagagacagg

SEQ ID NO: 3603271 - RNA, 22 nt, Human
auuugcagagacaggaccugac

SEQ ID NO: 3603272 - RNA, 21 nt, Human
auuugcagcugagagaaaaua

SEQ ID NO: 3603273 - RNA, 22 nt, Human
auuugcagcugagagaaaauaa

SEQ ID NO: 3603274 - RNA, 16 nt, Human
auuugcagcuuccaau

SEQ ID NO: 3603275 - RNA, 22 nt, Human
auuugcauaacaauuccucuac

SEQ ID NO: 3603276 - RNA, 13 nt, Human
auuugcauacuua

SEQ ID NO: 3603277 - RNA, 15 nt, Human
auuugcauacuuacc

SEQ ID NO: 3603278 - RNA, 22 nt, Human
auuugcauggcuccagaaaugu

SEQ ID NO: 3603279 - RNA, 12 nt, Human
auuugcauguua

SEQ ID NO: 3603280 - RNA, 13 nt, Human
auuugcauguuau

SEQ ID NO: 3603281 - RNA, 22 nt, Human
auuugcauguuauguuuaauaa

SEQ ID NO: 3603282 - RNA, 22 nt, Human
auuugcauugaacacaaacugu

SEQ ID NO: 3603283 - RNA, 16 nt, Human
auuugcauuuguuuau

SEQ ID NO: 3603284 - RNA, 20 nt, Human
auuugccacugauauucaga

SEQ ID NO: 3603285 - RNA, 22 nt, Human
auuugccacugauauucagaau

SEQ ID NO: 3603286 - RNA, 13 nt, Human
auuugccauagag

SEQ ID NO: 3603287 - RNA, 21 nt, Human
auuugcccauuuacacuuuug

SEQ ID NO: 3603288 - RNA, 22 nt, Human
auuugccuauucccacaccucc

SEQ ID NO: 3603289 - RNA, 15 nt, Human
auuugccugugccac

SEQ ID NO: 3603290 - RNA, 15 nt, Human
auuugccuugcagaa

SEQ ID NO: 3603291 - RNA, 15 nt, Human
auuugcgaaugguuc

SEQ ID NO: 3603292 - RNA, 18 nt, Human
auuugcuaaucaaagcca

SEQ ID NO: 3603293 - RNA, 16 nt, Human
auuugcuaauuuuuau

SEQ ID NO: 3603294 - RNA, 14 nt, Human
auuugcucauggaa

SEQ ID NO: 3603295 - RNA, 17 nt, Human
auuugcucauggaauug

SEQ ID NO: 3603296 - RNA, 19 nt, Human
auuugcugccaaaugcgua

SEQ ID NO: 3603297 - RNA, 14 nt, Human
auuugcugcucuuc

SEQ ID NO: 3603298 - RNA, 13 nt, Human
auuugcuggggaa

SEQ ID NO: 3603299 - RNA, 18 nt, Human
auuugcuuauuuaauaaa

SEQ ID NO: 3603300 - RNA, 20 nt, Human
auuugcuuucuuuucuccca

SEQ ID NO: 3603301 - RNA, 17 nt, Human
auuugcuuuuugugaua

SEQ ID NO: 3603302 - RNA, 19 nt, Human
auuuggaaacuaauaaaau

SEQ ID NO: 3603303 - RNA, 21 nt, Human
auuuggaaacuaauaaaauau

SEQ ID NO: 3603304 - RNA, 19 nt, Human
caaaugauugcuuuuaaaa

SEQ ID NO: 3603305 - RNA, 19 nt, Human
caaaugcaaaaacucuuug

SEQ ID NO: 3603306 - RNA, 18 nt, Human
caaaugcaguauauuucu

SEQ ID NO: 3603307 - RNA, 18 nt, Human
caaaugcaucaauccugu

SEQ ID NO: 3603308 - RNA, 15 nt, Human
caaaugcaucuuuga

SEQ ID NO: 3603309 - RNA, 16 nt, Human
caaaugcaugaacaag

SEQ ID NO: 3603310 - RNA, 20 nt, Human
caaaugcaugcuucuucuca

SEQ ID NO: 3603311 - RNA, 21 nt, Human
caaaugccaaauuaaaaaaga

SEQ ID NO: 3603312 - RNA, 14 nt, Human
caaaugccagggcc

SEQ ID NO: 3603313 - RNA, 19 nt, Human
caaaugcccaagggaaaga

SEQ ID NO: 3603314 - RNA, 17 nt, Human
caaaugccuuaaaaugg

SEQ ID NO: 3603315 - RNA, 19 nt, Human
caaaugccuuaaaauggaa

SEQ ID NO: 3603316 - RNA, 17 nt, Human
caaaugcuauuaaagug

SEQ ID NO: 3603317 - RNA, 22 nt, Human
caaaugcucucucaaauuguca

SEQ ID NO: 3603318 - RNA, 20 nt, Human
caaaugcugcgcccuucccc

SEQ ID NO: 3603319 - RNA, 21 nt, Human
caaaugcugcgcccuucccca

SEQ ID NO: 3603320 - RNA, 23 nt, Human
caaaugcuguaacuuucugaaau

SEQ ID NO: 3603321 - RNA, 15 nt, Human
caaaugcuguauucu

SEQ ID NO: 3603322 - RNA, 14 nt, Human
caaauggaaaggag

SEQ ID NO: 3603323 - RNA, 20 nt, Human
caaauggaaaugggcagagc

SEQ ID NO: 3603324 - RNA, 22 nt, Human
caaauggaaaugggcagagcag

SEQ ID NO: 3603325 - RNA, 15 nt, Human
caaauggaagacaca

SEQ ID NO: 3603326 - RNA, 17 nt, Human
caaauggagaagcugca

SEQ ID NO: 3603327 - RNA, 19 nt, Human
caaauggaguuggaguuca

SEQ ID NO: 3603328 - RNA, 22 nt, Human
caaauggauuuugggagugacu

SEQ ID NO: 3603329 - RNA, 18 nt, Human
caaauggcgucuggaagu

SEQ ID NO: 3603330 - RNA, 19 nt, Human
caaauggcgucuggaaguc

SEQ ID NO: 3603331 - RNA, 14 nt, Human
caaauggggccaga

SEQ ID NO: 3603332 - RNA, 15 nt, Human
caaauggggccagau

SEQ ID NO: 3603333 - RNA, 18 nt, Human
caaauggggccagaucca

SEQ ID NO: 3603334 - RNA, 20 nt, Human
caaauggggccagauccagc

SEQ ID NO: 3603335 - RNA, 23 nt, Human
caaauggggccagauccagccug

SEQ ID NO: 3603336 - RNA, 22 nt, Human
caaaugggugauauccugaaaa

SEQ ID NO: 3603337 - RNA, 13 nt, Human
caaaugguacaaa

SEQ ID NO: 3603338 - RNA, 22 nt, Human
caaauggugguuguuucuucca

SEQ ID NO: 3603339 - RNA, 23 nt, Human
caaaugguuaccuuguuauuuaa

SEQ ID NO: 3603340 - RNA, 23 nt, Human
caaaugguuuaacuucugccugu

SEQ ID NO: 3603341 - RNA, 17 nt, Human
caaauguaaacauuuuc

SEQ ID NO: 3603342 - RNA, 22 nt, Human
caaauguaauguggcuucugga

SEQ ID NO: 3603343 - RNA, 17 nt, Human
caaaugucaucagaacu

SEQ ID NO: 3603344 - RNA, 19 nt, Human
caaaugucaugcugccuua

SEQ ID NO: 3603345 - RNA, 18 nt, Human
caaauguccuccagaagc

SEQ ID NO: 3603346 - RNA, 19 nt, Human
caaauguccuccagaagcc

SEQ ID NO: 3603347 - RNA, 15 nt, Human
caaaugucuauaaac

SEQ ID NO: 3603348 - RNA, 18 nt, Human
caaaugugaagaugcauu

SEQ ID NO: 3603349 - RNA, 14 nt, Human
caaaugugcuuuga

SEQ ID NO: 3603350 - RNA, 18 nt, Human
caaaugugcuuugagaag

SEQ ID NO: 3603351 - RNA, 19 nt, Human
caaauguggcauuugugau

SEQ ID NO: 3603352 - RNA, 20 nt, Human
caaauguguaucggaugcuu

SEQ ID NO: 3603353 - RNA, 17 nt, Human
caaauguguuuuggucc

SEQ ID NO: 3603354 - RNA, 20 nt, Human
caaauguuaaaauguguugu

SEQ ID NO: 3603355 - RNA, 14 nt, Human
caaauguuacauag

SEQ ID NO: 3603356 - RNA, 19 nt, Human
caaauguucuaaguuucua

SEQ ID NO: 3603357 - RNA, 18 nt, Human
auuuugcuuugugauuuu

SEQ ID NO: 3603358 - RNA, 19 nt, Human
auuuuggaaaauaaauuau

SEQ ID NO: 3603359 - RNA, 23 nt, Human
auuuuggaaagcuccuagcagag

SEQ ID NO: 3603360 - RNA, 20 nt, Human
auuuuggaaguuuucaggac

SEQ ID NO: 3603361 - RNA, 11 nt, Human
auuuuggaauu

SEQ ID NO: 3603362 - RNA, 12 nt, Human
auuuuggaauuu

SEQ ID NO: 3603363 - RNA, 17 nt, Human
auuuuggagagauagga

SEQ ID NO: 3603364 - RNA, 22 nt, Human
auuuuggagaguuuccugaaac

SEQ ID NO: 3603365 - RNA, 19 nt, Human
auuuuggagauuauaauaa

SEQ ID NO: 3603366 - RNA, 20 nt, Human
auuuuggcgcuauuacaaau

SEQ ID NO: 3603367 - RNA, 18 nt, Human
auuuuggggauuuucaaa

SEQ ID NO: 3603368 - RNA, 23 nt, Human
auuuugggguacccacugcucug

SEQ ID NO: 3603369 - RNA, 11 nt, Human
auuuugggguc

SEQ ID NO: 3603370 - RNA, 13 nt, Human
auuuuggggucuc

SEQ ID NO: 3603371 - RNA, 16 nt, Human
auuuuggggucucuuu

SEQ ID NO: 3603372 - RNA, 17 nt, Human
auuuuggggucucuuuu

SEQ ID NO: 3603373 - RNA, 21 nt, Human
auuuuggucauagcauucacu

SEQ ID NO: 3603374 - RNA, 18 nt, Human
auuuugguccaaguugug

SEQ ID NO: 3603375 - RNA, 10 nt, Human
auuuuggucu

SEQ ID NO: 3603376 - RNA, 15 nt, Human
auuuuggugagaaau

SEQ ID NO: 3603377 - RNA, 16 nt, Human
auuuuggugagaaaug

SEQ ID NO: 3603378 - RNA, 21 nt, Human
auuuuggugagaaaugggacu

SEQ ID NO: 3603379 - RNA, 16 nt, Human
auuuugguucuucuca

SEQ ID NO: 3603380 - RNA, 15 nt, Human
auuuugguuguauuc

SEQ ID NO: 3603381 - RNA, 23 nt, Human
auuuugguuuuguuccccuccuc

SEQ ID NO: 3603382 - RNA, 10 nt, Human
auuuuguaaa

SEQ ID NO: 3603383 - RNA, 19 nt, Human
auuuuguaaaauguauuau

SEQ ID NO: 3603384 - RNA, 19 nt, Human
auuuuguaaacucaaaaua

SEQ ID NO: 3603385 - RNA, 17 nt, Human
auuuuguaaaggugaaa

SEQ ID NO: 3603386 - RNA, 17 nt, Human
auuuuguaacaaaugaa

SEQ ID NO: 3603387 - RNA, 17 nt, Human
auuuuguaacuuucucu

SEQ ID NO: 3603388 - RNA, 21 nt, Human
auuuuguaagaaggcaauauu

SEQ ID NO: 3603389 - RNA, 12 nt, Human
auuuuguaaguu

SEQ ID NO: 3603390 - RNA, 14 nt, Human
auuuuguaauaaua

SEQ ID NO: 3603391 - RNA, 12 nt, Human
auuuuguaauga

SEQ ID NO: 3603392 - RNA, 16 nt, Human
auuuuguaaugaauuc

SEQ ID NO: 3603393 - RNA, 22 nt, Human
auuuuguaauuauugugauuuc

SEQ ID NO: 3603394 - RNA, 23 nt, Human
auuuuguaucugcaggcagacac

SEQ ID NO: 3603395 - RNA, 16 nt, Human
auuuuguaucuugaug

SEQ ID NO: 3603396 - RNA, 16 nt, Human
auuuuguaugaaauau

SEQ ID NO: 3603397 - RNA, 21 nt, Human
auuuuguaugaaauauaugug

SEQ ID NO: 3603398 - RNA, 13 nt, Human
auuuuguaugcaa

SEQ ID NO: 3603399 - RNA, 17 nt, Human
auuuuguauuauugcug

SEQ ID NO: 3603400 - RNA, 23 nt, Human
auuuuguauuauugcuguugcuu

SEQ ID NO: 3603401 - RNA, 14 nt, Human
auuuuguauugugg

SEQ ID NO: 3603402 - RNA, 19 nt, Human
auuuuguauuguuucaauu

SEQ ID NO: 3603403 - RNA, 22 nt, Human
auuuuguauuuuccaagugugc

SEQ ID NO: 3603404 - RNA, 23 nt, Human
auuuugucauauaagauucauau

SEQ ID NO: 3603405 - RNA, 19 nt, Human
auuuugucauaucaaauaa

SEQ ID NO: 3603406 - RNA, 13 nt, Human
auuuugucuaaaa

SEQ ID NO: 3603407 - RNA, 21 nt, Human
auuuugucuaaaaugccucag

SEQ ID NO: 3603408 - RNA, 20 nt, Human
auuuugugaaacagacuugu

SEQ ID NO: 3603409 - RNA, 12 nt, Human
auuuugugaagc

SEQ ID NO: 3603410 - RNA, 18 nt, Human
auuuugugaagcccuguu

SEQ ID NO: 3603411 - RNA, 18 nt, Human
auuuugugaguuuguuuc

SEQ ID NO: 3603412 - RNA, 17 nt, Human
auuuugugaugcaaaua

SEQ ID NO: 3603413 - RNA, 18 nt, Human
auuuugugaugcaaauaa

SEQ ID NO: 3603414 - RNA, 16 nt, Human
auuuugugcucauuua

SEQ ID NO: 3603415 - RNA, 17 nt, Human
auuuuguguaagaaaua

SEQ ID NO: 3603416 - RNA, 12 nt, Human
auuuuguguccu

SEQ ID NO: 3603417 - RNA, 22 nt, Human
auuuugugugaccaacuguguu

SEQ ID NO: 3603418 - RNA, 23 nt, Human
auuuugugugaccaacuguguug

SEQ ID NO: 3603419 - RNA, 14 nt, Human
auuuuguucucugg

SEQ ID NO: 3603420 - RNA, 16 nt, Human
auuuuguucucuggga

SEQ ID NO: 3603421 - RNA, 21 nt, Human
auuuuguucucugggagaaaa

SEQ ID NO: 3603422 - RNA, 22 nt, Human
auuuuguucucugggagaaaau

SEQ ID NO: 3603423 - RNA, 18 nt, Human
auuuuguucuuacacaua

SEQ ID NO: 3603424 - RNA, 19 nt, Human
auuuuguugcuuuugugaa

SEQ ID NO: 3603425 - RNA, 13 nt, Human
auuuuguuguaaa

SEQ ID NO: 3603426 - RNA, 17 nt, Human
auuuuguuguaaaaaga

SEQ ID NO: 3603427 - RNA, 15 nt, Human
auuuuguuuaaauua

SEQ ID NO: 3603428 - RNA, 12 nt, Human
auuuuguuuaca

SEQ ID NO: 3603429 - RNA, 14 nt, Human
auuuuguuuauaag

SEQ ID NO: 3603430 - RNA, 11 nt, Human
auuuuguuucu

SEQ ID NO: 3603431 - RNA, 16 nt, Human
auuuuguuucuuuuaa

SEQ ID NO: 3603432 - RNA, 18 nt, Human
auuuuguuugguauugua

SEQ ID NO: 3603433 - RNA, 20 nt, Human
auuuuguuuuauuuugaaug

SEQ ID NO: 3603434 - RNA, 19 nt, Human
auuuuguuuugcuuuuucu

SEQ ID NO: 3603435 - RNA, 21 nt, Human
auuuuguuuugcuuuuucuga

SEQ ID NO: 3603436 - RNA, 22 nt, Human
auuuuguuuuugucuuaaaaag

SEQ ID NO: 3603437 - RNA, 20 nt, Human
auuuuuaaaaaauauuuucu

SEQ ID NO: 3603438 - RNA, 12 nt, Human
auuuuuaaaaac

SEQ ID NO: 3603439 - RNA, 17 nt, Human
auuuuuaaaaagaaauc

SEQ ID NO: 3603440 - RNA, 23 nt, Human
auuuuuaaaaagaaaucuggucu

SEQ ID NO: 3603441 - RNA, 16 nt, Human
auuuuuaaaacccauu

SEQ ID NO: 3603442 - RNA, 17 nt, Human
auuuuuaaaacccauuu

SEQ ID NO: 3603443 - RNA, 17 nt, Human
auuuuuaaaauauuuau

SEQ ID NO: 3603444 - RNA, 19 nt, Human
auuuuuaaaauuuuaauau

SEQ ID NO: 3603445 - RNA, 14 nt, Human
auuuuuaaaguaga

SEQ ID NO: 3603446 - RNA, 19 nt, Human
auuuuuaaaguagaagagg

SEQ ID NO: 3603447 - RNA, 13 nt, Human
auuuuuaagugcu

SEQ ID NO: 3603448 - RNA, 19 nt, Human
aucagacccuaccccacca

SEQ ID NO: 3603449 - RNA, 20 nt, Human
aucagacccuaccccaccac

SEQ ID NO: 3603450 - RNA, 19 nt, Human
aucagacuaagccagcacc

SEQ ID NO: 3603451 - RNA, 22 nt, Human
aucagacuagugacaagcuccu

SEQ ID NO: 3603452 - RNA, 17 nt, Human
aucagacugacaguuua

SEQ ID NO: 3603453 - RNA, 13 nt, Human
aucagagagcuca

SEQ ID NO: 3603454 - RNA, 17 nt, Human
aucagagcgcacaggga

SEQ ID NO: 3603455 - RNA, 15 nt, Human
aucagaggccuauaa

SEQ ID NO: 3603456 - RNA, 18 nt, Human
aucagaguagaaauaaaa

SEQ ID NO: 3603457 - RNA, 20 nt, Human
aucagagugacauccaggag

SEQ ID NO: 3603458 - RNA, 17 nt, Human
aucagaguugcugcaaa

SEQ ID NO: 3603459 - RNA, 22 nt, Human
aucagauaagacauaucucuaa

SEQ ID NO: 3603460 - RNA, 18 nt, Human
aucagaucauuucaaaac

SEQ ID NO: 3603461 - RNA, 21 nt, Human
aucagaucuggggcagcaccc

SEQ ID NO: 3603462 - RNA, 22 nt, Human
aucagaugaacucuuagaaaug

SEQ ID NO: 3603463 - RNA, 14 nt, Human
aucagauugcaugu

SEQ ID NO: 3603464 - RNA, 18 nt, Human
aucagauugcaugugacu

SEQ ID NO: 3603465 - RNA, 15 nt, Human
aucagauugcuuuug

SEQ ID NO: 3603466 - RNA, 18 nt, Human
aucagauugcuuuugugc

SEQ ID NO: 3603467 - RNA, 21 nt, Human
aucagcaagucucuuuauaug

SEQ ID NO: 3603468 - RNA, 15 nt, Human
aucagcacauauuuu

SEQ ID NO: 3603469 - RNA, 15 nt, Human
aucagcacgauuucu

SEQ ID NO: 3603470 - RNA, 19 nt, Human
aucagcacgauuucuguuu

SEQ ID NO: 3603471 - RNA, 14 nt, Human
aucagcacugaaaa

SEQ ID NO: 3603472 - RNA, 14 nt, Human
aucagccaauuaug

SEQ ID NO: 3603473 - RNA, 19 nt, Human
aucagccaauuauguuaaa

SEQ ID NO: 3603474 - RNA, 13 nt, Human
aucagccagcugc

SEQ ID NO: 3603475 - RNA, 15 nt, Human
aucagccccacccug

SEQ ID NO: 3603476 - RNA, 24 nt, Human
aucagcccugcccuucagcauccu

SEQ ID NO: 3603477 - RNA, 16 nt, Human
aucagcccuugggggu

SEQ ID NO: 3603478 - RNA, 19 nt, Human
aucagccugagucuccugu

SEQ ID NO: 3603479 - RNA, 20 nt, Human
aucagccugagucuccugug

SEQ ID NO: 3603480 - RNA, 19 nt, Human
aucagccugcuccagcugu

SEQ ID NO: 3603481 - RNA, 14 nt, Human
aucagccugugcca

SEQ ID NO: 3603482 - RNA, 16 nt, Human
aucagcguggccuugu

SEQ ID NO: 3603483 - RNA, 21 nt, Human
aucagcguggccuuguucugu

SEQ ID NO: 3603484 - RNA, 16 nt, Human
aucagcuagcaaaaga

SEQ ID NO: 3603485 - RNA, 23 nt, Human
aucagcuagcaaaagaaguaaca

SEQ ID NO: 3603486 - RNA, 17 nt, Human
aucagcuauuuugugaa

SEQ ID NO: 3603487 - RNA, 16 nt, Human
aucagcugcuuuguua

SEQ ID NO: 3603488 - RNA, 16 nt, Human
aucagcuguuugucau

SEQ ID NO: 3603489 - RNA, 18 nt, Human
aucagcuuucaaagcauu

SEQ ID NO: 3603490 - RNA, 23 nt, Human
aucaggaacguuuagcugacaaa

SEQ ID NO: 3603491 - RNA, 18 nt, Human
aucaggacccagaggaag

SEQ ID NO: 3603492 - RNA, 13 nt, Human
aucaggagaaaaa

SEQ ID NO: 3603493 - RNA, 22 nt, Human
aucaggagaaaaagccuccagu

SEQ ID NO: 3603494 - RNA, 19 nt, Human
aucaggaugaacccaggac

SEQ ID NO: 3603495 - RNA, 15 nt, Human
aucaggccaggcccu

SEQ ID NO: 3603496 - RNA, 16 nt, Human
aucaggccauuguccc

SEQ ID NO: 3603497 - RNA, 16 nt, Human
aucaggcuacuagaau

SEQ ID NO: 3603498 - RNA, 15 nt, Human
aucagggccuggggc

SEQ ID NO: 3603499 - RNA, 21 nt, Human
aucagggccuggggccugaga

SEQ ID NO: 3603500 - RNA, 18 nt, Human
aucagggggaagaagcag

SEQ ID NO: 3603501 - RNA, 23 nt, Human
aucagggggaagaagcagagaga

SEQ ID NO: 3603502 - RNA, 20 nt, Human
aucagggguaggaauggaaa

SEQ ID NO: 3603503 - RNA, 21 nt, Human
aucagguccugcucagcagug

SEQ ID NO: 3603504 - RNA, 20 nt, Human
aucaggugcccaucccugga

SEQ ID NO: 3603505 - RNA, 17 nt, Human
aucaggugcugccaucc

SEQ ID NO: 3603506 - RNA, 20 nt, Human
aucagguuuucuuuuaagaa

SEQ ID NO: 3603507 - RNA, 19 nt, Human
aucaguaaaauuauacugu

SEQ ID NO: 3603508 - RNA, 15 nt, Human
aucaguaaacacugu

SEQ ID NO: 3603509 - RNA, 14 nt, Human
aucaguaaauaacu

SEQ ID NO: 3603510 - RNA, 19 nt, Human
aucaguaagaaaaagaaga

SEQ ID NO: 3603511 - RNA, 17 nt, Human
aucaguagcuuaagaaa

SEQ ID NO: 3603512 - RNA, 18 nt, Human
aucaguaguuugcauuuc

SEQ ID NO: 3603513 - RNA, 16 nt, Human
aucaguauaauucugu

SEQ ID NO: 3603514 - RNA, 17 nt, Human
aucaguauuaauacuaa

SEQ ID NO: 3603515 - RNA, 22 nt, Human
aucaguauuaauacuaaaauau

SEQ ID NO: 3603516 - RNA, 12 nt, Human
auuuuucucaug

SEQ ID NO: 3603517 - RNA, 21 nt, Human
auuuuucuggagguugauaac

SEQ ID NO: 3603518 - RNA, 20 nt, Human
auuuuucuuaaaaaguaacu

SEQ ID NO: 3603519 - RNA, 11 nt, Human
auuuuucuucc

SEQ ID NO: 3603520 - RNA, 15 nt, Human
auuuuucuuuacaaa

SEQ ID NO: 3603521 - RNA, 16 nt, Human
auuuuucuuuacaaaa

SEQ ID NO: 3603522 - RNA, 17 nt, Human
auuuuugaauguaguaa

SEQ ID NO: 3603523 - RNA, 17 nt, Human
auuuuugaaugugauuu

SEQ ID NO: 3603524 - RNA, 22 nt, Human
auuuuugacagaauauguuuca

SEQ ID NO: 3603525 - RNA, 15 nt, Human
auuuuugacaguguu

SEQ ID NO: 3603526 - RNA, 21 nt, Human
auuuuugauacuaagcauuga

SEQ ID NO: 3603527 - RNA, 23 nt, Human
auuuuugauuuaugcauggaaac

SEQ ID NO: 3603528 - RNA, 12 nt, Human
auuuuugcaaua

SEQ ID NO: 3603529 - RNA, 20 nt, Human
auuuuugcaauaaugcagua

SEQ ID NO: 3603530 - RNA, 12 nt, Human
auuuuugccucu

SEQ ID NO: 3603531 - RNA, 14 nt, Human
auuuuugccuucau

SEQ ID NO: 3603532 - RNA, 16 nt, Human
auuuuugcuugacuuc

SEQ ID NO: 3603533 - RNA, 14 nt, Human
auuuuugcuuuuga

SEQ ID NO: 3603534 - RNA, 21 nt, Human
auuuuugcuuuugauaagaaa

SEQ ID NO: 3603535 - RNA, 23 nt, Human
auuuuuggaagaggacuccuuaa

SEQ ID NO: 3603536 - RNA, 18 nt, Human
auuuuuggagguuuauua

SEQ ID NO: 3603537 - RNA, 22 nt, Human
auuuuuggauugacaguaacuu

SEQ ID NO: 3603538 - RNA, 18 nt, Human
auuuuuggucauuguaau

SEQ ID NO: 3603539 - RNA, 17 nt, Human
auuuuugguugaauaaa

SEQ ID NO: 3603540 - RNA, 19 nt, Human
auuuuuguaaacuggaauu

SEQ ID NO: 3603541 - RNA, 13 nt, Human
auuuuuguaaagu

SEQ ID NO: 3603542 - RNA, 15 nt, Human
auuuuuguaaaguuu

SEQ ID NO: 3603543 - RNA, 13 nt, Human
auuuuuguacaug

SEQ ID NO: 3603544 - RNA, 19 nt, Human
auuuuuguagagccagggu

SEQ ID NO: 3603545 - RNA, 18 nt, Human
auuuuuguauucaauuaa

SEQ ID NO: 3603546 - RNA, 16 nt, Human
auuuuuguuacucucu

SEQ ID NO: 3603547 - RNA, 17 nt, Human
auuuuuguuucuuccaa

SEQ ID NO: 3603548 - RNA, 13 nt, Human
auuuuuguuuguu

SEQ ID NO: 3603549 - RNA, 14 nt, Human
auuuuuguuuguuu

SEQ ID NO: 3603550 - RNA, 21 nt, Human
auuuuuguuuuguuuuuacaa

SEQ ID NO: 3603551 - RNA, 19 nt, Human
auuuuuguuuuuauuaaaa

SEQ ID NO: 3603552 - RNA, 15 nt, Human
auuuuuuaaaaacua

SEQ ID NO: 3603553 - RNA, 12 nt, Human
auuuuuuaaagu

SEQ ID NO: 3603554 - RNA, 13 nt, Human
auuuuuuaaaugc

SEQ ID NO: 3603555 - RNA, 18 nt, Human
auuuuuuaaauugaauuc

SEQ ID NO: 3603556 - RNA, 22 nt, Human
auuuuuuaaccccgucaacaaa

SEQ ID NO: 3603557 - RNA, 23 nt, Human
auuuuuuaaccccgucaacaaau

SEQ ID NO: 3603558 - RNA, 18 nt, Human
auuuuuuaaguauuuaua

SEQ ID NO: 3603559 - RNA, 15 nt, Human
auuuuuuaauaaccc

SEQ ID NO: 3603560 - RNA, 16 nt, Human
auuuuuuaauuauugu

SEQ ID NO: 3603561 - RNA, 22 nt, Human
auuuuuuaauuugaugaaagcu

SEQ ID NO: 3603562 - RNA, 14 nt, Human
auuuuuuaggaaau

SEQ ID NO: 3603563 - RNA, 16 nt, Human
auuuuuuagugacuaa

SEQ ID NO: 3603564 - RNA, 18 nt, Human
auuuuuuauauauacagu

SEQ ID NO: 3603565 - RNA, 22 nt, Human
auuuuuuaugggcauugacaaa

SEQ ID NO: 3603566 - RNA, 16 nt, Human
auuuuuuauucuugug

SEQ ID NO: 3603567 - RNA, 17 nt, Human
auuuuuuauucuuguga

SEQ ID NO: 3603568 - RNA, 22 nt, Human
auuuuuucagaaauaugugguu

SEQ ID NO: 3603569 - RNA, 20 nt, Human
auuuuuucagacuugucaag

SEQ ID NO: 3603570 - RNA, 13 nt, Human
auuuuuuccaaaa

SEQ ID NO: 3603571 - RNA, 14 nt, Human
auuuuuucuugcau

SEQ ID NO: 3603572 - RNA, 14 nt, Human
auuuuuugaaaguu

SEQ ID NO: 3603573 - RNA, 15 nt, Human
auuuuuugaaaugcu

SEQ ID NO: 3603574 - RNA, 16 nt, Human
auuuuuuggcacuugc

SEQ ID NO: 3603575 - RNA, 18 nt, Human
auuuuuugguauuggcca

SEQ ID NO: 3603576 - RNA, 21 nt, Human
auuuuuugguuaagcuuugac

SEQ ID NO: 3603577 - RNA, 15 nt, Human
auuuuuuguauaauu

SEQ ID NO: 3603578 - RNA, 12 nt, Human
auuuuuuguuga

SEQ ID NO: 3603579 - RNA, 21 nt, Human
auuuuuuguugacauuagucu

SEQ ID NO: 3603580 - RNA, 15 nt, Human
auuuuuuuaaaauca

SEQ ID NO: 3603581 - RNA, 17 nt, Human
auuuuuuuaaaauuuug

SEQ ID NO: 3603582 - RNA, 16 nt, Human
auuuuuuuaaccaaag

SEQ ID NO: 3603583 - RNA, 19 nt, Human
auuuuuuuaaccaaaggug

SEQ ID NO: 3603584 - RNA, 17 nt, Human
auuuuuuuaauuuugua

SEQ ID NO: 3603585 - RNA, 18 nt, Human
auuuuuuuacuaauagac

SEQ ID NO: 3603586 - RNA, 23 nt, Human
auuuuuuuagaaagcauuugaau

SEQ ID NO: 3603587 - RNA, 21 nt, Human
auuuuuuuaucuugggacugg

SEQ ID NO: 3603588 - RNA, 16 nt, Human
auuuuuuuauuacuga

SEQ ID NO: 3603589 - RNA, 18 nt, Human
auuuuuuuauuguuuaaa

SEQ ID NO: 3603590 - RNA, 14 nt, Human
auuuuuuucaccuc

SEQ ID NO: 3603591 - RNA, 12 nt, Human
auuuuuuucuac

SEQ ID NO: 3603592 - RNA, 13 nt, Human
auuuuuuucucuc

SEQ ID NO: 3603593 - RNA, 21 nt, Human
auuuuuuucugauuguaacgu

SEQ ID NO: 3603594 - RNA, 21 nt, Human
auuuuuuugaacucuucucau

SEQ ID NO: 3603595 - RNA, 16 nt, Human
auuuuuuugagacaga

SEQ ID NO: 3603596 - RNA, 13 nt, Human
auuuuuuuguaau

SEQ ID NO: 3603597 - RNA, 15 nt, Human
auuuuuuuguaauaa

SEQ ID NO: 3603598 - RNA, 19 nt, Human
auuuuuuuguaauaagcaa

SEQ ID NO: 3603599 - RNA, 14 nt, Human
auuuuuuuguaauu

SEQ ID NO: 3603600 - RNA, 17 nt, Human
auuuuuuuguaugaaaa

SEQ ID NO: 3603601 - RNA, 13 nt, Human
auuuuuuugucuu

SEQ ID NO: 3603602 - RNA, 13 nt, Human
auuuuuuuguugu

SEQ ID NO: 3603603 - RNA, 14 nt, Human
auuuuuuuuaacau

SEQ ID NO: 3603604 - RNA, 18 nt, Human
auuuuuuuuaacauuccu

SEQ ID NO: 3603605 - RNA, 18 nt, Human
auuuuuuuuaaguauuua

SEQ ID NO: 3603606 - RNA, 16 nt, Human
auuuuuuuuauuagua

SEQ ID NO: 3603607 - RNA, 22 nt, Human
auuuuuuuucaugcuuuaucaa

SEQ ID NO: 3603608 - RNA, 14 nt, Human
auuuuuuuucaugu

SEQ ID NO: 3603609 - RNA, 20 nt, Human
auuuuuuuucauguuuuaac

SEQ ID NO: 3603610 - RNA, 23 nt, Human
auuuuuuuucccauuuagaaugg

SEQ ID NO: 3603611 - RNA, 15 nt, Human
auuuuuuuucuguua

SEQ ID NO: 3603612 - RNA, 16 nt, Human
auuuuuuuucuuugaa

SEQ ID NO: 3603613 - RNA, 15 nt, Human
auuuuuuuucuuuua

SEQ ID NO: 3603614 - RNA, 21 nt, Human
auuuuuuuuguuguuucagug

SEQ ID NO: 3603615 - RNA, 21 nt, Human
auuuuuuuuuagaacagaaaa

SEQ ID NO: 3603616 - RNA, 18 nt, Human
auuuuuuuuuccuucagu

SEQ ID NO: 3603617 - RNA, 15 nt, Human
auuuuuuuuucuaag

SEQ ID NO: 3603618 - RNA, 19 nt, Human
auuuuuuuuucuaagagaa

SEQ ID NO: 3603619 - RNA, 16 nt, Human
auuuuuuuuucuuuca

SEQ ID NO: 3603620 - RNA, 18 nt, Human
auuuuuuuuuuuaaucua

SEQ ID NO: 3603621 - RNA, 23 nt, Human
auuuuuuuuuuuguuucugagaa

SEQ ID NO: 3603622 - RNA, 20 nt, Human
auuuuuuuuuuuuuccuguc

SEQ ID NO: 3603623 - RNA, 23 nt, Human
auuuuuuuuuuuuuuuuuuuaag

SEQ ID NO: 3603624 - RNA, 19 nt, Human
caaaaaaaaaaaaaugcac

SEQ ID NO: 3603625 - RNA, 20 nt, Human
caaaaaaaaaguuuuauuuu

SEQ ID NO: 3603626 - RNA, 22 nt, Human
caaaaaaaaaguuuuauuuuuc

SEQ ID NO: 3603627 - RNA, 22 nt, Human
caaaaaaaaauuuuaaagaccc

SEQ ID NO: 3603628 - RNA, 15 nt, Human
caaaaaaaagucuau

SEQ ID NO: 3603629 - RNA, 13 nt, Human
caaaaaaaauuag

SEQ ID NO: 3603630 - RNA, 21 nt, Human
caaaaaaaauuuagccgggcg

SEQ ID NO: 3603631 - RNA, 13 nt, Human
caaaaaaacacua

SEQ ID NO: 3603632 - RNA, 20 nt, Human
caaaaaaaguugaaggccuu

SEQ ID NO: 3603633 - RNA, 21 nt, Human
caaaaaaaguuguaugaucug

SEQ ID NO: 3603634 - RNA, 15 nt, Human
caaaaaaauacugcc

SEQ ID NO: 3603635 - RNA, 23 nt, Human
caaaaaaauacugccagaugcug

SEQ ID NO: 3603636 - RNA, 17 nt, Human
caaaaaaaucugcagaa

SEQ ID NO: 3603637 - RNA, 18 nt, Human
caaaaaaaucuuccaauu

SEQ ID NO: 3603638 - RNA, 14 nt, Human
caaaaaaauuaaau

SEQ ID NO: 3603639 - RNA, 15 nt, Human
caaaaaacuacuucu

SEQ ID NO: 3603640 - RNA, 15 nt, Human
caaaaaacugcagug

SEQ ID NO: 3603641 - RNA, 13 nt, Human
caaaaaaucuuaa

SEQ ID NO: 3603642 - RNA, 19 nt, Human
caaaaaaucuuaauacugu

SEQ ID NO: 3603643 - RNA, 16 nt, Human
caaaaaauguuuuaaa

SEQ ID NO: 3603644 - RNA, 18 nt, Human
caaaaaauuagccgggcg

SEQ ID NO: 3603645 - RNA, 14 nt, Human
caaaaacaaaaaga

SEQ ID NO: 3603646 - RNA, 22 nt, Human
caaaaacagccucacagaagaa

SEQ ID NO: 3603647 - RNA, 14 nt, Human
caaaaacauggccu

SEQ ID NO: 3603648 - RNA, 22 nt, Human
caaaaacauguaugugcauuuc

SEQ ID NO: 3603649 - RNA, 15 nt, Human
caaaaaccaaauguu

SEQ ID NO: 3603650 - RNA, 19 nt, Human
caaaaaccaguauuguaca

SEQ ID NO: 3603651 - RNA, 17 nt, Human
caaaaaccuauuccacu

SEQ ID NO: 3603652 - RNA, 17 nt, Human
caaaaaccucacccgag

SEQ ID NO: 3603653 - RNA, 23 nt, Human
caaaaacuuuggaguccccucac

SEQ ID NO: 3603654 - RNA, 13 nt, Human
caaaaagaaauga

SEQ ID NO: 3603655 - RNA, 12 nt, Human
caaaaagaacaa

SEQ ID NO: 3603656 - RNA, 19 nt, Human
caaaaagaacaaaaaaauc

SEQ ID NO: 3603657 - RNA, 14 nt, Human
caaaaagaaccacu

SEQ ID NO: 3603658 - RNA, 13 nt, Human
caaaaagaccaga

SEQ ID NO: 3603659 - RNA, 14 nt, Human
caaaaagaccagac

SEQ ID NO: 3603660 - RNA, 20 nt, Human
caaaaagauaccuuaaaauu

SEQ ID NO: 3603661 - RNA, 18 nt, Human
caaaaagcuaauaccagu

SEQ ID NO: 3603662 - RNA, 13 nt, Human
caaaaagcuuccc

SEQ ID NO: 3603663 - RNA, 14 nt, Human
caaaaagcuucugu

SEQ ID NO: 3603664 - RNA, 20 nt, Human
caaaaagggaaacuauuguc

SEQ ID NO: 3603665 - RNA, 14 nt, Human
caaaaaguauauua

SEQ ID NO: 3603666 - RNA, 15 nt, Human
caacaguaaaccacu

SEQ ID NO: 3603667 - RNA, 22 nt, Human
caacaguaaaccacugaaaaaa

SEQ ID NO: 3603668 - RNA, 16 nt, Human
caacagugaagacaga

SEQ ID NO: 3603669 - RNA, 13 nt, Human
caacagugcuaaa

SEQ ID NO: 3603670 - RNA, 14 nt, Human
caacagugugaagu

SEQ ID NO: 3603671 - RNA, 16 nt, Human
caacagugugaaguua

SEQ ID NO: 3603672 - RNA, 22 nt, Human
caacagugugaaguuagaauuc

SEQ ID NO: 3603673 - RNA, 20 nt, Human
caacaguguuaggccuggca

SEQ ID NO: 3603674 - RNA, 22 nt, Human
caacaguguuaggccuggcaca

SEQ ID NO: 3603675 - RNA, 12 nt, Human
caacaguuuucc

SEQ ID NO: 3603676 - RNA, 13 nt, Human
caacaguuuuccu

SEQ ID NO: 3603677 - RNA, 20 nt, Human
caacaguuuuccuaugcuuu

SEQ ID NO: 3603678 - RNA, 16 nt, Human
caacauaacccacuug

SEQ ID NO: 3603679 - RNA, 17 nt, Human
caacauaacucaagucu

SEQ ID NO: 3603680 - RNA, 16 nt, Human
caacauacucccaucu

SEQ ID NO: 3603681 - RNA, 21 nt, Human
caacauaguauucaugacuau

SEQ ID NO: 3603682 - RNA, 23 nt, Human
caacauagugggacccugucucu

SEQ ID NO: 3603683 - RNA, 13 nt, Human
caacauauaaaau

SEQ ID NO: 3603684 - RNA, 13 nt, Human
caacaucaauguu

SEQ ID NO: 3603685 - RNA, 15 nt, Human
caacaucaauguuca

SEQ ID NO: 3603686 - RNA, 16 nt, Human
caacaucaauguucau

SEQ ID NO: 3603687 - RNA, 17 nt, Human
caacaucacagcccagc

SEQ ID NO: 3603688 - RNA, 12 nt, Human
caacaucagcuu

SEQ ID NO: 3603689 - RNA, 15 nt, Human
caacaucagcuugac

SEQ ID NO: 3603690 - RNA, 21 nt, Human
caacauccauguccuaugugu

SEQ ID NO: 3603691 - RNA, 23 nt, Human
caacauccauguccuauguguga

SEQ ID NO: 3603692 - RNA, 17 nt, Human
caacaucccauugcccu

SEQ ID NO: 3603693 - RNA, 20 nt, Human
caacaucccauugcccuggu

SEQ ID NO: 3603694 - RNA, 15 nt, Human
caacauccugccagc

SEQ ID NO: 3603695 - RNA, 18 nt, Human
caacauccugccagcccc

SEQ ID NO: 3603696 - RNA, 13 nt, Human
caacaucuagcaa

SEQ ID NO: 3603697 - RNA, 13 nt, Human
caacaucuuuuua

SEQ ID NO: 3603698 - RNA, 19 nt, Human
caacaugaggccacuggag

SEQ ID NO: 3603699 - RNA, 23 nt, Human
caacaugccagccacugugauag

SEQ ID NO: 3603700 - RNA, 20 nt, Human
caacaugccugcuuuagaau

SEQ ID NO: 3603701 - RNA, 13 nt, Human
caacauggcuuug

SEQ ID NO: 3603702 - RNA, 17 nt, Human
caacauguauaauauuu

SEQ ID NO: 3603703 - RNA, 18 nt, Human
caacauguauaauauuuu

SEQ ID NO: 3603704 - RNA, 17 nt, Human
caacauguuacugacca

SEQ ID NO: 3603705 - RNA, 19 nt, Human
caacauguugggaaacuug

SEQ ID NO: 3603706 - RNA, 15 nt, Human
caacauuaaacacaa

SEQ ID NO: 3603707 - RNA, 22 nt, Human
caacauucauugccaagggccc

SEQ ID NO: 3603708 - RNA, 14 nt, Human
caacauucuuugca

SEQ ID NO: 3603709 - RNA, 16 nt, Human
caacauuguagccuca

SEQ ID NO: 3603710 - RNA, 10 nt, Human
caacauugug

SEQ ID NO: 3603711 - RNA, 20 nt, Human
caacauuguucaccuuugua

SEQ ID NO: 3603712 - RNA, 23 nt, Human
caacauuguucaccuuuguagca

SEQ ID NO: 3603713 - RNA, 17 nt, Human
caacauuucucaauaau

SEQ ID NO: 3603714 - RNA, 22 nt, Human
caacauuucucauguugaaacu

SEQ ID NO: 3603715 - RNA, 20 nt, Human
caacauuuugagaacaaaga

SEQ ID NO: 3603716 - RNA, 12 nt, Human
caaccaaauggu

SEQ ID NO: 3603717 - RNA, 22 nt, Human
caaccaaguaugaaucuauuug

SEQ ID NO: 3603718 - RNA, 14 nt, Human
caaccaagugugcu

SEQ ID NO: 3603719 - RNA, 20 nt, Human
caaccaauuuacacugccau

SEQ ID NO: 3603720 - RNA, 14 nt, Human
caaccacacaccuc

SEQ ID NO: 3603721 - RNA, 22 nt, Human
caaccacauacaacacaaagag

SEQ ID NO: 3603722 - RNA, 14 nt, Human
caaccaccgcuccc

SEQ ID NO: 3603723 - RNA, 20 nt, Human
caaccaccgcuccccagccc

SEQ ID NO: 3603724 - RNA, 21 nt, Human
caaccacguugggacagggag

SEQ ID NO: 3603725 - RNA, 19 nt, Human
caaccacuguaaaaugaaa

SEQ ID NO: 3603726 - RNA, 18 nt, Human
caaccagacagaggguca

SEQ ID NO: 3603727 - RNA, 21 nt, Human
caaccagaccauugucucaga

SEQ ID NO: 3603728 - RNA, 18 nt, Human
caaccagagcacuguaua

SEQ ID NO: 3603729 - RNA, 20 nt, Human
caaccagagcacuguauacc

SEQ ID NO: 3603730 - RNA, 20 nt, Human
caaccagauaacauaccuuu

SEQ ID NO: 3603731 - RNA, 19 nt, Human
caaccagauugucagcucc

SEQ ID NO: 3603732 - RNA, 20 nt, Human
caaccagauugucagcuccu

SEQ ID NO: 3603733 - RNA, 16 nt, Human
caaccaggcaccucuu

SEQ ID NO: 3603734 - RNA, 19 nt, Human
caaccaggcaccucuuccu

SEQ ID NO: 3603735 - RNA, 16 nt, Human
caaccagugccaagga

SEQ ID NO: 3603736 - RNA, 23 nt, Human
caaccaugagaccacuguuauca

SEQ ID NO: 3603737 - RNA, 20 nt, Human
caaaguaauuuggaaauuag

SEQ ID NO: 3603738 - RNA, 21 nt, Human
caaaguacacuguuucaaacu

SEQ ID NO: 3603739 - RNA, 22 nt, Human
caaaguacacuguuucaaacuu

SEQ ID NO: 3603740 - RNA, 19 nt, Human
caaaguacagguacuuugu

SEQ ID NO: 3603741 - RNA, 17 nt, Human
caaaguacuguaagaau

SEQ ID NO: 3603742 - RNA, 22 nt, Human
caaaguacuguaagaauaauuu

SEQ ID NO: 3603743 - RNA, 20 nt, Human
caaaguagaucaugcauaga

SEQ ID NO: 3603744 - RNA, 21 nt, Human
caaaguaguacuucuucugua

SEQ ID NO: 3603745 - RNA, 14 nt, Human
caaaguauuguaaa

SEQ ID NO: 3603746 - RNA, 15 nt, Human
caaaguauuguaaau

SEQ ID NO: 3603747 - RNA, 19 nt, Human
caaaguauuguaaauuaua

SEQ ID NO: 3603748 - RNA, 23 nt, Human
caaaguauuuuuuuaucuuggga

SEQ ID NO: 3603749 - RNA, 22 nt, Human
caaagucaugauguuuuuaaaa

SEQ ID NO: 3603750 - RNA, 21 nt, Human
caaagucaugcaaaggcuggg

SEQ ID NO: 3603751 - RNA, 12 nt, Human
caaagucauuaa

SEQ ID NO: 3603752 - RNA, 17 nt, Human
caaagucauuaaagaca

SEQ ID NO: 3603753 - RNA, 19 nt, Human
caaaguccugggauuacag

SEQ ID NO: 3603754 - RNA, 19 nt, Human
caaaguccuuuuuuuccau

SEQ ID NO: 3603755 - RNA, 15 nt, Human
caaagucuaaaguuu

SEQ ID NO: 3603756 - RNA, 15 nt, Human
caaagucuagguugg

SEQ ID NO: 3603757 - RNA, 12 nt, Human
caaagucucuaa

SEQ ID NO: 3603758 - RNA, 14 nt, Human
caaagucucuaauu

SEQ ID NO: 3603759 - RNA, 15 nt, Human
caaagucucuaauuc

SEQ ID NO: 3603760 - RNA, 20 nt, Human
caaagucugauuugugauga

SEQ ID NO: 3603761 - RNA, 14 nt, Human
caaagugccaaaga

SEQ ID NO: 3603762 - RNA, 15 nt, Human
caaagugccaaagaa

SEQ ID NO: 3603763 - RNA, 16 nt, Human
caaagugccacucauu

SEQ ID NO: 3603764 - RNA, 23 nt, Human
caaagugcugggauuacaagcgu

SEQ ID NO: 3603765 - RNA, 14 nt, Human
caaaguggaacgaa

SEQ ID NO: 3603766 - RNA, 15 nt, Human
caaaguggaaggaaa

SEQ ID NO: 3603767 - RNA, 19 nt, Human
caaagugguauagaaaugc

SEQ ID NO: 3603768 - RNA, 17 nt, Human
caaaguggugagaggca

SEQ ID NO: 3603769 - RNA, 19 nt, Human
caaaguguauuuuauaaaa

SEQ ID NO: 3603770 - RNA, 19 nt, Human
caaaguguggucucuggaa

SEQ ID NO: 3603771 - RNA, 14 nt, Human
caaaguguguauua

SEQ ID NO: 3603772 - RNA, 17 nt, Human
caaaguuaaaauuguua

SEQ ID NO: 3603773 - RNA, 16 nt, Human
caaaguuaacagauuu

SEQ ID NO: 3603774 - RNA, 20 nt, Human
caaaguuaaccuaccuguaa

SEQ ID NO: 3603775 - RNA, 21 nt, Human
caaaguuaaccuaccuguaac

SEQ ID NO: 3603776 - RNA, 21 nt, Human
caaaguuacuagguaacuuca

SEQ ID NO: 3603777 - RNA, 14 nt, Human
caaaguuagagaac

SEQ ID NO: 3603778 - RNA, 13 nt, Human
caaaguuauccag

SEQ ID NO: 3603779 - RNA, 16 nt, Human
caaaguuccaaaaugc

SEQ ID NO: 3603780 - RNA, 18 nt, Human
caaaguuccaaaaugcca

SEQ ID NO: 3603781 - RNA, 20 nt, Human
caaaguucccuacuuccugu

SEQ ID NO: 3603782 - RNA, 22 nt, Human
caaaguucuaauaauuucuaau

SEQ ID NO: 3603783 - RNA, 15 nt, Human
caaaguucuguguuu

SEQ ID NO: 3603784 - RNA, 17 nt, Human
caaaguucuguguuuaa

SEQ ID NO: 3603785 - RNA, 20 nt, Human
caaaguucuguguuuaauuu

SEQ ID NO: 3603786 - RNA, 22 nt, Human
caaaguucuguguuuaauuucu

SEQ ID NO: 3603787 - RNA, 15 nt, Human
caaaguugccuaaau

SEQ ID NO: 3603788 - RNA, 17 nt, Human
caaaguugccuaaaucc

SEQ ID NO: 3603789 - RNA, 20 nt, Human
caaaguuuaauaaauuuauu

SEQ ID NO: 3603790 - RNA, 19 nt, Human
caaaguuuaccagaaagca

SEQ ID NO: 3603791 - RNA, 20 nt, Human
caaaguuucagaguauauug

SEQ ID NO: 3603792 - RNA, 17 nt, Human
caaaguuugacaggaac

SEQ ID NO: 3603793 - RNA, 20 nt, Human
caaaguuuucaugugcucag

SEQ ID NO: 3603794 - RNA, 13 nt, Human
caaaguuuugaaa

SEQ ID NO: 3603795 - RNA, 17 nt, Human
caaauaaaaacuaaauu

SEQ ID NO: 3603796 - RNA, 22 nt, Human
caaauaaaaacuaaauuguaaa

SEQ ID NO: 3603797 - RNA, 16 nt, Human
caaauaaaaauauugu

SEQ ID NO: 3603798 - RNA, 17 nt, Human
caaauaaaauucccuaa

SEQ ID NO: 3603799 - RNA, 20 nt, Human
caaauaaacacuguguaagc

SEQ ID NO: 3603800 - RNA, 17 nt, Human
caaauaaacucuaaaca

SEQ ID NO: 3603801 - RNA, 13 nt, Human
caaauaacaacuu

SEQ ID NO: 3603802 - RNA, 22 nt, Human
caaauaaccaacccuucccuga

SEQ ID NO: 3603803 - RNA, 16 nt, Human
caaauaacuucagucc

SEQ ID NO: 3603804 - RNA, 23 nt, Human
caaauaacuucaguccugcucca

SEQ ID NO: 3603805 - RNA, 17 nt, Human
caaauaaguguauuuug

SEQ ID NO: 3603806 - RNA, 22 nt, Human
caaauaaugaucgaaaaaauaa

SEQ ID NO: 3603807 - RNA, 13 nt, Human
caaauaaugucuc

SEQ ID NO: 3603808 - RNA, 20 nt, Human
caaauaauuuuucacuucaa

SEQ ID NO: 3603809 - RNA, 16 nt, Human
caaauacuaaaaagaa

SEQ ID NO: 3603810 - RNA, 16 nt, Human
caaauacuaaugaaaa

SEQ ID NO: 3603811 - RNA, 17 nt, Human
caaauacuaaugaaaac

SEQ ID NO: 3603812 - RNA, 15 nt, Human
caaauacucaugugu

SEQ ID NO: 3603813 - RNA, 18 nt, Human
caaauacucauguguaug

SEQ ID NO: 3603814 - RNA, 18 nt, Human
caaauacugaaauauuag

SEQ ID NO: 3603815 - RNA, 18 nt, Human
caaauacuguauauucag

SEQ ID NO: 3603816 - RNA, 19 nt, Human
caaauacuuagcaaaaagu

SEQ ID NO: 3603817 - RNA, 22 nt, Human
caaauacuuagcaaaaaguggg

SEQ ID NO: 3603818 - RNA, 16 nt, Human
caaauacuuuaaagga

SEQ ID NO: 3603819 - RNA, 12 nt, Human
caaauagaaaac

SEQ ID NO: 3603820 - RNA, 14 nt, Human
caaauagaaaacag

SEQ ID NO: 3603821 - RNA, 13 nt, Human
caaauauaaacau

SEQ ID NO: 3603822 - RNA, 19 nt, Human
caaauauagcguucccaac

SEQ ID NO: 3603823 - RNA, 17 nt, Human
caaauauauucucuuug

SEQ ID NO: 3603824 - RNA, 13 nt, Human
caaauauauuguu

SEQ ID NO: 3603825 - RNA, 16 nt, Human
caaauaucucuauuua

SEQ ID NO: 3603826 - RNA, 21 nt, Human
caaauaugaguacaaaugccu

SEQ ID NO: 3603827 - RNA, 14 nt, Human
caaauaugcaaagc

SEQ ID NO: 3603828 - RNA, 21 nt, Human
caaauaugcaaagcacugacu

SEQ ID NO: 3603829 - RNA, 13 nt, Human
caaauauguccug

SEQ ID NO: 3603830 - RNA, 19 nt, Human
caaauauuaaaaagucuuu

SEQ ID NO: 3603831 - RNA, 17 nt, Human
caaauauuagaugugau

SEQ ID NO: 3603832 - RNA, 20 nt, Human
caaauauuagaugugauuua

SEQ ID NO: 3603833 - RNA, 12 nt, Human
caaauauuauuu

SEQ ID NO: 3603834 - RNA, 13 nt, Human
caaauauuguuaa

SEQ ID NO: 3603835 - RNA, 22 nt, Human
caaauauuguugacaacuguga

SEQ ID NO: 3603836 - RNA, 15 nt, Human
caaauauuuauuuuc

SEQ ID NO: 3603837 - RNA, 20 nt, Human
caaauauuuauuuucuuucu

SEQ ID NO: 3603838 - RNA, 15 nt, Human
caaauauuuuuuugu

SEQ ID NO: 3603839 - RNA, 17 nt, Human
caaauauuuuuuuguag

SEQ ID NO: 3603840 - RNA, 18 nt, Human
caaaucaaaaucucucca

SEQ ID NO: 3603841 - RNA, 15 nt, Human
caaaucaagcuucag

SEQ ID NO: 3603842 - RNA, 24 nt, Human
caaaucaaguuuccaagcaaaugu

SEQ ID NO: 3603843 - RNA, 17 nt, Human
caaaucaauaagaaggu

SEQ ID NO: 3603844 - RNA, 17 nt, Human
caaaucaauacacuagu

SEQ ID NO: 3603845 - RNA, 19 nt, Human
caaaucaauucuagucaua

SEQ ID NO: 3603846 - RNA, 15 nt, Human
caaaucacauauuuu

SEQ ID NO: 3603847 - RNA, 18 nt, Human
caaaucacauauuuuaaa

SEQ ID NO: 3603848 - RNA, 19 nt, Human
caaaucaccacaaacugua

SEQ ID NO: 3603849 - RNA, 14 nt, Human
caaaucagaaguca

SEQ ID NO: 3603850 - RNA, 15 nt, Human
caaaucagaagucau

SEQ ID NO: 3603851 - RNA, 13 nt, Human
caaaucagucagu

SEQ ID NO: 3603852 - RNA, 13 nt, Human
caaaucauuuguu

SEQ ID NO: 3603853 - RNA, 16 nt, Human
caaaucauuuguuuaa

SEQ ID NO: 3603854 - RNA, 17 nt, Human
caaaucauuuguuuaaa

SEQ ID NO: 3603855 - RNA, 17 nt, Human
caaauccaggacccugc

SEQ ID NO: 3603856 - RNA, 21 nt, Human
caaauccgaaccuccucugug

SEQ ID NO: 3603857 - RNA, 21 nt, Human
caaauccgcucucuuccugcc

SEQ ID NO: 3603858 - RNA, 22 nt, Human
caaauccuaugugauuuuaacu

SEQ ID NO: 3603859 - RNA, 17 nt, Human
caaauccuuagaucugg

SEQ ID NO: 3603860 - RNA, 20 nt, Human
caaauccuuccaaaaauuau

SEQ ID NO: 3603861 - RNA, 20 nt, Human
caaauccuugugggaaaaga

SEQ ID NO: 3603862 - RNA, 16 nt, Human
auccuccucagaucuu

SEQ ID NO: 3603863 - RNA, 15 nt, Human
auccuccuccagggu

SEQ ID NO: 3603864 - RNA, 11 nt, Human
auccuccuccc

SEQ ID NO: 3603865 - RNA, 13 nt, Human
auccuccuccuuc

SEQ ID NO: 3603866 - RNA, 12 nt, Human
auccuccuggaa

SEQ ID NO: 3603867 - RNA, 23 nt, Human
auccuccuggaaccuugcugucc

SEQ ID NO: 3603868 - RNA, 14 nt, Human
auccucuccuuuga

SEQ ID NO: 3603869 - RNA, 19 nt, Human
auccucucuggggcugugu

SEQ ID NO: 3603870 - RNA, 16 nt, Human
auccucucuuccucuu

SEQ ID NO: 3603871 - RNA, 17 nt, Human
auccucuggagccagcc

SEQ ID NO: 3603872 - RNA, 17 nt, Human
auccucuguacagagcc

SEQ ID NO: 3603873 - RNA, 18 nt, Human
auccucuguacagagccc

SEQ ID NO: 3603874 - RNA, 13 nt, Human
auccucuuccucu

SEQ ID NO: 3603875 - RNA, 14 nt, Human
auccucuuccucug

SEQ ID NO: 3603876 - RNA, 22 nt, Human
auccucuucugcuuaggagaga

SEQ ID NO: 3603877 - RNA, 23 nt, Human
auccucuuuagaguuagacuguu

SEQ ID NO: 3603878 - RNA, 17 nt, Human
auccucuuugagugaag

SEQ ID NO: 3603879 - RNA, 14 nt, Human
auccucuuuuucca

SEQ ID NO: 3603880 - RNA, 14 nt, Human
auccugaaauuuca

SEQ ID NO: 3603881 - RNA, 17 nt, Human
auccugaaauuucagau

SEQ ID NO: 3603882 - RNA, 20 nt, Human
caaggaagggauguauuugu

SEQ ID NO: 3603883 - RNA, 12 nt, Human
caaggaagucaa

SEQ ID NO: 3603884 - RNA, 15 nt, Human
caaggaauuucuuaa

SEQ ID NO: 3603885 - RNA, 23 nt, Human
caaggaauuucuuaacuucuugc

SEQ ID NO: 3603886 - RNA, 18 nt, Human
caaggaccaacaagggca

SEQ ID NO: 3603887 - RNA, 21 nt, Human
caaggaccaacaagggcagug

SEQ ID NO: 3603888 - RNA, 15 nt, Human
caaggaccaggacuc

SEQ ID NO: 3603889 - RNA, 14 nt, Human
caaggaccccucac

SEQ ID NO: 3603890 - RNA, 21 nt, Human
caaggacuacguuaagggaag

SEQ ID NO: 3603891 - RNA, 14 nt, Human
caaggacuaggguc

SEQ ID NO: 3603892 - RNA, 18 nt, Human
caaggacuaggguccugg

SEQ ID NO: 3603893 - RNA, 15 nt, Human
caaggacugagggac

SEQ ID NO: 3603894 - RNA, 22 nt, Human
caaggacugagggacucugaag

SEQ ID NO: 3603895 - RNA, 15 nt, Human
caaggacugcaggga

SEQ ID NO: 3603896 - RNA, 22 nt, Human
caaggacugcagggacugccag

SEQ ID NO: 3603897 - RNA, 23 nt, Human
caaggacuuccuguccagcucca

SEQ ID NO: 3603898 - RNA, 16 nt, Human
caaggacuugaaagca

SEQ ID NO: 3603899 - RNA, 18 nt, Human
caaggagaaacagagaca

SEQ ID NO: 3603900 - RNA, 20 nt, Human
caaggagaaacagagacagg

SEQ ID NO: 3603901 - RNA, 13 nt, Human
caaggagaacaaa

SEQ ID NO: 3603902 - RNA, 14 nt, Human
caaggagaggaggc

SEQ ID NO: 3603903 - RNA, 18 nt, Human
caaggagaggaggcaacu

SEQ ID NO: 3603904 - RNA, 16 nt, Human
caaggagauuuacaac

SEQ ID NO: 3603905 - RNA, 17 nt, Human
caaggagcacagguccc

SEQ ID NO: 3603906 - RNA, 22 nt, Human
caaggagcacaggucccaccuc

SEQ ID NO: 3603907 - RNA, 23 nt, Human
caaggagcugagaauagaaggaa

SEQ ID NO: 3603908 - RNA, 11 nt, Human
caaggagcugc

SEQ ID NO: 3603909 - RNA, 12 nt, Human
caaggaggaaaa

SEQ ID NO: 3603910 - RNA, 18 nt, Human
caaggaggggcuguaaaa

SEQ ID NO: 3603911 - RNA, 18 nt, Human
caaggaguaugcagggag

SEQ ID NO: 3603912 - RNA, 16 nt, Human
caaggagucacugaga

SEQ ID NO: 3603913 - RNA, 21 nt, Human
caaggaguuccaugaagacca

SEQ ID NO: 3603914 - RNA, 22 nt, Human
caaggauagaugcuggcccagg

SEQ ID NO: 3603915 - RNA, 18 nt, Human
caaggauccugagccaga

SEQ ID NO: 3603916 - RNA, 14 nt, Human
caaggaucuuucac

SEQ ID NO: 3603917 - RNA, 21 nt, Human
caaggaugaucuaggaagacu

SEQ ID NO: 3603918 - RNA, 14 nt, Human
caaggcaaaaacaa

SEQ ID NO: 3603919 - RNA, 13 nt, Human
caaggcaaauguu

SEQ ID NO: 3603920 - RNA, 15 nt, Human
caaggcaaggcaggu

SEQ ID NO: 3603921 - RNA, 16 nt, Human
caaggcaaggcuguca

SEQ ID NO: 3603922 - RNA, 18 nt, Human
caaggcaaggcugucaau

SEQ ID NO: 3603923 - RNA, 18 nt, Human
caaggcaaggggugccug

SEQ ID NO: 3603924 - RNA, 21 nt, Human
caaggcaaggggugccuggga

SEQ ID NO: 3603925 - RNA, 14 nt, Human
caaggcacucuaga

SEQ ID NO: 3603926 - RNA, 15 nt, Human
caaggcacugccuga

SEQ ID NO: 3603927 - RNA, 15 nt, Human
caaggcacuguacua

SEQ ID NO: 3603928 - RNA, 14 nt, Human
caaggcagcaaggc

SEQ ID NO: 3603929 - RNA, 15 nt, Human
caaggcagcaaggcc

SEQ ID NO: 3603930 - RNA, 16 nt, Human
caaggcagcaaggccc

SEQ ID NO: 3603931 - RNA, 19 nt, Human
caaggcagcaaggcccgag

SEQ ID NO: 3603932 - RNA, 14 nt, Human
caaggcaggugccu

SEQ ID NO: 3603933 - RNA, 22 nt, Human
caaggcaggugccuccaggugu

SEQ ID NO: 3603934 - RNA, 19 nt, Human
caaggccaccucuuccugg

SEQ ID NO: 3603935 - RNA, 22 nt, Human
caaggccaccucuuccuggccg

SEQ ID NO: 3603936 - RNA, 14 nt, Human
caaggccagagugg

SEQ ID NO: 3603937 - RNA, 18 nt, Human
caaggccagaguggccug

SEQ ID NO: 3603938 - RNA, 20 nt, Human
caaggccagaguggccuggc

SEQ ID NO: 3603939 - RNA, 21 nt, Human
caaggccagcaagguggagug

SEQ ID NO: 3603940 - RNA, 23 nt, Human
caaggccagcaagguggagugga

SEQ ID NO: 3603941 - RNA, 17 nt, Human
caaggccauccuucccu

SEQ ID NO: 3603942 - RNA, 15 nt, Human
caaggccccagagac

SEQ ID NO: 3603943 - RNA, 17 nt, Human
caaggcccccugccugc

SEQ ID NO: 3603944 - RNA, 14 nt, Human
caaggccccugaca

SEQ ID NO: 3603945 - RNA, 12 nt, Human
caaggcccugcu

SEQ ID NO: 3603946 - RNA, 14 nt, Human
caaggcccugcugc

SEQ ID NO: 3603947 - RNA, 16 nt, Human
caaggcccugcugccc

SEQ ID NO: 3603948 - RNA, 23 nt, Human
caaggccgaagcucuggcugaac

SEQ ID NO: 3603949 - RNA, 17 nt, Human
caaggccucccacagug

SEQ ID NO: 3603950 - RNA, 21 nt, Human
caaggccugucagcuaaagaa

SEQ ID NO: 3603951 - RNA, 14 nt, Human
caaggccugucccu

SEQ ID NO: 3603952 - RNA, 14 nt, Human
caaggccuucuccu

SEQ ID NO: 3603953 - RNA, 18 nt, Human
caaggccuuucugugugu

SEQ ID NO: 3603954 - RNA, 22 nt, Human
caaggcgguggacuugaacuuu

SEQ ID NO: 3603955 - RNA, 18 nt, Human
caaggcugaccaagagag

SEQ ID NO: 3603956 - RNA, 22 nt, Human
caaggcugagacagugaauuug

SEQ ID NO: 3603957 - RNA, 12 nt, Human
caaggcugcagu

SEQ ID NO: 3603958 - RNA, 17 nt, Human
caaggcugcgucuggag

SEQ ID NO: 3603959 - RNA, 18 nt, Human
caaggcugcgucuggagg

SEQ ID NO: 3603960 - RNA, 21 nt, Human
caaggcugggggaagaagcuc

SEQ ID NO: 3603961 - RNA, 13 nt, Human
caaggcugucaau

SEQ ID NO: 3603962 - RNA, 14 nt, Human
caaggcugucaauu

SEQ ID NO: 3603963 - RNA, 23 nt, Human
caaggcugucaauuacaggaagu

SEQ ID NO: 3603964 - RNA, 20 nt, Human
caaggcuguggaccauggag

SEQ ID NO: 3603965 - RNA, 14 nt, Human
caaggcuuagaccc

SEQ ID NO: 3603966 - RNA, 16 nt, Human
caaggcuugcugcaga

SEQ ID NO: 3603967 - RNA, 20 nt, Human
caagggaaaauaaaaaaaga

SEQ ID NO: 3603968 - RNA, 21 nt, Human
caagggaaaauaaaaaaagaa

SEQ ID NO: 3603969 - RNA, 23 nt, Human
caagggaaaauaaaaaaagaaaa

SEQ ID NO: 3603970 - RNA, 14 nt, Human
caagggaaggacag

SEQ ID NO: 3603971 - RNA, 23 nt, Human
caagggaauuucuucaacucccu

SEQ ID NO: 3603972 - RNA, 17 nt, Human
caagggagagaccucau

SEQ ID NO: 3603973 - RNA, 16 nt, Human
caagggaggcugcugc

SEQ ID NO: 3603974 - RNA, 18 nt, Human
caagggagguaagggagg

SEQ ID NO: 3603975 - RNA, 20 nt, Human
caagggaucugguccuaccc

SEQ ID NO: 3603976 - RNA, 19 nt, Human
caagggcaaaauucccagg

SEQ ID NO: 3603977 - RNA, 20 nt, Human
caagggcagaacacuaaccu

SEQ ID NO: 3603978 - RNA, 11 nt, Human
caagggcagcu

SEQ ID NO: 3603979 - RNA, 14 nt, Human
caagggcagcuuug

SEQ ID NO: 3603980 - RNA, 17 nt, Human
caagggcaugagcauug

SEQ ID NO: 3603981 - RNA, 14 nt, Human
caagggccaugcug

SEQ ID NO: 3603982 - RNA, 21 nt, Human
caagggccaugcugaagggac

SEQ ID NO: 3603983 - RNA, 14 nt, Human
caagggccuggccu

SEQ ID NO: 3603984 - RNA, 16 nt, Human
caagggccuggccuga

SEQ ID NO: 3603985 - RNA, 16 nt, Human
caagggcggccuuucc

SEQ ID NO: 3603986 - RNA, 19 nt, Human
caagggcugcuucaaacuc

SEQ ID NO: 3603987 - RNA, 14 nt, Human
caagggcuguaggu

SEQ ID NO: 3603988 - RNA, 17 nt, Human
caagggcugucauugca

SEQ ID NO: 3603989 - RNA, 22 nt, Human
caagggcuuacacguggaggaa

SEQ ID NO: 3603990 - RNA, 21 nt, Human
caagggcuuuccugugccagg

SEQ ID NO: 3603991 - RNA, 22 nt, Human
caaggggaaucuggagguagcc

SEQ ID NO: 3603992 - RNA, 21 nt, Human
caaggggaauguuugccucug

SEQ ID NO: 3603993 - RNA, 21 nt, Human
caaggggauuuuuaugucugg

SEQ ID NO: 3603994 - RNA, 17 nt, Human
caaggggccauuuggca

SEQ ID NO: 3603995 - RNA, 15 nt, Human
caaggggccugagca

SEQ ID NO: 3603996 - RNA, 18 nt, Human
caaggggugccugggaac

SEQ ID NO: 3603997 - RNA, 15 nt, Human
caagggucaggccuu

SEQ ID NO: 3603998 - RNA, 17 nt, Human
caagggucuagggagag

SEQ ID NO: 3603999 - RNA, 14 nt, Human
caagguaaggaggg

SEQ ID NO: 3604000 - RNA, 15 nt, Human
caagguagccauccc

SEQ ID NO: 3604001 - RNA, 9 nt, Human
caagguaua

SEQ ID NO: 3604002 - RNA, 17 nt, Human
caagguauaauaaaauu

SEQ ID NO: 3604003 - RNA, 19 nt, Human
caaggucauggccacacug

SEQ ID NO: 3604004 - RNA, 14 nt, Human
caaggucauuuuuu

SEQ ID NO: 3604005 - RNA, 19 nt, Human
caaggucguuuuuuucauu

SEQ ID NO: 3604006 - RNA, 15 nt, Human
caaggucugagccac

SEQ ID NO: 3604007 - RNA, 13 nt, Human
caaggucuggccu

SEQ ID NO: 3604008 - RNA, 15 nt, Human
caaggugcaaaucaa

SEQ ID NO: 3604009 - RNA, 17 nt, Human
caaggugcaggcaggcu

SEQ ID NO: 3604010 - RNA, 19 nt, Human
caagguggccaaauuauuu

SEQ ID NO: 3604011 - RNA, 19 nt, Human
caagguggcuccagcacca

SEQ ID NO: 3604012 - RNA, 21 nt, Human
caaggugggcagggaggcacc

SEQ ID NO: 3604013 - RNA, 24 nt, Human
caaggugggcugagcccuggcagg

SEQ ID NO: 3604014 - RNA, 17 nt, Human
caagguggucaguaaau

SEQ ID NO: 3604015 - RNA, 13 nt, Human
caagguguccuac

SEQ ID NO: 3604016 - RNA, 15 nt, Human
caagguguccuacag

SEQ ID NO: 3604017 - RNA, 21 nt, Human
caagguguccuacagaaaaac

SEQ ID NO: 3604018 - RNA, 20 nt, Human
caagguuacuuaauucaacu

SEQ ID NO: 3604019 - RNA, 21 nt, Human
caagguuacuuaauucaacuu

SEQ ID NO: 3604020 - RNA, 17 nt, Human
caagguuauaauuuuuu

SEQ ID NO: 3604021 - RNA, 17 nt, Human
caagguuccacagagua

SEQ ID NO: 3604022 - RNA, 17 nt, Human
caagguucccucugaga

SEQ ID NO: 3604023 - RNA, 13 nt, Human
caacaagauuucc

SEQ ID NO: 3604024 - RNA, 15 nt, Human
caacaagggagagac

SEQ ID NO: 3604025 - RNA, 21 nt, Human
caacaagggagagaccucauc

SEQ ID NO: 3604026 - RNA, 20 nt, Human
caacaagguggugugaucuu

SEQ ID NO: 3604027 - RNA, 22 nt, Human
caacaauacaugcugcuaauuc

SEQ ID NO: 3604028 - RNA, 15 nt, Human
caacaauccuagugc

SEQ ID NO: 3604029 - RNA, 14 nt, Human
caacaauucagcau

SEQ ID NO: 3604030 - RNA, 13 nt, Human
caacaauucuaaa

SEQ ID NO: 3604031 - RNA, 14 nt, Human
caacaauuuaugaa

SEQ ID NO: 3604032 - RNA, 18 nt, Human
caacaauuuaugaauuga

SEQ ID NO: 3604033 - RNA, 13 nt, Human
caacaauuucuac

SEQ ID NO: 3604034 - RNA, 18 nt, Human
caacaauuuucagauuug

SEQ ID NO: 3604035 - RNA, 19 nt, Human
caacaauuuucagauuugc

SEQ ID NO: 3604036 - RNA, 15 nt, Human
caacacaaagagaaa

SEQ ID NO: 3604037 - RNA, 20 nt, Human
caacacaagcuggaagcaca

SEQ ID NO: 3604038 - RNA, 16 nt, Human
caacacaaggugggca

SEQ ID NO: 3604039 - RNA, 14 nt, Human
caacacagaggaau

SEQ ID NO: 3604040 - RNA, 17 nt, Human
caacaccaaaaaauauc

SEQ ID NO: 3604041 - RNA, 13 nt, Human
caacaccagcccc

SEQ ID NO: 3604042 - RNA, 22 nt, Human
caacaccaugauuccuuuaaca

SEQ ID NO: 3604043 - RNA, 16 nt, Human
caacacccaucuguuu

SEQ ID NO: 3604044 - RNA, 22 nt, Human
caacaccuucagaggcugaggu

SEQ ID NO: 3604045 - RNA, 23 nt, Human
caacacgagcaggcuacugucag

SEQ ID NO: 3604046 - RNA, 17 nt, Human
caacacgcaccugccuc

SEQ ID NO: 3604047 - RNA, 15 nt, Human
caacacgcaggagca

SEQ ID NO: 3604048 - RNA, 20 nt, Human
caacacgcauggucaacccu

SEQ ID NO: 3604049 - RNA, 14 nt, Human
caacacuaacauga

SEQ ID NO: 3604050 - RNA, 20 nt, Human
caacacucauugaccugagg

SEQ ID NO: 3604051 - RNA, 12 nt, Human
caacacugccag

SEQ ID NO: 3604052 - RNA, 18 nt, Human
caacacuggugugaccug

SEQ ID NO: 3604053 - RNA, 21 nt, Human
caacacugugggugugugacu

SEQ ID NO: 3604054 - RNA, 24 nt, Human
caacacuuccagcauuuagcuggc

SEQ ID NO: 3604055 - RNA, 22 nt, Human
caacagaaaccuauccucacug

SEQ ID NO: 3604056 - RNA, 17 nt, Human
caacagaagcauuugua

SEQ ID NO: 3604057 - RNA, 18 nt, Human
caacagaagcauuuguau

SEQ ID NO: 3604058 - RNA, 23 nt, Human
caacagaagcauuuguauuuugu

SEQ ID NO: 3604059 - RNA, 20 nt, Human
caacagaagucaugaagccc

SEQ ID NO: 3604060 - RNA, 23 nt, Human
caacagaagucaugaagcccaag

SEQ ID NO: 3604061 - RNA, 12 nt, Human
caacagaagugg

SEQ ID NO: 3604062 - RNA, 17 nt, Human
caacagaaugaaaaaug

SEQ ID NO: 3604063 - RNA, 18 nt, Human
caacagagaaggcaggaa

SEQ ID NO: 3604064 - RNA, 17 nt, Human
caacagauacuggaagu

SEQ ID NO: 3604065 - RNA, 14 nt, Human
caacagaucaguaa

SEQ ID NO: 3604066 - RNA, 14 nt, Human
caacagaucuggaa

SEQ ID NO: 3604067 - RNA, 17 nt, Human
caacagaucuggaaccu

SEQ ID NO: 3604068 - RNA, 23 nt, Human
caacagaugcuuuucugucucug

SEQ ID NO: 3604069 - RNA, 19 nt, Human
caacagauuugugaacuca

SEQ ID NO: 3604070 - RNA, 20 nt, Human
caacagauuugugaacucag

SEQ ID NO: 3604071 - RNA, 15 nt, Human
caacagcaaacaggu

SEQ ID NO: 3604072 - RNA, 14 nt, Human
caacagccucacuu

SEQ ID NO: 3604073 - RNA, 21 nt, Human
caacagcuacaacagccucac

SEQ ID NO: 3604074 - RNA, 15 nt, Human
caacagcucaagucu

SEQ ID NO: 3604075 - RNA, 23 nt, Human
caacagcuccccauuacccucag

SEQ ID NO: 3604076 - RNA, 14 nt, Human
caacagcugaagca

SEQ ID NO: 3604077 - RNA, 23 nt, Human
caacaggaaucaagagcugcccu

SEQ ID NO: 3604078 - RNA, 21 nt, Human
caacaggagcugggauccuaa

SEQ ID NO: 3604079 - RNA, 22 nt, Human
caacaggagcugggauccuaag

SEQ ID NO: 3604080 - RNA, 14 nt, Human
caacaggaggacaa

SEQ ID NO: 3604081 - RNA, 17 nt, Human
caacaggaggacaauuc

SEQ ID NO: 3604082 - RNA, 21 nt, Human
caacaggccauugugaaccaa

SEQ ID NO: 3604083 - RNA, 16 nt, Human
caacaggccucagggc

SEQ ID NO: 3604084 - RNA, 20 nt, Human
caacaggcugggcuucagug

SEQ ID NO: 3604085 - RNA, 23 nt, Human
caacaggcugggcuucaguggca

SEQ ID NO: 3604086 - RNA, 24 nt, Human
caacaggcugggcuucaguggcag

SEQ ID NO: 3604087 - RNA, 19 nt, Human
caacaggcuguucugcacu

SEQ ID NO: 3604088 - RNA, 21 nt, Human
caacaggcuguucugcacuga

SEQ ID NO: 3604089 - RNA, 23 nt, Human
caacagguaaaacagggccacau

SEQ ID NO: 3604090 - RNA, 18 nt, Human
caacagguggcaggacca

SEQ ID NO: 3604091 - RNA, 21 nt, Human
caacagguggcaggaccagga

SEQ ID NO: 3604092 - RNA, 15 nt, Human
caacagguuuuccug

SEQ ID NO: 3604093 - RNA, 12 nt, Human
caacagucaugu

SEQ ID NO: 3604094 - RNA, 14 nt, Human
caacagucauguuu

SEQ ID NO: 3604095 - RNA, 16 nt, Human
caacagucauguuuua

SEQ ID NO: 3604096 - RNA, 11 nt, Human
caacagugagu

SEQ ID NO: 3604097 - RNA, 12 nt, Human
caacagugcuaa

SEQ ID NO: 3604098 - RNA, 16 nt, Human
caacagugcuaaaaau

SEQ ID NO: 3604099 - RNA, 17 nt, Human
caacagugcuaaaaaug

SEQ ID NO: 3604100 - RNA, 21 nt, Human
caacagugugaaguuagaauu

SEQ ID NO: 3604101 - RNA, 23 nt, Human
caacaguguuaggccuggcacag

SEQ ID NO: 3604102 - RNA, 22 nt, Human
caacaguuuuuuaugcuaauca

SEQ ID NO: 3604103 - RNA, 17 nt, Human
caacauaacccacuugu

SEQ ID NO: 3604104 - RNA, 18 nt, Human
caacauaacccacuuguc

SEQ ID NO: 3604105 - RNA, 16 nt, Human
caacauaaucuaguuu

SEQ ID NO: 3604106 - RNA, 14 nt, Human
caacauacucccau

SEQ ID NO: 3604107 - RNA, 20 nt, Human
caacauacucccaucuguga

SEQ ID NO: 3604108 - RNA, 17 nt, Human
caacaucaauguucauu

SEQ ID NO: 3604109 - RNA, 14 nt, Human
caacauccacucuc

SEQ ID NO: 3604110 - RNA, 15 nt, Human
caacaucccauugcc

SEQ ID NO: 3604111 - RNA, 18 nt, Human
caacaucccauugcccug

SEQ ID NO: 3604112 - RNA, 19 nt, Human
caacaucccauugcccugg

SEQ ID NO: 3604113 - RNA, 16 nt, Human
caacauccugccagcc

SEQ ID NO: 3604114 - RNA, 15 nt, Human
caacaugaugaggua

SEQ ID NO: 3604115 - RNA, 23 nt, Human
caacaugccugccccaaacaaau

SEQ ID NO: 3604116 - RNA, 13 nt, Human
caacauggagaaa

SEQ ID NO: 3604117 - RNA, 22 nt, Human
caacauggagaaacccugucuc

SEQ ID NO: 3604118 - RNA, 21 nt, Human
caacauggcuacuugcuuuga

SEQ ID NO: 3604119 - RNA, 18 nt, Human
caacauggugaaaccccg

SEQ ID NO: 3604120 - RNA, 20 nt, Human
caacauguuacugaccagca

SEQ ID NO: 3604121 - RNA, 22 nt, Human
caacauguuauuuguaauagau

SEQ ID NO: 3604122 - RNA, 23 nt, Human
caacauguuauuuguaauagaug

SEQ ID NO: 3604123 - RNA, 20 nt, Human
caacauguuuccagcauucc

SEQ ID NO: 3604124 - RNA, 15 nt, Human
caacauugccuauuu

SEQ ID NO: 3604125 - RNA, 16 nt, Human
caacauugugauguau

SEQ ID NO: 3604126 - RNA, 23 nt, Human
caacauuuacaguccuucaaaau

SEQ ID NO: 3604127 - RNA, 16 nt, Human
caacauuucaaaauga

SEQ ID NO: 3604128 - RNA, 16 nt, Human
caaccaauguagaaag

SEQ ID NO: 3604129 - RNA, 20 nt, Human
caaccacacaccucaccaga

SEQ ID NO: 3604130 - RNA, 19 nt, Human
caaccaccgcuccccagcc

SEQ ID NO: 3604131 - RNA, 21 nt, Human
caaccaccgcuccccagccca

SEQ ID NO: 3604132 - RNA, 23 nt, Human
caaccacuggucuguagggauuu

SEQ ID NO: 3604133 - RNA, 14 nt, Human
caaccacuguaaaa

SEQ ID NO: 3604134 - RNA, 13 nt, Human
caaccagacagag

SEQ ID NO: 3604135 - RNA, 13 nt, Human
caaccagagcacu

SEQ ID NO: 3604136 - RNA, 18 nt, Human
caaccaggcuccugugau

SEQ ID NO: 3604137 - RNA, 19 nt, Human
caaccagggagcugcaggg

SEQ ID NO: 3604138 - RNA, 17 nt, Human
caaccagugccaaggac

SEQ ID NO: 3604139 - RNA, 19 nt, Human
caaccagugccaaggaccu

SEQ ID NO: 3604140 - RNA, 22 nt, Human
caaccauauggauauuagucau

SEQ ID NO: 3604141 - RNA, 12 nt, Human
caaccauauuua

SEQ ID NO: 3604142 - RNA, 15 nt, Human
caaccauauuuagca

SEQ ID NO: 3604143 - RNA, 18 nt, Human
caaccaugagaccacugu

SEQ ID NO: 3604144 - RNA, 13 nt, Human
caaccauggacuu

SEQ ID NO: 3604145 - RNA, 14 nt, Human
caaccauggacuuu

SEQ ID NO: 3604146 - RNA, 14 nt, Human
caaccauuaaaguc

SEQ ID NO: 3604147 - RNA, 18 nt, Human
caaccauuauaaccuuaa

SEQ ID NO: 3604148 - RNA, 17 nt, Human
caaccauuuccucagac

SEQ ID NO: 3604149 - RNA, 18 nt, Human
caacccaaaccuggagau

SEQ ID NO: 3604150 - RNA, 19 nt, Human
caacccaaauguucaucaa

SEQ ID NO: 3604151 - RNA, 18 nt, Human
caacccaaccucauccuc

SEQ ID NO: 3604152 - RNA, 15 nt, Human
caacccaaggacuga

SEQ ID NO: 3604153 - RNA, 15 nt, Human
caacccauuagccau

SEQ ID NO: 3604154 - RNA, 14 nt, Human
caaccccagccgcu

SEQ ID NO: 3604155 - RNA, 13 nt, Human
caaccccaguucu

SEQ ID NO: 3604156 - RNA, 17 nt, Human
caaccccaguucugcuc

SEQ ID NO: 3604157 - RNA, 13 nt, Human
caacccccacccc

SEQ ID NO: 3604158 - RNA, 23 nt, Human
caacccccaccccacacuuguuc

SEQ ID NO: 3604159 - RNA, 14 nt, Human
caacccccagcucc

SEQ ID NO: 3604160 - RNA, 21 nt, Human
caacccccauucucaucugca

SEQ ID NO: 3604161 - RNA, 18 nt, Human
caaccccccagcacugag

SEQ ID NO: 3604162 - RNA, 20 nt, Human
caaccccccagcacugagga

SEQ ID NO: 3604163 - RNA, 15 nt, Human
caaccccucgcccag

SEQ ID NO: 3604164 - RNA, 22 nt, Human
caaccccucgcccagucccagc

SEQ ID NO: 3604165 - RNA, 10 nt, Human
caaccccuga

SEQ ID NO: 3604166 - RNA, 16 nt, Human
caaccccugaggaaga

SEQ ID NO: 3604167 - RNA, 18 nt, Human
caaccccuggaccccagc

SEQ ID NO: 3604168 - RNA, 14 nt, Human
caaccccuguggag

SEQ ID NO: 3604169 - RNA, 16 nt, Human
caaccccuguggagcc

SEQ ID NO: 3604170 - RNA, 14 nt, Human
caaccccuucgcuc

SEQ ID NO: 3604171 - RNA, 24 nt, Human
augggagcuccucuccuggaggau

SEQ ID NO: 3604172 - RNA, 23 nt, Human
augggagcugaggccacacucag

SEQ ID NO: 3604173 - RNA, 21 nt, Human
augggagcugguuagaaaugc

SEQ ID NO: 3604174 - RNA, 22 nt, Human
augggagcugguuagaaaugca

SEQ ID NO: 3604175 - RNA, 22 nt, Human
augggagcugucaagcauguau

SEQ ID NO: 3604176 - RNA, 13 nt, Human
augggaggaaaga

SEQ ID NO: 3604177 - RNA, 13 nt, Human
augggagggagcu

SEQ ID NO: 3604178 - RNA, 21 nt, Human
augggagggauggcccuuccu

SEQ ID NO: 3604179 - RNA, 17 nt, Human
augggaggggaaauggg

SEQ ID NO: 3604180 - RNA, 22 nt, Human
augggagggggcuugaagccaa

SEQ ID NO: 3604181 - RNA, 16 nt, Human
augggauaaaugccau

SEQ ID NO: 3604182 - RNA, 14 nt, Human
augggaugagaaaa

SEQ ID NO: 3604183 - RNA, 17 nt, Human
augggaugauugaagaa

SEQ ID NO: 3604184 - RNA, 19 nt, Human
augggaugauugaagaaac

SEQ ID NO: 3604185 - RNA, 12 nt, Human
agguugcaggga

SEQ ID NO: 3604186 - RNA, 18 nt, Human
agguugcagggagccgag

SEQ ID NO: 3604187 - RNA, 18 nt, Human
agguugcagugagccaag

SEQ ID NO: 3604188 - RNA, 16 nt, Human
agguugcagugagcug

SEQ ID NO: 3604189 - RNA, 20 nt, Human
agguugcauugagcugagau

SEQ ID NO: 3604190 - RNA, 17 nt, Human
agguugcugguugcugu

SEQ ID NO: 3604191 - RNA, 16 nt, Human
agguugcuguuucaca

SEQ ID NO: 3604192 - RNA, 18 nt, Human
agguuggaagcuagcucc

SEQ ID NO: 3604193 - RNA, 19 nt, Human
agguuggaagcuagcuccc

SEQ ID NO: 3604194 - RNA, 16 nt, Human
agguuggaccccagag

SEQ ID NO: 3604195 - RNA, 17 nt, Human
agguuggaccccagaga

SEQ ID NO: 3604196 - RNA, 16 nt, Human
agguuggcucugccag

SEQ ID NO: 3604197 - RNA, 18 nt, Human
agguuggcucugccaguc

SEQ ID NO: 3604198 - RNA, 22 nt, Human
agguuggcucugccaguccugu

SEQ ID NO: 3604199 - RNA, 20 nt, Human
agguugggaaugaggcuugc

SEQ ID NO: 3604200 - RNA, 20 nt, Human
agguugggccauacuggccu

SEQ ID NO: 3604201 - RNA, 21 nt, Human
agguugggccauacuggccuc

SEQ ID NO: 3604202 - RNA, 22 nt, Human
agguugggccauacuggccucg

SEQ ID NO: 3604203 - RNA, 16 nt, Human
agguugggguguacua

SEQ ID NO: 3604204 - RNA, 19 nt, Human
agguugggguguacuaguu

SEQ ID NO: 3604205 - RNA, 18 nt, Human
agguugggugcugcuaau

SEQ ID NO: 3604206 - RNA, 14 nt, Human
agguuggugaauuu

SEQ ID NO: 3604207 - RNA, 17 nt, Human
agguuguaaauguguuu

SEQ ID NO: 3604208 - RNA, 17 nt, Human
agguugucacugagaag

SEQ ID NO: 3604209 - RNA, 20 nt, Human
agguugucugaagucacugc

SEQ ID NO: 3604210 - RNA, 16 nt, Human
agguuguuccuaaaau

SEQ ID NO: 3604211 - RNA, 13 nt, Human
agguuuaaaacua

SEQ ID NO: 3604212 - RNA, 14 nt, Human
agguuuaaagaguc

SEQ ID NO: 3604213 - RNA, 20 nt, Human
agguuuaaagagucuagauu

SEQ ID NO: 3604214 - RNA, 15 nt, Human
agguuuaacauaaag

SEQ ID NO: 3604215 - RNA, 17 nt, Human
agguuuaacauaaaggu

SEQ ID NO: 3604216 - RNA, 13 nt, Human
agguuuaacucag

SEQ ID NO: 3604217 - RNA, 20 nt, Human
agguuuaacucagaucacua

SEQ ID NO: 3604218 - RNA, 20 nt, Human
agguuuaaguagauuucaug

SEQ ID NO: 3604219 - RNA, 22 nt, Human
agguuuacaauaggagugguga

SEQ ID NO: 3604220 - RNA, 19 nt, Human
agguuuacuagcaccugcc

SEQ ID NO: 3604221 - RNA, 16 nt, Human
agguuuaugaaaaaga

SEQ ID NO: 3604222 - RNA, 13 nt, Human
agguuucaaagau

SEQ ID NO: 3604223 - RNA, 14 nt, Human
agguuucaaagaug

SEQ ID NO: 3604224 - RNA, 19 nt, Human
agguuucucaaagaaauuu

SEQ ID NO: 3604225 - RNA, 15 nt, Human
agguuucugaaaauu

SEQ ID NO: 3604226 - RNA, 14 nt, Human
agguuugaguagag

SEQ ID NO: 3604227 - RNA, 14 nt, Human
agguuuggaaggag

SEQ ID NO: 3604228 - RNA, 21 nt, Human
agguuuggaugggagugagac

SEQ ID NO: 3604229 - RNA, 16 nt, Human
agguuuggcuccugcc

SEQ ID NO: 3604230 - RNA, 18 nt, Human
agguuuggcuccugccca

SEQ ID NO: 3604231 - RNA, 13 nt, Human
agguuuguauauu

SEQ ID NO: 3604232 - RNA, 16 nt, Human
agguuugucaucagau

SEQ ID NO: 3604233 - RNA, 17 nt, Human
agguuugucaucagaug

SEQ ID NO: 3604234 - RNA, 22 nt, Human
agguuugugagagcgaggcuga

SEQ ID NO: 3604235 - RNA, 15 nt, Human
agguuuguguuuucu

SEQ ID NO: 3604236 - RNA, 15 nt, Human
agguuuuaaagugau

SEQ ID NO: 3604237 - RNA, 21 nt, Human
agguuuuaaagugauuaaacg

SEQ ID NO: 3604238 - RNA, 19 nt, Human
agguuuuaagugguuugau

SEQ ID NO: 3604239 - RNA, 14 nt, Human
agguuuuaaguugu

SEQ ID NO: 3604240 - RNA, 17 nt, Human
agguuuuagguucuaaa

SEQ ID NO: 3604241 - RNA, 23 nt, Human
agguuuuagguucuaaaguucua

SEQ ID NO: 3604242 - RNA, 15 nt, Human
agguuuuaugauauu

SEQ ID NO: 3604243 - RNA, 23 nt, Human
agguuuuaugauauuuuuuuaag

SEQ ID NO: 3604244 - RNA, 10 nt, Human
agguuuucag

SEQ ID NO: 3604245 - RNA, 13 nt, Human
agguuuucuccac

SEQ ID NO: 3604246 - RNA, 14 nt, Human
agguuuucuccccc

SEQ ID NO: 3604247 - RNA, 21 nt, Human
agguuuugcacucuuguuucu

SEQ ID NO: 3604248 - RNA, 15 nt, Human
agguuuuguaaagau

SEQ ID NO: 3604249 - RNA, 18 nt, Human
agguuuuguuugcuaucu

SEQ ID NO: 3604250 - RNA, 19 nt, Human
agguuuuguuugcuaucuu

SEQ ID NO: 3604251 - RNA, 12 nt, Human
agguuuuucaau

SEQ ID NO: 3604252 - RNA, 16 nt, Human
agguuuuucaauuaaa

SEQ ID NO: 3604253 - RNA, 20 nt, Human
agguuuuucaauuaaacgga

SEQ ID NO: 3604254 - RNA, 22 nt, Human
agguuuuucaauuaaacggauu

SEQ ID NO: 3604255 - RNA, 23 nt, Human
agguuuuugauagcauuguaagc

SEQ ID NO: 3604256 - RNA, 23 nt, Human
aguaaaaacaaagaaauuaugug

SEQ ID NO: 3604257 - RNA, 19 nt, Human
aguaaaaagaaaacaaaac

SEQ ID NO: 3604258 - RNA, 20 nt, Human
aguaaaacaaacaauaccug

SEQ ID NO: 3604259 - RNA, 12 nt, Human
aguaaaagcaaa

SEQ ID NO: 3604260 - RNA, 16 nt, Human
aguaaaagcaaaaaag

SEQ ID NO: 3604261 - RNA, 22 nt, Human
aguaaaauaaauauugucuuuu

SEQ ID NO: 3604262 - RNA, 12 nt, Human
aguaaaauucag

SEQ ID NO: 3604263 - RNA, 14 nt, Human
aguaaaauugccau

SEQ ID NO: 3604264 - RNA, 20 nt, Human
aguaaaauugccauauugca

SEQ ID NO: 3604265 - RNA, 23 nt, Human
aguaaaauugccauauugcacau

SEQ ID NO: 3604266 - RNA, 17 nt, Human
aguaaaccacugaaaaa

SEQ ID NO: 3604267 - RNA, 16 nt, Human
aguaaacgggaacaug

SEQ ID NO: 3604268 - RNA, 24 nt, Human
aguaaacuccccuuucccucgcua

SEQ ID NO: 3604269 - RNA, 14 nt, Human
aguaaacugcccug

SEQ ID NO: 3604270 - RNA, 12 nt, Human
aguaaagaaauu

SEQ ID NO: 3604271 - RNA, 13 nt, Human
aguaaagaaauuu

SEQ ID NO: 3604272 - RNA, 15 nt, Human
aguaaagaauuauuu

SEQ ID NO: 3604273 - RNA, 18 nt, Human
aguaaagagaaacuuugu

SEQ ID NO: 3604274 - RNA, 23 nt, Human
aguaaagccauuaaaugaauauu

SEQ ID NO: 3604275 - RNA, 18 nt, Human
aguaaagucaaggagaaa

SEQ ID NO: 3604276 - RNA, 18 nt, Human
aguaaagugauaauuucu

SEQ ID NO: 3604277 - RNA, 18 nt, Human
aguaaaguguucugccag

SEQ ID NO: 3604278 - RNA, 15 nt, Human
aguaaaguuaaaaga

SEQ ID NO: 3604279 - RNA, 22 nt, Human
aguaaauaucccaaacugugau

SEQ ID NO: 3604280 - RNA, 18 nt, Human
aguaaauauugaggcuuu

SEQ ID NO: 3604281 - RNA, 17 nt, Human
aguaaaucagauguuga

SEQ ID NO: 3604282 - RNA, 15 nt, Human
aguaaaucucuucug

SEQ ID NO: 3604283 - RNA, 18 nt, Human
aguaaaucucuucugugu

SEQ ID NO: 3604284 - RNA, 11 nt, Human
aguaaaugcua

SEQ ID NO: 3604285 - RNA, 21 nt, Human
aguaaaugggggugcauuuga

SEQ ID NO: 3604286 - RNA, 14 nt, Human
aguaaauguaguuc

SEQ ID NO: 3604287 - RNA, 19 nt, Human
aguaaauguaguucauacu

SEQ ID NO: 3604288 - RNA, 18 nt, Human
aguaaaugucuuuguaag

SEQ ID NO: 3604289 - RNA, 20 nt, Human
aguaaaugugauucaccucu

SEQ ID NO: 3604290 - RNA, 23 nt, Human
aguaaauguuaucuuauacugua

SEQ ID NO: 3604291 - RNA, 12 nt, Human
aguaacaaaaau

SEQ ID NO: 3604292 - RNA, 15 nt, Human
aguaacaagagugau

SEQ ID NO: 3604293 - RNA, 19 nt, Human
aguaacaaugaagauaaaa

SEQ ID NO: 3604294 - RNA, 12 nt, Human
aguaacacuaau

SEQ ID NO: 3604295 - RNA, 15 nt, Human
aguaacauuugcugu

SEQ ID NO: 3604296 - RNA, 18 nt, Human
aguaacccccacuggacu

SEQ ID NO: 3604297 - RNA, 20 nt, Human
aguaacccccacuggacuga

SEQ ID NO: 3604298 - RNA, 16 nt, Human
aguaacgcgucuuccu

SEQ ID NO: 3604299 - RNA, 22 nt, Human
aguaacgcgucuuccugagugg

SEQ ID NO: 3604300 - RNA, 12 nt, Human
aguaacucauuu

SEQ ID NO: 3604301 - RNA, 19 nt, Human
aguaacugccaucaagaug

SEQ ID NO: 3604302 - RNA, 17 nt, Human
aguaacugucaggcuga

SEQ ID NO: 3604303 - RNA, 23 nt, Human
aguaacuguuuuuuaagucucuc

SEQ ID NO: 3604304 - RNA, 14 nt, Human
aguaacuuaaguua

SEQ ID NO: 3604305 - RNA, 17 nt, Human
aguaacuuacuuaggug

SEQ ID NO: 3604306 - RNA, 14 nt, Human
aguaacuuggcuuu

SEQ ID NO: 3604307 - RNA, 15 nt, Human
aguaacuuggcuuuc

SEQ ID NO: 3604308 - RNA, 18 nt, Human
aguaacuuggcuuucauu

SEQ ID NO: 3604309 - RNA, 16 nt, Human
aguaacuugucuuaaa

SEQ ID NO: 3604310 - RNA, 23 nt, Human
aguaacuugucuuaaauaaaaga

SEQ ID NO: 3604311 - RNA, 20 nt, Human
aguaacuuuauguguaaaua

SEQ ID NO: 3604312 - RNA, 14 nt, Human
aguaagaaaauauu

SEQ ID NO: 3604313 - RNA, 16 nt, Human
aguaagaagacaugaa

SEQ ID NO: 3604314 - RNA, 21 nt, Human
aguaagaauaccacaucaaau

SEQ ID NO: 3604315 - RNA, 19 nt, Human
aguaagaccggaagcuccu

SEQ ID NO: 3604316 - RNA, 22 nt, Human
aguaagaccggaagcuccuggu

SEQ ID NO: 3604317 - RNA, 15 nt, Human
aguaagaucacuguu

SEQ ID NO: 3604318 - RNA, 18 nt, Human
aguaagaucucuuucuaa

SEQ ID NO: 3604319 - RNA, 23 nt, Human
aguaagauuuacccagaauguca

SEQ ID NO: 3604320 - RNA, 15 nt, Human
aguaagcauuucaaa

SEQ ID NO: 3604321 - RNA, 22 nt, Human
aguaagcccuugaagauaucuu

SEQ ID NO: 3604322 - RNA, 17 nt, Human
aguaagccucaucauca

SEQ ID NO: 3604323 - RNA, 20 nt, Human
aguaagcugcucuauuguag

SEQ ID NO: 3604324 - RNA, 13 nt, Human
aguaaggcugugu

SEQ ID NO: 3604325 - RNA, 19 nt, Human
aguaagggaagcagaagga

SEQ ID NO: 3604326 - RNA, 16 nt, Human
aguaagucucaaggua

SEQ ID NO: 3604327 - RNA, 22 nt, Human
aguaauaaaauucaacaaacau

SEQ ID NO: 3604328 - RNA, 14 nt, Human
aguaauaaagacuc

SEQ ID NO: 3604329 - RNA, 18 nt, Human
aguaauacaggauuauuu

SEQ ID NO: 3604330 - RNA, 23 nt, Human
aguaauaccucuaauaguauaaa

SEQ ID NO: 3604331 - RNA, 14 nt, Human
aguaauagccuggg

SEQ ID NO: 3604332 - RNA, 15 nt, Human
aguaauauauucuga

SEQ ID NO: 3604333 - RNA, 22 nt, Human
aguaauauauucugaagcaaca

SEQ ID NO: 3604334 - RNA, 21 nt, Human
augcauggugccccaggacca

SEQ ID NO: 3604335 - RNA, 16 nt, Human
augcaugguuucagca

SEQ ID NO: 3604336 - RNA, 20 nt, Human
augcaugguuucagcacuag

SEQ ID NO: 3604337 - RNA, 13 nt, Human
augcauguaauca

SEQ ID NO: 3604338 - RNA, 13 nt, Human
augcaugugaaga

SEQ ID NO: 3604339 - RNA, 15 nt, Human
augcauuaaaagaaa

SEQ ID NO: 3604340 - RNA, 16 nt, Human
augcauuaaaagaaaa

SEQ ID NO: 3604341 - RNA, 17 nt, Human
augcauuaaaccugucu

SEQ ID NO: 3604342 - RNA, 22 nt, Human
augcauuauaggaucauuuguu

SEQ ID NO: 3604343 - RNA, 16 nt, Human
augcauuauuaaauug

SEQ ID NO: 3604344 - RNA, 17 nt, Human
augcauucuucucuguu

SEQ ID NO: 3604345 - RNA, 21 nt, Human
augcauucuugguuggcuggc

SEQ ID NO: 3604346 - RNA, 17 nt, Human
augcauugcuaaaauau

SEQ ID NO: 3604347 - RNA, 21 nt, Human
augcauugcucuggaucuguu

SEQ ID NO: 3604348 - RNA, 14 nt, Human
augcauuguaguuu

SEQ ID NO: 3604349 - RNA, 13 nt, Human
augcauuuggaac

SEQ ID NO: 3604350 - RNA, 15 nt, Human
augcauuugggucca

SEQ ID NO: 3604351 - RNA, 20 nt, Human
augcauuuggguccaggagg

SEQ ID NO: 3604352 - RNA, 13 nt, Human
augcauuuugcag

SEQ ID NO: 3604353 - RNA, 20 nt, Human
augccaaagaucacuuguug

SEQ ID NO: 3604354 - RNA, 13 nt, Human
augccaaauuaaa

SEQ ID NO: 3604355 - RNA, 19 nt, Human
augccaaauuaaaaaagau

SEQ ID NO: 3604356 - RNA, 20 nt, Human
augccaacaagaaugcauug

SEQ ID NO: 3604357 - RNA, 22 nt, Human
augccaagaaaagggcugacau

SEQ ID NO: 3604358 - RNA, 20 nt, Human
augccaagagugcacccaug

SEQ ID NO: 3604359 - RNA, 16 nt, Human
augccaauuauuguua

SEQ ID NO: 3604360 - RNA, 15 nt, Human
augccacacaccuuu

SEQ ID NO: 3604361 - RNA, 18 nt, Human
augccacacagagugguc

SEQ ID NO: 3604362 - RNA, 16 nt, Human
augccacacaucaccc

SEQ ID NO: 3604363 - RNA, 17 nt, Human
augccacaccaagcugu

SEQ ID NO: 3604364 - RNA, 19 nt, Human
augccacagcccugucagc

SEQ ID NO: 3604365 - RNA, 18 nt, Human
augccacaucaaaccuuu

SEQ ID NO: 3604366 - RNA, 12 nt, Human
augccacauuca

SEQ ID NO: 3604367 - RNA, 20 nt, Human
augccaccaacuuacaaaaa

SEQ ID NO: 3604368 - RNA, 14 nt, Human
augccacccuagcc

SEQ ID NO: 3604369 - RNA, 19 nt, Human
augccacccuguuuucagc

SEQ ID NO: 3604370 - RNA, 20 nt, Human
augccacccuguuuucagcu

SEQ ID NO: 3604371 - RNA, 12 nt, Human
augccacuuccu

SEQ ID NO: 3604372 - RNA, 18 nt, Human
augccagccaagcucugc

SEQ ID NO: 3604373 - RNA, 19 nt, Human
augccagcucagucccauc

SEQ ID NO: 3604374 - RNA, 21 nt, Human
augccagggccaugucagaca

SEQ ID NO: 3604375 - RNA, 18 nt, Human
augccagggccgaccaga

SEQ ID NO: 3604376 - RNA, 23 nt, Human
augccaguaacgcgucuuccuga

SEQ ID NO: 3604377 - RNA, 20 nt, Human
augccaguaggcucaacuag

SEQ ID NO: 3604378 - RNA, 20 nt, Human
augccagugugcugaugggc

SEQ ID NO: 3604379 - RNA, 12 nt, Human
augccauaauac

SEQ ID NO: 3604380 - RNA, 23 nt, Human
augccauccucuuucucuuuucu

SEQ ID NO: 3604381 - RNA, 19 nt, Human
augccaucuguguccuggu

SEQ ID NO: 3604382 - RNA, 21 nt, Human
augccaugaggaacaaggcaa

SEQ ID NO: 3604383 - RNA, 17 nt, Human
augccauuuaaagcuua

SEQ ID NO: 3604384 - RNA, 21 nt, Human
augccauuuaaagcuuauuaa

SEQ ID NO: 3604385 - RNA, 23 nt, Human
augccauuugcacuuacacaaga

SEQ ID NO: 3604386 - RNA, 12 nt, Human
augccauuuguu

SEQ ID NO: 3604387 - RNA, 16 nt, Human
augccauuuguuuauu

SEQ ID NO: 3604388 - RNA, 21 nt, Human
augccauuuuaaggaaaacua

SEQ ID NO: 3604389 - RNA, 15 nt, Human
augcccaagggaaag

SEQ ID NO: 3604390 - RNA, 17 nt, Human
augcccaauuagggccu

SEQ ID NO: 3604391 - RNA, 12 nt, Human
augcccaccccc

SEQ ID NO: 3604392 - RNA, 15 nt, Human
augcccacccccugc

SEQ ID NO: 3604393 - RNA, 16 nt, Human
augcccacccccugcc

SEQ ID NO: 3604394 - RNA, 18 nt, Human
augcccacccccugcccu

SEQ ID NO: 3604395 - RNA, 20 nt, Human
augcccacccccugcccugc

SEQ ID NO: 3604396 - RNA, 15 nt, Human
augcccaccugccca

SEQ ID NO: 3604397 - RNA, 16 nt, Human
augcccaccugcccau

SEQ ID NO: 3604398 - RNA, 21 nt, Human
augcccaccugcccaucacag

SEQ ID NO: 3604399 - RNA, 21 nt, Human
augcccagagggcccaggcag

SEQ ID NO: 3604400 - RNA, 15 nt, Human
augcccagccccuuc

SEQ ID NO: 3604401 - RNA, 17 nt, Human
augcccagggccacucu

SEQ ID NO: 3604402 - RNA, 19 nt, Human
augcccaguuucugccucu

SEQ ID NO: 3604403 - RNA, 21 nt, Human
augcccauuugccuuuaaaaa

SEQ ID NO: 3604404 - RNA, 15 nt, Human
augcccccagcuggc

SEQ ID NO: 3604405 - RNA, 21 nt, Human
augccccccucaaaccuccuc

SEQ ID NO: 3604406 - RNA, 22 nt, Human
augcccccuaauccccuucucc

SEQ ID NO: 3604407 - RNA, 10 nt, Human
augcccccug

SEQ ID NO: 3604408 - RNA, 15 nt, Human
augcccccuguggau

SEQ ID NO: 3604409 - RNA, 19 nt, Human
augcccccuguggaugcug

SEQ ID NO: 3604410 - RNA, 18 nt, Human
augcccccuuucagaugu

SEQ ID NO: 3604411 - RNA, 16 nt, Human
augccccggccaccuc

SEQ ID NO: 3604412 - RNA, 20 nt, Human
augccccugaauuuaaauag

SEQ ID NO: 3604413 - RNA, 14 nt, Human
augcccucagggga

SEQ ID NO: 3604414 - RNA, 19 nt, Human
augcccucccuucucccug

SEQ ID NO: 3604415 - RNA, 22 nt, Human
augcccucccuucucccuggau

SEQ ID NO: 3604416 - RNA, 13 nt, Human
augcccuccucuc

SEQ ID NO: 3604417 - RNA, 15 nt, Human
augcccuggaggugg

SEQ ID NO: 3604418 - RNA, 16 nt, Human
augcccuggagguggc

SEQ ID NO: 3604419 - RNA, 13 nt, Human
augcccugugcaa

SEQ ID NO: 3604420 - RNA, 20 nt, Human
augccggugagaauaagaga

SEQ ID NO: 3604421 - RNA, 16 nt, Human
augccuaagaagauga

SEQ ID NO: 3604422 - RNA, 13 nt, Human
augccuaauaaac

SEQ ID NO: 3604423 - RNA, 23 nt, Human
augccuaccaauauuuaaucuuu

SEQ ID NO: 3604424 - RNA, 18 nt, Human
augccuaguuuuuaguaa

SEQ ID NO: 3604425 - RNA, 15 nt, Human
augccucacuaauuu

SEQ ID NO: 3604426 - RNA, 23 nt, Human
augccucacuaauuuuuguauua

SEQ ID NO: 3604427 - RNA, 15 nt, Human
augccucagaagugc

SEQ ID NO: 3604428 - RNA, 16 nt, Human
augccucagaagugca

SEQ ID NO: 3604429 - RNA, 24 nt, Human
augccucagcccugacccugugga

SEQ ID NO: 3604430 - RNA, 16 nt, Human
augccucagccuccug

SEQ ID NO: 3604431 - RNA, 20 nt, Human
augccuccaccccccagaac

SEQ ID NO: 3604432 - RNA, 17 nt, Human
augccuccaccgcugcc

SEQ ID NO: 3604433 - RNA, 21 nt, Human
augccuccaccgcugccuaag

SEQ ID NO: 3604434 - RNA, 20 nt, Human
augccucccccuagccauuu

SEQ ID NO: 3604435 - RNA, 18 nt, Human
augccucccugacccugc

SEQ ID NO: 3604436 - RNA, 13 nt, Human
augccuccucagg

SEQ ID NO: 3604437 - RNA, 18 nt, Human
augccuccucaggagccg

SEQ ID NO: 3604438 - RNA, 14 nt, Human
augccuccuguggg

SEQ ID NO: 3604439 - RNA, 15 nt, Human
augccuccugugggg

SEQ ID NO: 3604440 - RNA, 16 nt, Human
augccuccuuccucuu

SEQ ID NO: 3604441 - RNA, 16 nt, Human
augccucuccuuugua

SEQ ID NO: 3604442 - RNA, 15 nt, Human
augccucucucaggc

SEQ ID NO: 3604443 - RNA, 13 nt, Human
augccucugaggc

SEQ ID NO: 3604444 - RNA, 21 nt, Human
augccucugaggccagccugg

SEQ ID NO: 3604445 - RNA, 22 nt, Human
augccucugaggccagccuggc

SEQ ID NO: 3604446 - RNA, 19 nt, Human
augccucugucuucuggac

SEQ ID NO: 3604447 - RNA, 15 nt, Human
augccugaacuugaa

SEQ ID NO: 3604448 - RNA, 21 nt, Human
augccugagagacauggcuuu

SEQ ID NO: 3604449 - RNA, 12 nt, Human
augccugagggu

SEQ ID NO: 3604450 - RNA, 16 nt, Human
augccugagugccugg

SEQ ID NO: 3604451 - RNA, 19 nt, Human
augccugagugccuggcca

SEQ ID NO: 3604452 - RNA, 20 nt, Human
augccugagugccuggccaa

SEQ ID NO: 3604453 - RNA, 18 nt, Human
augccugcuuuuuggaaa

SEQ ID NO: 3604454 - RNA, 19 nt, Human
augccugcuuuuuggaaag

SEQ ID NO: 3604455 - RNA, 23 nt, Human
augccuggaagcuuuguccccug

SEQ ID NO: 3604456 - RNA, 13 nt, Human
augccuggcuucg

SEQ ID NO: 3604457 - RNA, 17 nt, Human
augccugguggcagcug

SEQ ID NO: 3604458 - RNA, 19 nt, Human
augccugguggcagcugcg

SEQ ID NO: 3604459 - RNA, 13 nt, Human
augccuuaaaaug

SEQ ID NO: 3604460 - RNA, 15 nt, Human
augccuuacuuugua

SEQ ID NO: 3604461 - RNA, 23 nt, Human
augccuuacuuuguaugauauuc

SEQ ID NO: 3604462 - RNA, 18 nt, Human
augccuuccagcacccug

SEQ ID NO: 3604463 - RNA, 14 nt, Human
augccuucuuauug

SEQ ID NO: 3604464 - RNA, 15 nt, Human
augccuugaauaaua

SEQ ID NO: 3604465 - RNA, 23 nt, Human
augccuugaauaauaagcaggau

SEQ ID NO: 3604466 - RNA, 24 nt, Human
augccuugguuuuuacugcucuga

SEQ ID NO: 3604467 - RNA, 19 nt, Human
augccuugugcuguuaaua

SEQ ID NO: 3604468 - RNA, 17 nt, Human
augccuuuaaaguauga

SEQ ID NO: 3604469 - RNA, 20 nt, Human
augccuuuaaaucugugaug

SEQ ID NO: 3604470 - RNA, 22 nt, Human
augccuuucuaguccuauucua

SEQ ID NO: 3604471 - RNA, 20 nt, Human
augccuuugagacaguuucu

SEQ ID NO: 3604472 - RNA, 23 nt, Human
augccuuugagacaguuucuuag

SEQ ID NO: 3604473 - RNA, 14 nt, Human
augccuuuuauuuc

SEQ ID NO: 3604474 - RNA, 14 nt, Human
augccuuuucccaa

SEQ ID NO: 3604475 - RNA, 23 nt, Human
augccuuuucccaaaauguugaa

SEQ ID NO: 3604476 - RNA, 19 nt, Human
augccuuuuuuucucugca

SEQ ID NO: 3604477 - RNA, 17 nt, Human
augcgaaugguagucua

SEQ ID NO: 3604478 - RNA, 19 nt, Human
augcgagugcucauuucag

SEQ ID NO: 3604479 - RNA, 18 nt, Human
augcgauuuuauuacugg

SEQ ID NO: 3604480 - RNA, 20 nt, Human
augcgauuuuauuacuggcg

SEQ ID NO: 3604481 - RNA, 23 nt, Human
augcgcagccccaucugugcauu

SEQ ID NO: 3604482 - RNA, 13 nt, Human
augcgcaggcugg

SEQ ID NO: 3604483 - RNA, 23 nt, Human
augggauucagugcuucuuaaag

SEQ ID NO: 3604484 - RNA, 21 nt, Human
augggcaacccccagccugcu

SEQ ID NO: 3604485 - RNA, 20 nt, Human
augggcacaaagggcccaga

SEQ ID NO: 3604486 - RNA, 23 nt, Human
augggcacugcuggguggcccau

SEQ ID NO: 3604487 - RNA, 12 nt, Human
augggcaggaga

SEQ ID NO: 3604488 - RNA, 17 nt, Human
augggcaucuuuuguau

SEQ ID NO: 3604489 - RNA, 14 nt, Human
augggcauugacaa

SEQ ID NO: 3604490 - RNA, 22 nt, Human
augggccaccgccuugcccagc

SEQ ID NO: 3604491 - RNA, 22 nt, Human
augggccagccccuccaucugu

SEQ ID NO: 3604492 - RNA, 16 nt, Human
augggccccuggcacu

SEQ ID NO: 3604493 - RNA, 15 nt, Human
augggccuccugugu

SEQ ID NO: 3604494 - RNA, 19 nt, Human
augggccugcuuccugucu

SEQ ID NO: 3604495 - RNA, 15 nt, Human
augggcucaggaucu

SEQ ID NO: 3604496 - RNA, 21 nt, Human
augggcucugacagaaagcag

SEQ ID NO: 3604497 - RNA, 14 nt, Human
augggcucuuccaa

SEQ ID NO: 3604498 - RNA, 19 nt, Human
augggcugcagcagaggca

SEQ ID NO: 3604499 - RNA, 23 nt, Human
augggcuggguucuacccaggug

SEQ ID NO: 3604500 - RNA, 15 nt, Human
augggcuuucucuuu

SEQ ID NO: 3604501 - RNA, 17 nt, Human
auggggaaaaaaaucau

SEQ ID NO: 3604502 - RNA, 17 nt, Human
auggggaggacaaaaug

SEQ ID NO: 3604503 - RNA, 17 nt, Human
auggggaggcaagugug

SEQ ID NO: 3604504 - RNA, 21 nt, Human
auggggaggcaaguguggggg

SEQ ID NO: 3604505 - RNA, 11 nt, Human
auggggaggga

SEQ ID NO: 3604506 - RNA, 19 nt, Human
auggggaucacagagacau

SEQ ID NO: 3604507 - RNA, 14 nt, Human
auggggcagaaauc

SEQ ID NO: 3604508 - RNA, 23 nt, Human
auggggcaggccaccuggcucuc

SEQ ID NO: 3604509 - RNA, 13 nt, Human
auggggccagauc

SEQ ID NO: 3604510 - RNA, 14 nt, Human
auggggcccugccu

SEQ ID NO: 3604511 - RNA, 12 nt, Human
auggggcugcac

SEQ ID NO: 3604512 - RNA, 11 nt, Human
augggggaaag

SEQ ID NO: 3604513 - RNA, 18 nt, Human
augggggagggggcagaa

SEQ ID NO: 3604514 - RNA, 20 nt, Human
augggggagucugaagcaga

SEQ ID NO: 3604515 - RNA, 14 nt, Human
augggggcaagaag

SEQ ID NO: 3604516 - RNA, 14 nt, Human
augggggcagggcu

SEQ ID NO: 3604517 - RNA, 20 nt, Human
auggggggagcacccugagg

SEQ ID NO: 3604518 - RNA, 21 nt, Human
auggggggagcacccugaggg

SEQ ID NO: 3604519 - RNA, 16 nt, Human
auggggggccaacacc

SEQ ID NO: 3604520 - RNA, 17 nt, Human
auggggguagcagcugg

SEQ ID NO: 3604521 - RNA, 14 nt, Human
augggggugcauuu

SEQ ID NO: 3604522 - RNA, 15 nt, Human
augggggugcauuug

SEQ ID NO: 3604523 - RNA, 16 nt, Human
auggggucucucacag

SEQ ID NO: 3604524 - RNA, 21 nt, Human
auggggucucucacagacagg

SEQ ID NO: 3604525 - RNA, 21 nt, Human
auggggugaugcugggcuggc

SEQ ID NO: 3604526 - RNA, 15 nt, Human
augggguggaaggca

SEQ ID NO: 3604527 - RNA, 16 nt, Human
auggggugggccucug

SEQ ID NO: 3604528 - RNA, 19 nt, Human
auggggugggccucugguu

SEQ ID NO: 3604529 - RNA, 18 nt, Human
augggguuggcugggccc

SEQ ID NO: 3604530 - RNA, 17 nt, Human
auggguagagaaacacu

SEQ ID NO: 3604531 - RNA, 23 nt, Human
auggguagcuucugaccucagca

SEQ ID NO: 3604532 - RNA, 23 nt, Human
auggguagggcucugacaaagcu

SEQ ID NO: 3604533 - RNA, 14 nt, Human
augggucacaggaa

SEQ ID NO: 3604534 - RNA, 21 nt, Human
auggguccaggauuccucuuu

SEQ ID NO: 3604535 - RNA, 22 nt, Human
augggucgcccaugagagcgca

SEQ ID NO: 3604536 - RNA, 19 nt, Human
augggucuggcugagcuga

SEQ ID NO: 3604537 - RNA, 16 nt, Human
augggugaaggcuggc

SEQ ID NO: 3604538 - RNA, 22 nt, Human
augggugaagggagagccagcu

SEQ ID NO: 3604539 - RNA, 16 nt, Human
augggugcaaggaaaa

SEQ ID NO: 3604540 - RNA, 21 nt, Human
auggguguuguauggggaggc

SEQ ID NO: 3604541 - RNA, 16 nt, Human
auggguuggugcuucu

SEQ ID NO: 3604542 - RNA, 13 nt, Human
augguaaaauugc

SEQ ID NO: 3604543 - RNA, 18 nt, Human
augguaaagauauuauuc

SEQ ID NO: 3604544 - RNA, 15 nt, Human
augguaagagaaaag

SEQ ID NO: 3604545 - RNA, 20 nt, Human
augguaauucuuauucuuuc

SEQ ID NO: 3604546 - RNA, 15 nt, Human
augguaccagcccug

SEQ ID NO: 3604547 - RNA, 20 nt, Human
augguaccagcccuggggcu

SEQ ID NO: 3604548 - RNA, 14 nt, Human
augguacccccuuc

SEQ ID NO: 3604549 - RNA, 17 nt, Human
augguacccccuucugg

SEQ ID NO: 3604550 - RNA, 13 nt, Human
augguacuauuua

SEQ ID NO: 3604551 - RNA, 13 nt, Human
augguagcauuuu

SEQ ID NO: 3604552 - RNA, 17 nt, Human
augguaggcauuuccua

SEQ ID NO: 3604553 - RNA, 18 nt, Human
augguaggcauuuccuau

SEQ ID NO: 3604554 - RNA, 19 nt, Human
augguagucuaaccaaaug

SEQ ID NO: 3604555 - RNA, 12 nt, Human
augguaguuucu

SEQ ID NO: 3604556 - RNA, 13 nt, Human
augguaguuucug

SEQ ID NO: 3604557 - RNA, 15 nt, Human
augguaguuucugug

SEQ ID NO: 3604558 - RNA, 22 nt, Human
augguaguuucugugguuggcu

SEQ ID NO: 3604559 - RNA, 23 nt, Human
augguaguuucugugguuggcug

SEQ ID NO: 3604560 - RNA, 17 nt, Human
augguauauauacauau

SEQ ID NO: 3604561 - RNA, 21 nt, Human
augguauauuugguacuguau

SEQ ID NO: 3604562 - RNA, 20 nt, Human
augguaugagcugagggggg

SEQ ID NO: 3604563 - RNA, 15 nt, Human
auggucacacacuga

SEQ ID NO: 3604564 - RNA, 19 nt, Human
auggucacacacugaugcu

SEQ ID NO: 3604565 - RNA, 19 nt, Human
auggucaccaaaucagcug

SEQ ID NO: 3604566 - RNA, 18 nt, Human
auggucagcccuagggug

SEQ ID NO: 3604567 - RNA, 18 nt, Human
auggucagcguugcaugu

SEQ ID NO: 3604568 - RNA, 13 nt, Human
auggucagcuccc

SEQ ID NO: 3604569 - RNA, 20 nt, Human
auggucagcucccuucucug

SEQ ID NO: 3604570 - RNA, 14 nt, Human
auggucaucuuuuu

SEQ ID NO: 3604571 - RNA, 17 nt, Human
auggucauugcaguuua

SEQ ID NO: 3604572 - RNA, 19 nt, Human
augguccaauuaguuuccu

SEQ ID NO: 3604573 - RNA, 22 nt, Human
auggucccacaucccugggccu

SEQ ID NO: 3604574 - RNA, 13 nt, Human
auggucccaucca

SEQ ID NO: 3604575 - RNA, 15 nt, Human
auggucccauccagg

SEQ ID NO: 3604576 - RNA, 15 nt, Human
augguccgugcuaag

SEQ ID NO: 3604577 - RNA, 18 nt, Human
augguccgugcuaaggac

SEQ ID NO: 3604578 - RNA, 20 nt, Human
augguccgugcuaaggacuu

SEQ ID NO: 3604579 - RNA, 15 nt, Human
auggucgcccaggag

SEQ ID NO: 3604580 - RNA, 14 nt, Human
auggucuaaaaaua

SEQ ID NO: 3604581 - RNA, 14 nt, Human
auggucuaauguuu

SEQ ID NO: 3604582 - RNA, 16 nt, Human
auggucuaauguuuaa

SEQ ID NO: 3604583 - RNA, 14 nt, Human
auggucuggucuau

SEQ ID NO: 3604584 - RNA, 16 nt, Human
auggucuggucuaugu

SEQ ID NO: 3604585 - RNA, 15 nt, Human
auggucuuacagcag

SEQ ID NO: 3604586 - RNA, 18 nt, Human
auggucuuauauuuacaa

SEQ ID NO: 3604587 - RNA, 15 nt, Human
auggucuucagccuc

SEQ ID NO: 3604588 - RNA, 12 nt, Human
auggugaaaaug

SEQ ID NO: 3604589 - RNA, 16 nt, Human
auggugaaaauguacu

SEQ ID NO: 3604590 - RNA, 20 nt, Human
auggugaaaccccaucucua

SEQ ID NO: 3604591 - RNA, 24 nt, Human
auggugaaaccccgucucuacuaa

SEQ ID NO: 3604592 - RNA, 16 nt, Human
auggugaugaaaugua

SEQ ID NO: 3604593 - RNA, 19 nt, Human
auggugaugcagucuuaga

SEQ ID NO: 3604594 - RNA, 20 nt, Human
auggugaugcagucuuagau

SEQ ID NO: 3604595 - RNA, 12 nt, Human
auggugauuuua

SEQ ID NO: 3604596 - RNA, 17 nt, Human
auggugauuuuaaaugu

SEQ ID NO: 3604597 - RNA, 15 nt, Human
auggugcaaugaccu

SEQ ID NO: 3604598 - RNA, 19 nt, Human
auggugcaaugaccuuuca

SEQ ID NO: 3604599 - RNA, 15 nt, Human
auggugccccaggac

SEQ ID NO: 3604600 - RNA, 19 nt, Human
auggugccuaguauugaca

SEQ ID NO: 3604601 - RNA, 21 nt, Human
auggugccuaguauugacaaa

SEQ ID NO: 3604602 - RNA, 15 nt, Human
auggugccucuggag

SEQ ID NO: 3604603 - RNA, 11 nt, Human
auggugccuga

SEQ ID NO: 3604604 - RNA, 16 nt, Human
auggugccugagaggc

SEQ ID NO: 3604605 - RNA, 17 nt, Human
auggugccugagaggca

SEQ ID NO: 3604606 - RNA, 23 nt, Human
auggugccugagaggcaggcaua

SEQ ID NO: 3604607 - RNA, 22 nt, Human
auggugccugauucggcugucu

SEQ ID NO: 3604608 - RNA, 22 nt, Human
auggugcucaccaugcuuccag

SEQ ID NO: 3604609 - RNA, 19 nt, Human
auggugcuuaaguuccagc

SEQ ID NO: 3604610 - RNA, 20 nt, Human
augguggacucgccuguaau

SEQ ID NO: 3604611 - RNA, 22 nt, Human
augguggcuucuuuucuuugua

SEQ ID NO: 3604612 - RNA, 23 nt, Human
augguggggucuccucaggacca

SEQ ID NO: 3604613 - RNA, 22 nt, Human
augguguaauaagacauaacgu

SEQ ID NO: 3604614 - RNA, 13 nt, Human
augguguacauaa

SEQ ID NO: 3604615 - RNA, 16 nt, Human
augguguagaacacua

SEQ ID NO: 3604616 - RNA, 18 nt, Human
augguguagaacacuaau

SEQ ID NO: 3604617 - RNA, 22 nt, Human
augguguagaacacuaauucau

SEQ ID NO: 3604618 - RNA, 22 nt, Human
auggugugaaagucagaugccc

SEQ ID NO: 3604619 - RNA, 17 nt, Human
auggugugccuuccaga

SEQ ID NO: 3604620 - RNA, 15 nt, Human
augguguggccugug

SEQ ID NO: 3604621 - RNA, 18 nt, Human
augguguggguguccugc

SEQ ID NO: 3604622 - RNA, 20 nt, Human
augguguggguguccugccu

SEQ ID NO: 3604623 - RNA, 14 nt, Human
augguguguuacac

SEQ ID NO: 3604624 - RNA, 18 nt, Human
augguguuacugcaguug

SEQ ID NO: 3604625 - RNA, 16 nt, Human
augguguuucucccuc

SEQ ID NO: 3604626 - RNA, 21 nt, Human
augguguuuucuuaugcagga

SEQ ID NO: 3604627 - RNA, 23 nt, Human
augguuaagaguccaagaaucca

SEQ ID NO: 3604628 - RNA, 19 nt, Human
augguuacaaucauugcug

SEQ ID NO: 3604629 - RNA, 16 nt, Human
augguuacacuguuag

SEQ ID NO: 3604630 - RNA, 18 nt, Human
augguuacuucuucucuu

SEQ ID NO: 3604631 - RNA, 16 nt, Human
augguuauaaaaguga

SEQ ID NO: 3604632 - RNA, 21 nt, Human
aguaauauauuuaaagggaaa

SEQ ID NO: 3604633 - RNA, 22 nt, Human
aguaauaugccugcuauuugaa

SEQ ID NO: 3604634 - RNA, 18 nt, Human
aguaauauuuauauauuu

SEQ ID NO: 3604635 - RNA, 15 nt, Human
aguaauauuuauuaa

SEQ ID NO: 3604636 - RNA, 15 nt, Human
aguaaucaauaaaga

SEQ ID NO: 3604637 - RNA, 20 nt, Human
aguaaucagauuacugcuuu

SEQ ID NO: 3604638 - RNA, 22 nt, Human
aguaaucagauuacugcuuuaa

SEQ ID NO: 3604639 - RNA, 14 nt, Human
aguaaucccgccac

SEQ ID NO: 3604640 - RNA, 19 nt, Human
aguaaucccgccaccuauc

SEQ ID NO: 3604641 - RNA, 19 nt, Human
aguaaucuaauauggccac

SEQ ID NO: 3604642 - RNA, 13 nt, Human
aguaaucugcauu

SEQ ID NO: 3604643 - RNA, 15 nt, Human
aguaaucuguacauu

SEQ ID NO: 3604644 - RNA, 19 nt, Human
aguaaucuguguacaaaga

SEQ ID NO: 3604645 - RNA, 21 nt, Human
aguaaucuguguacaaagaaa

SEQ ID NO: 3604646 - RNA, 21 nt, Human
aguaaugaauuuuuaugauau

SEQ ID NO: 3604647 - RNA, 17 nt, Human
aguaaugagcuuaagaa

SEQ ID NO: 3604648 - RNA, 21 nt, Human
aguaaugaguuuaaaaaucaa

SEQ ID NO: 3604649 - RNA, 18 nt, Human
aguaaugauaacuggaaa

SEQ ID NO: 3604650 - RNA, 20 nt, Human
aguaaugauaacuggaaacu

SEQ ID NO: 3604651 - RNA, 15 nt, Human
aguaaugaucucaaa

SEQ ID NO: 3604652 - RNA, 17 nt, Human
aguaaugcauacagaaa

SEQ ID NO: 3604653 - RNA, 20 nt, Human
aguaaugcauacagaaauau

SEQ ID NO: 3604654 - RNA, 13 nt, Human
aguaaugccucug

SEQ ID NO: 3604655 - RNA, 20 nt, Human
aguaaugccucugucuagca

SEQ ID NO: 3604656 - RNA, 22 nt, Human
aguaauggguuucauauuucuu

SEQ ID NO: 3604657 - RNA, 14 nt, Human
aguaaugguguaga

SEQ ID NO: 3604658 - RNA, 16 nt, Human
aguaaugguguagaac

SEQ ID NO: 3604659 - RNA, 19 nt, Human
aguaaugguguagaacacu

SEQ ID NO: 3604660 - RNA, 22 nt, Human
aguaaugguguagaacacuaau

SEQ ID NO: 3604661 - RNA, 21 nt, Human
aguaauguggaagaaaauggu

SEQ ID NO: 3604662 - RNA, 22 nt, Human
aguaauuaucgggaacaguguu

SEQ ID NO: 3604663 - RNA, 21 nt, Human
aguaauuaugcacuaaauaug

SEQ ID NO: 3604664 - RNA, 14 nt, Human
aguaauucucaggc

SEQ ID NO: 3604665 - RNA, 16 nt, Human
aguaauugcauuugcu

SEQ ID NO: 3604666 - RNA, 13 nt, Human
aguaauugugaaa

SEQ ID NO: 3604667 - RNA, 16 nt, Human
aguaauugugaaaaag

SEQ ID NO: 3604668 - RNA, 22 nt, Human
aguaauuguguuuacauuuuau

SEQ ID NO: 3604669 - RNA, 23 nt, Human
aguaauuguguuuacauuuuaug

SEQ ID NO: 3604670 - RNA, 18 nt, Human
aguaauuguuccagagac

SEQ ID NO: 3604671 - RNA, 12 nt, Human
aguaauuuagaa

SEQ ID NO: 3604672 - RNA, 22 nt, Human
aguaauuucaguguaaagugug

SEQ ID NO: 3604673 - RNA, 14 nt, Human
aguaauuuggaaau

SEQ ID NO: 3604674 - RNA, 14 nt, Human
aguaauuuguaaag

SEQ ID NO: 3604675 - RNA, 16 nt, Human
aguacaaaugccuuaa

SEQ ID NO: 3604676 - RNA, 14 nt, Human
aguacaauaaaagu

SEQ ID NO: 3604677 - RNA, 18 nt, Human
aguacaaugugacuuuga

SEQ ID NO: 3604678 - RNA, 13 nt, Human
aguacaauguguu

SEQ ID NO: 3604679 - RNA, 15 nt, Human
aguacacucugcugu

SEQ ID NO: 3604680 - RNA, 13 nt, Human
aguacacugagag

SEQ ID NO: 3604681 - RNA, 12 nt, Human
aguacacugccu

SEQ ID NO: 3604682 - RNA, 16 nt, Human
aguacacuguuucaaa

SEQ ID NO: 3604683 - RNA, 14 nt, Human
aguacagaauuuga

SEQ ID NO: 3604684 - RNA, 17 nt, Human
aguacagagaagccauc

SEQ ID NO: 3604685 - RNA, 16 nt, Human
aguacagcaugugccu

SEQ ID NO: 3604686 - RNA, 14 nt, Human
aguacaggcagcac

SEQ ID NO: 3604687 - RNA, 18 nt, Human
aguacaggcagcacagag

SEQ ID NO: 3604688 - RNA, 21 nt, Human
aguacagguaaggugagggaa

SEQ ID NO: 3604689 - RNA, 16 nt, Human
aguacagguacuuugu

SEQ ID NO: 3604690 - RNA, 17 nt, Human
aguacagguacuuuguc

SEQ ID NO: 3604691 - RNA, 19 nt, Human
aguacagugguucuacaau

SEQ ID NO: 3604692 - RNA, 22 nt, Human
aguacagugguucuacaaucua

SEQ ID NO: 3604693 - RNA, 19 nt, Human
aguacauauuuauuuucuu

SEQ ID NO: 3604694 - RNA, 22 nt, Human
aguacaugauaaaugauagaca

SEQ ID NO: 3604695 - RNA, 14 nt, Human
aguacauguuaaac

SEQ ID NO: 3604696 - RNA, 14 nt, Human
aguacauuguuacc

SEQ ID NO: 3604697 - RNA, 19 nt, Human
aguacauuguuaccucuau

SEQ ID NO: 3604698 - RNA, 21 nt, Human
aguacauuuaaauuuuuuggc

SEQ ID NO: 3604699 - RNA, 21 nt, Human
aguacauuuuuugaaaugcug

SEQ ID NO: 3604700 - RNA, 15 nt, Human
aguaccaaaguuuua

SEQ ID NO: 3604701 - RNA, 18 nt, Human
aguaccaaaguuuuauca

SEQ ID NO: 3604702 - RNA, 19 nt, Human
aguaccaaaguuuuaucaa

SEQ ID NO: 3604703 - RNA, 14 nt, Human
aguaccaaaugcuu

SEQ ID NO: 3604704 - RNA, 16 nt, Human
aguaccaaucauuuua

SEQ ID NO: 3604705 - RNA, 17 nt, Human
aguaccaccaaaaaagc

SEQ ID NO: 3604706 - RNA, 22 nt, Human
aguaccaccaaaaaagcuguau

SEQ ID NO: 3604707 - RNA, 23 nt, Human
aguaccauaguaccauuuauaca

SEQ ID NO: 3604708 - RNA, 21 nt, Human
aguaccauuuauacaaauuag

SEQ ID NO: 3604709 - RNA, 22 nt, Human
aguacccaaaagcucagccagc

SEQ ID NO: 3604710 - RNA, 15 nt, Human
aguaccuauaaagua

SEQ ID NO: 3604711 - RNA, 23 nt, Human
aguaccuauaaaguaaagcuaaa

SEQ ID NO: 3604712 - RNA, 15 nt, Human
aguaccugaaaagua

SEQ ID NO: 3604713 - RNA, 15 nt, Human
aguaccugagggucu

SEQ ID NO: 3604714 - RNA, 16 nt, Human
aguaccugagggucug

SEQ ID NO: 3604715 - RNA, 13 nt, Human
aguaccuggagga

SEQ ID NO: 3604716 - RNA, 21 nt, Human
aguaccuggguccccagcccu

SEQ ID NO: 3604717 - RNA, 12 nt, Human
aguaccuugcuu

SEQ ID NO: 3604718 - RNA, 14 nt, Human
aguaccuuugcucu

SEQ ID NO: 3604719 - RNA, 17 nt, Human
aguaccuuugcucuugc

SEQ ID NO: 3604720 - RNA, 13 nt, Human
aguaccuuuguca

SEQ ID NO: 3604721 - RNA, 14 nt, Human
aguaccuuugucac

SEQ ID NO: 3604722 - RNA, 19 nt, Human
aguaccuuuuauaucccau

SEQ ID NO: 3604723 - RNA, 16 nt, Human
aguacgaaccuacagu

SEQ ID NO: 3604724 - RNA, 13 nt, Human
aguacguuauugu

SEQ ID NO: 3604725 - RNA, 16 nt, Human
aguacguugugcauuu

SEQ ID NO: 3604726 - RNA, 17 nt, Human
aguacuaacacaaggac

SEQ ID NO: 3604727 - RNA, 18 nt, Human
aguacuaacacaaggaca

SEQ ID NO: 3604728 - RNA, 23 nt, Human
aguacuacacauuuuuaaauugu

SEQ ID NO: 3604729 - RNA, 14 nt, Human
aguacuagaaacug

SEQ ID NO: 3604730 - RNA, 13 nt, Human
aguacucauacau

SEQ ID NO: 3604731 - RNA, 16 nt, Human
aguacuccugcaaaau

SEQ ID NO: 3604732 - RNA, 21 nt, Human
aguacuccugcaaaauuuuau

SEQ ID NO: 3604733 - RNA, 15 nt, Human
aguacuccuuaagaa

SEQ ID NO: 3604734 - RNA, 23 nt, Human
aguacugagcagugauauucuuu

SEQ ID NO: 3604735 - RNA, 16 nt, Human
aguacugggauuacag

SEQ ID NO: 3604736 - RNA, 23 nt, Human
aguacuguaagaauaauuuauag

SEQ ID NO: 3604737 - RNA, 21 nt, Human
aguacuguaauaauaccucaa

SEQ ID NO: 3604738 - RNA, 17 nt, Human
aguacugugaauccagu

SEQ ID NO: 3604739 - RNA, 13 nt, Human
aguacugugggca

SEQ ID NO: 3604740 - RNA, 17 nt, Human
aguacugugggcaauuu

SEQ ID NO: 3604741 - RNA, 18 nt, Human
aguacugugggcaauuua

SEQ ID NO: 3604742 - RNA, 19 nt, Human
aguacugugggcaauuuag

SEQ ID NO: 3604743 - RNA, 20 nt, Human
aguacugugggcaauuuaga

SEQ ID NO: 3604744 - RNA, 15 nt, Human
aguacuguguacugu

SEQ ID NO: 3604745 - RNA, 23 nt, Human
aguacuuagcuaguuuuauucuu

SEQ ID NO: 3604746 - RNA, 19 nt, Human
aguacuucagcaagagaga

SEQ ID NO: 3604747 - RNA, 19 nt, Human
aguacuucuccacccugcu

SEQ ID NO: 3604748 - RNA, 14 nt, Human
aguacuucuucugu

SEQ ID NO: 3604749 - RNA, 19 nt, Human
aguacuucuucuguaauau

SEQ ID NO: 3604750 - RNA, 23 nt, Human
aguacuucuucuguaauauuuac

SEQ ID NO: 3604751 - RNA, 12 nt, Human
aguacuucuuuu

SEQ ID NO: 3604752 - RNA, 11 nt, Human
aguacuugaaa

SEQ ID NO: 3604753 - RNA, 16 nt, Human
aguacuugaaaaagua

SEQ ID NO: 3604754 - RNA, 18 nt, Human
aguacuugaguguaaugu

SEQ ID NO: 3604755 - RNA, 23 nt, Human
aguacuugggagaccuguaauca

SEQ ID NO: 3604756 - RNA, 13 nt, Human
aguacuuguaguu

SEQ ID NO: 3604757 - RNA, 14 nt, Human
aguacuuguaguuc

SEQ ID NO: 3604758 - RNA, 17 nt, Human
aguacuuuauagaagaa

SEQ ID NO: 3604759 - RNA, 14 nt, Human
aguagaaaauguga

SEQ ID NO: 3604760 - RNA, 18 nt, Human
aguagaaaaugugacccu

SEQ ID NO: 3604761 - RNA, 14 nt, Human
aguagaaaggccuu

SEQ ID NO: 3604762 - RNA, 16 nt, Human
aguagaaaggccuuua

SEQ ID NO: 3604763 - RNA, 17 nt, Human
aguagaaaggccuuuaa

SEQ ID NO: 3604764 - RNA, 14 nt, Human
aguagaaauuuuac

SEQ ID NO: 3604765 - RNA, 17 nt, Human
aguagaaauuuuacaau

SEQ ID NO: 3604766 - RNA, 16 nt, Human
aguagaacuuuguaua

SEQ ID NO: 3604767 - RNA, 19 nt, Human
aguagaagucuuagaugua

SEQ ID NO: 3604768 - RNA, 21 nt, Human
aguagaagucuuagauguaua

SEQ ID NO: 3604769 - RNA, 14 nt, Human
aguagacauuuaua

SEQ ID NO: 3604770 - RNA, 22 nt, Human
aguagacauuucucuuacugca

SEQ ID NO: 3604771 - RNA, 16 nt, Human
aguagacauuuuaaca

SEQ ID NO: 3604772 - RNA, 19 nt, Human
aguagacauuuuaacaaga

SEQ ID NO: 3604773 - RNA, 22 nt, Human
aguagagacgagguuucacugu

SEQ ID NO: 3604774 - RNA, 20 nt, Human
aguagagauggggaaagaau

SEQ ID NO: 3604775 - RNA, 15 nt, Human
aguagaggcuuagag

SEQ ID NO: 3604776 - RNA, 17 nt, Human
aguagagucaucuccau

SEQ ID NO: 3604777 - RNA, 16 nt, Human
aguagauauuacuuua

SEQ ID NO: 3604778 - RNA, 18 nt, Human
aguagauauuacuuuauc

SEQ ID NO: 3604779 - RNA, 21 nt, Human
aguagauauuacuuuaucacu

SEQ ID NO: 3604780 - RNA, 18 nt, Human
aguagaucaugcauagag

SEQ ID NO: 3604781 - RNA, 22 nt, Human
augcgcaggcuggcccugcccu

SEQ ID NO: 3604782 - RNA, 21 nt, Human
augcgcauucuaaccuggagg

SEQ ID NO: 3604783 - RNA, 12 nt, Human
augcggccaaga

SEQ ID NO: 3604784 - RNA, 13 nt, Human
augcggcccagcc

SEQ ID NO: 3604785 - RNA, 21 nt, Human
augcggcccagcccggcuccc

SEQ ID NO: 3604786 - RNA, 16 nt, Human
augcggcccaggaugg

SEQ ID NO: 3604787 - RNA, 18 nt, Human
augcgggcugggcagcug

SEQ ID NO: 3604788 - RNA, 15 nt, Human
augcgguagccagca

SEQ ID NO: 3604789 - RNA, 21 nt, Human
augcgguagccagcacacagg

SEQ ID NO: 3604790 - RNA, 19 nt, Human
augcgguuaauuuugaagu

SEQ ID NO: 3604791 - RNA, 21 nt, Human
augcgguuauaaaaaaugguu

SEQ ID NO: 3604792 - RNA, 14 nt, Human
augcguucacucca

SEQ ID NO: 3604793 - RNA, 14 nt, Human
augcuaaaccuuag

SEQ ID NO: 3604794 - RNA, 20 nt, Human
augcuaaaccuuaguacuga

SEQ ID NO: 3604795 - RNA, 23 nt, Human
augcuaacaaagacaaaagucug

SEQ ID NO: 3604796 - RNA, 22 nt, Human
augcuaacaguucacuugcagu

SEQ ID NO: 3604797 - RNA, 15 nt, Human
augcuaagagaagua

SEQ ID NO: 3604798 - RNA, 22 nt, Human
augcuaauagugaucaagaaga

SEQ ID NO: 3604799 - RNA, 21 nt, Human
augcuaauucucagaaaggca

SEQ ID NO: 3604800 - RNA, 18 nt, Human
augcuacacacugcaugu

SEQ ID NO: 3604801 - RNA, 23 nt, Human
augcuaccuugugacccagcacu

SEQ ID NO: 3604802 - RNA, 20 nt, Human
augcuacugucucacugaaa

SEQ ID NO: 3604803 - RNA, 22 nt, Human
augcuacuuuauuuauacacug

SEQ ID NO: 3604804 - RNA, 16 nt, Human
augcuagaacucccuu

SEQ ID NO: 3604805 - RNA, 20 nt, Human
augcuagaacucccuuucaa

SEQ ID NO: 3604806 - RNA, 15 nt, Human
augcuaggucucgga

SEQ ID NO: 3604807 - RNA, 18 nt, Human
augcuagguuaauuccaa

SEQ ID NO: 3604808 - RNA, 14 nt, Human
augcuagguucuac

SEQ ID NO: 3604809 - RNA, 13 nt, Human
augcuaucucugu

SEQ ID NO: 3604810 - RNA, 14 nt, Human
augcuaugucauuu

SEQ ID NO: 3604811 - RNA, 23 nt, Human
augcuauugacaauaaaauauua

SEQ ID NO: 3604812 - RNA, 11 nt, Human
augcuauuucu

SEQ ID NO: 3604813 - RNA, 15 nt, Human
augcuauuugaacaa

SEQ ID NO: 3604814 - RNA, 14 nt, Human
augcuauuugcaau

SEQ ID NO: 3604815 - RNA, 13 nt, Human
augcucaaagaaa

SEQ ID NO: 3604816 - RNA, 14 nt, Human
augcucaaguuuuu

SEQ ID NO: 3604817 - RNA, 20 nt, Human
augcucaaguuuuucagaaa

SEQ ID NO: 3604818 - RNA, 13 nt, Human
augcucacacucc

SEQ ID NO: 3604819 - RNA, 15 nt, Human
augcucacagucuca

SEQ ID NO: 3604820 - RNA, 12 nt, Human
augcucagacca

SEQ ID NO: 3604821 - RNA, 21 nt, Human
augcucaggggcccuggagca

SEQ ID NO: 3604822 - RNA, 21 nt, Human
augcucagguacagagaagga

SEQ ID NO: 3604823 - RNA, 21 nt, Human
augcucaguugcuaaacacug

SEQ ID NO: 3604824 - RNA, 21 nt, Human
augcucauaacggaucagaaa

SEQ ID NO: 3604825 - RNA, 16 nt, Human
augcucaucugcuggu

SEQ ID NO: 3604826 - RNA, 19 nt, Human
augcucaugguccccaugg

SEQ ID NO: 3604827 - RNA, 18 nt, Human
augcuccaagauucuaga

SEQ ID NO: 3604828 - RNA, 22 nt, Human
augcuccagauuagagccugua

SEQ ID NO: 3604829 - RNA, 21 nt, Human
augcuccagcaacacagccug

SEQ ID NO: 3604830 - RNA, 22 nt, Human
augcuccagcaacacagccugg

SEQ ID NO: 3604831 - RNA, 22 nt, Human
augcuccccacagcgucccugg

SEQ ID NO: 3604832 - RNA, 22 nt, Human
augcucccccauccuccccuuc

SEQ ID NO: 3604833 - RNA, 16 nt, Human
augcuccccugugcca

SEQ ID NO: 3604834 - RNA, 14 nt, Human
augcucccuccccu

SEQ ID NO: 3604835 - RNA, 16 nt, Human
augcucccuccccugc

SEQ ID NO: 3604836 - RNA, 22 nt, Human
augcucccuccccugcccuggu

SEQ ID NO: 3604837 - RNA, 16 nt, Human
augcuccucacugccc

SEQ ID NO: 3604838 - RNA, 18 nt, Human
augcuccucuuccccaga

SEQ ID NO: 3604839 - RNA, 20 nt, Human
augcuccucuuccccagacg

SEQ ID NO: 3604840 - RNA, 21 nt, Human
augcucuaucuugcucuguaa

SEQ ID NO: 3604841 - RNA, 18 nt, Human
augcucucucaaauuguc

SEQ ID NO: 3604842 - RNA, 21 nt, Human
augcucucugcagccagccca

SEQ ID NO: 3604843 - RNA, 23 nt, Human
augcucugagaagaggagcccuc

SEQ ID NO: 3604844 - RNA, 15 nt, Human
augcucugcauguua

SEQ ID NO: 3604845 - RNA, 23 nt, Human
augcucugugcgaggguuacuau

SEQ ID NO: 3604846 - RNA, 15 nt, Human
augcucuuaauugcc

SEQ ID NO: 3604847 - RNA, 19 nt, Human
augcucuuauuucaucauu

SEQ ID NO: 3604848 - RNA, 13 nt, Human
augcucuucugug

SEQ ID NO: 3604849 - RNA, 14 nt, Human
augcucuucugugg

SEQ ID NO: 3604850 - RNA, 16 nt, Human
augcucuuuacuucau

SEQ ID NO: 3604851 - RNA, 15 nt, Human
augcucuuuuuuacu

SEQ ID NO: 3604852 - RNA, 20 nt, Human
augcucuuuuuuacucauug

SEQ ID NO: 3604853 - RNA, 17 nt, Human
augcugaaaaaacaccu

SEQ ID NO: 3604854 - RNA, 23 nt, Human
augcugaaaauguccuugugaug

SEQ ID NO: 3604855 - RNA, 14 nt, Human
augcugaaaccaag

SEQ ID NO: 3604856 - RNA, 17 nt, Human
augcugacccaugggca

SEQ ID NO: 3604857 - RNA, 17 nt, Human
augcugaggccugggcc

SEQ ID NO: 3604858 - RNA, 18 nt, Human
augcugaggccugggccg

SEQ ID NO: 3604859 - RNA, 20 nt, Human
augcugaggguguuucuucc

SEQ ID NO: 3604860 - RNA, 22 nt, Human
augcugaguauguuaagcucuu

SEQ ID NO: 3604861 - RNA, 18 nt, Human
augcugaugaaucacugu

SEQ ID NO: 3604862 - RNA, 13 nt, Human
augcugauggagc

SEQ ID NO: 3604863 - RNA, 14 nt, Human
augcugauguccuc

SEQ ID NO: 3604864 - RNA, 16 nt, Human
augcugauguucagug

SEQ ID NO: 3604865 - RNA, 17 nt, Human
augcugauguucagugu

SEQ ID NO: 3604866 - RNA, 19 nt, Human
augcugauguucaguguaa

SEQ ID NO: 3604867 - RNA, 24 nt, Human
augcugauguucaguguaauuucu

SEQ ID NO: 3604868 - RNA, 22 nt, Human
augcugccaauauccuaauaaa

SEQ ID NO: 3604869 - RNA, 13 nt, Human
augcugccagugu

SEQ ID NO: 3604870 - RNA, 17 nt, Human
augcugcccaugccacc

SEQ ID NO: 3604871 - RNA, 15 nt, Human
augcugccccugccu

SEQ ID NO: 3604872 - RNA, 14 nt, Human
augcugcccuguga

SEQ ID NO: 3604873 - RNA, 15 nt, Human
augcugcccugugag

SEQ ID NO: 3604874 - RNA, 19 nt, Human
augcugccuaggcugaccu

SEQ ID NO: 3604875 - RNA, 16 nt, Human
augcugcgcccuuccc

SEQ ID NO: 3604876 - RNA, 21 nt, Human
augcugcugccccugcacagc

SEQ ID NO: 3604877 - RNA, 23 nt, Human
augcugcugccccugcacagcag

SEQ ID NO: 3604878 - RNA, 13 nt, Human
augcugcuggaca

SEQ ID NO: 3604879 - RNA, 21 nt, Human
augcugcuggggaagacagug

SEQ ID NO: 3604880 - RNA, 20 nt, Human
augcugcuuuaauugugaau

SEQ ID NO: 3604881 - RNA, 15 nt, Human
augcugcuuuuauau

SEQ ID NO: 3604882 - RNA, 20 nt, Human
augcugcuuuuauaucugua

SEQ ID NO: 3604883 - RNA, 23 nt, Human
augcuggacaggucugggagagg

SEQ ID NO: 3604884 - RNA, 20 nt, Human
augcuggacuggaggccccu

SEQ ID NO: 3604885 - RNA, 22 nt, Human
augcuggacuggaggccccugg

SEQ ID NO: 3604886 - RNA, 16 nt, Human
augcuggagaaaaaua

SEQ ID NO: 3604887 - RNA, 23 nt, Human
augcuggagaaaaauaucuguaa

SEQ ID NO: 3604888 - RNA, 19 nt, Human
augcuggagaagagaggag

SEQ ID NO: 3604889 - RNA, 12 nt, Human
augcuggagagg

SEQ ID NO: 3604890 - RNA, 13 nt, Human
augcuggagaggu

SEQ ID NO: 3604891 - RNA, 14 nt, Human
augcuggagagguu

SEQ ID NO: 3604892 - RNA, 22 nt, Human
augcuggccagccuggggccug

SEQ ID NO: 3604893 - RNA, 19 nt, Human
augcuggcccagggcccag

SEQ ID NO: 3604894 - RNA, 20 nt, Human
augcuggcccagggcccaga

SEQ ID NO: 3604895 - RNA, 21 nt, Human
augcuggcuauagaugucuuu

SEQ ID NO: 3604896 - RNA, 12 nt, Human
augcuggcuggc

SEQ ID NO: 3604897 - RNA, 22 nt, Human
augcuggcuguuggcugggggc

SEQ ID NO: 3604898 - RNA, 15 nt, Human
augcugggacucagc

SEQ ID NO: 3604899 - RNA, 16 nt, Human
augcugggacucagcc

SEQ ID NO: 3604900 - RNA, 16 nt, Human
augcugggcugacggu

SEQ ID NO: 3604901 - RNA, 14 nt, Human
augcugggcuggcu

SEQ ID NO: 3604902 - RNA, 16 nt, Human
augcugggcugggugc

SEQ ID NO: 3604903 - RNA, 22 nt, Human
augcugguuuuccuaaaugcag

SEQ ID NO: 3604904 - RNA, 22 nt, Human
augcuguaacuuucugaaauaa

SEQ ID NO: 3604905 - RNA, 12 nt, Human
augcuguacaua

SEQ ID NO: 3604906 - RNA, 14 nt, Human
augcuguaucugug

SEQ ID NO: 3604907 - RNA, 15 nt, Human
augcuguaucugugc

SEQ ID NO: 3604908 - RNA, 19 nt, Human
augcuguauucuucuuugg

SEQ ID NO: 3604909 - RNA, 23 nt, Human
augcugucccuuacgugaguccu

SEQ ID NO: 3604910 - RNA, 16 nt, Human
augcugucuggcacag

SEQ ID NO: 3604911 - RNA, 20 nt, Human
augcugucuuucuugcuccc

SEQ ID NO: 3604912 - RNA, 23 nt, Human
augcugucuuucuugcucccuga

SEQ ID NO: 3604913 - RNA, 23 nt, Human
augcugugacacauggccccucc

SEQ ID NO: 3604914 - RNA, 18 nt, Human
augcugugccccuggccu

SEQ ID NO: 3604915 - RNA, 19 nt, Human
augcugugcccuaaagugu

SEQ ID NO: 3604916 - RNA, 20 nt, Human
augcugugcgcccagggcug

SEQ ID NO: 3604917 - RNA, 18 nt, Human
augcugugcuaugaauuu

SEQ ID NO: 3604918 - RNA, 17 nt, Human
augcuguucaugaaaga

SEQ ID NO: 3604919 - RNA, 12 nt, Human
augcuguugauu

SEQ ID NO: 3604920 - RNA, 16 nt, Human
augcuguugauugcua

SEQ ID NO: 3604921 - RNA, 16 nt, Human
augcuguugccucauc

SEQ ID NO: 3604922 - RNA, 17 nt, Human
augcuguugccucaucu

SEQ ID NO: 3604923 - RNA, 11 nt, Human
augcuguuugu

SEQ ID NO: 3604924 - RNA, 22 nt, Human
augcuguuuguagugaaauaau

SEQ ID NO: 3604925 - RNA, 14 nt, Human
augcuuaaauuuua

SEQ ID NO: 3604926 - RNA, 13 nt, Human
augcuuaauuucu

SEQ ID NO: 3604927 - RNA, 16 nt, Human
augcuuaauuucuaaa

SEQ ID NO: 3604928 - RNA, 19 nt, Human
augcuuaauuucuaaagau

SEQ ID NO: 3604929 - RNA, 20 nt, Human
augguuaugaaagaauauau

SEQ ID NO: 3604930 - RNA, 18 nt, Human
augguucguucuguuuac

SEQ ID NO: 3604931 - RNA, 13 nt, Human
augguucugugcc

SEQ ID NO: 3604932 - RNA, 17 nt, Human
augguugaugauacuuc

SEQ ID NO: 3604933 - RNA, 21 nt, Human
augguuguauuagauguucuc

SEQ ID NO: 3604934 - RNA, 13 nt, Human
augguuucaaaga

SEQ ID NO: 3604935 - RNA, 22 nt, Human
augguuuggugcuuuuuauaaa

SEQ ID NO: 3604936 - RNA, 15 nt, Human
augguuuguccugau

SEQ ID NO: 3604937 - RNA, 15 nt, Human
augguuuucaaaaua

SEQ ID NO: 3604938 - RNA, 21 nt, Human
augguuuucuccaagagcuac

SEQ ID NO: 3604939 - RNA, 19 nt, Human
augguuuugugccaucugu

SEQ ID NO: 3604940 - RNA, 16 nt, Human
augguuuuuaaauuuu

SEQ ID NO: 3604941 - RNA, 11 nt, Human
auguaaaaaag

SEQ ID NO: 3604942 - RNA, 19 nt, Human
auguaaaaaagaaaaacac

SEQ ID NO: 3604943 - RNA, 11 nt, Human
auguaaaacaa

SEQ ID NO: 3604944 - RNA, 12 nt, Human
auguaaaacaaa

SEQ ID NO: 3604945 - RNA, 14 nt, Human
auguaaaacaaaaa

SEQ ID NO: 3604946 - RNA, 20 nt, Human
auguaaaacaaaaaacaaua

SEQ ID NO: 3604947 - RNA, 17 nt, Human
auguaaaacagaaaaaa

SEQ ID NO: 3604948 - RNA, 23 nt, Human
auguaaaagaacuuacugauuau

SEQ ID NO: 3604949 - RNA, 22 nt, Human
auguaaaaggccaaaccucugu

SEQ ID NO: 3604950 - RNA, 12 nt, Human
auguaaaaucuu

SEQ ID NO: 3604951 - RNA, 13 nt, Human
auguaaaaucuug

SEQ ID NO: 3604952 - RNA, 22 nt, Human
auguaaaaucuugucaugugua

SEQ ID NO: 3604953 - RNA, 23 nt, Human
auguaaaaucuugucauguguau

SEQ ID NO: 3604954 - RNA, 19 nt, Human
auguaaaauuuugccuaau

SEQ ID NO: 3604955 - RNA, 13 nt, Human
auguaaacaaauc

SEQ ID NO: 3604956 - RNA, 16 nt, Human
auguaaacaaaucuuu

SEQ ID NO: 3604957 - RNA, 17 nt, Human
auguaaacagugccugc

SEQ ID NO: 3604958 - RNA, 20 nt, Human
auguaaacagugccugcuga

SEQ ID NO: 3604959 - RNA, 22 nt, Human
auguaaacagugccugcugaau

SEQ ID NO: 3604960 - RNA, 18 nt, Human
auguaaacauaccaacau

SEQ ID NO: 3604961 - RNA, 12 nt, Human
auguaaacauuu

SEQ ID NO: 3604962 - RNA, 11 nt, Human
auguaaacugc

SEQ ID NO: 3604963 - RNA, 14 nt, Human
auguaaacugccau

SEQ ID NO: 3604964 - RNA, 22 nt, Human
auguaaacuguuucuuuaaaau

SEQ ID NO: 3604965 - RNA, 16 nt, Human
auguaaagaaaugucu

SEQ ID NO: 3604966 - RNA, 21 nt, Human
auguaaagcaaccaaaaagaa

SEQ ID NO: 3604967 - RNA, 14 nt, Human
auguaaagccaugc

SEQ ID NO: 3604968 - RNA, 20 nt, Human
auguaaaggagucaaaacua

SEQ ID NO: 3604969 - RNA, 21 nt, Human
auguaaauaaaggauuucuag

SEQ ID NO: 3604970 - RNA, 17 nt, Human
auguaaauaauacauua

SEQ ID NO: 3604971 - RNA, 18 nt, Human
auguaaauagguuucuaa

SEQ ID NO: 3604972 - RNA, 12 nt, Human
auguaaauagug

SEQ ID NO: 3604973 - RNA, 17 nt, Human
auguaaauagugcagaa

SEQ ID NO: 3604974 - RNA, 12 nt, Human
auguaaauauuc

SEQ ID NO: 3604975 - RNA, 15 nt, Human
auguaaauauucuau

SEQ ID NO: 3604976 - RNA, 15 nt, Human
auguaaauauuuuaa

SEQ ID NO: 3604977 - RNA, 20 nt, Human
auguaaauauuuuaaagaau

SEQ ID NO: 3604978 - RNA, 14 nt, Human
auguaaauccccac

SEQ ID NO: 3604979 - RNA, 12 nt, Human
auguaaaugaag

SEQ ID NO: 3604980 - RNA, 18 nt, Human
auguaaaugucucacuga

SEQ ID NO: 3604981 - RNA, 19 nt, Human
auguaaaugucucacugag

SEQ ID NO: 3604982 - RNA, 15 nt, Human
auguaaauuaccagu

SEQ ID NO: 3604983 - RNA, 15 nt, Human
auguaaauuuguacu

SEQ ID NO: 3604984 - RNA, 14 nt, Human
auguaacugcugaa

SEQ ID NO: 3604985 - RNA, 14 nt, Human
auguaacuguuacc

SEQ ID NO: 3604986 - RNA, 17 nt, Human
auguaacuguuaccauu

SEQ ID NO: 3604987 - RNA, 17 nt, Human
auguaacuuuuguaaga

SEQ ID NO: 3604988 - RNA, 19 nt, Human
auguaagaauucagaagac

SEQ ID NO: 3604989 - RNA, 20 nt, Human
auguaagagcuuuacaaaaa

SEQ ID NO: 3604990 - RNA, 23 nt, Human
auguaagagcuuuacaaaaagac

SEQ ID NO: 3604991 - RNA, 24 nt, Human
auguaagauuauagauucuaaaga

SEQ ID NO: 3604992 - RNA, 16 nt, Human
auguaagcauacuuug

SEQ ID NO: 3604993 - RNA, 22 nt, Human
auguaagcauacuuuguaaaua

SEQ ID NO: 3604994 - RNA, 17 nt, Human
auguaagcugaaaauau

SEQ ID NO: 3604995 - RNA, 14 nt, Human
auguaagcuguuua

SEQ ID NO: 3604996 - RNA, 18 nt, Human
auguaaguuuaccuaugu

SEQ ID NO: 3604997 - RNA, 19 nt, Human
auguaauaaaaaguauaug

SEQ ID NO: 3604998 - RNA, 16 nt, Human
auguaauaaacuuuaa

SEQ ID NO: 3604999 - RNA, 15 nt, Human
auguaaugcaacuac

SEQ ID NO: 3605000 - RNA, 14 nt, Human
auguaaugucccuu

SEQ ID NO: 3605001 - RNA, 21 nt, Human
auguaauguuuucuuugcaaa

SEQ ID NO: 3605002 - RNA, 18 nt, Human
auguaauuaaacuguuaa

SEQ ID NO: 3605003 - RNA, 15 nt, Human
auguaauuaaguacu

SEQ ID NO: 3605004 - RNA, 23 nt, Human
auguaauuaaguacuauguauca

SEQ ID NO: 3605005 - RNA, 17 nt, Human
auguaauuauuuaugua

SEQ ID NO: 3605006 - RNA, 23 nt, Human
auguaauuauuuauguauggugc

SEQ ID NO: 3605007 - RNA, 20 nt, Human
auguaauuguuugucuuuaa

SEQ ID NO: 3605008 - RNA, 16 nt, Human
auguaauuuaaaugaa

SEQ ID NO: 3605009 - RNA, 20 nt, Human
auguaauuuaaaugaaagaa

SEQ ID NO: 3605010 - RNA, 22 nt, Human
auguaauuuaggguacuaaauu

SEQ ID NO: 3605011 - RNA, 13 nt, Human
auguaauuugugu

SEQ ID NO: 3605012 - RNA, 20 nt, Human
auguaauuuuauuuuaaaau

SEQ ID NO: 3605013 - RNA, 12 nt, Human
auguaauuuugu

SEQ ID NO: 3605014 - RNA, 22 nt, Human
auguaauuuuguguaagaaaua

SEQ ID NO: 3605015 - RNA, 18 nt, Human
auguacagacauauuuaa

SEQ ID NO: 3605016 - RNA, 21 nt, Human
auguacagagaacuaacacua

SEQ ID NO: 3605017 - RNA, 14 nt, Human
auguacaggaugcu

SEQ ID NO: 3605018 - RNA, 13 nt, Human
auguacagucugu

SEQ ID NO: 3605019 - RNA, 14 nt, Human
auguacagucuguc

SEQ ID NO: 3605020 - RNA, 16 nt, Human
auguacaguugaaaua

SEQ ID NO: 3605021 - RNA, 18 nt, Human
auguacauagugcuaaca

SEQ ID NO: 3605022 - RNA, 17 nt, Human
auguacauguauuaaau

SEQ ID NO: 3605023 - RNA, 14 nt, Human
auguacauuaauua

SEQ ID NO: 3605024 - RNA, 18 nt, Human
auguaccaugaaacaaag

SEQ ID NO: 3605025 - RNA, 15 nt, Human
auguaccauuugcau

SEQ ID NO: 3605026 - RNA, 17 nt, Human
auguacccucugaaaua

SEQ ID NO: 3605027 - RNA, 14 nt, Human
auguaccucuuuua

SEQ ID NO: 3605028 - RNA, 22 nt, Human
auguaccuucuuucacucuguc

SEQ ID NO: 3605029 - RNA, 18 nt, Human
auguacuaguacugugua

SEQ ID NO: 3605030 - RNA, 21 nt, Human
auguacuaguacuguguacug

SEQ ID NO: 3605031 - RNA, 22 nt, Human
auguacuaguacuguguacugu

SEQ ID NO: 3605032 - RNA, 20 nt, Human
auguacuccucuuuacacug

SEQ ID NO: 3605033 - RNA, 22 nt, Human
auguacucuacugauaucuaaa

SEQ ID NO: 3605034 - RNA, 17 nt, Human
auguacugauuucagua

SEQ ID NO: 3605035 - RNA, 18 nt, Human
auguacugauuucaguaa

SEQ ID NO: 3605036 - RNA, 18 nt, Human
auguacuguacuaauucu

SEQ ID NO: 3605037 - RNA, 20 nt, Human
auguacuguacuaauucuua

SEQ ID NO: 3605038 - RNA, 16 nt, Human
auguacuguaguuuuu

SEQ ID NO: 3605039 - RNA, 19 nt, Human
auguacuguauauuacaga

SEQ ID NO: 3605040 - RNA, 22 nt, Human
auguacuuuuauuuuacacaga

SEQ ID NO: 3605041 - RNA, 12 nt, Human
auguagaaagcu

SEQ ID NO: 3605042 - RNA, 13 nt, Human
auguagaagcugc

SEQ ID NO: 3605043 - RNA, 20 nt, Human
auguagaauauucagacaaa

SEQ ID NO: 3605044 - RNA, 18 nt, Human
auguagacaguuggguuu

SEQ ID NO: 3605045 - RNA, 21 nt, Human
auguagacuauauacaugugu

SEQ ID NO: 3605046 - RNA, 13 nt, Human
auguagaggagaa

SEQ ID NO: 3605047 - RNA, 17 nt, Human
auguagaggagaaacug

SEQ ID NO: 3605048 - RNA, 18 nt, Human
auguagaggcuuguuuac

SEQ ID NO: 3605049 - RNA, 21 nt, Human
auguagauauuuggcuuaaau

SEQ ID NO: 3605050 - RNA, 17 nt, Human
auguagauguaugcaca

SEQ ID NO: 3605051 - RNA, 19 nt, Human
auguagauguaugcacaca

SEQ ID NO: 3605052 - RNA, 22 nt, Human
auguagauguaugcacacacau

SEQ ID NO: 3605053 - RNA, 19 nt, Human
auguagauuaaggugaugu

SEQ ID NO: 3605054 - RNA, 16 nt, Human
auguagauuuauuuca

SEQ ID NO: 3605055 - RNA, 17 nt, Human
auguagauuuauuucau

SEQ ID NO: 3605056 - RNA, 20 nt, Human
auguagauuuauuucaucau

SEQ ID NO: 3605057 - RNA, 20 nt, Human
auguagcaaaacgcauggag

SEQ ID NO: 3605058 - RNA, 21 nt, Human
auguagcaaucagauuuuccu

SEQ ID NO: 3605059 - RNA, 16 nt, Human
auguagcacauaaacu

SEQ ID NO: 3605060 - RNA, 18 nt, Human
auguagcauuaugcaauu

SEQ ID NO: 3605061 - RNA, 23 nt, Human
auguagccaugaccuuacauuuc

SEQ ID NO: 3605062 - RNA, 12 nt, Human
auguagccaugg

SEQ ID NO: 3605063 - RNA, 16 nt, Human
auguagccaugggacc

SEQ ID NO: 3605064 - RNA, 16 nt, Human
auguagcccauccuuc

SEQ ID NO: 3605065 - RNA, 18 nt, Human
auguagcccccuggccuc

SEQ ID NO: 3605066 - RNA, 21 nt, Human
auguagcccccuggccucugu

SEQ ID NO: 3605067 - RNA, 16 nt, Human
auguagccuucacaca

SEQ ID NO: 3605068 - RNA, 22 nt, Human
auguagccuucacacagauaga

SEQ ID NO: 3605069 - RNA, 22 nt, Human
auguagccuuuacuguuugaua

SEQ ID NO: 3605070 - RNA, 12 nt, Human
auguagcucuuu

SEQ ID NO: 3605071 - RNA, 15 nt, Human
auguagcugguuucc

SEQ ID NO: 3605072 - RNA, 21 nt, Human
auguaggaaaaaaauagucua

SEQ ID NO: 3605073 - RNA, 14 nt, Human
auguaggaaguagg

SEQ ID NO: 3605074 - RNA, 12 nt, Human
auguaggaggga

SEQ ID NO: 3605075 - RNA, 22 nt, Human
auguaggcuggcuuucagagua

SEQ ID NO: 3605076 - RNA, 21 nt, Human
auguaggugucugcacccagg

SEQ ID NO: 3605077 - RNA, 12 nt, Human
auguaguaacac

SEQ ID NO: 3605078 - RNA, 20 nt, Human
aguagaugcgcagccccauc

SEQ ID NO: 3605079 - RNA, 15 nt, Human
aguagauggugaaau

SEQ ID NO: 3605080 - RNA, 20 nt, Human
aguagauguggccuuugaau

SEQ ID NO: 3605081 - RNA, 21 nt, Human
aguagauguggccuuugaauu

SEQ ID NO: 3605082 - RNA, 17 nt, Human
aguagauguucuacuuu

SEQ ID NO: 3605083 - RNA, 22 nt, Human
aguagauucuggacagucagcu

SEQ ID NO: 3605084 - RNA, 20 nt, Human
aguagauugcagaaaauucu

SEQ ID NO: 3605085 - RNA, 21 nt, Human
aguagcaauuauggaaaaaaa

SEQ ID NO: 3605086 - RNA, 14 nt, Human
aguagcacaggcug

SEQ ID NO: 3605087 - RNA, 21 nt, Human
aguagcacaggcugagugcag

SEQ ID NO: 3605088 - RNA, 22 nt, Human
aguagcacaggcugagugcagg

SEQ ID NO: 3605089 - RNA, 20 nt, Human
aguagcaguagaugcaugua

SEQ ID NO: 3605090 - RNA, 22 nt, Human
aguagcagugauugucuuaaua

SEQ ID NO: 3605091 - RNA, 23 nt, Human
aguagcaugagagaauuguauca

SEQ ID NO: 3605092 - RNA, 20 nt, Human
aguagcauguugagccaggc

SEQ ID NO: 3605093 - RNA, 21 nt, Human
aguagccauguuaacaugaca

SEQ ID NO: 3605094 - RNA, 22 nt, Human
aguagccauguuaacaugacau

SEQ ID NO: 3605095 - RNA, 21 nt, Human
aguagcccuuucugugugcac

SEQ ID NO: 3605096 - RNA, 18 nt, Human
aguagccgagagccugcu

SEQ ID NO: 3605097 - RNA, 22 nt, Human
aguagccuaacacacuccaaga

SEQ ID NO: 3605098 - RNA, 15 nt, Human
aguagcucuccugac

SEQ ID NO: 3605099 - RNA, 22 nt, Human
aguagcugagcucacaaggcag

SEQ ID NO: 3605100 - RNA, 21 nt, Human
aguagcugggacuacaggcac

SEQ ID NO: 3605101 - RNA, 23 nt, Human
aguagcugggauuuuaaacuaga

SEQ ID NO: 3605102 - RNA, 16 nt, Human
aguagcuuaagaaaaa

SEQ ID NO: 3605103 - RNA, 17 nt, Human
aguagcuuaagaaaaaa

SEQ ID NO: 3605104 - RNA, 19 nt, Human
aguagcuugcucccugugu

SEQ ID NO: 3605105 - RNA, 18 nt, Human
aguaggaagacuuuggaa

SEQ ID NO: 3605106 - RNA, 22 nt, Human
aguaggaagacuuuggaaagac

SEQ ID NO: 3605107 - RNA, 22 nt, Human
aguaggauaugccugcucuuug

SEQ ID NO: 3605108 - RNA, 17 nt, Human
aguaggcauuuuuacca

SEQ ID NO: 3605109 - RNA, 21 nt, Human
aguagggaggaccacaggugu

SEQ ID NO: 3605110 - RNA, 18 nt, Human
aguaggggaagacaugca

SEQ ID NO: 3605111 - RNA, 13 nt, Human
aguagggggucua

SEQ ID NO: 3605112 - RNA, 18 nt, Human
aguaggggucugucuuuu

SEQ ID NO: 3605113 - RNA, 20 nt, Human
aguaggggucugucuuuuaa

SEQ ID NO: 3605114 - RNA, 20 nt, Human
aguaggucguuuuaaaaaca

SEQ ID NO: 3605115 - RNA, 18 nt, Human
aguaguaaaaauuaaaaa

SEQ ID NO: 3605116 - RNA, 22 nt, Human
aguaguaccaaaugcuuuaaaa

SEQ ID NO: 3605117 - RNA, 20 nt, Human
aguaguacuucuucuguaau

SEQ ID NO: 3605118 - RNA, 12 nt, Human
aguaguccugug

SEQ ID NO: 3605119 - RNA, 16 nt, Human
aguaguccuuggcaua

SEQ ID NO: 3605120 - RNA, 13 nt, Human
aguagucucugug

SEQ ID NO: 3605121 - RNA, 15 nt, Human
aguagugagaagaau

SEQ ID NO: 3605122 - RNA, 17 nt, Human
aguagugagaagaauau

SEQ ID NO: 3605123 - RNA, 14 nt, Human
aguagugucuggau

SEQ ID NO: 3605124 - RNA, 14 nt, Human
aguaguguuacaug

SEQ ID NO: 3605125 - RNA, 13 nt, Human
aguaguuaucaug

SEQ ID NO: 3605126 - RNA, 15 nt, Human
aguaguuaucauguu

SEQ ID NO: 3605127 - RNA, 12 nt, Human
aguaguucacau

SEQ ID NO: 3605128 - RNA, 19 nt, Human
aguaguucucuugguguua

SEQ ID NO: 3605129 - RNA, 14 nt, Human
aguaguucuguauu

SEQ ID NO: 3605130 - RNA, 15 nt, Human
aguaguucuguauuu

SEQ ID NO: 3605131 - RNA, 18 nt, Human
aguaguucuguauuugaa

SEQ ID NO: 3605132 - RNA, 18 nt, Human
aguaguucuguuuggugu

SEQ ID NO: 3605133 - RNA, 13 nt, Human
aguaguuugcauu

SEQ ID NO: 3605134 - RNA, 15 nt, Human
aguauaaaaacuuga

SEQ ID NO: 3605135 - RNA, 17 nt, Human
aguauaaaauacaacaa

SEQ ID NO: 3605136 - RNA, 16 nt, Human
aguauaaacaaaguua

SEQ ID NO: 3605137 - RNA, 19 nt, Human
aguauaaacaaaguuacua

SEQ ID NO: 3605138 - RNA, 23 nt, Human
aguauaaauuuguguaauauuac

SEQ ID NO: 3605139 - RNA, 14 nt, Human
aguauaauuaacau

SEQ ID NO: 3605140 - RNA, 23 nt, Human
aguauaauuaacauguuaaacca

SEQ ID NO: 3605141 - RNA, 18 nt, Human
aguauaauuuuuuguaau

SEQ ID NO: 3605142 - RNA, 14 nt, Human
aguauacaagauaa

SEQ ID NO: 3605143 - RNA, 18 nt, Human
aguauacaagauaagcuu

SEQ ID NO: 3605144 - RNA, 17 nt, Human
aguauacaauauauaaa

SEQ ID NO: 3605145 - RNA, 23 nt, Human
aguauacaauauauaaaaauaua

SEQ ID NO: 3605146 - RNA, 23 nt, Human
aguauacuagggagccauuugag

SEQ ID NO: 3605147 - RNA, 17 nt, Human
aguauacucuuaggcca

SEQ ID NO: 3605148 - RNA, 12 nt, Human
aguauagaauag

SEQ ID NO: 3605149 - RNA, 14 nt, Human
aguauagagagaag

SEQ ID NO: 3605150 - RNA, 17 nt, Human
aguauagccuauggcag

SEQ ID NO: 3605151 - RNA, 19 nt, Human
aguauauaaugguuucaaa

SEQ ID NO: 3605152 - RNA, 21 nt, Human
aguauaucauguaaagaaaug

SEQ ID NO: 3605153 - RNA, 18 nt, Human
aguauaucuggacaagcc

SEQ ID NO: 3605154 - RNA, 15 nt, Human
aguauauguucccuc

SEQ ID NO: 3605155 - RNA, 16 nt, Human
aguauauuaaaaaugg

SEQ ID NO: 3605156 - RNA, 15 nt, Human
aguauauuauguauu

SEQ ID NO: 3605157 - RNA, 17 nt, Human
aguauauuauguauuua

SEQ ID NO: 3605158 - RNA, 22 nt, Human
aguauauuguugaagagacaga

SEQ ID NO: 3605159 - RNA, 20 nt, Human
aguauauuuuauuucaaugu

SEQ ID NO: 3605160 - RNA, 19 nt, Human
aguaucaaauauuagaugu

SEQ ID NO: 3605161 - RNA, 23 nt, Human
aguaucaaauauuagaugugauu

SEQ ID NO: 3605162 - RNA, 22 nt, Human
aguaucacugucuuuccuagau

SEQ ID NO: 3605163 - RNA, 13 nt, Human
aguaucagaauug

SEQ ID NO: 3605164 - RNA, 18 nt, Human
aguaucagaauugaaaca

SEQ ID NO: 3605165 - RNA, 15 nt, Human
aguaucaggccugcc

SEQ ID NO: 3605166 - RNA, 21 nt, Human
aguaucaguguuuuaaauucu

SEQ ID NO: 3605167 - RNA, 15 nt, Human
aguauccuccagguu

SEQ ID NO: 3605168 - RNA, 17 nt, Human
aguauccuccagguuuu

SEQ ID NO: 3605169 - RNA, 20 nt, Human
aguauccuccagguuuuuca

SEQ ID NO: 3605170 - RNA, 14 nt, Human
aguauccugcuucu

SEQ ID NO: 3605171 - RNA, 16 nt, Human
aguaucuaacauguau

SEQ ID NO: 3605172 - RNA, 19 nt, Human
aguaucuauauauguguau

SEQ ID NO: 3605173 - RNA, 23 nt, Human
aguaucucggaccuuucagcugu

SEQ ID NO: 3605174 - RNA, 18 nt, Human
aguaucucuucagucucu

SEQ ID NO: 3605175 - RNA, 12 nt, Human
aguaucuugaag

SEQ ID NO: 3605176 - RNA, 15 nt, Human
aguaucuugaagacu

SEQ ID NO: 3605177 - RNA, 17 nt, Human
aguaucuuugcacucca

SEQ ID NO: 3605178 - RNA, 16 nt, Human
aguaucuuuuuauuca

SEQ ID NO: 3605179 - RNA, 17 nt, Human
aguaucuuuuuucaaaa

SEQ ID NO: 3605180 - RNA, 13 nt, Human
aguaugaaucuau

SEQ ID NO: 3605181 - RNA, 15 nt, Human
aguaugaaucuaugc

SEQ ID NO: 3605182 - RNA, 17 nt, Human
aguaugaauuauucaau

SEQ ID NO: 3605183 - RNA, 14 nt, Human
aguaugagcccuaa

SEQ ID NO: 3605184 - RNA, 15 nt, Human
aguaugaggcauuug

SEQ ID NO: 3605185 - RNA, 20 nt, Human
aguaugaggcauuuguuuga

SEQ ID NO: 3605186 - RNA, 23 nt, Human
aguaugcuugaaaagauaaauua

SEQ ID NO: 3605187 - RNA, 14 nt, Human
aguauggagcucag

SEQ ID NO: 3605188 - RNA, 16 nt, Human
aguauggccuguguca

SEQ ID NO: 3605189 - RNA, 23 nt, Human
aguaugguaaucuuuaccuguau

SEQ ID NO: 3605190 - RNA, 16 nt, Human
aguaugguacauuuuu

SEQ ID NO: 3605191 - RNA, 22 nt, Human
aguaugguacauuuuucaacuu

SEQ ID NO: 3605192 - RNA, 17 nt, Human
aguaugguggcuggguu

SEQ ID NO: 3605193 - RNA, 15 nt, Human
aguauguaaaguaug

SEQ ID NO: 3605194 - RNA, 14 nt, Human
aguaugucugaugg

SEQ ID NO: 3605195 - RNA, 14 nt, Human
aguaugugccagga

SEQ ID NO: 3605196 - RNA, 17 nt, Human
aguauguggaagugugg

SEQ ID NO: 3605197 - RNA, 23 nt, Human
aguaugugggcagauuuucagca

SEQ ID NO: 3605198 - RNA, 14 nt, Human
aguauguguaaaau

SEQ ID NO: 3605199 - RNA, 16 nt, Human
aguauguuaagcucuu

SEQ ID NO: 3605200 - RNA, 21 nt, Human
aguauguucuaaccuuuacau

SEQ ID NO: 3605201 - RNA, 14 nt, Human
aguauguuuuacuu

SEQ ID NO: 3605202 - RNA, 18 nt, Human
aguauguuuuagcaugug

SEQ ID NO: 3605203 - RNA, 14 nt, Human
aguauuaaaacauu

SEQ ID NO: 3605204 - RNA, 16 nt, Human
aguauuaaaacauugg

SEQ ID NO: 3605205 - RNA, 13 nt, Human
aguauuaaaaugu

SEQ ID NO: 3605206 - RNA, 14 nt, Human
aguauuaaaaugua

SEQ ID NO: 3605207 - RNA, 19 nt, Human
aguauuaaaauguaugcau

SEQ ID NO: 3605208 - RNA, 15 nt, Human
aguauuaaaauuugg

SEQ ID NO: 3605209 - RNA, 20 nt, Human
aguauuaaaggggggagggg

SEQ ID NO: 3605210 - RNA, 17 nt, Human
aguauuacuaaauugac

SEQ ID NO: 3605211 - RNA, 21 nt, Human
aguauuagaauaccacaggaa

SEQ ID NO: 3605212 - RNA, 20 nt, Human
aguauuagacuggaaguuca

SEQ ID NO: 3605213 - RNA, 14 nt, Human
aguauuauauguac

SEQ ID NO: 3605214 - RNA, 14 nt, Human
aguauuauuuucca

SEQ ID NO: 3605215 - RNA, 14 nt, Human
aguauuccaccuua

SEQ ID NO: 3605216 - RNA, 19 nt, Human
aguauucuuauuuaaugaa

SEQ ID NO: 3605217 - RNA, 18 nt, Human
aguauucuugucaaaaaa

SEQ ID NO: 3605218 - RNA, 14 nt, Human
aguauugaagcauu

SEQ ID NO: 3605219 - RNA, 13 nt, Human
aguauugacaaaa

SEQ ID NO: 3605220 - RNA, 19 nt, Human
aguauugacaaaauguuau

SEQ ID NO: 3605221 - RNA, 12 nt, Human
aguauugcaaag

SEQ ID NO: 3605222 - RNA, 16 nt, Human
aguauugcaaagucag

SEQ ID NO: 3605223 - RNA, 22 nt, Human
aguauugcaucuguauaaguaa

SEQ ID NO: 3605224 - RNA, 17 nt, Human
aguauugccaaacauua

SEQ ID NO: 3605225 - RNA, 18 nt, Human
aguauugccaaacauuaa

SEQ ID NO: 3605226 - RNA, 22 nt, Human
aguauugccaaacauuaauguu

SEQ ID NO: 3605227 - RNA, 13 nt, Human
augcuuacugaua

SEQ ID NO: 3605228 - RNA, 22 nt, Human
augcuuacugauauauuuuaca

SEQ ID NO: 3605229 - RNA, 17 nt, Human
augcuuagauguuccag

SEQ ID NO: 3605230 - RNA, 15 nt, Human
augcuuagucacugc

SEQ ID NO: 3605231 - RNA, 23 nt, Human
augcuuagucacugccugcagag

SEQ ID NO: 3605232 - RNA, 19 nt, Human
augcuuaucaucuaaagau

SEQ ID NO: 3605233 - RNA, 10 nt, Human
augcuucaua

SEQ ID NO: 3605234 - RNA, 11 nt, Human
augcuucauac

SEQ ID NO: 3605235 - RNA, 15 nt, Human
augcuucauacaggg

SEQ ID NO: 3605236 - RNA, 20 nt, Human
augcuucaucauucccucuc

SEQ ID NO: 3605237 - RNA, 22 nt, Human
augcuucaucauucccucucau

SEQ ID NO: 3605238 - RNA, 22 nt, Human
augcuuccagaaacacccacag

SEQ ID NO: 3605239 - RNA, 16 nt, Human
augcuuccuagaaguu

SEQ ID NO: 3605240 - RNA, 16 nt, Human
augcuuccugacaauc

SEQ ID NO: 3605241 - RNA, 20 nt, Human
augcuucuaaguaaauacaa

SEQ ID NO: 3605242 - RNA, 22 nt, Human
augcuucuaaguaaauacaauu

SEQ ID NO: 3605243 - RNA, 20 nt, Human
augcuucucacugccaugcc

SEQ ID NO: 3605244 - RNA, 15 nt, Human
augcuucuucucaaa

SEQ ID NO: 3605245 - RNA, 15 nt, Human
augcuugaaaaaugu

SEQ ID NO: 3605246 - RNA, 18 nt, Human
augcuugcauaagagcuu

SEQ ID NO: 3605247 - RNA, 19 nt, Human
augcuugcauauauuucau

SEQ ID NO: 3605248 - RNA, 22 nt, Human
augcuugcggcaaaaggaaagc

SEQ ID NO: 3605249 - RNA, 12 nt, Human
augcuugggaag

SEQ ID NO: 3605250 - RNA, 23 nt, Human
augcuugggaagacuccuagcug

SEQ ID NO: 3605251 - RNA, 12 nt, Human
augcuuguacau

SEQ ID NO: 3605252 - RNA, 13 nt, Human
augcuuguacaua

SEQ ID NO: 3605253 - RNA, 14 nt, Human
augcuuguacauaa

SEQ ID NO: 3605254 - RNA, 18 nt, Human
augcuuuaccaaacagca

SEQ ID NO: 3605255 - RNA, 18 nt, Human
augcuuuagaaagguuuu

SEQ ID NO: 3605256 - RNA, 15 nt, Human
augcuuuagcuuauu

SEQ ID NO: 3605257 - RNA, 18 nt, Human
augcuuuauuuguaaauu

SEQ ID NO: 3605258 - RNA, 15 nt, Human
augcuuuccaaaccu

SEQ ID NO: 3605259 - RNA, 16 nt, Human
augcuuuccauauuuu

SEQ ID NO: 3605260 - RNA, 12 nt, Human
augcuuuccuuc

SEQ ID NO: 3605261 - RNA, 18 nt, Human
augcuuugaaacagaaaa

SEQ ID NO: 3605262 - RNA, 16 nt, Human
augcuuugcuuugucu

SEQ ID NO: 3605263 - RNA, 22 nt, Human
augcuuugugugauugaaucug

SEQ ID NO: 3605264 - RNA, 13 nt, Human
augcuuuugucua

SEQ ID NO: 3605265 - RNA, 23 nt, Human
auggaaaaaaaaaaaagaggaaa

SEQ ID NO: 3605266 - RNA, 17 nt, Human
auggaaaaauaaaacug

SEQ ID NO: 3605267 - RNA, 21 nt, Human
auggaaaacgcucucuacucu

SEQ ID NO: 3605268 - RNA, 15 nt, Human
auggaaaacuuaguu

SEQ ID NO: 3605269 - RNA, 16 nt, Human
auggaaaacuuaguuu

SEQ ID NO: 3605270 - RNA, 14 nt, Human
auggaaaagagaua

SEQ ID NO: 3605271 - RNA, 23 nt, Human
auggaaacaaaguggaaggaaag

SEQ ID NO: 3605272 - RNA, 23 nt, Human
auggaaaccugaaaaaaaguuua

SEQ ID NO: 3605273 - RNA, 16 nt, Human
auggaaacugaaacua

SEQ ID NO: 3605274 - RNA, 14 nt, Human
auggaaacugaaug

SEQ ID NO: 3605275 - RNA, 20 nt, Human
auggaaacuguugccagaga

SEQ ID NO: 3605276 - RNA, 17 nt, Human
auggaaagaaucuaaua

SEQ ID NO: 3605277 - RNA, 22 nt, Human
auggaaaggagaggaaagaacu

SEQ ID NO: 3605278 - RNA, 13 nt, Human
auggaaaggaugg

SEQ ID NO: 3605279 - RNA, 16 nt, Human
auggaaauauauauua

SEQ ID NO: 3605280 - RNA, 20 nt, Human
auggaaaugggcagagcaga

SEQ ID NO: 3605281 - RNA, 13 nt, Human
auggaaauguuua

SEQ ID NO: 3605282 - RNA, 11 nt, Human
auggaacacuc

SEQ ID NO: 3605283 - RNA, 15 nt, Human
auggaacacucugag

SEQ ID NO: 3605284 - RNA, 17 nt, Human
auggaacacucugagac

SEQ ID NO: 3605285 - RNA, 14 nt, Human
auggaacacuucga

SEQ ID NO: 3605286 - RNA, 16 nt, Human
auggaacauaaaauac

SEQ ID NO: 3605287 - RNA, 16 nt, Human
auggaaccgcaggaag

SEQ ID NO: 3605288 - RNA, 17 nt, Human
auggaaccgcaggaagc

SEQ ID NO: 3605289 - RNA, 18 nt, Human
auggaaccgcaggaagcu

SEQ ID NO: 3605290 - RNA, 18 nt, Human
auggaaccugacguagcu

SEQ ID NO: 3605291 - RNA, 23 nt, Human
auggaacgcguugaaauuguaau

SEQ ID NO: 3605292 - RNA, 14 nt, Human
auggaacuuagcca

SEQ ID NO: 3605293 - RNA, 19 nt, Human
auggaacuucuaauauauu

SEQ ID NO: 3605294 - RNA, 19 nt, Human
auggaagacaaaauguuuu

SEQ ID NO: 3605295 - RNA, 16 nt, Human
auggaagacacauuga

SEQ ID NO: 3605296 - RNA, 16 nt, Human
auggaagacagcucuu

SEQ ID NO: 3605297 - RNA, 14 nt, Human
auggaagagagaaa

SEQ ID NO: 3605298 - RNA, 19 nt, Human
auggaagaggcuacagggc

SEQ ID NO: 3605299 - RNA, 16 nt, Human
auggaagauuuuaaau

SEQ ID NO: 3605300 - RNA, 15 nt, Human
auggaauaacaugua

SEQ ID NO: 3605301 - RNA, 15 nt, Human
auggaauacaguguu

SEQ ID NO: 3605302 - RNA, 16 nt, Human
auggaauacaguguua

SEQ ID NO: 3605303 - RNA, 22 nt, Human
auggaauacaguguuauuuucu

SEQ ID NO: 3605304 - RNA, 17 nt, Human
auggaauacucuuauau

SEQ ID NO: 3605305 - RNA, 20 nt, Human
auggaaucuaccaacuguuu

SEQ ID NO: 3605306 - RNA, 13 nt, Human
auggaaugagggu

SEQ ID NO: 3605307 - RNA, 21 nt, Human
auggaaugaugggucaguugu

SEQ ID NO: 3605308 - RNA, 16 nt, Human
auggaaugguuauaaa

SEQ ID NO: 3605309 - RNA, 18 nt, Human
auggaaugguuauaaaag

SEQ ID NO: 3605310 - RNA, 20 nt, Human
auggaaugguuauaaaagug

SEQ ID NO: 3605311 - RNA, 16 nt, Human
auggaauucacaaagu

SEQ ID NO: 3605312 - RNA, 20 nt, Human
auggaauucacaaaguaauu

SEQ ID NO: 3605313 - RNA, 16 nt, Human
auggaauugauuugca

SEQ ID NO: 3605314 - RNA, 19 nt, Human
auggaauugauuugcauug

SEQ ID NO: 3605315 - RNA, 12 nt, Human
auggaauuuaua

SEQ ID NO: 3605316 - RNA, 13 nt, Human
auggacaauggac

SEQ ID NO: 3605317 - RNA, 15 nt, Human
auggacaauggaccg

SEQ ID NO: 3605318 - RNA, 22 nt, Human
auggacaccccuuauccaggac

SEQ ID NO: 3605319 - RNA, 15 nt, Human
auggacacuacaccc

SEQ ID NO: 3605320 - RNA, 13 nt, Human
auggacacuccag

SEQ ID NO: 3605321 - RNA, 17 nt, Human
auggacacuccagugcc

SEQ ID NO: 3605322 - RNA, 14 nt, Human
auggacagauuaau

SEQ ID NO: 3605323 - RNA, 18 nt, Human
auggacagcauugccagu

SEQ ID NO: 3605324 - RNA, 13 nt, Human
auguaaacugcca

SEQ ID NO: 3605325 - RNA, 17 nt, Human
auguaaagaaaugucuu

SEQ ID NO: 3605326 - RNA, 13 nt, Human
auguaaagacaaa

SEQ ID NO: 3605327 - RNA, 21 nt, Human
auguaaagauauuuuuaucuu

SEQ ID NO: 3605328 - RNA, 16 nt, Human
auguaaagcuugucug

SEQ ID NO: 3605329 - RNA, 13 nt, Human
auguaaaguaugu

SEQ ID NO: 3605330 - RNA, 17 nt, Human
auguaaaguauguaaac

SEQ ID NO: 3605331 - RNA, 13 nt, Human
auguaaauaauuc

SEQ ID NO: 3605332 - RNA, 13 nt, Human
auguaaauauuuu

SEQ ID NO: 3605333 - RNA, 23 nt, Human
auguaaauauuuuaaagaauugu

SEQ ID NO: 3605334 - RNA, 14 nt, Human
auguaaaucccauu

SEQ ID NO: 3605335 - RNA, 13 nt, Human
auguaaaugugca

SEQ ID NO: 3605336 - RNA, 23 nt, Human
auguaaauuaccaguaaagugua

SEQ ID NO: 3605337 - RNA, 23 nt, Human
auguaaauuaucaggcaaauuug

SEQ ID NO: 3605338 - RNA, 14 nt, Human
auguaaauuaugua

SEQ ID NO: 3605339 - RNA, 17 nt, Human
auguaaauuuguacuau

SEQ ID NO: 3605340 - RNA, 21 nt, Human
auguaaauuuguacuauuuaa

SEQ ID NO: 3605341 - RNA, 20 nt, Human
auguaaauuuuguaugaaaa

SEQ ID NO: 3605342 - RNA, 13 nt, Human
auguaacagaaag

SEQ ID NO: 3605343 - RNA, 14 nt, Human
auguaacagaaagg

SEQ ID NO: 3605344 - RNA, 14 nt, Human
auguaacuagaauu

SEQ ID NO: 3605345 - RNA, 20 nt, Human
auguaacugcauugagaacu

SEQ ID NO: 3605346 - RNA, 15 nt, Human
auguaacugccuaga

SEQ ID NO: 3605347 - RNA, 13 nt, Human
auguaacugcuga

SEQ ID NO: 3605348 - RNA, 22 nt, Human
auguaacuguccguaguaucag

SEQ ID NO: 3605349 - RNA, 13 nt, Human
auguaacuguuac

SEQ ID NO: 3605350 - RNA, 18 nt, Human
auguaacuguuaccauug

SEQ ID NO: 3605351 - RNA, 23 nt, Human
auguaacuguuaccauuggaaau

SEQ ID NO: 3605352 - RNA, 20 nt, Human
auguaacuuugguuaaaauc

SEQ ID NO: 3605353 - RNA, 13 nt, Human
auguaagaaucau

SEQ ID NO: 3605354 - RNA, 20 nt, Human
auguaagagcaccuuccuca

SEQ ID NO: 3605355 - RNA, 19 nt, Human
auguaagauuauagauucu

SEQ ID NO: 3605356 - RNA, 20 nt, Human
auguaagauuauagauucua

SEQ ID NO: 3605357 - RNA, 19 nt, Human
auguaagcauacuuuguaa

SEQ ID NO: 3605358 - RNA, 16 nt, Human
auguaagcugaaaaua

SEQ ID NO: 3605359 - RNA, 15 nt, Human
auguaagcuguuuau

SEQ ID NO: 3605360 - RNA, 16 nt, Human
auguaagggaaacugc

SEQ ID NO: 3605361 - RNA, 19 nt, Human
auguaagggaaacugccag

SEQ ID NO: 3605362 - RNA, 21 nt, Human
auguaagggaaacugccagca

SEQ ID NO: 3605363 - RNA, 17 nt, Human
auguaaguaaaugucug

SEQ ID NO: 3605364 - RNA, 15 nt, Human
auguaagugggccca

SEQ ID NO: 3605365 - RNA, 18 nt, Human
auguaagugggcccaccc

SEQ ID NO: 3605366 - RNA, 17 nt, Human
auguaauaacugugaag

SEQ ID NO: 3605367 - RNA, 15 nt, Human
auguaaucaauguuu

SEQ ID NO: 3605368 - RNA, 16 nt, Human
auguaaucaauguuuc

SEQ ID NO: 3605369 - RNA, 20 nt, Human
auguaaucucucugcagcug

SEQ ID NO: 3605370 - RNA, 21 nt, Human
auguaaucucucugcagcugc

SEQ ID NO: 3605371 - RNA, 23 nt, Human
auguaaucucucugcagcugccg

SEQ ID NO: 3605372 - RNA, 23 nt, Human
auguaaucugauggcuucuccag

SEQ ID NO: 3605373 - RNA, 19 nt, Human
auguaaucuugaauuguaa

SEQ ID NO: 3605374 - RNA, 20 nt, Human
auguaaugugugguggccuc

SEQ ID NO: 3605375 - RNA, 12 nt, Human
auguaauguuuu

SEQ ID NO: 3605376 - RNA, 19 nt, Human
auguaauuaaacuguuaac

SEQ ID NO: 3605377 - RNA, 17 nt, Human
auguaauuaaguacuau

SEQ ID NO: 3605378 - RNA, 12 nt, Human
auguaauuuaaa

SEQ ID NO: 3605379 - RNA, 21 nt, Human
auguaauuuaggguacuaaau

SEQ ID NO: 3605380 - RNA, 17 nt, Human
auguaauuuguguaaua

SEQ ID NO: 3605381 - RNA, 15 nt, Human
auguaauuuugugua

SEQ ID NO: 3605382 - RNA, 20 nt, Human
auguacaaaaaaaaaacccu

SEQ ID NO: 3605383 - RNA, 21 nt, Human
auguacaaaaucgauuggcuu

SEQ ID NO: 3605384 - RNA, 14 nt, Human
auguacaagaugaa

SEQ ID NO: 3605385 - RNA, 23 nt, Human
auguacaauugugggcauaaacu

SEQ ID NO: 3605386 - RNA, 13 nt, Human
auguacagacaga

SEQ ID NO: 3605387 - RNA, 19 nt, Human
auguacagacauauuuaac

SEQ ID NO: 3605388 - RNA, 20 nt, Human
auguacaggaugcuuugguu

SEQ ID NO: 3605389 - RNA, 15 nt, Human
auguacagucuguca

SEQ ID NO: 3605390 - RNA, 17 nt, Human
auguacagucugucaug

SEQ ID NO: 3605391 - RNA, 11 nt, Human
auguacagugu

SEQ ID NO: 3605392 - RNA, 14 nt, Human
auguacaguguucu

SEQ ID NO: 3605393 - RNA, 20 nt, Human
auguacaguguucuguuuaa

SEQ ID NO: 3605394 - RNA, 17 nt, Human
auguacauguacugauu

SEQ ID NO: 3605395 - RNA, 14 nt, Human
auguacauguauua

SEQ ID NO: 3605396 - RNA, 20 nt, Human
auguacauuuccaaauucac

SEQ ID NO: 3605397 - RNA, 19 nt, Human
auguacauuucugaaauga

SEQ ID NO: 3605398 - RNA, 16 nt, Human
auguacauuuggaacu

SEQ ID NO: 3605399 - RNA, 19 nt, Human
auguaccauaugaucuguu

SEQ ID NO: 3605400 - RNA, 21 nt, Human
auguaccauguacaugaagaa

SEQ ID NO: 3605401 - RNA, 16 nt, Human
auguacccaccgggcc

SEQ ID NO: 3605402 - RNA, 21 nt, Human
auguacccaccgggccacucc

SEQ ID NO: 3605403 - RNA, 14 nt, Human
auguaccuccccug

SEQ ID NO: 3605404 - RNA, 18 nt, Human
auguaccuccccugccuu

SEQ ID NO: 3605405 - RNA, 23 nt, Human
auguaccuccccugccuugcugu

SEQ ID NO: 3605406 - RNA, 21 nt, Human
auguaccucuuuuagucauuu

SEQ ID NO: 3605407 - RNA, 17 nt, Human
auguacgacuugcauac

SEQ ID NO: 3605408 - RNA, 18 nt, Human
auguacggauuuucaguu

SEQ ID NO: 3605409 - RNA, 18 nt, Human
auguacguccagccugcc

SEQ ID NO: 3605410 - RNA, 20 nt, Human
auguacguccagccugcccc

SEQ ID NO: 3605411 - RNA, 14 nt, Human
auguacguuuguau

SEQ ID NO: 3605412 - RNA, 21 nt, Human
auguacguuuguaugugugua

SEQ ID NO: 3605413 - RNA, 15 nt, Human
auguacuaguacugu

SEQ ID NO: 3605414 - RNA, 19 nt, Human
auguacuaguacuguguac

SEQ ID NO: 3605415 - RNA, 18 nt, Human
auguacuaguguucuguu

SEQ ID NO: 3605416 - RNA, 20 nt, Human
auguacuaguguucuguuug

SEQ ID NO: 3605417 - RNA, 18 nt, Human
aguccugugaaugccacu

SEQ ID NO: 3605418 - RNA, 20 nt, Human
aguccugugaaugccacugc

SEQ ID NO: 3605419 - RNA, 21 nt, Human
aguccugugaaugccacugcc

SEQ ID NO: 3605420 - RNA, 13 nt, Human
aguccugugaauu

SEQ ID NO: 3605421 - RNA, 16 nt, Human
aguccugugaauuucu

SEQ ID NO: 3605422 - RNA, 16 nt, Human
aguccuuaccagcaga

SEQ ID NO: 3605423 - RNA, 18 nt, Human
aguccuuaccagcagagc

SEQ ID NO: 3605424 - RNA, 21 nt, Human
aguccuuaccucuuccggaga

SEQ ID NO: 3605425 - RNA, 23 nt, Human
aguccuuaccucuuccggagaug

SEQ ID NO: 3605426 - RNA, 17 nt, Human
aguccuuuauguggaaa

SEQ ID NO: 3605427 - RNA, 20 nt, Human
aguccuuuuacuacagcuau

SEQ ID NO: 3605428 - RNA, 23 nt, Human
aguccuuuuacuacagcuaugaa

SEQ ID NO: 3605429 - RNA, 23 nt, Human
aguccuuuuguaaagugaagaau

SEQ ID NO: 3605430 - RNA, 21 nt, Human
aguccuuuuuuuccaucuuua

SEQ ID NO: 3605431 - RNA, 21 nt, Human
agucgaauuaauagcuuuuau

SEQ ID NO: 3605432 - RNA, 23 nt, Human
agucgauuauuuccaguguucua

SEQ ID NO: 3605433 - RNA, 19 nt, Human
agucgcaucucagugcagg

SEQ ID NO: 3605434 - RNA, 14 nt, Human
agucgcgcugccug

SEQ ID NO: 3605435 - RNA, 18 nt, Human
agucgcgcugccugugug

SEQ ID NO: 3605436 - RNA, 16 nt, Human
agucgcugaggaaaaa

SEQ ID NO: 3605437 - RNA, 18 nt, Human
agucgcugugccacaggc

SEQ ID NO: 3605438 - RNA, 20 nt, Human
agucggaacggagaaaggug

SEQ ID NO: 3605439 - RNA, 12 nt, Human
agucggauuaga

SEQ ID NO: 3605440 - RNA, 15 nt, Human
agucgggggcuggcc

SEQ ID NO: 3605441 - RNA, 20 nt, Human
agucgggggcuggccuagga

SEQ ID NO: 3605442 - RNA, 17 nt, Human
agucguccuuacuccug

SEQ ID NO: 3605443 - RNA, 20 nt, Human
agucguccuuacuccugugg

SEQ ID NO: 3605444 - RNA, 18 nt, Human
agucgucgcacagucucu

SEQ ID NO: 3605445 - RNA, 17 nt, Human
agucgugaccugcuagg

SEQ ID NO: 3605446 - RNA, 18 nt, Human
agucgugagcucuuguga

SEQ ID NO: 3605447 - RNA, 15 nt, Human
agucgugccuguguc

SEQ ID NO: 3605448 - RNA, 18 nt, Human
agucguggagaugucuuc

SEQ ID NO: 3605449 - RNA, 18 nt, Human
agucguggggugugcugg

SEQ ID NO: 3605450 - RNA, 19 nt, Human
agucguggggugugcuggg

SEQ ID NO: 3605451 - RNA, 21 nt, Human
agucguggggugugcugggag

SEQ ID NO: 3605452 - RNA, 14 nt, Human
agucguuuuccaaa

SEQ ID NO: 3605453 - RNA, 20 nt, Human
agucuaaagauggaguuucu

SEQ ID NO: 3605454 - RNA, 21 nt, Human
agucuaaagauggaguuucua

SEQ ID NO: 3605455 - RNA, 22 nt, Human
agucuaaagauggaguuucuaa

SEQ ID NO: 3605456 - RNA, 23 nt, Human
agucuaaagauggaguuucuaag

SEQ ID NO: 3605457 - RNA, 21 nt, Human
agucuaaagcugguuuaaugu

SEQ ID NO: 3605458 - RNA, 13 nt, Human
agucuaaaguuua

SEQ ID NO: 3605459 - RNA, 16 nt, Human
agucuaaauauuuccu

SEQ ID NO: 3605460 - RNA, 20 nt, Human
agucuaaauuuauuauuuaa

SEQ ID NO: 3605461 - RNA, 13 nt, Human
agucuaaccaaau

SEQ ID NO: 3605462 - RNA, 14 nt, Human
agucuaaccaaaug

SEQ ID NO: 3605463 - RNA, 21 nt, Human
agucuaagaacccauggaaaa

SEQ ID NO: 3605464 - RNA, 14 nt, Human
agucuacgcucucc

SEQ ID NO: 3605465 - RNA, 21 nt, Human
agucuacucuuaagccaucuu

SEQ ID NO: 3605466 - RNA, 16 nt, Human
agucuagacuaaaaga

SEQ ID NO: 3605467 - RNA, 18 nt, Human
agucuagauucaaagguu

SEQ ID NO: 3605468 - RNA, 20 nt, Human
agucuagauucaaagguucu

SEQ ID NO: 3605469 - RNA, 23 nt, Human
agucuagcguagugcagcagggc

SEQ ID NO: 3605470 - RNA, 20 nt, Human
agucuaggagcugggaggaa

SEQ ID NO: 3605471 - RNA, 12 nt, Human
agucuaguguag

SEQ ID NO: 3605472 - RNA, 17 nt, Human
agucuaguuccugauga

SEQ ID NO: 3605473 - RNA, 22 nt, Human
agucuaguuccugaugacccag

SEQ ID NO: 3605474 - RNA, 18 nt, Human
agucuauaugaaaaacaa

SEQ ID NO: 3605475 - RNA, 18 nt, Human
agucuaucaaucaacuua

SEQ ID NO: 3605476 - RNA, 23 nt, Human
agucuaucugguauuaaaugcca

SEQ ID NO: 3605477 - RNA, 23 nt, Human
agucuauggccagguaugcaugg

SEQ ID NO: 3605478 - RNA, 14 nt, Human
agucuauucauuau

SEQ ID NO: 3605479 - RNA, 15 nt, Human
agucuauuuacggaa

SEQ ID NO: 3605480 - RNA, 20 nt, Human
agucuauuuacggaacucaa

SEQ ID NO: 3605481 - RNA, 21 nt, Human
agucucaccauuuccccaggg

SEQ ID NO: 3605482 - RNA, 23 nt, Human
agucucaccauuuccccagggca

SEQ ID NO: 3605483 - RNA, 18 nt, Human
agucucacugcuugaacu

SEQ ID NO: 3605484 - RNA, 23 nt, Human
agucucacuguugcccaggcugg

SEQ ID NO: 3605485 - RNA, 13 nt, Human
agucucagcuaag

SEQ ID NO: 3605486 - RNA, 16 nt, Human
agucucaggaaaucaa

SEQ ID NO: 3605487 - RNA, 19 nt, Human
agucucagugaagacuaug

SEQ ID NO: 3605488 - RNA, 19 nt, Human
agucucaguggcuucaucu

SEQ ID NO: 3605489 - RNA, 20 nt, Human
agucucauagguuaaaaaaa

SEQ ID NO: 3605490 - RNA, 19 nt, Human
agucucaugccuugagauc

SEQ ID NO: 3605491 - RNA, 17 nt, Human
agucucauuacuuuuga

SEQ ID NO: 3605492 - RNA, 18 nt, Human
agucucauuacuuuugaa

SEQ ID NO: 3605493 - RNA, 14 nt, Human
agucuccaccagga

SEQ ID NO: 3605494 - RNA, 16 nt, Human
agucuccggccucucc

SEQ ID NO: 3605495 - RNA, 21 nt, Human
agucuccucuuuaaaacaaaa

SEQ ID NO: 3605496 - RNA, 14 nt, Human
agucuccuuccccu

SEQ ID NO: 3605497 - RNA, 17 nt, Human
agucuccuuugcacuga

SEQ ID NO: 3605498 - RNA, 18 nt, Human
agucuccuuugcacugag

SEQ ID NO: 3605499 - RNA, 19 nt, Human
agucuccuuugcacugagg

SEQ ID NO: 3605500 - RNA, 23 nt, Human
agucuccuuugcacugagggcca

SEQ ID NO: 3605501 - RNA, 15 nt, Human
agucucgcucuguca

SEQ ID NO: 3605502 - RNA, 21 nt, Human
agucucgcucuguugcccagg

SEQ ID NO: 3605503 - RNA, 14 nt, Human
agucucuaauucua

SEQ ID NO: 3605504 - RNA, 20 nt, Human
agucucuauaccaauaaagu

SEQ ID NO: 3605505 - RNA, 22 nt, Human
agucucuauaccaauaaaguga

SEQ ID NO: 3605506 - RNA, 18 nt, Human
agucucuaucauuaaagu

SEQ ID NO: 3605507 - RNA, 20 nt, Human
agucucuaucauuaaaguuc

SEQ ID NO: 3605508 - RNA, 12 nt, Human
agucucuauuua

SEQ ID NO: 3605509 - RNA, 20 nt, Human
agucucuauuuaaauucuuu

SEQ ID NO: 3605510 - RNA, 22 nt, Human
agucucuccuguaagccaaaga

SEQ ID NO: 3605511 - RNA, 20 nt, Human
agucucucucucucucuccc

SEQ ID NO: 3605512 - RNA, 16 nt, Human
agucucucuucucucc

SEQ ID NO: 3605513 - RNA, 18 nt, Human
agucucugaagugaaacu

SEQ ID NO: 3605514 - RNA, 21 nt, Human
agucucugagggcuuccuuug

SEQ ID NO: 3605515 - RNA, 12 nt, Human
agucucugcucc

SEQ ID NO: 3605516 - RNA, 16 nt, Human
agucucugcuggccca

SEQ ID NO: 3605517 - RNA, 17 nt, Human
agucucugcuggcccag

SEQ ID NO: 3605518 - RNA, 12 nt, Human
agucucugugaa

SEQ ID NO: 3605519 - RNA, 13 nt, Human
agucucuucucca

SEQ ID NO: 3605520 - RNA, 19 nt, Human
agucucuucuccacuggau

SEQ ID NO: 3605521 - RNA, 21 nt, Human
agucucuucuccacuggaugg

SEQ ID NO: 3605522 - RNA, 17 nt, Human
agucucuuuaaucuuca

SEQ ID NO: 3605523 - RNA, 21 nt, Human
agucucuuuaaucuucaguuu

SEQ ID NO: 3605524 - RNA, 15 nt, Human
agucucuuuucuuua

SEQ ID NO: 3605525 - RNA, 18 nt, Human
agucucuuuuuuacaaag

SEQ ID NO: 3605526 - RNA, 20 nt, Human
agucucuuuuuuuggcccag

SEQ ID NO: 3605527 - RNA, 18 nt, Human
agucugaacagcuguaau

SEQ ID NO: 3605528 - RNA, 20 nt, Human
agucugaaccuauuucuuaa

SEQ ID NO: 3605529 - RNA, 21 nt, Human
agucugaagcagaugcaaaga

SEQ ID NO: 3605530 - RNA, 23 nt, Human
agucugacuuccccgcauuccag

SEQ ID NO: 3605531 - RNA, 23 nt, Human
agucugagagaggccauucuuuc

SEQ ID NO: 3605532 - RNA, 14 nt, Human
agucugagguccug

SEQ ID NO: 3605533 - RNA, 16 nt, Human
agucugagguccugag

SEQ ID NO: 3605534 - RNA, 18 nt, Human
agucugagguccugagca

SEQ ID NO: 3605535 - RNA, 20 nt, Human
agucugagguccugagcacu

SEQ ID NO: 3605536 - RNA, 22 nt, Human
agucugauucccaagcucugcu

SEQ ID NO: 3605537 - RNA, 22 nt, Human
agucugcaaaaugaggaaugua

SEQ ID NO: 3605538 - RNA, 23 nt, Human
agucugcacaugcagcugcaccc

SEQ ID NO: 3605539 - RNA, 14 nt, Human
agucugcauauauu

SEQ ID NO: 3605540 - RNA, 19 nt, Human
agucugccuauccuggcca

SEQ ID NO: 3605541 - RNA, 16 nt, Human
agucugcuauauuuuc

SEQ ID NO: 3605542 - RNA, 17 nt, Human
agucugcuauauuuuca

SEQ ID NO: 3605543 - RNA, 15 nt, Human
agucugcugcccucc

SEQ ID NO: 3605544 - RNA, 16 nt, Human
agucugcugcccucca

SEQ ID NO: 3605545 - RNA, 18 nt, Human
agucuggaaugcaguggu

SEQ ID NO: 3605546 - RNA, 13 nt, Human
agucuggaggggc

SEQ ID NO: 3605547 - RNA, 13 nt, Human
agucuggaguggg

SEQ ID NO: 3605548 - RNA, 20 nt, Human
agucuggauaacuuccacag

SEQ ID NO: 3605549 - RNA, 17 nt, Human
agucuggaucugggacc

SEQ ID NO: 3605550 - RNA, 15 nt, Human
agucuggccaacauc

SEQ ID NO: 3605551 - RNA, 17 nt, Human
agucuggcugagcccug

SEQ ID NO: 3605552 - RNA, 21 nt, Human
agucuguauuuuuaaagcaug

SEQ ID NO: 3605553 - RNA, 13 nt, Human
agucugucaugaa

SEQ ID NO: 3605554 - RNA, 12 nt, Human
agucuguccuug

SEQ ID NO: 3605555 - RNA, 14 nt, Human
agucugucucuguc

SEQ ID NO: 3605556 - RNA, 17 nt, Human
agucugucuucuguaua

SEQ ID NO: 3605557 - RNA, 18 nt, Human
agucugucuucuguauau

SEQ ID NO: 3605558 - RNA, 20 nt, Human
agucugucuucuguauauaa

SEQ ID NO: 3605559 - RNA, 22 nt, Human
agucugucuucuguauauaaau

SEQ ID NO: 3605560 - RNA, 14 nt, Human
agucuguggaucag

SEQ ID NO: 3605561 - RNA, 11 nt, Human
agucuguguga

SEQ ID NO: 3605562 - RNA, 15 nt, Human
agucugugugaaggu

SEQ ID NO: 3605563 - RNA, 18 nt, Human
agucugugugaugaacuu

SEQ ID NO: 3605564 - RNA, 22 nt, Human
agucugugugaugaacuuucuc

SEQ ID NO: 3605565 - RNA, 17 nt, Human
auguuaaagagaaugag

SEQ ID NO: 3605566 - RNA, 15 nt, Human
auguuaaagauguag

SEQ ID NO: 3605567 - RNA, 18 nt, Human
auguuaaagauguagcaa

SEQ ID NO: 3605568 - RNA, 20 nt, Human
auguuaaagauguagcaaac

SEQ ID NO: 3605569 - RNA, 13 nt, Human
auguuaaauaaau

SEQ ID NO: 3605570 - RNA, 14 nt, Human
auguuaaauaaauu

SEQ ID NO: 3605571 - RNA, 16 nt, Human
auguuaaauaaauugu

SEQ ID NO: 3605572 - RNA, 19 nt, Human
auguuaaauaaauuguaua

SEQ ID NO: 3605573 - RNA, 20 nt, Human
auguuaaaucccauucauaa

SEQ ID NO: 3605574 - RNA, 12 nt, Human
auguuaaauuug

SEQ ID NO: 3605575 - RNA, 15 nt, Human
auguuaaauuuguaa

SEQ ID NO: 3605576 - RNA, 17 nt, Human
auguuaaauuuguaagu

SEQ ID NO: 3605577 - RNA, 18 nt, Human
auguuaaauuuguaaguu

SEQ ID NO: 3605578 - RNA, 20 nt, Human
auguuaaauuuguaaguuuc

SEQ ID NO: 3605579 - RNA, 18 nt, Human
auguuaacaaugccuauu

SEQ ID NO: 3605580 - RNA, 12 nt, Human
auguuaacacau

SEQ ID NO: 3605581 - RNA, 16 nt, Human
auguuaacacauuuug

SEQ ID NO: 3605582 - RNA, 18 nt, Human
auguuaaccucaguguca

SEQ ID NO: 3605583 - RNA, 16 nt, Human
auguuaaccucugcuu

SEQ ID NO: 3605584 - RNA, 12 nt, Human
auguuaagcaga

SEQ ID NO: 3605585 - RNA, 13 nt, Human
auguuaagcucuu

SEQ ID NO: 3605586 - RNA, 18 nt, Human
auguuaaggaaacucuua

SEQ ID NO: 3605587 - RNA, 19 nt, Human
auguuaaggaaacucuuau

SEQ ID NO: 3605588 - RNA, 23 nt, Human
auguuaaggaaacucuuaucuca

SEQ ID NO: 3605589 - RNA, 20 nt, Human
auguuaagggaagaauucca

SEQ ID NO: 3605590 - RNA, 17 nt, Human
auguuaaguuacuucac

SEQ ID NO: 3605591 - RNA, 23 nt, Human
auguuaaguuacuucacuuuaau

SEQ ID NO: 3605592 - RNA, 13 nt, Human
auguuaauauuuu

SEQ ID NO: 3605593 - RNA, 23 nt, Human
auguuaauucagcacugauuuca

SEQ ID NO: 3605594 - RNA, 17 nt, Human
auguuaauuuuuuggua

SEQ ID NO: 3605595 - RNA, 20 nt, Human
auguuaauuuuuugguacaa

SEQ ID NO: 3605596 - RNA, 19 nt, Human
auguuacaaaaauaaacua

SEQ ID NO: 3605597 - RNA, 17 nt, Human
auguuacacuaagggug

SEQ ID NO: 3605598 - RNA, 20 nt, Human
auguuacagaaucuaacugg

SEQ ID NO: 3605599 - RNA, 20 nt, Human
auguuacauaagauaaaugu

SEQ ID NO: 3605600 - RNA, 14 nt, Human
auguuacauuguuu

SEQ ID NO: 3605601 - RNA, 21 nt, Human
auguuaccuccuauaaacuua

SEQ ID NO: 3605602 - RNA, 13 nt, Human
auguuacugacca

SEQ ID NO: 3605603 - RNA, 20 nt, Human
auguuacugaucaugcauug

SEQ ID NO: 3605604 - RNA, 14 nt, Human
auguuacugccuua

SEQ ID NO: 3605605 - RNA, 12 nt, Human
auguuagagcac

SEQ ID NO: 3605606 - RNA, 23 nt, Human
auguuagaggaucccucucugga

SEQ ID NO: 3605607 - RNA, 16 nt, Human
auguuagagguuuuaa

SEQ ID NO: 3605608 - RNA, 21 nt, Human
auguuagagguuuuaaaguga

SEQ ID NO: 3605609 - RNA, 15 nt, Human
auguuagcaaagagu

SEQ ID NO: 3605610 - RNA, 12 nt, Human
auguuagccagg

SEQ ID NO: 3605611 - RNA, 19 nt, Human
auguuaggaaaauuucaca

SEQ ID NO: 3605612 - RNA, 15 nt, Human
auguuaggcugggcc

SEQ ID NO: 3605613 - RNA, 15 nt, Human
auguuaguaauaccu

SEQ ID NO: 3605614 - RNA, 21 nt, Human
auguuaguaauaccucuaaua

SEQ ID NO: 3605615 - RNA, 15 nt, Human
auguuagucauuguu

SEQ ID NO: 3605616 - RNA, 18 nt, Human
auguuaguguuuuaagaa

SEQ ID NO: 3605617 - RNA, 22 nt, Human
auguuaguguuuuaagaaaugu

SEQ ID NO: 3605618 - RNA, 21 nt, Human
auguuaguuaccuuauaguua

SEQ ID NO: 3605619 - RNA, 22 nt, Human
auguuauacaaccuucauuuaa

SEQ ID NO: 3605620 - RNA, 15 nt, Human
auguuauagaacuuc

SEQ ID NO: 3605621 - RNA, 17 nt, Human
auguuauauauaaauau

SEQ ID NO: 3605622 - RNA, 18 nt, Human
auguuauauauaaauaua

SEQ ID NO: 3605623 - RNA, 13 nt, Human
auguuauauuuaa

SEQ ID NO: 3605624 - RNA, 22 nt, Human
auguuauauuuaaugcauuaaa

SEQ ID NO: 3605625 - RNA, 14 nt, Human
auguuauauuuuuc

SEQ ID NO: 3605626 - RNA, 16 nt, Human
auguuaucuucucaag

SEQ ID NO: 3605627 - RNA, 22 nt, Human
auguuaucuucucaaguucuaa

SEQ ID NO: 3605628 - RNA, 23 nt, Human
auguuaucuugguguguuaagag

SEQ ID NO: 3605629 - RNA, 24 nt, Human
auguuaugacuauguaaacuacuu

SEQ ID NO: 3605630 - RNA, 23 nt, Human
auguuaugauaaaaaauuuugua

SEQ ID NO: 3605631 - RNA, 18 nt, Human
auguuaugcccagcguuu

SEQ ID NO: 3605632 - RNA, 13 nt, Human
auguuauguauau

SEQ ID NO: 3605633 - RNA, 16 nt, Human
auguuauguauauggu

SEQ ID NO: 3605634 - RNA, 16 nt, Human
auguuauguuuaauaa

SEQ ID NO: 3605635 - RNA, 22 nt, Human
auguuauugaaaaaaauuggca

SEQ ID NO: 3605636 - RNA, 15 nt, Human
auguuauugcauaau

SEQ ID NO: 3605637 - RNA, 13 nt, Human
auguuauuuaaca

SEQ ID NO: 3605638 - RNA, 12 nt, Human
auguuauuuaua

SEQ ID NO: 3605639 - RNA, 20 nt, Human
auguuauuuguuauuuucag

SEQ ID NO: 3605640 - RNA, 18 nt, Human
auguuauuuucuguugaa

SEQ ID NO: 3605641 - RNA, 21 nt, Human
auguuauuuucuguugaaguu

SEQ ID NO: 3605642 - RNA, 19 nt, Human
auguuauuuucuucuaagu

SEQ ID NO: 3605643 - RNA, 17 nt, Human
auguuauuuuuuaauua

SEQ ID NO: 3605644 - RNA, 14 nt, Human
auguucaaagucaa

SEQ ID NO: 3605645 - RNA, 17 nt, Human
auguucacgcaacuuga

SEQ ID NO: 3605646 - RNA, 17 nt, Human
auguucagaagaaauuc

SEQ ID NO: 3605647 - RNA, 14 nt, Human
auguucaguguaau

SEQ ID NO: 3605648 - RNA, 21 nt, Human
auguucaguguaauuucuuug

SEQ ID NO: 3605649 - RNA, 18 nt, Human
auguucaucaaugaauga

SEQ ID NO: 3605650 - RNA, 19 nt, Human
auguucaucaaugaaugaa

SEQ ID NO: 3605651 - RNA, 19 nt, Human
auguucaucccaugaugua

SEQ ID NO: 3605652 - RNA, 21 nt, Human
auguucauuguaauguuacug

SEQ ID NO: 3605653 - RNA, 14 nt, Human
auguuccauuaaac

SEQ ID NO: 3605654 - RNA, 15 nt, Human
auguuccauuaaacg

SEQ ID NO: 3605655 - RNA, 15 nt, Human
auguucccacuucaa

SEQ ID NO: 3605656 - RNA, 15 nt, Human
auguuccuagugaaa

SEQ ID NO: 3605657 - RNA, 17 nt, Human
auguuccuagugaaaga

SEQ ID NO: 3605658 - RNA, 23 nt, Human
auguuccugaauucuauuugcug

SEQ ID NO: 3605659 - RNA, 21 nt, Human
auguucgguuuuuuuccuguu

SEQ ID NO: 3605660 - RNA, 18 nt, Human
auguucuaaggcucugag

SEQ ID NO: 3605661 - RNA, 12 nt, Human
auguucuaaguu

SEQ ID NO: 3605662 - RNA, 15 nt, Human
auguucuaaguuucu

SEQ ID NO: 3605663 - RNA, 16 nt, Human
auguucuaaguuucua

SEQ ID NO: 3605664 - RNA, 20 nt, Human
auguucuaaguuucuaagau

SEQ ID NO: 3605665 - RNA, 20 nt, Human
auguucucuaucauuuaaua

SEQ ID NO: 3605666 - RNA, 16 nt, Human
auguucucucuucucc

SEQ ID NO: 3605667 - RNA, 16 nt, Human
auguucugaauaauuu

SEQ ID NO: 3605668 - RNA, 15 nt, Human
auguucugacauuaa

SEQ ID NO: 3605669 - RNA, 19 nt, Human
auguucugacauuaacagu

SEQ ID NO: 3605670 - RNA, 16 nt, Human
auguucugcccccagc

SEQ ID NO: 3605671 - RNA, 20 nt, Human
auguucugcccccagcccaa

SEQ ID NO: 3605672 - RNA, 11 nt, Human
auguucuggga

SEQ ID NO: 3605673 - RNA, 14 nt, Human
auguucugucccuu

SEQ ID NO: 3605674 - RNA, 21 nt, Human
auguucugugccuguaaacau

SEQ ID NO: 3605675 - RNA, 13 nt, Human
auguucuguuugc

SEQ ID NO: 3605676 - RNA, 17 nt, Human
auguucuguuugcugug

SEQ ID NO: 3605677 - RNA, 14 nt, Human
auguucuuaauucu

SEQ ID NO: 3605678 - RNA, 20 nt, Human
auguucuuaguggauguucu

SEQ ID NO: 3605679 - RNA, 20 nt, Human
auguucuuaugcaaaaugga

SEQ ID NO: 3605680 - RNA, 19 nt, Human
auguucuugcagucaucag

SEQ ID NO: 3605681 - RNA, 12 nt, Human
auguugaaagau

SEQ ID NO: 3605682 - RNA, 18 nt, Human
auguugaaagaucaaaag

SEQ ID NO: 3605683 - RNA, 22 nt, Human
auguugaaauaugauguuaaaa

SEQ ID NO: 3605684 - RNA, 15 nt, Human
auguugaagccuuug

SEQ ID NO: 3605685 - RNA, 14 nt, Human
auguugaauacuuu

SEQ ID NO: 3605686 - RNA, 14 nt, Human
auguugaauucuuu

SEQ ID NO: 3605687 - RNA, 19 nt, Human
auguugacaucacuggcau

SEQ ID NO: 3605688 - RNA, 15 nt, Human
auguugacaugggac

SEQ ID NO: 3605689 - RNA, 16 nt, Human
auguugacauuuguuu

SEQ ID NO: 3605690 - RNA, 16 nt, Human
auguugaccaugucua

SEQ ID NO: 3605691 - RNA, 19 nt, Human
auguugaccaugucuauga

SEQ ID NO: 3605692 - RNA, 23 nt, Human
auguugauccauccagcuugcca

SEQ ID NO: 3605693 - RNA, 21 nt, Human
auguugaugcaauccuuacaa

SEQ ID NO: 3605694 - RNA, 22 nt, Human
auguugaugcaauccuuacaaa

SEQ ID NO: 3605695 - RNA, 18 nt, Human
auguugauuacagugcag

SEQ ID NO: 3605696 - RNA, 13 nt, Human
auguugauuucua

SEQ ID NO: 3605697 - RNA, 20 nt, Human
auguugauuuuuacuguguu

SEQ ID NO: 3605698 - RNA, 23 nt, Human
auguugauuuuuacuguguuuua

SEQ ID NO: 3605699 - RNA, 16 nt, Human
auguugccaaaauggu

SEQ ID NO: 3605700 - RNA, 22 nt, Human
auguugccaguuuaaucauugc

SEQ ID NO: 3605701 - RNA, 16 nt, Human
auguugcccaggcagg

SEQ ID NO: 3605702 - RNA, 17 nt, Human
auguugcuauaauaaag

SEQ ID NO: 3605703 - RNA, 19 nt, Human
auguugcucagucucccuu

SEQ ID NO: 3605704 - RNA, 15 nt, Human
auguugcuggacugu

SEQ ID NO: 3605705 - RNA, 15 nt, Human
auguugcuggaucag

SEQ ID NO: 3605706 - RNA, 20 nt, Human
auguugcugugcacggugga

SEQ ID NO: 3605707 - RNA, 17 nt, Human
auguuggacaccuuuag

SEQ ID NO: 3605708 - RNA, 22 nt, Human
auguuggacaccuuuagguucu

SEQ ID NO: 3605709 - RNA, 16 nt, Human
auguuggauuuauaaa

SEQ ID NO: 3605710 - RNA, 20 nt, Human
auguuggcagaugcagcucu

SEQ ID NO: 3605711 - RNA, 14 nt, Human
auguuggccaggcu

SEQ ID NO: 3605712 - RNA, 15 nt, Human
auguuggccaggcug

SEQ ID NO: 3605713 - RNA, 21 nt, Human
auguuggccaggcugcucuca

SEQ ID NO: 3605714 - RNA, 21 nt, Human
auguacuaguuuuaguuuucu

SEQ ID NO: 3605715 - RNA, 17 nt, Human
auguacuauaacauaga

SEQ ID NO: 3605716 - RNA, 15 nt, Human
auguacugcauuauu

SEQ ID NO: 3605717 - RNA, 20 nt, Human
auguacugcauuauuugaga

SEQ ID NO: 3605718 - RNA, 13 nt, Human
auguacuguacua

SEQ ID NO: 3605719 - RNA, 14 nt, Human
auguacuguacuaa

SEQ ID NO: 3605720 - RNA, 19 nt, Human
auguacuguaguuuuucuu

SEQ ID NO: 3605721 - RNA, 14 nt, Human
auguacuuuuuagu

SEQ ID NO: 3605722 - RNA, 15 nt, Human
auguagagaaaagca

SEQ ID NO: 3605723 - RNA, 19 nt, Human
auguagaggagaaacugga

SEQ ID NO: 3605724 - RNA, 19 nt, Human
auguagaggggaaaagaga

SEQ ID NO: 3605725 - RNA, 22 nt, Human
auguagauauugugaaguacau

SEQ ID NO: 3605726 - RNA, 16 nt, Human
auguagauauuuggcu

SEQ ID NO: 3605727 - RNA, 17 nt, Human
auguagaugugcauuuu

SEQ ID NO: 3605728 - RNA, 22 nt, Human
auguagauuaaggugaugugau

SEQ ID NO: 3605729 - RNA, 17 nt, Human
auguagcaaaacgcaug

SEQ ID NO: 3605730 - RNA, 15 nt, Human
auguagcacauaaac

SEQ ID NO: 3605731 - RNA, 14 nt, Human
auguagcagugagu

SEQ ID NO: 3605732 - RNA, 19 nt, Human
auguagcccccuggccucu

SEQ ID NO: 3605733 - RNA, 23 nt, Human
auguagcccccuggccucugugc

SEQ ID NO: 3605734 - RNA, 16 nt, Human
auguagccuuuacugu

SEQ ID NO: 3605735 - RNA, 19 nt, Human
auguagcgcuuugaauaug

SEQ ID NO: 3605736 - RNA, 13 nt, Human
auguagcguguuu

SEQ ID NO: 3605737 - RNA, 21 nt, Human
auguagcucuuugucagggag

SEQ ID NO: 3605738 - RNA, 19 nt, Human
auguagcuucagucauuaa

SEQ ID NO: 3605739 - RNA, 20 nt, Human
auguagcuucagucauuaaa

SEQ ID NO: 3605740 - RNA, 17 nt, Human
auguaggaaaaaaauag

SEQ ID NO: 3605741 - RNA, 22 nt, Human
auguaggaaagaccauuuuucc

SEQ ID NO: 3605742 - RNA, 17 nt, Human
auguaggcauucuggag

SEQ ID NO: 3605743 - RNA, 20 nt, Human
auguagggcauaaugaugau

SEQ ID NO: 3605744 - RNA, 18 nt, Human
auguagguaagacuguag

SEQ ID NO: 3605745 - RNA, 19 nt, Human
auguagguaagacuguaga

SEQ ID NO: 3605746 - RNA, 17 nt, Human
auguagguaugaauaag

SEQ ID NO: 3605747 - RNA, 15 nt, Human
auguaggugucugca

SEQ ID NO: 3605748 - RNA, 14 nt, Human
auguaguaacacua

SEQ ID NO: 3605749 - RNA, 16 nt, Human
auguaguaacacuaau

SEQ ID NO: 3605750 - RNA, 17 nt, Human
auguaguaauugacaug

SEQ ID NO: 3605751 - RNA, 16 nt, Human
auguaguauaaagaaa

SEQ ID NO: 3605752 - RNA, 17 nt, Human
auguaguauaaagaaaa

SEQ ID NO: 3605753 - RNA, 21 nt, Human
auguaguaucaaauauuagau

SEQ ID NO: 3605754 - RNA, 19 nt, Human
auguaguaucuauaugacu

SEQ ID NO: 3605755 - RNA, 18 nt, Human
auguagugccgcucuugg

SEQ ID NO: 3605756 - RNA, 14 nt, Human
auguaguucauacu

SEQ ID NO: 3605757 - RNA, 20 nt, Human
auguaguuugaggaaauuug

SEQ ID NO: 3605758 - RNA, 20 nt, Human
auguaguuuuuauauguugu

SEQ ID NO: 3605759 - RNA, 20 nt, Human
auguauaaaauacauaguga

SEQ ID NO: 3605760 - RNA, 14 nt, Human
auguauaaauauac

SEQ ID NO: 3605761 - RNA, 19 nt, Human
auguauacuauaguaccag

SEQ ID NO: 3605762 - RNA, 21 nt, Human
auguauacugccacuaaccuu

SEQ ID NO: 3605763 - RNA, 16 nt, Human
auguauaguauuugaa

SEQ ID NO: 3605764 - RNA, 16 nt, Human
auguauaguuuucccu

SEQ ID NO: 3605765 - RNA, 15 nt, Human
auguauauaaaaaug

SEQ ID NO: 3605766 - RNA, 13 nt, Human
auguauauacaca

SEQ ID NO: 3605767 - RNA, 19 nt, Human
auguauauauauauaugca

SEQ ID NO: 3605768 - RNA, 12 nt, Human
auguauauauuu

SEQ ID NO: 3605769 - RNA, 14 nt, Human
auguauauauuuag

SEQ ID NO: 3605770 - RNA, 17 nt, Human
auguauauauuuagugc

SEQ ID NO: 3605771 - RNA, 19 nt, Human
auguauauuuaaaagaaag

SEQ ID NO: 3605772 - RNA, 18 nt, Human
auguauauuuuauauaaa

SEQ ID NO: 3605773 - RNA, 19 nt, Human
auguauauuuuauaucaau

SEQ ID NO: 3605774 - RNA, 21 nt, Human
auguaucauaauuaccaagug

SEQ ID NO: 3605775 - RNA, 20 nt, Human
auguauccaugggggcaggg

SEQ ID NO: 3605776 - RNA, 19 nt, Human
auguaucgggaagauuucu

SEQ ID NO: 3605777 - RNA, 16 nt, Human
auguaucuaagaauaa

SEQ ID NO: 3605778 - RNA, 15 nt, Human
auguaucugagcagg

SEQ ID NO: 3605779 - RNA, 17 nt, Human
auguaucugaguugcca

SEQ ID NO: 3605780 - RNA, 14 nt, Human
auguaucugugaag

SEQ ID NO: 3605781 - RNA, 14 nt, Human
auguaugauuacau

SEQ ID NO: 3605782 - RNA, 14 nt, Human
auguaugcagcuau

SEQ ID NO: 3605783 - RNA, 17 nt, Human
auguaugcauaauaauc

SEQ ID NO: 3605784 - RNA, 14 nt, Human
auguaugcauucac

SEQ ID NO: 3605785 - RNA, 21 nt, Human
auguauggaauacaguguuau

SEQ ID NO: 3605786 - RNA, 16 nt, Human
auguaugugcacuguc

SEQ ID NO: 3605787 - RNA, 12 nt, Human
auguauguguaa

SEQ ID NO: 3605788 - RNA, 15 nt, Human
auguauguguguaug

SEQ ID NO: 3605789 - RNA, 14 nt, Human
auguauguguuuag

SEQ ID NO: 3605790 - RNA, 20 nt, Human
auguauguguuuagaauuga

SEQ ID NO: 3605791 - RNA, 20 nt, Human
auguauguuuacacugucaa

SEQ ID NO: 3605792 - RNA, 18 nt, Human
auguauguuuacauauca

SEQ ID NO: 3605793 - RNA, 16 nt, Human
auguauuaaauuacau

SEQ ID NO: 3605794 - RNA, 23 nt, Human
auguauuaacacuacucaaagca

SEQ ID NO: 3605795 - RNA, 21 nt, Human
auguauuaagcccacaguaua

SEQ ID NO: 3605796 - RNA, 23 nt, Human
auguauuaagcccacaguauauu

SEQ ID NO: 3605797 - RNA, 21 nt, Human
auguauuaauaaauagagcaa

SEQ ID NO: 3605798 - RNA, 16 nt, Human
auguauuaauauucau

SEQ ID NO: 3605799 - RNA, 19 nt, Human
auguauuagugauauuucu

SEQ ID NO: 3605800 - RNA, 21 nt, Human
auguauuagugauauuucucu

SEQ ID NO: 3605801 - RNA, 22 nt, Human
auguauuagugauauuucucua

SEQ ID NO: 3605802 - RNA, 13 nt, Human
auguauuauucug

SEQ ID NO: 3605803 - RNA, 16 nt, Human
auguauuauucugcag

SEQ ID NO: 3605804 - RNA, 17 nt, Human
auguauuauuuauaauu

SEQ ID NO: 3605805 - RNA, 15 nt, Human
auguauuauuucauu

SEQ ID NO: 3605806 - RNA, 22 nt, Human
auguauuauuucauuauguaaa

SEQ ID NO: 3605807 - RNA, 17 nt, Human
auguauugcacauugua

SEQ ID NO: 3605808 - RNA, 13 nt, Human
auguauuggccug

SEQ ID NO: 3605809 - RNA, 21 nt, Human
auguauuguaaacauguguuu

SEQ ID NO: 3605810 - RNA, 15 nt, Human
auguauuguaccuuu

SEQ ID NO: 3605811 - RNA, 21 nt, Human
auguauuuaccaaaaauuuug

SEQ ID NO: 3605812 - RNA, 17 nt, Human
auguauuuauaaauaua

SEQ ID NO: 3605813 - RNA, 13 nt, Human
auguauuuaugua

SEQ ID NO: 3605814 - RNA, 19 nt, Human
auguauuuauuuaaaagau

SEQ ID NO: 3605815 - RNA, 21 nt, Human
auguauuuauuuaaaagauuc

SEQ ID NO: 3605816 - RNA, 22 nt, Human
auguauuuauuuaaaagauuca

SEQ ID NO: 3605817 - RNA, 13 nt, Human
auguauuuguagu

SEQ ID NO: 3605818 - RNA, 19 nt, Human
auguauuuguaguguuauu

SEQ ID NO: 3605819 - RNA, 21 nt, Human
auguauuuguaguguuauugc

SEQ ID NO: 3605820 - RNA, 18 nt, Human
auguauuuguucauguuu

SEQ ID NO: 3605821 - RNA, 14 nt, Human
auguauuuguuugc

SEQ ID NO: 3605822 - RNA, 18 nt, Human
auguauuuuauguuauau

SEQ ID NO: 3605823 - RNA, 23 nt, Human
auguauuuucuucaccucugcua

SEQ ID NO: 3605824 - RNA, 14 nt, Human
auguauuuugugag

SEQ ID NO: 3605825 - RNA, 17 nt, Human
auguauuuugugaguuu

SEQ ID NO: 3605826 - RNA, 15 nt, Human
auguauuuuucuaca

SEQ ID NO: 3605827 - RNA, 17 nt, Human
auguauuuuuguacccu

SEQ ID NO: 3605828 - RNA, 15 nt, Human
augucaaaaguagaa

SEQ ID NO: 3605829 - RNA, 17 nt, Human
augucaaaaguagaacu

SEQ ID NO: 3605830 - RNA, 23 nt, Human
augucaaaaguagaacuuuguau

SEQ ID NO: 3605831 - RNA, 17 nt, Human
augucaaaauuguuuaa

SEQ ID NO: 3605832 - RNA, 20 nt, Human
augucaaagagaaaacuuau

SEQ ID NO: 3605833 - RNA, 23 nt, Human
augucaaauauuuagauguaauu

SEQ ID NO: 3605834 - RNA, 14 nt, Human
augucaaaugugaa

SEQ ID NO: 3605835 - RNA, 15 nt, Human
augucaagaggcuga

SEQ ID NO: 3605836 - RNA, 15 nt, Human
augucaagauucagc

SEQ ID NO: 3605837 - RNA, 16 nt, Human
augucaagauucagcu

SEQ ID NO: 3605838 - RNA, 23 nt, Human
augucaagggcagcuuugcucau

SEQ ID NO: 3605839 - RNA, 22 nt, Human
augucaaggguucaagauuguu

SEQ ID NO: 3605840 - RNA, 20 nt, Human
augucaaggugcuguuguca

SEQ ID NO: 3605841 - RNA, 21 nt, Human
augucaaggugcuguugucau

SEQ ID NO: 3605842 - RNA, 23 nt, Human
augucaauaaacaacagcugaag

SEQ ID NO: 3605843 - RNA, 21 nt, Human
augucaaucagccuaguugau

SEQ ID NO: 3605844 - RNA, 14 nt, Human
augucacaggcagg

SEQ ID NO: 3605845 - RNA, 16 nt, Human
augucacaggcagguc

SEQ ID NO: 3605846 - RNA, 17 nt, Human
augucacaggcaggucc

SEQ ID NO: 3605847 - RNA, 15 nt, Human
augucaccaccuucc

SEQ ID NO: 3605848 - RNA, 16 nt, Human
augucaccaccuuccc

SEQ ID NO: 3605849 - RNA, 16 nt, Human
augucacguacugucu

SEQ ID NO: 3605850 - RNA, 21 nt, Human
augucacguacugucugauug

SEQ ID NO: 3605851 - RNA, 22 nt, Human
augucacuaaagcaggccuuuu

SEQ ID NO: 3605852 - RNA, 18 nt, Human
augucacuucuggauaua

SEQ ID NO: 3605853 - RNA, 15 nt, Human
augucagacacagau

SEQ ID NO: 3605854 - RNA, 16 nt, Human
augucagauacaaugu

SEQ ID NO: 3605855 - RNA, 18 nt, Human
augucagauacaauguau

SEQ ID NO: 3605856 - RNA, 14 nt, Human
augucagauuccuu

SEQ ID NO: 3605857 - RNA, 15 nt, Human
augucagauuccuuu

SEQ ID NO: 3605858 - RNA, 16 nt, Human
augucagauuccuuuc

SEQ ID NO: 3605859 - RNA, 16 nt, Human
augucagcaaaaagca

SEQ ID NO: 3605860 - RNA, 16 nt, Human
augucagcaguugcug

SEQ ID NO: 3605861 - RNA, 23 nt, Human
augucagccgagccgggccuggg

SEQ ID NO: 3605862 - RNA, 17 nt, Human
augucaggaacagaagg

SEQ ID NO: 3605863 - RNA, 19 nt, Human
auguuggccaggcuggucu

SEQ ID NO: 3605864 - RNA, 15 nt, Human
auguugguauuuauc

SEQ ID NO: 3605865 - RNA, 16 nt, Human
auguuggucaggcugg

SEQ ID NO: 3605866 - RNA, 18 nt, Human
auguuggucauuuuaugu

SEQ ID NO: 3605867 - RNA, 14 nt, Human
auguugguuuacuu

SEQ ID NO: 3605868 - RNA, 16 nt, Human
auguugguuuacuuuc

SEQ ID NO: 3605869 - RNA, 22 nt, Human
auguuguaaauuaggaggcuca

SEQ ID NO: 3605870 - RNA, 11 nt, Human
auguuguacaa

SEQ ID NO: 3605871 - RNA, 15 nt, Human
auguuguacaaugua

SEQ ID NO: 3605872 - RNA, 21 nt, Human
auguuguagauacaaucagcu

SEQ ID NO: 3605873 - RNA, 13 nt, Human
auguugucaaaga

SEQ ID NO: 3605874 - RNA, 15 nt, Human
auguugucaaagaga

SEQ ID NO: 3605875 - RNA, 13 nt, Human
auguugucuaaga

SEQ ID NO: 3605876 - RNA, 16 nt, Human
auguugucuaagaaau

SEQ ID NO: 3605877 - RNA, 12 nt, Human
auguugugaaua

SEQ ID NO: 3605878 - RNA, 18 nt, Human
auguugugccucccuggu

SEQ ID NO: 3605879 - RNA, 16 nt, Human
auguuguguucuaaua

SEQ ID NO: 3605880 - RNA, 22 nt, Human
auguuguguuucuguucaccuu

SEQ ID NO: 3605881 - RNA, 15 nt, Human
auguuguguuuuuaa

SEQ ID NO: 3605882 - RNA, 23 nt, Human
auguuguuagagaaaaaugcuuu

SEQ ID NO: 3605883 - RNA, 16 nt, Human
auguuguuaugcuauu

SEQ ID NO: 3605884 - RNA, 16 nt, Human
auguuuaaaaaaguuu

SEQ ID NO: 3605885 - RNA, 14 nt, Human
auguuuaaaacacc

SEQ ID NO: 3605886 - RNA, 21 nt, Human
auguuuaaaacaccuucuaua

SEQ ID NO: 3605887 - RNA, 12 nt, Human
auguuuaaaaua

SEQ ID NO: 3605888 - RNA, 15 nt, Human
auguuuaaaauaaaa

SEQ ID NO: 3605889 - RNA, 14 nt, Human
auguuuaaaccuuu

SEQ ID NO: 3605890 - RNA, 14 nt, Human
auguuuaaaguaau

SEQ ID NO: 3605891 - RNA, 14 nt, Human
auguuuaagcagaa

SEQ ID NO: 3605892 - RNA, 16 nt, Human
auguuuacaaauggac

SEQ ID NO: 3605893 - RNA, 15 nt, Human
auguuuacagaggac

SEQ ID NO: 3605894 - RNA, 15 nt, Human
auguuuaccuuuuaa

SEQ ID NO: 3605895 - RNA, 18 nt, Human
auguuuaccuuuuaauua

SEQ ID NO: 3605896 - RNA, 17 nt, Human
auguuuaguaaucauau

SEQ ID NO: 3605897 - RNA, 15 nt, Human
auguuuauagcauuc

SEQ ID NO: 3605898 - RNA, 17 nt, Human
auguuuauauaaaugcu

SEQ ID NO: 3605899 - RNA, 21 nt, Human
auguuuauauaaaugcuuuua

SEQ ID NO: 3605900 - RNA, 15 nt, Human
auguuuaugaaaaua

SEQ ID NO: 3605901 - RNA, 20 nt, Human
auguuuaugagccagacaaa

SEQ ID NO: 3605902 - RNA, 22 nt, Human
auguuuaugcaaggaaggaaag

SEQ ID NO: 3605903 - RNA, 13 nt, Human
auguuuauguaaa

SEQ ID NO: 3605904 - RNA, 23 nt, Human
auguuuauguaaacaaaucuuuc

SEQ ID NO: 3605905 - RNA, 20 nt, Human
auguuuauuaaaugcuucau

SEQ ID NO: 3605906 - RNA, 22 nt, Human
auguuuauuacaguauaauuaa

SEQ ID NO: 3605907 - RNA, 23 nt, Human
auguuuauuacaguauaauuaac

SEQ ID NO: 3605908 - RNA, 18 nt, Human
auguuuauuccugauaau

SEQ ID NO: 3605909 - RNA, 12 nt, Human
auguuucaaacu

SEQ ID NO: 3605910 - RNA, 17 nt, Human
auguuucaaacuuugga

SEQ ID NO: 3605911 - RNA, 17 nt, Human
auguuucacaaggucuu

SEQ ID NO: 3605912 - RNA, 21 nt, Human
auguuucacauaaaaccucau

SEQ ID NO: 3605913 - RNA, 19 nt, Human
auguuucacgaaguuuguu

SEQ ID NO: 3605914 - RNA, 13 nt, Human
auguuuccagcag

SEQ ID NO: 3605915 - RNA, 20 nt, Human
auguuuccagcauucccagg

SEQ ID NO: 3605916 - RNA, 14 nt, Human
auguuuccucuagu

SEQ ID NO: 3605917 - RNA, 15 nt, Human
auguuuccuucccuc

SEQ ID NO: 3605918 - RNA, 20 nt, Human
auguuucgugaaguauacug

SEQ ID NO: 3605919 - RNA, 23 nt, Human
auguuucgugaaguauacuguau

SEQ ID NO: 3605920 - RNA, 13 nt, Human
auguuucuaucug

SEQ ID NO: 3605921 - RNA, 23 nt, Human
auguuucugcaguagucucugug

SEQ ID NO: 3605922 - RNA, 20 nt, Human
auguuucuggguccugaaga

SEQ ID NO: 3605923 - RNA, 18 nt, Human
auguuucuuaaaugggcu

SEQ ID NO: 3605924 - RNA, 14 nt, Human
auguuucuuaacua

SEQ ID NO: 3605925 - RNA, 13 nt, Human
auguuugaauaug

SEQ ID NO: 3605926 - RNA, 21 nt, Human
auguuugauagauuuucugcu

SEQ ID NO: 3605927 - RNA, 22 nt, Human
auguuugcaccuuucuaguuga

SEQ ID NO: 3605928 - RNA, 19 nt, Human
auguuugccucugccucug

SEQ ID NO: 3605929 - RNA, 16 nt, Human
auguuugcucagaaca

SEQ ID NO: 3605930 - RNA, 23 nt, Human
auguuugcucuuguuuuuauuaa

SEQ ID NO: 3605931 - RNA, 16 nt, Human
auguuuggcauguaaa

SEQ ID NO: 3605932 - RNA, 18 nt, Human
auguuuggugaacuauau

SEQ ID NO: 3605933 - RNA, 18 nt, Human
auguuuguacaagauugu

SEQ ID NO: 3605934 - RNA, 16 nt, Human
auguuuguggccucag

SEQ ID NO: 3605935 - RNA, 21 nt, Human
auguuuuaaacauagaaaguu

SEQ ID NO: 3605936 - RNA, 13 nt, Human
auguuuuaaagaa

SEQ ID NO: 3605937 - RNA, 14 nt, Human
auguuuuaaaugua

SEQ ID NO: 3605938 - RNA, 18 nt, Human
auguuuuaaauguacaga

SEQ ID NO: 3605939 - RNA, 16 nt, Human
auguuuuaacaaaaac

SEQ ID NO: 3605940 - RNA, 14 nt, Human
auguuuuaauucca

SEQ ID NO: 3605941 - RNA, 16 nt, Human
auguuuuaauuccaug

SEQ ID NO: 3605942 - RNA, 16 nt, Human
auguuuuacugugaaa

SEQ ID NO: 3605943 - RNA, 23 nt, Human
auguuuuagacaaauacucaugu

SEQ ID NO: 3605944 - RNA, 14 nt, Human
auguuuuagaguua

SEQ ID NO: 3605945 - RNA, 15 nt, Human
auguuuuauuucauu

SEQ ID NO: 3605946 - RNA, 18 nt, Human
auguuuucaaauguucuc

SEQ ID NO: 3605947 - RNA, 21 nt, Human
auguuuucaggcuagauguau

SEQ ID NO: 3605948 - RNA, 14 nt, Human
auguuuuccaugag

SEQ ID NO: 3605949 - RNA, 17 nt, Human
auguuuuccuugccaaa

SEQ ID NO: 3605950 - RNA, 18 nt, Human
auguuuucgaaaaucaaa

SEQ ID NO: 3605951 - RNA, 20 nt, Human
auguuuucgaaaaucaaaug

SEQ ID NO: 3605952 - RNA, 23 nt, Human
auguuuucgaaaaucaaauggua

SEQ ID NO: 3605953 - RNA, 17 nt, Human
auguuuucuuugcaaag

SEQ ID NO: 3605954 - RNA, 18 nt, Human
auguuuucuuugcaaagu

SEQ ID NO: 3605955 - RNA, 22 nt, Human
auguuuugauaaaguaguaaaa

SEQ ID NO: 3605956 - RNA, 23 nt, Human
auguuuugcauguaaaagccuag

SEQ ID NO: 3605957 - RNA, 17 nt, Human
auguuuugguaucuguu

SEQ ID NO: 3605958 - RNA, 22 nt, Human
auguuuugguccacuuuuccag

SEQ ID NO: 3605959 - RNA, 11 nt, Human
auguuuuggug

SEQ ID NO: 3605960 - RNA, 15 nt, Human
auguuuuguaaacau

SEQ ID NO: 3605961 - RNA, 16 nt, Human
auguuuuguaaacauu

SEQ ID NO: 3605962 - RNA, 17 nt, Human
auguuuuguaaacauuu

SEQ ID NO: 3605963 - RNA, 14 nt, Human
auguuuuguauaca

SEQ ID NO: 3605964 - RNA, 15 nt, Human
auguuuuguauacaa

SEQ ID NO: 3605965 - RNA, 22 nt, Human
auguuuuguauacaaauauauu

SEQ ID NO: 3605966 - RNA, 17 nt, Human
auguuuuguuucugaaa

SEQ ID NO: 3605967 - RNA, 21 nt, Human
auguuuuguuucugaaaauuc

SEQ ID NO: 3605968 - RNA, 13 nt, Human
auguuuuuaaaau

SEQ ID NO: 3605969 - RNA, 15 nt, Human
auguuuuuaaaaucu

SEQ ID NO: 3605970 - RNA, 23 nt, Human
auguuuuuaaaaucuuauuaaag

SEQ ID NO: 3605971 - RNA, 12 nt, Human
auguuuuuaaug

SEQ ID NO: 3605972 - RNA, 16 nt, Human
auguuuuuaauguaua

SEQ ID NO: 3605973 - RNA, 12 nt, Human
auguuuuuauac

SEQ ID NO: 3605974 - RNA, 15 nt, Human
auguuuuuauacaaa

SEQ ID NO: 3605975 - RNA, 16 nt, Human
auguuuuucuaaagga

SEQ ID NO: 3605976 - RNA, 21 nt, Human
auguuuuucugccagggagcu

SEQ ID NO: 3605977 - RNA, 19 nt, Human
auguuuuuguucaaagcca

SEQ ID NO: 3605978 - RNA, 22 nt, Human
auguuuuuuagaucaaauacuu

SEQ ID NO: 3605979 - RNA, 15 nt, Human
auguuuuuucaugug

SEQ ID NO: 3605980 - RNA, 19 nt, Human
auguuuuuugccacagcuu

SEQ ID NO: 3605981 - RNA, 21 nt, Human
auguuuuuugccacagcuuuu

SEQ ID NO: 3605982 - RNA, 15 nt, Human
auguuuuuuuuuaaa

SEQ ID NO: 3605983 - RNA, 20 nt, Human
auuaaaaaaaaagaucuguu

SEQ ID NO: 3605984 - RNA, 15 nt, Human
auuaaaaaaaacaaa

SEQ ID NO: 3605985 - RNA, 13 nt, Human
auuaaaaaagaga

SEQ ID NO: 3605986 - RNA, 16 nt, Human
auuaaaaaagagacau

SEQ ID NO: 3605987 - RNA, 15 nt, Human
auuaaaaaagauaaa

SEQ ID NO: 3605988 - RNA, 18 nt, Human
auuaaaaaagcauacuuc

SEQ ID NO: 3605989 - RNA, 19 nt, Human
auuaaaaaagcauacuucu

SEQ ID NO: 3605990 - RNA, 12 nt, Human
auuaaaaaauuu

SEQ ID NO: 3605991 - RNA, 17 nt, Human
auuaaaaacuaguaguu

SEQ ID NO: 3605992 - RNA, 14 nt, Human
auuaaaaacugagu

SEQ ID NO: 3605993 - RNA, 14 nt, Human
auuaaaaagucuuu

SEQ ID NO: 3605994 - RNA, 23 nt, Human
auuaaaaagucuuuuaaaaagua

SEQ ID NO: 3605995 - RNA, 17 nt, Human
auuaaaaaguuaaucuu

SEQ ID NO: 3605996 - RNA, 15 nt, Human
auuaaaaauauaaaa

SEQ ID NO: 3605997 - RNA, 16 nt, Human
auuaaaaauauaaaac

SEQ ID NO: 3605998 - RNA, 15 nt, Human
auuaaaaaucucaaa

SEQ ID NO: 3605999 - RNA, 19 nt, Human
auuaaaaaucucaaauuuc

SEQ ID NO: 3606000 - RNA, 14 nt, Human
auuaaaaaugguaa

SEQ ID NO: 3606001 - RNA, 23 nt, Human
auuaaaaaugguaaaauugcaug

SEQ ID NO: 3606002 - RNA, 13 nt, Human
auuaaaaauuaua

SEQ ID NO: 3606003 - RNA, 11 nt, Human
auuaaaacaau

SEQ ID NO: 3606004 - RNA, 19 nt, Human
auuaaaacacaacaucuuu

SEQ ID NO: 3606005 - RNA, 21 nt, Human
auuaaaaccugggauuauaua

SEQ ID NO: 3606006 - RNA, 16 nt, Human
auuaaaacuaaauuuc

SEQ ID NO: 3606007 - RNA, 19 nt, Human
auuaaaacugaagucugaa

SEQ ID NO: 3606008 - RNA, 12 nt, Human
auuaaaacugcu

SEQ ID NO: 3606009 - RNA, 14 nt, Human
auuaaaacugcuuu

SEQ ID NO: 3606010 - RNA, 20 nt, Human
auuaaaacuucuuaaauauc

SEQ ID NO: 3606011 - RNA, 14 nt, Human
auuaaaagaauauc

SEQ ID NO: 3606012 - RNA, 16 nt, Human
auuaaaagaauaucug

SEQ ID NO: 3606013 - RNA, 16 nt, Human
auuaaaagaauauuuu

SEQ ID NO: 3606014 - RNA, 21 nt, Human
agucuguguucaaaaauauau

SEQ ID NO: 3606015 - RNA, 16 nt, Human
agucuguugauuaaag

SEQ ID NO: 3606016 - RNA, 17 nt, Human
agucuguuuuaugacuu

SEQ ID NO: 3606017 - RNA, 18 nt, Human
agucuguuuuaugacuuc

SEQ ID NO: 3606018 - RNA, 16 nt, Human
agucuguuuuguaaag

SEQ ID NO: 3606019 - RNA, 13 nt, Human
agucuuaaaauaa

SEQ ID NO: 3606020 - RNA, 17 nt, Human
agucuuaaaauaacuua

SEQ ID NO: 3606021 - RNA, 23 nt, Human
agucuuaaaauaacuuauaucau

SEQ ID NO: 3606022 - RNA, 21 nt, Human
agucuuaaggacaaagugcca

SEQ ID NO: 3606023 - RNA, 22 nt, Human
agucuuaauauauauauccaga

SEQ ID NO: 3606024 - RNA, 18 nt, Human
agucuuacucuguugcca

SEQ ID NO: 3606025 - RNA, 24 nt, Human
agucuuagacuugaaauacuacuu

SEQ ID NO: 3606026 - RNA, 19 nt, Human
agucuuagaucauaguuuu

SEQ ID NO: 3606027 - RNA, 20 nt, Human
agucuuagaucauaguuuua

SEQ ID NO: 3606028 - RNA, 13 nt, Human
agucuuagaugua

SEQ ID NO: 3606029 - RNA, 14 nt, Human
agucuuagauguau

SEQ ID NO: 3606030 - RNA, 16 nt, Human
agucuuaucaagcagc

SEQ ID NO: 3606031 - RNA, 19 nt, Human
agucuucacucucugaaga

SEQ ID NO: 3606032 - RNA, 18 nt, Human
agucuucaguuugcagag

SEQ ID NO: 3606033 - RNA, 15 nt, Human
agucuucaugaaaug

SEQ ID NO: 3606034 - RNA, 17 nt, Human
agucuucaugaaaugcu

SEQ ID NO: 3606035 - RNA, 23 nt, Human
agucuucaugaaaugcuauguca

SEQ ID NO: 3606036 - RNA, 19 nt, Human
agucuucccuagggcuggg

SEQ ID NO: 3606037 - RNA, 15 nt, Human
agucuuccugacacu

SEQ ID NO: 3606038 - RNA, 18 nt, Human
agucuuccugacacuuua

SEQ ID NO: 3606039 - RNA, 12 nt, Human
agucuucucaua

SEQ ID NO: 3606040 - RNA, 18 nt, Human
agucuucucauagcauua

SEQ ID NO: 3606041 - RNA, 16 nt, Human
agucuugcagcaggau

SEQ ID NO: 3606042 - RNA, 14 nt, Human
agucuugcagcuga

SEQ ID NO: 3606043 - RNA, 15 nt, Human
agucuuggcggcagc

SEQ ID NO: 3606044 - RNA, 21 nt, Human
agucuuggcggcagcagccau

SEQ ID NO: 3606045 - RNA, 17 nt, Human
agucuugguuucucucu

SEQ ID NO: 3606046 - RNA, 10 nt, Human
agucuuguau

SEQ ID NO: 3606047 - RNA, 11 nt, Human
agucuuguaua

SEQ ID NO: 3606048 - RNA, 15 nt, Human
agucuuguauaacua

SEQ ID NO: 3606049 - RNA, 20 nt, Human
agucuugucucagauuuuau

SEQ ID NO: 3606050 - RNA, 21 nt, Human
agucuugucucagauuuuauu

SEQ ID NO: 3606051 - RNA, 22 nt, Human
agucuugugacuagugcugaag

SEQ ID NO: 3606052 - RNA, 12 nt, Human
agucuugugcuu

SEQ ID NO: 3606053 - RNA, 15 nt, Human
agucuugugcuuuuc

SEQ ID NO: 3606054 - RNA, 20 nt, Human
agucuuucacaguaccaucu

SEQ ID NO: 3606055 - RNA, 16 nt, Human
agucuuucacauuuaa

SEQ ID NO: 3606056 - RNA, 15 nt, Human
agucuuucaugugug

SEQ ID NO: 3606057 - RNA, 17 nt, Human
agucuuucaugugugcc

SEQ ID NO: 3606058 - RNA, 14 nt, Human
agucuuugaagcug

SEQ ID NO: 3606059 - RNA, 21 nt, Human
agucuuugaagcugaaaauau

SEQ ID NO: 3606060 - RNA, 17 nt, Human
agucuuugccagucauu

SEQ ID NO: 3606061 - RNA, 22 nt, Human
agucuuugccagucauucagca

SEQ ID NO: 3606062 - RNA, 17 nt, Human
agucuuuggaacccuaa

SEQ ID NO: 3606063 - RNA, 18 nt, Human
agucuuugguucuaagga

SEQ ID NO: 3606064 - RNA, 23 nt, Human
agucuuuguaaguaaacugcccu

SEQ ID NO: 3606065 - RNA, 18 nt, Human
agucuuuuaaaaaguauu

SEQ ID NO: 3606066 - RNA, 12 nt, Human
agucuuuugcuu

SEQ ID NO: 3606067 - RNA, 14 nt, Human
agucuuuugcuuuu

SEQ ID NO: 3606068 - RNA, 20 nt, Human
agucuuuugcuuuuggcaaa

SEQ ID NO: 3606069 - RNA, 17 nt, Human
agucuuuuucuguugua

SEQ ID NO: 3606070 - RNA, 16 nt, Human
agucuuuuuuuuccug

SEQ ID NO: 3606071 - RNA, 14 nt, Human
agugaaaaagaugu

SEQ ID NO: 3606072 - RNA, 15 nt, Human
agugaaaauugucuu

SEQ ID NO: 3606073 - RNA, 19 nt, Human
agugaaaccuuuagggcag

SEQ ID NO: 3606074 - RNA, 13 nt, Human
agugaaacugcuu

SEQ ID NO: 3606075 - RNA, 16 nt, Human
agugaaagaggcagcu

SEQ ID NO: 3606076 - RNA, 20 nt, Human
agugaaaggaagauaaacgu

SEQ ID NO: 3606077 - RNA, 19 nt, Human
agugaaagugaggaaauaa

SEQ ID NO: 3606078 - RNA, 19 nt, Human
agugaaauaacaaaaugga

SEQ ID NO: 3606079 - RNA, 14 nt, Human
agugaaauaauaga

SEQ ID NO: 3606080 - RNA, 18 nt, Human
agugaaauaccauuauua

SEQ ID NO: 3606081 - RNA, 17 nt, Human
agugaaauuauuuugga

SEQ ID NO: 3606082 - RNA, 13 nt, Human
agugaaauuuauu

SEQ ID NO: 3606083 - RNA, 16 nt, Human
agugaacacuagccag

SEQ ID NO: 3606084 - RNA, 20 nt, Human
agugaacauaauucuuauua

SEQ ID NO: 3606085 - RNA, 22 nt, Human
agugaaccaaagagacuggagc

SEQ ID NO: 3606086 - RNA, 23 nt, Human
agugaaccaaagagacuggagca

SEQ ID NO: 3606087 - RNA, 17 nt, Human
agugaaccuaccuucau

SEQ ID NO: 3606088 - RNA, 22 nt, Human
agugaagaauacuucucauuuu

SEQ ID NO: 3606089 - RNA, 17 nt, Human
agugaagaauccuuuug

SEQ ID NO: 3606090 - RNA, 12 nt, Human
agugaagacaga

SEQ ID NO: 3606091 - RNA, 21 nt, Human
agugaagacuagaaaauuaga

SEQ ID NO: 3606092 - RNA, 17 nt, Human
agugaagacuccagaaa

SEQ ID NO: 3606093 - RNA, 14 nt, Human
agugaagaggggca

SEQ ID NO: 3606094 - RNA, 15 nt, Human
agugaagaggggcag

SEQ ID NO: 3606095 - RNA, 22 nt, Human
agugaagccagcugcaggaauc

SEQ ID NO: 3606096 - RNA, 17 nt, Human
agugaagugagaaguuc

SEQ ID NO: 3606097 - RNA, 16 nt, Human
agugaaguugcugcuu

SEQ ID NO: 3606098 - RNA, 23 nt, Human
agugaaguugcugcuucucccag

SEQ ID NO: 3606099 - RNA, 12 nt, Human
agugaauaaacu

SEQ ID NO: 3606100 - RNA, 14 nt, Human
agugaauaaauguc

SEQ ID NO: 3606101 - RNA, 13 nt, Human
agugaaugauuca

SEQ ID NO: 3606102 - RNA, 17 nt, Human
agugaaugauucagugu

SEQ ID NO: 3606103 - RNA, 19 nt, Human
agugaaugauucaguguua

SEQ ID NO: 3606104 - RNA, 20 nt, Human
agugaauuaguuuuaaaaug

SEQ ID NO: 3606105 - RNA, 20 nt, Human
agugaauucuugaaggaaaa

SEQ ID NO: 3606106 - RNA, 21 nt, Human
agugaauugugaccaaguuau

SEQ ID NO: 3606107 - RNA, 19 nt, Human
agugaauuugggcugcugu

SEQ ID NO: 3606108 - RNA, 23 nt, Human
agugaauuuuucucuaacucaga

SEQ ID NO: 3606109 - RNA, 14 nt, Human
agugaauuuuugca

SEQ ID NO: 3606110 - RNA, 15 nt, Human
agugaauuuuugcaa

SEQ ID NO: 3606111 - RNA, 22 nt, Human
agugaauuuuugcaauaaugca

SEQ ID NO: 3606112 - RNA, 13 nt, Human
agugacaaaccau

SEQ ID NO: 3606113 - RNA, 23 nt, Human
agugacaaggccccagagacuca

SEQ ID NO: 3606114 - RNA, 13 nt, Human
agugacacagcag

SEQ ID NO: 3606115 - RNA, 17 nt, Human
agugacacagcagcuuc

SEQ ID NO: 3606116 - RNA, 23 nt, Human
agugacacuucagagagcuggua

SEQ ID NO: 3606117 - RNA, 14 nt, Human
agugacagaggcag

SEQ ID NO: 3606118 - RNA, 19 nt, Human
agugacagaggcagcccca

SEQ ID NO: 3606119 - RNA, 15 nt, Human
agugacagaguucac

SEQ ID NO: 3606120 - RNA, 12 nt, Human
agugacagcuag

SEQ ID NO: 3606121 - RNA, 20 nt, Human
agugacagcuaggaugugca

SEQ ID NO: 3606122 - RNA, 16 nt, Human
agugacagggaagcua

SEQ ID NO: 3606123 - RNA, 23 nt, Human
agugacagggaagcuacagguua

SEQ ID NO: 3606124 - RNA, 18 nt, Human
agugaccauugcaugccg

SEQ ID NO: 3606125 - RNA, 18 nt, Human
agugacccggaggccaca

SEQ ID NO: 3606126 - RNA, 19 nt, Human
agugacccggaggccacau

SEQ ID NO: 3606127 - RNA, 21 nt, Human
agugacccuucccaaucagca

SEQ ID NO: 3606128 - RNA, 17 nt, Human
agugaccucagcuuuga

SEQ ID NO: 3606129 - RNA, 13 nt, Human
agugaccucucuc

SEQ ID NO: 3606130 - RNA, 14 nt, Human
agugaccugaggaa

SEQ ID NO: 3606131 - RNA, 15 nt, Human
agugaccugaggaag

SEQ ID NO: 3606132 - RNA, 22 nt, Human
agugaccuggaaggcccagcac

SEQ ID NO: 3606133 - RNA, 14 nt, Human
agugacgguuccua

SEQ ID NO: 3606134 - RNA, 20 nt, Human
agugacgguuccuacacagg

SEQ ID NO: 3606135 - RNA, 23 nt, Human
agugacgguuccuacacaggaca

SEQ ID NO: 3606136 - RNA, 22 nt, Human
agugacuaaaccauugugcauu

SEQ ID NO: 3606137 - RNA, 15 nt, Human
agugacuaauggcau

SEQ ID NO: 3606138 - RNA, 17 nt, Human
agugacuaauggcauga

SEQ ID NO: 3606139 - RNA, 18 nt, Human
agugacucauccucuuga

SEQ ID NO: 3606140 - RNA, 14 nt, Human
agugacucgagggu

SEQ ID NO: 3606141 - RNA, 19 nt, Human
agugacucgggcuccugug

SEQ ID NO: 3606142 - RNA, 15 nt, Human
agugacucuccaggg

SEQ ID NO: 3606143 - RNA, 18 nt, Human
agugacuguaucugugua

SEQ ID NO: 3606144 - RNA, 12 nt, Human
agugacuucuga

SEQ ID NO: 3606145 - RNA, 15 nt, Human
agugacuucugagau

SEQ ID NO: 3606146 - RNA, 20 nt, Human
agugacuuuucaaguauuua

SEQ ID NO: 3606147 - RNA, 17 nt, Human
agugagaaaacugugac

SEQ ID NO: 3606148 - RNA, 16 nt, Human
agugagaaaaugaaca

SEQ ID NO: 3606149 - RNA, 17 nt, Human
agugagaagaauauugu

SEQ ID NO: 3606150 - RNA, 19 nt, Human
agugagaagaauauuguuc

SEQ ID NO: 3606151 - RNA, 16 nt, Human
agugagaagcuuugcc

SEQ ID NO: 3606152 - RNA, 17 nt, Human
agugagaauaggcagcc

SEQ ID NO: 3606153 - RNA, 19 nt, Human
agugagacaaaauuuuagu

SEQ ID NO: 3606154 - RNA, 18 nt, Human
agugagaccccugucucc

SEQ ID NO: 3606155 - RNA, 17 nt, Human
agugagacccugucucu

SEQ ID NO: 3606156 - RNA, 22 nt, Human
agugagacuggggccacuacau

SEQ ID NO: 3606157 - RNA, 12 nt, Human
agugagaggcug

SEQ ID NO: 3606158 - RNA, 13 nt, Human
agugagagggcau

SEQ ID NO: 3606159 - RNA, 17 nt, Human
agugagaggggaggcca

SEQ ID NO: 3606160 - RNA, 19 nt, Human
agugagaggggaggccaag

SEQ ID NO: 3606161 - RNA, 22 nt, Human
agugagauagcauugugaacug

SEQ ID NO: 3606162 - RNA, 14 nt, Human
agugagaugaggga

SEQ ID NO: 3606163 - RNA, 22 nt, Human
agugagcacuaaggugugcucu

SEQ ID NO: 3606164 - RNA, 19 nt, Human
augucaggaacagaaggau

SEQ ID NO: 3606165 - RNA, 23 nt, Human
augucaggggcggggagggugac

SEQ ID NO: 3606166 - RNA, 13 nt, Human
augucaguaugug

SEQ ID NO: 3606167 - RNA, 14 nt, Human
augucaguaugugg

SEQ ID NO: 3606168 - RNA, 13 nt, Human
augucaguauuuc

SEQ ID NO: 3606169 - RNA, 16 nt, Human
augucaguauuucaac

SEQ ID NO: 3606170 - RNA, 16 nt, Human
augucaguauuucagu

SEQ ID NO: 3606171 - RNA, 24 nt, Human
augucaguauuucaguguaguuaa

SEQ ID NO: 3606172 - RNA, 15 nt, Human
augucagugugacug

SEQ ID NO: 3606173 - RNA, 21 nt, Human
augucagugugacugaucucu

SEQ ID NO: 3606174 - RNA, 17 nt, Human
augucaguuguuauuua

SEQ ID NO: 3606175 - RNA, 14 nt, Human
augucauaaaguga

SEQ ID NO: 3606176 - RNA, 13 nt, Human
augucauacagag

SEQ ID NO: 3606177 - RNA, 17 nt, Human
augucauacagagaagu

SEQ ID NO: 3606178 - RNA, 18 nt, Human
augucauacagagaaguc

SEQ ID NO: 3606179 - RNA, 22 nt, Human
augucauauacugccauguacu

SEQ ID NO: 3606180 - RNA, 22 nt, Human
augucaucacucuagguuuuac

SEQ ID NO: 3606181 - RNA, 16 nt, Human
auguccaaagaggcug

SEQ ID NO: 3606182 - RNA, 22 nt, Human
auguccaaagaggcugccccuc

SEQ ID NO: 3606183 - RNA, 23 nt, Human
auguccaagaagcccaggaaagg

SEQ ID NO: 3606184 - RNA, 16 nt, Human
auguccacuguguaua

SEQ ID NO: 3606185 - RNA, 12 nt, Human
auguccagaaga

SEQ ID NO: 3606186 - RNA, 22 nt, Human
auguccagcaccuugugccugg

SEQ ID NO: 3606187 - RNA, 18 nt, Human
auguccaucagaugacaa

SEQ ID NO: 3606188 - RNA, 16 nt, Human
auguccccaaaccugc

SEQ ID NO: 3606189 - RNA, 18 nt, Human
auguccccaaaccugcaa

SEQ ID NO: 3606190 - RNA, 17 nt, Human
augucccugggccaggg

SEQ ID NO: 3606191 - RNA, 21 nt, Human
augucccuucacauaguuuuu

SEQ ID NO: 3606192 - RNA, 17 nt, Human
augucccuuucuucucc

SEQ ID NO: 3606193 - RNA, 19 nt, Human
auguccuauauuggcuaaa

SEQ ID NO: 3606194 - RNA, 16 nt, Human
auguccuccagaagcc

SEQ ID NO: 3606195 - RNA, 20 nt, Human
auguccugccuauuaucugu

SEQ ID NO: 3606196 - RNA, 22 nt, Human
auguccugccuauuaucuguca

SEQ ID NO: 3606197 - RNA, 20 nt, Human
auguccugugagauguguau

SEQ ID NO: 3606198 - RNA, 13 nt, Human
auguccuguguca

SEQ ID NO: 3606199 - RNA, 20 nt, Human
auguccugugucaguuuaug

SEQ ID NO: 3606200 - RNA, 19 nt, Human
augucguggacacacacag

SEQ ID NO: 3606201 - RNA, 12 nt, Human
augucuaaaauu

SEQ ID NO: 3606202 - RNA, 13 nt, Human
augucuaaagagc

SEQ ID NO: 3606203 - RNA, 17 nt, Human
augucuauuaaggugau

SEQ ID NO: 3606204 - RNA, 16 nt, Human
augucuauucagcuuc

SEQ ID NO: 3606205 - RNA, 15 nt, Human
augucuauuuaagcc

SEQ ID NO: 3606206 - RNA, 20 nt, Human
augucucaauaguaaaagau

SEQ ID NO: 3606207 - RNA, 18 nt, Human
augucucacugagcacug

SEQ ID NO: 3606208 - RNA, 18 nt, Human
augucuccuaagcaccug

SEQ ID NO: 3606209 - RNA, 15 nt, Human
augucucgcuaguga

SEQ ID NO: 3606210 - RNA, 17 nt, Human
augucucucagaauucu

SEQ ID NO: 3606211 - RNA, 13 nt, Human
augucugaacuuu

SEQ ID NO: 3606212 - RNA, 22 nt, Human
augucugagugaaccuguauaa

SEQ ID NO: 3606213 - RNA, 14 nt, Human
augucugcagcccu

SEQ ID NO: 3606214 - RNA, 19 nt, Human
augucugcagugugccccc

SEQ ID NO: 3606215 - RNA, 14 nt, Human
augucugcauuucg

SEQ ID NO: 3606216 - RNA, 13 nt, Human
augucugccaauu

SEQ ID NO: 3606217 - RNA, 21 nt, Human
augucugccaauuuuugccuu

SEQ ID NO: 3606218 - RNA, 15 nt, Human
augucugccauguug

SEQ ID NO: 3606219 - RNA, 20 nt, Human
augucugcugaauaauaaac

SEQ ID NO: 3606220 - RNA, 12 nt, Human
augucuggagac

SEQ ID NO: 3606221 - RNA, 13 nt, Human
augucuggagacc

SEQ ID NO: 3606222 - RNA, 18 nt, Human
augucuggagaccaccag

SEQ ID NO: 3606223 - RNA, 23 nt, Human
augucuggagaccaccagggcau

SEQ ID NO: 3606224 - RNA, 14 nt, Human
augucugguucuca

SEQ ID NO: 3606225 - RNA, 16 nt, Human
augucugguucucaau

SEQ ID NO: 3606226 - RNA, 17 nt, Human
augucugguucucaauu

SEQ ID NO: 3606227 - RNA, 19 nt, Human
augucugguucucaauucc

SEQ ID NO: 3606228 - RNA, 19 nt, Human
augucuguaucacucugug

SEQ ID NO: 3606229 - RNA, 11 nt, Human
augucugugcu

SEQ ID NO: 3606230 - RNA, 16 nt, Human
augucuguggccuugu

SEQ ID NO: 3606231 - RNA, 13 nt, Human
augucuguuacca

SEQ ID NO: 3606232 - RNA, 23 nt, Human
augucuguuaccaugucacugug

SEQ ID NO: 3606233 - RNA, 14 nt, Human
augucuguuuaaga

SEQ ID NO: 3606234 - RNA, 24 nt, Human
augucuguuugcugauggucuggu

SEQ ID NO: 3606235 - RNA, 18 nt, Human
augucuuaaugaaguuug

SEQ ID NO: 3606236 - RNA, 21 nt, Human
augucuuaaugaaguuugaau

SEQ ID NO: 3606237 - RNA, 17 nt, Human
augucuuaauuuuugaa

SEQ ID NO: 3606238 - RNA, 16 nt, Human
augucuucaaggcuuc

SEQ ID NO: 3606239 - RNA, 20 nt, Human
augucuucaaggcuucaguc

SEQ ID NO: 3606240 - RNA, 19 nt, Human
augucuucauaaaguacuu

SEQ ID NO: 3606241 - RNA, 20 nt, Human
augucuucguacaguucuuc

SEQ ID NO: 3606242 - RNA, 22 nt, Human
augucuucucacaagccagcca

SEQ ID NO: 3606243 - RNA, 12 nt, Human
augucuucugcc

SEQ ID NO: 3606244 - RNA, 19 nt, Human
augucuucugccuguuaua

SEQ ID NO: 3606245 - RNA, 20 nt, Human
augucuugcuguugacauau

SEQ ID NO: 3606246 - RNA, 20 nt, Human
augucuuggacacuguacaa

SEQ ID NO: 3606247 - RNA, 19 nt, Human
augucuuggguaggcggga

SEQ ID NO: 3606248 - RNA, 15 nt, Human
augucuugguacuug

SEQ ID NO: 3606249 - RNA, 18 nt, Human
augucuugguacuugcug

SEQ ID NO: 3606250 - RNA, 23 nt, Human
augucuugguacuugcugcuauu

SEQ ID NO: 3606251 - RNA, 14 nt, Human
augucuuguacaug

SEQ ID NO: 3606252 - RNA, 22 nt, Human
augucuuguacauguguagccu

SEQ ID NO: 3606253 - RNA, 18 nt, Human
augucuuguuaauauucu

SEQ ID NO: 3606254 - RNA, 21 nt, Human
augucuuguuaauauucuuuc

SEQ ID NO: 3606255 - RNA, 12 nt, Human
augucuuuguaa

SEQ ID NO: 3606256 - RNA, 13 nt, Human
augucuuuguaag

SEQ ID NO: 3606257 - RNA, 13 nt, Human
augucuuuuaaaa

SEQ ID NO: 3606258 - RNA, 14 nt, Human
augucuuuuaaaau

SEQ ID NO: 3606259 - RNA, 14 nt, Human
augucuuuuauagu

SEQ ID NO: 3606260 - RNA, 22 nt, Human
augucuuuuauauuuguaucga

SEQ ID NO: 3606261 - RNA, 15 nt, Human
augucuuuuuauuaa

SEQ ID NO: 3606262 - RNA, 22 nt, Human
augucuuuuuuuuaaugugcug

SEQ ID NO: 3606263 - RNA, 14 nt, Human
augugaaacauguu

SEQ ID NO: 3606264 - RNA, 13 nt, Human
augugaaaccuuu

SEQ ID NO: 3606265 - RNA, 18 nt, Human
augugaaaccuuuuuuaa

SEQ ID NO: 3606266 - RNA, 19 nt, Human
augugaaaccuuuuuuaag

SEQ ID NO: 3606267 - RNA, 20 nt, Human
augugaaaccuuuuuuaaga

SEQ ID NO: 3606268 - RNA, 21 nt, Human
augugaaaccuuuuuuaagau

SEQ ID NO: 3606269 - RNA, 22 nt, Human
augugaaacuggauuaaacuua

SEQ ID NO: 3606270 - RNA, 17 nt, Human
augugaaaucauucauu

SEQ ID NO: 3606271 - RNA, 23 nt, Human
augugaaauuuacaucauuucuu

SEQ ID NO: 3606272 - RNA, 16 nt, Human
augugaacccgggacg

SEQ ID NO: 3606273 - RNA, 13 nt, Human
augugaacuugua

SEQ ID NO: 3606274 - RNA, 23 nt, Human
augugaacuuguagcuguaaaac

SEQ ID NO: 3606275 - RNA, 21 nt, Human
augugaagccaauucagacag

SEQ ID NO: 3606276 - RNA, 13 nt, Human
augugaagccuuc

SEQ ID NO: 3606277 - RNA, 17 nt, Human
augugaagccuuccccu

SEQ ID NO: 3606278 - RNA, 21 nt, Human
augugaagucaccaguggccu

SEQ ID NO: 3606279 - RNA, 14 nt, Human
augugaaguguuaa

SEQ ID NO: 3606280 - RNA, 16 nt, Human
augugaaguguuaaua

SEQ ID NO: 3606281 - RNA, 12 nt, Human
augugaaucaga

SEQ ID NO: 3606282 - RNA, 21 nt, Human
augugaaucagacccuacccc

SEQ ID NO: 3606283 - RNA, 16 nt, Human
augugaauuacuaacu

SEQ ID NO: 3606284 - RNA, 21 nt, Human
augugaauuauugacacugaa

SEQ ID NO: 3606285 - RNA, 23 nt, Human
augugaauuguuaguuucugagu

SEQ ID NO: 3606286 - RNA, 14 nt, Human
augugaauuuuuaa

SEQ ID NO: 3606287 - RNA, 18 nt, Human
augugaauuuuuaagcug

SEQ ID NO: 3606288 - RNA, 19 nt, Human
augugaauuuuuaagcugc

SEQ ID NO: 3606289 - RNA, 14 nt, Human
augugacaguggcg

SEQ ID NO: 3606290 - RNA, 23 nt, Human
augugacauucuuaaaaaaagaa

SEQ ID NO: 3606291 - RNA, 11 nt, Human
augugacauuu

SEQ ID NO: 3606292 - RNA, 14 nt, Human
augugacauuuguc

SEQ ID NO: 3606293 - RNA, 15 nt, Human
augugacauuuguca

SEQ ID NO: 3606294 - RNA, 22 nt, Human
augugacauuugucauuuucau

SEQ ID NO: 3606295 - RNA, 19 nt, Human
augugaccacucugucuug

SEQ ID NO: 3606296 - RNA, 16 nt, Human
augugaccauaaugua

SEQ ID NO: 3606297 - RNA, 12 nt, Human
augugacccucc

SEQ ID NO: 3606298 - RNA, 14 nt, Human
augugacccuccaa

SEQ ID NO: 3606299 - RNA, 12 nt, Human
augugacucuga

SEQ ID NO: 3606300 - RNA, 13 nt, Human
augugacucugaa

SEQ ID NO: 3606301 - RNA, 14 nt, Human
augugacucuggcu

SEQ ID NO: 3606302 - RNA, 21 nt, Human
augugacucuuuccaaccggc

SEQ ID NO: 3606303 - RNA, 14 nt, Human
augugacuguauaa

SEQ ID NO: 3606304 - RNA, 21 nt, Human
augugacuuugaaaauauaua

SEQ ID NO: 3606305 - RNA, 13 nt, Human
augugagaccauu

SEQ ID NO: 3606306 - RNA, 23 nt, Human
augugagcugcugccaugaacug

SEQ ID NO: 3606307 - RNA, 20 nt, Human
augugagugacgaugaugua

SEQ ID NO: 3606308 - RNA, 16 nt, Human
augugagugguugaau

SEQ ID NO: 3606309 - RNA, 22 nt, Human
augugaguuuggucuggacuga

SEQ ID NO: 3606310 - RNA, 20 nt, Human
augugauaaggaaaucaacu

SEQ ID NO: 3606311 - RNA, 19 nt, Human
augugauauaaacagcuuc

SEQ ID NO: 3606312 - RNA, 17 nt, Human
augugauauauaagugu

SEQ ID NO: 3606313 - RNA, 22 nt, Human
augugauauauaaguguacaua

SEQ ID NO: 3606314 - RNA, 14 nt, Human
auuaaaagaauuuu

SEQ ID NO: 3606315 - RNA, 13 nt, Human
auuaaaagcaggc

SEQ ID NO: 3606316 - RNA, 16 nt, Human
auuaaaaggauaguau

SEQ ID NO: 3606317 - RNA, 22 nt, Human
auuaaaagggauuacccaagca

SEQ ID NO: 3606318 - RNA, 23 nt, Human
auuaaaagucacaauguucuuua

SEQ ID NO: 3606319 - RNA, 12 nt, Human
auuaaaauaugc

SEQ ID NO: 3606320 - RNA, 20 nt, Human
auuaaaauaugcacuaaguc

SEQ ID NO: 3606321 - RNA, 23 nt, Human
auuaaaauaugcacuaagucucu

SEQ ID NO: 3606322 - RNA, 14 nt, Human
auuaaaauccucaa

SEQ ID NO: 3606323 - RNA, 11 nt, Human
auuaaaaucuu

SEQ ID NO: 3606324 - RNA, 18 nt, Human
auuaaaaugauuguaaaa

SEQ ID NO: 3606325 - RNA, 21 nt, Human
auuaaaaugcuuacauuugaa

SEQ ID NO: 3606326 - RNA, 14 nt, Human
auuaaaaugcuucc

SEQ ID NO: 3606327 - RNA, 13 nt, Human
auuaaaauggaug

SEQ ID NO: 3606328 - RNA, 23 nt, Human
auuaaaauguaugcauguugucu

SEQ ID NO: 3606329 - RNA, 20 nt, Human
auuaaacaaaguuucagagu

SEQ ID NO: 3606330 - RNA, 12 nt, Human
auuaaacagaug

SEQ ID NO: 3606331 - RNA, 21 nt, Human
auuaaacagaugaugagaauu

SEQ ID NO: 3606332 - RNA, 23 nt, Human
auuaaacaugacuccauagaccu

SEQ ID NO: 3606333 - RNA, 22 nt, Human
auuaaaccugucuccacugugc

SEQ ID NO: 3606334 - RNA, 15 nt, Human
auuaaacgauuuuua

SEQ ID NO: 3606335 - RNA, 21 nt, Human
auuaaacguaugcaugugaag

SEQ ID NO: 3606336 - RNA, 23 nt, Human
auuaaacucuucacaaaaucugu

SEQ ID NO: 3606337 - RNA, 19 nt, Human
auuaaacugcgaagucaag

SEQ ID NO: 3606338 - RNA, 13 nt, Human
auuaaacuuauga

SEQ ID NO: 3606339 - RNA, 15 nt, Human
auuaaacuuaugaau

SEQ ID NO: 3606340 - RNA, 18 nt, Human
auuaaacuucauauguaa

SEQ ID NO: 3606341 - RNA, 17 nt, Human
auuaaacuuccaaagaa

SEQ ID NO: 3606342 - RNA, 15 nt, Human
auuaaacuuccuucu

SEQ ID NO: 3606343 - RNA, 16 nt, Human
auuaaagaagaccuga

SEQ ID NO: 3606344 - RNA, 21 nt, Human
auuaaagaagaccugagaaug

SEQ ID NO: 3606345 - RNA, 22 nt, Human
auuaaagaagaccugagaaugu

SEQ ID NO: 3606346 - RNA, 12 nt, Human
auuaaagaauau

SEQ ID NO: 3606347 - RNA, 22 nt, Human
auuaaagacaggagacaaaaga

SEQ ID NO: 3606348 - RNA, 15 nt, Human
auuaaagcauuuacu

SEQ ID NO: 3606349 - RNA, 11 nt, Human
auuaaagccau

SEQ ID NO: 3606350 - RNA, 21 nt, Human
auuaaagccauguuuauuaca

SEQ ID NO: 3606351 - RNA, 16 nt, Human
auuaaagccuuuagua

SEQ ID NO: 3606352 - RNA, 16 nt, Human
auuaaagucugaauca

SEQ ID NO: 3606353 - RNA, 13 nt, Human
auuaaagugccca

SEQ ID NO: 3606354 - RNA, 18 nt, Human
auuaaagugcuaagguuc

SEQ ID NO: 3606355 - RNA, 22 nt, Human
auuaaagugcuaagguucuaag

SEQ ID NO: 3606356 - RNA, 17 nt, Human
auuaaaguguccauuga

SEQ ID NO: 3606357 - RNA, 23 nt, Human
auuaaaguguccauugacaugua

SEQ ID NO: 3606358 - RNA, 13 nt, Human
auuaaaguuucaa

SEQ ID NO: 3606359 - RNA, 15 nt, Human
auuaaaguuucaaaa

SEQ ID NO: 3606360 - RNA, 19 nt, Human
auuaaaguuucaaaaaucu

SEQ ID NO: 3606361 - RNA, 13 nt, Human
auuaaauaaaauc

SEQ ID NO: 3606362 - RNA, 14 nt, Human
auuaaauaaaauca

SEQ ID NO: 3606363 - RNA, 21 nt, Human
auuaaauaaaaucaauuuuua

SEQ ID NO: 3606364 - RNA, 17 nt, Human
auuaaauaagauucuaa

SEQ ID NO: 3606365 - RNA, 19 nt, Human
auuaaauaagauucuaacg

SEQ ID NO: 3606366 - RNA, 19 nt, Human
auuaaauacaaaacuucca

SEQ ID NO: 3606367 - RNA, 12 nt, Human
auuaaauacaua

SEQ ID NO: 3606368 - RNA, 11 nt, Human
auuaaauagcu

SEQ ID NO: 3606369 - RNA, 15 nt, Human
auuaaauauaauaug

SEQ ID NO: 3606370 - RNA, 14 nt, Human
auuaaauauagauu

SEQ ID NO: 3606371 - RNA, 16 nt, Human
auuaaauauauguaug

SEQ ID NO: 3606372 - RNA, 17 nt, Human
auuaaauauauguaugu

SEQ ID NO: 3606373 - RNA, 18 nt, Human
auuaaauauauguaugua

SEQ ID NO: 3606374 - RNA, 21 nt, Human
auuaaauauauguauguaaaa

SEQ ID NO: 3606375 - RNA, 22 nt, Human
auuaaauauguuagcaaagagu

SEQ ID NO: 3606376 - RNA, 15 nt, Human
auuaaaugacacuca

SEQ ID NO: 3606377 - RNA, 12 nt, Human
auuaaaugacuc

SEQ ID NO: 3606378 - RNA, 13 nt, Human
auuaaaugacucu

SEQ ID NO: 3606379 - RNA, 14 nt, Human
auuaaaugacucuu

SEQ ID NO: 3606380 - RNA, 17 nt, Human
auuaaaugacucuuccc

SEQ ID NO: 3606381 - RNA, 14 nt, Human
auuaaaugcccagc

SEQ ID NO: 3606382 - RNA, 14 nt, Human
auuaaauguagcuu

SEQ ID NO: 3606383 - RNA, 22 nt, Human
auuaaauguagcuucagucauu

SEQ ID NO: 3606384 - RNA, 17 nt, Human
auuaaauuacauuugua

SEQ ID NO: 3606385 - RNA, 22 nt, Human
auuaaauuacuauagcaaagua

SEQ ID NO: 3606386 - RNA, 18 nt, Human
auuaaauuaggaauaaau

SEQ ID NO: 3606387 - RNA, 15 nt, Human
auuaaauuggaaagc

SEQ ID NO: 3606388 - RNA, 20 nt, Human
auuaaauuuuuuaaaaagca

SEQ ID NO: 3606389 - RNA, 17 nt, Human
auuaaauuuuuuguuga

SEQ ID NO: 3606390 - RNA, 18 nt, Human
auuaaauuuuuuuguaug

SEQ ID NO: 3606391 - RNA, 19 nt, Human
auuaaauuuuuuuguauga

SEQ ID NO: 3606392 - RNA, 18 nt, Human
auuaacaaaauguauguc

SEQ ID NO: 3606393 - RNA, 19 nt, Human
auuaacaaaauguaugucu

SEQ ID NO: 3606394 - RNA, 20 nt, Human
auuaacaaauaugcuaauuu

SEQ ID NO: 3606395 - RNA, 19 nt, Human
auuaacaauuaggcagacu

SEQ ID NO: 3606396 - RNA, 13 nt, Human
auuaacacaaagg

SEQ ID NO: 3606397 - RNA, 19 nt, Human
auuaacacuacucaaagca

SEQ ID NO: 3606398 - RNA, 21 nt, Human
auuaacaguuuuccaugaaaa

SEQ ID NO: 3606399 - RNA, 24 nt, Human
auuaacauaccuaagaaguacauu

SEQ ID NO: 3606400 - RNA, 14 nt, Human
auuaacauauaaua

SEQ ID NO: 3606401 - RNA, 18 nt, Human
auuaacauauaauauaug

SEQ ID NO: 3606402 - RNA, 20 nt, Human
auuaacauauaauauauguu

SEQ ID NO: 3606403 - RNA, 13 nt, Human
auuaacauguuaa

SEQ ID NO: 3606404 - RNA, 15 nt, Human
auuaacauguuaaac

SEQ ID NO: 3606405 - RNA, 22 nt, Human
auuaacauugggaaaucuuaua

SEQ ID NO: 3606406 - RNA, 17 nt, Human
auuaaccaaaaaaguua

SEQ ID NO: 3606407 - RNA, 18 nt, Human
auuaaccagaaauccagu

SEQ ID NO: 3606408 - RNA, 15 nt, Human
auuaaccauagaugu

SEQ ID NO: 3606409 - RNA, 21 nt, Human
auuaacccacuagcucuuguu

SEQ ID NO: 3606410 - RNA, 13 nt, Human
auuaaccucugca

SEQ ID NO: 3606411 - RNA, 16 nt, Human
auuaaccuggugcugg

SEQ ID NO: 3606412 - RNA, 17 nt, Human
auuaaccuggugcugga

SEQ ID NO: 3606413 - RNA, 17 nt, Human
auuaaccuuacuaauua

SEQ ID NO: 3606414 - RNA, 14 nt, Human
auuaacugaaacau

SEQ ID NO: 3606415 - RNA, 14 nt, Human
auuaacuuaauaau

SEQ ID NO: 3606416 - RNA, 19 nt, Human
auuaacuuacccuguauau

SEQ ID NO: 3606417 - RNA, 17 nt, Human
auuaacuuauuuagaga

SEQ ID NO: 3606418 - RNA, 12 nt, Human
auuaacuuuuau

SEQ ID NO: 3606419 - RNA, 20 nt, Human
auuaagaaaaucauauugcu

SEQ ID NO: 3606420 - RNA, 14 nt, Human
auuaagaaagacua

SEQ ID NO: 3606421 - RNA, 13 nt, Human
auuaagaaaggaa

SEQ ID NO: 3606422 - RNA, 15 nt, Human
auuaagaaggcaaaa

SEQ ID NO: 3606423 - RNA, 22 nt, Human
auuaagaaggcaaaaauguaaa

SEQ ID NO: 3606424 - RNA, 22 nt, Human
auuaagaaugaaauacuguuug

SEQ ID NO: 3606425 - RNA, 15 nt, Human
auuaagaaugaucug

SEQ ID NO: 3606426 - RNA, 23 nt, Human
auuaagaaugaucugauugaccg

SEQ ID NO: 3606427 - RNA, 21 nt, Human
auuaagaauguugguuuacuu

SEQ ID NO: 3606428 - RNA, 18 nt, Human
auuaagagguaagacuua

SEQ ID NO: 3606429 - RNA, 15 nt, Human
auuaagauacaaauu

SEQ ID NO: 3606430 - RNA, 16 nt, Human
auuaagauacaaauua

SEQ ID NO: 3606431 - RNA, 15 nt, Human
auuaagauuauaauu

SEQ ID NO: 3606432 - RNA, 17 nt, Human
auuaagauugaggccug

SEQ ID NO: 3606433 - RNA, 15 nt, Human
auuaagcaguaaaaa

SEQ ID NO: 3606434 - RNA, 19 nt, Human
auuaagcaguaaaaacugu

SEQ ID NO: 3606435 - RNA, 20 nt, Human
auuaagcccacaguauauuu

SEQ ID NO: 3606436 - RNA, 20 nt, Human
auuaagcccucuuccaucau

SEQ ID NO: 3606437 - RNA, 13 nt, Human
auuaaggaagaca

SEQ ID NO: 3606438 - RNA, 23 nt, Human
auuaaggauguagcuuuucaccu

SEQ ID NO: 3606439 - RNA, 20 nt, Human
auuaaggcaacugaacaaaa

SEQ ID NO: 3606440 - RNA, 17 nt, Human
auuaagguaguuauuca

SEQ ID NO: 3606441 - RNA, 16 nt, Human
auuaaggucucucuuu

SEQ ID NO: 3606442 - RNA, 21 nt, Human
auuaaggucucucuuuggacu

SEQ ID NO: 3606443 - RNA, 16 nt, Human
auuaaggugaugugau

SEQ ID NO: 3606444 - RNA, 15 nt, Human
auuaagguguuugaa

SEQ ID NO: 3606445 - RNA, 20 nt, Human
auuaagguguuugaaaauag

SEQ ID NO: 3606446 - RNA, 15 nt, Human
auuaaguaaugauaa

SEQ ID NO: 3606447 - RNA, 21 nt, Human
auuaaguaaugauaacuggaa

SEQ ID NO: 3606448 - RNA, 16 nt, Human
auuaagucaagaauau

SEQ ID NO: 3606449 - RNA, 21 nt, Human
auuaaguccuacuuuuaaaga

SEQ ID NO: 3606450 - RNA, 24 nt, Human
auuaagucugugagauucauucau

SEQ ID NO: 3606451 - RNA, 13 nt, Human
auuaaguuaucuu

SEQ ID NO: 3606452 - RNA, 13 nt, Human
auuaaguuguuaa

SEQ ID NO: 3606453 - RNA, 17 nt, Human
auuaauaaauagagcaa

SEQ ID NO: 3606454 - RNA, 16 nt, Human
auuaauaaucuuauua

SEQ ID NO: 3606455 - RNA, 21 nt, Human
auuaauacucuauuuuuacau

SEQ ID NO: 3606456 - RNA, 16 nt, Human
auuaauaguaauuugu

SEQ ID NO: 3606457 - RNA, 21 nt, Human
auuaauaguaauuuguaaagu

SEQ ID NO: 3606458 - RNA, 12 nt, Human
auuaauauauua

SEQ ID NO: 3606459 - RNA, 13 nt, Human
auuaauauauuaa

SEQ ID NO: 3606460 - RNA, 18 nt, Human
auuaauaucccuacaugu

SEQ ID NO: 3606461 - RNA, 19 nt, Human
auuaauaucccuacaugua

SEQ ID NO: 3606462 - RNA, 20 nt, Human
auuaauaucccuacauguau

SEQ ID NO: 3606463 - RNA, 14 nt, Human
auuaauaugaaaac

SEQ ID NO: 3606464 - RNA, 15 nt, Human
agugagcacucccaa

SEQ ID NO: 3606465 - RNA, 21 nt, Human
agugagcagucaggaaagaga

SEQ ID NO: 3606466 - RNA, 21 nt, Human
agugagcauggaacacuucga

SEQ ID NO: 3606467 - RNA, 21 nt, Human
agugagccugaauuuuguugc

SEQ ID NO: 3606468 - RNA, 15 nt, Human
agugagccuggcucu

SEQ ID NO: 3606469 - RNA, 14 nt, Human
agugagcuacagag

SEQ ID NO: 3606470 - RNA, 16 nt, Human
agugagcucuaugggc

SEQ ID NO: 3606471 - RNA, 23 nt, Human
agugagcugagaucgugccguua

SEQ ID NO: 3606472 - RNA, 16 nt, Human
agugagcuuugcugcu

SEQ ID NO: 3606473 - RNA, 19 nt, Human
agugagcuuugcugcuaca

SEQ ID NO: 3606474 - RNA, 14 nt, Human
agugaggaaaucaa

SEQ ID NO: 3606475 - RNA, 15 nt, Human
agugaggaaaucaaa

SEQ ID NO: 3606476 - RNA, 19 nt, Human
agugaggaagccaggucca

SEQ ID NO: 3606477 - RNA, 21 nt, Human
agugaggaauaguugagcccc

SEQ ID NO: 3606478 - RNA, 14 nt, Human
agugaggaugucug

SEQ ID NO: 3606479 - RNA, 21 nt, Human
agugucuuaauuaaaagaaua

SEQ ID NO: 3606480 - RNA, 14 nt, Human
agugucuuccauaa

SEQ ID NO: 3606481 - RNA, 16 nt, Human
agugucuuccuguggg

SEQ ID NO: 3606482 - RNA, 13 nt, Human
agugucuuuccac

SEQ ID NO: 3606483 - RNA, 22 nt, Human
agugucuuucuuuggugccuuu

SEQ ID NO: 3606484 - RNA, 16 nt, Human
agugugaaauauauua

SEQ ID NO: 3606485 - RNA, 22 nt, Human
agugugaacaaaagaugcucuu

SEQ ID NO: 3606486 - RNA, 20 nt, Human
agugugaagcuuccuuggcu

SEQ ID NO: 3606487 - RNA, 12 nt, Human
agugugaaguua

SEQ ID NO: 3606488 - RNA, 14 nt, Human
agugugaaguuaga

SEQ ID NO: 3606489 - RNA, 20 nt, Human
agugugaaguuagaauuccu

SEQ ID NO: 3606490 - RNA, 21 nt, Human
agugugaaguuagaauuccuu

SEQ ID NO: 3606491 - RNA, 18 nt, Human
agugugaauaaagugcug

SEQ ID NO: 3606492 - RNA, 23 nt, Human
agugugacaaggauugcuacugu

SEQ ID NO: 3606493 - RNA, 15 nt, Human
agugugacagggcca

SEQ ID NO: 3606494 - RNA, 17 nt, Human
agugugacagggccagu

SEQ ID NO: 3606495 - RNA, 17 nt, Human
agugugaccaaaaguua

SEQ ID NO: 3606496 - RNA, 22 nt, Human
agugugaccaaaaguuacaugu

SEQ ID NO: 3606497 - RNA, 14 nt, Human
agugugaccaggca

SEQ ID NO: 3606498 - RNA, 12 nt, Human
agugugaguaag

SEQ ID NO: 3606499 - RNA, 17 nt, Human
agugugaguaagagcug

SEQ ID NO: 3606500 - RNA, 18 nt, Human
agugugauugggaauaaa

SEQ ID NO: 3606501 - RNA, 21 nt, Human
agugugauugggaauaaauau

SEQ ID NO: 3606502 - RNA, 16 nt, Human
agugugcacgaguggg

SEQ ID NO: 3606503 - RNA, 19 nt, Human
agugugcacgagugggaag

SEQ ID NO: 3606504 - RNA, 16 nt, Human
auuaaagaaaaaaaug

SEQ ID NO: 3606505 - RNA, 13 nt, Human
auuaaagaaaaua

SEQ ID NO: 3606506 - RNA, 20 nt, Human
auuaaagaaggguugagcug

SEQ ID NO: 3606507 - RNA, 21 nt, Human
auuaaagaaggguugagcugg

SEQ ID NO: 3606508 - RNA, 13 nt, Human
auuaaagacagag

SEQ ID NO: 3606509 - RNA, 15 nt, Human
auuaaagacuccagu

SEQ ID NO: 3606510 - RNA, 17 nt, Human
auuaaagcuaaaguauc

SEQ ID NO: 3606511 - RNA, 16 nt, Human
auuaaaggcuucucuc

SEQ ID NO: 3606512 - RNA, 19 nt, Human
auuaaaggcuucucucuca

SEQ ID NO: 3606513 - RNA, 20 nt, Human
auuaaaggcuucucucucac

SEQ ID NO: 3606514 - RNA, 11 nt, Human
auuaaagucag

SEQ ID NO: 3606515 - RNA, 18 nt, Human
auuaaagugauacugaaa

SEQ ID NO: 3606516 - RNA, 21 nt, Human
auuaaagugcuaagguucuaa

SEQ ID NO: 3606517 - RNA, 15 nt, Human
auuaaaguguccauu

SEQ ID NO: 3606518 - RNA, 21 nt, Human
auuaaaguucuguaaaauaua

SEQ ID NO: 3606519 - RNA, 16 nt, Human
auuaaaguuucaaaaa

SEQ ID NO: 3606520 - RNA, 20 nt, Human
auuaaaguuucaaaaaucug

SEQ ID NO: 3606521 - RNA, 13 nt, Human
auuaaauaaaaug

SEQ ID NO: 3606522 - RNA, 16 nt, Human
auuaaauaagauucua

SEQ ID NO: 3606523 - RNA, 17 nt, Human
auuaaauacaaaacuuc

SEQ ID NO: 3606524 - RNA, 14 nt, Human
auuaaauacagaca

SEQ ID NO: 3606525 - RNA, 13 nt, Human
auuaaauacauau

SEQ ID NO: 3606526 - RNA, 17 nt, Human
auuaaauaguuauauaa

SEQ ID NO: 3606527 - RNA, 14 nt, Human
auuaaauauauuuu

SEQ ID NO: 3606528 - RNA, 18 nt, Human
auuaaaucuaugaaguau

SEQ ID NO: 3606529 - RNA, 11 nt, Human
auuaaaucugu

SEQ ID NO: 3606530 - RNA, 18 nt, Human
auuaaaugaacaucuaua

SEQ ID NO: 3606531 - RNA, 19 nt, Human
auuaaaugaauauuuugau

SEQ ID NO: 3606532 - RNA, 22 nt, Human
auuaaaugaauauuuugauaau

SEQ ID NO: 3606533 - RNA, 21 nt, Human
auuaaaugacucuucccucaa

SEQ ID NO: 3606534 - RNA, 15 nt, Human
auuaaaugcccagcc

SEQ ID NO: 3606535 - RNA, 19 nt, Human
auuaaaugcccagccccuu

SEQ ID NO: 3606536 - RNA, 16 nt, Human
auuaaaugcuucauuu

SEQ ID NO: 3606537 - RNA, 11 nt, Human
auuaaauguuu

SEQ ID NO: 3606538 - RNA, 13 nt, Human
auuaaauguuuga

SEQ ID NO: 3606539 - RNA, 13 nt, Human
auuaaauuacaga

SEQ ID NO: 3606540 - RNA, 13 nt, Human
auuaaauuaggaa

SEQ ID NO: 3606541 - RNA, 13 nt, Human
auuaaauucacaa

SEQ ID NO: 3606542 - RNA, 17 nt, Human
auuaaauucacaaacuu

SEQ ID NO: 3606543 - RNA, 13 nt, Human
auuaaauucuugc

SEQ ID NO: 3606544 - RNA, 12 nt, Human
auuaaauuuaau

SEQ ID NO: 3606545 - RNA, 13 nt, Human
auuaaauuuaauu

SEQ ID NO: 3606546 - RNA, 15 nt, Human
auuaaauuuaauuag

SEQ ID NO: 3606547 - RNA, 17 nt, Human
auuaaauuugcaacaau

SEQ ID NO: 3606548 - RNA, 20 nt, Human
auuaaauuuugaguucuaca

SEQ ID NO: 3606549 - RNA, 13 nt, Human
auuaaauuuuucc

SEQ ID NO: 3606550 - RNA, 19 nt, Human
auuaaauuuuuuguugaca

SEQ ID NO: 3606551 - RNA, 16 nt, Human
auuaaauuuuuuugua

SEQ ID NO: 3606552 - RNA, 21 nt, Human
auuaaauuuuuuuguaugaaa

SEQ ID NO: 3606553 - RNA, 22 nt, Human
auuaaauuuuuuuguaugaaaa

SEQ ID NO: 3606554 - RNA, 18 nt, Human
auuaaauuuuuuuuacau

SEQ ID NO: 3606555 - RNA, 12 nt, Human
auuaacaaaagu

SEQ ID NO: 3606556 - RNA, 16 nt, Human
auuaacaauuaauugu

SEQ ID NO: 3606557 - RNA, 21 nt, Human
auuaacacuacucaaagcaaa

SEQ ID NO: 3606558 - RNA, 11 nt, Human
auuaacacugc

SEQ ID NO: 3606559 - RNA, 14 nt, Human
auuaacaguuuucc

SEQ ID NO: 3606560 - RNA, 19 nt, Human
auuaacaguuuuccaugaa

SEQ ID NO: 3606561 - RNA, 23 nt, Human
auuaacaguuuuccaugaaaacg

SEQ ID NO: 3606562 - RNA, 12 nt, Human
auuaacauaccu

SEQ ID NO: 3606563 - RNA, 14 nt, Human
auuaacauguuaaa

SEQ ID NO: 3606564 - RNA, 19 nt, Human
auuaacauguuaaaccaug

SEQ ID NO: 3606565 - RNA, 21 nt, Human
auuaacauugggaaaucuuau

SEQ ID NO: 3606566 - RNA, 19 nt, Human
auuaaccaaaaaaguuaca

SEQ ID NO: 3606567 - RNA, 17 nt, Human
auuaaccacuucagcug

SEQ ID NO: 3606568 - RNA, 16 nt, Human
auuaaccgaugcuuua

SEQ ID NO: 3606569 - RNA, 17 nt, Human
auuaaccgaugcuuuac

SEQ ID NO: 3606570 - RNA, 21 nt, Human
auuaaccgaugcuuuaccaaa

SEQ ID NO: 3606571 - RNA, 13 nt, Human
auuaaccuagaga

SEQ ID NO: 3606572 - RNA, 14 nt, Human
auuaaccuggugcu

SEQ ID NO: 3606573 - RNA, 17 nt, Human
auuaacuaaucuauugg

SEQ ID NO: 3606574 - RNA, 14 nt, Human
auuaacuacauuua

SEQ ID NO: 3606575 - RNA, 17 nt, Human
auuaacuacauuuauga

SEQ ID NO: 3606576 - RNA, 21 nt, Human
auuaacuacauuuaugaguaa

SEQ ID NO: 3606577 - RNA, 17 nt, Human
auuaacucauuagacug

SEQ ID NO: 3606578 - RNA, 22 nt, Human
auuaacugaguagcucuccuga

SEQ ID NO: 3606579 - RNA, 17 nt, Human
auuaacugcuuccuaua

SEQ ID NO: 3606580 - RNA, 19 nt, Human
auuaacuuaauaaucaaga

SEQ ID NO: 3606581 - RNA, 12 nt, Human
auuaacuuauuu

SEQ ID NO: 3606582 - RNA, 18 nt, Human
auuaacuucucuggaaag

SEQ ID NO: 3606583 - RNA, 16 nt, Human
auuaacuuuuauaaac

SEQ ID NO: 3606584 - RNA, 17 nt, Human
auuaacuuuuauaaacu

SEQ ID NO: 3606585 - RNA, 23 nt, Human
auuaacuuuuauaaacuuuaccu

SEQ ID NO: 3606586 - RNA, 13 nt, Human
auuaagaaaauca

SEQ ID NO: 3606587 - RNA, 14 nt, Human
auuaagaaaaucau

SEQ ID NO: 3606588 - RNA, 15 nt, Human
auuaagaaaaucuau

SEQ ID NO: 3606589 - RNA, 14 nt, Human
auuaagaagaaaau

SEQ ID NO: 3606590 - RNA, 14 nt, Human
auuaagaagaaacu

SEQ ID NO: 3606591 - RNA, 19 nt, Human
auuaagaaggcaaaaaugu

SEQ ID NO: 3606592 - RNA, 20 nt, Human
auuaagaauauguuuccuug

SEQ ID NO: 3606593 - RNA, 16 nt, Human
auuaagaaugaaauac

SEQ ID NO: 3606594 - RNA, 14 nt, Human
auuaagaaugaucu

SEQ ID NO: 3606595 - RNA, 23 nt, Human
auuaagaauguugguuuacuuuc

SEQ ID NO: 3606596 - RNA, 17 nt, Human
auuaagaggcagaaaau

SEQ ID NO: 3606597 - RNA, 20 nt, Human
auuaagauggauucucagau

SEQ ID NO: 3606598 - RNA, 23 nt, Human
auuaagauggauucucagauauu

SEQ ID NO: 3606599 - RNA, 16 nt, Human
auuaagauuauaauug

SEQ ID NO: 3606600 - RNA, 17 nt, Human
auuaagauuauaauugu

SEQ ID NO: 3606601 - RNA, 13 nt, Human
auuaagauuucca

SEQ ID NO: 3606602 - RNA, 15 nt, Human
auuaagauuuuacaa

SEQ ID NO: 3606603 - RNA, 18 nt, Human
auuaagauuuuacaaaag

SEQ ID NO: 3606604 - RNA, 11 nt, Human
auuaagcaaau

SEQ ID NO: 3606605 - RNA, 17 nt, Human
auuaagcaaauguuaaa

SEQ ID NO: 3606606 - RNA, 14 nt, Human
auuaagcauauauu

SEQ ID NO: 3606607 - RNA, 15 nt, Human
auuaagcauauauuu

SEQ ID NO: 3606608 - RNA, 14 nt, Human
auuaagcaucagaa

SEQ ID NO: 3606609 - RNA, 20 nt, Human
auuaagcaugacagaaaaua

SEQ ID NO: 3606610 - RNA, 16 nt, Human
auuaagcccucuucca

SEQ ID NO: 3606611 - RNA, 17 nt, Human
auuaagcccucuuccau

SEQ ID NO: 3606612 - RNA, 18 nt, Human
auuaagcuuuuuggaauc

SEQ ID NO: 3606613 - RNA, 14 nt, Human
auuaaggauguagc

SEQ ID NO: 3606614 - RNA, 18 nt, Human
auuaaggauguagcuuuu

SEQ ID NO: 3606615 - RNA, 21 nt, Human
auuaaggauguagcuuuucac

SEQ ID NO: 3606616 - RNA, 17 nt, Human
auuaaggauuuuaugcu

SEQ ID NO: 3606617 - RNA, 20 nt, Human
auuaagggccgauuuaauua

SEQ ID NO: 3606618 - RNA, 18 nt, Human
auuaaggggaagaaugaa

SEQ ID NO: 3606619 - RNA, 15 nt, Human
auuaaggugauguga

SEQ ID NO: 3606620 - RNA, 17 nt, Human
auuaaggugaugugauu

SEQ ID NO: 3606621 - RNA, 18 nt, Human
auuaagguguuugaaaau

SEQ ID NO: 3606622 - RNA, 19 nt, Human
auuaaguaacuuauuuaug

SEQ ID NO: 3606623 - RNA, 19 nt, Human
auuaaguaagucucaaggu

SEQ ID NO: 3606624 - RNA, 23 nt, Human
auuaaguaaugauaacuggaaac

SEQ ID NO: 3606625 - RNA, 16 nt, Human
auuaaguacuauguau

SEQ ID NO: 3606626 - RNA, 19 nt, Human
auuaaguacuauguaucaa

SEQ ID NO: 3606627 - RNA, 17 nt, Human
auuaaguaucugacauc

SEQ ID NO: 3606628 - RNA, 19 nt, Human
auuaaguucucaaugugaa

SEQ ID NO: 3606629 - RNA, 15 nt, Human
auuaauaauaaauuc

SEQ ID NO: 3606630 - RNA, 12 nt, Human
auuaauaaucuu

SEQ ID NO: 3606631 - RNA, 13 nt, Human
auuaauaaucuua

SEQ ID NO: 3606632 - RNA, 18 nt, Human
auuaauagcagccuuucu

SEQ ID NO: 3606633 - RNA, 18 nt, Human
auuaauagcauucgaaga

SEQ ID NO: 3606634 - RNA, 20 nt, Human
auuaauauauguauuauuua

SEQ ID NO: 3606635 - RNA, 14 nt, Human
auuaauaucuuucu

SEQ ID NO: 3606636 - RNA, 17 nt, Human
auuaauaucuuucugca

SEQ ID NO: 3606637 - RNA, 19 nt, Human
auuaauaucuuucugcaca

SEQ ID NO: 3606638 - RNA, 12 nt, Human
auuaauaugaaa

SEQ ID NO: 3606639 - RNA, 19 nt, Human
auuaauauucauuguauaa

SEQ ID NO: 3606640 - RNA, 17 nt, Human
auuaauauuccucaguu

SEQ ID NO: 3606641 - RNA, 23 nt, Human
auuaauauuuaacauuauuuaua

SEQ ID NO: 3606642 - RNA, 23 nt, Human
auuaaucaaucaucugugugaaa

SEQ ID NO: 3606643 - RNA, 16 nt, Human
auuaaucacuguguau

SEQ ID NO: 3606644 - RNA, 17 nt, Human
auuaaucacuguguaua

SEQ ID NO: 3606645 - RNA, 18 nt, Human
auuaaucacuguguauau

SEQ ID NO: 3606646 - RNA, 19 nt, Human
auuaaucacuguguauauu

SEQ ID NO: 3606647 - RNA, 20 nt, Human
auuaaucacuguguauauuu

SEQ ID NO: 3606648 - RNA, 21 nt, Human
auuaaucacuguguauauuug

SEQ ID NO: 3606649 - RNA, 14 nt, Human
auuaaucaucuaua

SEQ ID NO: 3606650 - RNA, 15 nt, Human
auuaaucaugaaugu

SEQ ID NO: 3606651 - RNA, 19 nt, Human
auuaaucaugaauguguaa

SEQ ID NO: 3606652 - RNA, 18 nt, Human
auuaauccacauguuuca

SEQ ID NO: 3606653 - RNA, 14 nt, Human
auuaauccagaaua

SEQ ID NO: 3606654 - RNA, 16 nt, Human
auuaaucugccucccu

SEQ ID NO: 3606655 - RNA, 22 nt, Human
agugugcacgagugggaaggac

SEQ ID NO: 3606656 - RNA, 17 nt, Human
agugugcacuaaggggc

SEQ ID NO: 3606657 - RNA, 22 nt, Human
agugugcacuaaggggcccggc

SEQ ID NO: 3606658 - RNA, 15 nt, Human
agugugcauauugua

SEQ ID NO: 3606659 - RNA, 18 nt, Human
agugugcauggaggcccu

SEQ ID NO: 3606660 - RNA, 17 nt, Human
agugugccccccauccu

SEQ ID NO: 3606661 - RNA, 20 nt, Human
agugugccccccauccuggc

SEQ ID NO: 3606662 - RNA, 22 nt, Human
agugugccccccauccuggccc

SEQ ID NO: 3606663 - RNA, 20 nt, Human
agugugccugaagucccaga

SEQ ID NO: 3606664 - RNA, 21 nt, Human
agugugccugaagucccagau

SEQ ID NO: 3606665 - RNA, 20 nt, Human
agugugcgugguggucccug

SEQ ID NO: 3606666 - RNA, 16 nt, Human
agugugcuaaaaauga

SEQ ID NO: 3606667 - RNA, 20 nt, Human
agugugcugcuguaagaaau

SEQ ID NO: 3606668 - RNA, 19 nt, Human
aguguggaaauuaagaaga

SEQ ID NO: 3606669 - RNA, 18 nt, Human
aguguggagucauucuca

SEQ ID NO: 3606670 - RNA, 23 nt, Human
aguguggagucauucucauugaa

SEQ ID NO: 3606671 - RNA, 22 nt, Human
aguguggaguggguaauccagg

SEQ ID NO: 3606672 - RNA, 15 nt, Human
aguguggcaaaauaa

SEQ ID NO: 3606673 - RNA, 13 nt, Human
aguguggccaggc

SEQ ID NO: 3606674 - RNA, 16 nt, Human
aguguggcuccccucu

SEQ ID NO: 3606675 - RNA, 17 nt, Human
aguguggcuccccucua

SEQ ID NO: 3606676 - RNA, 14 nt, Human
agugugggaaugcg

SEQ ID NO: 3606677 - RNA, 16 nt, Human
agugugggucugugug

SEQ ID NO: 3606678 - RNA, 17 nt, Human
agugugggucugugugu

SEQ ID NO: 3606679 - RNA, 16 nt, Human
agugugguguuuccug

SEQ ID NO: 3606680 - RNA, 19 nt, Human
agugugguguuuccuggca

SEQ ID NO: 3606681 - RNA, 22 nt, Human
agugugguguuuccuggcacug

SEQ ID NO: 3606682 - RNA, 22 nt, Human
agugugguuaugaacuuuauag

SEQ ID NO: 3606683 - RNA, 9 nt, Human
aguguguaa

SEQ ID NO: 3606684 - RNA, 23 nt, Human
aguguguauauauuuugugugaa

SEQ ID NO: 3606685 - RNA, 16 nt, Human
aguguguaugccaaga

SEQ ID NO: 3606686 - RNA, 19 nt, Human
aguguguaugugcgugugu

SEQ ID NO: 3606687 - RNA, 20 nt, Human
aguguguaugugcgugugug

SEQ ID NO: 3606688 - RNA, 20 nt, Human
aguguguauuaaaaaaaaca

SEQ ID NO: 3606689 - RNA, 19 nt, Human
aguguguauuguucccagu

SEQ ID NO: 3606690 - RNA, 21 nt, Human
aguguguauuguucccaguga

SEQ ID NO: 3606691 - RNA, 21 nt, Human
aguguguccaagugugugugc

SEQ ID NO: 3606692 - RNA, 19 nt, Human
agugugucuccugcaugca

SEQ ID NO: 3606693 - RNA, 22 nt, Human
agugugugcacaugugugcgug

SEQ ID NO: 3606694 - RNA, 16 nt, Human
agugugugcaugugug

SEQ ID NO: 3606695 - RNA, 19 nt, Human
aguguguggucaacauuuc

SEQ ID NO: 3606696 - RNA, 16 nt, Human
agugugugguguuagg

SEQ ID NO: 3606697 - RNA, 20 nt, Human
aguguguguggcagcaggca

SEQ ID NO: 3606698 - RNA, 20 nt, Human
agugugugugugcaugugug

SEQ ID NO: 3606699 - RNA, 18 nt, Human
aguguguguuuuucauaa

SEQ ID NO: 3606700 - RNA, 12 nt, Human
aguguguucuga

SEQ ID NO: 3606701 - RNA, 15 nt, Human
aguguguuguugcuu

SEQ ID NO: 3606702 - RNA, 21 nt, Human
aguguuaaaaaauuuuugaaa

SEQ ID NO: 3606703 - RNA, 15 nt, Human
aguguuaauacuagu

SEQ ID NO: 3606704 - RNA, 15 nt, Human
aguguuaaucaauuu

SEQ ID NO: 3606705 - RNA, 15 nt, Human
aguguuaccugugug

SEQ ID NO: 3606706 - RNA, 17 nt, Human
aguguuaccugugugcu

SEQ ID NO: 3606707 - RNA, 21 nt, Human
aguguuagccuuuuuucccca

SEQ ID NO: 3606708 - RNA, 15 nt, Human
aguguuaggccuggc

SEQ ID NO: 3606709 - RNA, 16 nt, Human
aguguuaggccuggca

SEQ ID NO: 3606710 - RNA, 18 nt, Human
aguguuagggaagggccu

SEQ ID NO: 3606711 - RNA, 19 nt, Human
aguguuaugcggucuaggg

SEQ ID NO: 3606712 - RNA, 14 nt, Human
aguguuauguauuu

SEQ ID NO: 3606713 - RNA, 21 nt, Human
aguguucauaaauaaaguuug

SEQ ID NO: 3606714 - RNA, 16 nt, Human
aguguuccccuuccac

SEQ ID NO: 3606715 - RNA, 14 nt, Human
aguguucccuaucc

SEQ ID NO: 3606716 - RNA, 18 nt, Human
aguguucccuuuccuacu

SEQ ID NO: 3606717 - RNA, 16 nt, Human
aguguuccuauuuggg

SEQ ID NO: 3606718 - RNA, 13 nt, Human
aguguucugucua

SEQ ID NO: 3606719 - RNA, 15 nt, Human
aguguucuguuacaa

SEQ ID NO: 3606720 - RNA, 20 nt, Human
aguguucuguuacaaaaugu

SEQ ID NO: 3606721 - RNA, 16 nt, Human
aguguucuuucucuuu

SEQ ID NO: 3606722 - RNA, 17 nt, Human
aguguugaaaauguuca

SEQ ID NO: 3606723 - RNA, 20 nt, Human
aguguugagcaucugucccc

SEQ ID NO: 3606724 - RNA, 16 nt, Human
aguguugccuaaguau

SEQ ID NO: 3606725 - RNA, 17 nt, Human
aguguugccuaaguauu

SEQ ID NO: 3606726 - RNA, 23 nt, Human
aguguuggagaagaacugaaauc

SEQ ID NO: 3606727 - RNA, 23 nt, Human
aguguugguuuaauauuaccuaa

SEQ ID NO: 3606728 - RNA, 19 nt, Human
aguguuguggauuuaacag

SEQ ID NO: 3606729 - RNA, 22 nt, Human
aguguuguuuguaaauaagaga

SEQ ID NO: 3606730 - RNA, 18 nt, Human
aguguuuauguuguuuau

SEQ ID NO: 3606731 - RNA, 14 nt, Human
aguguuucaugggu

SEQ ID NO: 3606732 - RNA, 15 nt, Human
aguguuucccauaau

SEQ ID NO: 3606733 - RNA, 16 nt, Human
aguguuucccauaauu

SEQ ID NO: 3606734 - RNA, 19 nt, Human
aguguuucgacagcugauu

SEQ ID NO: 3606735 - RNA, 20 nt, Human
aguguuucuaugaguggaaa

SEQ ID NO: 3606736 - RNA, 15 nt, Human
aguguuucugugcau

SEQ ID NO: 3606737 - RNA, 13 nt, Human
aguguuucuguua

SEQ ID NO: 3606738 - RNA, 15 nt, Human
aguguuucuguuauu

SEQ ID NO: 3606739 - RNA, 22 nt, Human
aguguuugggggacguuucuca

SEQ ID NO: 3606740 - RNA, 19 nt, Human
aguguuuuaaauucugaga

SEQ ID NO: 3606741 - RNA, 18 nt, Human
aguguuuuaugagaaagc

SEQ ID NO: 3606742 - RNA, 18 nt, Human
aguguuuucagaagaaau

SEQ ID NO: 3606743 - RNA, 15 nt, Human
aguguuuucugggau

SEQ ID NO: 3606744 - RNA, 13 nt, Human
aguguuuugcaag

SEQ ID NO: 3606745 - RNA, 15 nt, Human
aguguuuuggacucc

SEQ ID NO: 3606746 - RNA, 16 nt, Human
aguguuuuguaccagu

SEQ ID NO: 3606747 - RNA, 17 nt, Human
aguguuuuuaccucugu

SEQ ID NO: 3606748 - RNA, 13 nt, Human
aguuaaaaaaaaa

SEQ ID NO: 3606749 - RNA, 23 nt, Human
aguuaaaaaaaaaaaaaggaaaa

SEQ ID NO: 3606750 - RNA, 14 nt, Human
aguuaaaaaaaaua

SEQ ID NO: 3606751 - RNA, 15 nt, Human
aguuaaaaaaaauaa

SEQ ID NO: 3606752 - RNA, 19 nt, Human
aguuaaaaaaaauaauaaa

SEQ ID NO: 3606753 - RNA, 18 nt, Human
aguuaaaagcacaaagga

SEQ ID NO: 3606754 - RNA, 19 nt, Human
aguuaaaagcacaaaggaa

SEQ ID NO: 3606755 - RNA, 20 nt, Human
aguuaaaauuguuaucaaaa

SEQ ID NO: 3606756 - RNA, 22 nt, Human
aguuaaaauuguuaucaaaaua

SEQ ID NO: 3606757 - RNA, 14 nt, Human
aguuaaagaaagga

SEQ ID NO: 3606758 - RNA, 14 nt, Human
aguuaaaucucaaa

SEQ ID NO: 3606759 - RNA, 12 nt, Human
aguuaaauguag

SEQ ID NO: 3606760 - RNA, 14 nt, Human
aguuaaauuuucau

SEQ ID NO: 3606761 - RNA, 12 nt, Human
aguuaacacacu

SEQ ID NO: 3606762 - RNA, 13 nt, Human
aguuaacacacua

SEQ ID NO: 3606763 - RNA, 16 nt, Human
aguuaacacacuaccg

SEQ ID NO: 3606764 - RNA, 22 nt, Human
aguuaacacacuaccgaaugug

SEQ ID NO: 3606765 - RNA, 19 nt, Human
aguuaacagacaacacguu

SEQ ID NO: 3606766 - RNA, 19 nt, Human
aguuaacaggcaaacauuu

SEQ ID NO: 3606767 - RNA, 15 nt, Human
aguuaacuauugcau

SEQ ID NO: 3606768 - RNA, 17 nt, Human
aguuaacuauugcauuu

SEQ ID NO: 3606769 - RNA, 15 nt, Human
aguuaagaagcuguu

SEQ ID NO: 3606770 - RNA, 22 nt, Human
aguuaagaagcuguuguacauu

SEQ ID NO: 3606771 - RNA, 19 nt, Human
aguuaagacaugauuuccu

SEQ ID NO: 3606772 - RNA, 17 nt, Human
aguuaagaccuggcagc

SEQ ID NO: 3606773 - RNA, 13 nt, Human
aguuaagagaaac

SEQ ID NO: 3606774 - RNA, 15 nt, Human
aguuaagagaaacuu

SEQ ID NO: 3606775 - RNA, 14 nt, Human
aguuaagccuuugg

SEQ ID NO: 3606776 - RNA, 18 nt, Human
aguuaaggagaaucaugu

SEQ ID NO: 3606777 - RNA, 16 nt, Human
aguuaaggugggcccg

SEQ ID NO: 3606778 - RNA, 20 nt, Human
aguuaauaagcaaaauccug

SEQ ID NO: 3606779 - RNA, 20 nt, Human
aguuaauguauauaaaaaug

SEQ ID NO: 3606780 - RNA, 14 nt, Human
aguuaauuagcauu

SEQ ID NO: 3606781 - RNA, 14 nt, Human
aguuaauuuaaagu

SEQ ID NO: 3606782 - RNA, 21 nt, Human
aguuacaaauuauaauguauu

SEQ ID NO: 3606783 - RNA, 22 nt, Human
aguuacaaauuauaauguauuc

SEQ ID NO: 3606784 - RNA, 21 nt, Human
aguuacacagaaaugcugcug

SEQ ID NO: 3606785 - RNA, 13 nt, Human
aguuacacauuuu

SEQ ID NO: 3606786 - RNA, 19 nt, Human
aguuacacauuuuucagau

SEQ ID NO: 3606787 - RNA, 16 nt, Human
aguuacagaaaguggu

SEQ ID NO: 3606788 - RNA, 19 nt, Human
aguuacagaaaugauuacu

SEQ ID NO: 3606789 - RNA, 16 nt, Human
aguuacagacaaagcg

SEQ ID NO: 3606790 - RNA, 18 nt, Human
aguuacagacaaagcgug

SEQ ID NO: 3606791 - RNA, 22 nt, Human
aguuacagccuguuaguaacau

SEQ ID NO: 3606792 - RNA, 23 nt, Human
aguuacagcgagaggcagagaaa

SEQ ID NO: 3606793 - RNA, 14 nt, Human
aguuacaguucugu

SEQ ID NO: 3606794 - RNA, 21 nt, Human
aguuacaugcauacuucaaaa

SEQ ID NO: 3606795 - RNA, 22 nt, Human
aguuacaugcauacuucaaaag

SEQ ID NO: 3606796 - RNA, 15 nt, Human
aguuaccagugccuu

SEQ ID NO: 3606797 - RNA, 17 nt, Human
aguuacccaaauuaaga

SEQ ID NO: 3606798 - RNA, 18 nt, Human
aguuacccaaauuaagag

SEQ ID NO: 3606799 - RNA, 23 nt, Human
aguuaccugagagauuuaacauu

SEQ ID NO: 3606800 - RNA, 22 nt, Human
aguuaccuuauaguuacugugu

SEQ ID NO: 3606801 - RNA, 18 nt, Human
aguuacuaagaagaaaau

SEQ ID NO: 3606802 - RNA, 23 nt, Human
aguuacuaagaagaaaauugcug

SEQ ID NO: 3606803 - RNA, 21 nt, Human
aguuacuaccuccucuccuga

SEQ ID NO: 3606804 - RNA, 21 nt, Human
auuaaucuuaguguaugauua

SEQ ID NO: 3606805 - RNA, 15 nt, Human
auuaaucuuggauag

SEQ ID NO: 3606806 - RNA, 23 nt, Human
auuaaucuuucuuuaccugagac

SEQ ID NO: 3606807 - RNA, 17 nt, Human
auuaaucuuuuauauug

SEQ ID NO: 3606808 - RNA, 12 nt, Human
auuaaugaaaua

SEQ ID NO: 3606809 - RNA, 18 nt, Human
auuaaugaaauaucugua

SEQ ID NO: 3606810 - RNA, 16 nt, Human
auuaaugacacuuguc

SEQ ID NO: 3606811 - RNA, 13 nt, Human
auuaaugcacuuu

SEQ ID NO: 3606812 - RNA, 14 nt, Human
auuaaugcacuuuc

SEQ ID NO: 3606813 - RNA, 20 nt, Human
auuaaugccauuaucccuga

SEQ ID NO: 3606814 - RNA, 17 nt, Human
auuaaugccuuuaaagu

SEQ ID NO: 3606815 - RNA, 14 nt, Human
auuaaugcuaaggg

SEQ ID NO: 3606816 - RNA, 12 nt, Human
auuaaugcuuug

SEQ ID NO: 3606817 - RNA, 15 nt, Human
auuaauggaaauguu

SEQ ID NO: 3606818 - RNA, 13 nt, Human
auuaauggcacug

SEQ ID NO: 3606819 - RNA, 14 nt, Human
auuaauggcacuga

SEQ ID NO: 3606820 - RNA, 15 nt, Human
auuaauggcacugau

SEQ ID NO: 3606821 - RNA, 15 nt, Human
auuaauggucuaaaa

SEQ ID NO: 3606822 - RNA, 12 nt, Human
auuaauguguug

SEQ ID NO: 3606823 - RNA, 13 nt, Human
auuaauguuaauu

SEQ ID NO: 3606824 - RNA, 15 nt, Human
auuaauguugauuuc

SEQ ID NO: 3606825 - RNA, 16 nt, Human
auuaauguugauuucu

SEQ ID NO: 3606826 - RNA, 12 nt, Human
auuaauguuucu

SEQ ID NO: 3606827 - RNA, 16 nt, Human
auuaauguuucuaucu

SEQ ID NO: 3606828 - RNA, 18 nt, Human
auuaauguuucuaucuga

SEQ ID NO: 3606829 - RNA, 20 nt, Human
auuaauguuucuaucugauu

SEQ ID NO: 3606830 - RNA, 15 nt, Human
auuaauguuuucaaa

SEQ ID NO: 3606831 - RNA, 16 nt, Human
auuaauuaauuuggag

SEQ ID NO: 3606832 - RNA, 19 nt, Human
auuaauucaccuuccagug

SEQ ID NO: 3606833 - RNA, 22 nt, Human
auuaauuccuucagcacuuuag

SEQ ID NO: 3606834 - RNA, 13 nt, Human
auuaauucuauaa

SEQ ID NO: 3606835 - RNA, 13 nt, Human
auuaauugcuuug

SEQ ID NO: 3606836 - RNA, 14 nt, Human
auuaauugcuuuga

SEQ ID NO: 3606837 - RNA, 17 nt, Human
auuaauuggcagcagau

SEQ ID NO: 3606838 - RNA, 20 nt, Human
auuaauuggcagcagauuuu

SEQ ID NO: 3606839 - RNA, 20 nt, Human
auuaauugugugaacuugga

SEQ ID NO: 3606840 - RNA, 15 nt, Human
auuaauuuaucagau

SEQ ID NO: 3606841 - RNA, 20 nt, Human
auuaauuugauuaacaaaua

SEQ ID NO: 3606842 - RNA, 18 nt, Human
auuaauuuuaguuuuuca

SEQ ID NO: 3606843 - RNA, 17 nt, Human
auuaauuuuuuuauugu

SEQ ID NO: 3606844 - RNA, 21 nt, Human
auuaauuuuuuuauuguuuaa

SEQ ID NO: 3606845 - RNA, 22 nt, Human
auuaauuuuuuuauuguuuaaa

SEQ ID NO: 3606846 - RNA, 16 nt, Human
auuaauuuuuuuucau

SEQ ID NO: 3606847 - RNA, 13 nt, Human
auuacaaaguuaa

SEQ ID NO: 3606848 - RNA, 22 nt, Human
auuacaaauauauagcacauca

SEQ ID NO: 3606849 - RNA, 14 nt, Human
auuacaaauugcuu

SEQ ID NO: 3606850 - RNA, 15 nt, Human
auuacaaauugcuua

SEQ ID NO: 3606851 - RNA, 15 nt, Human
auuacaacggaguca

SEQ ID NO: 3606852 - RNA, 20 nt, Human
auuacaagccuggaaaaaaa

SEQ ID NO: 3606853 - RNA, 12 nt, Human
auuacaauggaa

SEQ ID NO: 3606854 - RNA, 15 nt, Human
auuacaauggaaaca

SEQ ID NO: 3606855 - RNA, 14 nt, Human
auuacaauuuuauc

SEQ ID NO: 3606856 - RNA, 18 nt, Human
auuacacauuuguacaga

SEQ ID NO: 3606857 - RNA, 18 nt, Human
auuacacuguauuuguau

SEQ ID NO: 3606858 - RNA, 19 nt, Human
auuacacuguauuuguauc

SEQ ID NO: 3606859 - RNA, 20 nt, Human
auuacacuguauuuguaucu

SEQ ID NO: 3606860 - RNA, 12 nt, Human
auuacagagagg

SEQ ID NO: 3606861 - RNA, 15 nt, Human
auuacagagaggaga

SEQ ID NO: 3606862 - RNA, 22 nt, Human
auuacagagaggagaaacacau

SEQ ID NO: 3606863 - RNA, 17 nt, Human
auuacagaggaaguuau

SEQ ID NO: 3606864 - RNA, 21 nt, Human
auuacagagguauuaaaacua

SEQ ID NO: 3606865 - RNA, 15 nt, Human
auuacagcuggagaa

SEQ ID NO: 3606866 - RNA, 15 nt, Human
auuacaggcuccugc

SEQ ID NO: 3606867 - RNA, 16 nt, Human
auuacaggcuccugcc

SEQ ID NO: 3606868 - RNA, 16 nt, Human
auuacaggugugaacc

SEQ ID NO: 3606869 - RNA, 23 nt, Human
auuacagucucacucagaacugu

SEQ ID NO: 3606870 - RNA, 18 nt, Human
auuacagugccuaaaaua

SEQ ID NO: 3606871 - RNA, 19 nt, Human
auuacagugccuaaaauaa

SEQ ID NO: 3606872 - RNA, 15 nt, Human
auuacagugggugcc

SEQ ID NO: 3606873 - RNA, 22 nt, Human
auuacaguguuuauccuuucau

SEQ ID NO: 3606874 - RNA, 23 nt, Human
auuacaguuuuguuuaaaaggaa

SEQ ID NO: 3606875 - RNA, 22 nt, Human
auuacauaauuuaguuguuucu

SEQ ID NO: 3606876 - RNA, 15 nt, Human
auuacauccuugugg

SEQ ID NO: 3606877 - RNA, 18 nt, Human
auuacaucuuucacauug

SEQ ID NO: 3606878 - RNA, 22 nt, Human
auuacaucuuucacauuggcua

SEQ ID NO: 3606879 - RNA, 19 nt, Human
auuacauguaaaacauuau

SEQ ID NO: 3606880 - RNA, 22 nt, Human
auuacauuacugaaaacuucau

SEQ ID NO: 3606881 - RNA, 21 nt, Human
auuacauuccuugauaauguu

SEQ ID NO: 3606882 - RNA, 15 nt, Human
auuacauuuccaaau

SEQ ID NO: 3606883 - RNA, 13 nt, Human
auuacauuuguaa

SEQ ID NO: 3606884 - RNA, 14 nt, Human
auuacauuuguaau

SEQ ID NO: 3606885 - RNA, 19 nt, Human
auuacauuuguaauuuaag

SEQ ID NO: 3606886 - RNA, 23 nt, Human
auuacauuuuauuaagcuuuuug

SEQ ID NO: 3606887 - RNA, 18 nt, Human
auuaccaaaaaucuuggg

SEQ ID NO: 3606888 - RNA, 14 nt, Human
auuaccaaccuguu

SEQ ID NO: 3606889 - RNA, 22 nt, Human
auuaccaccaucccgugcuuuu

SEQ ID NO: 3606890 - RNA, 18 nt, Human
auuaccacugaagauaga

SEQ ID NO: 3606891 - RNA, 22 nt, Human
auuaccacugaagauagaagaa

SEQ ID NO: 3606892 - RNA, 23 nt, Human
auuaccagacgguucaccagccu

SEQ ID NO: 3606893 - RNA, 17 nt, Human
auuaccagaguuguucu

SEQ ID NO: 3606894 - RNA, 21 nt, Human
auuaccaguaaaguguaacau

SEQ ID NO: 3606895 - RNA, 14 nt, Human
auuaccauguaaug

SEQ ID NO: 3606896 - RNA, 19 nt, Human
auuaccauuuguuaauauc

SEQ ID NO: 3606897 - RNA, 22 nt, Human
auuacccccucauuguuuauua

SEQ ID NO: 3606898 - RNA, 13 nt, Human
auuacccccuccu

SEQ ID NO: 3606899 - RNA, 15 nt, Human
auuacccuucuuucc

SEQ ID NO: 3606900 - RNA, 15 nt, Human
auuaccuaaugaaag

SEQ ID NO: 3606901 - RNA, 21 nt, Human
auuaccuaguagucauuucau

SEQ ID NO: 3606902 - RNA, 12 nt, Human
auuaccuccuga

SEQ ID NO: 3606903 - RNA, 20 nt, Human
auuaccucuuuggaaaagga

SEQ ID NO: 3606904 - RNA, 22 nt, Human
auuaccugaauuuuggcugugu

SEQ ID NO: 3606905 - RNA, 14 nt, Human
auuaccuguggaua

SEQ ID NO: 3606906 - RNA, 15 nt, Human
auuaccuguggauau

SEQ ID NO: 3606907 - RNA, 13 nt, Human
auuaccuuacugu

SEQ ID NO: 3606908 - RNA, 21 nt, Human
auuaccuuagauuagcucugg

SEQ ID NO: 3606909 - RNA, 12 nt, Human
auuaccuucucc

SEQ ID NO: 3606910 - RNA, 22 nt, Human
auuacgaaguucaagaucaaaa

SEQ ID NO: 3606911 - RNA, 15 nt, Human
auuacggcuccucuc

SEQ ID NO: 3606912 - RNA, 12 nt, Human
auuacuaacuuc

SEQ ID NO: 3606913 - RNA, 15 nt, Human
auuacuaacuucuaa

SEQ ID NO: 3606914 - RNA, 15 nt, Human
auuacuaauuuuaca

SEQ ID NO: 3606915 - RNA, 15 nt, Human
auuacuacaaaauuu

SEQ ID NO: 3606916 - RNA, 14 nt, Human
auuacuagaguugg

SEQ ID NO: 3606917 - RNA, 14 nt, Human
auuacuccuauuuu

SEQ ID NO: 3606918 - RNA, 16 nt, Human
auuacuccuauuuuug

SEQ ID NO: 3606919 - RNA, 13 nt, Human
auuacucuuguaa

SEQ ID NO: 3606920 - RNA, 16 nt, Human
auuacucuuguaagau

SEQ ID NO: 3606921 - RNA, 21 nt, Human
auuacucuuguaagauuuuga

SEQ ID NO: 3606922 - RNA, 16 nt, Human
auuacugaaaacuuca

SEQ ID NO: 3606923 - RNA, 14 nt, Human
auuacugcaugcac

SEQ ID NO: 3606924 - RNA, 17 nt, Human
auuacugcaugcacuuc

SEQ ID NO: 3606925 - RNA, 14 nt, Human
auuacugccuugaa

SEQ ID NO: 3606926 - RNA, 12 nt, Human
auuacugcuaag

SEQ ID NO: 3606927 - RNA, 21 nt, Human
auuacugcuuuaaucagaaac

SEQ ID NO: 3606928 - RNA, 17 nt, Human
auuacuggccuuuuuca

SEQ ID NO: 3606929 - RNA, 18 nt, Human
auuacuguuuauuacuuc

SEQ ID NO: 3606930 - RNA, 18 nt, Human
auuacuuaguauugcaaa

SEQ ID NO: 3606931 - RNA, 22 nt, Human
auuacuuaguauugcaaaguca

SEQ ID NO: 3606932 - RNA, 18 nt, Human
auuacuuaucccugccca

SEQ ID NO: 3606933 - RNA, 22 nt, Human
auuacuuaucccugcccauuuc

SEQ ID NO: 3606934 - RNA, 18 nt, Human
auuacuuauuuuugacag

SEQ ID NO: 3606935 - RNA, 16 nt, Human
auuacuucucuauaaa

SEQ ID NO: 3606936 - RNA, 16 nt, Human
auuacuuguaaauaua

SEQ ID NO: 3606937 - RNA, 17 nt, Human
auuacuuguaaauauaa

SEQ ID NO: 3606938 - RNA, 20 nt, Human
auuacuuguugcaaaggucu

SEQ ID NO: 3606939 - RNA, 16 nt, Human
auuacuuuaacaugcc

SEQ ID NO: 3606940 - RNA, 12 nt, Human
auuacuuuacca

SEQ ID NO: 3606941 - RNA, 21 nt, Human
auuacuuuggggcuaauuuaa

SEQ ID NO: 3606942 - RNA, 15 nt, Human
auuacuuuuuuccaa

SEQ ID NO: 3606943 - RNA, 15 nt, Human
auuagaaaauauucu

SEQ ID NO: 3606944 - RNA, 17 nt, Human
auuagaaaauauucucu

SEQ ID NO: 3606945 - RNA, 18 nt, Human
auuagaaaauguuauuua

SEQ ID NO: 3606946 - RNA, 16 nt, Human
auuagaaauagacagu

SEQ ID NO: 3606947 - RNA, 15 nt, Human
auuagaaauauuuua

SEQ ID NO: 3606948 - RNA, 21 nt, Human
auuagaaauauuuuaaaauca

SEQ ID NO: 3606949 - RNA, 15 nt, Human
auuagaaauuagaaa

SEQ ID NO: 3606950 - RNA, 20 nt, Human
auuagaaauuagcuguguga

SEQ ID NO: 3606951 - RNA, 14 nt, Human
auuagaacccuugc

SEQ ID NO: 3606952 - RNA, 11 nt, Human
auuagaacuuc

SEQ ID NO: 3606953 - RNA, 21 nt, Human
auuagaagacaauugacaaca

SEQ ID NO: 3606954 - RNA, 19 nt, Human
auuagaaucaaacauuuug

SEQ ID NO: 3606955 - RNA, 15 nt, Human
aguuacuauccuggc

SEQ ID NO: 3606956 - RNA, 15 nt, Human
aguuacucugaaggg

SEQ ID NO: 3606957 - RNA, 14 nt, Human
aguuacugaaugca

SEQ ID NO: 3606958 - RNA, 15 nt, Human
aguuacuguaaaaug

SEQ ID NO: 3606959 - RNA, 13 nt, Human
aguuacugugcau

SEQ ID NO: 3606960 - RNA, 13 nt, Human
aguuacuugauaa

SEQ ID NO: 3606961 - RNA, 21 nt, Human
aguuacuuuagauggcaagca

SEQ ID NO: 3606962 - RNA, 20 nt, Human
aguuacuuuauguuugucuu

SEQ ID NO: 3606963 - RNA, 23 nt, Human
aguuacuuuccaauucuccuuua

SEQ ID NO: 3606964 - RNA, 21 nt, Human
aguuacuuuuccuugcauaca

SEQ ID NO: 3606965 - RNA, 18 nt, Human
aguuagagaugccucccu

SEQ ID NO: 3606966 - RNA, 22 nt, Human
aguuagauuauugaaauauuau

SEQ ID NO: 3606967 - RNA, 16 nt, Human
aguuagcucaggaggc

SEQ ID NO: 3606968 - RNA, 15 nt, Human
aguuagcuuuaacuu

SEQ ID NO: 3606969 - RNA, 14 nt, Human
aguuaggaaauaaa

SEQ ID NO: 3606970 - RNA, 18 nt, Human
aguuaggaaauaaaaccu

SEQ ID NO: 3606971 - RNA, 16 nt, Human
aguuaggaaugagaag

SEQ ID NO: 3606972 - RNA, 15 nt, Human
aguuaguuccacuga

SEQ ID NO: 3606973 - RNA, 19 nt, Human
aguuaguuccacugagacc

SEQ ID NO: 3606974 - RNA, 16 nt, Human
aguuaguuucuuuggg

SEQ ID NO: 3606975 - RNA, 17 nt, Human
aguuaguuucuuuggga

SEQ ID NO: 3606976 - RNA, 17 nt, Human
aguuaguuuuuagguca

SEQ ID NO: 3606977 - RNA, 19 nt, Human
aguuauaaaauuaaaaguu

SEQ ID NO: 3606978 - RNA, 12 nt, Human
aguuauaaauca

SEQ ID NO: 3606979 - RNA, 21 nt, Human
aguuauacaguuauaaaauua

SEQ ID NO: 3606980 - RNA, 20 nt, Human
aguuauacuuauuuguauau

SEQ ID NO: 3606981 - RNA, 14 nt, Human
aguuauagugaaua

SEQ ID NO: 3606982 - RNA, 20 nt, Human
aguuauagugaauacugcua

SEQ ID NO: 3606983 - RNA, 23 nt, Human
aguuauagugaauacugcuacag

SEQ ID NO: 3606984 - RNA, 13 nt, Human
aguuauaguuuca

SEQ ID NO: 3606985 - RNA, 15 nt, Human
aguuauaguuucaga

SEQ ID NO: 3606986 - RNA, 17 nt, Human
aguuauauaaagagaaa

SEQ ID NO: 3606987 - RNA, 20 nt, Human
aguuauauaaagagaaaauu

SEQ ID NO: 3606988 - RNA, 23 nt, Human
aguuauauagguuuuguuugcua

SEQ ID NO: 3606989 - RNA, 23 nt, Human
aguuauauuucagauguaauguu

SEQ ID NO: 3606990 - RNA, 16 nt, Human
aguuaucaaucucuag

SEQ ID NO: 3606991 - RNA, 21 nt, Human
aguuaucagacacucuggcug

SEQ ID NO: 3606992 - RNA, 20 nt, Human
aguuaucaugaauuuuaaag

SEQ ID NO: 3606993 - RNA, 22 nt, Human
aguuaucaugaauuuuaaagua

SEQ ID NO: 3606994 - RNA, 13 nt, Human
aguuaucauguua

SEQ ID NO: 3606995 - RNA, 16 nt, Human
aguuaucuaaaagaaa

SEQ ID NO: 3606996 - RNA, 15 nt, Human
aguuaucuaaguuaa

SEQ ID NO: 3606997 - RNA, 12 nt, Human
aguuaugaugua

SEQ ID NO: 3606998 - RNA, 18 nt, Human
aguuauggccuauacacu

SEQ ID NO: 3606999 - RNA, 15 nt, Human
aguuauggugccgaa

SEQ ID NO: 3607000 - RNA, 14 nt, Human
aguuauguaaauaa

SEQ ID NO: 3607001 - RNA, 17 nt, Human
aguuauguaaauaauuc

SEQ ID NO: 3607002 - RNA, 12 nt, Human
aguuauguguau

SEQ ID NO: 3607003 - RNA, 19 nt, Human
aguuauguguaugugagua

SEQ ID NO: 3607004 - RNA, 13 nt, Human
aguuauuaaaauu

SEQ ID NO: 3607005 - RNA, 15 nt, Human
aguuauuaaaauugu

SEQ ID NO: 3607006 - RNA, 16 nt, Human
aguuauuaaaauuguu

SEQ ID NO: 3607007 - RNA, 18 nt, Human
aguuauuaaaauuguugu

SEQ ID NO: 3607008 - RNA, 20 nt, Human
aguuauuaacuuuaauguuu

SEQ ID NO: 3607009 - RNA, 19 nt, Human
aguuauuaaguucuuuaaa

SEQ ID NO: 3607010 - RNA, 22 nt, Human
aguuauucauucugugaucauu

SEQ ID NO: 3607011 - RNA, 18 nt, Human
aguuauuccuugaucauu

SEQ ID NO: 3607012 - RNA, 23 nt, Human
aguuauugaagcagaguggcagu

SEQ ID NO: 3607013 - RNA, 17 nt, Human
aguuauugacaaacucu

SEQ ID NO: 3607014 - RNA, 17 nt, Human
aguuauugauaaguuca

SEQ ID NO: 3607015 - RNA, 13 nt, Human
aguuauugcaguu

SEQ ID NO: 3607016 - RNA, 19 nt, Human
aguuauugguggaaucuuu

SEQ ID NO: 3607017 - RNA, 22 nt, Human
aguuauuguacagcuguuuaag

SEQ ID NO: 3607018 - RNA, 23 nt, Human
aguuauuuucuacagugguuuua

SEQ ID NO: 3607019 - RNA, 15 nt, Human
aguuauuuuuguaca

SEQ ID NO: 3607020 - RNA, 13 nt, Human
aguucaaacaaga

SEQ ID NO: 3607021 - RNA, 22 nt, Human
aguucaaagucaugauguuuuu

SEQ ID NO: 3607022 - RNA, 18 nt, Human
aguucaaauucuucugaa

SEQ ID NO: 3607023 - RNA, 15 nt, Human
aguucaagaucaaaa

SEQ ID NO: 3607024 - RNA, 20 nt, Human
aguucaagaucaaaaaggcu

SEQ ID NO: 3607025 - RNA, 13 nt, Human
aguucaaggacca

SEQ ID NO: 3607026 - RNA, 13 nt, Human
aguucaauccuac

SEQ ID NO: 3607027 - RNA, 10 nt, Human
aguucaauga

SEQ ID NO: 3607028 - RNA, 21 nt, Human
aguucaaugaucuagguuuaa

SEQ ID NO: 3607029 - RNA, 16 nt, Human
aguucaauucucauuu

SEQ ID NO: 3607030 - RNA, 22 nt, Human
aguucacacccugcaaggccca

SEQ ID NO: 3607031 - RNA, 23 nt, Human
aguucacacccugcaaggcccac

SEQ ID NO: 3607032 - RNA, 14 nt, Human
aguucaccauuaaa

SEQ ID NO: 3607033 - RNA, 22 nt, Human
aguucacucuccauuuaauaau

SEQ ID NO: 3607034 - RNA, 14 nt, Human
aguucacuugcagu

SEQ ID NO: 3607035 - RNA, 17 nt, Human
aguucagagcugcccuc

SEQ ID NO: 3607036 - RNA, 20 nt, Human
aguucagagcugcccucucc

SEQ ID NO: 3607037 - RNA, 20 nt, Human
aguucagaguccuuaaaaug

SEQ ID NO: 3607038 - RNA, 17 nt, Human
aguucagaguuuucugg

SEQ ID NO: 3607039 - RNA, 15 nt, Human
aguucagcaccaccc

SEQ ID NO: 3607040 - RNA, 21 nt, Human
aguucagcacuugucucauuu

SEQ ID NO: 3607041 - RNA, 15 nt, Human
aguucagccacccug

SEQ ID NO: 3607042 - RNA, 21 nt, Human
aguucagcgcugucaggauug

SEQ ID NO: 3607043 - RNA, 16 nt, Human
aguucagcugcuucuc

SEQ ID NO: 3607044 - RNA, 13 nt, Human
aguucagcuuggg

SEQ ID NO: 3607045 - RNA, 14 nt, Human
aguucagcuugggg

SEQ ID NO: 3607046 - RNA, 19 nt, Human
aguucaggagucccaagga

SEQ ID NO: 3607047 - RNA, 22 nt, Human
aguucagggaagauaaguugga

SEQ ID NO: 3607048 - RNA, 18 nt, Human
aguucagguaacaggcag

SEQ ID NO: 3607049 - RNA, 17 nt, Human
aguucaguaccuggagg

SEQ ID NO: 3607050 - RNA, 20 nt, Human
aguucaguuccucuuugcau

SEQ ID NO: 3607051 - RNA, 18 nt, Human
aguucauaacagugccau

SEQ ID NO: 3607052 - RNA, 20 nt, Human
aguucauaacagugccauug

SEQ ID NO: 3607053 - RNA, 11 nt, Human
aguucauacau

SEQ ID NO: 3607054 - RNA, 21 nt, Human
aguucauaccuaaguacugua

SEQ ID NO: 3607055 - RNA, 22 nt, Human
aguucauaccuaaguacuguaa

SEQ ID NO: 3607056 - RNA, 20 nt, Human
aguucauauuccauauuuau

SEQ ID NO: 3607057 - RNA, 16 nt, Human
aguucauccaauccuc

SEQ ID NO: 3607058 - RNA, 17 nt, Human
aguucauccauucuauu

SEQ ID NO: 3607059 - RNA, 18 nt, Human
aguucaucccagccccaa

SEQ ID NO: 3607060 - RNA, 13 nt, Human
aguucaucccuuc

SEQ ID NO: 3607061 - RNA, 19 nt, Human
aguucaucccuucucuucc

SEQ ID NO: 3607062 - RNA, 17 nt, Human
aguucaucgauuuucua

SEQ ID NO: 3607063 - RNA, 13 nt, Human
aguucauguaaau

SEQ ID NO: 3607064 - RNA, 17 nt, Human
aguucauguaaauaaua

SEQ ID NO: 3607065 - RNA, 23 nt, Human
aguucauguuugcuucauaaaug

SEQ ID NO: 3607066 - RNA, 18 nt, Human
aguucauuagaaauauuu

SEQ ID NO: 3607067 - RNA, 17 nt, Human
aguucauucauauuaca

SEQ ID NO: 3607068 - RNA, 18 nt, Human
aguuccaaaaugccaaau

SEQ ID NO: 3607069 - RNA, 13 nt, Human
aguuccaagaguc

SEQ ID NO: 3607070 - RNA, 17 nt, Human
aguuccaaucaguagcu

SEQ ID NO: 3607071 - RNA, 18 nt, Human
aguuccacagauuguuuc

SEQ ID NO: 3607072 - RNA, 13 nt, Human
aguuccacugaga

SEQ ID NO: 3607073 - RNA, 14 nt, Human
aguuccacugagcu

SEQ ID NO: 3607074 - RNA, 15 nt, Human
aguuccacugagcuc

SEQ ID NO: 3607075 - RNA, 16 nt, Human
aguuccagaaaguaaa

SEQ ID NO: 3607076 - RNA, 19 nt, Human
aguucccacauuaaagaag

SEQ ID NO: 3607077 - RNA, 12 nt, Human
aguucccagaau

SEQ ID NO: 3607078 - RNA, 16 nt, Human
aguucccagaaucaaa

SEQ ID NO: 3607079 - RNA, 16 nt, Human
aguuccccaaauacaa

SEQ ID NO: 3607080 - RNA, 14 nt, Human
aguuccccaugcag

SEQ ID NO: 3607081 - RNA, 14 nt, Human
aguuccccuaugug

SEQ ID NO: 3607082 - RNA, 23 nt, Human
aguuccccuggaagcagugccca

SEQ ID NO: 3607083 - RNA, 15 nt, Human
aguucccuacuuccu

SEQ ID NO: 3607084 - RNA, 14 nt, Human
aguucccucugcuc

SEQ ID NO: 3607085 - RNA, 18 nt, Human
aguucccucugcucagcc

SEQ ID NO: 3607086 - RNA, 22 nt, Human
aguucccucugcucagccaagc

SEQ ID NO: 3607087 - RNA, 21 nt, Human
aguucccugucucuugaaaaa

SEQ ID NO: 3607088 - RNA, 22 nt, Human
aguucccuugaaacuuugggaa

SEQ ID NO: 3607089 - RNA, 15 nt, Human
aguucccuuggccuc

SEQ ID NO: 3607090 - RNA, 18 nt, Human
aguucccuuggccucaga

SEQ ID NO: 3607091 - RNA, 13 nt, Human
aguuccuaagaag

SEQ ID NO: 3607092 - RNA, 14 nt, Human
aguuccucgcccug

SEQ ID NO: 3607093 - RNA, 15 nt, Human
aguuccucgcccugg

SEQ ID NO: 3607094 - RNA, 16 nt, Human
aguuccucgcccuggg

SEQ ID NO: 3607095 - RNA, 19 nt, Human
aguuccucuaacuuggcuc

SEQ ID NO: 3607096 - RNA, 19 nt, Human
aguuccugaugacccaggc

SEQ ID NO: 3607097 - RNA, 21 nt, Human
aguuccugcggagugaagagg

SEQ ID NO: 3607098 - RNA, 16 nt, Human
aguuccuguaugaaag

SEQ ID NO: 3607099 - RNA, 14 nt, Human
aguuccugucccug

SEQ ID NO: 3607100 - RNA, 21 nt, Human
aguuccugucccuucucuuaa

SEQ ID NO: 3607101 - RNA, 15 nt, Human
aguuccuguggcucc

SEQ ID NO: 3607102 - RNA, 13 nt, Human
aguuccuuucaaa

SEQ ID NO: 3607103 - RNA, 16 nt, Human
aguuccuuugugugua

SEQ ID NO: 3607104 - RNA, 18 nt, Human
aguuccuuuguguguacu

SEQ ID NO: 3607105 - RNA, 17 nt, Human
auuagaaauauuuuaaa

SEQ ID NO: 3607106 - RNA, 24 nt, Human
auuagaaauauuuuaaaaucagcu

SEQ ID NO: 3607107 - RNA, 22 nt, Human
auuagaaauuaccuguggauau

SEQ ID NO: 3607108 - RNA, 15 nt, Human
auuagaaauuagcug

SEQ ID NO: 3607109 - RNA, 17 nt, Human
auuagaaauuggcugga

SEQ ID NO: 3607110 - RNA, 18 nt, Human
auuagaacaggcaaguga

SEQ ID NO: 3607111 - RNA, 19 nt, Human
auuagaacaggcaagugaa

SEQ ID NO: 3607112 - RNA, 20 nt, Human
auuagaaucaaacauuuuga

SEQ ID NO: 3607113 - RNA, 21 nt, Human
auuagaauuagugccagaauu

SEQ ID NO: 3607114 - RNA, 13 nt, Human
auuagaauucugu

SEQ ID NO: 3607115 - RNA, 14 nt, Human
auuagaauucugua

SEQ ID NO: 3607116 - RNA, 17 nt, Human
auuagaauucuguauag

SEQ ID NO: 3607117 - RNA, 16 nt, Human
auuagacuggacagcu

SEQ ID NO: 3607118 - RNA, 19 nt, Human
auuagacuggacagcuugu

SEQ ID NO: 3607119 - RNA, 14 nt, Human
auuagagaacaucc

SEQ ID NO: 3607120 - RNA, 13 nt, Human
auuagagaagaga

SEQ ID NO: 3607121 - RNA, 16 nt, Human
auuagagaguguugaa

SEQ ID NO: 3607122 - RNA, 18 nt, Human
auuagagaguguugaaac

SEQ ID NO: 3607123 - RNA, 21 nt, Human
auuagagggaggagaaugagc

SEQ ID NO: 3607124 - RNA, 13 nt, Human
auuagagggaggu

SEQ ID NO: 3607125 - RNA, 23 nt, Human
auuagagucaacuacacaaagca

SEQ ID NO: 3607126 - RNA, 15 nt, Human
auuagagucagccuu

SEQ ID NO: 3607127 - RNA, 23 nt, Human
auuagagugucuuuccacggagc

SEQ ID NO: 3607128 - RNA, 19 nt, Human
auuagauccuaagaugugu

SEQ ID NO: 3607129 - RNA, 23 nt, Human
auuagaugaauuauccuauuuca

SEQ ID NO: 3607130 - RNA, 15 nt, Human
auuagaugugauuua

SEQ ID NO: 3607131 - RNA, 22 nt, Human
auuagaugugauuuaauagugu

SEQ ID NO: 3607132 - RNA, 22 nt, Human
auuagauguuacaaguuuauau

SEQ ID NO: 3607133 - RNA, 18 nt, Human
auuagauuuuauuuuacu

SEQ ID NO: 3607134 - RNA, 17 nt, Human
auuagcaaaaaaaguug

SEQ ID NO: 3607135 - RNA, 22 nt, Human
auuagcaaaaaaaguuguauga

SEQ ID NO: 3607136 - RNA, 18 nt, Human
auuagcaaggucauuucu

SEQ ID NO: 3607137 - RNA, 14 nt, Human
auuagcacagauuu

SEQ ID NO: 3607138 - RNA, 16 nt, Human
auuagcacagauuuua

SEQ ID NO: 3607139 - RNA, 18 nt, Human
auuagcagucccuccaca

SEQ ID NO: 3607140 - RNA, 17 nt, Human
auuagccacaaaauugg

SEQ ID NO: 3607141 - RNA, 14 nt, Human
auuagccaggauca

SEQ ID NO: 3607142 - RNA, 15 nt, Human
auuagccagguaaug

SEQ ID NO: 3607143 - RNA, 12 nt, Human
auuagccaguaa

SEQ ID NO: 3607144 - RNA, 17 nt, Human
auuagccaguaauccug

SEQ ID NO: 3607145 - RNA, 18 nt, Human
auuagccaguaauccugu

SEQ ID NO: 3607146 - RNA, 19 nt, Human
auuagccaguaauccugua

SEQ ID NO: 3607147 - RNA, 15 nt, Human
auuagcccugcauuu

SEQ ID NO: 3607148 - RNA, 17 nt, Human
auuagcccugcauuuuc

SEQ ID NO: 3607149 - RNA, 16 nt, Human
auuagccugaguagaa

SEQ ID NO: 3607150 - RNA, 20 nt, Human
auuagcgacaacagauugga

SEQ ID NO: 3607151 - RNA, 19 nt, Human
auuagcucacuuggugaua

SEQ ID NO: 3607152 - RNA, 22 nt, Human
auuagcugugauuuuuguugau

SEQ ID NO: 3607153 - RNA, 21 nt, Human
auuagcuuuguguuugguuua

SEQ ID NO: 3607154 - RNA, 15 nt, Human
auuagcuuuuucauc

SEQ ID NO: 3607155 - RNA, 15 nt, Human
auuaggaaaauaugg

SEQ ID NO: 3607156 - RNA, 21 nt, Human
auuaggaaguguaacagcuga

SEQ ID NO: 3607157 - RNA, 13 nt, Human
auuaggaauaaau

SEQ ID NO: 3607158 - RNA, 23 nt, Human
auuaggacaaucaguccccuccc

SEQ ID NO: 3607159 - RNA, 17 nt, Human
auuaggaggcucaacaa

SEQ ID NO: 3607160 - RNA, 22 nt, Human
auuaggaggcucaacaauaaaa

SEQ ID NO: 3607161 - RNA, 16 nt, Human
auuaggauuucaugau

SEQ ID NO: 3607162 - RNA, 19 nt, Human
auuaggauuugccccuucc

SEQ ID NO: 3607163 - RNA, 14 nt, Human
auuaggauuuugau

SEQ ID NO: 3607164 - RNA, 20 nt, Human
auuaggcaaggcuaugugau

SEQ ID NO: 3607165 - RNA, 22 nt, Human
auuaggcuguaacuacuuuaua

SEQ ID NO: 3607166 - RNA, 23 nt, Human
auuaggcuguaacuacuuuauaa

SEQ ID NO: 3607167 - RNA, 16 nt, Human
auuagggagaaaauuc

SEQ ID NO: 3607168 - RNA, 18 nt, Human
auuagggcauuugagaaa

SEQ ID NO: 3607169 - RNA, 17 nt, Human
auuagggcucuaauuuc

SEQ ID NO: 3607170 - RNA, 18 nt, Human
auuagguuaacauuguug

SEQ ID NO: 3607171 - RNA, 16 nt, Human
auuagguugaaacaua

SEQ ID NO: 3607172 - RNA, 17 nt, Human
auuagguugaaacauau

SEQ ID NO: 3607173 - RNA, 15 nt, Human
auuagguuuuguaca

SEQ ID NO: 3607174 - RNA, 16 nt, Human
auuaguaaaugucuuu

SEQ ID NO: 3607175 - RNA, 20 nt, Human
auuaguaaaugucuuuguaa

SEQ ID NO: 3607176 - RNA, 19 nt, Human
auuaguacacagcaccaga

SEQ ID NO: 3607177 - RNA, 21 nt, Human
auuaguacuuuauagaagaau

SEQ ID NO: 3607178 - RNA, 18 nt, Human
auuaguauuuauuuaaug

SEQ ID NO: 3607179 - RNA, 13 nt, Human
auuaguccuugcu

SEQ ID NO: 3607180 - RNA, 20 nt, Human
auuagucucagugaagacua

SEQ ID NO: 3607181 - RNA, 16 nt, Human
auuagugccacuuaau

SEQ ID NO: 3607182 - RNA, 18 nt, Human
auuagugccacuuaaugu

SEQ ID NO: 3607183 - RNA, 19 nt, Human
auuagugccagaauuuuag

SEQ ID NO: 3607184 - RNA, 22 nt, Human
auuagugcuaagugugaacugg

SEQ ID NO: 3607185 - RNA, 12 nt, Human
auuaguuauaua

SEQ ID NO: 3607186 - RNA, 18 nt, Human
auuaguuccccaaauaca

SEQ ID NO: 3607187 - RNA, 12 nt, Human
auuaguuuagaa

SEQ ID NO: 3607188 - RNA, 12 nt, Human
auuaguuuccuu

SEQ ID NO: 3607189 - RNA, 13 nt, Human
auuaguuuugauu

SEQ ID NO: 3607190 - RNA, 18 nt, Human
auuauaaacaagaaugaa

SEQ ID NO: 3607191 - RNA, 16 nt, Human
auuauaaaguuuucua

SEQ ID NO: 3607192 - RNA, 22 nt, Human
auuauaaccuuaauuuauuauu

SEQ ID NO: 3607193 - RNA, 12 nt, Human
auuauaacugua

SEQ ID NO: 3607194 - RNA, 20 nt, Human
auuauaacuuaaaauauuuu

SEQ ID NO: 3607195 - RNA, 20 nt, Human
auuauaagaggcugauaauu

SEQ ID NO: 3607196 - RNA, 12 nt, Human
auuauaagcauu

SEQ ID NO: 3607197 - RNA, 17 nt, Human
auuauaagcauugaaau

SEQ ID NO: 3607198 - RNA, 12 nt, Human
auuauaaggacu

SEQ ID NO: 3607199 - RNA, 13 nt, Human
auuauaaggacug

SEQ ID NO: 3607200 - RNA, 15 nt, Human
auuauaauaaauaua

SEQ ID NO: 3607201 - RNA, 18 nt, Human
auuauaaucuuauaauug

SEQ ID NO: 3607202 - RNA, 13 nt, Human
auuauaauguauu

SEQ ID NO: 3607203 - RNA, 18 nt, Human
auuauaauuguugcauag

SEQ ID NO: 3607204 - RNA, 17 nt, Human
auuauaauuuaaugcau

SEQ ID NO: 3607205 - RNA, 21 nt, Human
auuauacauggguagcuucug

SEQ ID NO: 3607206 - RNA, 15 nt, Human
auuauacaugugaua

SEQ ID NO: 3607207 - RNA, 15 nt, Human
auuauaccaaaaugu

SEQ ID NO: 3607208 - RNA, 20 nt, Human
auuauaccaaaauguugcug

SEQ ID NO: 3607209 - RNA, 15 nt, Human
auuauacuaagaaaa

SEQ ID NO: 3607210 - RNA, 15 nt, Human
auuauacugugugug

SEQ ID NO: 3607211 - RNA, 14 nt, Human
auuauacuuguaau

SEQ ID NO: 3607212 - RNA, 18 nt, Human
auuauacuuguaauuaug

SEQ ID NO: 3607213 - RNA, 14 nt, Human
auuauagagcagaa

SEQ ID NO: 3607214 - RNA, 16 nt, Human
auuauagagcagaaau

SEQ ID NO: 3607215 - RNA, 13 nt, Human
auuauagauucua

SEQ ID NO: 3607216 - RNA, 13 nt, Human
auuauagcucuaa

SEQ ID NO: 3607217 - RNA, 16 nt, Human
auuauagcucuaaugu

SEQ ID NO: 3607218 - RNA, 19 nt, Human
auuauaguuucugaggcuu

SEQ ID NO: 3607219 - RNA, 17 nt, Human
auuauauaacuguauuu

SEQ ID NO: 3607220 - RNA, 19 nt, Human
auuauauaacuguauuuga

SEQ ID NO: 3607221 - RNA, 13 nt, Human
auuauauagguug

SEQ ID NO: 3607222 - RNA, 20 nt, Human
auuauauagguugugcaaau

SEQ ID NO: 3607223 - RNA, 15 nt, Human
auuauaucaaaguau

SEQ ID NO: 3607224 - RNA, 18 nt, Human
auuauaucagacugcuuu

SEQ ID NO: 3607225 - RNA, 22 nt, Human
auuauaucugaggaauucugua

SEQ ID NO: 3607226 - RNA, 16 nt, Human
auuauauggaaauaua

SEQ ID NO: 3607227 - RNA, 18 nt, Human
auuauauggaaauauaua

SEQ ID NO: 3607228 - RNA, 21 nt, Human
auuauauggaaauauauauua

SEQ ID NO: 3607229 - RNA, 17 nt, Human
auuauauguuguaagca

SEQ ID NO: 3607230 - RNA, 15 nt, Human
auuauauugcaauga

SEQ ID NO: 3607231 - RNA, 13 nt, Human
auuauauuggugg

SEQ ID NO: 3607232 - RNA, 19 nt, Human
auuauauuugugcuauagu

SEQ ID NO: 3607233 - RNA, 15 nt, Human
auuaucaagcuaaua

SEQ ID NO: 3607234 - RNA, 17 nt, Human
auuaucaagcuaauaaa

SEQ ID NO: 3607235 - RNA, 20 nt, Human
auuaucaggcaaauuugcau

SEQ ID NO: 3607236 - RNA, 15 nt, Human
auuaucaugcaaaug

SEQ ID NO: 3607237 - RNA, 17 nt, Human
auuaucaugcaaaugcu

SEQ ID NO: 3607238 - RNA, 16 nt, Human
auuaucauguguaauc

SEQ ID NO: 3607239 - RNA, 14 nt, Human
auuaucccagcugc

SEQ ID NO: 3607240 - RNA, 21 nt, Human
auuauccugaacucuucugca

SEQ ID NO: 3607241 - RNA, 21 nt, Human
auuauccuuuccucauuaaau

SEQ ID NO: 3607242 - RNA, 16 nt, Human
auuaucggaagcagug

SEQ ID NO: 3607243 - RNA, 17 nt, Human
auuaucggaagcagugc

SEQ ID NO: 3607244 - RNA, 17 nt, Human
auuaucgggaacagugu

SEQ ID NO: 3607245 - RNA, 20 nt, Human
auuaucgggaacaguguuuc

SEQ ID NO: 3607246 - RNA, 22 nt, Human
auuaucgggaacaguguuuccc

SEQ ID NO: 3607247 - RNA, 19 nt, Human
auuaucguuuucuuaaagu

SEQ ID NO: 3607248 - RNA, 13 nt, Human
auuaucuaauuua

SEQ ID NO: 3607249 - RNA, 18 nt, Human
auuaucuagauacuguau

SEQ ID NO: 3607250 - RNA, 14 nt, Human
auuaucuauacaua

SEQ ID NO: 3607251 - RNA, 19 nt, Human
auuaucuauacauaucuuu

SEQ ID NO: 3607252 - RNA, 19 nt, Human
auuaucuauagcuaaguac

SEQ ID NO: 3607253 - RNA, 15 nt, Human
auuaucuauuuguau

SEQ ID NO: 3607254 - RNA, 18 nt, Human
auuaucucaaaacugcac

SEQ ID NO: 3607255 - RNA, 14 nt, Human
auuagaaugaaaau

SEQ ID NO: 3607256 - RNA, 17 nt, Human
auuagaauuaccauuug

SEQ ID NO: 3607257 - RNA, 21 nt, Human
auuagaauuaccauuuguuaa

SEQ ID NO: 3607258 - RNA, 13 nt, Human
auuagaauuauuu

SEQ ID NO: 3607259 - RNA, 16 nt, Human
auuagaauucuguaua

SEQ ID NO: 3607260 - RNA, 18 nt, Human
auuagacacuuuggaaga

SEQ ID NO: 3607261 - RNA, 15 nt, Human
auuagacagaacacc

SEQ ID NO: 3607262 - RNA, 13 nt, Human
auuagacuccucc

SEQ ID NO: 3607263 - RNA, 15 nt, Human
auuagacuggaacuu

SEQ ID NO: 3607264 - RNA, 14 nt, Human
auuagacugugauu

SEQ ID NO: 3607265 - RNA, 19 nt, Human
auuagacuuuagaaauaaa

SEQ ID NO: 3607266 - RNA, 24 nt, Human
auuagagaaauauaguucacaaug

SEQ ID NO: 3607267 - RNA, 17 nt, Human
auuagagaguguugaaa

SEQ ID NO: 3607268 - RNA, 21 nt, Human
auuagagcagaugaccccucc

SEQ ID NO: 3607269 - RNA, 13 nt, Human
auuagagccugua

SEQ ID NO: 3607270 - RNA, 16 nt, Human
auuagagugucuuucc

SEQ ID NO: 3607271 - RNA, 17 nt, Human
auuagagugucuuucca

SEQ ID NO: 3607272 - RNA, 16 nt, Human
auuagaucaaauaguu

SEQ ID NO: 3607273 - RNA, 19 nt, Human
auuagaucaaauaguugca

SEQ ID NO: 3607274 - RNA, 20 nt, Human
auuagaucuucaaacagaau

SEQ ID NO: 3607275 - RNA, 14 nt, Human
auuagauguucucu

SEQ ID NO: 3607276 - RNA, 16 nt, Human
auuagauguucucuau

SEQ ID NO: 3607277 - RNA, 23 nt, Human
auuagauguucucuaucauuuaa

SEQ ID NO: 3607278 - RNA, 23 nt, Human
auuagauuucucauuugccaaua

SEQ ID NO: 3607279 - RNA, 20 nt, Human
auuagauuuuaaaacuucau

SEQ ID NO: 3607280 - RNA, 22 nt, Human
auuagauuuuauuuuacuauug

SEQ ID NO: 3607281 - RNA, 14 nt, Human
auuagcaaaaaaag

SEQ ID NO: 3607282 - RNA, 20 nt, Human
auuagcaaaaaaaguuguau

SEQ ID NO: 3607283 - RNA, 19 nt, Human
auuagcaaggucauuucuu

SEQ ID NO: 3607284 - RNA, 22 nt, Human
auuagcaauugacugucacugu

SEQ ID NO: 3607285 - RNA, 17 nt, Human
auuagcacagauuuuaa

SEQ ID NO: 3607286 - RNA, 17 nt, Human
auuagcauucuggcagu

SEQ ID NO: 3607287 - RNA, 12 nt, Human
auuagcucugga

SEQ ID NO: 3607288 - RNA, 13 nt, Human
auuagcugcuucu

SEQ ID NO: 3607289 - RNA, 20 nt, Human
auuagcugguuggagagcua

SEQ ID NO: 3607290 - RNA, 16 nt, Human
auuagcugugugaaau

SEQ ID NO: 3607291 - RNA, 13 nt, Human
auuagcuuauguu

SEQ ID NO: 3607292 - RNA, 12 nt, Human
auuagcuuugug

SEQ ID NO: 3607293 - RNA, 15 nt, Human
auuagcuuuguguuu

SEQ ID NO: 3607294 - RNA, 15 nt, Human
auuaggaaguguuua

SEQ ID NO: 3607295 - RNA, 22 nt, Human
auuaggacaaucaguccccucc

SEQ ID NO: 3607296 - RNA, 14 nt, Human
auuaggcagacucu

SEQ ID NO: 3607297 - RNA, 13 nt, Human
auuaggccagcaa

SEQ ID NO: 3607298 - RNA, 20 nt, Human
auuagggagaaaauucaauu

SEQ ID NO: 3607299 - RNA, 23 nt, Human
auuagggagaaaauucaauugua

SEQ ID NO: 3607300 - RNA, 18 nt, Human
auuagggcaauuggaaca

SEQ ID NO: 3607301 - RNA, 15 nt, Human
auuagggguugcuaa

SEQ ID NO: 3607302 - RNA, 22 nt, Human
auuagggguugcuaagaagcga

SEQ ID NO: 3607303 - RNA, 13 nt, Human
auuagguauuuug

SEQ ID NO: 3607304 - RNA, 23 nt, Human
auuaggugaucccguuuucccca

SEQ ID NO: 3607305 - RNA, 16 nt, Human
auuaggugugacugaa

SEQ ID NO: 3607306 - RNA, 23 nt, Human
auuagguugaaacauaucucuua

SEQ ID NO: 3607307 - RNA, 18 nt, Human
auuagguuucagcagagc

SEQ ID NO: 3607308 - RNA, 19 nt, Human
auuagguuucagcagagcu

SEQ ID NO: 3607309 - RNA, 14 nt, Human
auuaguaaagaaau

SEQ ID NO: 3607310 - RNA, 16 nt, Human
auuaguaaaugcuuau

SEQ ID NO: 3607311 - RNA, 15 nt, Human
auuaguaaaugucuu

SEQ ID NO: 3607312 - RNA, 23 nt, Human
auuaguaaaugucuuuguaaguc

SEQ ID NO: 3607313 - RNA, 23 nt, Human
auuaguaacauaauaaauuaaaa

SEQ ID NO: 3607314 - RNA, 18 nt, Human
auuaguaagcuagcaaau

SEQ ID NO: 3607315 - RNA, 22 nt, Human
auuaguaccauaguaccauuua

SEQ ID NO: 3607316 - RNA, 18 nt, Human
auuaguacuuuauagaag

SEQ ID NO: 3607317 - RNA, 21 nt, Human
auuaguauguauguguaccua

SEQ ID NO: 3607318 - RNA, 14 nt, Human
auuaguauuguugu

SEQ ID NO: 3607319 - RNA, 15 nt, Human
auuaguauuguuguc

SEQ ID NO: 3607320 - RNA, 13 nt, Human
auuagucauagaa

SEQ ID NO: 3607321 - RNA, 17 nt, Human
auuagucauagaagaac

SEQ ID NO: 3607322 - RNA, 19 nt, Human
auuagucauagaagaacua

SEQ ID NO: 3607323 - RNA, 14 nt, Human
auuaguccuugcuu

SEQ ID NO: 3607324 - RNA, 23 nt, Human
auuagugcagccaaguagccucu

SEQ ID NO: 3607325 - RNA, 19 nt, Human
auuagugccacuuaaugua

SEQ ID NO: 3607326 - RNA, 20 nt, Human
auuagugccacuuaauguau

SEQ ID NO: 3607327 - RNA, 16 nt, Human
auuagugccagaauuu

SEQ ID NO: 3607328 - RNA, 18 nt, Human
auuagugccagaauuuua

SEQ ID NO: 3607329 - RNA, 15 nt, Human
auuagugcuaagugu

SEQ ID NO: 3607330 - RNA, 17 nt, Human
auuagugcuaaguguga

SEQ ID NO: 3607331 - RNA, 18 nt, Human
auuagugcuaagugugaa

SEQ ID NO: 3607332 - RNA, 20 nt, Human
auuagugcuaagugugaacu

SEQ ID NO: 3607333 - RNA, 15 nt, Human
auuaguguuauauga

SEQ ID NO: 3607334 - RNA, 19 nt, Human
auuaguguuauaugaacau

SEQ ID NO: 3607335 - RNA, 21 nt, Human
auuaguguuauaugaacauac

SEQ ID NO: 3607336 - RNA, 14 nt, Human
auuaguuaauauau

SEQ ID NO: 3607337 - RNA, 18 nt, Human
auuaguucccugucucuu

SEQ ID NO: 3607338 - RNA, 21 nt, Human
auuaguucccugucucuugaa

SEQ ID NO: 3607339 - RNA, 14 nt, Human
auuaguugcuuugu

SEQ ID NO: 3607340 - RNA, 15 nt, Human
auuaguugcuuuguu

SEQ ID NO: 3607341 - RNA, 18 nt, Human
auuaguuuacaucauuuu

SEQ ID NO: 3607342 - RNA, 17 nt, Human
auuaguuuccuuuuuaa

SEQ ID NO: 3607343 - RNA, 11 nt, Human
auuaguuuuaa

SEQ ID NO: 3607344 - RNA, 16 nt, Human
auuaguuuuaaaauga

SEQ ID NO: 3607345 - RNA, 14 nt, Human
auuaguuuucuugu

SEQ ID NO: 3607346 - RNA, 19 nt, Human
auuaguuuucuuguugcuu

SEQ ID NO: 3607347 - RNA, 23 nt, Human
auuauaaaaagccacuagacucu

SEQ ID NO: 3607348 - RNA, 13 nt, Human
auuauaaaaauau

SEQ ID NO: 3607349 - RNA, 13 nt, Human
auuauaaacgcuu

SEQ ID NO: 3607350 - RNA, 17 nt, Human
auuauaaacucauuuug

SEQ ID NO: 3607351 - RNA, 19 nt, Human
auuauaaacucauuuugcu

SEQ ID NO: 3607352 - RNA, 22 nt, Human
auuauaaaggauaaagaaggau

SEQ ID NO: 3607353 - RNA, 20 nt, Human
auuauaaauauauauaaaga

SEQ ID NO: 3607354 - RNA, 17 nt, Human
auuauaaauaucauugu

SEQ ID NO: 3607355 - RNA, 17 nt, Human
auuauaacaaguguguc

SEQ ID NO: 3607356 - RNA, 21 nt, Human
auuauaacugaaggagaaggu

SEQ ID NO: 3607357 - RNA, 15 nt, Human
auuauaacuuaaaaa

SEQ ID NO: 3607358 - RNA, 22 nt, Human
auuauaacuuaaaaaaaugaca

SEQ ID NO: 3607359 - RNA, 10 nt, Human
auuauaagga

SEQ ID NO: 3607360 - RNA, 16 nt, Human
auuauaaggacugcau

SEQ ID NO: 3607361 - RNA, 17 nt, Human
auuauaagucuuacaua

SEQ ID NO: 3607362 - RNA, 19 nt, Human
auuauaagucuuacauaaa

SEQ ID NO: 3607363 - RNA, 12 nt, Human
auuauaauauuu

SEQ ID NO: 3607364 - RNA, 18 nt, Human
auuauaaucaccagggcc

SEQ ID NO: 3607365 - RNA, 14 nt, Human
auuauaaucuuaua

SEQ ID NO: 3607366 - RNA, 14 nt, Human
auuauaaugaauuu

SEQ ID NO: 3607367 - RNA, 13 nt, Human
auuauaauuguau

SEQ ID NO: 3607368 - RNA, 22 nt, Human
auuauaauuuuuuucaauauuu

SEQ ID NO: 3607369 - RNA, 18 nt, Human
auuauacaaauuaaaaag

SEQ ID NO: 3607370 - RNA, 20 nt, Human
auuauacaugugauacauuu

SEQ ID NO: 3607371 - RNA, 21 nt, Human
auuauacaugugauacauuuu

SEQ ID NO: 3607372 - RNA, 22 nt, Human
auuauacaugugauacauuuuu

SEQ ID NO: 3607373 - RNA, 18 nt, Human
auuauaccaaaauguugc

SEQ ID NO: 3607374 - RNA, 19 nt, Human
auuauacccccugcaaagc

SEQ ID NO: 3607375 - RNA, 17 nt, Human
auuauacuaagaaaaga

SEQ ID NO: 3607376 - RNA, 16 nt, Human
auuauacuguguguga

SEQ ID NO: 3607377 - RNA, 21 nt, Human
auuauacuuguaauuauggag

SEQ ID NO: 3607378 - RNA, 21 nt, Human
auuauagaugggaaugaagcu

SEQ ID NO: 3607379 - RNA, 19 nt, Human
auuauagauucuaaagauu

SEQ ID NO: 3607380 - RNA, 15 nt, Human
auuauagcucuaaug

SEQ ID NO: 3607381 - RNA, 17 nt, Human
auuauaggagccuuaau

SEQ ID NO: 3607382 - RNA, 23 nt, Human
auuauagugauguaaucuugaau

SEQ ID NO: 3607383 - RNA, 23 nt, Human
auuauauagguugugcaaauuaa

SEQ ID NO: 3607384 - RNA, 16 nt, Human
auuauauauauaauau

SEQ ID NO: 3607385 - RNA, 18 nt, Human
auuauaucaaaguauuug

SEQ ID NO: 3607386 - RNA, 23 nt, Human
auuauaucauuggaacaacugau

SEQ ID NO: 3607387 - RNA, 18 nt, Human
auuauaucugaggaauuc

SEQ ID NO: 3607388 - RNA, 19 nt, Human
auuauaucugaggaauucu

SEQ ID NO: 3607389 - RNA, 19 nt, Human
auuauaugcuauuucuaua

SEQ ID NO: 3607390 - RNA, 20 nt, Human
auuauauggaaauauauauu

SEQ ID NO: 3607391 - RNA, 22 nt, Human
auuauauguacccucugaaaua

SEQ ID NO: 3607392 - RNA, 14 nt, Human
auuauauuaugaag

SEQ ID NO: 3607393 - RNA, 20 nt, Human
auuauauuauuaguuuugau

SEQ ID NO: 3607394 - RNA, 20 nt, Human
auuauauuccucuugcauuu

SEQ ID NO: 3607395 - RNA, 14 nt, Human
auuauauugagaca

SEQ ID NO: 3607396 - RNA, 20 nt, Human
auuauauuggugguucucag

SEQ ID NO: 3607397 - RNA, 17 nt, Human
auuauauuuacaaaugg

SEQ ID NO: 3607398 - RNA, 15 nt, Human
auuauauuuggaugc

SEQ ID NO: 3607399 - RNA, 16 nt, Human
auuauauuuggaugca

SEQ ID NO: 3607400 - RNA, 17 nt, Human
auuauauuuggaugcag

SEQ ID NO: 3607401 - RNA, 22 nt, Human
auuaucaaagggauaaagaaaa

SEQ ID NO: 3607402 - RNA, 13 nt, Human
auuaucaagcuaa

SEQ ID NO: 3607403 - RNA, 14 nt, Human
auuaucaagcuaau

SEQ ID NO: 3607404 - RNA, 22 nt, Human
auuaucaagcuaauaaaauauc

SEQ ID NO: 3607405 - RNA, 23 nt, Human
auuaucaagcuaauaaaauauca

SEQ ID NO: 3607406 - RNA, 17 nt, Human
auuaucaauaucuaaua

SEQ ID NO: 3607407 - RNA, 19 nt, Human
auuaucaauaucuaauaua

SEQ ID NO: 3607408 - RNA, 13 nt, Human
auuaucagcaaag

SEQ ID NO: 3607409 - RNA, 15 nt, Human
auuaucagcaaagaa

SEQ ID NO: 3607410 - RNA, 21 nt, Human
auuaucaggcaaauuugcauu

SEQ ID NO: 3607411 - RNA, 13 nt, Human
auuaucaugugua

SEQ ID NO: 3607412 - RNA, 14 nt, Human
auuaucauguguaa

SEQ ID NO: 3607413 - RNA, 21 nt, Human
auuaucauguguaaucaauaa

SEQ ID NO: 3607414 - RNA, 23 nt, Human
auuaucauuuuagaagacucuac

SEQ ID NO: 3607415 - RNA, 17 nt, Human
auuauccagguaaucca

SEQ ID NO: 3607416 - RNA, 14 nt, Human
auuauccauauuga

SEQ ID NO: 3607417 - RNA, 17 nt, Human
auuauccauauugaguc

SEQ ID NO: 3607418 - RNA, 21 nt, Human
auuauccuagauuauaucaaa

SEQ ID NO: 3607419 - RNA, 16 nt, Human
auuauccuugcuauga

SEQ ID NO: 3607420 - RNA, 19 nt, Human
auuaucgggaacaguguuu

SEQ ID NO: 3607421 - RNA, 16 nt, Human
auuaucgggagcagug

SEQ ID NO: 3607422 - RNA, 17 nt, Human
auuaucgggagcagugu

SEQ ID NO: 3607423 - RNA, 19 nt, Human
auuaucgggagcagugucu

SEQ ID NO: 3607424 - RNA, 21 nt, Human
auuaucgggagcagugucuuc

SEQ ID NO: 3607425 - RNA, 23 nt, Human
auuaucucaaaacugcacuguca

SEQ ID NO: 3607426 - RNA, 17 nt, Human
auuaucucacuugugcc

SEQ ID NO: 3607427 - RNA, 12 nt, Human
auuaucuuaaaa

SEQ ID NO: 3607428 - RNA, 18 nt, Human
auuaucuuguucaggaaa

SEQ ID NO: 3607429 - RNA, 14 nt, Human
auuaugaaacuugu

SEQ ID NO: 3607430 - RNA, 15 nt, Human
auuaugaaacuugug

SEQ ID NO: 3607431 - RNA, 20 nt, Human
auuaugaaacuuguguaaau

SEQ ID NO: 3607432 - RNA, 20 nt, Human
auuaugaaagcaacaaagaa

SEQ ID NO: 3607433 - RNA, 22 nt, Human
auuaugaaagcaacaaagaaau

SEQ ID NO: 3607434 - RNA, 23 nt, Human
auuaugaaagcaacaaagaaauc

SEQ ID NO: 3607435 - RNA, 17 nt, Human
auuaugaauuacauuug

SEQ ID NO: 3607436 - RNA, 19 nt, Human
auuaugaauuacauuugua

SEQ ID NO: 3607437 - RNA, 12 nt, Human
auuaugacaguu

SEQ ID NO: 3607438 - RNA, 14 nt, Human
auuaugacaguuau

SEQ ID NO: 3607439 - RNA, 16 nt, Human
auuaugacaguuauac

SEQ ID NO: 3607440 - RNA, 19 nt, Human
auuaugacaguuauacugu

SEQ ID NO: 3607441 - RNA, 14 nt, Human
auuaugcaaauucc

SEQ ID NO: 3607442 - RNA, 18 nt, Human
auuaugcaauuuuuauau

SEQ ID NO: 3607443 - RNA, 22 nt, Human
auuaugcccaguuucugccucu

SEQ ID NO: 3607444 - RNA, 18 nt, Human
auuaugcggaaagguauu

SEQ ID NO: 3607445 - RNA, 18 nt, Human
auuaugcuguauuuucuu

SEQ ID NO: 3607446 - RNA, 12 nt, Human
auuaugcuucuu

SEQ ID NO: 3607447 - RNA, 18 nt, Human
auuauggaaaaaaaauau

SEQ ID NO: 3607448 - RNA, 15 nt, Human
auuauggaaaaauaa

SEQ ID NO: 3607449 - RNA, 19 nt, Human
auuauggaaaaauaaaacu

SEQ ID NO: 3607450 - RNA, 22 nt, Human
auuauggaaaaauaaaacuguc

SEQ ID NO: 3607451 - RNA, 20 nt, Human
auuauggaagauuuuaaauu

SEQ ID NO: 3607452 - RNA, 17 nt, Human
auuaugggucacaggaa

SEQ ID NO: 3607453 - RNA, 23 nt, Human
auuauggguuaggcauuaauguu

SEQ ID NO: 3607454 - RNA, 17 nt, Human
auuauguaaaucccauu

SEQ ID NO: 3607455 - RNA, 23 nt, Human
auuauguaaaucccauuauucaa

SEQ ID NO: 3607456 - RNA, 12 nt, Human
auuauguaaauu

SEQ ID NO: 3607457 - RNA, 14 nt, Human
auuauguaaugcaa

SEQ ID NO: 3607458 - RNA, 12 nt, Human
auuauguagcuc

SEQ ID NO: 3607459 - RNA, 16 nt, Human
auuauguauguuuaca

SEQ ID NO: 3607460 - RNA, 19 nt, Human
auuaugucuuuuauauuug

SEQ ID NO: 3607461 - RNA, 13 nt, Human
auuaugugacauu

SEQ ID NO: 3607462 - RNA, 20 nt, Human
auuaugugacauuuuacauu

SEQ ID NO: 3607463 - RNA, 21 nt, Human
auuaugugccagauuuaugca

SEQ ID NO: 3607464 - RNA, 14 nt, Human
auuaugugguuuua

SEQ ID NO: 3607465 - RNA, 21 nt, Human
auuaugugugcauguguguau

SEQ ID NO: 3607466 - RNA, 11 nt, Human
auuauguuaaa

SEQ ID NO: 3607467 - RNA, 14 nt, Human
auuauguuaaaaca

SEQ ID NO: 3607468 - RNA, 12 nt, Human
auuauguuaaac

SEQ ID NO: 3607469 - RNA, 13 nt, Human
auuauguuaauau

SEQ ID NO: 3607470 - RNA, 14 nt, Human
auuauguuaauauu

SEQ ID NO: 3607471 - RNA, 16 nt, Human
auuauguuaauauuuc

SEQ ID NO: 3607472 - RNA, 17 nt, Human
auuauguuaauauuucu

SEQ ID NO: 3607473 - RNA, 14 nt, Human
auuauguuauugaa

SEQ ID NO: 3607474 - RNA, 16 nt, Human
auuauguuauugaaaa

SEQ ID NO: 3607475 - RNA, 18 nt, Human
auuauguuauugaaaaaa

SEQ ID NO: 3607476 - RNA, 15 nt, Human
auuauuaacuacauu

SEQ ID NO: 3607477 - RNA, 18 nt, Human
auuauuaacuacauuuau

SEQ ID NO: 3607478 - RNA, 14 nt, Human
auuauuaaguaacu

SEQ ID NO: 3607479 - RNA, 18 nt, Human
auuauuaaguaacuuauu

SEQ ID NO: 3607480 - RNA, 14 nt, Human
auuauuaaugcuuu

SEQ ID NO: 3607481 - RNA, 16 nt, Human
auuauuaaugcuuugg

SEQ ID NO: 3607482 - RNA, 15 nt, Human
auuauuacaguguuu

SEQ ID NO: 3607483 - RNA, 15 nt, Human
auuauuacuguugau

SEQ ID NO: 3607484 - RNA, 15 nt, Human
auuauuaguacugcu

SEQ ID NO: 3607485 - RNA, 15 nt, Human
auuauuauaaaaggg

SEQ ID NO: 3607486 - RNA, 15 nt, Human
auuauuauauacaua

SEQ ID NO: 3607487 - RNA, 14 nt, Human
auuauuauucagaa

SEQ ID NO: 3607488 - RNA, 15 nt, Human
auuauuauucuucau

SEQ ID NO: 3607489 - RNA, 15 nt, Human
auuauuauuugcagu

SEQ ID NO: 3607490 - RNA, 15 nt, Human
auuauuauuuggccc

SEQ ID NO: 3607491 - RNA, 15 nt, Human
auuauucaaaguugc

SEQ ID NO: 3607492 - RNA, 22 nt, Human
auuauucaaaguugccuaaauc

SEQ ID NO: 3607493 - RNA, 24 nt, Human
auuauucaaaguugccuaaaucca

SEQ ID NO: 3607494 - RNA, 15 nt, Human
auuauucaccaugua

SEQ ID NO: 3607495 - RNA, 21 nt, Human
auuauucaccauguaaaacaa

SEQ ID NO: 3607496 - RNA, 14 nt, Human
auuauucacuagua

SEQ ID NO: 3607497 - RNA, 13 nt, Human
auuauucaguguc

SEQ ID NO: 3607498 - RNA, 18 nt, Human
auuauucaguuaagaaaa

SEQ ID NO: 3607499 - RNA, 21 nt, Human
auuauucaguuaagaaaaaaa

SEQ ID NO: 3607500 - RNA, 16 nt, Human
auuauucauuuaaaau

SEQ ID NO: 3607501 - RNA, 21 nt, Human
auuauucauuuaaaaugauua

SEQ ID NO: 3607502 - RNA, 15 nt, Human
auuauuccagaucug

SEQ ID NO: 3607503 - RNA, 17 nt, Human
auuauucccuguacaau

SEQ ID NO: 3607504 - RNA, 21 nt, Human
auuauucucuuuuaucuguuu

SEQ ID NO: 3607505 - RNA, 16 nt, Human
auuauucugauuccac

SEQ ID NO: 3607506 - RNA, 13 nt, Human
auuauucuuucuc

SEQ ID NO: 3607507 - RNA, 16 nt, Human
auuauugacacugaac

SEQ ID NO: 3607508 - RNA, 20 nt, Human
auuauugaguuccaguugaa

SEQ ID NO: 3607509 - RNA, 15 nt, Human
auuauugauaguacu

SEQ ID NO: 3607510 - RNA, 17 nt, Human
auuauugauaguacucu

SEQ ID NO: 3607511 - RNA, 16 nt, Human
auuauugcuguugcuu

SEQ ID NO: 3607512 - RNA, 19 nt, Human
auuauugcuguugcuugaa

SEQ ID NO: 3607513 - RNA, 15 nt, Human
auuauugcuuauugc

SEQ ID NO: 3607514 - RNA, 19 nt, Human
auuauugugauuucccgug

SEQ ID NO: 3607515 - RNA, 23 nt, Human
auuauugugguaggccuuuuaac

SEQ ID NO: 3607516 - RNA, 12 nt, Human
auuauuuaaaca

SEQ ID NO: 3607517 - RNA, 16 nt, Human
auuauuuauguauggu

SEQ ID NO: 3607518 - RNA, 19 nt, Human
auuauuuauguauggugca

SEQ ID NO: 3607519 - RNA, 15 nt, Human
auuauuuauguauug

SEQ ID NO: 3607520 - RNA, 15 nt, Human
auuauuuauuaaauu

SEQ ID NO: 3607521 - RNA, 13 nt, Human
auuauuuauuauu

SEQ ID NO: 3607522 - RNA, 23 nt, Human
auuauuuauucagcuucauuugu

SEQ ID NO: 3607523 - RNA, 18 nt, Human
auuauuucacuuuagaug

SEQ ID NO: 3607524 - RNA, 11 nt, Human
auuauuucaga

SEQ ID NO: 3607525 - RNA, 22 nt, Human
auuauuucugucacaguaaaaa

SEQ ID NO: 3607526 - RNA, 14 nt, Human
auuauuugaaaaca

SEQ ID NO: 3607527 - RNA, 16 nt, Human
auuauuugaaugacua

SEQ ID NO: 3607528 - RNA, 16 nt, Human
auuauuugauuauuua

SEQ ID NO: 3607529 - RNA, 17 nt, Human
auuauuugcauguuaug

SEQ ID NO: 3607530 - RNA, 15 nt, Human
auuauuuguguaaua

SEQ ID NO: 3607531 - RNA, 17 nt, Human
auuauuuguguaauaga

SEQ ID NO: 3607532 - RNA, 22 nt, Human
auuauuuguuauuuguacaguu

SEQ ID NO: 3607533 - RNA, 13 nt, Human
auuauuuuaaaaa

SEQ ID NO: 3607534 - RNA, 15 nt, Human
auuauuuuaauuagg

SEQ ID NO: 3607535 - RNA, 13 nt, Human
auuauuuucaagg

SEQ ID NO: 3607536 - RNA, 12 nt, Human
auuauuuucauc

SEQ ID NO: 3607537 - RNA, 15 nt, Human
auuauuuucugucag

SEQ ID NO: 3607538 - RNA, 21 nt, Human
auuauuuuggggucucuuuug

SEQ ID NO: 3607539 - RNA, 22 nt, Human
auuauuuuggggucucuuuugu

SEQ ID NO: 3607540 - RNA, 12 nt, Human
auuauuuuguga

SEQ ID NO: 3607541 - RNA, 21 nt, Human
auuauuuuguucauacauauu

SEQ ID NO: 3607542 - RNA, 19 nt, Human
auuauuuuuauaauuguac

SEQ ID NO: 3607543 - RNA, 14 nt, Human
auuauuuuuguaga

SEQ ID NO: 3607544 - RNA, 14 nt, Human
auuauuuuuuauga

SEQ ID NO: 3607545 - RNA, 16 nt, Human
auuauuuuuucagacc

SEQ ID NO: 3607546 - RNA, 17 nt, Human
auuauuuuuucagaccg

SEQ ID NO: 3607547 - RNA, 19 nt, Human
auuauuuuuuuaaaauuuu

SEQ ID NO: 3607548 - RNA, 21 nt, Human
auuauuuuuuuaaaauuuugu

SEQ ID NO: 3607549 - RNA, 12 nt, Human
auucaaaaaugu

SEQ ID NO: 3607550 - RNA, 14 nt, Human
auucaaaaauguac

SEQ ID NO: 3607551 - RNA, 16 nt, Human
auucaaaaauguacaa

SEQ ID NO: 3607552 - RNA, 15 nt, Human
auucaaaaauuucac

SEQ ID NO: 3607553 - RNA, 11 nt, Human
auucaaaacau

SEQ ID NO: 3607554 - RNA, 13 nt, Human
auucaaaaguucc

SEQ ID NO: 3607555 - RNA, 22 nt, Human
aguucgacucugugcuggccag

SEQ ID NO: 3607556 - RNA, 17 nt, Human
aguucgagaccagccug

SEQ ID NO: 3607557 - RNA, 19 nt, Human
aguucgagaccagccuggc

SEQ ID NO: 3607558 - RNA, 18 nt, Human
aguucgcagccacccuga

SEQ ID NO: 3607559 - RNA, 18 nt, Human
aguucgccuggagcccuc

SEQ ID NO: 3607560 - RNA, 19 nt, Human
aguucgccuggagcccucc

SEQ ID NO: 3607561 - RNA, 13 nt, Human
aguucgucuguug

SEQ ID NO: 3607562 - RNA, 15 nt, Human
aguucuaaauuuugu

SEQ ID NO: 3607563 - RNA, 13 nt, Human
aguucuaagauuc

SEQ ID NO: 3607564 - RNA, 14 nt, Human
aguucuaagauucu

SEQ ID NO: 3607565 - RNA, 15 nt, Human
aguucuaagauucua

SEQ ID NO: 3607566 - RNA, 18 nt, Human
aguucuaagauucuaaug

SEQ ID NO: 3607567 - RNA, 16 nt, Human
aguucuaagauucuga

SEQ ID NO: 3607568 - RNA, 17 nt, Human
aguucuaagauucugau

SEQ ID NO: 3607569 - RNA, 15 nt, Human
aguucuacauaagua

SEQ ID NO: 3607570 - RNA, 23 nt, Human
aguucuaccucaggcagcucaag

SEQ ID NO: 3607571 - RNA, 10 nt, Human
aguucuagac

SEQ ID NO: 3607572 - RNA, 17 nt, Human
aguucuagagaagaggc

SEQ ID NO: 3607573 - RNA, 10 nt, Human
aguucuaggc

SEQ ID NO: 3607574 - RNA, 17 nt, Human
aguucuagucucucugg

SEQ ID NO: 3607575 - RNA, 19 nt, Human
aguucuagucucucugggg

SEQ ID NO: 3607576 - RNA, 13 nt, Human
aguucuaguguuu

SEQ ID NO: 3607577 - RNA, 15 nt, Human
aguucuaguugcuug

SEQ ID NO: 3607578 - RNA, 14 nt, Human
aguucuauuucuau

SEQ ID NO: 3607579 - RNA, 22 nt, Human
aguucuauuucuaucccaaacu

SEQ ID NO: 3607580 - RNA, 20 nt, Human
aguucucacuguucccucug

SEQ ID NO: 3607581 - RNA, 17 nt, Human
aguucucagggcuccug

SEQ ID NO: 3607582 - RNA, 23 nt, Human
aguucucagggcuccugccuucu

SEQ ID NO: 3607583 - RNA, 13 nt, Human
aguucucccugua

SEQ ID NO: 3607584 - RNA, 22 nt, Human
aguucucccuguacaguguuac

SEQ ID NO: 3607585 - RNA, 17 nt, Human
aguucucucguaacugg

SEQ ID NO: 3607586 - RNA, 13 nt, Human
aguucugaagaau

SEQ ID NO: 3607587 - RNA, 14 nt, Human
aguucugacuugac

SEQ ID NO: 3607588 - RNA, 17 nt, Human
aguucugagcugccagu

SEQ ID NO: 3607589 - RNA, 14 nt, Human
aguucugaguguuu

SEQ ID NO: 3607590 - RNA, 22 nt, Human
aguucugaguguuuuuacuaca

SEQ ID NO: 3607591 - RNA, 14 nt, Human
aguucugccaggag

SEQ ID NO: 3607592 - RNA, 19 nt, Human
aguucugcuccagacaggg

SEQ ID NO: 3607593 - RNA, 16 nt, Human
aguucugcuccucucc

SEQ ID NO: 3607594 - RNA, 17 nt, Human
aguucugcuccucucca

SEQ ID NO: 3607595 - RNA, 20 nt, Human
aguucugcuccucuccaggc

SEQ ID NO: 3607596 - RNA, 12 nt, Human
aguucugcucua

SEQ ID NO: 3607597 - RNA, 19 nt, Human
aguucuggaaaagaacugu

SEQ ID NO: 3607598 - RNA, 22 nt, Human
aguucuggauggugugccuucc

SEQ ID NO: 3607599 - RNA, 11 nt, Human
aguucugggca

SEQ ID NO: 3607600 - RNA, 17 nt, Human
aguucugggugcucccu

SEQ ID NO: 3607601 - RNA, 16 nt, Human
aguucuggucaaagaa

SEQ ID NO: 3607602 - RNA, 14 nt, Human
aguucuguaaaaua

SEQ ID NO: 3607603 - RNA, 23 nt, Human
aguucuguacucaaauguagcca

SEQ ID NO: 3607604 - RNA, 21 nt, Human
aguucuguauuugaaagugcc

SEQ ID NO: 3607605 - RNA, 21 nt, Human
aguucugugacuaggaaaaaa

SEQ ID NO: 3607606 - RNA, 22 nt, Human
aguucugugguuucauguuagu

SEQ ID NO: 3607607 - RNA, 22 nt, Human
aguucuguguauuuaauuguaa

SEQ ID NO: 3607608 - RNA, 18 nt, Human
aguucuguguuuaauuuc

SEQ ID NO: 3607609 - RNA, 21 nt, Human
aguucuguuauauccccugcu

SEQ ID NO: 3607610 - RNA, 22 nt, Human
aguucuguuauauccccugcua

SEQ ID NO: 3607611 - RNA, 21 nt, Human
aguucuguuugguguguccca

SEQ ID NO: 3607612 - RNA, 14 nt, Human
aguucuuaacccag

SEQ ID NO: 3607613 - RNA, 22 nt, Human
aguucuuaaggauugugauauu

SEQ ID NO: 3607614 - RNA, 14 nt, Human
aguucuuagauauc

SEQ ID NO: 3607615 - RNA, 21 nt, Human
aguucuuaguugcuguauguc

SEQ ID NO: 3607616 - RNA, 15 nt, Human
aguucuuccuguaau

SEQ ID NO: 3607617 - RNA, 17 nt, Human
aguucuucgggaagaga

SEQ ID NO: 3607618 - RNA, 18 nt, Human
aguucuucgggaagagag

SEQ ID NO: 3607619 - RNA, 22 nt, Human
aguucuucgggaagagaggagu

SEQ ID NO: 3607620 - RNA, 14 nt, Human
aguucuugaacagu

SEQ ID NO: 3607621 - RNA, 22 nt, Human
aguucuugucugauuggcucac

SEQ ID NO: 3607622 - RNA, 19 nt, Human
aguucuuuccauaauaaaa

SEQ ID NO: 3607623 - RNA, 16 nt, Human
aguucuuugggccaga

SEQ ID NO: 3607624 - RNA, 19 nt, Human
aguucuuugggccagacau

SEQ ID NO: 3607625 - RNA, 17 nt, Human
aguugaaaaacagcuga

SEQ ID NO: 3607626 - RNA, 18 nt, Human
aguugaaaaacagcugag

SEQ ID NO: 3607627 - RNA, 20 nt, Human
aguugaaaagacuccaaaga

SEQ ID NO: 3607628 - RNA, 22 nt, Human
aguugaaaagacuccaaagaaa

SEQ ID NO: 3607629 - RNA, 23 nt, Human
aguugaaaaucuuauaauuuaaa

SEQ ID NO: 3607630 - RNA, 15 nt, Human
aguugaaagggcaau

SEQ ID NO: 3607631 - RNA, 19 nt, Human
aguugaaccuauuucucuu

SEQ ID NO: 3607632 - RNA, 17 nt, Human
aguugaagacuuuguuu

SEQ ID NO: 3607633 - RNA, 15 nt, Human
aguugaaguuuagga

SEQ ID NO: 3607634 - RNA, 15 nt, Human
aguugaauacuugaa

SEQ ID NO: 3607635 - RNA, 12 nt, Human
aguugaauauug

SEQ ID NO: 3607636 - RNA, 14 nt, Human
aguugaaucuauug

SEQ ID NO: 3607637 - RNA, 19 nt, Human
aguugaaugacaacagaag

SEQ ID NO: 3607638 - RNA, 22 nt, Human
aguugaauguugcaaugugaaa

SEQ ID NO: 3607639 - RNA, 19 nt, Human
auaaaagcugaaguuacuu

SEQ ID NO: 3607640 - RNA, 19 nt, Human
auaaaaggaagccaaagag

SEQ ID NO: 3607641 - RNA, 19 nt, Human
auaaaaggcaaauguguac

SEQ ID NO: 3607642 - RNA, 17 nt, Human
auaaaagggcaaaucug

SEQ ID NO: 3607643 - RNA, 18 nt, Human
auaaaagggcaaaucugc

SEQ ID NO: 3607644 - RNA, 21 nt, Human
auaaaaguacauguuaaacuu

SEQ ID NO: 3607645 - RNA, 19 nt, Human
auaaaagugaaugaaagau

SEQ ID NO: 3607646 - RNA, 21 nt, Human
auaaaagugaaugaaagauua

SEQ ID NO: 3607647 - RNA, 13 nt, Human
auaaaagugauca

SEQ ID NO: 3607648 - RNA, 19 nt, Human
auaaaaguuuuacaaaggg

SEQ ID NO: 3607649 - RNA, 14 nt, Human
auaaaauaaauaua

SEQ ID NO: 3607650 - RNA, 18 nt, Human
auaaaauaauucuaaagg

SEQ ID NO: 3607651 - RNA, 22 nt, Human
auaaaauaauuuuaucucuuuc

SEQ ID NO: 3607652 - RNA, 21 nt, Human
auaaaauaauuuuuauauuug

SEQ ID NO: 3607653 - RNA, 13 nt, Human
auaaaauaucauu

SEQ ID NO: 3607654 - RNA, 15 nt, Human
auaaaauaucauuca

SEQ ID NO: 3607655 - RNA, 16 nt, Human
auaaaauaucauucag

SEQ ID NO: 3607656 - RNA, 17 nt, Human
auaaaauaucauucagc

SEQ ID NO: 3607657 - RNA, 19 nt, Human
auaaaauaucauucagcaa

SEQ ID NO: 3607658 - RNA, 18 nt, Human
auaaaauauuauugaacu

SEQ ID NO: 3607659 - RNA, 16 nt, Human
auaaaauauuuucugu

SEQ ID NO: 3607660 - RNA, 20 nt, Human
auaaaauauuuucugugugu

SEQ ID NO: 3607661 - RNA, 16 nt, Human
auaaaaucagccaauu

SEQ ID NO: 3607662 - RNA, 16 nt, Human
auaaaaucauaaguau

SEQ ID NO: 3607663 - RNA, 18 nt, Human
auaaaaucauguacauuu

SEQ ID NO: 3607664 - RNA, 13 nt, Human
auaaaaugaaaau

SEQ ID NO: 3607665 - RNA, 19 nt, Human
auaaaaugaaaauuguauu

SEQ ID NO: 3607666 - RNA, 19 nt, Human
auaaaaugaggacauguuu

SEQ ID NO: 3607667 - RNA, 14 nt, Human
auaaaauggcaaca

SEQ ID NO: 3607668 - RNA, 23 nt, Human
auaaaauguaaacuguuucuuua

SEQ ID NO: 3607669 - RNA, 17 nt, Human
auaaaauguaauuacuu

SEQ ID NO: 3607670 - RNA, 19 nt, Human
auaaaauguccaguaagau

SEQ ID NO: 3607671 - RNA, 15 nt, Human
auaaaauuaaaaguu

SEQ ID NO: 3607672 - RNA, 15 nt, Human
auaaaauuaaagaaa

SEQ ID NO: 3607673 - RNA, 18 nt, Human
auaaaauuaaagaaaaua

SEQ ID NO: 3607674 - RNA, 16 nt, Human
auaaaauuaagaaugu

SEQ ID NO: 3607675 - RNA, 13 nt, Human
auaaaauuagaaa

SEQ ID NO: 3607676 - RNA, 13 nt, Human
auaaaauuauaga

SEQ ID NO: 3607677 - RNA, 17 nt, Human
auaaaauuauagcucua

SEQ ID NO: 3607678 - RNA, 15 nt, Human
auaaaauuauuugca

SEQ ID NO: 3607679 - RNA, 18 nt, Human
auaaaauuauuuuggauu

SEQ ID NO: 3607680 - RNA, 14 nt, Human
auaaaauuuugcuu

SEQ ID NO: 3607681 - RNA, 20 nt, Human
auaaaauuuuuaaucuuuaa

SEQ ID NO: 3607682 - RNA, 16 nt, Human
auaaacaacagcugaa

SEQ ID NO: 3607683 - RNA, 22 nt, Human
auaaacaagaaaaauaaagaaa

SEQ ID NO: 3607684 - RNA, 14 nt, Human
auaaacacauagau

SEQ ID NO: 3607685 - RNA, 20 nt, Human
auaaacacauagauucaccu

SEQ ID NO: 3607686 - RNA, 24 nt, Human
auaaacacauagauucaccuguaa

SEQ ID NO: 3607687 - RNA, 22 nt, Human
auaaacacaucacagaugaaua

SEQ ID NO: 3607688 - RNA, 14 nt, Human
auaaacacuacaga

SEQ ID NO: 3607689 - RNA, 18 nt, Human
auaaacacucuugaaaaa

SEQ ID NO: 3607690 - RNA, 14 nt, Human
auaaacacugugua

SEQ ID NO: 3607691 - RNA, 13 nt, Human
auaaacagaaaug

SEQ ID NO: 3607692 - RNA, 14 nt, Human
auaaacagacaaua

SEQ ID NO: 3607693 - RNA, 20 nt, Human
auaaacauacgugugcaugu

SEQ ID NO: 3607694 - RNA, 19 nt, Human
auaaacaucagguuaggca

SEQ ID NO: 3607695 - RNA, 22 nt, Human
auaaacaucagguuaggcagua

SEQ ID NO: 3607696 - RNA, 12 nt, Human
auaaacaugaaa

SEQ ID NO: 3607697 - RNA, 16 nt, Human
auaaacauuaaauguc

SEQ ID NO: 3607698 - RNA, 17 nt, Human
auaaacauuaaaugucu

SEQ ID NO: 3607699 - RNA, 21 nt, Human
auaaacauuaaaugucuuaua

SEQ ID NO: 3607700 - RNA, 13 nt, Human
auaaacauuguau

SEQ ID NO: 3607701 - RNA, 18 nt, Human
auaaaccuaaaaaagaua

SEQ ID NO: 3607702 - RNA, 19 nt, Human
auaaaccuaaaaaagauau

SEQ ID NO: 3607703 - RNA, 22 nt, Human
auaaaccuaaaaaagauauauu

SEQ ID NO: 3607704 - RNA, 14 nt, Human
auaaaccuccgcca

SEQ ID NO: 3607705 - RNA, 17 nt, Human
auaaaccuccgccaaug

SEQ ID NO: 3607706 - RNA, 19 nt, Human
auaaaccucuaauuuauuu

SEQ ID NO: 3607707 - RNA, 20 nt, Human
auaaaccucuaauuuauuuu

SEQ ID NO: 3607708 - RNA, 20 nt, Human
auaaacgugaugaucagcug

SEQ ID NO: 3607709 - RNA, 14 nt, Human
auaaacuaauaauu

SEQ ID NO: 3607710 - RNA, 17 nt, Human
auaaacuacucuuugau

SEQ ID NO: 3607711 - RNA, 15 nt, Human
auaaacucuaaacau

SEQ ID NO: 3607712 - RNA, 20 nt, Human
auaaacugacuuuauccuca

SEQ ID NO: 3607713 - RNA, 14 nt, Human
auaaacugugugca

SEQ ID NO: 3607714 - RNA, 14 nt, Human
auaaacuuagaaua

SEQ ID NO: 3607715 - RNA, 21 nt, Human
auaaacuuagaauaaaauugu

SEQ ID NO: 3607716 - RNA, 16 nt, Human
auaaacuucagcacca

SEQ ID NO: 3607717 - RNA, 20 nt, Human
auaaacuuuaauauaaagua

SEQ ID NO: 3607718 - RNA, 22 nt, Human
auaaacuuuaauauaaaguagu

SEQ ID NO: 3607719 - RNA, 17 nt, Human
auaaacuuuagaguaga

SEQ ID NO: 3607720 - RNA, 15 nt, Human
auaaacuuuuagaaa

SEQ ID NO: 3607721 - RNA, 17 nt, Human
auaaacuuuuuuucaau

SEQ ID NO: 3607722 - RNA, 18 nt, Human
auaaacuuuuuuucaaug

SEQ ID NO: 3607723 - RNA, 19 nt, Human
auaaacuuuuuuucaaugu

SEQ ID NO: 3607724 - RNA, 13 nt, Human
auaaagaaaagau

SEQ ID NO: 3607725 - RNA, 14 nt, Human
auaaagaaaagaug

SEQ ID NO: 3607726 - RNA, 16 nt, Human
auaaagaaaagaugca

SEQ ID NO: 3607727 - RNA, 19 nt, Human
auaaagaaaagaugcacuu

SEQ ID NO: 3607728 - RNA, 18 nt, Human
auaaagaaauagaacaag

SEQ ID NO: 3607729 - RNA, 19 nt, Human
auaaagaauacuugaacuu

SEQ ID NO: 3607730 - RNA, 14 nt, Human
auaaagacaaccau

SEQ ID NO: 3607731 - RNA, 22 nt, Human
auaaagacaaccauauuuagca

SEQ ID NO: 3607732 - RNA, 24 nt, Human
auaaagacguuuuauaagcaucau

SEQ ID NO: 3607733 - RNA, 18 nt, Human
auaaagagaaaauugaau

SEQ ID NO: 3607734 - RNA, 19 nt, Human
auaaagaugaucuacucag

SEQ ID NO: 3607735 - RNA, 20 nt, Human
auaaagaugaucuacucaga

SEQ ID NO: 3607736 - RNA, 23 nt, Human
auaaagaugaucuacucagaaau

SEQ ID NO: 3607737 - RNA, 15 nt, Human
auaaagauguuaaaa

SEQ ID NO: 3607738 - RNA, 20 nt, Human
auaaagauuauauaaagacc

SEQ ID NO: 3607739 - RNA, 18 nt, Human
auaaagcaaauagacaca

SEQ ID NO: 3607740 - RNA, 17 nt, Human
auaaagcaauuuuccuu

SEQ ID NO: 3607741 - RNA, 21 nt, Human
auaaagcaauuuuccuugaag

SEQ ID NO: 3607742 - RNA, 15 nt, Human
auaaagcaggcagaa

SEQ ID NO: 3607743 - RNA, 12 nt, Human
auaaagcauuua

SEQ ID NO: 3607744 - RNA, 14 nt, Human
auaaagcauuuaac

SEQ ID NO: 3607745 - RNA, 16 nt, Human
auaaagccacugaaaa

SEQ ID NO: 3607746 - RNA, 21 nt, Human
auucugcaguaaaucuuuuac

SEQ ID NO: 3607747 - RNA, 19 nt, Human
auucugcauugcuagauaa

SEQ ID NO: 3607748 - RNA, 16 nt, Human
auucugcccaaaaaua

SEQ ID NO: 3607749 - RNA, 19 nt, Human
auucugcccaaaaauaugg

SEQ ID NO: 3607750 - RNA, 14 nt, Human
auucugccugccca

SEQ ID NO: 3607751 - RNA, 16 nt, Human
auucugccugcccagg

SEQ ID NO: 3607752 - RNA, 17 nt, Human
auucugccugcccaggc

SEQ ID NO: 3607753 - RNA, 21 nt, Human
auucugccugcccaggccccu

SEQ ID NO: 3607754 - RNA, 21 nt, Human
auucugccuuugcagaaacag

SEQ ID NO: 3607755 - RNA, 17 nt, Human
auucugcucuauuauau

SEQ ID NO: 3607756 - RNA, 17 nt, Human
auucugcuugagaauau

SEQ ID NO: 3607757 - RNA, 21 nt, Human
auucuggauaaagccacugaa

SEQ ID NO: 3607758 - RNA, 19 nt, Human
auucuggcugauaaaagau

SEQ ID NO: 3607759 - RNA, 15 nt, Human
auucugggaauguau

SEQ ID NO: 3607760 - RNA, 22 nt, Human
auucugggaauguauaguauuu

SEQ ID NO: 3607761 - RNA, 22 nt, Human
auucugggcaccacaaaauaua

SEQ ID NO: 3607762 - RNA, 24 nt, Human
auucugggcaccacaaaauauaca

SEQ ID NO: 3607763 - RNA, 14 nt, Human
auucugguuacaug

SEQ ID NO: 3607764 - RNA, 16 nt, Human
auucugguuccagggu

SEQ ID NO: 3607765 - RNA, 19 nt, Human
auucugguuccaggguccc

SEQ ID NO: 3607766 - RNA, 15 nt, Human
auucuguaaaagaaa

SEQ ID NO: 3607767 - RNA, 14 nt, Human
auucuguacucuua

SEQ ID NO: 3607768 - RNA, 13 nt, Human
auucuguacugau

SEQ ID NO: 3607769 - RNA, 12 nt, Human
auucuguauaga

SEQ ID NO: 3607770 - RNA, 21 nt, Human
auucuguauagauuagaauuc

SEQ ID NO: 3607771 - RNA, 20 nt, Human
auucugugaucuuuuaaagu

SEQ ID NO: 3607772 - RNA, 18 nt, Human
auucuguguugcauuauu

SEQ ID NO: 3607773 - RNA, 12 nt, Human
auucuguuaaaa

SEQ ID NO: 3607774 - RNA, 15 nt, Human
auucuguuaaaaucu

SEQ ID NO: 3607775 - RNA, 13 nt, Human
auucuguucugau

SEQ ID NO: 3607776 - RNA, 19 nt, Human
auucuguuuuuaaaaauua

SEQ ID NO: 3607777 - RNA, 17 nt, Human
auucuuaaaaugcaaua

SEQ ID NO: 3607778 - RNA, 18 nt, Human
auucuuaaaguugaauuu

SEQ ID NO: 3607779 - RNA, 21 nt, Human
auucuuaaaguugaauuuauu

SEQ ID NO: 3607780 - RNA, 21 nt, Human
auucuuacaaacaugugguua

SEQ ID NO: 3607781 - RNA, 15 nt, Human
auucuuacacugccu

SEQ ID NO: 3607782 - RNA, 13 nt, Human
auucuuacuaaaa

SEQ ID NO: 3607783 - RNA, 20 nt, Human
auucuuagccuguggcagua

SEQ ID NO: 3607784 - RNA, 15 nt, Human
auucuuauaaauaug

SEQ ID NO: 3607785 - RNA, 14 nt, Human
auucuuaugcuuau

SEQ ID NO: 3607786 - RNA, 21 nt, Human
auucuuauuccauauuagaaa

SEQ ID NO: 3607787 - RNA, 22 nt, Human
auucuuauuccauauuagaaaa

SEQ ID NO: 3607788 - RNA, 14 nt, Human
auucuuauuuaaug

SEQ ID NO: 3607789 - RNA, 16 nt, Human
auucuuauuuuuccua

SEQ ID NO: 3607790 - RNA, 21 nt, Human
auucuucaagaucccauuuga

SEQ ID NO: 3607791 - RNA, 23 nt, Human
auucuucagcaaaaauauuuuau

SEQ ID NO: 3607792 - RNA, 22 nt, Human
auucuucaggcuuccugcaauu

SEQ ID NO: 3607793 - RNA, 23 nt, Human
auucuucaguugguugugucuuu

SEQ ID NO: 3607794 - RNA, 21 nt, Human
auucuuccaagcugagagucu

SEQ ID NO: 3607795 - RNA, 20 nt, Human
auucuucccaacuugccuuu

SEQ ID NO: 3607796 - RNA, 23 nt, Human
auucuucccaacuugccuuugaa

SEQ ID NO: 3607797 - RNA, 16 nt, Human
auucuucccauucucc

SEQ ID NO: 3607798 - RNA, 17 nt, Human
auucuucccauucucca

SEQ ID NO: 3607799 - RNA, 20 nt, Human
auucuucccuaucuuugcca

SEQ ID NO: 3607800 - RNA, 13 nt, Human
auucuuccucccu

SEQ ID NO: 3607801 - RNA, 21 nt, Human
auucuucucuuccuuuuauca

SEQ ID NO: 3607802 - RNA, 21 nt, Human
auucuucugaacucaaacuga

SEQ ID NO: 3607803 - RNA, 17 nt, Human
auucuucugagcacugu

SEQ ID NO: 3607804 - RNA, 14 nt, Human
auucuucugccuca

SEQ ID NO: 3607805 - RNA, 12 nt, Human
auucuucugcuu

SEQ ID NO: 3607806 - RNA, 20 nt, Human
auucuucugcuucagccucc

SEQ ID NO: 3607807 - RNA, 13 nt, Human
auucuucuguguu

SEQ ID NO: 3607808 - RNA, 17 nt, Human
auucuugaucaguaguu

SEQ ID NO: 3607809 - RNA, 14 nt, Human
auucuugauguaaa

SEQ ID NO: 3607810 - RNA, 16 nt, Human
auucuugauguaaaau

SEQ ID NO: 3607811 - RNA, 18 nt, Human
auucuugauguaaaaucu

SEQ ID NO: 3607812 - RNA, 20 nt, Human
auucuugauguaaaaucuug

SEQ ID NO: 3607813 - RNA, 15 nt, Human
auucuugcaaaguau

SEQ ID NO: 3607814 - RNA, 16 nt, Human
auucuugcaaaguauc

SEQ ID NO: 3607815 - RNA, 13 nt, Human
auucuugcauauu

SEQ ID NO: 3607816 - RNA, 22 nt, Human
auucuuggcccgcacagagcug

SEQ ID NO: 3607817 - RNA, 12 nt, Human
auucuugugaau

SEQ ID NO: 3607818 - RNA, 18 nt, Human
auucuuuauacaacagug

SEQ ID NO: 3607819 - RNA, 19 nt, Human
auucuuuauacaacagugc

SEQ ID NO: 3607820 - RNA, 23 nt, Human
auucuuuauacaacagugcuaaa

SEQ ID NO: 3607821 - RNA, 13 nt, Human
auucuuucaauac

SEQ ID NO: 3607822 - RNA, 16 nt, Human
auucuuucaauacaga

SEQ ID NO: 3607823 - RNA, 21 nt, Human
auucuuucaauacagauauau

SEQ ID NO: 3607824 - RNA, 14 nt, Human
auucuuucaauucu

SEQ ID NO: 3607825 - RNA, 20 nt, Human
auucuuucaauucuguaggu

SEQ ID NO: 3607826 - RNA, 12 nt, Human
auucuuucccag

SEQ ID NO: 3607827 - RNA, 22 nt, Human
auucuuuccugaggcugggcuc

SEQ ID NO: 3607828 - RNA, 15 nt, Human
auucuuugauguuaa

SEQ ID NO: 3607829 - RNA, 20 nt, Human
auucuuugcuugaacacagu

SEQ ID NO: 3607830 - RNA, 19 nt, Human
auucuuugggcguugguca

SEQ ID NO: 3607831 - RNA, 13 nt, Human
auucuuuuaaaag

SEQ ID NO: 3607832 - RNA, 14 nt, Human
auucuuuuaacuuc

SEQ ID NO: 3607833 - RNA, 17 nt, Human
auucuuuuaacuucuuu

SEQ ID NO: 3607834 - RNA, 22 nt, Human
auucuuuuaauuguuucagaau

SEQ ID NO: 3607835 - RNA, 22 nt, Human
auucuuuuauacucagcuuucu

SEQ ID NO: 3607836 - RNA, 15 nt, Human
auucuuuugaauugu

SEQ ID NO: 3607837 - RNA, 17 nt, Human
auucuuuuguaauuuaa

SEQ ID NO: 3607838 - RNA, 16 nt, Human
auucuuuuuaaaguau

SEQ ID NO: 3607839 - RNA, 14 nt, Human
auucuuuuugcucu

SEQ ID NO: 3607840 - RNA, 15 nt, Human
auucuuuuugcucua

SEQ ID NO: 3607841 - RNA, 19 nt, Human
auucuuuuugcucuaaaau

SEQ ID NO: 3607842 - RNA, 21 nt, Human
auucuuuuugcucuaaaauau

SEQ ID NO: 3607843 - RNA, 22 nt, Human
auucuuuuugcucuaaaauauu

SEQ ID NO: 3607844 - RNA, 16 nt, Human
auucuuuuuuauuaau

SEQ ID NO: 3607845 - RNA, 16 nt, Human
auugaaaaaaauuggc

SEQ ID NO: 3607846 - RNA, 19 nt, Human
auugaaaaaaauuggcauu

SEQ ID NO: 3607847 - RNA, 17 nt, Human
auugaaaaacucuuuau

SEQ ID NO: 3607848 - RNA, 15 nt, Human
auugaaaaaucacca

SEQ ID NO: 3607849 - RNA, 14 nt, Human
auugaaaaggaaga

SEQ ID NO: 3607850 - RNA, 17 nt, Human
auugaaaaggaagauca

SEQ ID NO: 3607851 - RNA, 16 nt, Human
auugaaaaguuuuugu

SEQ ID NO: 3607852 - RNA, 19 nt, Human
auugaaaaguuuuuguuug

SEQ ID NO: 3607853 - RNA, 22 nt, Human
auugaaaauaggagagagauca

SEQ ID NO: 3607854 - RNA, 21 nt, Human
auugaaaauaguaaaugcuuu

SEQ ID NO: 3607855 - RNA, 16 nt, Human
auugaaaauguaagua

SEQ ID NO: 3607856 - RNA, 22 nt, Human
auugaaaauguccaggaaagug

SEQ ID NO: 3607857 - RNA, 18 nt, Human
auugaaaauugaaaagua

SEQ ID NO: 3607858 - RNA, 18 nt, Human
auugaaagaauguaaagc

SEQ ID NO: 3607859 - RNA, 16 nt, Human
auugaaagaauuaucc

SEQ ID NO: 3607860 - RNA, 15 nt, Human
auugaaagagaacca

SEQ ID NO: 3607861 - RNA, 18 nt, Human
auugaaagagaaccaguu

SEQ ID NO: 3607862 - RNA, 12 nt, Human
auugaaaucuuu

SEQ ID NO: 3607863 - RNA, 17 nt, Human
auugaaaucuuuuugcu

SEQ ID NO: 3607864 - RNA, 14 nt, Human
auugaaauuuauac

SEQ ID NO: 3607865 - RNA, 18 nt, Human
auugaacacaaacuguaa

SEQ ID NO: 3607866 - RNA, 19 nt, Human
auugaacacaaacuguaaa

SEQ ID NO: 3607867 - RNA, 14 nt, Human
auugaacccaggag

SEQ ID NO: 3607868 - RNA, 15 nt, Human
auugaacucugagag

SEQ ID NO: 3607869 - RNA, 16 nt, Human
auugaacuuuuguacu

SEQ ID NO: 3607870 - RNA, 10 nt, Human
auugaagaau

SEQ ID NO: 3607871 - RNA, 16 nt, Human
auugaagaauguuaga

SEQ ID NO: 3607872 - RNA, 20 nt, Human
auugaagacaauuugauaca

SEQ ID NO: 3607873 - RNA, 14 nt, Human
auugaagcagagug

SEQ ID NO: 3607874 - RNA, 22 nt, Human
auugaagcauuuuauaaaucgc

SEQ ID NO: 3607875 - RNA, 15 nt, Human
auugaaggaaagauu

SEQ ID NO: 3607876 - RNA, 22 nt, Human
auugaaggugauaagggaaaag

SEQ ID NO: 3607877 - RNA, 16 nt, Human
auugaaguaaacuuuu

SEQ ID NO: 3607878 - RNA, 22 nt, Human
auugaaguaaacuuuuuguucu

SEQ ID NO: 3607879 - RNA, 14 nt, Human
auugaaguaaugaa

SEQ ID NO: 3607880 - RNA, 19 nt, Human
auugaaguauuuugcugga

SEQ ID NO: 3607881 - RNA, 22 nt, Human
auugaauaaugguaccagauaa

SEQ ID NO: 3607882 - RNA, 15 nt, Human
auugaauacuuugaa

SEQ ID NO: 3607883 - RNA, 18 nt, Human
auugaauacuuugaaugu

SEQ ID NO: 3607884 - RNA, 23 nt, Human
auugaauauaauauauuugugua

SEQ ID NO: 3607885 - RNA, 14 nt, Human
auugaauauugugu

SEQ ID NO: 3607886 - RNA, 15 nt, Human
auugaauauuguguu

SEQ ID NO: 3607887 - RNA, 23 nt, Human
auugaauauuguguuccuuuuua

SEQ ID NO: 3607888 - RNA, 21 nt, Human
auugaauggcuauguuuuuaa

SEQ ID NO: 3607889 - RNA, 23 nt, Human
auugaauggcuauguuuuuaaug

SEQ ID NO: 3607890 - RNA, 21 nt, Human
auugaauuaucuugguugaaa

SEQ ID NO: 3607891 - RNA, 13 nt, Human
auugaauuuaaca

SEQ ID NO: 3607892 - RNA, 16 nt, Human
auugaauuuaacaaug

SEQ ID NO: 3607893 - RNA, 23 nt, Human
auugaauuuuuccuaugcuauug

SEQ ID NO: 3607894 - RNA, 15 nt, Human
auugacaagucauuu

SEQ ID NO: 3607895 - RNA, 22 nt, Human
auaaagccucaagguuuuaggu

SEQ ID NO: 3607896 - RNA, 20 nt, Human
auaaagccuguuuugucuuu

SEQ ID NO: 3607897 - RNA, 20 nt, Human
auaaagccuucaaacucccu

SEQ ID NO: 3607898 - RNA, 17 nt, Human
auaaagcgauauacaga

SEQ ID NO: 3607899 - RNA, 22 nt, Human
auaaagcgauauacagaugaaa

SEQ ID NO: 3607900 - RNA, 21 nt, Human
auaaagcugccccaucugggg

SEQ ID NO: 3607901 - RNA, 13 nt, Human
auaaagcuuguug

SEQ ID NO: 3607902 - RNA, 12 nt, Human
auaaaggaaaag

SEQ ID NO: 3607903 - RNA, 17 nt, Human
auaaaggaugugauugu

SEQ ID NO: 3607904 - RNA, 21 nt, Human
auaaaggaugugauuguggaa

SEQ ID NO: 3607905 - RNA, 18 nt, Human
auaaaggauuaaugucaa

SEQ ID NO: 3607906 - RNA, 17 nt, Human
auaaaggcaguuuucua

SEQ ID NO: 3607907 - RNA, 14 nt, Human
auaaaggccuuuuu

SEQ ID NO: 3607908 - RNA, 16 nt, Human
auaaaggcuaacuaug

SEQ ID NO: 3607909 - RNA, 14 nt, Human
auaaagggaacaaa

SEQ ID NO: 3607910 - RNA, 17 nt, Human
auaaagggggagggaaa

SEQ ID NO: 3607911 - RNA, 16 nt, Human
auaaagguuauuuucu

SEQ ID NO: 3607912 - RNA, 13 nt, Human
auaaaguagaaau

SEQ ID NO: 3607913 - RNA, 16 nt, Human
auaaaguaguaaaaau

SEQ ID NO: 3607914 - RNA, 16 nt, Human
auaaaguaguaaaaga

SEQ ID NO: 3607915 - RNA, 14 nt, Human
auaaaguaucauca

SEQ ID NO: 3607916 - RNA, 15 nt, Human
auaaaguaucaugca

SEQ ID NO: 3607917 - RNA, 18 nt, Human
auaaaguauuccaccuua

SEQ ID NO: 3607918 - RNA, 19 nt, Human
auaaaguauuuaauuagug

SEQ ID NO: 3607919 - RNA, 22 nt, Human
auaaagugcugcggagcaagag

SEQ ID NO: 3607920 - RNA, 16 nt, Human
auaaagugcuuuaaaa

SEQ ID NO: 3607921 - RNA, 14 nt, Human
auaaaguguaacaa

SEQ ID NO: 3607922 - RNA, 22 nt, Human
auaaaguuagaaucuauuuucu

SEQ ID NO: 3607923 - RNA, 15 nt, Human
auaaaguucuguacu

SEQ ID NO: 3607924 - RNA, 21 nt, Human
auaaaguugauaaagauuuuu

SEQ ID NO: 3607925 - RNA, 16 nt, Human
auaaaguuggugacag

SEQ ID NO: 3607926 - RNA, 17 nt, Human
auaaaguuggugacaga

SEQ ID NO: 3607927 - RNA, 15 nt, Human
auaaaguuugaucuu

SEQ ID NO: 3607928 - RNA, 17 nt, Human
auaaaguuuuauauauu

SEQ ID NO: 3607929 - RNA, 21 nt, Human
auaaaguuuuauauauuauau

SEQ ID NO: 3607930 - RNA, 14 nt, Human
auaaauaaaaauaa

SEQ ID NO: 3607931 - RNA, 13 nt, Human
auaaauaaaacau

SEQ ID NO: 3607932 - RNA, 14 nt, Human
auaaauaaaagccu

SEQ ID NO: 3607933 - RNA, 15 nt, Human
auaaauaaaagccuc

SEQ ID NO: 3607934 - RNA, 13 nt, Human
auaaauaaaguuu

SEQ ID NO: 3607935 - RNA, 14 nt, Human
auaaauaaauauau

SEQ ID NO: 3607936 - RNA, 16 nt, Human
auaaauaaaugcaaua

SEQ ID NO: 3607937 - RNA, 12 nt, Human
auaaauaacuuu

SEQ ID NO: 3607938 - RNA, 12 nt, Human
auaaauaauuuu

SEQ ID NO: 3607939 - RNA, 12 nt, Human
auaaauacauac

SEQ ID NO: 3607940 - RNA, 19 nt, Human
auaaauacauacggucagg

SEQ ID NO: 3607941 - RNA, 22 nt, Human
auaaauacauacggucagguuu

SEQ ID NO: 3607942 - RNA, 14 nt, Human
auaaauaccucuua

SEQ ID NO: 3607943 - RNA, 18 nt, Human
auaaauagaaaaguagac

SEQ ID NO: 3607944 - RNA, 11 nt, Human
auaaauagcua

SEQ ID NO: 3607945 - RNA, 21 nt, Human
auaaauagcuagacuggugac

SEQ ID NO: 3607946 - RNA, 15 nt, Human
auaaauagcuauauc

SEQ ID NO: 3607947 - RNA, 16 nt, Human
auaaauauaagccuuu

SEQ ID NO: 3607948 - RNA, 14 nt, Human
auaaauauauauaa

SEQ ID NO: 3607949 - RNA, 16 nt, Human
auaaauauauauaaac

SEQ ID NO: 3607950 - RNA, 21 nt, Human
auaaauauauauaaaccuaaa

SEQ ID NO: 3607951 - RNA, 22 nt, Human
auaaauauauauaaaccuaaaa

SEQ ID NO: 3607952 - RNA, 17 nt, Human
auaaauauauauaaaga

SEQ ID NO: 3607953 - RNA, 12 nt, Human
auaaauauauua

SEQ ID NO: 3607954 - RNA, 14 nt, Human
auaaauauauuauu

SEQ ID NO: 3607955 - RNA, 14 nt, Human
auaaauauccuuua

SEQ ID NO: 3607956 - RNA, 14 nt, Human
auaaauaugaagcu

SEQ ID NO: 3607957 - RNA, 13 nt, Human
auaaauaugcagu

SEQ ID NO: 3607958 - RNA, 21 nt, Human
auaaauauugucuuuuuguau

SEQ ID NO: 3607959 - RNA, 11 nt, Human
auaaauauuua

SEQ ID NO: 3607960 - RNA, 14 nt, Human
auaaauauuuaugu

SEQ ID NO: 3607961 - RNA, 18 nt, Human
auaaauauuuuugccaua

SEQ ID NO: 3607962 - RNA, 15 nt, Human
auaaaucagucaagc

SEQ ID NO: 3607963 - RNA, 14 nt, Human
auaaaucauauuga

SEQ ID NO: 3607964 - RNA, 20 nt, Human
auaaaucauucuuacuaaaa

SEQ ID NO: 3607965 - RNA, 19 nt, Human
auaaaucauuuuaugucaa

SEQ ID NO: 3607966 - RNA, 18 nt, Human
auaaauccacccauguua

SEQ ID NO: 3607967 - RNA, 20 nt, Human
auaaauccacccauguuauc

SEQ ID NO: 3607968 - RNA, 20 nt, Human
auaaauccagugaccucucu

SEQ ID NO: 3607969 - RNA, 14 nt, Human
auaaaucgcuuuug

SEQ ID NO: 3607970 - RNA, 19 nt, Human
auaaaucgcuuuugauaau

SEQ ID NO: 3607971 - RNA, 18 nt, Human
auaaaucugacccagugc

SEQ ID NO: 3607972 - RNA, 22 nt, Human
auaaaucugugaacuugaaauu

SEQ ID NO: 3607973 - RNA, 18 nt, Human
auaaaucuuccaaaguuu

SEQ ID NO: 3607974 - RNA, 15 nt, Human
auaaaugaaugucac

SEQ ID NO: 3607975 - RNA, 20 nt, Human
auaaaugagcuauguauuaa

SEQ ID NO: 3607976 - RNA, 18 nt, Human
auaaaugauucuuaguga

SEQ ID NO: 3607977 - RNA, 17 nt, Human
auaaaugcaauauguau

SEQ ID NO: 3607978 - RNA, 18 nt, Human
auaaaugcaauauguauu

SEQ ID NO: 3607979 - RNA, 14 nt, Human
auaaaugcagccca

SEQ ID NO: 3607980 - RNA, 18 nt, Human
auaaaugccaucaauaaa

SEQ ID NO: 3607981 - RNA, 21 nt, Human
auaaaugcuuuuaaaaaucua

SEQ ID NO: 3607982 - RNA, 13 nt, Human
auaaauggaaauc

SEQ ID NO: 3607983 - RNA, 16 nt, Human
auaaauggcugguuuu

SEQ ID NO: 3607984 - RNA, 16 nt, Human
auaaaugguuaaaaga

SEQ ID NO: 3607985 - RNA, 16 nt, Human
auaaauguauauacac

SEQ ID NO: 3607986 - RNA, 13 nt, Human
auaaauguaucau

SEQ ID NO: 3607987 - RNA, 17 nt, Human
auaaauguaucauagaa

SEQ ID NO: 3607988 - RNA, 17 nt, Human
auaaaugucauuaaaau

SEQ ID NO: 3607989 - RNA, 12 nt, Human
auaaaugucugu

SEQ ID NO: 3607990 - RNA, 20 nt, Human
auaaaugucuuuuuuuuaau

SEQ ID NO: 3607991 - RNA, 15 nt, Human
auaaauguuaagaaa

SEQ ID NO: 3607992 - RNA, 14 nt, Human
auaaauuaggacca

SEQ ID NO: 3607993 - RNA, 11 nt, Human
auaaauuauuu

SEQ ID NO: 3607994 - RNA, 19 nt, Human
auaaauuauuugauuauuu

SEQ ID NO: 3607995 - RNA, 23 nt, Human
auaaauucacuuucauuuuugau

SEQ ID NO: 3607996 - RNA, 12 nt, Human
auaaauucagau

SEQ ID NO: 3607997 - RNA, 13 nt, Human
auaaauucagaua

SEQ ID NO: 3607998 - RNA, 22 nt, Human
auaaauucagauauauuuuuca

SEQ ID NO: 3607999 - RNA, 20 nt, Human
auaaauuccucuuugcuuug

SEQ ID NO: 3608000 - RNA, 21 nt, Human
auaaauuccucuuugcuuugc

SEQ ID NO: 3608001 - RNA, 21 nt, Human
auaaauucuauaggaacauau

SEQ ID NO: 3608002 - RNA, 14 nt, Human
auaaauugaaauau

SEQ ID NO: 3608003 - RNA, 13 nt, Human
auaaauugaaauu

SEQ ID NO: 3608004 - RNA, 17 nt, Human
auaaauugaaauuguga

SEQ ID NO: 3608005 - RNA, 21 nt, Human
auaaauugcacaccuuggaau

SEQ ID NO: 3608006 - RNA, 12 nt, Human
auaaauugcaug

SEQ ID NO: 3608007 - RNA, 20 nt, Human
auaaauugcaugcugcuuua

SEQ ID NO: 3608008 - RNA, 17 nt, Human
auaaauuguauauucac

SEQ ID NO: 3608009 - RNA, 19 nt, Human
auaaauuguauauucacuu

SEQ ID NO: 3608010 - RNA, 14 nt, Human
auaaauuguuuagu

SEQ ID NO: 3608011 - RNA, 22 nt, Human
auaaauuguuuaguggaaaaua

SEQ ID NO: 3608012 - RNA, 14 nt, Human
auaaauuuauuuac

SEQ ID NO: 3608013 - RNA, 17 nt, Human
auaaauuucgcuucuua

SEQ ID NO: 3608014 - RNA, 12 nt, Human
auaaauuugacu

SEQ ID NO: 3608015 - RNA, 15 nt, Human
auaaauuuguguaau

SEQ ID NO: 3608016 - RNA, 20 nt, Human
auaaauuuguguaauauuac

SEQ ID NO: 3608017 - RNA, 16 nt, Human
auaaauuuugaaaagu

SEQ ID NO: 3608018 - RNA, 21 nt, Human
auaacaaaaucacuuccauag

SEQ ID NO: 3608019 - RNA, 14 nt, Human
auaacaaaauggac

SEQ ID NO: 3608020 - RNA, 20 nt, Human
auaacaaagauaucuuuucu

SEQ ID NO: 3608021 - RNA, 21 nt, Human
auaacaaaggauacuuauuua

SEQ ID NO: 3608022 - RNA, 21 nt, Human
auaacaaaugccaaauuaaaa

SEQ ID NO: 3608023 - RNA, 16 nt, Human
auaacaaugugcucuc

SEQ ID NO: 3608024 - RNA, 14 nt, Human
auaacaauuccucu

SEQ ID NO: 3608025 - RNA, 13 nt, Human
auaacacacagcu

SEQ ID NO: 3608026 - RNA, 11 nt, Human
auaacacacau

SEQ ID NO: 3608027 - RNA, 16 nt, Human
auaacacacuuuuuau

SEQ ID NO: 3608028 - RNA, 22 nt, Human
auaacacagagagacagacuug

SEQ ID NO: 3608029 - RNA, 13 nt, Human
auaacacauuuuu

SEQ ID NO: 3608030 - RNA, 13 nt, Human
auaacaccugcca

SEQ ID NO: 3608031 - RNA, 21 nt, Human
auaacacucuaggauguauau

SEQ ID NO: 3608032 - RNA, 16 nt, Human
auaacacugugaagag

SEQ ID NO: 3608033 - RNA, 12 nt, Human
auaacagcacug

SEQ ID NO: 3608034 - RNA, 17 nt, Human
auaacagccgcuccaga

SEQ ID NO: 3608035 - RNA, 13 nt, Human
auaacagcugcaa

SEQ ID NO: 3608036 - RNA, 18 nt, Human
auaacaggcauuuguuca

SEQ ID NO: 3608037 - RNA, 18 nt, Human
auaacaggguaaauuauu

SEQ ID NO: 3608038 - RNA, 15 nt, Human
auaacaguaguguua

SEQ ID NO: 3608039 - RNA, 22 nt, Human
auaacauagaauugcaaucuau

SEQ ID NO: 3608040 - RNA, 11 nt, Human
auaacauauau

SEQ ID NO: 3608041 - RNA, 20 nt, Human
auaacauauauggaagagga

SEQ ID NO: 3608042 - RNA, 17 nt, Human
auaacauccagagcuuu

SEQ ID NO: 3608043 - RNA, 20 nt, Human
auaacaucuuuauugaaauu

SEQ ID NO: 3608044 - RNA, 21 nt, Human
auaacaucuuuauugaaauuc

SEQ ID NO: 3608045 - RNA, 14 nt, Human
auaacaugaaauga

SEQ ID NO: 3608046 - RNA, 20 nt, Human
auaacauuaccuuacugugg

SEQ ID NO: 3608047 - RNA, 16 nt, Human
auuccaacaguuuaau

SEQ ID NO: 3608048 - RNA, 17 nt, Human
auuccaacaguuuaaug

SEQ ID NO: 3608049 - RNA, 19 nt, Human
auuccaacucguauagcau

SEQ ID NO: 3608050 - RNA, 23 nt, Human
auuccaacucguauagcaugcau

SEQ ID NO: 3608051 - RNA, 14 nt, Human
auuccaagacagua

SEQ ID NO: 3608052 - RNA, 22 nt, Human
auuccaagacaugucuguucua

SEQ ID NO: 3608053 - RNA, 13 nt, Human
auuccacagcugc

SEQ ID NO: 3608054 - RNA, 16 nt, Human
auuccaccugcaauca

SEQ ID NO: 3608055 - RNA, 16 nt, Human
auuccaccuuaaauua

SEQ ID NO: 3608056 - RNA, 23 nt, Human
auuccaccuuaaauuaaacaauu

SEQ ID NO: 3608057 - RNA, 17 nt, Human
auuccacuacaccuggc

SEQ ID NO: 3608058 - RNA, 19 nt, Human
auuccacuacaccuggcug

SEQ ID NO: 3608059 - RNA, 12 nt, Human
auuccacuggac

SEQ ID NO: 3608060 - RNA, 18 nt, Human
auuccagaauaucuggga

SEQ ID NO: 3608061 - RNA, 18 nt, Human
auuccagaaugaagaauu

SEQ ID NO: 3608062 - RNA, 18 nt, Human
auuccagagaguggcucc

SEQ ID NO: 3608063 - RNA, 16 nt, Human
auuccagaucccaggc

SEQ ID NO: 3608064 - RNA, 14 nt, Human
auuccagccccucu

SEQ ID NO: 3608065 - RNA, 16 nt, Human
auuccagcucauucau

SEQ ID NO: 3608066 - RNA, 19 nt, Human
auuccagcucauucauuuu

SEQ ID NO: 3608067 - RNA, 20 nt, Human
auuccagucaggcucucugg

SEQ ID NO: 3608068 - RNA, 15 nt, Human
auuccauaauuccau

SEQ ID NO: 3608069 - RNA, 16 nt, Human
auuccauaguauauua

SEQ ID NO: 3608070 - RNA, 18 nt, Human
auuccauaguauauuaaa

SEQ ID NO: 3608071 - RNA, 21 nt, Human
auuccauaguauauuaaaaau

SEQ ID NO: 3608072 - RNA, 21 nt, Human
auuccauaucuugcgaaucca

SEQ ID NO: 3608073 - RNA, 15 nt, Human
auuccauauuagaaa

SEQ ID NO: 3608074 - RNA, 19 nt, Human
auuccauauuagaaaacuu

SEQ ID NO: 3608075 - RNA, 20 nt, Human
auuccauauuagaaaacuuu

SEQ ID NO: 3608076 - RNA, 16 nt, Human
auuccauauucaugua

SEQ ID NO: 3608077 - RNA, 13 nt, Human
auuccauauuuau

SEQ ID NO: 3608078 - RNA, 17 nt, Human
auuccauauuuauucaa

SEQ ID NO: 3608079 - RNA, 19 nt, Human
auuccaugaaucgcuucuc

SEQ ID NO: 3608080 - RNA, 15 nt, Human
auuccaugaauguau

SEQ ID NO: 3608081 - RNA, 16 nt, Human
auuccaugaauguauc

SEQ ID NO: 3608082 - RNA, 13 nt, Human
auuccaugacugc

SEQ ID NO: 3608083 - RNA, 20 nt, Human
auuccaugacugcuugcccu

SEQ ID NO: 3608084 - RNA, 14 nt, Human
auuccaugugccca

SEQ ID NO: 3608085 - RNA, 15 nt, Human
auuccaugugcccag

SEQ ID NO: 3608086 - RNA, 16 nt, Human
auuccaugugcccagu

SEQ ID NO: 3608087 - RNA, 23 nt, Human
auuccauugguccaagauuccgg

SEQ ID NO: 3608088 - RNA, 20 nt, Human
auuccauuuacugcauucuu

SEQ ID NO: 3608089 - RNA, 15 nt, Human
auuccauuuaucuuu

SEQ ID NO: 3608090 - RNA, 14 nt, Human
auucccaagaaaug

SEQ ID NO: 3608091 - RNA, 18 nt, Human
auucccacaccuccacag

SEQ ID NO: 3608092 - RNA, 19 nt, Human
auucccacaccuccacagu

SEQ ID NO: 3608093 - RNA, 22 nt, Human
auucccacccaauucaaaacau

SEQ ID NO: 3608094 - RNA, 19 nt, Human
auucccagagcaaaauaau

SEQ ID NO: 3608095 - RNA, 18 nt, Human
auucccagauuugaagac

SEQ ID NO: 3608096 - RNA, 18 nt, Human
auucccaggaguucugcu

SEQ ID NO: 3608097 - RNA, 20 nt, Human
auucccaggaguucugcuca

SEQ ID NO: 3608098 - RNA, 20 nt, Human
auucccagggaagugcucug

SEQ ID NO: 3608099 - RNA, 18 nt, Human
auucccauugaaaaugua

SEQ ID NO: 3608100 - RNA, 14 nt, Human
auuccccagccucu

SEQ ID NO: 3608101 - RNA, 20 nt, Human
auuccccaggaggccagccu

SEQ ID NO: 3608102 - RNA, 22 nt, Human
auuccccagguggcugacccag
